United States Patent 9,782,462 (MODIFIED POLYNUCLEOTIDES FOR THE PRODUCTION OF PROTEINS ASSOCIATED WITH HUMAN DISEASE) - sequence listing, part 69

SEQ ID NO: 131892 - DNA, 1143 bp, Artificial Sequence
  Description of Artificial Sequence: Synthetic coding sequence
atgctcgtcattcccccaggtctctcggaggaagaggaggctctacagaagaaattcaacaaattaaagaaaaagaagaaagctctgctggcactgaaaaagcaatcatcctccagcactacaagccaaggtggagtcaaaaggtcgctttcagagcagcctgtgatggacactgccactgccacagaacaggccaaacagctcgtcaagagcggagcgatatccgctatcaaggctgagaccaaaaacagcggattcaaaaggagcaggaccttagaaggaaaactcaaagatccagagaagggacctgttcctacgttccagccatttcagcggtccatctcggcagatgatgacctacaggagagctccaggaggccccagcgcaaatcattatatgagagctttgtgagctcttcagatagattaagagaacttggtcccgacggcgaggaggccgagggcccaggcgcaggggatgggccgcctcgcagcttcgactggggttacgaggagaggtcaggcgctcacagttcagcttccccccctcgctcgagatcacgagatagatctcacgaaagaaatcgggatcgcgatcgggatagggagcgcgacagggatcgggatcgggatcgcgacagggaacgggaccgcgacagagatagagatcgcgacagagatagagagcgcgatagagacagggagcgggaccgcgaccgggaccgcgagggtccttttcgacggagtgattccttccctgagcgcagggcaccccgcaaaggtaacacactgtacgtatacggtgaggacatgaccccaaccctgctgcgaggggccttttcgccatttgggaacattatcgatctctccatggatcctccacggaactgcgcatttgtcacctacgagaaaatggaaagcgccgatcaagccgtggccgaactgaatggcacacaggtagagagtgtccaactgaaagtcaacatcgcacgaaagcaaccaatgctcgatgctgcgacagggaaatctgtgtggggatctcttgccgtccagaactctcctaaggggtgccatagggacaagcgaacacagatcgtttacagtgacgacgtgtataaagagaacctcgtcgatgggttctag

SEQ ID NO: 131893 - DNA, 885 bp, Artificial Sequence
  Description of Artificial Sequence: Synthetic coding sequence
atgttggtaatacctccagggctgtctgaagaggaggaggctcttcagaaaaagtttaataaactgaagaaaaaaaagaaagctctgttagcccttaaaaaacagtcatctagtagcaccacatctcagggcggcgtgaaaaggtccctgagtgagcaacctgttatggacaccgccaccgccacagagcaagctaagcaactggttaagtctggagcaatttcagcaattaaagccgagacaaaaaattctggctttaaaaggtccaggaccttagaaggaaaacttaaggacccagagaaggggccagtccctacctttcaaccattccagagatccatctcagcggacgacgacctgcaagagtcttccagacgtccgcagagaaaatcactctatgagtcttttgtctcttcgtcggaccgcttaagggagcttggacccgacggagaagaagcggagggccccggcgccggggacggcccgccccgttcttttgattggggttatgaagaacgctccggagcacactcttccgccagccctcctaggtcccgcagccgcgacaggtcccatgagcggaaccgcgatcgggatagggatagagaaagagatcgcgacagggacagagaccgagatcgtgagcgggaccgagatagagatagagatcgcgaccgcgacagagagcgggacagggatagagaacgcgatagagatcgcgatcgggaaggccccttcagaaggtccgactcttttcctgagcgcagagcacctaggaaggggaatactctgtacgtttatggtgaggacatgacacctactctgttgcgcggagccttttcaccattcggcaacataatagatctgtctatggatccgccctag

SEQ ID NO: 131894 - DNA, 723 bp, Artificial Sequence
  Description of Artificial Sequence: Synthetic coding sequence
atgctggtgatccccccaggtctcagtgaggaggaagaggccctgcaaaagaagtttaataagcttaagaagaaaaagaaggctctgcttgccctcaagaaacagtctagcagttcgaccactagtcaaggtggagttaaaagaagtcttagcgagcaaccggtgatggataccgccacagcaactgaacaggcaaaacaattggtgaaatctggtgctatttctgcaataaaggctgaaacaaagaacagcggcttcaagcgcagtagaactctcgaagggaagctgaaagatcctgaaaagggccctgtcccaacctttcagcctttccagcggtctatctccgccgacgatgatctacaggagtcttctcgaagaccccagcggaagtccctgtatgagtccgaccgtcttcgtgagcttgggccggacggtgaggaggccgaaggccctggagctggcgacggccccccacggagctttgattggggatacgaggagcggagtggagcacattcatcagcttccccaccacgctcaaggagtcgggaccggtcacatgagcggaatagagaccgcgaccgcgatcgcgagagagacagggatcgggaccgcgatcgagaccgcgaacgtgacagagaccgggacagagacagagacagggaccgagaaagagatcgcgatcgagaacgcgaccgcgatcgggaccgggaagggccatag

SEQ ID NO: 131895 - DNA, 885 bp, Artificial Sequence
  Description of Artificial Sequence: Synthetic coding sequence
atgctggtgatccctcccgggctatccgaagaggaggaggctctgcaaaagaaatttaacaagctgaagaagaagaagaaagccttattggcgttaaaaaaacagagttctagtagcactacctcccaggggggcgtgaagagatctttgtcagagcagccagtgatggatactgccacagccactgagcaggcaaagcagctagtgaaatccggcgcgatcagcgcaatcaaagccgaaactaagaactccgggtttaagcgcagcaggaccttagaagggaaacttaaggaccctgagaaggggccagtgcctaccttccagccatttcagcgttccatttcagctgacgacgatttacaggaatcaagccgccgcccccaacgaaaaagcctgtatgaaagttttgtgtcatcctcggataggctgcgtgagctcggccctgacggcgaagaggcagagggcccaggagctggagatggacctcccaggtctttcgactggggctacgaggaacggtcgggcgcgcactctagtgccagtccgccccggtcgcgctcacgtgacagatcacacgagcgaaatcgtgatagggacagagaccgtgagcgcgatcgagatagagaccgcgaccgagacagggagcgggacagagacagagatcgagacagagatcgggacagggaaagggatcgagatagagaacgcgatagagatcgggatcgcgagggacctttccgaaggtctgactcatttcctgagaggcgagcaccccgcaaaggaaacactttatacgtgtacggtgaagacatgactccgacgttattgcgcggagccttcagtccatttgggaacataatcgacctgtccatggacccaccttag

SEQ ID NO: 131896 - DNA, 1005 bp, Artificial Sequence
  Description of Artificial Sequence: Synthetic coding sequence
atgctcgtgattcctcctggcctgagcgaagaggaagaagcacttcaaaagaagttcaacaagctcaagaaaaaaaagaaggccctcctagcccttaaaaaacaaagcagctcgagtactacctctcagggaggggtgaaaagatccctgtccgaacagccggttatggacaccgcaaccgctactgagcaggccaagcagcttgtgaaaagcggcgccatatcagctatcaaggcggaaacgaagaatagtggctttaagcgcagccgcaccctggaaggcaagttgaaagacccagaaaaagggcctgtgccgaccttccaaccgttccagcgatcaattagtgccgacgatgatctgcaagagtcgtcccggcgccctcagcgaaagagcttatacgagagcgacaggctgcgcgagctaggccccgacggcgaggaggccgagggccccggtgccggagacggccctcctaggtcctttgattggggatacgaagaacgaagtggcgcgcatagttccgcatcccccccccgtagtcggagtcgcgaccgctctcacgagcgcaatagagatcgcgatagagatcgggagcgcgaccgggatcgagaccgggaccgcgaccgggagagggacagagacagggatagggatcgggacagagaccgagagcgggacagggacagagagagggaccgcgatagagatcgtgagggtccctttagaaggtcagactcgtttcctgagaggcgtgcgccacgaaaaggtaataccctgtacgtttatggtgaggatatgacacctactctgctgagaggagccttctcaccttttggtaatatcattgatctgagtatggaccctcctaggaattgtgccttcgttacatacgagaaaatggaatctgccgatcaggccgtggcagagttaaacggcactcaggtggagtctgttcaattaaaggtgaacattgctcgaaagcagcctatgctggatgccgcctag

SEQ ID NO: 131897 - DNA, 1005 bp, Artificial Sequence
  Description of Artificial Sequence: Synthetic coding sequence
atgctggtcattcccccaggactgtccgaggaggaggaggcgttacagaagaagtttaacaagctcaaaaagaagaagaaggccttactggccctgaaaaaacagtccagctcaagcacgacatctcagggtggcgtgaaacggagcctcagtgagcagcctgtgatggatactgctacggccacggagcaggctaaacagctggtaaaatccggagccattagcgccatcaaggcggagaccaagaactccggcttcaaaagatcccggacgttggagggaaagctcaaggatccggaaaagggaccagttcccacatttcagcccttccaacgctcaatatctgctgatgacgacctccaagagagctcaaggagacctcagcgcaagagtctttacgaatccgaccggctcagagagctcgggcccgatggtgaagaggccgagggccccggcgccggtgacggccctcccagatccttcgattggggctacgaagagaggtccggagcacatagtagtgcctcaccaccaagatcacgaagtcgcgataggagtcatgagagaaacagggacagagatcgggaccgtgagcgggacagggacagagatagagaccgagaccgtgagagggaccgagaccgtgatcgggatagagatcgcgatcgagaacgagatagagatagggagcgggaccgcgaccgtgacagagaaggaccattcagaaggagcgatagcttccctgaacggcgagccccccgcaagggtaatactctgtacgtttacggggaggacatgacccccacactgctccgtggcgcattctcacccttcgggaacatcattgatctgtctatggacccgccacggaactgcgcatttgttacctacgagaagatggaaagtgcagaccaggctgtagctgagcttaacggcacacaggtggagagtgtacagttgaaagtcaacatcgcccgcaagcaacccatgctggatgccgcctag

SEQ ID NO: 131898 - DNA, 1005 bp, Artificial Sequence
  Description of Artificial Sequence: Synthetic coding sequence
atgctagtcataccacccgggctgtctgaagaggaagaggccttacagaagaaattcaacaaattgaagaaaaagaagaaggccctactggcacttaaaaaacagtcctccagtagtacgacctcacagggaggggttaaacgctctctgagcgaacaacccgtgatggacacagcaacagcgactgaacaggccaagcagctggtgaaatcaggcgccatctcagccataaaggcagaaacaaaaaattcaggattcaaaaggtcacggacattagaaggaaagcttaaggatcctgagaagggccctgtgcccacttttcagccattccagcggagtatttccgctgacgacgatctgcaggagtcctctcgcagaccccagcgcaagtcgctttatgagtctgaccgcctccgggagctgggccccgacggggaagaagcagaaggcccaggagccggggatggccccccccgcagctttgactgggggtatgaggagagaagcggcgcccatagtagcgcatcacctccacgtagcagaagccgggatcggagccacgagcggaaccgggatcgcgatagagacagagaaagagatagagatcgcgatcgcgaccgcgatagagagagagacagagatagagatagggaccgggacagggatagggaaagagaccgggacagagagcgtgaccgagatcgggaccgcgaggggccctttagaaggtcagactcttttccggagcgacgcgcaccaagaaaggggaataccctgtatgtttacggcgaagacatgactccaacccttctcaggggcgccttctccccattcggtaacatcatcgatctaagcatggacccccctaggaactgcgccttcgtgacttatgaaaagatggaaagcgctgaccaggccgtagcagaacttaatggcacacaagtagaaagcgtccagctcaaggtcaatatcgctcgcaagcagccaatgctcgacgccgcctag

SEQ ID NO: 131899 - DNA, 1053 bp, Artificial Sequence
  Description of Artificial Sequence: Synthetic coding sequence
atgctcgtgatcccacccgggttatctgaagaggaagaggccctgcagaagaagtttaacaagctgaagaaaaagaaaaaggccctcctggctctcaagaagcaatcctccagtagcaccacctctcaagggggcgtgaagagaagcctgtcagaacagccggtcatggataccgctaccgcgaccgagcaggcaaagcagctggtgaaatcgggagccatctcagcaattaaggcagagacgaagaattccgggttcaaacgctcaagaaccctggagggtaagctgaaggaccctgagaaaggtcctgtccctactttccagccattccaacgtagtatcagcgccgacgatgacctccaggagtcgagtcgcaggccccaaaggaagagcctgtacgagagttttgattggggatatgaggagcggagcggggcccattcaagtgcgagcccgccacgctccaggtcccgagatagatcccacgaaagaaaccgcgaccgagaccgcgaccgcgagcgggaccgcgaccgggacagggaccgggaccgtgagagagatcgggatagggaccgagacagagacagagacagggagcgtgaccgggatagagagagagaccgcgaccgcgatagggaaggaccatttcgacgctccgattcttttcccgagcgcagagcccctcgcaaggggaatacgttgtatgtctacggggaggatatgacgccaactctcttgagaggcgccttctcgcctttcggtaacattatcgacctgtccatggatcccccaagaaactgcgcctttgtgacctacgaaaaaatggaaagtgctgaccaggctgtcgcagagctgaatggaacccaggtcgaaagcgtgcagttaaaagtaaacattgcccggaaacagcctatgctcgacgcagccactgggaagagtgtgtggggcagcctggccgtgcagaacagtcctaagggttgtcatcgggataagagaacccagattgtgtactctgatgatgtttataaggagaacctggtggatgggttctag

SEQ ID NO: 131900 - DNA, 1143 bp, Artificial Sequence
  Description of Artificial Sequence: Synthetic coding sequence
atgctggtcatcccccccggcctgagtgaggaagaagaggcactgcagaagaaattcaacaagctcaagaagaagaagaaggctctgctagcactcaaaaagcagtcttcaagcagcacgacctctcagggtggtgtcaagcgttccttgagtgaacagccggtgatggacaccgccactgctacggagcaggccaaacagctggtgaagtccggagctatatctgctatcaaagctgaaacaaaaaattccggctttaagcggtcgaggacgctcgagggaaagctgaaagacccggagaagggcccagtgccaactttccaacccttccagcgcagtatatcagctgatgacgacttacaggagagctccaggagaccacagagaaaatcgttgtacgagagcttcgtgtcttcttccgacagactcagagagcttggcccggatggtgaggaagccgagggacctggcgcaggggacgggcccccccgaagcttcgactggggatacgaggaacgatccggagctcactcctctgcaagcccgcctcgctcacgctcaagggataggtcacacgagcgcaatagggatcgggatcgtgatcgagaacgggacagggatagggacagggatcgggatagagagcgagatagagacagggaccgtgacagggatagggatcgggagagggaccgcgaccgggagcgggatagggatagagacagagagggcccattccgtagatccgattccttccctgagcggagagctcctaggaaaggcaacactctgtatgtatacggcgaagatatgactccaactttgctgagaggagccttcagcccatttggaaacataatcgacctttcaatggaccccccgcggaactgcgctttcgtgacatacgagaaaatggagagcgctgatcaagcagttgcagaactgaacgggactcaggtggagtctgttcagctcaaagtgaatattgctcgcaaacagccaatgctggatgccgctaccgggaaatccgtgtgggggtctttggcggtgcagaattcccccaaggggtgtcacagggataagcgcacacagatcgtgtacagcgacgacgtatataaggagaacttagtcgacggcttctag

SEQ ID NO: 131901 - DNA, 723 bp, Artificial Sequence
  Description of Artificial Sequence: Synthetic coding sequence
atgctcgtgatcccacctggattgagtgaagaggaagaggccttacagaaaaagtttaacaagttgaaaaagaaaaagaaggctcttctcgcactcaagaagcaaagctcttcaagtactacaagccagggcggagtgaaaagatcgctttccgagcagcctgtcatggacaccgcaaccgcgacagaacaggcaaaacagcttgtgaaatctggcgcaatctcagccattaaagcagagacaaaaaatagtggatttaagcgcagcagaactctggaaggtaagctaaaggaccctgaaaagggccctgtccccacattccagcccttccaaagaagcattagcgcagatgatgaccttcaggaatccagccgccgacctcagcggaagtcattgtacgagtccgacagattgagggaattgggtcccgacggcgaggaagcagaagggccaggcgctggcgacggcccaccccggtccttcgattgggggtacgaagagcggtccggcgctcatagtagcgccagccctccacgatctcggagtcgagatagatcccatgagaggaaccgtgaccgcgatcgagacagggagcgggaccgtgatagggaccgggaccgtgatcgggaaagagatcgcgatagggaccgcgaccgcgacagggatcgggaaagggaccgggacagggagcgcgatagggatcgcgacagggagggcccctag

SEQ ID NO: 131902 - DNA, 1005 bp, Artificial Sequence
  Description of Artificial Sequence: Synthetic coding sequence
atgttggtcatacctcccgggttaagcgaagaggaggaggcgttgcagaaaaagtttaacaaactgaagaagaagaagaaggcactgctcgcgttgaagaagcagtcatcatcatctacaacaagccagggaggggtgaaaaggtctttgtcagaacagcccgtgatggatactgcaacagctaccgagcaggctaagcagctggtaaaaagcggagctataagtgccattaaggctgagactaaaaactccggattcaagaggtcccgcactctggaaggcaaacttaaagaccctgaaaaaggccctgtgcccaccttccagccctttcagagatctatctccgccgatgacgacttgcaggagtctagccgacgcccacagagaaaaagtttgtacgagtccgatcgtctaagagagcttggtccagacggagaagaagccgaagggccgggcgccggtgatggccctccaaggtctttcgattggggctacgaagaacgtagtggagcccattcatctgcatctcctccccggagtaggtcccgcgaccggtcccacgaaaggaatagagacagggatcgcgaccgagaacgtgacagagacagagaccgggaccgtgatcgtgagcgggacagagaccgagatagagaccgagacagagaccgtgagagggatagagaccgggagcgagacagagaccgcgaccgcgaagggcctttcagaaggtccgactccttccccgaacgcagagctccccgtaagggaaacacgctgtatgtgtatggtgaggatatgaccccaacactcctgcgaggagcattttccccgtttggtaatattatcgacctttccatggatccaccccggaattgtgccttcgtgacatacgagaagatggagtctgccgatcaggcagttgcagagctcaacggaacacaggtcgagtcagtccagctcaaggtcaatatagctcgaaagcagcctatgctggatgctgcctag

SEQ ID NO: 131903 - DNA, 885 bp, Artificial Sequence
  Description of Artificial Sequence: Synthetic coding sequence
atgctggtcatcccacctggcctgtctgaggaggaggaggctctgcagaaaaagtttaacaagttaaaaaaaaagaagaaagccctcctggctctcaaaaaacagagtagcagtagtactacttcacaaggaggagtgaagcgaagtctgagcgagcaacctgtaatggataccgccaccgcaacagagcaggccaagcagctggttaagtcaggagctattagcgcaattaaggccgagacaaagaactccggattcaagaggtcgcgcactttggaaggcaaactgaaggacccagaaaagggacctgttccgacctttcaaccatttcagcgttcgattagcgctgacgacgacctacaagagtctagccggagaccccagcgcaagagcctgtatgagtccttcgtcagttccagtgatcgtctgagggaattaggccccgatggcgaggaggctgaggggccaggggctggggatggccctcctagaagtttcgactggggttacgaagagcgcagtggggctcactcctctgcctccccccctcgcagtcgaagtagggatcggagccatgaacgcaacagggaccgggatagggatagagagcgagatcgggaccgtgacagagacagggacagagaacgtgaccgcgatagagatagagatagagatagagatcgggaacgggacagagaccgcgaaagagatagggatagagaccgggaggggccttttagacgctctgattctttccccgagaggcgagctccgcgcaaaggtaataccctgtacgtgtatggggaggacatgacacctacactgcttcgcggagctttttctccatttgggaacattatagatctatcgatggacccgccatag

SEQ ID NO: 131904 - DNA, 885 bp, Artificial Sequence
  Description of Artificial Sequence: Synthetic coding sequence
atgctggtcatccctccaggcctctccgaggaagaggaggctctccaaaagaagtttaacaaactgaagaaaaagaaaaaagcactcctggccctcaagaagcaaagcagttcttcaaccacctctcagggaggcgtcaagcgctccctttcagaacagcctgtgatggataccgccaccgcaactgaacaggctaagcaactagtcaagagtggcgccatctctgctattaaggccgaaactaagaattccggctttaaaaggtccagaacactggaggggaagctgaaggatcctgagaaaggacccgtgcccaccttccagcctttccagcgttcaatttcagcagacgacgacctccaggaatctagccggaggccccagaggaagtctctttatgaaagcttcgtgagctcctctgaccgactcagggagttgggtcctgacggcgaagaagccgaaggccctggagccggcgacggaccgccaagatctttcgactggggttacgaggagaggtccggcgctcattccagtgcttcccccccccgttcaaggagtcgggacaggagtcacgaacggaatcgagacagggatcgggatagagagcgggatagagatcgggatagagaccgggatagggagcgggaccgagatcgagaccgggatcgagacagggaccgggagagggatagggaccgtgaaagagatagagatcgagatcgagaaggccctttcagaaggtcggacagctttcccgagcggcgggctcccaggaagggtaacaccctttacgtgtatggagaagatatgacaccaactcttctgcgaggagctttcagtccattcggcaacatcatcgacctgagtatggatccaccttag

SEQ ID NO: 131905 - DNA, 885 bp, Artificial Sequence
  Description of Artificial Sequence: Synthetic coding sequence
atgctggtaatccctcccgggttaagcgaagaggaagaggccttgcaaaaaaaattcaataagctgaaaaaaaaaaagaaggccctcttggccttaaagaagcaaagctcgagttcaacaacctcgcagggaggtgttaagcgtagcctttcagagcaacccgtcatggacacagcaacagccaccgagcaggcgaaacagttggttaagtcaggcgcaatcagcgcaattaaagctgagactaaaaattcaggcttcaaacggtcgaggaccctcgaaggaaaactgaaagaccctgagaagggacccgtgcctactttccaaccgttccagagatctatctcggccgacgacgacctccaagaaagctcacgccgaccacagcgcaaatccctgtacgaaagctttgtgtcttcttcggacaggcttagggagttaggccccgacggcgaggaggcagaggggccaggggccggcgacggaccccctcgctccttcgactgggggtacgaggaaagatccggggcccactcctcggcctccccaccacggagccgctctagggatagatcccatgagcgcaacagggaccgagaccgcgatagggagagagaccgggatcgggatcgggaccgtgacagagaaagggatcgggatcgcgatagagatcgcgacagagatagagaaagagaccgtgaccgtgagcgggaccgagacagggaccgcgagggcccatttcgtagatctgactcttttcccgaacgaagagctccccggaaggggaataccttgtatgtctacggagaagatatgactccaactctgctccgcggagcattctctcccttcggtaacattatcgacctctcgatggatccaccgtag

SEQ ID NO: 131906 - DNA, 723 bp, Artificial Sequence
  Description of Artificial Sequence: Synthetic coding sequence
atgctggtcatcccgcccggcctatccgaggaagaggaggctttacaaaaaaagttcaataaactcaagaagaagaaaaaggcactgctagctctcaaaaagcagtcatctagctcaactacttcgcaagggggcgtgaagcggtctctgagtgagcagcctgtgatggacactgccaccgccaccgaacaggccaagcagctcgtgaagtccggggccatctccgccattaaggccgagacaaagaacagcggctttaaaagatcccggacgctggaaggcaagttaaaggatcctgagaagggcccagtcccgaccttccagccctttcagcgttctatctctgcagacgacgacttacaagaatctagcaggcggccacagcgaaaatcattgtatgaatccgatcgactaagagaattggggcccgatggggaagaggccgagggccccggagctggcgatggtcccccacgatcatttgactggggttatgaagagcgcagtggcgcacacagtagcgcgagccctccaagatccagaagtcgcgataggagccacgagcgtaaccgtgatcgggaccgcgacagggaaagagatcgcgatcgcgatcgcgaccgcgatcgggagcgcgaccgggaccgagatcgcgatcgcgatcgcgatagagagcgagatcgagatagagaacgagaccgcgatagagatagggaaggcccctag

SEQ ID NO: 131907 - DNA, 1143 bp, Artificial Sequence
  Description of Artificial Sequence: Synthetic coding sequence
atgctggtaattcctcctggcctgagcgaggaggaggaagctctccagaaaaagttcaataaactgaaaaaaaagaagaaagcgcttttggcactcaagaagcagagctcaagcagtaccacttcccagggtggggttaaacggtccctgtctgaacagcccgttatggacaccgccacggcaaccgagcaggcaaaacagcttgtgaaatccggtgccatttccgctataaaagccgagaccaagaatagcgggtttaaacgatcgcgcacgcttgaggggaagctgaaggatcctgagaaggggccggtcccgacgttccagccctttcagcggtccatatcggcggacgacgacttacaggaatcaagccggcggcctcagcgaaaaagtctctatgagagttttgtgtctagttcggacaggcttagagaacttggcccagatggagaggaggcagaaggtcctggtgctggagatggtcccccaagatccttcgattgggggtatgaagagcgatcaggtgcgcactcgtctgcctcgccaccccgcagcaggagccgggaccgttctcacgagcgaaacagagatagggaccgcgacagagaacgcgatcgcgatagggatagagatcgtgacagagagagagatagagatcgggaccgagatcgcgacagagaccgcgaacgtgacagggatcgcgagagagatcgcgaccgagaccgagagggcccatttcgacggtccgactcattccctgaaagacgggcacctagaaaaggcaacacgctatatgtgtacggggaagacatgacccctacgctgctgagaggcgcgttttccccgttcgggaacattatagatctgtcgatggatcctccacgtaactgtgccttcgtgacctatgaaaagatggaatccgctgatcaggccgtggctgagctcaacggcacacaggtggaatctgtgcagttgaaagttaatatcgcgcgaaaacagcctatgttggatgctgctacgggcaaaagcgtctggggaagcctggccgtccaaaacagcccaaagggatgccacagagataaacgcacacagatagtctattcagacgatgtgtacaaagagaatcttgtcgacgggttctag

SEQ ID NO: 131908 - DNA, 480 bp, Artificial Sequence
  Description of Artificial Sequence: Synthetic coding sequence
atgctggtcattccgcctggcctttctgaagaggaagaagccttacaaaaaaaatttaacaagctgaagaagaaaaaaaaggcactcctcgcccttaaaaaacagtcctcgagttctacaacaagtcagggcggtgtgaagcggagcctttctgagcaacctgtgatggacacggcaacagcaaccgagcaggcaaagcagctagtgaagagcggggctatctcagcaatcaaagctgagaccaagaactctggatttaagaggagccggaccctcgaggggaaactgaaggaccccgagaagggcccggtaccgacttttcagccctttcaaaggtcaattagtgccgacgacgacctgcaggaatcttcccgacgcccgcagaggaaatccctctatgaatcttttgtatcctcctccgatcgactgcgggaactgggcccggatggcgaggaagctgaagggccaggtgccggatag

SEQ ID NO: 131909 - DNA, 1164 bp, Artificial Sequence
  Description of Artificial Sequence: Synthetic coding sequence
atggtccccaagggcgccaccatgctggtgatccctcccggcctgtcggaggaagaggaagcccttcaaaagaagttcaataaactgaagaaaaaaaagaaggccctcttggcgctgaagaagcagtccagtagctctacaacctctcaagggggtgtcaagagatctttgagcgagcaacccgtgatggacaccgccaccgctactgagcaggccaaacagcttgttaaatcaggggctattagcgctataaaggctgagaccaaaaattcggggttcaagcgatcaaggacacttgaggggaagctgaaggatccggagaaggggcccgttcccacgttccagccttttcagagaagcatcagcgcagacgatgatcttcaggaatcctctcgccgcccccaaaggaagagcctttacgaatcctttgtgagctcaagtgatcggcttcgggagttgggacctgacggtgaagaagccgagggcccaggcgccggggacgggcctcccaggagcttcgattggggatatgaagaacggtcaggagcgcactcctccgcgagccctcctcggagccgctctcgtgatcgcagccatgagcgtaacagagacagagatagggatcgggaacgtgacagagatcgggatagagatcgcgacagagaacgcgaccgcgacagggatagagacagagatagagatcgcgagcgcgatagggaccgggaacgagaccgcgaccgggacagggagggcccatttaggcggagcgactcctttcccgaacgccgtgcccctcgtaaaggaaacaccctgtacgtatatggcgaagacatgacccctactcttctgagaggagctttcagccccttcggtaacattattgacttaagtatggaccctcctcgaaattgcgcatttgttacatatgaaaagatggaatcggccgatcaggctgtagccgagctcaacgggacacaagtggaaagcgtgcagcttaaggtcaatatcgccaggaagcagcctatgctggatgctgccacgggaaaaagcgtatggggttcactggccgtgcagaactcaccaaaaggatgtcatagagacaaacggacgcagatcgtgtattcagatgacgtgtacaaggaaaacctggtggacggcttctag

SEQ ID NO: 131910 - DNA, 1164 bp, Artificial Sequence
  Description of Artificial Sequence: Synthetic coding sequence
atggtgcctaagggcgcaaccatgctcgtgatcccccccggtctttcagaagaggaagaagctctccagaagaagtttaataagctcaagaagaagaagaaggctctcctagccctgaagaaacagagctctagctccaccacatctcagggcggtgtgaaaaggtccctcagcgaacagcctgttatggacacagcaactgctaccgagcaagccaagcagctggtgaagagtggcgcgatttcggccataaaggctgagaccaagaacagcggcttcaagcgctccagaaccctcgaaggaaaactgaaggacccggagaaaggtcccgtacctacgttccagccatttcagcgctccatcagcgccgacgacgacttgcaggagtcctctagacgcccgcaaagaaagtctctgtacgaaagctttgtctcctccagtgatagactgagagaactgggaccagatggagaggaggcagagggcccgggagctggcgacggtccacccaggagctttgattggggatacgaagagcggtccggagcccacagcagcgccagtccgccccgcagtagatcacgcgatcggtctcacgagcgcaacagagaccgcgatagggatcgcgagagggatcgggatagagacagagatagggaccgggagcgtgaccgcgaccgtgaccgggatcgagatcgcgatcgcgaaagagatagagacagggaacgtgatagagacagagacagggaggggcctttccgacgttcagattcctttcccgaacgaagggcacccagaaagggcaatactttgtatgtgtatggggaggatatgaccccaaccctacttagaggcgcgttctcccccttcggaaacatcattgacctgagtatggaccctcccagaaactgtgcctttgtcacttacgagaagatggagagcgctgaccaggcggtcgctgaattgaacgggacccaagtcgagagtgtgcagctgaaggtgaatattgcgagaaaacaaccaatgctcgatgcagctacgggcaaaagcgtctgggggtcactcgcggtgcaaaatagccctaaaggatgtcacagagataaaagaacgcagattgtgtactcagatgatgtctacaaggaaaacctcgtcgatggcttctag

SEQ ID NO: 131911 - DNA, 1164 bp, Artificial Sequence
  Description of Artificial Sequence: Synthetic coding sequence
atggtgcccaagggcgccaccatgctggtcataccccctggactcagcgaagaggaagaagccctgcagaagaaattcaacaagctcaaaaaaaagaaaaaagctctgctcgccctgaaaaagcagagctctagcagcacaacatcccaggggggtgtcaagaggtccttgagcgagcagccagtcatggacactgccacggccacagaacaggccaagcaactagtgaaatcgggggccatcagtgcaatcaaggctgaaactaagaactccggatttaaaaggagccgaactctggagggtaagttaaaggaccctgagaaaggtcctgtgcccactttccagccatttcaaagatccatatccgccgatgacgatttacaagaatcttcccgcagaccccaacggaagagtctctacgaaagtttcgtaagctctagcgaccggctgagggaactggggcctgacggagaggaggctgaaggacccggtgccggtgacgggccacctcggtctttcgactggggctacgaggagaggtccggcgctcactcgagtgcatctccacctagaagccgctcgcgcgatcgctcacatgagaggaaccgcgacagggatagagacagagaacgcgacagggatagggatcgggatcgcgacagggagagagacagagacagggaccgggaccgtgacagagatcgggagcgggaccgggatagggaaagggatcgcgatcgagacagggaaggtccgtttcgcaggtccgattcatttccagaacgccgagctcctagaaagggtaacaccctctatgtgtatggggaggatatgacaccaaccctcctgaggggagcgttctctccatttggaaacatcatagacctgtccatggatcccccccgtaactgtgcgttcgtcacttacgaaaagatggaatcagccgaccaggctgtggctgagcttaacgggacccaggtagaaagtgttcaactcaaagtgaacatcgctcgaaagcagccgatgctggacgcggccaccggcaaaagtgtctggggctccttagccgttcagaactcaccgaaggggtgtcaccgggataaaaggacccaaatagtgtattctgacgacgtgtataaggaaaacctggtggatgggttctag

SEQ ID NO: 131912 - DNA, 1164 bp, Artificial Sequence
  Description of Artificial Sequence: Synthetic coding sequence
atggtgcctaaaggggcaacgatgctggtgattccgcccggactcagtgaggaggaggaggcactccagaagaaatttaacaagctgaaaaaaaaaaaaaaagccttgctagcactcaagaagcagtctagctctagtaccacaagtcagggcggggtgaagagaagcctgagcgaacagcccgtgatggacactgcaaccgcaaccgaacaggctaagcagctcgttaaatctggggcgatctccgccatcaaggccgagaccaagaattccggtttcaagcgcagccgcacactcgaaggtaagcttaaggaccccgaaaaggggccagtgcccaccttccaaccattccagaggtccatcagcgccgacgacgacctgcaggagtcatcccgtaggccgcagaggaaatccttgtatgagagttttgtctccagctccgatagactgagggaactggggccagatggtgaagaggctgagggtcctggcgccggggacggtcctccccgctcctttgactggggttatgaagagagatctggtgctcacagctctgccagtcctccaaggtctcgcagtcgcgaccggtctcacgagcgtaatagggacagagatagggaccgagaacgcgaccgggatcgtgatcgggatcgtgatcgtgaaagggaccgggaccgcgatcgcgacagagatcgcgaccgcgaacgcgatcgggacagagaaagggatagggatagagacagagaaggcccttttcgtaggtcagacagctttcctgagcgcagggcaccaaggaaggggaatactttatacgtgtacggggaggacatgacccctacactgttgagaggagcgttttcgccttttgggaatattattgacctctctatggatccacctcgaaattgcgctttcgtcacctacgagaaaatggagagcgccgaccaagccgttgcggagctgaacgggacccaggtagaatctgttcaacttaaggtgaacatcgcccggaagcagcccatgctggacgctgccacaggcaagtcggtgtggggcagcttggcagtccaaaattctcctaagggctgccacagagataaacggacacagatcgtgtattccgacgatgtatataaggaaaatctggtagatggattctag

SEQ ID NO: 131913 - DNA, 1164 bp, Artificial Sequence
  Description of Artificial Sequence: Synthetic coding sequence
atggtgccaaaaggtgcgacaatgctggttatccccccagggctcagcgaagaggaggaggccttacagaagaaattcaataaacttaagaaaaagaagaaagccttactggctcttaagaaacagtcgtccagtagcacaacttctcagggcggagtgaagagatctctctctgagcaacctgtgatggacacagctactgccacagagcaggcaaagcagctggtgaaaagcggtgcaatttctgcaataaaagcagagactaagaatagtggattcaaacggtcaagaacattggaagggaagctgaaggacccagagaaaggccccgtgcccaccttccagcctttccagcgctccatcagtgccgacgatgatctccaggagagtagccggcggccgcaacgcaaaagcctgtatgaaagtttcgtctcatcttctgatcgccttcgggaactgggccctgatggagaagaagctgagggcccaggcgctggtgatggtccgcctcgcagcttcgactggggatacgaggagaggagcggggcccactcgtcagctagccccccccgatcaaggtctagggatagatctcatgaacgtaaccgggatagagaccgcgacagggagcgagatcgtgatagagatagggaccgcgaccgggagagggatagagaccgagaccgggaccgggacagggaccgtgaaagagacagagaccgcgaacgtgatagggatcgggatcgagaggggccttttagacggtctgactcatttccagaacgcagggcccctcgtaaaggtaatacactgtacgtgtatggggaggacatgactcccactctcctgcgtggagccttttcgcctttcgggaacatcatcgacctgtccatggaccctccacgtaactgtgcattcgttacttacgaaaagatggagtccgcagatcaagctgtcgctgagctaaacgggactcaagtggagtctgtacaactcaaggtgaacatcgcccgtaagcagccaatgctggatgctgccacagggaaatccgtctggggatcccttgccgttcagaacagcccgaaaggatgccatcgtgacaagagaacacagattgtttacagtgatgacgtgtataaggagaacctggttgatgggttttag

SEQ ID NO: 131914 - DNA, 3294 bp, Artificial Sequence
  Description of Artificial Sequence: Synthetic coding sequence
atggccacacaggtcatggggcaatcctccggcgggggaggactgttcacttccagcggtaatatcgggatggctctgcctaatgacatgtacgatcttcatgatctaagcaaggcagagctggccgctccccagctcataatgctggcgaacgtcgcactcactggcgaagtcaatggcagttgttgtgattacctggtcggggaagaacgccagatggccgagcttatgcctgttggcgataacaactttagtgatagcgaagaaggggaaggattggaggagtcggccgacatcaaaggcgagccacacgggctggagaacatggaactgcgttccttagaattgagcgtcgtggaacctcagcctgtttttgaagccagtggagctccagatatttatagcagcaacaaggacctacccccagagacccctggagctgaagacaaaggcaaatccagcaagaccaagccatttagatgtaaaccttgtcagtacgaagccgagagtgaggaacaattcgtacaccatatcagggtgcactccgcaaaaaaatttttcgtggaggagtccgctgaaaaacaggcgaaagcccgagaatccgggtcctctacggccgaggaaggagacttctccaagggtcccattaggtgtgaccgatgtggatacaataccaatcgctacgatcattatactgctcacctgaaacaccacaccagagcaggtgacaacgagagagtttataagtgcataatctgcacatacactaccgtgtctgagtaccactggcggaaacacttgagaaaccattttcctaggaaggtctacacatgcggcaagtgtaactatttctccgacaggaagaacaactacgtgcagcacgtcaggacccacaccggagagagaccctataaatgtgaactttgcccatattccagtagtcagaaaacccacctgactcggcacatgcggacccattcaggcgaaaaaccttttaaatgcgaccaatgttcttacgtcgcttccaatcagcatgaggtgactaggcacgccagacaagtccataatggccccaaaccacttaactgcccccattgcgattataaaactgcggaccggtctaattttaagaagcacgtcgagttgcacgtgaatccgcgtcaattcaactgcccagtctgcgattacgccgcatcaaagaagtgcaaccttcagtatcacttcaagtcaaagcatcctacttgcccaaacaagacaatggacgtgtctaaggtgaagcttaagaagacaaaaaagagagaagccgacttgcctgataacatcaccaatgagaaaacagaaattgaacagaccaagattaaaggtgacgtcgccgggaagaaaaatgaaaagtccgtgaaagctgagaaaagagacgtctccaaagagaaaaagccatctaacaacgtgtctgttattcaggtaactacccgaaccaggaaatctgtaaccgaggtgaaggaaatggacgtccacaccggatcgaattccgagaaatttagcaagaccaaaaagagcaagcgtaaattggaggtcgacagccatagcttgcacggtccagtcaacgatgaggaaagctctacaaagaaaaaaaagaaagttgaatctaagtctaaaaacaacagccaggaagtacccaagggggactcaaaggtggaagagaacaagaagcaaaacacttgcatgaagaagagcacgaaaaagaagacgttaaagaataaatccagcaagaagtcaagcaagcctcctcagaaggaacccgtggaaaagggttctgcccaaatggacccgccgcagatgggccccgcccctacagaggctgtacagaagggacccgtccaagtggagcccccgcctcctatggagcacgcccagatggaaggagctcagatcagacctgcacccgatgagcccgtgcaaatggaggtggtgcaggagggccccgcccagaaagaactcctccctcctgtggaacccgctcagatggttggcgcacagatcgtgctggcccatatggaactccccccacctatggagacggcacaaactgaagttgcgcagatgggtcccgcgcctatggagccagcacagatggaggtggcccaggtggagagcgctcctatgcaggttgtgcagaaagagcccgtacaaatggagctgtctccgcctatggaggttgtgcaaaaggaaccagttcagatcgaactaagcccgccaatggaggtggtccagaaggaaccagtcaaaatcgaactttccccccctatcgaggttgttcagaaagagcccgtgcagatggagctgagccctccaatgggcgttgtgcaaaaagagccggcacagagggaaccccctcctcccagggaacctcctttgcatatggaaccaatctccaaaaagccccccttgagaaaagataaaaaggagaaaagcaacatgcagtccgagcgtgcacgcaaggaacaggtccttatcgaagtcggactggttcctgtgaaggacagttggctgctgaaggagtcagtgtccacagaagacctctcaccacctagtccacccctgccgaaggaaaacctccgtgaggaggcttcaggagaccagaaactgctcaatactggagaaggaaataaagaagccccccttcagaaagtaggggcggaggaggccgatgagagccttccagggctggcagctaacataaacgagagcacacacatcagctcatctgggcagaaccttaacactccggagggagagaccctgaacgggaaacatcagactgattcaattgtatgcgaaatgaagatggatacagaccagaacacaagagagaatctcacaggcatcaatagcaccgtcgaagagccggtgtctcctatgctgcctcccagtgctgtggaagaacgagaagcagtctcgaaaacagccctggcttctccccctgcgacaatggccgccaacgaaagccaggaaattgatgaagatgaggggatccactcccatgagggcagcgacctatccgataacatgtctgagggctcagatgatagtggactccatggcgctcggcctgtgccacaggaaagctcccgcaagaacgccaaagaggccctagccgtaaaggcagcgaagggggattttgtgtgcatattctgcgatcggtcctttcgaaagggcaaggactacagcaagcacctgaaccgccatctggtgaacgtttattatcttgaggaggctgcccagggtcaggagtag

SEQ ID NO: 131915 - DNA, 3225 bp, Artificial Sequence
  Description of Artificial Sequence: Synthetic coding sequence
atggccactcaggtcatgggccaaagctcagggggcggaggcttgtttactagcagcggcaatatcggcatggcgctacctaatgatatgtacgacctgcatgatttatcaaaggcggagcttgcagcacctcagctcatcatgttggccaacgttgcgctcaccggcgaggtgaatggatcctgttgtgattacctagtcggcgaagaaagacagatggctgagctgatgcctgtcggcgacaataacttctctgactccgaagaaggcgaggggctggaagaaagcgccgatattaagggggagccccatggccttgagaacatggagctcagatccttggagctctctgttgtggagcctcagcccgtgttcgaggctagcggtgctccagatatctattccagtaacaaagacttgcctcctgagactcctggggctgaagataagggcaaatcttctaagacgaagccctttcgatgtaaaccttgccagtatgaggccgagagtgaagaacagttcgtgcaccacatccgcgtgcactccgctaagaagttcttcgtggaagaatcggcagagaaacaggccaaggccagagaatctggcagttcaacagccgaagaaggggacttcagcaagggacctatcaggtgtgatcggtgcgggtacaacacaaatcgctacgatcactacactgcccatctgaagcatcacacaagagctggagataatgagcgagtatacaagtgcattatatgtacatatacaaccgtgagtgagtaccattggaggaaacacttacgcaaccacttccctcgcaaagtttacacttgcggcaaatgtaattacttctctgaccgcaagaacaactatgtgcaacacgtcaggacccatacaggaaagcgacctagcggtgagaagccttttaaatgcgaccagtgttcttacgtggcaagcaatcaacacgaggtgactcgtcacgccaggcaggtgcacaatggcccaaaacccctgaactgccctcactgtgactataagactgcagatagatccaacttcaagaagcatgtggaactgcacgtgaatcctaggcaattcaattgccccgtttgtgattatgctgccagtaagaagtgcaatcttcaatatcacttcaagtccaagcaccccacttgtccaaacaagaccatggacgtgagcaaagttaagcttaagaaaaccaagaagcgggaggctgatctgcccgacaatattactaacgagaagaccgagatcgagcagaccaagataaagggggatgtcgccggcaagaagaatgagaagtctgtcaaggcagagaaacgggatgtgagcaaggaaaaaaagccgagcaacaatgtttctgtgattcaggtgacaacccggactcgaaaatcagtcacggaagtgaaagagatggacgtgcatactggtagcaactcggaaaaatttagcaaaactaagaaatcaaaaaggaagcttgaagtggatagccactcgctacacggccccgttaacgacgaagaatcttcaacaaagaagaagaagaaagtcgaaagtaagagcaaaaataatagccaagaagtaccaaagggagattcaaaggtggaggaaaataagaaacagaacacatgcatgaaaaagtccacaaagaaaaaaactctgaaaaataagtctagtaaaaagtcctccaaaccccctcagaaggaacctgtggagaagggttccgcccaaatggaccctccccaaatggggcccgcccctaccgaggcagtacaaaaagggccagtacaggtggagcccccgcccccaatggagcacgcccaaatggaaggtgctcaaatcaggccggctccggacgaaccagtccaaatggaggtcgtccaggaggggcctgcacagaaggagctgctccccccagttgagccagcccagatggtgggcgcccagattgtcttggcacatatggaattaccacccccaatggagacagcacagacagaggtggcgcagatgggaccagctcccatggaacctgctcagatggaggtggctcaagtcgagtccgctcctatgcaggtggttcagaaggagccggtacagatggaactgtctcccccaatggaggtggttcagaaggagcccgtccagatagaactctcaccccctatggaggtggtgcagaaggagcccgttaagatcgaattaagcccacccatagaggtagtgcagaaggagccagtgcagatggagctcagccctccaatgggtgtggtgcagaaagagccagcccagcgcgagccccctcctccccgggagccccctctccatatggaacccatctccaaaaaacccccattgagaaaggataagaaggagaagtcaaatatgcaatccgagcgggcccgcaaggagcaagttttaattgaagtgggcctggtcccagtgaaagattcctggctgctgaaggagtccgtcagcactgaggatctatccccacccagcccacctcttccaaaagagaatctcagagaagaggcttcgggagatcagaagttgcttaacaccggagagggaaataaggaagcgcctttgcagaaggtcggcgcagaagaagccgatgagtccctgcccggcctggctgccaacattaatgaaagcacccacatctcaagcagcggacaaaatttgaatacacccgagggggagacgctgaacgggaaacaccagacagattctattgtgtgtgaaatgaagatggacacagaccaaaacactagggagaatctgaccgggattaactctacagtagaagagccggtttcacctatgctgcccccaagcgcagtggaagaaagagaagccgtgtccaagaccgcactggcgtccccacctgcgaccatggctgctaatgaaagccaagaaatagatgaggacgagggtatccactctcacgagggcagtgacctgagcgataacatgtccgaaggatccgacgattctggtctccacggagccagaccggtgccacaagagagctcacggaaaaatgcgaaggaagcactggctgttaaagccgctaagggcgatttcgtgtgtattttctgcgaccggtcctttagaaaaggcaaagattattccaaacacctgaacagacacctggtaaatgtgtactacctggaggaggctgcacaaggtcaggagtag

SEQ ID NO: 131916 - DNA, 1383 bp, Artificial Sequence
  Description of Artificial Sequence: Synthetic coding sequence
atggctacacaagtgatgggacagtcatctggtggcggtgggctctttaccagctcgggaaacattggaatggccttgcccaacgacatgtacgacctccacgatctttccaaggctgaattagccgccccccagctgatcatgctagcaaatgtagctcttacaggcgaagtcaacggctcatgttgtgattacttagtgggagaggaaaggcagatggctgaactcatgccggtgggcgacaacaatttctccgattcagaggaaggtgagggtcttgaggaaagcgccgacattaagggcgagccccacgggctggagaacatggaactacgatcccttgagctgagcgtcgtcgagccccaacctgtgttcgaggccagtggagcaccagacatctatagcagcaataaggatttgccgcccgagacacctggtgccgaggacaaaggtaaatcaagcaagacaaagccctttaggtgtaagccctgccaatacgaggcagagtctgaagaacagttcgtccatcacataagggttcactctgccaagaagtttttcgtggaggagagcgccgaaaaacaggctaaagccagggaatcgggctctagtaccgctgaggagggcgatttcagcaagggaccaatccggtgcgatagatgcggatacaatacgaatcggtatgaccactataccgcccatctcaagcaccacacgagagcaggtgacaatgagcgcgtatataagtgtattatctgcacttacacaaccgtgagcgagtaccactggagaaaacacctgcgaaaccactttcctaggaaggtgtacacatgtggtaagtgcaactatttcagcgatcgtaaaaataactatgtgcagcacgtgcgtacacatacaggggagagaccgtataagtgtgaactgtgtccatacagctcttctcagaagacacatctaactagacatatgaggactcacagcggcgagaagccttttaagtgtgaccagtgttcatatgtagcctctaatcaacacgaggtcacgagacacgcgcgacaggtccacaacggaccaaaacctcttaactgccctcattgcgactacaaaaccgcagaccgctctaactttaagaagcatgtggaactacatgtcaaccccaggcagttcaactgccccgtttgcgactacgccgcgagcaaaaaatgtaatttgcagtatcatttcaagtcgaaacaccctacctgccccaacaagacaatggacgtctccaaagtgaaactgaaaaagacaaagaaaagagaagcggatctgccggataatataacgaatgaaaagactgaaatagagcaaacaaagaaaaagaagaagaaaaaaaagaaatag

SEQ ID NO: 131917 - DNA, 5745 bp, Artificial Sequence
  Description of Artificial Sequence: Synthetic coding sequence
atggctgacggaaaaggggatgctgcggctgtggcaggcgcgggcgcagaagcccccgccgtggccggtgcgggagatggagtcgagacggagtctatggttcgtggccatcggccagtgtctcctgctcctggagcaagcgggctccgtccctgcctgtggcagctggaaaccgagctaagagagcaggaagtgtccgaagtttccagcttgaactactgtaggagcttctgtcagacacttctccagtatgcttcaaacaagaacgcatctgagcatatcgtttatctgttggaagtctataggctggccatccagtccttcgcatccgccaggccctacttgactacggaatgtgaagacgtcctgttggtgctgggcagattggtcttgagctgcttcgagctcctgctgagtgtcagtgagtctgagcttccctgcgaagtgtggctgccttttctgcagtcgctgcaggagagtcatgacgccctcctggagttcggtaacaataatctgcaaattctggttcacgttaccaaagagggggtgtggaagaatccggtgttgcttaagattctatcccaacagcctgtggaaacagaagaggtcaacaagctgatagcccaggaaggcccatcctttctccagatgaggattaaacacctcctcaaatctaattgcatcccacaggcgacggcactgtccaaactttgtgcagaatccaaagaaatcagcaacgttagttcatttcagcaggcctacatcacgtgtctgtgcagcatgttaccaaatgaggatgctatcaaagagattgctaaagtcgattgcaaagaggttctggacattatttgcaacctcgagagcgaaggacaggacaatacagcgttcgtgctgtgtaccacgtatcttacccagcaactccagactgcaagtgtgtactgttcctgggagctcacattgttctggagcaagctacagcggcgcatcgaccccagcctggacacatttctagagcgctgtcggcagttcggcgtgatcgccaagacgcagcagcacctgttctgcctgatccgcgtcatccaaaccgaagctcaggacgccggcctgggtgtctctattttgctctgcgttcgcgctctgcagctgcggagttccgaggatgaggagatgaaagcgagtgtatgcaaaaccattgcctgccttcttcccgaggacctggaagtcagacgcgcttgtcagctgacggaattcctaatcgaaccgtccctagatggatttaatatgttagaagagctctacctgcagccagatcagaaattcgacgaggaaaatgctcctgtgcccaactccctaagatgtgaactgctgctggctctcaaagcccactggccattcgatcctgaattctgggactggaagacactcaaaaggcactgccaccagttactgggtcaagaagcctcagattcagatgatgatttgtcaggctatgagatgagcatcaacgacaccgacgtcctcgaatccttcctttccgactatgacgagggtaaagaagacaaacaatataggcgaagggatctgacagatcagcataaggaaaagagagacaaaaagccaatcgggtcaagcgaaagatatcagcgttggctgcagtacaaattcttctgcctgctgtgcaagagagaatgtatcgaggcccgcatactgcatcacagtaaaatgcacatggaggacggaatatacacatgtcccgtgtgcatcaagaagttcaaaaggaaggagatgtttgtgccccacgtaatggaacacgtgaagatgcccccctccaggcgtgataggtcaaagaagaaattactccttaagggctctcaaaaaggaatttgcccaaaatcaccaagtgccattccagagcaaaaccatagcctcaatgaccaggctaaaggggaaagccatgagtacgtaacattctccaaactcgaggactgccatttgcaggaccgggatctgtacccctgtcccggtactgactgctctcgggtgtttaaacagttcaagtacctcagcgtccacttgaaagccgaacaccagaataatgatgagaatgcaaagcactatctggacatgaaaaacagacgggaaaagtgcacctactgcagacggcacttcatgtctgcgtttcacctgagagagcatgagcaggttcattgtgggccacagccatacatgtgcgttagtatcgactgctatgcccgctttggttcagtaaacgagttgttgaaccataaacagaagcacgacgacctgagatataaatgcgaactgaacgggtgtaatatagttttcagcgacttggggcagctgtatcatcacgaagctcagcattttagggacgcctcgtatacctgcaactttcttggctgtaagaagttctactatagcaaaatcgagtatcagaaccacctaagtatgcacaacgttgaaaactctaacggtgatattaaaaagtccgtgaagctagaggagtctgcaactggcgagaagcaggactgtattaaccagcctcatctcctcaaccagacagacaagagtcaccttcctgaggacctgttttgcgccgagtcagcaaacagccaaattgacactgaaaccgccgagaacctgaaggagaatagtgacagcaatagttccgaccagctgagccattcaagctcggcaagcatgaatgaagagctgattgatactctggatcatagtgagaccatgcaagacgtgctgctgtccaacgagaaggtttttggaccttcaagtctgaaagaaaaatgttcgtctatggccgtgtgcttcgacgggaccaagttcacttgtggtttcgatgggtgtgggtcaacctacaaaaacgctagaggaatgcaaaagcatctccgcaaagtacatccataccactttaagcccaagaagatcaagacaaaggatctgttcccgagcctaggtaacgagcataatcagacaacggaaaaacttgatgccgagcccaaaccatgctcggacacgaactctgacagtcccgatgagggcctcgaccataatatccatattaagtgtaagcgcgagcaccaaggctacagcagcgagagttccatatgcgcatctaagcgtccatgcacagaggatacaatgctggaattacttttgaggctgaaacacctgagcctgaaaaattctattacgcatggaagctttagcggatcattgcaagggtaccctagcagcggcgctaagtcactgcaaagcgtctcaagcatttcagacctcaacttccagaaccaggatgaaaacatgccatcacaatacctggcccagctggcagccaagccgttcttttgcgaacttcaggggtgtaagtacgagttcgtaaccagggaggcactgctcatgcactacctcaaaaaacacaattatagtaaagaaaaagtgctccagcttacaatgttccagcaccggtattccccctttcagtgtcacatctgtcagagatcattcacaaggaaaacccatctgcggatccactacaagaataagcatcaaatcggatccgaccgggccacacacaaactgctcgataatgaaaagtgcgaccacgaaggaccatgtagtgtcgatcggctgaagggcgactgcagcgcggagctcggtggggacccaagctccaatagcgagaaacctcattgccatcccaaaaaggacgagtgctccagcgaaaccgacctggaatcctcatgcgaggaaaccgagagtaagacaagcgatatcagttcccctatcgggtctcatagagaagagcaggagggcagggagggccgggggagcaggcggaccgtagcaaaaggtaatctgtgttacatcttgaacaaataccacaaaccatttcattgcattcataagacctgtaactcatccttcacaaacctcaaaggcctcatcagacactatcgcaccgtgcaccagtacaacaaagaacaactctgtttggagaaagacaaagcccgcactaagagagagttggtgaagtgtaaaaagatttttgcttgcaagtataaagaatgcaacaagagattcctctgttctaaagcactagcgaaacactgttcagactctcataacctcgaccacatcgaagagcctaaggtgttgtccgaggctggttctgcagcccgattcagctgcaaccagcctcagtgccccgccgtattctacacattcaataagcttaagcatcatctgatggagcaacataacattgaaggggaaattcattcagactacgaaatccattgtgacctgaacggttgtggacagatcttcacacacagatccaactattcccaacacgtgtactacagacacaaggattattacgacgatctgttcaggagccagaaggtcgccaacgaacgtctattgaggagcgaaaaggtctgtcagaccgcagatacccagggacatgaacatcaaaccaccaggagatccttcaatgctaaatcaaaaaaatgcggactgattaaagagaaaaaagcgcctatctccttcaagaccagagccgaggccctgcacatgtgtgtggaacacagtgagcatactcagtatccttgcatggtccaaggttgcctgtccgtcgttaaacttgaaagtagcattgtgcgacattataagagaacccaccaaatgagtagcgcctacctggagcagcagatggagaatctggtggtgtgcgtgaaatatgggacgaaaattaaggaggaacccccttcagaagcagacccctgcataaagaaagaggagaacagatcgtgtgaatccgaacgaaccgagcacagtcatagcccaggcgattcttccgcccccatccagaacacggactgctgccactcatccgaaagggacggcggacagaaaggatgcattgagtctagcagtgtgttcgacgccgataccctgttgtaccgcgggacactgaagtgcaaccacagctctaaaactacaagcctggagcagtgtaacatcgtccaacccccacccccatgcaaaattgaaaacagtatcccgaaccccaatggtacagagtctggaacatatttcacctcttttcagctgcctctcccacggattaaggaatccgagacaaggcagcactcctccggccaagagaacacagtgaaaaacccaactcacgtcccgaaggaaaacttcagaaagcattctcagcccaggagcttcgacctcaaaacatataaacccatgggctttgagtctagcttccttaaatttatccaggagtccgaagaaaaagaagatgattttgacgactgggagccctcagagcatctgactctgtctaactcttctcagagcagtaatgacctcacaggcaacgtggtggccaacaacatggttaatgactctgagccagaagtggacatcccccattcctcaagtgactcgactatccacgaaaaccttaccgctattcctccattgatcgtagctgagacgacaaccgtgccctccctggagaacctacgggtggtgctggataaagcgcttactgactgcggcgagctggccctgaaacagcttcattatctgaggccggtcgtggtgctggaaaggtctaagttcagcaccccaatcctcgacctatttcctaccaagaagacggatgagctctgtgtaggttccagctag

SEQ ID NO: 131918 - DNA, 4824 bp, Artificial Sequence
  Description of Artificial Sequence: Synthetic coding sequence
atgttctatcatgatctcttctacagagagttaaccctgttctggagtaagcttcagcgacggatcgacccgtccctggacacttttcttgaacggtgccggcagttcggagtaatagcgaagacccagcagcatctgttctgccttattcgcgtcatccaaaccgaagcccaggatgccggcttgggcgttagcatactactgtgtgtgcgtgccttgcagctacgctcttcagaggatgaggaaatgaaggcttcagtgtgcaagaccatagcatgcctgttgcctgaggatctggaagttcggagagcttgccaactgaccgaattcctgatcgagccatcattagatggttttaatatgcttgaggaactgtatctacagcctgatcagaaatttgacgaagagaacgcgcccgtgcctaacagcctgcgatgtgaactgcttctggcccttaaagcgcactggccttttgatccagagttctgggattggaagaccctgaagcgccactgccaccagttactcggccaggaggcgtctgatagcgatgacgatttgtctgggtatgaaatgtccatcaacgacacggacgtgctagaaagctttctctccgactatgacgaaggtaaagaagacaagcagtatcggcgccgggatttgactgatcagcataaggagaagagagataagaaacccatcggctccagtgagcggtaccagcgctggttacaatacaaattcttctgtctgttgtgcaagcgggagtgtatcgaggcccggattctccatcattctaaaatgcatatggaagatgggatctatacctgcccagtctgcataaagaaattcaagaggaaagaaatgttcgtgccccacgtcatggagcatgtcaaaatgccaccaagtcgacgggaccgttctaagaagaagcttctgcttaagggaagccagaaaggaatttgcccgaagagcccatccgcgatcccagaacagaatcacagtctgaacgatcaagcaaagggggaatcccatgagtacgtgaccttcagtaaacttgaggattgtcacctgcaagaccgcgacctctacccctgccccgggacagactgttcacgggtcttcaagcagtttaagtatctcagcgttcatctgaaagccgagcatcaaaacaacgacgagaatgctaaacattacctggacatgaaaaaccggagggagaaatgcacttactgcaggaggcactttatgtctgcattccatctcagggaacacgagcaggtgcactgtggcccccagccctacatgtgtgtctcaatcgattgctatgctcggtttggctcggtaaacgagttacttaaccataaacaaaagcatgatgacctaagatacaaatgtgagttaaacggatgcaatatcgtcttttctgatcttggccaactgtatcaccatgaggcgcaacatttccgggatgcttcctatacttgcaactttctaggctgcaagaagttctactactccaagatcgagtaccagaaccatctgtccatgcataatgtggagaattctaacggagatatcaagaaatcagtgaagctcgaagaaagcgcaacgggggagaagcaggattgcatcaatcagccccacctgttgaaccagaccgacaaatctcacttgcccgaggacctgttttgcgccgagtccgctaatagccaaatcgacaccgagaccgccgaaaatctgaaggagaatagtgactctaactctagcgatcagttaagtcattccagcagcgcctcaatgaacgaagagttgattgacacgttagaccatagcgaaacgatgcaagacgtcctcctgtccaacgaaaaggtgtttggcccctcctcgctgaaggagaaatgctcatctatggctgtgtgtttcgatggcacaaagttcacctgcggatttgatgggtgcggaagtacctataaaaatgcacgggggatgcagaagcacttacgaaaggtacatccctatcacttcaaaccgaaaaaaatcaaaacaaaggatctcttcccctctctgggtaatgaacataaccagaccaccgagaagttggatgcagaacctaagccatgcagcgacaccaactctgactcaccagacgagggcctggatcacaacatccatataaagtgcaaaagggaacaccagggatacagctcggaaagttcgatttgcgcatcaaaaagaccttgcacagaggatacaatgctggaactgcttctgcggctgaaacacctaagcttgaagaattctattactcacggctcgttcagtggatccctgcaaggttaccccagtagcggggctaagtcattacagtcagtgtcctctatttctgacctgaacttccagaaccaggacgagaatatgccgtcacagtatcttgctcagctggccgcaaagcccttcttttgtgagttgcaaggttgtaagtacgagtttgttactcgggaagcactgctgatgcattacctcaaaaaacataactacagcaaggagaaggttttgcagttaactatgtttcagcaccggtattccccctttcagtgccacatatgccagcgaagtttcacgaggaagacacatctgcggatacattataaaaacaagcaccagatcggcagtgaccgggctacacacaagctcctggataatgaaaagtgcgaccacgaagggccgtgttctgtggaccggttgaaaggagactgtagcgctgaactcgggggcgaccctagcagcaatagcgagaagccccactgccaccccaagaaagacgaatgctcctcagaaaccgatctggagtcaagctgcgaggagacagaatctaagactagcgacatttcctcacccatcgggagtcaccgtgaagagcaagagggcagggagggccggggctcccgacgcaccgtggctaagggaaacctgtgttacattctgaataagtatcataagccttttcattgcatccataagacctgcaattctagcttcaccaacctcaaaggtctaatacggcactaccggaccgtccatcaatacaacaaggagcaactgtgcctggagaaggacaaggctcgaacaaagcgcgaactggtgaagtgcaaaaaaattttcgcctgcaagtataaggaatgcaacaagcgcttcctgtgtagtaaagctctcgcaaagcactgctccgactcgcacaacttagatcacattgaagaacctaaagtgctgagcgaagccgggtcggcggcaaggttctcctgtaaccaaccccaatgccccgctgtgttttacaccttcaataagcttaaacaccatctcatggaacaacataatattgagggtgagatacattccgactatgagattcattgcgatctgaatgggtgcgggcagatttttacacaccggtccaactattcccaacacgtttattaccgacataaagactattatgatgacttattccgcagtcagaaagtggccaacgaacgattactacggtccgagaaggtgtgccagacagccgatacacagggacatgagcaccaaactacccgacggagttttaacgcaaagtccaagaaatgcggcctgataaaggaaaagaaagcccctatttccttcaaaacaagagcagaagctttgcacatgtgtgtcgaacatagcgaacatacccagtacccctgtatggtgcagggatgcttgtctgtcgttaagctggaatcatccattgtccgtcactacaaaagaactcatcaaatgagctcagcatacctcgaacaacagatggagaatctggtggtttgtgtgaagtacggaacaaagattaaggaggagcctcccagcgaggcagatccgtgcataaaaaaagaggagaacaggtcttgcgagagcgagagaaccgagcacagtcactcgccaggcgacagttctgcacctattcagaacacagactgttgccacagctcagagagggatggagggcagaaaggctgcattgagtcttcatctgtgttcgacgcagatacactgctgtaccggggaacgctgaagtgtaaccacagcagtaagacaacctcactcgaacaatgtaacatcgtccagccaccccctccatgtaaaatagaaaacagcatccctaacccaaatggcacagaatccggcacctatttcacttccttccagttgccactcccacgaattaaagagagcgagacacggcaacacagttctgggcaggaaaataccgttaagaatccaacacacgtccccaaggagaattttcggaagcacagccaaccacggtctttcgatctcaaaacctacaagccaatgggatttgaatccagcttcctaaagtttatccaagagagcgaggaaaaagaagatgatttcgatgattgggaaccgagcgaacacttgaccctttctaactcctcacagagttcaaacgatctgacaggcaatgtcgtagctaacaatatggtgaatgactctgagcccgaagtggacatcccccactcttcatctgactccacaatccatgagaacttgacagccatcccgcctctgatcgttgcagagaccaccacagtgccatccctggagaatttgagggtggtgctggataaggcattaaccgactgcggagagctggccctgaaacagctgcattaccttaggcctgtggtggttctggaacggtcaaagttttccacccccatcttagacctgttccccaccaagaagacagacgagttgtgcgtaggttcaagttag

SEQ ID NO: 131919 - DNA, 1641 bp, Artificial Sequence
  Description of Artificial Sequence: Synthetic coding sequence
atgttttactatcccaacgtcctccagcggcatacagggtgcttcgcaacaatatggcttgccgccacgagagggtcaaggctggttaagcgggagtacctccgagtcaatgtggttaaaacgtgcgaagaaattttaaactatgtgcttgtacgagtccagccgccccagcccggcttgccaagaccaagattctctctttatctttccgcccagctacagataggggtcattcgcgtgtatagccagcagtgccagtatctcgttgaggacatccagcatattttagaacgactgcatcgggctcagttacagatccggattgatatggagacggaactgccaagtctgctccttccgaaccacttggctatgatggaaaccctggaagatgcacccgatccttttttcggaatgatgtctgtggatcccaggctaccttctccctttgatataccccaaataagacatctcctggaagctgcaatcccggagagggtagaggaaatcccgcccgaggtcccaactgaaccccgagaacccgagcgcatacccgtgaccgtactgccacctgaggccatcacaattcttgaggcagagcccatcaggatgctagaaatagaaggtgagcgggaactccccgaggtctccaggcgtgagctcgatcttctgattgctgaagaggaggccatcttactcgaaatccctcgactgccacctcccgctcctgccgaggtggagggcattggagaggcactgggaccagaagagctgcgcctgacaggatgggaacctggcgccctcttgatggaggtcacccccccagaagagttgcgactccctgcaccaccttcaccagagaggagaccgccagtacctcccccaccccgtcgaaggcgcagacggcgcttgttattttgggataaagagacgcagatttcacctgagaaattccaggaacagctacagacccgggcccactgttgggagtgtcctatggtgcaacctcccgagagaaccatcaggggtcctgccgagctgttccgcacgcctactcttagtggttggctcccccctgaactgctgggtctgtggacacattgcgctcagccaccacccaaggcccttcggcgcgagctgcccgaggaggccgcagcagaggaggagaggcgcaagatcgaagtgccatctgagatcgaggttcccagggaagccctggaaccttcagttcccctgatggtatccttagagatcagcctggaggcagctgaagaagagaagtctcgcattagcctaatccctcctgaggagcgatgggcttggcccgaggtggaagcacccgaagcccccgctttgcctgtggttccagaacttccagaggtccctatggagatgccactggtgctgcctcctgaactggaactgctgagcctggaggctgttcatcgagctgtcgcactggagctccaggccaaccgagagcccgatttctcgagtctggtgagtcctctgagtccgcgacgaatggccgccagggtgttttatctgctgctcgtcctgtccgctcagcaaatcctgcacgtgaagcaggaaaagccatatggacgcctgctgatccagccaggcccaaggtttcactag

SEQ ID NO: 131920 - DNA, 1590 bp, Artificial Sequence
  Description of Artificial Sequence: Synthetic coding sequence
atgttttattatcctaacgtgctgcaaagacacaccggatgctttgctaccatttggttagccgccaccaggggaagccgcttggttaagcgggaatatctccgcgtgaacgtggtcaagacctgcgaagaaatacttaactacgtcctcgtcagggtccagccaccacagccgggtctgccacgtcctcgctttagtctgtatctatccgcacagctgcagattggcgtcattcgagtctatagccagcagtgccagtacttggtggaggacattcagcatatccttgaacgtcttcatagagcccagctgcagatccggattgatatggaaaccgaactcccctcgctccttctgcccaatcacctggccatgatggaaaccctcgaggacgcgccagatcccttctttggaatgatgtcagttgacccaagactcccctcccctttcgatatcccacagatccggcaccttctagaggccgcaatacctgagagggtcgaggagataccccccgaagttccaacggaacccagggagccagaacggatacccgtgacagtcctgccccctgaggccattactattcttgaggcagaacccatccgcatgctggagatcgagggcgagagagagctaccggaagtgtcacggcgggaattggacctcctgatagcagaagaagaggcaattctgctggagatccccagactgccaccacctgcaccggccgaagtcgagggaataggcgaagctttgggtcctgaagagctcagattgacagggtgggaaccaggagccctgcttatgaggcggccaccagtgcccccacctccccggcgtcggcgccggcggagactgttgttttgggataaagagactcagattagtccagagaagtttcaggaacagctacagactcgtgcacactgttgggagtgcccgatggtacaacctcctgagcggacaatacgcgggcctgccgagctgttccggacccccactttgagcggttggctccctcccgagctgctaggcctctggacccactgtgcccagcccccgcccaaagctctgcgcagagaactcccggaagaggccgctgctgaagaagagcgacgcaaaattgaagtgccctccgagattgaagtccctcgagaagcattggagcccagtgttcccctgatggtcagtcttgaaatttcgctggaggccgctgaagaagaaaagagtaggattagcctgatccctcctgaagagagatgggcctggcctgaggtggaggcccctgaggccccagctctgccagttgtaccggagctgccggaggtaccaatggaaatgccgttagtgttaccgcctgagttagagctgctatcacttgaagctgtgcaccgcgccgttgcactggaacttcaagctaatcgggaaccagatttcagctccctcgtcagccccttatctcccagaaggatggccgctagggttttctatctgcttcttgtactgagcgcgcagcagatactgcacgtgaaacaggaaaaaccatacggcaggcttctaattcaacccgggcccaggtttcactag

SEQ ID NO: 131921 - DNA, 225 bp, Artificial Sequence
  Description of Artificial Sequence: Synthetic coding sequence
atgttctattaccccaacgtactgcaacgccatacgggctgcttcgccaccatttggctggcggctaccaggggcagcagactcgtgaaacgggagtacctgcgtgtcaacgtggtaaaaacttgcgaggagattctgaattacgtcctcgtgcgagtccagccgcctcagcctgggcttcccaggccgcgcttctcattgtacctatcagcccaactgcagtag

SEQ ID NO: 131922 - DNA, 1641 bp, Artificial Sequence
  Description of Artificial Sequence: Synthetic coding sequence
atgttctattatccgaacgtgttgcagcgccatacaggctgttttgcgacgatttggttggccgcaactagaggctctcgtttagtcaaaagagagtatctgcgcgttaatgttgtcaagacttgtgaggaaatcctcaattacgtgctggtgcgggtccagccgcctcagcccggactccccaggcctagattctcactgtatctctccgcccagctacagatcggagttattagggtgtacagtcagcaatgtcagtatctggtcgaggatatacaacatattcttgagcgattacatcgtgctcagttacagataaggattgacatggagaccgagctgccttcattactgctgccaaatcaccttgcaatgatggagaccctggaggacgcacctgatcctttctttggaatgatgtctgtggatccccgccttcccagcccttttgacattccccagatcagacatctgttggaagcagccattccagagcgggttgaagaaattcctcctgaagtgccaactgaaccacgagaaccagagagaatccctgtgacggtcttaccacccgaggcaatcaccatactggaagccgagcccattaggatgctggagattgagggcgagagggaattgcctgaagtgtcacgccgggagctggacttactgattgccgaggaggaagctatccttttagaaatacccagactacccccacctgcacctgcagaagtggaaggaatcggcgaggcgctaggccccgaggagttgcggcttaccggctgggaacctggagcgctgttgatggaggtgaccccccccgaggagctgcgcttaccggccccccccagtcctgaacgcagaccaccggtgcccccccctccccgtcgacggaggagacgtaggctactcttctgggataaggagacccagatttctcccgagaaatttcaggagcagctgcagaccagagcgcattgttgggagtgccctatggtgcagccacccgagcgaacaatacggggacctgcagaactctttcgtactcccaccctttctggctggctgccgcctgagcttttgggtctgtggacacattgtgctcaaccaccgcccaaggcactgcggagggaactgcccgaagaggctgcagctgaggaagaaaggagaaagattgaagtccctagcgagattgaagttcctagagaagccctggaaccttctgtacctttgatggtgtccctcgaaatttcactagaggccgcagaggaagagaaaagcaggatatcgcttataccccccgaagagaggtgggcatggccagaagtggaggccccagaagcccctgcgctgcccgtggtacctgaactacctgaggtaccaatggagatgcctctggtcctgccacccgaacttgaactgctgtctttagaggcagtgcacagagccgttgccctggagcttcaggctaaccgcgaacccgacttttcaagcctagtgtccccactcagccctcggcgtatggctgctcgagtgttctatcttctcctcgtgctctcagcacagcaaattctacatgtgaagcaagagaagccctacggtcgcttgcttatacagcccggccctcgcttccactag

SEQ ID NO: 131923 - DNA, 699 bp, Artificial Sequence
  Description of Artificial Sequence: Synthetic coding sequence
atggccggtgacaccgaggtgtggaaacagatgtttcaggagctaatgcgagaagtcaagccctggcacaggtggactctgcggccagataagggtcttcttcctaatgtgttaaaacctggatggatgcaataccagcaatggacatttgcacggtttcagtgctcttcctgttctcggaattgggctagcgcccaggtactcgtgctgttccacatgaactggagcgaggagaagagtcggggccaagtgaagatgcgggttttcacccaaagatgcaaaaaatgcccacaacctctgtttgaagacccagagttcactcaggaaaatatctctcgcattctaaaaaacctggtgttccggatcctgaagaagtgctatagaggacggtttcagctcatcgaagaagtcccaatgattaaggatatctcactagagggtccccacaactcagacaattgcgaagcttgcctgcagggcttctgcgcaggcccaattcaagtaacttctctgccacctagccagactcctagggttcactcaatttataaagtggaggaggttgtgaagccttgggccagtggcgaaaatgtctattcttatgcttgccagaaccacatctgccgtaatcttagcatattctgttgttgcgtgatcctgattgtcatagtggtgattgttgtgaagactgcaatctag

SEQ ID NO: 131924 - DNA, 741 bp, Artificial Sequence
  Description of Artificial Sequence: Synthetic coding sequence
atggtagtcgacttttggacctgggagcagacttttcaggaattgattcaggaggcgaagcctagggctacctggactcttaaactggacgggaacctgcagctggattgcctggctcagggatggaagcagtaccagcaaagagcctttggctggttcaggtgttcttcgtgtcagcgcagttgggcctctgcacaggtccagatcctgtgtcatacatactgggaacattggacttcccagggccaggtgcggatgcggttattcggccagagatgtcagaagtgttcctggtctcagtacgaaatgcccgagttctcaagtgactcgacaatgagaatactcagcaacctggtacaacacattctcaaaaagtactacggcaacggtacaaggaaaagtcccgagatgccagtgattctcgaggtgtctctcgaagggtctcacgatactgcgaactgcgaagcctgtaccttggggatatgcggccaaggcctgaaatcgtgtatgacaaagccaagcaaatccctgcttccccatctgaaaacagggaattcctcaccgggcatcggtgccgtgtaccttgctaaccaggcaaagaatcagtctgctgaggccaaagaggctaagggcagtggttatgagaaactagggccctccagggatcccgacccattgaacatctgtgtgtttatcctgctgctggtgttcattgtcgttaaatgttttaccagtgagtag

SEQ ID NO: 131925 - DNA, 447 bp, Artificial Sequence
  Description of Artificial Sequence: Synthetic coding sequence
atggccagggctttgtgccggttacccaggcgggggctttggctgctcctggcccaccatttattcatgactactgcctgccaagaagctaactacggcgctctgctcagagaactgtgtctcacccagtttcaggtggacatggaagctgtaggtgagacactttggtgcgattggggccggaccatcaggtcgtaccgggaactcgccgattgtacctggcatatggctgaaaagctcggatgtttctggcctaacgccgaggtggaccggttcttccttgctgtgcatggccggtacttccgatcctgcccaataagtggcagagcagtccgtgatcccccgggcagtatactgtacccctttatagtggtaccaataacggtcacactcttagtcactgccttggtcgtgtggcagtccaaacgcaccgaagggatcgtgtag

SEQ ID NO: 131926 - DNA, 381 bp, Artificial Sequence
  Description of Artificial Sequence: Synthetic coding sequence
atgactacggcttgccaagaggcaaactacggggcattactcagagaactttgtctgacccagttccaggtcgatatggaggcagtgggagagacgctgtggtgcgactggggccgaaccattcggtcttaccgggagctggctgactgtacatggcatatggccgaaaaactgggatgcttttggcctaatgcagaggtggacaggttctttctggctgttcatggtagatatttccgaagttgtccaatctcggggagagccgtccgagatccaccaggttctattctgtatcctttcatcgtagtgccaataactgtgacattgctcgtgactgcattggtagtctggcagagcaaacgaaccgaggggattgtttag

SEQ ID NO: 131927 - DNA, 381 bp, Artificial Sequence
  Description of Artificial Sequence: Synthetic coding sequence
atgacaaccgcctgtcaagaggcaaattacggcgcgctcctgcgggagctctgcttgacccagtttcaggttgatatggaagcggttggtgagaccttatggtgtgactggggacggactatccggtcttatagagaattggccgattgcacatggcatatggcggaaaagctggggtgcttttggcctaacgccgaagtcgatcggtttttcttggcagtccatggtaggtacttccgttcctgcccaattagtggtagagcggtgcgagatccgcccggaagcatcctctacccatttatagttgtgccaattacagtgacccttctggtgacggccttagtagtctggcagtccaaacggactgagggaatagtctag

SEQ ID NO: 131928 - DNA, 381 bp, Artificial Sequence
  Description of Artificial Sequence: Synthetic coding sequence
atgaccaccgcttgccaggaagccaactatggtgccctcctccgagaactgtgcctgacacagtttcaagtggatatggaagcagtaggagagaccctgtggtgcgactggggcagaactatccgttcatatcgcgagctggcagactgcacttggcacatggccgagaagctaggctgcttctggcccaacgcagaggttgatcggttctttctagccgtgcacgggcgatatttccgatcttgtccaataagcggccgcgctgtacgcgacccccctggatccatactttacccgttcatcgtggtgcccataacagtgacactgctagtgaccgcactcgtagtttggcaaagcaagagaacagaaggcattgtatag

SEQ ID NO: 131929 - DNA, 528 bp, Artificial Sequence
  Description of Artificial Sequence: Synthetic coding sequence
atggcctctcttcgggtcgagcgggctggtggcccacgactgcccagaacacgtgtcgggagaccagccgcactgagactgctgctattgctgggtgccgttctaaaccctcacgaagccctggcccagccactcccgactacgggcacaccgggatcggaaggtggaacggtgaagaactacgaaacggccgtgcaattttgttggaaccactacaaagatcaaatggaccccatcgagaaggattggtgtgactgggccatgatcagcagaccctactccacactgcgcgactgtttagagcatttcgctgagctcttcgatctcggttttcctaatccactcgcggagcggatcatcttcgagacccatcagattcacttcgccaactgttcgttggttcagcccacattcagtgacccgcccgaggacgtactcttggccatgattattgccccaatctgcttgatccccttcctcatcacattggtcgtctggaggtctaaggactccgaagcgcaggcgtag

SEQ ID NO: 131930 - DNA, 447 bp, Artificial Sequence
  Description of Artificial Sequence: Synthetic coding sequence
atggaaaccggggccctgcgccgcccgcagctccttccgctgctcttgttgctctgtggagggtgtcccagagccggcggctgcaatgagactggaatgctcgagcggctgcctctgtgtgggaaggcctttgcagacatgatgggcaaggtggatgtgtggaagtggtgtaacctgagcgagtttatcgtgtattacgaaagcttcaccaattgtaccgagatggaggcaaacgtagtcggatgctactggcccaatcctctcgcccaaggcttcatcaccggaattcacagacagtttttttctaactgtacagtggaccgtgtccatttagaggatcctcctgacgaagtgctgatacctctgattgtgattcctgtggtgctgacggtggccatggcggggctggttgtctggcgaagtaaacggaccgacactttactctag

SEQ ID NO: 131931 - DNA, 447 bp, Artificial Sequence
  Description of Artificial Sequence: Synthetic coding sequence
atggaaactggagctcttcgccggccacaactccttccactactgctgctgctgtgcggagggtgccctcgcgcaggaggatgtaatgaaactggcatgctggagcggctgcccctatgtggcaaggccttcgcagacatgatggggaaagtggacgtgtggaaatggtgcaatctgtcagaattcatagtgtattatgaaagttttacaaattgtaccgaaatggaggccaacgtggtcggctgctactggccaaacccattagcacaggggtttatcactgggatacatagacagttcttttctaattgtacagtagatcgggtccacctcgaggatccaccagatgaggtgcttatcccactgatcgtgatacccgtggtgctcaccgtagccatggctggcctggtggtttggcgtagcaagcggacagacacattgctgtag

SEQ ID NO: 131932 - DNA, 456 bp, Artificial Sequence
  Description of Artificial Sequence: Synthetic coding sequence
atggagacgggtgccctgaggcgacctcagctactcccactcctgctgctgttgtgcgggggatgccccagagccgggggctgcaacgagaccggcatgctcgagcgcctgcctctgtgcggaaaggcatttgcagacatgatgggcaaggtggacgtgtggaagtggtgcaatctgtctgagtttattgtctactatgagtcatttactaactgtaccgagatggaggctaacgtggtcggatgctattggcccaacccactagcacaggggttcatcaccggtattcaccgccagtttttctctaattgcacagtggatagggttcatctagaggatcctcccgacgaggtccttatccctctgatcgtgattcccgtggtactcactgtagccatggccggactggtagtgtggcgatccaagagaaccgatacattgttatgcggaaactag

SEQ ID NO: 131933 - DNA, 606 bp, Artificial Sequence
  Description of Artificial Sequence: Synthetic coding sequence
atggtgtcatggattatttctcgcttagtagtgctcatatttggcactctgtatccggcctattatagctataaggcagtaaaaagcaaagacataaaagaatacgtaaaatggatgatgtactggatcattttcgcgctgtttactactgccgagaccttcaccgacattttcctgtgctggtttcccttttattatgagctcaaaatcgcgtttgtggcatggttactttctccatatacaaaaggctccagtctgctttacagaaagttcgtgcatcccacactgagctctaaggaaaaggagatcgatgattgtcttgtgcaggccaaagatcgaagttacgatgctctggtgcacttcgggaaacgggggctgaatgtcgccgcaaccgctgcagttatggctgcaagtaaaggacagggggcactgtctgaaagactgagatcctttagcatgcaggaccttacaaccattcgcggggatggggcacctgccccctccggaccaccacctcccgggtccgggcgcgccagcggcaagcacggccagcctaagatgtctcgttcagcctctgagtctgcatcctccagcggtacagcctag

SEQ ID NO: 131934 - DNA, 525 bp, Artificial Sequence
  Description of Artificial Sequence: Synthetic coding sequence
atggaccacttacaagcgggcggggttaaatggatgatgtattggataatttttgccctgtttaccacagctgaaacttttaccgatatctttctatgttggttcccattctattatgagctgaagattgccttcgtagcatggctgctgagtccgtatacaaagggcagctcattgctgtatcggaaattcgttcaccctaccttatcttcgaaagagaaggaaatagacgactgcctcgttcaggctaaagatcgtagctacgacgccctggtccatttcggtaagagggggttaaatgttgccgctaccgcagctgttatggcagcatccaagggccagggggctttgagcgaacgtctgcggagcttctctatgcaggacctgaccactatccggggtgacggtgctcccgcacccagcggacctcctcctccaggaagcggccgcgcctctggaaaacatggccaaccgaaaatgagccggtcggcctcagagtccgcctcttcatccggaaccgcatag

SEQ ID NO: 131935 - DNA, 627 bp, Artificial Sequence
  Description of Artificial Sequence: Synthetic coding sequence
atgcaaaaagtgctgtctaacgggcagacagaggaagtacgatccggaagtaggctaatttttgggaccctgtacccggcatactactcatacaaggcagtgaaatccaaggacatcaaagagtatgtgaagtggatgatgtattggattatctttgccttgttcaccaccgcagagaccttcacagatatattcttgtgctggtttccattctattatgaactaaaaatcgcctttgtcgcctggctgcttagtccttacaccaaaggctcaagcttgttatacaggaagttcgttcaccccactctgtccagtaaggaaaaggaaatcgacgactgcctggtgcaggccaaggatagatcctatgatgcgttagtccatttcggaaaacgggggctgaatgtagccgccacagccgccgtgatggctgctagcaaggggcagggggccctttctgaacggctgcgtagctttagcatgcaggatctcaccactatacggggcgatggagcacctgcaccttcagggccgccgccgcccggctctggaagagccagtggaaagcatgggcagcctaagatgagtcgatcagccagtgaaagcgcctcaagcagcggaactgcttag

SEQ ID NO: 131936 - DNA, 543 bp, Artificial Sequence
  Description of Artificial Sequence: Synthetic coding sequence
atgagtctgcatccttgccggctgaataacctgccaaaccaggtgaaatggatgatgtactggatcatttttgccctgttcaccacagcggagacgttcacagacatttttttatgttggttccctttctattacgagctgaagatagcttttgtggcgtggctcttatctccgtatactaaaggctcatcattactgtacagaaaatttgttcaccctaccttgagctccaaggaaaaagagattgatgactgtctggtgcaggctaaggaccggtcctacgacgctctggtgcacttcggcaagagaggcctgaatgtggcggcgaccgctgcagtgatggcggcctccaaaggccagggagccctgtccgagagactgaggagcttctccatgcaggacctcaccaccatccgcggtgacggcgcacccgccccttccgggccgccgcctcccggcagcgggcgcgcatccgggaagcatggccagcccaagatgtctcggagtgcctccgaaagcgcctcctcttcaggaacagcctag

SEQ ID NO: 131937 - DNA, 432 bp, Artificial Sequence
  Description of Artificial Sequence: Synthetic coding sequence
atggtaagttggatcattagtcgcctcgtggtcctgatttttggaaccctatatccagcttattattcctataaggccgttaaaagcaaagatattaaggagtatgtcaagtggatgatgtactggatcatttttgctctgtttacgactgcagagactttcacagatattttcctctgttgggacagggtgccatatcgacgcgattgcggcgcatctgcctgccggacctcccccccttcaggcgagacggctccactcttacctagggctccccatcaccgtggcttgggcggccccgccgccaacaccgccagcttgaggtgtccaggggtcctcctgcgcgctcttgcagcccaggcacccccgaggatactaaggagccgattccggaagaaatccaccagtagctctgcaacggagactacttag

SEQ ID NO: 131938 - DNA, 759 bp, Artificial Sequence
  Description of Artificial Sequence: Synthetic coding sequence
atggtgtcatggattatctcgcggctggttgtcctaatattcgggaccctgtatcccgcttactcatcatataaagccgtaaagaccaagaatgtaaaggagtatgtgaaatggatgatgtactggatagtctttgcgttttttacaacagctgagaccttaacggacatcgtgctgagctggttccctttttacttcgaactgaaaatagcctttgtcatttggctgctttcaccctatactaagggaagtagtgttctgtaccgcaagttcgttcaccccacactctctaataaagagaaggaaatcgatgagtatattacccaggcacgcgataagtcctacgagaccatgatgcgagttggcaaacgtggcctaaatctggcagctaacgcagccgtgacagccgccgccaaaggcgtactcagtgaaaaactccggtccttttcaatgcaggatctcactttgatccgggacgaggacgccctgcccctgcagaggccagatggtaggcttaggccctcccccgggagcctgcttgatacgatcgaggacttgggtgatgacccagccctctccctccgcagtagcacaaatcccgctgactctcggactgaagcctctgaggacgacatgggcgataaagcaccgaaacgcgcaaaaccaataaagaaggcccccaaggcggagccactggcttctaagacccttaagaccagacctaagaagaaaacaagcggtgggggcgatagcgcatag

SEQ ID NO: 131939 - DNA, 765 bp, Artificial Sequence
  Description of Artificial Sequence: Synthetic coding sequence
atggtgtcctggattatctccagactggtcgtcttgatctttggcacactctaccctgcctactcgtcctacaaagccgtgaagacaaaaaacgtcaaggaatacgtcaaatggatgatgtattggatcgtgtttgcatttttcacaacagccgaaaccctaacggacatcgtcctatcctggttccccttttactttgaactcaagatcgcctttgtcatatggttactgtccccgtacaccaagggctcaagtgtcctgtacagaaaattcgtacaccccacactttccaacaaggaaaaggagatcgacgagtatattacccaggcaagggataaatcttacgaaactatgatgcgcgtcggaaagcgaggcctgaatttggcggctaatgctgccgttacagccgcggccaaaggccaaggggtccttagtgagaaacttcggtcgttctcaatgcaggacctgaccttgatccgagacgaggacgctcttcctctacagaggcccgacggccgcctgagaccatctcccggatcgctactggatacaatcgaggacctgggtgacgaccctgccttgagtctgagatctagcaccaaccctgccgatagtcggaccgaagcctccgaagacgacatgggagataaggccccaaaacgagcaaaaccaataaagaaagcaccaaaagctgagcctttggcatcaaaaacacttaagaccaggccgaagaagaagacttcgggaggaggagattcagcttag

SEQ ID NO: 131940 - DNA, 723 bp, Artificial Sequence
  Description of Artificial Sequence: Synthetic coding sequence
atgttataccctgcctattacagttacaaggctgtcaagactaaaaatgtcaaagagtatgtgcgttggatgatgtactggattgtgtttgctctgtacaccgtcatcgaaaccgtagcggaccagactgtcgcctggtttcccctgtattatgaacttaaaattgctttcgtcatctggctactgagtccctataccaagggcgcaagcctgatttatcggaaattcctccacccactcctgtctagtaaagagagggaaatcgatgactatattgtccaagctaaagaacgtggatatgagacaatggtgaacttcgggcggcaggggctgaatctggccgccactgctgcagtaacggctgccgtgaaatcccaaggagctatcacggaacgcctccgtagtttctcaatgcatgatcttactactattcagggggacgagcctgtaggacagaggccctatcaaccgttacctgaagcaaagaaaaagagcaaacccgccccctctgagtcagctgggtacggcataccacttaaagacggagacgaaaaaaccgacgaggaagcagagggcccatatagtgataacgagatgctcacgcataaggggctgaggaggtcgcaatctatgaaatctgtcaagactacaaagggcaggaaggaagtccgctacggttccctaaagtataaagtgaagaaaagaccccaggtgtacttctag

SEQ ID NO: 131941 - DNA, 768 bp, Artificial Sequence
  Description of Artificial Sequence: Synthetic coding sequence
atggtatcctggatgatcagtagagcagtcgtcctggtttttggcatgctttatcctgcctattattcctataaagcggtgaaaacgaaaaatgttaaggaatatgtgagatggatgatgtactggatcgtgttcgcactgtatactgtaattgaaacagttgcggaccagacagttgcatggtttcccctgtactatgaactgaagatcgccttcgtcatttggttgctgtccccctacactaagggtgcgtctctaatttacaggaaattccttcaccccttactctccagcaaggagagggaaatcgacgactatatcgtgcaagcaaaagagcgtgggtacgagactatggtcaattttgggcggcagggcctgaacctggctgccaccgctgcagtgacagccgccgtgaaaagccaaggcgcaattaccgagcggctcagatcattcagcatgcacgatctcaccaccatccagggtgacgagccggtcgggcaaaggccgtatcagccactccctgaggcaaagaaaaagagcaagcctgctcccagcgagtcagctggttacggcatcccgctgaaggacggagacgagaagactgacgaagaagcagaagggccatatagcgacaacgaaatgttaacccataaggggctgcgccggagccagagtatgaagagcgtaaaaaccactaaaggtcggaaagaagtgcgctatggcagcctaaagtacaaagtcaagaaaagaccccaggtctacttttag

SEQ ID NO: 131942 - DNA, 774 bp, Artificial Sequence
  Description of Artificial Sequence: Synthetic coding sequence
ctcatgatgtggctcttggttgagagggccttaattcagttggtctttgggatgctatacccggcttactactcatacaaagccgttaagaccaagaacgttaaggaatatgtacggtggatgatgtactggatagtgtttgctctgtatacagtgatcgagacagtggcagaccaaaccgtggcctggtttcccctgtactatgaactgaagattgccttcgtcatctggttattgagcccctacaccaagggagcatcactcatctataggaaatttctacaccccctgctgtctagcaaggagagagaaatagacgactacatcgtacaggccaaagagagaggttatgagacaatggttaatttcgggaggcaaggactgaatctcgctgccactgctgccgtgaccgccgctgttaaaagtcaaggggccattacagaacgcctgagaagcttttcaatgcatgatctgactactatacagggcgatgagcctgtcggccaacgcccttatcagcccctcccggaagccaagaaaaagtccaaaccagctccatctgagtcggccgggtacggaattcccttaaaggacggagacgagaagaccgacgaggaggcagagggaccgtattccgacaacgagatgctaacgcacaaaggcctgcggcgatctcagagcatgaagtctgtcaaaacaaccaaagggcgaaaagaggtaagatacggttctctcaaatacaaagtaaaaaaacgcccccaggtctacttttag

SEQ ID NO: 131943 - DNA, 774 bp, Artificial Sequence
  Description of Artificial Sequence: Synthetic coding sequence
atggtgtcttggatgatctgtcggctggtcgtcttggtgtttggaatgctttgtccagcctacgcgtcctacaaggcagtaaaaaccaagaatattcgggaatatgtcaggtggatgatgtactggattgtgtttgccctgttcatggccgcggagattgtgactgacatcttcatctcttggttcccattctactatgaaatcaagatggctttcgtgctgtggcttctgagtccttacacaaagggcgcctccctgctatacagaaagtttgtgcatccatcactgtctagacacgagaaggaaatagatgcttacatagttcaagccaaagagcgatcttatgaaaccgttctgtcttttgggaagcgggggctaaatatcgcagcttccgctgccgtgcaggctgccactaaatcacagggggcattggccggccgcctccgctcattctcgatgcaggacctacgcagcatcagcgatgcaccagccccagcttatcatgatcctctgtatttagaggatcaggtgtcgcacaggaggcccccgatcggctaccgggccggcggcctgcaggactctgacacagaggatgagtgttggtccgacactgaggccgtgcccagggctcccgcgcgaccacgcgagaagcctctcatccgctcccagtcgctgagagtggtgaagcggaagccgcccgtgagagaagggacctcccgcagtctcaaagtcaggactaggaagaagaccgtaccatcagacgtagatagttag

SEQ ID NO: 131944 - DNA, 522 bp, Artificial Sequence
  Description of Artificial Sequence: Synthetic coding sequence
atggtgtcgtggatgatttgtagactcgtggttctggtcttcggtatgctttgtcctgcttatgctagctataaagctgtgaagacaaagaacataagggagtatgtcagatggatgatgtactggatcgtctttgcattgtttatggccgccgagatcgtgactgacatcttcatttcttggtttccattctattacgaaatcaaaatggcctttgtcctgtggttgctgagcccatatacgaagggcgcctcactgctttatcgcaaatttgtgcatcctagcctctcccggcatgaaaaggagattgatgcgtatatcgtccaggctaaggagagaagttatgagaccgttttatctttcggcaagcgggggctcaacatcgccgcctcagctgcagtgcaggcggcaacaaaagggacgggccccggtgcttgtagaactgccacgccacgcatgagcgtcggtcagatactcaggcaaagccccggaagacaacctgggcctgagaggagcccttag

SEQ ID NO: 131945 - DNA, 570 bp, Artificial Sequence
  Description of Artificial Sequence: Synthetic coding sequence
atgtcagccgctatgagagaacgctttgacaggttcctccatgaaaagaattgtatgaccgatctcctcgccaagctggaggctaagacaggggtcaacagaagttttattgccctaggcgtcatcgggcttgtggcgctgtatctggtgttcggatatggagcgagcctcttgtgcaaccttatcgggtttggctaccctgcttatatctccataaaagcaatcgagagtcctaataaggaggacgatacacagtggctgacttattgggttgtctacggcgtattttcaatcgcagaatttttcagtgacatttttctgtcatggttccccttttattacatgttgaaatgtgggttcttactgtggtgcatggccccatcaccgtccaatggagctgaacttctctacaagaggattatccggcctttttttctgaagcatgaaagtcagatggattcagtcgtgaaggaccttaaggacaaggcaaaagagacagccgacgcaattacaaaggaagccaaaaaagctacagtgaacttgctcggagaagagaaaaaatctacatag

SEQ ID NO: 131946 - DNA, 396 bp, Artificial Sequence
  Description of Artificial Sequence: Synthetic coding sequence
atgtccgccgctatgcgcgagcggtttgaccggttcttgcacgaaaaaaactgtatgacggacctgctggctaagctcgaggcaaagacgggagtcaataggagctttatagcactgggcgtgataggacttgtggcgctttaccttgtctttggatatggggcttctctgctctgcaacctcattggtttcggctatccggcttacatctccatcaaggctattgagagtccgaataaggaggacgatacacagtggctgacctattgggtggtctatggcgtcttttccattgccgagtttttcagtgacatctttcttagttggtttcccttctactatatgctcaaggtgtggtctgggctcggattcttgctccctagatgcctgctgtag

SEQ ID NO: 131947 - DNA, 1413 bp, Artificial Sequence
  Description of Artificial Sequence: Synthetic coding sequence
atgcacttcagtatacctgagactgaaagtagatccggtgactcaggcgggagtgcgtacgtggcttataatatccacgtcaatggagttctgcactgtcgggtcagatactcccaactacttggtttacatgagcagctgaggaaggaatacggcgccaacgtcctcccagcttttccaccaaagaagttgtttagccttactcctgctgaggtggaacagcgccgcgagcagctggagaagtatatgcaggcggtaagacaagacccattgttagggtcaagcgaaactttcaacagtttcctcagacgcgctcagcaggagactcaacaggtgcccactgaagaagtgtcgctcgaagttctactgagcaatggtcagaaagtgctagtgaacgtactgacttccgatcagacagaggacgtcctggaagccgtagctgcaaaattggacttgcccgatgacctcatcggctatttttctcttttcctcgttcgcgagaaagaggatggagcctttagtttcgtcaggaaactccaggaatttgagctgccctacgtatccgtgacctcgttgcggagccaagaatacaagatcgtgttgagaaagtcttactgggattccgcctacgacgacgatgttatggaaaatagagtggggttgaacctgctctacgctcagacagtgtcagatatagagcggggatggattttggtcaccaaagagcagcacagacagttgaagtcgcttcaagagaaggtgtccaagaaagagtttctgcggcttgcacagactctccggcactatggataccttcgcttcgatgcatgcgtggccgactttcctgagaaagactgccctgttgtggtgtctgccggcaattcagagctgtcactccaacttagactccccgggcagcagctgagggagggctcctttcgggttacacggatgaggtgttggcgagtgacttccagtgtgcccctgccatccggctccacttcatccccgggacgggggagaggggaggtgcgcctggagctggcttttgaataccttatgtccaaagatcgcctccagtgggtcacaataacatcacctcaagcaattatgatgagcatctgcctgcaatcgatggtggacgagctgatggtgaaaaaatccggcggtagcatccggaaaatgctgcggaggagagtcggcgggaccctccggaggagtgacagtcaacaggctgttaagtcccctcccctgctcgagtcacccgacgcaactcgggagagtatggttaagcttagcagcaaattgtccgccgttagtctgaggggcatcggctccccttctaccgacgccagtgcgtccgacgtccacggaaatttcgcctttgaaggtatcggcgacgaggacctgtag

SEQ ID NO: 131948 - DNA, 2814 bp, Artificial Sequence
  Description of Artificial Sequence: Synthetic coding sequence
atgcatcggccccggaggagagggacacggcctcccttgcttgccctacttgccgccctcctgctggctgcgcgtggagccgccgcacaggagactgaactgtcggtgagtgcagagctcgtccctaccagctcttggaatatttctagtgagctcaacaaggactcctacctcacactcgacgagcctatgaataacatcaccacctccctaggacaaacagcagagttgcactgtaaagtgtccggtaaccctccacccaccatcagatggttcaagaacgacgcgcccgtggttcaagagccaagaaggctctccttccgctctacaatttacggaagtcggctcagaataaggaatctggataccacggacactggatactttcagtgtgtagccacaaacggcaaggaagtcgtgagtagtaccggggttctgttcgtcaagttcggcccccctccaacagcttcgcccgggtacagcgatgaatacgaggaagatgggttctgtcagccatatcggggcatagcctgcgctaggtttattggaaataggacggtctatatggagagcctccacatgcagggtgagattgagaaccagattacagcggcttttacaatgattggtacatctagccatctctctgataagtgctcgcagttcgccatcccttcactgtgccattacgccttcccttactgtgacgaaacttcgagcgtgccaaaacctagagacctgtgccgagacgagtgtgaaattctcgaaaacgtgctgtgtcagactgagtatatattcgcccgcagtaaccctatgattctcatgcgcttaaaactccccaactgcgaggacctgccacaacccgagtcccccgaggctgctaactgcatccgcatagggatcccaatggcggatccaattaacaaaaaccacaagtgttataacagtaccggagtggactatcgcggaacagtctctgtgaccaagtccggaaggcagtgccagccctggaattcacagtacccacacacccacaccttcacggctctgcggttccctgagcttaacggcggtcattcttattgtcgaaaccccgggaaccagaaagaagccccatggtgcttcaccctggatgagaacttcaagtcggatttatgcgatattcccgcttgcgactcgaaagacagcaaggaaaagaacaagatggagattttgtatatactcgtcccaagcgtggccatccctctggcaatcgcactcttattcttcttcatctgcgtttgtaggaataaccagaagtcttctagtgcacctgtgcagcgacagcccaagcacgtgcgggggcaaaacgttgagatgagcatgctgaacgcgtataagccgaagtcaaaggccaaagagttgccgctttccgctgttcggttcatggaggagcttggggaatgtgctttcggaaagatctataagggccacctgtacttacctggcatggaccacgcccagttggtagccatcaagaccctgaaagattataacaatcctcaacaatggactgaattccagcaggaagcctcactcatggcagagttacaccatcctaatatcgtctgtcttctgggggcggtgacccaggagcagcctgtatgtatgctttttgagtacatcaaccagggcgacctgcacgagttccttattatgcggagcccccattcagacgtcggctgttcctctgacgaagacggaacagtgaaatcgagcctagatcacggcgacttcttgcacatcgccatccaaattgccgccggaatggaatacctatcctctcatttttttgttcataaagacttagccgctagaaatattttgatcggggaacaactccatgtcaaaatttctgatctgggtttgtcaagggaaatctatagtgcagattattaccgcgtgcaatccaaatccctgctgccgattcgatggatgccacctgaggccatcatgtatggcaaatttagctccgactccgatatttggtcattcggcgtggtgctgtgggagattttttccttcggcttgcaaccatattacggctttagtaatcaggaagtgattgaaatggtcaggaagcgccagctgctgccctgctctgaggactgccctccacgcatgtattccttaatgaccgagtgctggaatgaaattccttctcgtcggccaagattcaaggatatacacgtgcggctgcggagctgggagggcttgagtagtcacaccagttccaccactcctagcggcggcaacgctacaacacaaacaacgtccctgtcagccagccctgtgagtaacttatccaaccctcgctatccaaactatatgtttccgtcacagggcataaccccccaggggcagattgcaggctttatcggcccacccattcctcagaaccagcgtttcatcccaatcaacggatatcccataccgcctggatatgccgccttccccgcagcacactatcagccgacaggccccccgcgagttatccaacattgcccccctcccaagtcaagaagcccttcatctgcatccggttcgacctccaccgggcacgtgacatcgctgccaagttctggctctaatcaggaggcaaacatccccctgctgccacacatgtccatcccaaaccatcccgggggtatggggattacagtttttggcaacaagagccagaagccgtacaagatcgactcgaaacaggcaagcttacttggtgacgccaatatccatggtcacacagaaagcatgatttccgcagaactgtag

SEQ ID NO: 131949 - DNA, 1182 bp, Artificial Sequence
  Description of Artificial Sequence: Synthetic coding sequence
atgcatcgtcccagacgacggggcactaggcctccacttctggccctcttagcagcactgttgctagcagcccggggcgccgcagctcaagaaacagagctcagcgtgagcgcagaactggtgcctacctcctcatggaatattagttctgaactcaacaaggacagctatctgactctcgacgagcctatgaacaatatcacgacctccctggggcagaccgcagaacttcattgtaaagtctcagggaaccctccaccaacaatccgatggtttaaaaacgacgcgcctgtcgttcaggagccacggcggctgtcatttcgcagcactatctacggatcccgactccggattcgaaaccttgacacaactgatactgggtattttcaatgcgtagccactaacggtaaggaggtggtcagcagcactggagtgctatttgtaaaattcggtcctccgcccactgcttcccctggctactccgacgagtacgaggaagacgggttttgtcaaccctaccgcggaattgcctgtgctcgttttatagggaatagaaccgtgtacatggagagtctacacatgcagggggagattgagaatcaaattacagccgcctttactatgatcggaacctccagccacctgagtgataaatgtagccagttcgccatcccatcgctttgtcattacgcattcccatattgcgacgagacaagtagcgtgccaaaacctcgggacctttgccgggacgagtgcgagatcctggagaatgtattatgccagacagagtacatttttgcccgcagcaatcctatgatcctcatgcgtctgaaactgcctaattgcgaagacttgccccaacctgagtcaccggaagctgccaactgcatacggatcggtattccaatggcagaccccattaacaagaaccacaagtgctacaactcaaccggcgtcgactaccgaggcacagtctccgtcactaagagcggccgtcagtgtcaaccatggaactcacagtaccctcacacacatactttcaccgctctcagatttccggagctgaacggcggacattcttattgccggaatcctggaaaccagaaagaagccccatggtgcttcactttggatgaaaattttaagagtgacctatgcgatatccctgcgtgcggaaagtag

SEQ ID NO: 131950 - DNA, 2823 bp, Artificial Sequence
  Description of Artificial Sequence: Synthetic coding sequence
cgggccaggggttgcagcgctcgccgaagagggaccagacctccattgctggccctccttgcagctctcctcctggcagcccggggtgccgctgcacaagaaaccgagctaagtgtttctgctgaactggtaccaacgtcctcctggaacatctcatctgaactaaacaaagattcctatcttacactcgacgagccaatgaataatataacgacatccctgggtcaaacagccgagcttcattgtaaggtgagcggcaaccccccacctacgatccggtggttcaagaatgatgcccccgttgtacaggagcctaggcggctcagctttcgcagtacaatctatggctctcggttgcggattaggaacctcgacacaaccgacactggctacttccaatgtgtggcaactaacggaaaagaggttgtgtccagtactggagtgctcttcgtgaaatttggtcccccccctacagcgagtcccggctattctgacgagtacgaggaagatggcttttgccagccatataggggaatcgcttgtgcacgctttatcgggaatcgcaccgtctatatggagtccctgcacatgcaaggcgaaattgagaaccagattacagccgcgttcacaatgattggtaccagttcacacctctccgacaagtgctctcagtttgctatcccaagcctgtgtcactacgcctttccatactgcgatgagacatcctccgtaccaaagccacgggacctgtgcagggatgaatgtgagatattagagaacgttctctgtcagaccgaatatatttttgctcgatccaaccccatgatcctgatgcggttgaaacttccaaattgcgaggacctgccccaacccgaaagtcctgaggcggcaaactgtattcgcatcggaatccccatggcggacccaatcaataagaatcacaagtgctacaacagtacaggtgttgattatcgaggaaccgtgagtgtcaccaaatctgggcgccagtgccagccatggaattcacaatatccgcacacacacacctttactgctctccgatttccagagttaaacggaggacatagttattgccgcaatcctggcaaccagaaagaagccccatggtgtttcaccctcgatgaaaacttcaaatcagatctttgcgatatcccagcatgcgactcaaaagactcaaaggaaaagaacaaaatggaaatcttgtacatactggtaccctctgtcgccatcccattagccatagcccttctctttttcttcatctgcgtttgtagaaataaccagaaaagttcttccgcccctgtgcagagacaaccaaagcatgtaagaggccaaaacgtggagatgtctatgttgaacgcatacaagccaaaatcaaaagcaaaggagttaccgctgagcgccgtcaggttcatggaagaactgggagagtgtgcctttgggaagatttacaaaggtcacctctatctgcctggcatggatcacgctcaactggttgccatcaaaacgcttaaagactataataatccacagcagtggactgaattccagcaggaagccagtctgatggcagagttgcaccaccccaatatagtatgcctgcttggcgcagtcacccaggagcagcccgtgtgcatgctctttgaatacattaatcagggtgacctgcacgaatttctgattatgagatcccctcactcagatgttggctgcagttccgatgaggatggcacagtgaagtcatctcttgaccatggagacttcctgcacattgctatacagatcgcagctggcatggagtatcttagttctcactttttcgtgcacaaggatttagccgctcgaaatatcttgattggtgagcagctgcatgtgaaaatttcagatctagggctgtctagggaaatatattctgctgactactaccgcgttcagtccaagagtctgctgcctatacgctggatgccaccggaggccattatgtacggtaaatttagctcagactctgatatttggtctttcggtgtggttctctgggaaatattctcttttggcttgcagccgtactacggcttctcaaaccaggaggtcatcgagatggttcggaaacgccagcttctcccatgctcagaggattgccccccgagaatgtattccctaatgaccgagtgctggaatgaaattccaagtagacggcctcgctttaaggacatccacgtccgtctgcggagttgggagggcctgagcagccataccagctcaacaacaccctccggcggcaacgccaccacacagaccactagcttatcggcaagtcccgtgtctaatctttcaaatcccaggtatcccaactacatgttcccaagccagggcattaccccccagggacagatcgctggattcattggccccccaattccacagaaccagaggtttattcccataaacggctatccaattccgcccgggtatgctgctttcccagccgcccactaccaacccacaggtcctcctagagtgatccagcactgccctcccccaaaaagtaggtctccttctagcgcttcaggctcaacctcaaccggccatgtgacgagtctgccttcctctggctcaaaccaggaagcgaatattcctctactgccgcacatgtccatccccaatcaccccggggggatggggattactgtgttcggaaataagtctcagaagccatacaaaatcgatagtaagcaagcaagtctgctaggggacgcaaacattcacggccacaccgaaagtatgatttctgccgagctgtag

SEQ ID NO: 131951 - DNA, 1167 bp, Artificial Sequence
  Description of Artificial Sequence: Synthetic coding sequence
atgctgtttgaatatataaaccagggagaccttcatgagttcctcatcatgcggtctccgcattccgacgtgggctgctcttcagatgaagatggcactgttaaaagtagcctcgatcacggagacttcctgcatatcgcaatccagattgcggccggtatggagtatctctccagccattttttcgtgcataaggatctggccgcacgaaacatcctcataggggagcagctacacgtgaaaatcagcgacctcgggcttagcagagaaatttatagcgcagattactaccgcgtgcagtctaagagcctcctgccaatcaggtggatgcccccggaggccataatgtacgggaagtttagctctgatagcgacatttggagctttggtgttgtgctttgggagattttctccttcgggttacagccgtactatggcttcagcaaccaggaagtgatagagatggtgcgcaaacggcaactgcttccttgcagcgaggattgtccgccccgcatgtattccctgatgaccgagtgctggaatgagattcctagtcggcggcctcggtttaaagacatccatgtaaggttacgatcctgggaaggattgagcagccacacgtcttcgacaacacccagcggcgggaacgctaccacccagacaacctctctttctgcctcacccgtgtccaacctctcaaatcccagatatcctaactatatgttcccttcgcagggcatcaccccccagggacagatcgcgggctttatcggcccacccatccctcagaaccagcggttcatacccatcaacgggtacccgatccctcccggctatgccgcattcccggccgcgcactatcagcctacaggccccccgcgggtcatccagcattgccccccccccaagagtaggtcgccatcttcagcttcgggctctacgtctactggtcatgttacctctctgccctcctccggatctaatcaagaggccaacatcccactcctcccacatatgtctatccccaatcacccaggaggcatgggcattactgtgttcggaaataagtcacaaaaaccttacaagatagattcaaagcaggcctcacttcttggtgacgctaacattcacgggcacaccgagtctatgatttccgctgaactgtag

SEQ ID NO: 131952 - DNA, 2832 bp, Artificial Sequence
  Description of Artificial Sequence: Synthetic coding sequence
atggccaggggaagtgccctgccacgccggccgctgctgtgtatccccgcagtatgggcagccgctgccctcctcctgagtgtcagccggacatccggggaggtggaagtgttggatccaaacgatcctctcggtccacttgatggccaggacggacccatccccacccttaaaggttattttctcaatttcttagagcccgtaaacaacataacgatcgtgcagggtcagacagccattctgcactgtaaagtggccggaaacccgcccccaaatgtgcgctggcttaaaaatgatgcccccgtggtgcaagaaccccgtcgcatcatcataagaaagaccgagtatggaagcaggctccgcatccaagatctggatacgactgacactgggtactaccagtgtgtggccacaaacgggatgaaaaccattaccgccactggggtcctttttgtcaggctgggccctacccacagcccaaaccacaactttcaagatgattatcatgaggacggattttgtcagccataccgcggtatcgcctgtgctcgttttataggcaatagaaccatatatgtggactccttgcagatgcagggggaaatagaaaaccggataacggccgcttttacgatgatcgggacatcaactcacctgtcagaccagtgtagccaattcgctataccgtcattttgccatttcgtctttcctttgtgcgatgccaggtcccggacccccaaacctagggagctgtgccgagatgagtgcgaggttctggagtctgatttatgcaggcaagaatacaccattgcacgcagcaaccctctcattctgatgcgcctgcaattacctaaatgtgaggctctccccatgcccgagagtcctgacgcagccaactgcatgcggattgggatcccggccgaaagacttggccgctaccaccagtgttacaacggaagcggaatggattacagaggcaccgcctccaccaccaaatctggacatcaatgtcaaccatgggccctccagcacccccattctcaccacctgtcttccaccgattttcccgagctcggtggtgggcatgcatactgccggaacccagggggccagatggagggaccttggtgtttcacacaaaataaaaatgtgcgaatggagttgtgcgatgtccctagctgctcaccacgcgactcctctaaaatggggattctgtacatcctggtccctagtattgccataccactggttattgcctgcctgttcttcctggtgtgcatgtgccgtaacaaacagaaggcaagtgcgagtactcctcaacgccgccaattgatggcatctcctagccaggacatggagatgccattaatcaaccagcacaaacaggccaaactcaaagaaatctccttgtctgccgtgcgattcatggaggagttgggagaagacaggtttggcaaggtgtataaggggcatctcttcggccccgcccctggggagcagacgcaggcggtggccatcaaaacactcaaggataaggcggagggccctctgagggaagagttccgccacgaggcaatgctgcgagcccggctgcagcaccccaacgtggtgtgtttattgggagtagttacaaaagaccagccactttctatgattttttcttattgttcccacggagatctccacgaattcctagtcatgagaagcccgcattctgacgtgggatctacggatgatgaccggactgtgaagtcagccctggagcctccagatttcgtgcatctggtcgcccagatcgccgccggaatggaatacctgtccagccaccatgtcgttcacaaggatcttgcaacaagaaatgtgctggtatatgacaagctgaacgtgaagatttccgacctgggactcttcagagaggtttatgctgccgattattataaactgctggggaacagcttactacccattagatggatggcccccgaggccataatgtacggaaagttctctatcgactctgatatttggagttatggagttgttctgtgggaggtatttagctatgggctccagccatactgcggttactctaaccaggatgtggtggaaatgataaggaaccgtcaagtgcttccgtgtcccgacgactgcccagcctgggtgtacgccctgatgatcgagtgctggaatgaattcccgagtcggagacctaggttcaaggatatccatagtcggctaagggcctggggaaatctgtctaattacaattcttcagcacagactagtggggcttccaataccacccagacatcatccctatcaacctcaccagtgagcaacgttagtaacgctcggtatgtcgggccaaagcagaaagccccccccttcccacaacctcagttcatacccatgaaagggcagatcagacccatggtgcctccaccgcagctctatgttccagtaaacggataccagcctgtgcctgcttacggggcctatctgcccaacttctatcctgtgcagattcctatgcagatggccccccagcaagtccccccacagatggtgcccaagccctcgtctcaccacagcggatcaggctccaccagcaccggctacgttacaactgcacctagcaacacttctatggccgacagagccgctcttttgtctgagggcgctgatgacacacagaatgcccctgaagatggggcgcagagcaccgtgcaggaagcggaagaagaagaagaaggaagtgtccccgaaactgaactcctcggagactgcgacaccctgcaggtggatgaggcccaggttcagctggaggcctag

SEQ ID NO: 131953 - DNA, 1239 bp, Artificial Sequence
  Description of Artificial Sequence: Synthetic coding sequence
atgggccaggaccaaacaaagcagcagatagagaagggcttgcagctttaccaatccaatcaaacggagaaggcgcttcaagtgtggaccaaagttctggagaagtcctctgatttaatgggccgcttccgagtcctgggctgccttgtgactgcacacagcgaaatggggcggtacaaggaaatgctgaagttcgcagttgttcagattgacactgccagggaattggaggacgcagatttcctgctagagtcttaccttaacctggcaaggtccaatgaaaagttatgtgaattccataagaccatctcatactgcaagacttgtctaggtttgccaggcacaagggcaggggcacagcttggcgggcaagtttccctgtctatgggaaacgcatttctaggcttgagcgtgttccagaaggcccttgaatccttcgagaaagccctgcgatatgcccataataatgacgacgctatgttggagtgtcgagtttgctgcagcctgggatcattctatgcacaggtgaaggactatgagaaggctctattttttccctgcaaagcagcagaactggtcaacaattacgggaagggctggagcctgaagtaccgggctatgagtcaataccacatggcagtggcctataggcttctgggacggcttgggtccgccatggagtgttgcgaagaatccatgaagatagcacttcagcacggtgacaggccgctgcaggccctctgcctgttgtgtttcgccgacattcaccgttctcggggagatctcgaaactgcatttccacgatatgactctgccatgtctattatgacggagattggaaatagactgggccaggtgcaggccctcctgggagtcgctaaatgctgggtggctcggaaggctctggataaggcccttgacgccattgaacgggcccaagacctggcagaggaagtggggaacaagttatcccagcttaagctacactgcctaagcgagagcatctatcgttctaaagggctgcagagagagcttagagcccacgtggtgcgatttcacgagtgtgtagaggagactgaactctattgtggtctctgcggagaaagtattggagagaagaactctaggttgcaggccctgccatgcagccatattttccatctacggtgcctgcagaataatgggacacgctcttgtcctaattgtcgaagatccagcatgaagccaggatttgtgtag

SEQ ID NO: 131954 - DNA, 1062 bp, Artificial Sequence
  Description of Artificial Sequence: Synthetic coding sequence
atgggtcaggaccagacaaagcaacaaatcgagaaaggcctacaactatatcagtctaatcagactgagaaggccctgcaggtctggacaaaggttctggagaagtcatcagacttaatgggaagatttcgagtcctgggatgtctcgttaccgcccactctgaaatggggcgctacaaagagatgctcaaattcgccgtggtccagatcgacaccgcccgggagctggaagatgccgactttttactcgaaagctacctaaatctggctcgttcaaacgagaaattgtgcgagttccacaaaactatcagctactgcaagacctgcctgggacttccaggaactagggcaggtgctcagctcggtgggcaggtgtcgctgtctatggggaacgcttttctcggcctgtctgtcttccagaaagcgttggaatcttttgagaaagccctccgttacgcacacaataacgacgacgccatgctggagtgccgggtctgttgttcattgggcagtttctatgcacaggtgaaggactacgagaaagcccttttctttccttgtaaggcagctgagctggtcaataactatgggaagggttggtctctgaagtaccgggccatgtctcagtaccacatggcggttgcctaccgccttttgggccgcctgggtagcgccatggaatgttgtgaagagtccatgaagatcgccctacagcatggggaccgtcctctgcaggctctgtgtcttctctgtttcgcagatatccaccggagcaggggcgatctggaactgtctcagctaaagctgcactgcctctcagagtcaatctaccgctccaaaggattgcagcgcgaattgcgggcccatgtggtgagattccatgaatgtgtggaggagaccgagctgtactgtggcctgtgcggggaaagcatcggcgagaagaactcacgactccaggcgctaccctgcagccacatctttcatctccgctgtctgcagaacaacggaaccaggagctgccccaactgccgccgctcgtctatgaagcctggctttgtgtag

SEQ ID NO: 131955 - DNA, 2010 bp, Artificial Sequence
  Description of Artificial Sequence: Synthetic coding sequence
atgggcacggccttagtgtaccacgaagatatgaccgctactagacttctgtgggatgatccggagtgtgagattgagcgtcctgaaagacttaccgctgccctggacagactgcgtcagcgaggtctcgaacaacgctgtctaagattgagcgcaagagaagcaagtgaagaagagcttgggctcgtccacagtccagaatatgtaagtctggtacgcgagacccaggtgctaggcaaagaggagcttcaggccctaagtgggcagttcgatgccatttactttcacccctccacatttcactgcgcacgtctcgcagccggagccggactccagctcgtggatgccgtgctcaccggcgccgtacaaaacggcttggctctggtccggccacccggacaccacggccagagagccgcagctaacggattttgcgtgttcaataatgtcgctatcgcagccgcccatgccaaacagaagcatgggttgcaccggatcctagtggtggattgggacgtgcaccatggtcagggcatccagtacctgttcgaggacgatccgagcgtcttgtacttttcatggcacaggtacgagcatggcaggttctggcccttccttcgtgagtcagatgctgacgctgttggaaggggccaaggcctgggatttaccgtcaatctcccatggaaccaagtaggtatgggcaacgcagactacgtcgcagcattcctgcacctcctgctgcctcttgcttttgagtttgatcctgagctggtcctggtatccgccggctttgattccgccataggagaccccgagggccagatgcaggccacccctgaatgtttcgcacatctgactcagctgctccaggtccttgcgggtggacgtgtctgcgcagttctagaaggcggctaccacctggaaagtctcgcagagtcagtatgtatgaccgtacagacactgttgggggaccccgctcctcctctttccggcccgatggcaccttgccaaagcgccctcgagagtatacagtccgctcgggccgcgcaggcaccgcactggaagtctttgcagcaacaggatgtgaccgcagttcctatgtcaccctcatcccactcacctgaaggtcgacccccccctctgttacctggtggcccagtgtgtaaagccgctgcttctgccccctcaagcttactggaccagccgtgcctttgcccggccccttccgtgcgcaccgctgtggctttaacaaccccagatataacactggtgctgccccctgatgtaattcagcaggaggcctctgccctgcgcgaggaaacggaggcgtgggcaagaccccacgagagcctagctagggaggaggcgctcacggcattagggaagctgctgtatttgctagacgggatgctcgatgggcaagtgaatagcggtatcgcggccacaccggcctctgcagcggccgcaacactcgacgtcgctgtgaggcgaggattatcccacggtgcgcagcggttgctttgcgtggccttagggcaactggataggcccccagacttagcacacgacggacgctcattgtggctgaatatcaggggaaaagaggccgcggctctgtcaatgttccacgtctctaccccactgcccgttatgaccgggggctttctaagctgcatcttggggctagtcctgcctctggcttacggcttccagcctgacttggtactcgtggccttgggtccgggtcacggcctgcaaggtcctcacgccgctttgcttgcagcaatgctcaggggcttggccggggggagagtgcttgccttgcttgaggaaaactcaaccccccagctcgccgggatcctggctcgggtgctcaacggggaggcgcctccatctctaggcccaagcagtgtggcgtcaccggaagatgtgcaggcccttatgtatttgcgcgggcagttagaaccccagtggaagatgctgcagtgtcatccacatctcgtcgcatag

SEQ ID NO: 131956 - DNA, 1206 bp, Artificial Sequence
  Description of Artificial Sequence: Synthetic coding sequence
atgcaacgttgctggcagggggacccccgagtgaggccgacctttcaagaaattacttccgagacagaagatttgtgcgagaagccggacgacgaggttaaggagacagcacacgatctggatgtaaaatctcccccggaaccacgatccgaagtggtacctgctagactgaagcgagcttcggccccgaccttcgataacgactacagtttatctgaactgctttcacagctcgactccggggtatcccaggccgtcgaggggcccgaggaactgagccgatcttcctccgagtctaaattgcccagctcaggatcaggcaagcgcctttccggtgttagttctgtggacagcgccttttcctcccgtggatctctgagtctgtccttcgaacgagaacctagcacaagcgacctggggacgaccgatgtgcagaaaaaaaaactcgtggatgccatcgtgtccggggacacatccaaactgatgaagatcctgcagcctcaggacgtcgatctggcacttgactcgggcgcctctttgctgcacctggctgtggaggcaggacaagaagaatgtgcgaagtggcttttgttaaataatgccaaccctaacctgtccaatcggagaggaagtacccctctacacatggcagtggaaaggcgagttaggggcgttgttgaactgctgctggcccgaaagatcagcgttaacgctaaggacgaggaccagtggactgcattgcacttcgcagctcaaaatggcgacgagtcaagtacaaggctactgctagagaagaatgcatccgtgaacgaagtggatttcgaggggagaacccctatgcacgttgcttgtcagcacgggcaggaaaatatcgttaggattcttctccgaaggggcgtcgatgtgtcactgcagggcaaggatgcttggcactgcacgacattagcaggccccccggcgcaccggcaagccgcaggccaggctgccggcggtgagtgcgagcgacctgacgccggctgggaagacgccattgcacccggaagaaccgcccgggctcttccaaggggtcctcaccctcaccggcctgtgcttcggcgccaaaggttacagccggctgggaccgatacaccagctcgtcccagacgccgcggcactcgagccctgccgggatgctcttgtattggcgctctcgcccgcaggccttag

SEQ ID NO: 131957 - DNA, 2355 bp, Artificial Sequence
  Description of Artificial Sequence: Synthetic coding sequence
atggagggggatggaggaacaccttgggcgctggctcttcttcgcacatttgatgcaggggaatttacaggatgggagaaagtgggtagcggtgggttcggacaagtgtacaaagtgaggcatgttcattggaaaacctggctggcaattaaatgctctccatcgctgcatgtcgacgatcgcgagcgtatggagctcctcgaagaggctaagaagatggagatggcgaagtttcgctatatccttccagtgtatggaatttgccgcgagccagtgggcctggtcatggaatatatggaaaccggctctctggaaaagcttctggcaagcgagccactgccatgggatctgaggttccgaattattcacgaaaccgcagtcgggatgaactttttacactgcatggctccccctctgctccacctggatcttaaacccgccaacattttgctagatgctcactaccacgtaaagatctccgacttcggcctagccaaatgtaatggactgagccactctcatgatcttagtatggacggcctgttcggaaccattgcctatttgcccccagaaaggattcgcgagaaatcaaggttgtttgatactaaacacgatgtatattcctttgcaatcgtgatatggggggtattaacacagaaaaagccatttgccgacgaaaaaaatattctgcacatcatggtgaaagtggtcaagggccataggcccgaattaccacccgtgtgtagggccagacctcgagcgtgcagccatctcattagacttatgcaacggtgctggcagggagacccacgggtgcggccgacctttcaggaaatcacgagcgagacggaggacctgtgtgaaaaacctgacgatgaggttaaggagactgcccacgatttagatgtgaaaagccctcccgagcctaggtctgaggtagtaccggcaagacttaagagggcctccgccccaacatttgataacgactactccttaagtgagctcctgagtcagctcgactccggtgtgtcgcaggcagtagaaggcccggaggagctctcccgtagctcgagtgagtctaaattaccgtcgagcggcagtggaaagcgtctgtctggagtgagctcggtggattccgccttttcatcaaggggcagcttaagcttgtcttttgaacgggagcctagtacttccgatctgggcaccaccgacgttcagaaaaagaagttagtcgacgctattgtgagcggcgatactagcaaactgatgaagatcctccagccacaggatgtagacttggcattggactcaggcgcttctctgctgcacctagccgttgaggccgggcaagaggaatgtgctaagtggcttctacttaacaatgctaatcccaatttgtcgaataggcggggctccactcccctgcatatggccgtagagaggagggtgaggggggtggtcgaactgctcctcgctagaaagatatcagtcaatgcaaaggacgaggaccagtggacagcactgcacttcgccgcccagaacggcgacgagtcatccacacgcctgctgctggagaagaacgcctcagtgaacgaagtggacttcgagggaagaacccccatgcatgtggcctgtcaacacggtcaggaaaacatcgttcgcatcctgcttcgcaggggcgtcgacgtgtctctgcaggggaaggatgcatggcttcccctgcactacgcggcatggcagggacatctgcccatcgtcaaattgttggctaaacagcccggggtgtccgtgaatgcccaaacattggatggacgcactccgctgcatctggctgcccagagaggccattatagagtcgccaggattctcatcgatctctgttcagatgtgaacgtctgttccctgctagcacaaacacccctgcatgtggccgcagagactggacacacctcaacagcgcgcttgctcctgcacaggggggctgggaaagaagccatgactagtgacggctatactgctctccaccttgccgccagaaacgggcacctggcaactgtcaagttgcttgttgaggaaaaagcagacgttttggccagggggcccctgaatcagactgctttacacttggccgccgcgcatggtcactccgaagtcgtggaggagctggtgagcgcagacgttattgacttgtttgatgaacaaggactgtccgcattacatctggctgcacagggacgccatgcacagaccgtggagaccttgctgcgccacggagcacacataaacctacaatctctcaagtttcagggagggcacggacccgctgcgacgctgctgagacgttcaaagacctag

SEQ ID NO: 131958 - DNA, 2499 bp, Artificial Sequence
  Description of Artificial Sequence: Synthetic coding sequence
atggaaggagatggagggacaccctgggccttagcactcttgaggacttttgatgccggggagtttaccgggtgggaaaaggtaggcagcggtggatttggccaggtgtacaaagttcgccacgttcactggaagacttggctggctataaagtgcagcccaagcctgcacgtcgatgatcgggagcgaatggagctgctggaagaggccaaaaaaatggagatggcgaaattcaggtatattttgccagtgtatggcatatgtcgggaaccagtcggtcttgttatggagtacatggagaccggctcactcgaaaagcttcttgcatctgagccacttccttgggacctgagattccggataattcacgagaccgccgttggtatgaactttctgcactgtatggcacccccgctgctgcaccttgatctgaagcctgcgaatatcctcctggacgcgcattatcacgtgaagatttccgactttggattggccaaatgtaatgggctctcccactcacacgacctttctatggacgggctgtttggcacaatcgcctacctccccccagagcggattagagagaagagtcggctgtttgacacaaagcatgatgtttacagctttgccatcgtgatctggggagtccttacccaaaagaaaccctttgcagatgagaagaatatcctgcatatcatggtaaaggtggtgaagggccatagaccggagctaccccccgtgtgcagggccagacccagggcctgttcacatctcatcagactgatgcagagatgctggcagggggatccacgcgtgaggccaacgttccagggtaacggactcaatggggaactgatccggcaagttttagccgcgcttctgcctgtgacaggacggtggcgatctccgggcgaagggttccggttggagtccgaggttatcattagggtgacttgccctctctcttctccccaggaaattaccagtgaaaccgaagacctttgcgaaaagccagatgacgaagtgaaggagactgcacatgacctggacgtaaaaagtcccccagagcctcgttctgaagtggtcccagctcgtctcaagagagcttccgctcctaccttcgacaatgactactccctgagcgagctcctctctcaacttgatagtggggtttctcaagcggttgaaggccccgaggaactgtctagatccagctctgaaagtaagttgccaagtagcggttccggaaagagactgagcggcgtgtcttcagtagactcggcttttagcagccgggggtcgctaagtctttcgttcgaaagggagcctagcaccagtgatctgggaaccacagatgtccaaaagaagaagctcgttgacgccattgtcagcggagacacaagtaaactcatgaaaatcttgcagcctcaggatgtcgatctagcactagattcaggagcctcactactgcacctggcggtcgaagccgggcaggaggagtgcgcgaaatggctcttactaaataacgccaacccaaatctgagcaaccggagggggagtaccccattgcatatggccgtggaaagaagagtccgaggcgtggtcgagcttctgctggccagaaaaatctctgtcaacgcgaaggacgaagaccaatggacagctctgcacttcgccgcgcagaatggagatgaaagcagcacccgattgctgctggagaaaaacgcttctgttaatgaggtggattttgagggccgaacccctatgcacgtggcctgccagcatggtcaggaaaatattgtcaggatccttctacgaaggggcgtcgatgtgagtttgcaagggaaggacgcctggctcccccttcattacgctgcgtggcagggacacttacccatcgtgaagctcctggcaaagcagcccggagtgtccgtgaacgcccagaccctggacggccgtacgcctttacacctggcggctcaaagaggccactacagagtggcccgaatcctcattgacctatgcagcgatgtcaatgtctgttcattactcgcgcaaactcctttgcacgttgccgcggagactggtcacacctctacagctcggctgttgctacaccgcggggccggcaaagaggccatgacctccgacggatatacggcactccacttggccgcccggaatggacacctggccactgttaagttattagtagaggagaaggctgatgtgctcgccagaggccccctgaatcagaccgctctgcatctggccgcggcccacggccatagtgaagttgtggaggaactggtgagcgctgacgtgatagacctcttcgacgagcaaggtctgtctgcgctgcatctcgctgcccaggggagacacgctcagacagtggagacactacttcggcacggagctcatataaaccttcagtctctgaaattccagggaggtcatggtcccgctgctactctgctgaggcgcagtaaaacgtag

SEQ ID NO: 131959 - DNA, 2166 bp, Artificial Sequence
  Description of Artificial Sequence: Synthetic coding sequence
atggaactcctggaggaagccaagaagatggagatggctaagtttagatatatactgccggtctacggcatttgcagggaaccagtgggcctcgtcatggaatacatggagacaggctcgctggagaagttactcgcttcagagccactgccatgggacctgaggtttcgtatcatccatgaaacagcagtgggaatgaactttctgcactgtatggcaccacctctgctgcacctggatctgaaacctgccaatattttactggatgctcattaccatgtcaaaatctcggacttcgggttggccaaatgcaacggactctcacatagccacgacctctctatggatggcctatttggtacgattgcctacctccctcccgagcggattagggagaagtcccgcctgtttgacactaaacacgatgtttattctttcgcgattgtgatctggggcgtgctgacccagaagaaacctttcgccgatgaaaagaacattctgcacatcatggttaaagtggttaagggccatcgccctgagctgcccccagtttgtagagctcggccccgtgcatgctcccacctgatcagacttatgcaacgctgctggcaaggcgatcccagggtgagacccacattccaggagatcactagcgaaacagaggacctatgtgagaagcccgacgatgaggtgaaagaaaccgcccatgaccttgacgtgaagtcccctcctgaacctcgctccgaggttgtgcccgctcgattgaagagagcctccgctcctacttttgacaatgactatagcctttcggagttgctctcgcaattggatagcggggtctcccaggctgttgaagggcctgaagagttatcccgatccagctccgaatctaaactgccaagctcagggtccggtaagagactgtctggcgtgtctagtgtggactctgcgtttagcagccgtgggtctttgagcctgtccttcgagagagagccaagtacatctgatctcggcaccacagacgtgcagaagaagaaacttgtggacgctattgtttccggagacacatcgaagctgatgaaaatcctgcagccgcaggacgtggatttggcgttagattctggggcttcactgctgcacctcgcagtggaagcaggtcaggaggagtgtgctaagtggttgctcctgaacaacgccaaccccaacctgagcaataggcggggctcaacccccctacacatggccgtggaacgcagagtgagaggagtcgtggagcttctgctcgcccggaagattagcgtcaacgcaaaagatgaagatcagtggactgctcttcattttgccgctcagaacggcgatgaatcatcaacgcgattgttactggaaaagaatgctagcgttaatgaagtagacttcgagggacgaactcctatgcacgttgcatgtcagcacggccaggagaacatagttagaatactcttacgacgcggagtggacgtgtctcttcagggtaaagatgcctggctgcccctgcattatgcagcctggcagggacacctccccatcgttaagctcctcgccaaacagcctggagtctctgtgaacgcccagaccctggacgggaggacacccctccatctcgcggcacagagaggacactaccgcgtcgcgaggatcctgatcgatctttgcagcgacgttaacgtctgttctctgttggcccagactcctctacatgtggcagcagagactggccatacttctacggccaggttactcctccatagaggtgcagggaaggaagcaatgacgagtgacgggtatacagcactgcacctggctgctagaaacggccatctcgccactgtgaagttactagtcgaggaaaaggccgacgtgctcgcccgggggcccctgaatcaaactgcattgcatctggctgctgcccacggtcacagtgaggtggtggaagagctggtgtctgcagacgtgatcgatctgtttgatgagcaggggctttccgcgctccacttagccgcacagggaagacacgctcagactgtagagaccttgctaaggcatggagctcacattaatctgcagtctttgaagttccaaggcggtcacggtccagccgccactctactcaggaggagcaaaacctag

SEQ ID NO: 131960 - DNA, 2166 bp, Artificial Sequence
  Description of Artificial Sequence: Synthetic coding sequence
atggaattgctggaggaggccaaaaaaatggaaatggccaagttccggtatatcctgccggtgtacggcatatgccgcgagccggtggggctcgtgatggaatacatggagaccggaagtctggagaagcttttggccagtgagccactcccctgggacctgaggttccgtataatccacgaaaccgcggtggggatgaattttcttcactgtatggcacctcccctgctgcatctcgacctcaaaccagctaacattctactcgacgctcattaccacgtcaagatctccgactttggcctggccaagtgcaatggcttgtctcactcccatgacttgtcaatggatggcctgtttggcacaatcgcgtatctccctcctgagcggattcgggaaaaatctcggctgtttgacactaaacatgatgtctactccttcgccattgttatctggggcgtattgactcaaaaaaagccttttgctgacgaaaagaatattctacatattatggtgaaggtcgtcaagggtcaccgtccagaattgcctcctgtgtgtagggccagaccaagggcctgcagccacctgatcagacttatgcaacgatgctggcagggcgaccctcgcgtcagaccaacattccaggaaattacttccgagacggaggatttatgtgagaaaccagatgatgaagtaaaggaaactgcacacgacctggacgtaaaatcacctccggagcctcggtctgaggtcgtgcccgcccggcttaagcgggccagcgcccctactttcgataacgactactctctctctgaactgctgtcacaactggacagcggcgtgagccaggccgtagagggccccgaagaattgagtcggagttcctcagagtcaaaattgccaagtagcggaagcggaaaaagactgtccggggtctctagcgtggatagcgctttctctagcagaggatcactctcactctccttcgagagagagccatctacatctgatctggggacaacagacgtgcagaaaaagaagttggtggacgcaattgtatcaggggatacttcaaagctcatgaagatcctacagccacaggatgtggacctggctttggacagcggcgcttctctgttgcatcttgcagttgaggcaggccaggaggagtgtgcaaagtggctgctgttgaacaatgctaatccaaacctgagcaacagaagagggtccacccccctccatatggcagttgaaaggcgagtcagaggggttgtggagctcctcctcgcgcggaagatttccgtgaatgctaaggacgaagaccaatggacagcactccattttgccgctcagaatggcgacgagtcttctaccagactactacttgagaaaaatgcatctgtcaacgaggtggattttgagggtcgaacacctatgcatgtggcttgccaacatggccaggagaatatagtccgtattcttctgaggcgcggcgtggacgttagtcttcagggaaaggatgcctggctgccactgcattatgccgcctggcagggccaccttccaatagttaaactgctggccaaacaacccggggtctccgtcaatgctcagacattggatggtcggacccccctgcacctggcagcgcagagaggccactatcgggtagcaagaatactgattgacctttgtagtgatgttaatgtctgttcactgctggcgcagacccctcttcacgtcgctgctgagacggggcataccagcaccgccagactcttgctgcatcggggggcgggaaaggaggccatgacatccgacggttacaccgcccttcacttagcagccaggaacggccacctggccactgtgaaacttctggtggaagagaaggcagacgtattggctagaggcccattgaaccaaacagctcttcatcttgctgctgctcacggtcacagcgaggtggtcgaagagttggtgagcgctgacgtgattgacctgtttgatgagcaggggttgagcgccctgcatctggcggcccaagggcggcacgcacagactgttgagactctactgcgacacggagcacacattaacctccaaagtctgaaattccaaggtggccatgggccagccgcaaccctactccgcaggtcgaagacatag

SEQ ID NO: 131961 - DNA, 3132 bp, Artificial Sequence
  Description of Artificial Sequence: Synthetic coding sequence
atggctgcaagtttcccacccacgcttgggttatcatctgcccccgatgagatccagcatccacatatcaagttctctgagtggaaatttaagctgtttagagtccgctctttcgagaagacccccgaggaggcccagaaagagaagaaggactctttcgagggaaagccttcgctcgagcagtcccccgcagtgctggataaagccgatgggcagaagcccgtgcctacccagcccctactcaaagcacatccaaagttctcaaaaaagtttcatgacaatgagaaggcccgggggaaagcgattcaccaagcaaacctgcgccacctgtgccgaatttgcggaaattcgttcagagccgacgaacataatagacggtatcccgtccacggccccgtagacggtaaaaccctgggcctcctcaggaaaaaggaaaagcgagctacgtcgtggccagatctcatagcaaaagtgtttaggattgatgttaaagccgatgtggattctatacatcccacggaattctgtcacaattgttggtctattatgcatcgaaagttttcaagtgcgccttgtgaggtttattttccgcgcaatgtcacaatggaatggcatccacacacaccatcctgtgacatctgtaatacggccaggcgtggacttaagagaaaatccctccaaccaaacctgcagctctcgaagaaacttaaaacagtgctggaccaggcaagacaggctaggcagcacaaacggcgagcccaggccaggatcagctctaaagacgttatgaaaaaaattgccaactgcagcaagatacacctgagcacaaagctgctcgcagttgactttccagaacatttcgtcaaatccatctcgtgccaaatatgtgagcacattctggctgaccctgtggagacaaactgtaagcacgtgttttgccgcgtttgtatcctgaggtgcctgaaggttatgggttcttactgcccctcctgcaggtacccatgctttcctaccgacctagaaagtccagtcaaaagttttttgagcgtcctaaacagtctcatggtcaaatgcccagctaaggagtgcaacgaagaggtgtctcttgagaaatacaatcaccatatttcctcgcacaaagagagcaaagaaattttcgtacacatcaataaggggggcaggcctcgacagcacctgctctctctgacacgcagggcccagaagcatagactcagggagttgaagcttcaggtaaaggccttcgcggacaaggaggaaggtggcgacgtgaagtcggtttgcatgactctgttcctccttgctctaagggctagaaacgaacacagacaggcggacgaactggaggctattatgcaaggcaagggctctgggttgcagcctgctgtgtgtcttgctatccgcgtcaacaccttcctgtcctgcagccaataccacaagatgtatcgcaccgttaaggcaatcactggtagacagatcttccagcccctccatgctctgcgcaacgctgaaaaggtccttctgccggggtaccaccacttcgaatggcagccacctctcaagaacgtaagctcctcgacagacgttggaatcatcgatggcttgagcggactttcttcatccgttgacgactacccagttgacacaatcgccaagcggttccggtacgactcggctctagtgagtgctctgatggatatggaggaggacattcttgagggcatgcgctcgcaggacctagatgactatttgaacgggcctttcacagtagtcgtcaaggaaagttgcgacggcatgggagacgtaagtgaaaagcacggctctggaccagtcgtccctgaaaaggccgtgcgattcagtttcacaattatgaagattactatcgcccattcatctcagaacgtaaaagtctttgaagaggctaaaccaaattctgagttatgctgcaagccactatgcctgatgctggccgacgagtctgatcatgaaacgctcacagccatcctgagcccgctgatcgctgagcgcgaggctatgaaaagcagcgaactgatgttggaactgggcggaatcctgagaacctttaagtttatcttcagggggaccggttatgatgaaaagctggtgagggaggtcgagggcctggaggcaagcggaagtgtttatatctgcacactctgtgatgcaacgaggctggaggcgagtcagaatctggtgtttcactcaatcacacgctcacacgctgagaatttagagagatatgaagtttggcggagcaacccttatcacgaatccgtggaggaactgcgtgaccgggttaaaggagtgtccgccaaacccttcattgagaccgtaccatccatagatgcactacattgtgacataggaaacgcagctgaattttataaaatttttcagctcgagatcggtgaggtgtacaagaaccctaacgccagtaaagaggagcggaaacggtggcaggctactctggacaaacatctgaggaaaaaaatgaacctgaagcctatcatgagaatgaatggcaatttcgcgcggaagcttatgacaaaggagacagtagacgcggtgtgtgaactgattccatctgaggagcgtcatgaggctctccgcgaattaatggacctgtacctgaagatgaaaccagtttggcgcagtagttgcccggccaaggagtgccccgaatccctttgtcagtactctttcaacagtcagcggttcgcagagttgttatccaccaaatttaaataccgttatgagggaaaaatcaccaactatttccataagactcttgcccacgtgccagagattatcgaaagagacggcagcatcggcgcttgggctagcgaagggaatgagtctggtaataagttgtttaggcggttcaggaaaatgaacgccagacagagcaagtgttatgaaatggaagacgtgctgaagcaccattggttgtacacatctaagtacttacagaagtttatgaatgcccacaacgccctgaagaccagtggctttacaatgaaccctcaagctagcctgggcgacccactaggaattgaggattctttggagtctcaggattccatggagttctag

SEQ ID NO: 131962 - DNA, 1584 bp, Artificial Sequence
  Description of Artificial Sequence: Synthetic coding sequence
atgtcactccagatggttactgtgtcaaataatatcgccttaatacaacccggttttagtctgatgaacttcgacggccaggtcttcttcttcggtcagaaaggctggccaaaacgctcttgccctaccggcgtctttcacttagatgtgaagcacaaccatgtcaaactcaaacctactatcttcagtaaggacagctgctaccttccaccgttacgctaccccgccacctgcaccttcaagggaagtctcgaatctgagaagcatcagtacattatacacggcggcaagaccccgaataacgaagttagtgacaaaatatatgtcatgtcgattgtctgtaaaaacaacaagaaagtgacatttcgttgcacagagaaagacctggttggggacgtgcccgaagcaagatatggccattccattaatgtggtctattctaggggaaaatcaatgggggtgctctttgggggtcggtcttacatgcctagtacccacaggactacagagaagtggaactccgtggcagattgtttgccttgcgtgtttctggtcgattttgagttcggttgtgcaacgagctatattttacccgaactccaagacggcctaagctttcacgtgtcgattgccaaaaacgacacgatctacatcctcggggggcactcactcgccaacaatatccgaccagcaaacctttatcgcattcgtgtggatttacccctgggatctccagctgtaaactgcacggtcctgccaggagggatttctgtaagctccgcaatacttacgcagaccaataatgacgaatttgtcatagtaggtggctaccaactggagaaccaaaagcggatgatttgcaacattatttcactcgaagataataaaatcgagattcgtgagatggagacacctgactggacaccagacattaaacactcaaaaatctggttcggatcaaatatggggaacgggacggtattcctgggcatcccgggcgataataagcaggtagtaagcgaagggttctatttttacatgctcaaatgtgccgaagacgatacaaacgaggagcagaccacttttaccaactctcaaacgtctacggaagatcctggcgactcgaccccttttgaggatagcgaagagttctgcttttcggccgaagccaactcgtttgatggggatgatgaatttgacacttacaacgaggatgatgaggaggacgaatctgagaccgggtactggattacttgctgtcctacttgcgatgtcgatatcaacacctgggtgcctttctatagcactgagctgaacaagcccgcgatgatttactgttcccatggtgacgggcactgggtccacgcgcagtgcatggatctcgcagagaggaccctgatccacttgtctgctggcagcaacaagtattattgcaacgaacatgtggagattgcgcgcgctcttcatacaccccagcgtgtgttgcctctcaaaaagccacccatgaagagcttgagaaagaagggttctgggaagatcctgacaccagccaagaaatctttcctacgacgcttgtttgactag

SEQ ID NO: 131963 - DNA, 216 bp, Artificial Sequence
  Description of Artificial Sequence: Synthetic coding sequence
atgagcctgcagatggtgacagtgtccaataacatagcattgattcagcctgggtttagtctcatgaacttcgatggccaggtctttttcttcggccagaaaggttggccgaaacgatcttgtccgacgggcgtctttcacctcgatgtcaagcacaatcacgtgaagctcaagcccacaattttttcaaaggacagttgctatctgccaccatag

SEQ ID NO: 131964 - DNA, 453 bp, Artificial Sequence
  Description of Artificial Sequence: Synthetic coding sequence
atgtccctccagatggtcaccgtgtccaataacatagccctcattcagccaggttttagcctgatgaacttcgacggccaagtattcttctttggtcaaaaaggctggccgaagcggtcctgtcccacaggcgtcttccacctggacgtcaaacacaatcatgtgaagttaaaacccacaatattctctaaagactcctgctacctcccccctctgcggtatccagcgacgtgtactttcaagggaagcctcgagtccgagaaacatcagtacatcattcatggcggaaagacgcccaacaacgaggtttctgataagatttatgtgatgtctatcgtttgcaaaaacaacaagaaagtcaccttcaggtgtacggaaaaggacctggtgggagatgtgccagaggcacggtatgggcattcaataaacgtcgtctattccagggggaagtag

SEQ ID NO: 131965 - DNA, 6 bp, Artificial Sequence
  Description of Artificial Sequence: Synthetic coding sequence
atgtag

SEQ ID NO: 131966 - DNA, 1503 bp, Artificial Sequence
  Description of Artificial Sequence: Synthetic coding sequence
atggatcacacagagggttccccggccgaagagcctcccgcgcacgcaccctctcctggaaagtttggggagcgccctcctcctaaaagactcacccgtgaagccatgcgaaactacctcaaggaacgaggagatcagaccgtactgatcctgcatgccaaagtcgcccagaagtcctatggaaatgagaagaggtttttctgcccgccgccctgtgtatacctgatgggaagcggttggaagaagaagaaagaacaaatggaacgggacgggtgctcagaacaggaaagccagccgtgcgcctttattgggataggaaacagtgatcaggaaatgcagcagctgaatttggaaggaaagaactattgtaccgctaaaactctgtacatatccgattctgataagaggaaacactttatgctgagcgttaagatgttctacggaaatagtgacgacataggagtgttcttgtccaaacggattaaggtgatctcaaagccctcgaagaaaaaacagtccctgaagaatgccgacctgtgtatcgcatctggtactaaggtggctctcttcaatcgcctgagatctcagacagtgtcaactaggtatctgcacgttgaaggtggcaacttccacgcctcatcacagcaatggggtgcatttttcatccatctcctggatgatgatgagtcagagggcgaggagtttactgttagagatggctatattcactacggccagacagtgaaactcgtttgctccgtcacaggaatggcccttccacggctcatcatccggaaggtggataaacagaccgccctgctggatgcagacgacccagtgtctcaattgcacaagtgcgccttctatctcaaggatactgagcgtatgtatctttgtctttcccaggaaagaatcatacagttccaggccactccctgtccaaaggagccaaataaggaaatgatcaacgacggtgcttcgtggacaatcattagtaccgacaaagccgagtataccttttacgaggggatgggaccagtgttggctcctgtgacgccagttccagtggtggaatccttgcagctcaatggtggcggcgacgtggccatgttagaactgacagggcagaacttcactccgaatctaagagtttggttcggcgacgtggaagctgaaacaatgtacaggtgtggggagtccatgctgtgtgtggtgcccgacatatcagcattcagagaggggtggcgctgggtacgacagccagtgcaggttccagtcactcttgttaggaacgacgggattatttatagtacttctctcactttcacctacacccctgagccagggccccgtccccactgtagcgccgcaggcgcaatcctgagagccaactccagccaggtcccccccaacgagtccaacacaaatagcgaggggtcctacacaaacgcctccacaaactcaacgagcgtaaccagcagcactgccactgtggtctcctag

SEQ ID NO: 131967 - DNA, 1461 bp, Artificial Sequence
  Description of Artificial Sequence: Synthetic coding sequence
atggcctggataaagcggaaattcggagaaaggccgccaccgaagcgccttacaagggaggccatgaggaactatctgaaggagcgtggtgatcagaccgtattaatactgcacgctaaggtcgcccaaaagtcatatggtaacgagaaacggttcttctgtcctcccccctgtgtgtatctcatgggatcaggatggaagaaaaagaaagagcagatggaacgggacggctgtagcgaacaagaatcacagccctgtgcatttattggaatcggaaactctgatcaagaaatgcagcagcttaatctggaagggaagaactactgcactgctaaaaccctttacatatctgacagcgataagaggaaacatttcatgttgagcgttaagatgttttatgggaactccgacgatatcggggtctttctgtccaagcgcatcaaagtaatctccaagccctccaaaaaaaagcagagtcttaaaaacgcagatctgtgtattgccagcggaacgaaggtcgccctgtttaatcggctgaggtcgcagaccgtcagtacgcggtatttgcatgtcgaaggcgggaactttcatgcttctagtcagcagtggggcgccttctttatacatttgctcgatgacgacgagtctgagggtgaagagtttacagttagagatggctatattcattatggccagactgtcaaattagtctgctccgtgaccggcatggcactgcctaggctgattattagaaaagtagataagcaaaccgcgttacttgacgccgacgaccccgtctcccagctgcacaagtgcgctttttatctcaaggataccgaaagaatgtacctttgtctttcccaagaacgcatcattcagttccaggctacaccctgtcctaaagagccgaataaagagatgattaacgatggggcaagttggaccataatctccactgataaagctgagtacactttttatgagggtatgggtcctgtcctagcccctgtaacaccagtccccgttgtcgaatcactccagctgaacgggggcggagacgtggccatgctcgagttgactggccagaattttacccccaacttgcgtgtatggtttggtgacgtggaggcggagacaatgtacaggtgcggtgaatcaatgctgtgcgttgtccccgacatctcagcctttcgggagggctggcgctgggtgagacagccggtacaggtacctgtgaccttggtgcgcaatgatggcattatttacagcactagtctcacgtttacatacactcctgagccaggcccgaggccccactgctcagcagccggtgctatcttgcgggccaacagtagccaggtcccaccaaacgaatcaaacactaactctgagggttcttacacaaacgccagcacaaactccacctcagttactagcagcacggcgaccgtggtttcatag

SEQ ID NO: 131968 - DNA, 1458 bp, Artificial Sequence
  Description of Artificial Sequence: Synthetic coding sequence
atgggagggtgccgaaagtttggtgaacggcctccacctaaaaggcttacacgcgaggctatgcgaaactatttgaaagagcggggcgaccagactgtgcttatcttgcacgctaaagtggcccagaaatcctatggcaatgagaaaaggttcttttgcccgccgccctgcgtctacctcatggggagcggatggaaaaaaaagaaagagcaaatggaacgcgatgggtgctccgaacaggaaagtcaaccctgcgcatttattgggattgggaactccgaccaggagatgcagcagctcaatttagagggcaaaaattactgcacagccaagacactgtatattagcgatagcgacaaacgtaagcactttatgctaagcgttaaaatgttttacgggaatagtgacgatattggggttttcttgagcaaaagaatcaaggtaatatcaaaacccagtaagaaaaaacaatctttgaagaatgcagacctgtgcatcgcgtctggtacgaaagttgcattgttcaacaggttgcgatcgcagaccgtgagtacaagatatttacatgtggagggggggaatttccatgccagctcccaacaatggggtgcattcttcattcacctgctcgatgatgacgagtcagagggagaggagtttacagtaagggacggctatattcattacggtcaaacggtgaaactagtttgctccgtgacaggcatggccctccccaggctaattattaggaaagtcgacaaacagactgctcttctcgatgctgatgatcctgtgagccaacttcacaagtgtgctttctaccttaaagatacggagcggatgtatttgtgcttaagtcaagagcgtattattcaattccaggctaccccatgccccaaagagcccaacaaggagatgataaatgacggcgcgtcttggacaattatctccactgacaaagctgagtacacattctacgagggaatgggccctgttttggcacctgtgacccccgtacctgtagtggagtcgctgcagttgaacggcggtggagatgtagcaatgttggagttaacggggcagaacttcactcccaatctcagagtgtggtttggagatgtggaggccgaaactatgtatcgctgtggagaatccatgctgtgcgttgtgccagatataagcgcctttcgagaggggtggcgttgggtgcggcagcctgtacaggtgcccgtgaccctcgttaggaacgatggaattatttatagcacttctttgacgttcacatacactcctgagcctggcccccgcccacattgctctgctgccggtgcaattcttagagctaactcgtcccaggttccccctaatgaaagtaacacaaactcagaaggctcatacaccaacgcaagcacaaactctacaagcgtgacatcctccactgccactgttgtatcttag

SEQ ID NO: 131969 - DNA, 1464 bp, Artificial Sequence
  Description of Artificial Sequence: Synthetic coding sequence
atggctccggtggtcaccgggaagtttggagaacgtccaccaccaaaaagattaaccagagaggcaatgagaaactatctcaaagagcggggggaccaaaccgtgctcattcttcatgctaaggtagcacagaaatcttatgggaatgaaaagagatttttctgtccacctccctgtgtgtatctgatgggtagtgggtggaagaagaaaaaagagcaaatggagagagacggctgttcagaacaagagtcccaaccttgcgcgttcattggtattggcaactccgatcaggagatgcaacagctcaatctagaggggaagaactattgcactgcgaagacactttacatcagcgatagtgacaagagaaaacattttatgctgtcagttaaaatgttttatggcaattcagacgacattggagtcttcctgagcaaacggatcaaggttattagtaagcctagcaagaagaagcagagtctgaagaacgcagacctctgcattgcctctggcacgaaagtggctctgttcaatcgactgaggtctcaaacagtgtcaactaggtacttgcatgtggaaggtggaaactttcacgcgtccagtcagcagtggggcgcattttttattcaccttctcgatgatgacgaaagcgaaggcgaggagtttactgtgcgtgatggctacatacactatggtcagaccgtgaaactcgtctgctccgtcacaggaatggcactgccaaggctaatcattcgcaaggtcgataaacagaccgctctgcttgacgccgatgacccggtaagccaactgcacaaatgcgcattttacctgaaagatacagaaagaatgtatctttgcttgagccaagaaaggattatccagttccaggccactccttgccccaaggagcccaacaaggaaatgatcaatgatggagcaagctggacaattatcagtacagacaaggccgaatatacattctatgaaggtatgggaccggttctcgcccctgtgactccggtccccgtagtggaaagtctgcaactgaatggaggcggcgacgtcgctatgctcgagctcacggggcagaactttacaccaaacctgcgcgtctggtttggcgacgtagaagcagaaaccatgtacaggtgcggagagagcatgctgtgtgttgtgcccgatattagtgcgttccgggagggatggagatgggtacgccagcccgttcaggtgccggtcaccttggtccgcaatgatgggatcatctactcgacatctctgacattcacctacactcccgagcctggcccaaggccccactgcagtgctgcaggagcgatactgcgcgctaattcttctcaggtccctccaaacgaatccaacaccaacagcgagggctcctacaccaatgcaagcactaattcaacaagtgtcacctcttcgacagcaacagtggtctcatag

SEQ ID NO: 131970 - DNA, 1461 bp, Artificial Sequence
  Description of Artificial Sequence: Synthetic coding sequence
atggcttggatcaaaagaaaattcggagaacgccccccccctaaaaggctcacccgggaggcaatgcggaattatttgaaagaacggggagaccagactgtgctgattttgcacgcaaaggttgctcagaaaagctacggaaacgagaagcgttttttctgcccaccaccctgcgtttatctgatgggaagtgggtggaaaaagaagaaggagcagatggaaagagacggctgctccgagcaagagtcgcagccttgcgcatttattggcattggcaatagcgaccaggaaatgcaacagcttaatctggaggggaaaaactactgtaccgcgaaaactctttacatatcagactctgacaagcgtaaacacttcatgcttagtgtcaaaatgttctacggcaattccgacgatatcggcgtgttcctctctaaaagaattaaggtaatcagcaagccctcgaaaaagaaacagtcactcaagaatgccgacctgtgtattgcctccggaaccaaggttgcccttttcaatagactacgttcacagaccgtctcaacacgctacctgcacgttgaaggcggaaacttccatgcaagcagccagcagtggggtgccttcttcatccaccttctcgatgatgacgagagtgagggcgaggagtttaccgtgcgcgacggctacattcattatgggcagaccgtcaagctggtgtgctccgtgaccgggatggctttgccgcgactcatcatacgaaaggttgataagcagacagctctcttggacgccgatgaccccgtctcacagctgcataagtgtgcattctacctcaaggacactgaacgaatgtatctgtgtttgtcccaggaaaggatcattcagtttcaagctacaccgtgccctaaggaacctaataaagagatgatcaatgatggtgctagctggacaattatatcaactgacaaagcggagtacactttttatgaagggatggggcctgtcctggcccccgtgaccccagtgcccgttgtggagagcctccagctgaacggtggcggagacgttgcaatgctcgagctgacaggccagaacttcactccaaacctgcgcgtgtggttcggcgatgtggaggctgaaaccatgtatcgctgcggtgagagtatgttgtgtgtggtacctgacatcagcgccttcagagaggggtggaggtgggtgcgccagcctgttcaagtgcccgtcacactggtgaggaacgatggaatcatttatagtaccagtttgacattcacatacacacctgagcctggcccaagaccacactgcagcgccgctggcgccatccttcgggcaaacagcagccaggtgcctcctaacgagtccaatactaactcagaagggtcatacacaaatgcctctaccaattctacaagtgtgacttctagcactgccactgtggtgagctag

SEQ ID NO: 131971 - DNA, 1503 bp, Artificial Sequence
  Description of Artificial Sequence: Synthetic coding sequence
atggatcacactgaaggatcacccgcagaagagcctcccgctcatgccccctcccccggaaaattcggagagcggccccccccaaagagattgactagggaggccatgcgcaattatttaaaagagagaggagaccagaccgtgttaatactccacgctaaggtcgcccaaaagtcctacggtaacgagaaaagattcttttgtcctccaccatgcgtctacttgatgggttctggttggaaaaaaaagaaggagcaaatggagagagacgggtgcagtgagcaagaatcccagccttgtgcttttatcggcataggcaacagcgatcaagagatgcagcagctgaatctagaaggtaagaactactgtactgctaagaccttatacatatccgacagcgataaaaggaaacactttatgttgtctgtgaagatgttctacggaaattccgatgatattggtgtgttcctcagcaagcggataaaagtgatctctaaacctagcaaaaagaaacagtccttgaagaatgctgacctgtgtatcgcctccgggaccaaagtagcgctgttcaataggctacggagccagaccgtgagcacccgctatctgcacgtggaaggtggaaacttccatgcatcctcacagcaatggggcgctttttttattcacctgttggatgatgacgagtcagagggcgaagaattcacggtaagggatggatacattcattacggccagacggtcaaactcgtttgctctgtaacaggtatggccctgccacgcctcattatacgaaaagtggacaaacagactgctctgctcgacgccgacgatcccgtctcacagctgcataaatgtgccttctacctcaaagatactgagcgcatgtacctctgcttgtcacaggagcgtattatacagtttcaagctacaccatgcccgaaagaaccaaacaaggagatgattaacgatggcgcctcctggacgattattagtaccgacaaggcagaatacacattctatgaaggcatgggaccggttctggctcctgtgacaccagttcccgtcgtggagagcctccagctcaacggtgggggcgatgtggccatgctcgaattgaccgggcagaatttcacacctaacctcagggtgtggttcggcgacgtggaagcggagactatgtataggtgtggggaaagcatgctttgcgtcgtgccagatatctcggcttttcgcgaaggatggcgctgggtgcgccagccagtgcaggtccccgttaccttggtccgcaatgatggaatcatttactccacatccctgacgtttacctatacccccgagccgggtccaaggccacattgcagtgcagccggcgccattctacgcgcgaattcctctcaggtaccgccaaacgagtctaacaccaatagtgagggaagttataccaacgcctcaactaattcaacctccgtgacatcaagcactgctactgtggtctcctag

SEQ ID NO: 131972 - DNA, 432 bp, Artificial Sequence
  Description of Artificial Sequence: Synthetic coding sequence
atgaggaactatttgaaggagagaggggatcagacagtactgattttgcatgctaaagtcgcacagaagtcctatgggaatgaaaagcgcttcttctgcccccccccatgcgtctatctgatggggagtggctggaaaaagaagaaagagcagatggaaagggacgggtgttcagagcaggaaagccagccatgtgccttcattggtataggcaactctgaccaggaaatgcaacaactgaatctggagggcaagaattactgtacagccaagaccctgtatataagtgatagcgacaagcgaaaacacttcatgctgagtgtaaagatgttctatggcaactccgatgacattggggtctttctttctaagagaatcaaggtgatcagcaagccaagtaagaagaagcaatctctcaaaaatgcagactag

SEQ ID NO: 131973 - DNA, 87 bp, Artificial Sequence
  Description of Artificial Sequence: Synthetic coding sequence
atggcgtggattaagaggaagttcggcgagcggccacccccaaagagactgacgcgtgaagctatgagaaactatctgaaagagtag

SEQ ID NO: 131974 - DNA, 294 bp, Artificial Sequence
  Description of Artificial Sequence: Synthetic coding sequence
atggcttggattaaacgcaaattcggagaaagacccccacccaagaggctgactagggaagctatgagaaactatctgaaagaacgtggagaccagaccgtcctgatcttgcatgcaaaagtcgctcaaaagagctacggaaacgagaagcgattcttctgtccacccccctgcgtgtacttgatgggatctggatggaaaaagaaaaaggaacagatggagcgggacggctgctcagagcaagagagtcagccttgcgctttcatcggcattggaaactctgaccaggaatag

SEQ ID NO: 131975 - DNA, 1398 bp, Artificial Sequence
  Description of Artificial Sequence: Synthetic coding sequence
atgcgaaactatctgaaggaaagaggcgaccaaaccgtgctaatacttcatgcaaaggtggctcagaagagctacggtaacgaaaaaaggttcttttgtcctccaccatgcgtgtacctgatggggtccggatggaagaagaagaaggaacaaatggagcgagacggctgctccgagcaggaatctcagccttgcgcatttataggcatcggaaattctgatcaggagatgcagcagcttaatctggagggcaaaaactactgtactgcaaagacattatacatttccgatagcgacaagagaaaacatttcatgctgtcagtcaaaatgttctatggaaattccgacgacatcggagtctttctaagtaagagaattaaagtgatcagcaaaccttctaaaaagaaacagtctctgaagaatgccgacttatgcatcgcttcaggcactaaagtcgcactgtttaaccgactgaggagtcaaacagtctccactcggtatcttcatgtggagggaggcaattttcatgccagttcacagcagtggggagccttctttatccatctgctggacgatgacgaaagcgagggtgaagagtttacagttagagatggatacatccactatggtcagaccgtgaaactggtatgctcggtcaccggcatggcacttcctaggttgatcattcgaaaagtcgataagcagaccgccctcctggatgcagatgacccagtgtctcagctccataagtgcgctttctatctgaaagacacagagcgtatgtatctgtgtctctcccaggagcgcattatccagttccaggcaacgccctgtcctaaagaaccaaacaaggagatgatcaatgatggagcaagctggaccatcatcagcactgacaaggccgaatacacattttacgagggaatggggccagtgctcgctccagtgacacccgtgcccgtggttgaatcgttgcagctcaatggcggaggtgacgttgcgatgctggagctgaccggccagaacttcacaccaaatctgcgcgtatggttcggggacgtggaagcggagaccatgtacaggtgcggagagagcatgctgtgcgtggtgccagatataagtgcatttagggaaggttggaggtgggtacggcaaccggtccaggttcccgtgaccttggttcggaacgacggaatcatctactctacgtctttgaccttcacttacacaccggaaccgggcccacgcccgcactgctccgcagcaggggccatcctgagagctaatagttctcaagttcctcccaacgagtctaacacaaattctgaaggttcctataccaatgctagtaccaatagtactagcgttacatcatccactgcgacagtggtgagctag

SEQ ID NO: 131976 - DNA, 474 bp, Artificial Sequence
  Description of Artificial Sequence: Synthetic coding sequence
atgcggaactacttaaaagagcgcggcgatcagactgtcctgattctgcacgctaaggtggctcagaagagctatggaaacgaaaagagattcttttgtcctccaccatgcgtttacctgatgggttccggatggaagaagaaaaaggagcagatggaaagagacggatgttcagagcaagagagtcagccctgtgcttttatcggaattggtaattctgatcaggagatgcagcagctgaatctggaagggaaaaactattgtactgctaagactctatatatttccgatagcgacaagcggaaacatttcatgctgtcggtgaaaatgttttatggcaattcagacgacattggtgttttcttgtcaaagaggatcaaggttatttcaaaaccatcaaagaagaagcaatcactgaaaaacgctgacctgtgtattgcttcgggcacaaaggttgcactgtttaaccgctag

SEQ ID NO: 131977 - DNA, 150 bp, Artificial Sequence
  Description of Artificial Sequence: Synthetic coding sequence
atggcctggatcaagcgcaaatttggggagcgtcccccacccaagcgactcacaagggaggcaatgcggaattatctgaaagagaggggcgatcagacagtactgatcctgcacgccaaagtggcgcagaagtcctatggaaatgagtag

SEQ ID NO: 131978 - DNA, 324 bp, Artificial Sequence
  Description of Artificial Sequence: Synthetic coding sequence
atggcttggatcaagcgtaagtttggggagaggcctcctccaaagaggctgactagagaggctatgcgcaactatttgaaagaacggggagaccagacggtcttgatactgcatgccaaggttgcccagaaatcctacggtaacgagaagcgctttttttgcccaccaccttgcgtgtatttgatgggctctgggtggaaaaagaagaaggagcaaatggagcgggacggctgtagtgaacaggaatcccaaccttgtgcttttatagggatcggcaactcagatcaggagatgcaacagctcaacctcgagggcaaaaattag

SEQ ID NO: 131979 - DNA, 285 bp, Artificial Sequence
  Description of Artificial Sequence: Synthetic coding sequence
atggcatggattaagcgaaagttcggtgagcgcccgccacctaaaagactcaccagggaggcgatgcggaactacctgaaggaacgcggcgatcagaccgtattaatcctgcatgccaaggtggcccagaagagctacggcaacgaaaagcgctttttttgccctcctccatgcgtgtacctgatgggcagtggatggaaaaagaagaaagagcagatggagcgggacgggtgctccgaacaggagagccaaccttgtgcctttataggcatcggaaacagctag

SEQ ID NO: 131980 - DNA, 537 bp, Artificial Sequence
  Description of Artificial Sequence: Synthetic coding sequence
atggaccatactgaagggagccctgccgaggagccaccggcccacgcaccctcacccggtaaatttggcgaacggccaccgccgaagcgcctcacccgagaagcaatgcgcaattacctgaaggaacgtggggaccagactgttctgattctacacgcaaaagtggcacaaaaaagctacggcaacgagaagagattcttttgcccacccccttgcgtttatttgatgggctccggttggaagaagaagaaggagcagatggaaagggatggatgttcagagcaggagtcacaaccgtgcgctttcatcggtattgggaacagtgatcaggaaatgcagcaactgaacctggagggcaagaactactgtaccgctaaaacactgtatatctcagattctgacaaacggaagcatttcatgctgtccgtgaaaatgttctacggaaacagtgacgacatcggagttttcctgagtaagcgaataaaggttatcagcaaaccaagtaaaaaaaagcagagccttaaaaatgcggattag

SEQ ID NO: 131981 - DNA, 333 bp, Artificial Sequence
  Description of Artificial Sequence: Synthetic coding sequence
atggcttggataaaaaggaagtttggagagcggcctccccccaaacggcttactagagaggctatgcgcaattacctgaaggaaaggggagaccaaactgtgttaatcctgcatgccaaagtcgctcagaagtcatatggaaacgaaaaacgatttttctgccccccaccctgcgtctacctgatgggcagcggatggaagaagaaaaaggagcagatggagcgggatgggtgctctgagcaggaaagccagccatgtgccttcattggcataggcaacagtgatcaagaaatgcagcagttgaatctggagggaaaaaattattgcacatag

SEQ ID NO: 131982 - DNA, 342 bp, Artificial Sequence
  Description of Artificial Sequence: Synthetic coding sequence
atggcttggatcaagagaaagttcggcgaacgtccccctcctaaacggctgactcgcgaagccatgcgcaattatctcaaggagaggggtgaccagacggtgctgatcttacacgcgaaagtggctcagaagagttacggcaacgaaaaaaggttcttttgcccccctccctgcgtataccttatgggctctggctggaaaaagaaaaaagaacagatggagagggacggctgctctgaacaggaatcccagccctgtgcgtttattggcatcggcaattcagatcaggagatgcaacagctgaacttggagggcaaaaattactgcacagccaagacgtag

SEQ ID NO: 131983 - DNA, 147 bp, Artificial Sequence
  Description of Artificial Sequence: Synthetic coding sequence
atggcttggataaagcgaaagttcggcgagaggcctcccccaaaaaggctgaccagggaagcaatgagaaactacctgaaggagaggggagaccaaacggtgctgattttacacgccaaagtggcccagaagagctacggaaactag

SEQ ID NO: 131984 - DNA, 570 bp, Artificial Sequence
  Description of Artificial Sequence: Synthetic coding sequence
atgaggaactacctcaaggaacgtggcgaccagacggtcttaatactccatgcaaaagtcgcccagaagtcttacgggaacgaaaaacggttcttttgccctcccccgtgcgtttatctgatgggttcaggctggaagaagaaaaaggagcagatggagcgtgatggctgctcggaacaggaaagtcagccctgtgcattcataggaatcggcaactctgatcaagagatgcagcagcttaatctggaggggaaaaactactgcactgctaagaccctgtatatcagcgattccgacaaacgcaaacattttatgctcagcgtcaagatgttctacgggaactctgacgacataggagtgtttctgtctaagcgcatcaaagtgatcagcaaaccatcgaaaaaaaagcagagtctgaaaaatgccgatttatgcattgcgtccggcacgaaggttgccctttttaatcgtctaagatcacagactgtctccacaaggtatttgcacgtcgagggcggcaacttccacgcttcatctcagcagtggggggctttctttatccacctctag

SEQ ID NO: 131985 - DNA, 600 bp, Artificial Sequence
  Description of Artificial Sequence: Synthetic coding sequence
atggcatccgtgtctgccctgacagaggaattagattccatcacttcggagttgcacgcggtagagatccaaatacaggaactgactgagcggcaacaagagctcattcagaagaagaaggtgttgactaaaaaaattaagcagtgtctggaagactctgatgccggtgccagtaacgaatacgattcttcaccagccgcttggaacaaggaagacttcccctggagcgggaaagtcaaagatattttacagaacgtgttcaaactcgagaagtttagaccactccagctcgagacaattaatgtcacgatggccggtaaggaggtattcttggtgatgccaacgggtggcggcaaatccctttgctaccagttacctgccctgtgttccgacgggttcactctggtgatctgccctctgattagtcttatggaggaccagctgatggtactaaaacagttgggtatcagcgcaactatgctgaacgccagtagtagtaaggagcacgtcaagtgggtgcatgccgagatggtaaacaaaaattctgaactgaaattgatttacgtgactccggaaaaaatcgccaagtcgaaaatgtag

SEQ ID NO: 131986 - DNA, 636 bp, Artificial Sequence
  Description of Artificial Sequence: Synthetic coding sequence
atggccagtgtctccgcactgactgaggaactcgacagcattactagcgaactccacgccgttgaaatccagatacaggaactgacagagaggcaacaggagctgattcagaagaagaaggttctcactaagaagataaagcagtgtctcgaagatagtgacgcgggggcctccaacgagtatgactcctctccagctgcttggaataaggaagatttcccatggagtggcaaggtgaaagatatcctgcagaacgtattcaagctggaaaaattcaggcccttgcagttagagaccattaacgtgactatggccgggaaggaagttttcctcgtgatgcctacgggtggcggcaaatctctgtgttaccagctgccggcgttgtgtagtgacggatttactctggtcatttgccccctgatctcactcatggaggatcaacttatggtcttaaagcagctgggtatttctgcaacaatgctcaatgcaagcagcagtaaggaacatgtaaaatgggtgcatgcagaaatggtgaataagaattctgagctgaagctgatatatgttaccccagagaaaatagctaagagcaagatgtttatgagccgacttgagaaggcatatgaggcccggtag

SEQ ID NO: 131987 - DNA, 1950 bp, Artificial Sequence
  Description of Artificial Sequence: Synthetic coding sequence
atggcttccgtgtccgccttgacagaggagctcgactccatcactagcgaactgcacgcagtcgaaatacagatccaagaattaacggaaaggcagcaggagctgattcagaagaaaaaggttctcacaaagaaaattaagcaatgcttggaggactctgacgctggcgcctcgaacgagtacgatagtagtccagctgcttggaacaaggaggacttcccgtggtcgggcaaggtgaaagacatcctgcagaacgtcttcaagcttgaaaaattcagaccactgcagcttgagaccataaacgtgacaatggccggtaaagaagtctttctggtcatgcctaccggaggggggaagtccctgtgctaccagctgcctgctttatgtagtgatggctttaccctggtgatctgcccgcttatctctctgatggaggatcagctgatggtgctgaagcagctgggaatttcagccacaatgttgaacgccagtagcagcaaggagcacgtcaagtgggtccacgccgagatggtcaataagaactccgagctaaagctgatctatgtgacaccagaaaaaatcgccaagagcaagatgtttatgagtagactagaaaaagcctacgaggcaaggcgatttacacgaatagccgtggatgaggtgcactgttgcagtcagtggggacacgactttcgccctgactacaaggccctgggaatacttaaacgccagtttcccaacgcctctttgatcggtctgacagccaccgccacaaatcacgtgctcacggatgctcagaaaatcctctgtatagagaagtgcttcacctttacagccagtttcaatcggcccaatctgtactacgaagtgagacagaagccatctaacaccgaggacttcatcgaggacattgtgaagctaatcaatggccgttacaagggacagtctggcattatttactgcttttctcagaaggacagcgagcaggtaaccgtgtcactgcaaaacctgggtatccacgcaggagcataccacgccaacctggagcccgaagacaagacaaccgtccaccgcaagtggagcgccaatgaaattcaggtggtcgtggctactgtcgcatttggaatggggatcgataagcccgacgtgaggttcgtcattcatcacagcatgtcaaagtctatggagaattactaccaggaaagtggacgggctggccgggatgatatgaaggccgattgtatcctttactacggcttcggggatatctttagaattagtagtatggtcgtcatggagaacgtgggccagcagaaactgtacgaaatggtctcctattgtcaaaacatctctaagtgcaggcgggtgctcatggcccaacatttcgatgaggtatggaacagtgaggcctgcaataaaatgtgcgacaactgttgtaaggattctgcatttgaacggaagaatattacagaatactgtcgggatctcatcaagatactaaaacaagccgaagagcttaacgagaaattaacacctttaaagttaatagactcttggatggggaaaggggccgcaaagctccgcgtggcaggagtagtcgctcccaccctgcccagagaagatctggaaaagattatagcacacttcttaatccagcaatatctgaaggaagattactcctttacagcgtacgcaaccataagctacctgaaaatagggccaaaagctaatctgttaaataacgaagctcacgccattaccatgcaagtgacaaaatctacgcaaaactcatttagggcagaatcatctcaaacatgccacagcgagcagggagacaaaaagatggaggaaaaaaattctggcaacttccagaagaaggccgccaacatgctccagcaaagcggtagtaaaaataccggcgcgaaaaagaggaaaattgacgacgcttag

SEQ ID NO: 131988 - DNA, 1950 bp, Artificial Sequence
  Description of Artificial Sequence: Synthetic coding sequence
atggctagcgtgagtgctctgaccgaagaactggacagcattacctcggagttgcatgcggtggagattcagattcaggagcttactgaacgccagcaggaattgattcagaagaaaaaggttctgacaaagaaaataaagcagtgtttggaagactcagacgcaggcgcctccaacgaatacgattccagcccagcagcctggaataaagaggatttcccatggagcggcaaagtgaaagatatactccagaacgtgttcaagctcgaaaagttcagaccactgcagctggaaacaatcaatgtgaccatggcaggcaaggaagtgttcctggttatgccaaccggagggggaaagagcttatgctaccagcttcctgcattgtgctcagatggatttacactcgtaatctgtccgctcattagccttatggaggaccagctgatggttctgaagcaactcggcatttcggcaaccatgttgaacgcatcctcttcaaaggaacacgtgaagtgggtgcatgccgagatggttaacaaaaactcggaactgaaactgatttatgttacaccagaaaagattgccaaatctaaaatgttcatgagccggctcgaaaaagcgtatgaggctaggcggttcacgaggatcgccgtggacgaagtgcattgctgttctcaatgggggcatgactttcgaccagattacaaggccctcggtatccttaagagacagtttccgaacgcatccctgattggccttaccgctacagctaccaatcatgtgctgacggacgctcaaaagattttgtgcatcgaaaagtgtttcaccttcacggcaagctttaataggccgaatctgtactatgaggtgcggcaaaaaccctcaaatacggaagactttatcgaggacattgtgaaactgattaatggaagatataagggacagtctggcatcatttattgtttttcccagaaggattccgagcaggtcaccgtgagtttgcagaacctagggattcatgctggagcatatcacgcaaatttggaacccgaggataagactactgtgcaccggaaatggtctgccaatgaaatacaggtcgtggttgcgacagttgcattcggaatggggatcgacaagccagatgtgagattcgtgattcaccacagcatgagcaagtcgatggagaactactaccaagaaagcgggagggcaggcagggatgatatgaaagcggattgtatcttatactatgggtttggggatatttttagaatctcatcaatggtggtcatggagaatgtaggccagcagaagctctatgagatggtctcttactgtcagaatatatctaagtgcagaagagtcttgatggcacagcacttcgacgaggtatggaattcagaggcatgtaacaagatgtgtgacaattgttgcaaagattctgcattcgaacgtaaaaacattactgagtactgtcgtgatcttattaaaatcttgaagcaggccgaagagctgaacgagaagctgaccccgctcaagctcatcgattcatggatgggcaagggagcagctaagctccgagtggcaggcgtggtggctcccactctgcccagggaagatttggagaagattattgctcactttctgatccaacagtatctgaaagaggactattcattcacagcatacgccactatatcctacttaaaaatagggcccaaggccaacttgctgaacaatgaagcccacgctataacaatgcaagtgactaagtccactcagaacagctttagagcagagtcaagccagacttgtcactcggagcagggagacaaaaagatggaagagaaaaacagtggtaattttcagaagaaagccgcaaatatgctgcaacagagtggaagcaaaaacactggggccaagaaaaggaaaatcgacgacgcctag

SEQ ID NO: 131989 - DNA, 321 bp, Artificial Sequence
  Description of Artificial Sequence: Synthetic coding sequence
atggcctcagtcagcgccttgacagaagagctggactctattacatccgagttgcacgccgttgagattcagattcaggaactgaccgagcggcagcaggagctcatacagaagaagaaggttcttacaaaaaaaataaaacagtgccttgaagatagtgacgccggagcctcaaatgagtacgactccagccctgcagcctggaataaagaggacttcccatggagcgggaaggtgaaggatatactgcaaaatgtgttcaagttagagaagttccgacctttgcaactcgaaactatcaatgtaactatggccggctag

SEQ ID NO: 131990 - DNA, 294 bp, Artificial Sequence
  Description of Artificial Sequence: Synthetic coding sequence
atggccagtgtgtctgcactgactgaagagttggatagtattacttctgaactgcatgctgtggaaattcaaatacaagaactgaccgagcggcagcaggaactgatacaaaaaaaaaaggtgcttactaagaaaattaagcagtgccttgaggattcagacgcaggagcatctaatgaatatgatagctcccccgcagcctggaacaaggaagactttccttggtccggcaaggttaaggacatccttcaaaacgtgtttaagcttgagaaatttcggccattgcaactgtag

SEQ ID NO: 131991 - DNA, 219 bp, Artificial Sequence
  Description of Artificial Sequence: Synthetic coding sequence
atggccagcgtgtcagcgctaactgaagaactggatagtatcacatccgagctgcatgccgttgagatccagatccaggaactcaccgagcgccagcaggagctgattcagaaaaagaaggtactcaccaagaagataaagcagtgcctggaggattccgatgcgggcgcgagcaatgagtatgactccagtcctgccgcatggaataaggaagactag

SEQ ID NO: 131992 - DNA, 396 bp, Artificial Sequence
  Description of Artificial Sequence: Synthetic coding sequence
atggcctccgtttccgcgctcactgaagagttagatagcatcacttctgaactgcacgcggtcgaaatccagatacaggagctaacggaaagacagcaggagctcatccagaaaaaaaaggtactcaccaagaagatcaagcagtgcttagaagactcagatgctggcgcctctaacgaatatgactcctccccagctgcctggaataaggaagactttccgtggagtggcaaggttaaggacatcttgcagaatgtgttcaaactggagaaattccggccattgcaactcgaaacaataaatgtgaccatggccggcaaagaagtgttcttggtgatgcccactggaggcggaaaatccctttgctatcagttgcccgctttatgcagtgattag

SEQ ID NO: 131993 - DNA, 2976 bp, Artificial Sequence
  Description of Artificial Sequence: Synthetic coding sequence
atgagctcccaccacacgaccttcccttttgatcctgaaaggcgggtcagaagcacattgaagaaggtatttggttttgactctttcaagacacctctacaagagtccgcaacaatggctgttgtgaaaggtaataaagacgtgttcgtgtgtatgcccacaggggccggcaagtccctctgttaccagctgcctgctctgctagctaaaggcatcacaattgtggtatctccactcatagccctgatccaggatcaggtggaccacctgctcacactgaaggtacgggtcagtagtctgaactccaagctgtcggcccaggagaggaaggagctcttagctgatctcgagcgagagaaaccgcagaccaagatactgtatattacacctgaaatggctgcgtccagctctttccagccaacattaaactctctcgtcagccggcacctcctctcctatttagtagtggacgaggcacactgtgtctctcagtggggccacgattttaggcccgactacctgcgcttaggcgccctcagatccagactcggccatgctccttgcgtcgccctcacggccacagctactccccaggtgcaggaggacgtgttcgcagcactgcacctgaagaagccagtcgcgatctttaagaccccctgtttcagagcaaacttattttacgacgtccagttcaaagagctcatctctgacccttatgggaacctcaaagacttctgtctcaaagcattggggcaagaggccgacaaaggtttgtctggctgtgggattgtgtactgccgcacaagagaggcatgcgagcagttggctattgaactgagctgcagaggcgtcaatgccaaggcgtaccatgccggccttaaggcgtccgagcggaccctggtccaaaatgattggatggaggaaaaggtaccggtgatagtcgccaccatatctttcgggatgggagtggacaaggcaaatgtgagatttgtggctcattggaatatcgcaaagagcatggccggatattaccaagagtccggtcgagccggacgcgatgggaagccttcctggtgtaggctatattatagccggaatgatagagaccaagtgagcttcctaattcgaaaagaggtcgctaagctgcaggagaaacgaggtaacaaggccagtgataaagcaacaataatggctttcgatgcgctggtgacattctgcgaagaactgggctgccggcacgccgccattgctaagtactttggagatgctttgccggcctgtgctaagggttgtgatcactgccagaatcctactgccgttcggcggcgccttgaagcgttggagcggagtagcagctggtcaaagacatgtatcggcccaagtcaggggaatggcttcgaccccgagttatacgagggagggcggaaagggtacggggattttagtaggtatgacgagggctctggagggtcaggagatgaggggagagacgaagctcacaaacgggagtggaacctcttctaccaaaagcaaatgcagcttaggaaaggcaaagaccctaagattgaggaattcgtgccacctgacgagaactgtccattaaaagaagctagctctaggaggataccccggctcacagttaaagctagggaacattgcctcaggctcttagaggaggctctgagcagcaacaggcaatccacgaggacggcggatgaggccgatctgcgcgccaaggcggtagagctcgagcacgagaccttcagaaatgccaaggtggctaacctatacaaagccagtgtcctgaagaaggtggcagatatccatcgtgctagcaaagacggccagccttatgatatgggaggctctgccaaaagctgttctgcacaggcagagcctccagagccgaacgagtatgatattcctcctgctagccacgtgtatagccttaagcctaaacgggtgggggctggcttccctaagggctcctgccccttccagactgccacagaactcatggagaccacgagaattagagaacaggcgccacagccagagagagggggggaacacgaacccccatctcggccatgcggattgctggacgaggatgggtccgagcctctccccggaccccgaggggaggtgcctggcggatccgcccactacggcgggcccagtcccgaaaagaaagctaaaagctccagcggtggcagctccctggcgaaggggcgtgcctcgaaaaaacagcaattgttagccacagctgcccacaaagattcgcagagtatcgcaaggtttttttgtcggcgggtggagtcccccgccctgctggcaagcgcgcctgaggccgaaggcgcatgtccatcatgtgagggcgtgcaaggacccccgatggccccagaaaagtacacaggtgaggaggatggcgcaggaggtcattcccctgctcctccccagactgaagaatgcctgagagagcgcccttctacttgccctccccgggatcagggtaccccagaggtgcaacctacaccggccaaggatacctggaagggtaagcggcccagatcacaacaggaaaatccagagagtcaaccgcagaaaaggcctaggccatcggctaagccttcagtggttgctgaagtgaagggatctgtgtctgcctcggaacagggcacgctgaacccaacggctcaggatccgttccaactgtccgcccccggagtatccctgaaagaggctgccaacgtcgtggtcaagtgtctgaccccgttttataaggagggcaaattcgcatccaaggagttgtttaaggggttcgccaggcacctgtcccacttactgactcaaaagacatcgccaggacggagtgtcaaagaagaggcccagaatctaattcggcacttcttccatggtcgtgcccgatgtgaaagcgaggcagattggcacggtttgtgcggccctcagcgatag

SEQ ID NO: 131994 - DNA, 1308 bp, Artificial Sequence
  Description of Artificial Sequence: Synthetic coding sequence
atgtctagccaccacacaacctttcccttcgatcctgagaggagagtccgttccacacttaagaaggtgttcggtttcgattcatttaagactccgttgcaggagtctgccactatggccgtggtcaagggcaataaagatgtgtttgtatgcatgccaacaggagcaggtaagagcctgtgctatcagcttccagctcttctcgcaaaagggatcaccatcgttgtgtcccctctgatcgcacttatacaggaccaggtggatcacctccttactctcaaggttcgcgtttcatccctcaactctaagctgtccgcccaagagaggaaggagctgttagctgacctagagagagagaagcctcagacaaagatcttgtatatcactcctgaaatggctgccagtagttctttccagcctactctaaatagcctcgtatccagacacttactctcctacctggtagtagatgaggcccattgtgtgtcccaatgggggcatgatttcaggccagattatttgagactgggtgcactccgtagtagactcgggcacgcaccttgtgtggcgctgacggctacagctacgccccaagttcaagaggatgtgttcgcagccttgcacctgaagaaacccgtcgcaatcttcaagacaccctgtttcagagcaaaccttttttacgatgtccagtttaaggagctcattagcgatccctatggcaacctcaaggacttctgccttaaggcccttggccaggaggcagataagggtctctcagggtgtggcattgtgtactgtaggactagggaagcctgcgagcaactggcaatagagctgtcgtgtagaggtgtgaatgcaaaagcgtaccacgcaggactcaaggcttctgagcgcacattggtacagaacgattggatggaggagaaggtacctgtgattgtggccacaatcagtttcggcatgggcgtagataaagccaatgtgagattcgtagcccactggaacattgctaagagtatggctggctattatcaggaatcggggagggctgggcgcgatggcaaaccctcgtggtgtaggctgtactattctagaaacgatagagatcaagtgtcttttctcatcagaaaggaggtggccaagttgcaagagaagagagggaataaagcttcagataaagccacaataatggcctttgatgccctggtcactttctgtgaggagctcgggagatgggggcggggacacggcaaatccctgcgtgctgcatggtgctcccaggtcgtcagtcgacatgccgagctgtag

SEQ ID NO: 131995 - DNA, 1233 bp, Artificial Sequence
  Description of Artificial Sequence: Synthetic coding sequence
atgtcctctcaccataccacattcccgtttgatcctgaaagacgggtcaggagcaccctcaaaaaagtgttcgggttcgacagctttaagacgcccctgcaggaaagcgctactatggcagtcgtgaagggcaataaagacgtattcgtgtgtatgcctacaggggccggcaagtccctttgctatcagctgccagcactgttagcgaaaggtatcaccatcgtggtttcccccttgatcgctctaatacaggaccaggtggatcacctgctaactttgaaggtccgtgtgagctctttgaattcaaaattatccgcacaggagcgaaaggagctgttagcagatctcgaacgggaaaaacctcagactaagattctctacatcaccccagaaatggcagccagtagttcttttcagcctaccttgaacagcctcgtgtcccgacaccttctgtcatacctggtggttgatgaggcgcattgtgtaagccagtgggggcatgattttcgtccggattatctgcgcctgggagccctgaggagcagactaggccacgccccgtgcgtggcactgacggctacagccacaccccaggtgcaggaagatgtattcgccgccctgcacctcaagaaacctgtggctatttttaagacgccttgtttcagggccaatctcttttacgacgtccagtttaaagaactgatcagcgacccctacggaaacctgaaggacttctgcctcaaggccctgggccaggaagccgacaagggcctgtctggatgcggcatcgtgtattgtagaaccagagaggcatgtgagcagctggcaatcgaactttcttgcaggggcgtaaacgccaaggcctaccatgccggactgaaggcaagtgaacggaccctggtacagaacgactggatggaggagaaagtcccagtaatcgtcgccaccattagctttggtatgggagtcgacaaagccaatgtacgcttcgtggcccactggaatattgccaaatcaatggctgggtattatcaggagtccggccgagccggacgagacggaaaaccatcgtggtgcagactatattattcgaggaatgaccgcgatcaagtgagttttctcatccgcaaggaagtcgctaaactgcaggagaagcggggaaataaggcctctgacaaggccaccataatggcttttgatgccctggtcacattctgcgaggaactgggatag

SEQ ID NO: 131996 - DNA, 3057 bp, Artificial Sequence
  Description of Artificial Sequence: Synthetic coding sequence
atgtcttcccatcacaccacatttcccttcgaccctgaaagacgggtgagaagtactctcaagaaggtctttgggtttgatagctttaagactccgctgcaggagagcgctacaatggctgtggtaaaaggcaacaaggatgtgtttgtgtgcatgcctacgggagccgggaagagtctttgctaccagttgcctgcgcttcttgctaagggcatcactatcgtagtttctcccttaattgctcttatacaggatcaggtcgatcacctccttacattaaaagtgagagtgtcttctctgaacagcaaactgagcgctcaggagcgaaaggaattattggccgatctggagagggagaagccacagaccaaaattctgtatataactcctgaaatggcagcttcatcctcttttcagcctacactgaactctcttgtatcaaggcacctcctgtcatatctcgtcgtggacgaagcccactgtgtttctcagtggggccacgattttcgtccagactacctccgtctgggcgccctaaggtcaaggctgggccacgcaccgtgcgtcgctctgacagctaccgccactccccaagtgcaggaggacgtcttcgcggcccttcatctcaagaaacctgtggccatatttaagacaccgtgctttcgcgcaaacttattttacgacgtgcagtttaaggagttaatatcagacccctacgggaacttgaaggacttttgtctcaaggcattgggacaggaagccgataagggtctctcaggatgcggcattgtctactgcagaacccgggaggcctgtgagcagctggcaatcgaactgtcatgccggggcgtaaatgccaaggcctaccatgccgggctgaaggcatcagagcgaacactagtacagaatgactggatggaagagaaggttccggtcatcgtcgccaccattagcttcgggatgggcgttgacaaagccaatgtaagattcgtggctcactggaatatcgcgaagagcatggctgggtactatcaagagagtggacgtgccggccgtgatgggaaaccctcttggtgccggctatattatagccgcaatgatcgagaccaggtcagttttcttataaggaaagaggttgccaaactacaggaaaagagggggaataaggcttcagacaaagcaactattatggcattcgatgcactagtgacgttttgtgaggagcttggctgccgccacgccgccatcgcaaaatacttcggtgatgcgcttcctgcctgtgccaaaggatgtgaccattgtcagaaccccacggccgtcaggaggcggctcgaggcgcttgaacggagctcttcatggtctaagacttgcatcgggccatcccagggcaatgggtttgaccccgagctctacgaagggggacggaagggatacggcgactttagccgatatgacgaaggaagcgggggatcaggggatgagggtagggatgaagcccataagcgtgaatggaatctgttctaccagaagcaaatgcagctcaggaagggcaaagatcctaagatcgaggaatttgtgcctcccgacgaaaattgccccctgaaagaagcaagttctcgacgaatccccagactgactgttaaggcccgagagcactgcctgcgcctcctggaggaggctctcagcagcaaccggcagagcacccgaaccgccgatgaggcagacctccgagcgaaggcagtagagcttgagcacgaaacttttaggaacgccaaagtggcaaatttatataaagctagtgtcctgaagaaggtggcagacattcaccgggcatcaaaagatggccagccctatgacatgggtggctcggcaaagagctgtagcgcacaagctgaacctcctgagcctaatgaatacgatattcctcccgcgagccacgtgtattccttaaagccaaagagagttggtgccggctttcccaaagggtcctgtccattccagaccgcgaccgaactcatggagacgacgcggattagggaacaggctccccagcctgagaggggcggggagcatgaacctcccagccggccttgcggcctcctggacgaagatggcagtgaacccttgcctggcccacgaggagaggtgccaggaggttccgcacactacggcggtccttcccctgagaagaaggcgaagtcgtcctcgggaggctcaagcttggctaaaggcagggccagcaagaagcagcaactgctggccaccgccgcgcataaggactcccaatctatcgcgaggtttttttgtagaagagtcgaatcccccgccctgctcgcctccgcaccggaagccgaaggcgcatgccctagttgcgagggcgtgcaagggcctcctatggctcccgaaaagtatacaggcgaggaagatggagccgggggccattcgcctgccccaccgcaaaccgaagaatgcctgcgggaacgaccgtcaacatgcccgcccagggatcagggcacccctgaagtccagcctactcccgccaaggacacttggaagggcaagagaccaaggtcgcagcaggagaaccccgagagtcaaccccaaaagcggcccaggccttccgcgaaaccgagcgttgtggcagaggtgaagggctctgtgagtgcctctgaacagggaaccctgaaccccactgcccaagatccatttcaactatccgcacctggggtctcgctcaaagaagccgccaacgttgtggtaaagtgcctgacacccttctacaaagagggcaaatttgcctctaaagagctgttcaaaggattcgctcgacacctctcacacctccttactcaaaaaaccagccccggacgatcggtcaaagaggaggcacagaatctgattcggcacttcttccacggacgagccagatgtgagagcgggccccacgggtgggttttctgggacacatgtagaggccaaaaggtcgaaggaggaggagcagctgccggacggaggggacggaagtcaggtccttctccctcctcgaagtctggctag

SEQ ID NO: 131997 - DNA, 1761 bp, Artificial Sequence
  Description of Artificial Sequence: Synthetic coding sequence
atgttcctggttagatgcagacacgcagcaatcgcaaagtatttcggcgacgctctgcctgcctgcgcgaaggggtgtgatcactgtcagaatcccacagccgtgaggcggcgtttggaggcactggagagatcaagttcctggagcaagacctgcataggaccatcccaaggcaatggattcgatcccgaactttacgaaggcggacgcaagggttatggcgacttctcacgatacgatgagggatctgggggatccggggacgaaggtagagacgaggcccataaacgtgagtggaacctgttttatcagaaacagatgcaactgcgcaagggaaaagatcccaaaattgaggaattcgtgcctcccgatgagaactgtccgctgaaagaggcttcatcccgccgcatacccagactcaccgtcaaggcgcgtgagcactgcctgaggctactggaggaagcgctttctagcaataggcaatccacccggaccgccgacgaggctgacctgagggccaaagctgtcgagctggagcacgaaaccttcagaaatgcgaaagtggctaacctctacaaagcatccgtcctcaaaaaggtggctgatatccacagggcaagtaaagacgggcagccctatgacatgggcggctccgccaagtcttgctctgcacaggccgaacctcccgaaccgaatgagtacgatattcctcccgcaagtcatgtttattccctgaagcctaaacgtgtcggcgctgggttccctaagggcagttgccctttccagacagctaccgagctgatggaaactactagaataagagaacaagccccgcagcccgaaagaggcggtgaacacgaacccccctcccgcccctgcggacttctggacgaagacgggagcgaaccactgccggggcctcgaggtgaggtgcctggaggctccgctcactatggtggccccagcccagagaaaaaggcaaagtcatcgtccggagggtctagccttgccaagggtcgtgcaagcaagaagcagcagctcttggctacagccgcccataaagattcgcaatccatagccaggtttttctgtagacgagtggaaagccctgcccttctcgcctctgcccccgaggccgaaggcgcctgccccagctgcgagggcgtccagggaccgcccatggctccagagaagtatacgggtgaggaagatggcgccggcggacactccccagccccaccacagacagaggaatgccttcgcgagaggccctcaacgtgtccacctagggatcagggcacccccgaggtccagcccacacccgccaaagacacctggaaaggcaagaggccgcggtctcaacaagaaaacccagaatctcaaccccaaaagagaccacgcccatctgccaaaccatcagtggtagctgaggtgaagggatccgttagtgcctccgagcaagggaccctgaatcccacggcccaggacccctttcagctctcagcccctggtgtgagtttgaaagaagcggccaacgtggtcgttaaatgtttaacgcctttttacaaggaaggcaagtttgccagcaaggaattatttaaagggtttgcccgacatctgagccacctgctcacacaaaaaacctcccccggccggagcgtgaaggaggaggcccagaacctgattcgccatttcttccacggcagagcccggtgtgagtccgaggcagattggcacggcctgtgtggacctcagaggtag

SEQ ID NO: 131998 - DNA, 1200 bp, Artificial Sequence
  Description of Artificial Sequence: Synthetic coding sequence
atggcgcaaagggctttcccaaacccttacgcagattataacaagtcactcgcggagggatacttcgatgccgcgggacggctcactcccgagttttcgcagagactgaccaacaagatcagagaactgttgcaacagatggaaagaggcttaaagtccgcagacccccgggatgggaccggctatacggggtgggctgggatcgccgttctctacctgcacctgtacgacgtatttggggacccagcttacctgcaattggcccacgggtacgtgaagcaaagcctgaattgccttacaaagagaagcatcacattcttgtgcggtgacgccgggcccttggctgtggccgctgtcctctatcataagatgaacaacgaaaaacaggccgaggattgcatcacgcggctcattcacttaaacaagatagaccctcacgcccctaatgagatgctgtatggccgcatcggctacatctacgccctcctgttcgtgaacaagaattttggagtggagaaaattccccaaagccacatccagcagatttgcgaaacaatcctgactagtggagaaaatttggcacggaagcgcaactttaccgccaagtccccgctcatgtacgaatggtaccaggaatactatgtgggtgcagctcacggcttggccggcatctactattacctgatgcagccgtcattacaagtgtcacagggaaaactgcattctttggtgaagcctagtgttgattatgtgtgccagctgaagttcccctctggcaattaccctccgtgtattggcgacaatcgagatttgctggtacattggtgccatggggccccgggcgtgatttacatgctcattcaagcatataaagtctttcgagaggagaagtacctttgtgatgcttaccagtgtgccgacgtcatatggcagtacggcctgctcaagaaaggttacggcctctgccacggatctgccggcaacgcatatgcgttcctcacactctataatctgactcaggacatgaaatatttgtaccgggcatgtaaattcgcagaatggtgtttggagtacggtgaacatggatgcaggacaccagacacccccttcagtctttttgagggcatggccgggactatatactttctggccgatctgctggtgccgactaaagctcgctttcccgcattcgaactgtag

SEQ ID NO: 131999 - DNA, 528 bp, Artificial Sequence
  Description of Artificial Sequence: Synthetic coding sequence
atgctgcccccaatggcccttccttcagtgagctggatgctccttagctgcctgatcctgctctgtcaggtgcagggagaagagacgcagaaagaacttccttctccaaggatttcctgccccaagggcagtaaggcttacggtagtccatgctacgcattgtttttatctcccaaaagctggatggatgcggacctggcatgtcagaaaagacctagtggcaagctcgtgagcgtgctgtcaggggcagagggcagcttcgtgtcatcattggtgaggtctatcagcaatagttattcctacatctggattggtctgcacgacccaacccagggcagcgagccggatggggacgggtgggaatggtcatccacggatgtcatgaactactttgcgtgggagaagaacccctctactatactgaatccagggcattgcggttccctgtcccggagcacaggcttcttgaagtggaaggattacaattgtgacgctaagttgccgtatgtctgtaagtttaaggactag

SEQ ID NO: 132000 - DNA, 528 bp, Artificial Sequence
  Description of Artificial Sequence: Synthetic coding sequence
atgctgcctcctatggccctgccttctgtgagttggatgctcctgtcttgtctcattcttctgtgtcaggttcagggcgaggagacccagaaggaactgccttcccctagaatcagttgccccaaaggtagcaaggcctacggatccccatgttatgctttattcctgtcccccaagtcatggatggatgctgacctggcctgccaaaagcgcccatctggcaagcttgtctcggtgctttccggggcagaaggaagtttcgtctcaagtttagtccgttcaatcagcaattcctattcctatatttggattgggctacacgatccaacgcagggcagtgaaccagacggtgatggatgggaatggtccagcaccgatgtcatgaactacttcgcatgggaaaagaacccaagtacgatcctgaatcctggacactgtgggagcctgtctcgtagcaccggcttcttaaaatggaaggattataactgtgatgctaaactgccttacgtttgcaagtttaaagattag

SEQ ID NO: 132001 - DNA, 390 bp, Artificial Sequence
  Description of Artificial Sequence: Synthetic coding sequence
atgttgccacccatggccttacccagcgtctcatggatgctgctctcctgcctcattctgctgtgtcaagtacagggagaggaaactcaaaaagagttgccaagtccccgtatctcctgccctaaaggctcaaaagcctatgggagtccctgctacgctctatttcttagccccaagtcctggatggatgctgatgggtcggaaccagacggtgatggatgggagtggtcttctaccgatgttatgaattactttgcctgggaaaagaacccttccacaattctcaaccccggtcattgcggaagtctgtcccgttcgaccggattcttaaagtggaaggactataattgtgatgctaagctcccttacgtctgcaagtttaaagattag

SEQ ID NO: 132002 - DNA, 477 bp, Artificial Sequence
  Description of Artificial Sequence: Synthetic coding sequence
atggccagtaggtccatgcgtctgctgctgttactctcctgtcttgccaaaactggagtgctgggagacatcataatgcggccaagctgtgccccagggtggttttatcacaagagtaattgctacggctattttagaaagctacggaactggtcggatgctgagttagagtgccagagttacggtaatggcgctcatctggcctcaatcctgtctctcaaggaggcctctaccatagccgagtacatcagcggataccagcgcagccagcctatctggatcggcttgcatgaccctcagaagcgacagcagtggcagtggattgacggcgcaatgtacttgtacagatcttggtcgggcaagtccatgggcggaaataagcactgtgcagaaatgagttcaaacaataacttcttaacctggtcctcaaatgagtgtaacaaaagacaacactttttgtgcaagtacaggccctag

SEQ ID NO: 132003 - DNA, 477 bp, Artificial Sequence
  Description of Artificial Sequence: Synthetic coding sequence
atggccagcagatctatgcgattactccttctgctgtcctgcctggctaagacaggggtgctgggcgacataatcatgagaccctcatgtgcgcctgggtggttttatcataaatctaattgttatggctactttcgtaaattgaggaattggagcgatgccgagctcgaatgccagagctacggtaacggcgcgcacctggcttccattttatctttaaaagaagcttcaacgatcgcggagtatatttccggttatcagcgatctcagcccatatggataggcctgcatgacccacagaaacggcaacagtggcagtggattgatggcgcaatgtacttataccggtcttggagcggaaagagtatgggggggaacaagcactgcgcggagatgagcagtaacaataatttcttgacctggtcatctaatgaatgtaacaagcggcagcactttctgtgcaaatatcggccctag

SEQ ID NO: 132004 - DNA, 405 bp, Artificial Sequence
  Description of Artificial Sequence: Synthetic coding sequence
atggctagccgatccatgcggctccttcttctgctctcttgtctagctaagacaggcgtcctcggcgatattattatgcgcccctcgtgcgcccccggctggttctatcacaagagcaattgctacggatattttagaaagctgcggaactggtccgatgccgaggtccgtaaccttcttcccgcatggcctggtctatctagagccaaagatcaaccagagccacagatttctttcgactcaggtagttccgttctgcccggccattacgaggagaagcctttgtggctcgttaagtggagggaagagggatgtgtattcaacagttttaatagtgtgtccatcgcagaggccggcgccgtctgccagacactggatggactccaggcccacacagacacatag

SEQ ID NO: 132005 - DNA, 375 bp, Artificial Sequence
  Description of Artificial Sequence: Synthetic coding sequence
atggcgtcccggtccatgcgtctgctgctgctcttgagctgtctcgcaaaaactggcgtattgggggatatcattatgcggccctcctgtgcaccgggatggttctaccacaagtcaaattgctacgggtatttccgaaagttaaggaactggagtgacgctgagcttgaatgccaaagttatggcaatggagcccatctagcgtcgatcctgagcttaaaggaagcctcgacaatagcagagtatatctcaggataccagcggagccagcctatctggattgggcttcatgacccccagaagcagccactgaactcctgtctgttctttttgtggccgtgggagggcctgccagtggagtcactgctggggtag

SEQ ID NO: 132006 - DNA, 900 bp, Artificial Sequence
  Description of Artificial Sequence: Synthetic coding sequence
atgtcaagtatcaaaattgagtgtgttctccccgagaattgccgctgcggcgagtcacccgtatgggaagaagtgagtaattctctactgttcgtggatattcctgctaaaaaagtctgtcgatgggactctttcacaaaacaggtgcagagagtcaccatggatgcgccagtgagctctgtggctctgcggcagtcaggggggtacgttgcgactatcggcaccaagttttgtgctctgaattggaaggagcagtctgccgtggttctcgccacagtcgacaacgacaagaagaacaataggttcaatgatggaaaagtcgatcccgcaggaaggtatttcgccggaaccatggcggaggaaactgccccagccgtcttggagagacaccagggcgcgctctatagtctcttcccggatcaccacgtaaaaaaatactttgaccaggtggacatttctaacggtctagactggtcactggatcataaaattttctactacatagacagtctatcatactctgtagatgcttttgattacgatctccagacgggccagatctccaacagacggtctgtctacaagttagaaaaggaagagcagatcccagacgggatgtgcatcgatgccgaggggaaactgtgggtcgcctgttataacggaggacgcgtgattcggttggatcctgtcacagggaagaggctacagacggtgaagttgcctgtagacaagacaacctcttgttgcttcggcgggaagaattattctgaaatgtatgtaacttgcgcgcgagacgggatggatcccgaaggactccttcggcagcctgaggctggagggatctttaaaattacaggattgggcgtgaaaggtatcgctccatactcatatgctggctag

SEQ ID NO: 132007 - DNA, 900 bp, Artificial Sequence
  Description of Artificial Sequence: Synthetic coding sequence
atgtccagtattaaaatagaatgtgtcctgccagaaaattgcaggtgcggagaaagccctgtgtgggaagaagtcagcaactccctcttatttgtggacattccagctaagaaggtgtgccggtgggattcattcaccaaacaagtccagagagttacaatggatgcccccgtctcctccgtggctcttaggcagtccggaggttacgttgctacgattggaaccaaattctgtgcgctgaattggaaagaacagtctgccgttgttcttgccactgtcgataacgacaagaagaacaaccgattcaacgacggaaaggttgatccagcgggccgttacttcgccggcacgatggcagaagagacggctcccgcagtactcgaaaggcatcagggcgccttgtactctctcttccccgatcaccacgttaagaaatactttgaccaggtcgatatctcaaacggattggattggagcctcgaccacaaaatattttactatatcgacagcctttcttatagcgtggacgcctttgattacgacctgcaaaccggccagatcagcaatcggcggtctgtttacaaattggagaaggaagagcagatccctgacggcatgtgcatcgatgcagagggcaagttgtgggtagcatgttataatggaggacgcgtgataaggctcgaccccgtcaccgggaaacgattgcagactgtgaaactacctgtcgataaaactacctcttgttgttttggtgggaaaaattactctgagatgtacgtaacttgcgctcgcgacggtatggatccagaagggctgctgcgccagcccgaggcaggcggtatctttaaaatcacaggattaggagtgaagggcatcgccccatactcatacgcagggtag

SEQ ID NO: 132008 - DNA, 900 bp, Artificial Sequence
  Description of Artificial Sequence: Synthetic coding sequence
atgtcgtcaataaaaatcgagtgcgtactgccagaaaattgccgttgcggcgaaagcccagtgtgggaggaagtttccaattctctcctgtttgtcgacatcccagccaagaaggtgtgcaggtgggacagctttactaagcaggtgcagagagtaacgatggacgctccagtgtctagtgtcgctctgcgccagagcggagggtatgtcgctacgattggaacgaagttctgtgccctgaactggaaggagcagtcagccgtcgtgctggcaaccgtcgacaacgacaagaagaataatagatttaatgatggtaaagtggacccagccggcaggtatttcgctggcaccatggctgaggagacagcacctgccgtcttagaacgccaccagggggctctgtatagcctcttccccgatcaccacgtgaaaaaatattttgatcaggttgacatctctaatggcctcgactggtccttggatcataagatcttttactacattgactcactgtcttactccgtggatgccttcgattacgacctgcagacaggccaaatcagtaaccggcgtagcgtttataaactggaaaaagaggagcagattccagacggcatgtgcattgacgctgagggcaagctgtgggttgcttgttacaacggagggagggtcattagactggatcctgtgacgggcaagcgactccagaccgttaagctgcccgtggacaagacaacgtcttgttgctttggaggcaagaactattccgagatgtacgtcacttgtgcacgggatggcatggaccccgagggcttgctgagacagccagaggcaggaggtatttttaaaattaccggtctaggagtgaaaggcattgcgccctactcatatgctggatag

SEQ ID NO: 132009 - DNA, 684 bp, Artificial Sequence
  Description of Artificial Sequence: Synthetic coding sequence
atgagcagcatcaagatagagtgtgtgcttccagaaaactgtcggtgtggtgaatcgcccgtgtgggaagaagtttcaaattctttacttttcgtggacatacccgcaaaaaaagtttgccgttgggattctttcaccaaacaagtacagcgagtaaccatggacgcacccgtgtccagtgtggccctgcggcagagcggaggctacgttgccactatcgggaccaaattctgtgccttaaactggaaagagcaatctgccgtggtcctagccacagtggataacgacaaaaaaaataatagatttaacgatggcaaggtcgatccagcaggacgttattttgcagccaatagacgcagtgtttacaagctcgaaaaggaagagcagatcccagatggcatgtgcattgatgcagaaggaaaattgtgggtggcatgctataacggcggccgagttatcagactggacccggtgacaggaaagagactccagaccgtgaagttgccagtggataagaccaccagttgctgctttggcgggaaaaattatagtgagatgtacgtgacctgtgcccgcgacggcatggatcctgagggcctgctgaggcaacctgaagcaggcgggatctttaaaatcactggtttaggagttaaaggcatcgcaccttactcttacgccggatag

SEQ ID NO: 132010 - DNA, 3876 bp, Artificial Sequence
  Description of Artificial Sequence: Synthetic coding sequence
atgtcaagcgccgtgggccctcggggcccacgccctcccacagtcccccccccaatgcaggagctgccagacctgtcccacctcactgaagaagagaggaatatcattatggcagtcatggaccgacaaaaggaggaggaggaaaaagaggaagcgatgctgaaatgtgtggtgcgggatatggctaaaccggcagcatgtaagaccccacggaatgctgagaaccaaccacaccagccgtcacctaggctgcatcaacaattcgagtcttataaggagcaagtgagaaagatcggagaggaggcgagacggtaccagggcgaacataaagacgacgccccaacttgcgggatctgccacaaaactaaatttgccgacggctgtggccacctgtgctcatattgtcgaactaagttttgcgctcggtgcggcggccgcgtgtctctgaggagtaataatgaagacaagtatgttatgtgggtgtgtaacctttgcagaaaacagcaagagatactgaccaaatccggtgcctggttcttcggcagcgggccccaacagacgtcccaggacggaacattgagcgataccgcaaccggtgctgggtctgaggtgcctcgtgagaagaaagcgaggctgcaggagcggtcccgttcccagactcctctgtccaccgcggcagctagtagccaagacgccgctcccccatcagctccacccgaccggtcaaaaggagccgagccttcccagcaggccctgggtcccgagcaaaagcaggcgagctctaggagtcgctccgagccaccacgcgagcggaaaaagaccccaggcctgtcagagcagaacggcaaaggggccctgaagagtgagagaaagcgggtgcctaagacttctgctcagccagttgaaggcgccgttgaggagagggagcgcaaagagaggcgagagagcagaaggctggaaaaagggagatctcaggactacccagacacgcctgagaaacgggacgaaggaaaggctgctgatgaggagaaacagcgtaaggaagaggactatcagacacggtaccggagcgatcctaaccttgccaggtatcctgttaaacctccccccgaagaacaacagatgcgcatgcacgccagagtcagtagagcgagacatgaaagaagacatagcgatgtggccctgcccagaacagaagccggcgcagctcttccagagggaaaggcaggaaaacgagcccctgccgctgccagagctagccctccggattcccctcgcgcatactcagccgagcgcactgcagagacaagagcgcccggcgcaaagcaactgactaatcactccccacccgcgcctagacatggaccagtgcctgccgaagctcccgaattaaaggcccaagaaccgctcagaaagcagtcacgcttggatccgtcttccgcagtactaatgaggaaagccaaacgggagaaggtggaaacaatgctgcgaaatgactccctgtcgtctgaccagtctgaatccgtgcgcccctccccacccaaacctcaccgcagcaaacggggcggcaagaaacggcagatgtccgttagctcttccgaggaagagggtgtaagtaccccagagtacacatcgtgcgaggatgttgaactcgaaagcgagtcagttagcgaaaaaggcgacttagactattactggcttgaccctgctacttggcattcccgggaaacctcacctatcagcagccatcctgtcacctggcagccctcaaaggagggcgataggcttataggacgagtaatattaaataagcgcacaactatgcctaaagacagtggtgcactgttaggcctcaaagtggtcggggggaaaatgaccgatctcggccgtctgggcgctttcatcactaaggtgaagaaaggttccctggcagacgtggtaggacacctgcgagctggtgatgaagtgctcgagtggaatggcaagcccctgccaggggctacaaacgaggaggtgtataatattatcctggaaagtaagagcgaaccgcaggtcgagataattgtatctagaccgatcggcgatatccccagaattcctgaaagcagtcatcctccactcgagtcaagttcaagctcctttgaaagccagaagatggagagaccttctatttcagtgatctctccgacaagccctggagctctgaaagatgcaccccaagtcctcccagggcagcttagtgttaagctctggtacgataaggtcggccaccagttgattgtgaatgtgttgcaggctacggacctgccagctcgggtcgatgggaggccccggaacccatatgtcaaaatgtacttcctgccggacagatcagacaagagtaagcgccggaccaagacagtgaaaaaaattcttgaacctaagtggaatcagacctttgtttatagtcacgtgcatcggagggacttcagggaacgcatgctggagataacggtctgggatcagcctcgagtgcaggaagaagagtccgaattcctcggcgagattctcattgagctggaaacggcactgctcgatgacgagcctcattggtacaagctgcaaacccatgacgaatcctccctccctctgcctcagccttcacctttcatgccgcggaggcacatacatggcgagagtagttctaagaagctgcagagatctcaacgcatctccgactccgacatctcagattacgaggtcgacgacggaataggtgtagtcccaccaggctaccgctcctctgcccgagaatcgaagagcaccacactgacagtgccagaacagcagcgcacaacgcaccaccggagcaggtcggtttctccccacagagggaacgaccagggaaagcctaggagccggctaccaaatgtgcccctccagaggtctttggacgagatccatcctactcgacgtagccgcagtcccactcgtcaccatgacgcctcacgatcaccggtggaccatagaacacgcgatgtcgactctcagtacctgagcgagcaggatagaatgcatcgtcagaggagcccaacacagtcaccacctgcggacacctccttcagcagcagaagaggaagacagctgcctcaagtgcccgtgcgtagtggctctatcgaacaagagtccggacataaaaagctgaagtctaccattcagagaagcactgagaccggcatggcagctgaaatgaggaagatggtacgacagccatccagagaatcaaccgatggatctattaattcttactccagcgagggaaacttaatcttccccggagttcgcctaggggccgattcccagttttccgatttcctggatggactgggcccagcccagctagtggggcgccagacactggccacccctgcgatgggggacatccagataggcatggaggacaaaaaaggccaattggaggtcgaggtgatcagggcccggtcattgacacagaaacccggatcgaagagcacccccgccccatatgtgaaagtgtatctgttggagaacggcgcttgtattgccaaaaaaaaaacccgcattgctaggaagaccttggatccactgtatcagcagagcttggtttttgacgaatcccctcagggcaaggttctgcaggtgatagtttggggagactacggtcgtatggaccacaaatgcttcatgggggtagcccaaatactgctagaagagctcgaccttagctctatggtcataggatggtataaactgtttcctccctcttcgctcgtcgatccaacactaaccccgttaaccagacgcgccagccagtcaagtctggagagctccactggacccccttgcataagaagctag

SEQ ID NO: 132011 - DNA, 4428 bp, Artificial Sequence
  Description of Artificial Sequence: Synthetic coding sequence
atgagttccgccgtcggaccaagggggccacgcccgcccactgtccccccccctatgcaggagctgcctgacctgtctcacctgactgaagaggagcgcaatattattatggcggtgatggatcgccaaaaggaggaagaagaaaaagaagaagcaatgttaaagtgcgtggtgcgggacatggccaagcccgcagcttgcaagactccgagaaacgccgaaaaccagccacatcagccaagtccccgactgcatcagcagttcgagagttacaaggagcaagttcgaaagatcggggaagaggccagaaggtaccagggcgagcacaaagacgacgcaccaacctgcggcatctgtcataagaccaaattcgctgacggttgtgggcacctgtgctcctactgccgcaccaagttctgcgctcggtgtggtggccgcgtgtccctgagatccaacaacgaagatatctgcgttatgtgggtctgcaacctgtgcagaaaacagcaggaaatccttaccaagtccggcgcgtggttctttgggtccggcccgcagcaaacctcccaagacgggactttgagtgatacggcaactggagccggtagcgaggtgcctagagagaagaaagctcgactccaggaacgctccagaagtcagacccctctgtctacggctgccgcctcctcccaggacgccgctccaccgtccgcaccaccggataggtcaaaaggcgccgaaccttcccagcaagccctgggccctgagcagaagcaagcgtctagccggtcaagatcggaaccaccgagggaaagaaagaagactcctgggctttccgagcagaacggaaagggggcactaaaaagtgagcgtaaacgcgtgccaaaaaccagcgcacagcctgtcgagggagctgtggaggagcgagaaagaaaggagagaagagagtctcggcgactcgaaaaaggccgatcccaggactaccctgatacgccagagaaaagggacgaaggcaaggccgccgacgaggaaaaacaaagaaaagaagaggactatcagacaaggtacagaagcgatccaaatctggcacgctacccagtgaaacccccgccagaggagcagcagatgcgcatgcacgctagggtgagccgagcccgacatgagaggcgtcacagtgacgtagcactgcccagaacggaagccggagccgccttacccgagggaaaggcgggaaaaagagcgcccgccgccgcacgggcaagccctcccgattcccccagagcctattccgccgagcggaccgcagaaacccgggcgccaggagccaaacagctgactaatcatagcccccccgctcccaggcatggacctgttccagcagaggctcctgagctgaaggctcaagaaccactccgaaagcagagccggctggatccaagctctgccgtgctcatgaggaaggcaaaaagggagaaagtggaaacaatgctccgcaacgattcactcagctcggaccagtccgagtcagtgcgccctagtccacccaaacctcacaggtctaagcgcggcggcaagaagagacagatgtcagtgtccagttccgaagaagagggcgtgtctactcccgagtacactagctgcgaagacgttgaacttgaatctgagagtgtgtctgagaaaggcgacttggactactattggctggaccctgccacatggcactctcgggaaacgtctcccatttcctcgcatcccgtcacgtggcagccttctaaggaaggcgaccgcctgattgggagagtcatactgaacaaacggacaacgatgcctaaagacagcggggcactgctaggattaaaagtcgttggcggtaagatgaccgacttaggccggctgggtgcttttatcaccaaggtcaaaaagggatcgttagctgatgttgttggccaccttagggccggtgatgaggtcctcgaatggaacggcaagccgctcccaggtgcaacaaatgaagaagtttacaacatcatcctggaatctaagtcagagccgcaggtcgagatcattgtgagcaggccaataggtgacatcccacgtatcccagaatcatctcacccacccctcgaatcatcatcaagctcttttgaaagtcagaaaatggagcgcccatccatttccgtgataagccccacctcacccggcgcacttaaggatgctcctcaggtattgcctggccaactgtctgtaaaactgtggtatgacaaggttgggcaccaacttatcgtgaatgttctgcaggcaacagacctcccggcgcgggtcgacggacgcccaaggaatccatacgtgaaaatgtacttcctcccagaccgaagcgacaaatccaagagacgcacaaagacggtcaaaaaaatcctggagccaaagtggaaccagacctttgtgtacagtcacgtgcacaggcgcgattttcgcgaaagaatgctggagatcacggtctgggatcagcccagagtccaggaggaggagagcgagtttctcggtgagattctgatcgagctggagactgccctccttgacgacgaaccacactggtacaagctccagacgcacgacgaaagttcgctcccactgcctcagccctcacccttcatgccccgaagacacatccacggcgagtcctcaagtaagaagttgcagagaagccaacgaatttctgacagcgacatatctgactatgaagtggacgatggaatcggcgtggtgccccctggataccgctcgagtgcgcgggagagcaagagtacaaccttgaccgtgcctgaacaacagcgcacgacccatcaccgctctcgaagtgttagtccacacagaggaaacgatcagggtaaaccgcggagccggctcccaaatgtcccattgcaaaggtccctggatgagatccaccccacccgaaggtctagatcccctacccggcaccatgatgccagccggtccccagttgatcatcgaacccgtgacgtggatagccagtatcttagcgaacaggactctgagctcttgatgctccctcgggcaaagcgcggtaggtctgccgagtgtttgcatactaccaggatgcacaggcaaagatcccccacacagtcgccacccgcggatacaagttttagcagccgaagagggagacagctcccacaggtgcccgtcaggtcaggcagtatcgagcaagcctccctggtcgtcgaggaacgaactaggcagatgaagatgaaggttcataggtttaaacaaaccacaggaagtggcagtagccaggagttggatcgcgagcagtatagcaaatacaacattcacaaggaccagtataggagctgcgacaacgtgagtgccaagagttctgacagtgacgtttctgacgtctctgccatttcacgcacttctagtgccagcagactatcatccaccagctttatgtccgagcagagtgaaaggccgcgggggagaatccgacgcatgggcacttcaggacgctccatcatgaagagcacctctgtgtcaggcgaaatgtacacgctggagcacaacgacggttcgcagagcgatactgccgtgggtacggtgggcgccggagggaagaagcgcaggtccagcttaagcgcgaaagtggtagctatcgtgtcgagaagatcgcgcagcacctcgcagctctcccagactgaaagcgggcataaaaaacttaaatcgacaattcagcggtcgactgagacgggcatggccgccgaaatgcgtaaaatggttaggcagcccagccgggagagcactgacggctcaatcaatagttattcttcggagggaaacctcatattcccaggggttagactgggggctgactcccaatttagcgatttcctggacgggctgggtcctgcccaactggtgggtcggcagactttggcaacacccgccatgggagacatccagattggcatggaggacaaaaaaggtcagttggaggtcgaggtgattcgagcccgctctttaacccagaagcctggctctaagagcacccctgcaccctacgtgaaagtgtacttacttgagaacggcgcatgcatcgccaaaaagaaaacccgaattgctaggaagaccctggatccgctgtaccagcagagccttgttttcgacgagagtccccagggtaaagtcttacaggtcatcgtttggggtgattatggtcggatggaccataaatgtttcatgggcgtggcacagatactgctcgaagagctcgacctgtcttcaatggttattggctggtacaaactgtttcccccgtctagccttgtcgatcctacactaaccccgctgactcgcagggccagccagagcagcctcgaatcctccactgggcccccctgtatccgcagttag

SEQ ID NO: 132012 - DNA, 4116 bp, Artificial Sequence
  Description of Artificial Sequence: Synthetic coding sequence
atgtccagtgccgtaggcccaagggggcctaggcctcctaccgtgcctccccctatgcaggaactccccgacctgagtcatctgaccgaagaggagcgaaacatcattatggccgtgatggatcgtcagaaagaggaggaggagaaggaggaagctatgttgaaatgcgttgtgagagacatggcaaagccggcggcatgtaaaactcccaggaacgctgagaaccagcctcatcaacccagtccccggttgcaccagcagtttgagagctacaaggagcaggtccgtaagataggagaggaagccagaagataccagggcgaacataaagacgatgcgcctacatgtggaatctgccataaaacaaagttcgccgacggatgcgggcatctgtgttcgtactgtcgaacaaagttttgtgctcgctgtggtggacgtgtgtcgttacggtcaaataacgagaacaagatagtcatgtgggtatgcaatctgtgcagaaagcaacaagagattttgactaagagtggtgcctggttctttggctcgggaccccaacagacatctcaggacggtaccctcagcgacactgcgacaggggcaggttcggaggtgccccgtgagaaaaaggcccggctacaggaacgaagtcggagtcaaacccctttgtcaaccgcagcagctagctcacaggacgcggctcccccatctgctccacccgacagaagtaaaggagccgaaccctctcagcaagctttggggcccgagcagaagcaggccagctctcgctctaggtcggagccaccaagagaaaggaagaagactcccggtctttccgagcaaaatggtaaaggagccctgaagtcagagaggaaacgggtcccaaagaccagtgcacagcctgtcgagggagccgtggaggaaagagaacggaaggagagacgagagagtcgccggctcgaaaaaggacgaagtcaggactacccagatacccccgaaaaaagggacgaaggaaaggccgctgatgaggagaagcagagaaaggaggaggactatcagacgcgctatcggtcagatcctaatctagcaagatatcccgttaagcccccccccgaagagcagcaaatgagaatgcacgcaagagtgtcacgagcgcgccacgagcgacggcactctgacgtggcgttgccaagaacagaggccggagcggcgttgcctgagggtaaggcaggcaaaagggcaccagcagcagcacgggcctcgcctcctgattctccacgggcctacagcgccgaacgtacggccgagacgagggcaccaggggctaaacaattaaccaatcatagccctcctgccccacggcatggcccagtgccagcggaagcccctgagctgaaggcacaggaacccctgcgaaaacagagccggttggacccaagctctgccgttctgatgcgaaaggctaagcgtgagaaagtggagacgatgctccgcaatgactccctatctagtgatcagagtgaaagcgtccgcccatcaccaccgaaaccacaccgttctaaaagaggcgggaaaaagaggcagatgtcggtatcaagctcggaagaggaaggggtgagtactcccgaatatacttcatgtgaagatgttgagttagagtcggagtctgtatctgaaaaaggcgatctcgactattactggctggatcctgcgacttggcactcccgggagactagccctattagttctcacccagtcacttggcagcccagcaaggaaggtgacagactgatcgggagagttattcttaataagcgcaccacaatgcccaaagactctggggcccttttgggcctcaaggtggtgggcggtaagatgacagatctgggccggctcggagcctttataaccaaagtcaagaaaggaagcctcgcagatgtagtgggacatctgcgcgccggagatgaagttttagagtggaatggaaagccacttcctggggctaccaacgaggaagtctacaatattattctggaatctaagtcagagccacaagttgaaatcatagttagcagacctattggcgacatcccaagaatccccgagagttctcatccgcctttggagtcctcaagttcgagctttgagagccaaaaaatggagcgcccaagcatctctgtcataagtccgacttcgccaggcgccctgaaagacgcgccacaagttttgcccgggcagctcagcgtgaaactgtggtacgacaaggtgggtcatcaattgatcgttaacgtcctgcaggccaccgatctccccgctagggtcgacggacggccacgaaacccatatgttaagatgtacttcctgcctgacaggtccgataaatccaagcgccgcactaaaaccgtgaaaaagatcctagagccgaagtggaatcaaaccttcgtctattcccacgttcaccggagggactttcgcgagaggatgctggagatcacagtttgggaccaaccacgcgtacaggaagaagaatccgaatttttgggcgagatcctgatcgaactggagacagcacttcttgatgacgagccacactggtacaaactgcagacccacgatgagtccagcctccccctgccacagccctcgccatttatgccaagacggcatatccatggggaatcctcaagtaaaaagctccagagatcacagcgaatatcagattccgacatttctgattacgaggtcgatgatggcatcggggtcgtccctccagttggttaccgaagttccgcccgagagtccaagtctactacacttaccgttcccgagcagcaacggaccacccatcatcgcagtaggagtgtaagtccacaccgcggaaatgaccagggtaaaccacgctcaagactgcccaatgtgccactgcaacggtctctcgacgagatccacccaacccgtcgttctcggagtcccacgcggcatcacgacgctagtcgctcaccagtagatcaccggactcgcgatgtcgattcccagtatttgagcgaacaggacagcgaactcctgatgttgcctagagccaaacgcggcagatcagccgagtgtttgcatactacatcggagctgcagccttttctggatcgggccaggagtgcttccaccaactgcctgaggcccgatacgagcctgcatagcccggaaagagagcgggggcgatggagccccagcctggatagacgacggccccccagcccaagaatccagatccaacacgcatcccctgagaatgatcgaatgcatcggcagcggtctcccacgcagtccccacccgccgataccagtttttcatctcggaggggccgccagcttccccaagtgccagtgcgcagtggcagtatcgagcaggagtccggccacaagaagctcaagtccaccattcagaggagtactgagaccggaatggcagccgagatgcgtaagatggttcgacagcctagtcgcgagtcgacggacggttccattaacagttactcatctgagggcaacttgatttttccaggagttaggctgggggcagacagccaattctctgactttctcgacggcctaggaccagcccagcttgttggaagacagaccctggcaaccccagctatgggagacatccagattggcatggaagacaaaaaaggccagctcgaggtcgaggtaatccgtgcgcggagcctcactcaaaaacctggctccaaaagtacgcccgccccctacgtgaaggtctatttactagaaaacggggcctgcatcgctaagaagaaaaccaggatagctcgaaaaacactggaccccctgtatcagcagtcactggtctttgatgaatcgcctcagggaaaagttcttcaggtgattgtgtggggggattatggccggatggaccacaaatgttttatgggtgtggctcagatcctattggaagaactggacttaagcagcatggtaattggctggtacaagctttttccaccaagctctttggttgatcctaccctcacaccacttacccgccgcgcaagccagagctctctcgagtctagtaccggccctccttgtatcaggagctag

SEQ ID NO: 132013 - DNA, 4626 bp, Artificial Sequence
  Description of Artificial Sequence: Synthetic coding sequence
atgtccagtgccgtcgggccacggggccccagaccaccaaccgttcccccaccaatgcaggagctcccagatctttcccacctcaccgaggaagaacggaatatcattatggctgtcatggatcgccagaaagaggaggaggagaaggaagaagccatgctaaagtgtgtcgtgagagacatggcaaaaccagccgcttgcaagactcccagaaacgcagaaaatcaacctcatcaaccctcaccaagactgcaccagcaattcgagtcctacaaagaacaggtgcgcaagatcggcgaggaggcgagaagataccaaggcgaacataaggacgacgctccgacctgcgggatttgccataagacgaaattcgcagacggctgtgggcacctgtgctcctattgtcgcaccaagttctgcgcaagatgcggcggccgcgtctctctcagaagcaataacgaggataagtatgttatgtgggtgtgcaacttgtgtagaaaacagcaggaaattctgaccaagagtggggcatggttctttggctccggtccacagcagaccagtcaggacggcaccctgtcagataccgccacaggcgcagggtctgaggtgcctcgagagaagaaggccagattacaggagagatctaggagccagaccccgctctcaaccgccgcagcgtcgtctcaggatgctgcccccccttccgcccctcctgatagatcaaagggggctgaaccaagccagcaggcgctgggccccgagcagaagcaggcatcatcacgctccaggtctgaaccgcctagggaacggaagaaaacccctgggctgagtgagcagaacggaaaaggagcacttaaatctgagcggaagcgggtcccaaaaacttcggcacagccggtcgaaggggccgtagaggagagggagcggaaggaaagacgggaaagtcggagactggaaaaaggtagaagtcaggattacccagacactccagagaaaagggatgagggcaaggccgccgacgaggaaaagcagcggaaggaagaggactaccagactcggtataggagcgatccaaatctcgccagataccctgtgaagccacccccggaggaacaacaaatgaggatgcacgcacgcgtttcacgggccaggcacgaacgacgccactcggacgttgccctgccacggacagaagcgggagccgcacttccagaggggaaagcgggtaagcgagctcccgccgccgccagagcaagtccacccgatagccctcgggcctatagcgctgagaggactgctgagacacgcgctcctggtgcaaagcagctgaccaatcactccccaccggccccccgtcatggtccagtgccagcagaagccccagagttaaaggcccaagagcccctaaggaagcaaagccggctcgacccaagcagtgccgtactgatgcgaaaggccaagagggagaaggtagagactatgttaagaaatgactccctaagctcggatcaaagcgaaagcgtgcgaccaagtccccccaaaccacacaggtccaaaagagggggcaaaaagaggcagatgtctgtctctagttccgaagaagagggggtgagcacaccagagtatacatcatgcgaggacgtggaactggagagcgaatctgtgagtgagaagggggatctggattactattggctggatcccgcaacatggcactccagggagacatctccaattagttcccatcctgttacatggcagccttctaaagagggcgatcgcctcattgggagggtcatcttgaacaaacgtaccacaatgccaaaagacagcggtgctctgctgggtctgaaagtcgtgggtggcaagatgacagacttgggcagactgggtgcttttatcaccaaggtgaaaaaggggagcctggcggacgtggtgggtcacctcagagccggcgacgaagtgttggagtggaatggtaagccactgccaggcgcaaccaatgaagaagtgtacaatattatcctggagtctaagagtgaaccacaagtcgaaattattgtctcccggcctataggcgatatccctcggatccctgagagtagccaccccccactggagtcctcctcttcgtccttcgagtcccagaagatggaacggccaagcatttctgtgatctcacccaccagccccggcgccttaaaggacgcaccacaagtactgccaggccagctgagcgtcaagctttggtacgataaagtgggccaccagctgatcgtcaacgtgctccaagccaccgacctgcccgcgagggtggacggtagaccacgcaatccatatgtaaagatgtactttctcccagacagaagtgataagagtaagcgccgaacaaaaacggtcaaaaagattctggaacctaagtggaatcaaacctttgtttattctcatgtgcaccggagggacttccgagaaagaatgctggaaataaccgtctgggatcagcccagagtccaggaggaagaaagcgagtttcttggcgagatactcattgagctggagacggcattgctggatgatgagccgcactggtacaaactgcagactcacgacgaaagttccctgcctttgcctcagccttcccccttcatgcctcgacgacatatacacggagagtcgtcctcaaaaaaactccaaaggagccaacgaatcagcgattcagacatctctgattacgaggtggatgatgggattggcgtggtgccccctgtcggatatcgaagctccgcaagggagagcaagagcacgaccctgactgtgcccgagcagcagaggacgacccatcaccggtcccggtccgtgagccctcatagaggaaacgaccaggggaaaccgaggtcgcggctgcctaacgttcctctgcagcgatctctggacgagatccatcccactcgaaggtcacgttcacctacaaggcaccacgacgcatcacggtccccagtggatcacaggacaagagacgtggatagccaatatttgtctgagcaggattccgagttacttatgctgccaagggccaaacggggacggtccgccgaatgtttacacacgacacgtcacttggtccgacactataagactctgcccccgaaaatgccactgctccaatcgtcaagccactggaatatctacagcgagcttcagccatttctcgacagggcgagatcagctagcacgaactgtttacggcccgacacatccttgcattcacctgaacgggaacgtatgcatcgccagagaagtccaacccagtccccaccagccgacactagctttagctcccgtcgcgggcgccaactcccacaggtcccagtgcggtctggctccattgagcaagcttccctcgtcgtggaggaacggacaagacagatgaagatgaaagtgcacagatttaaacaaaccacaggcagtgggtcaagccaggaactggaccgcgagcagtactccaaatacaacatccacaaagatcagtatcggagttgtgacaacgtcagtgcaaaatcttctgattcagacgtgtcggatgtgtctgctattagtcggacgtcgtctgcgtccaggttgtcatccacttcattcatgtccgagcaaagcgagcggcctaggggaaggataagcagcttcaccccgaaaatgcagggcagaaggatgggcaccagcggacggtctattatgaaaagcacctcagtctccggcgagatgtatacactggagcataatgatgggtctcaatccgataccgccgtcggcaccgtcggtgctggaggcaagaagcggagaagtagtcttagcgcaaaggtagtcgctattgtatctagaaggagccggtccacaagccagctgtcacagactgaaagcgggcacaaaaaactgaagtcaaccattcagcgaagcaccgaaaccggcatggcagcagagatgcgtaagatggtgcgacagccaagccgcgaatctacagatgggagcatcaattcgtattcgtccgagggtaatctgatcttccccggtgtcagactgggagctgacagtcagttctctgactttttggatggtctgggacctgcacagttggtaggtcggcaaactcttgccaccccagccatgggtgacatacagatcgggatggaggacaagaaaggccagctggaagtcgaagtcattcgggctcggagcttgacacaaaagcccggctctaaatcaaccccagctccgtatgtcaaagtgtatttgctggagaatggagcctgcattgctaaaaagaagacgagaatcgctcgaaaaacgttggaccctctgtatcaacagtcgctcgtgtttgacgaatcccctcagggcaaagttctgcaggttatcgtgtggggcgattacggtagaatggatcataagtgcttcatgggagtggcccaaatcctgctcgaagaactggatttgtcaagcatggttataggctggtataagctctttcccccctcttcacttgtcgaccccactcttacacccctgacgagaagagcctcccagtcaagtctggagtcttccaccgggccgccgtgtatcagatcttag

SEQ ID NO: 132014 - DNA, 4446 bp, Artificial Sequence
  Description of Artificial Sequence: Synthetic coding sequence
atgagtagcgctgtgggcccaaggggcccacggccaccgaccgtgccccccccaatgcaggagctacccgatctgtcccaccttacagaagaagaaagaaacataatcatggccgtcatggaccgccagaaggaggaagaagagaaggaagaagccatgttgaagtgcgtggtcagggacatggcaaaaccggcagcctgtaaaacaccgcgtaatgcagagaaccaacctcaccaaccttcccccaggttgcaccagcagtttgagagctataaggagcaggtgaggaaaatcggagaggaagcaagacgctaccagggtgaacacaaggacgacgcacctacatgtggcatctgccacaaaactaaattcgctgacgggtgcggccatctgtgttcttattgccgtactaagttctgcgctcggtgcggtgggagggtgtctttaaggagcaataatgaaaacaaaatagtgatgtgggtttgcaacttatgtcgaaagcagcaggaaatcctgaccaaaagtggagcctggttcttcggctcagggccccagcaaacgagtcaagatgggaccctgagtgacacggcgacgggagctggctcagaggttcctcgagaaaaaaaggcccggttacaagaaagaagtcgcagccaaacccctctttctacagctgcagcctcttctcaggacgcagccccaccaagcgcgcctccagaccgctccaagggtgccgagccctcccagcaggctctcggccctgaacaaaaacaggcatccagccgttcacgatccgagcccccccgggaacggaagaaaactccaggcctctccgagcaaaatggaaaaggagcacttaagagtgagagaaagcgggttcccaaaacctcagcccagcccgtggaaggcgcagtcgaggaaagggaaaggaaggagcgaagagaaagtaggcgcttagagaagggtaggtctcaggactatcctgataccccagagaaacgggatgaaggaaaggccgccgatgaagagaaacaacggaaggaggaagactatcaaacacggtacagatccgaccctaatctggcccggtatcccgtgaagccgccacccgaagagcagcagatgcgtatgcatgcacgcgtttcccgggctcggcacgagaggagacactcagacgttgcactacctcggactgaagccggagcggctcttccagaaggtaaagccgggaagagggctcccgccgcagcaagagccagcccgccagactcccctcgggcctattcagcagagcggaccgctgagaccagagcccctggtgcaaagcagctcacaaatcatagccctccagcaccaaggcatgggcctgtgcccgccgaagctcccgagctcaaagcacaggagccattgcgaaagcaaagtagactcgatccttcgtctgccgtcctcatgcgtaaggccaaaagagaaaaagtggagactatgctgcgcaatgattcactgagctctgaccagagcgaaagcgtgcgcccatctccccccaaaccacaccgatccaaaaggggggggaaaaaacgacagatgtccgtgagctcctccgaagaagagggggtgagtactcctgagtatacctcgtgtgaggacgtcgaactggagagtgaatctgtttctgaaaaaggggaccttgactattattggctggaccctgctacgtggcactcaagggaaacttctcccataagctcccaccctgtcacctggcagccctccaaagaaggcgacagactcataggccgcgtgattctcaataagagaacgaccatgccgaaggatagcggagctttgctgggattaaaggtcgtggggggtaagatgactgatctcggccggttaggtgctttcatcacgaaagttaaaaaagggtccctggcagacgtagtcggacacctgcgcgccggagacgaagtgctggagtggaacggcaagccccttcctggagccactaatgaggaggtgtacaatataatcctggagtccaagagcgaaccacaggtcgaaatcatcgtatcccggccgatcggggatattccacgtatccccgagagctcacatccaccactcgagagttcttcgtctagttttgagtcacagaaaatggagagacccagcattagtgttattagcccaacttccccaggggccctgaaggacgcaccacaagtgttgccaggacagttgagcgtcaaactctggtacgataaggtggggcaccagctcattgtgaatgtgttgcaagcgaccgacttgccggcccgggtggacggacgaccccgcaatccatacgtgaagatgtatttcctgcccgacagaagcgataaaagtaaacggagaaccaagactgtcaagaagatcctggaacctaagtggaaccaaaccttcgtttattcccacgtacatcgtagggattttcgggaaagaatgctggagatcacagtgtgggaccagcccagggttcaggaggaggaaagcgagtttttgggggagatcttgatcgagctggagactgcactcctcgatgacgaacctcattggtataaactgcaaacccacgatgagagctctctaccactgcctcaacccagtcctttcatgcctcgtcggcacatccacggggaatcaagtagcaaaaaactacagagatctcagcggatatctgattccgacatttctgactatgaggttgatgacggcattggcgtggtgccacctgttggataccgctcttctgctcgcgagtccaaatctactaccctgactgtccctgagcaacagcggactacccatcaccgctctagatctgtttcccctcatcgtggaaatgaccagggtaagcctcgctcacggctgccaaatgtgcctctgcaaaggtccctagacgagatacaccccactagacggtctaggagtcccactcgccaccatgatgccagccgctcccccgtggaccataggaccagggacgtagactctcagtacctctctgagcaggattccgaacttctgatgctccctcgggcgaagagaggtaggtccgctgagtgcctgcacactacctcagaactgcaaccttttttggatagggctcgctccgcttccacgaattgcctccggcccgatacaagccttcatagccccgaaagagaaagaatgcaccgccagcgctcgcctacgcagagcccacccgctgatactagcttctcctcgaggcgcggaaggcaactgcctcaggtgccagtgcggtccgggagcatcgagcaggcctcactggtcgtggaagagcggacccgacagatgaaaatgaaggtacatcggtttaagcagaccaccggatcaggaagctcccaggagcttgacagggaacagtactccaagtataacatccataaagaccagtaccgcagctgcgataacgtctccgcaaaatcgtcagactccgacgtgtcagacgtgtcggctatctcacggacaagctcagctagtagactgtcctcaacatcattcatgtccgagcagagcgagcggccccgcggccggatcagcagttttacccctaaaatgcagggtcggaggatgggcacatctggtcggagtattatgaagtcaacaagcgtcagcggcgaaatgtacacgcttgaacacaatgacggaagccagagcgacaccgcagtgggcacggttggtgccggcggtaaaaagcggcgcagctcacttagtgccaaagttgtcgctatcgtgtcccgccgaagccgcagcacaagccaactgtcccagactgaaagtggccacaaaaaattaaagagcaccatccagcgctcaacagagacagggatggcagcagagatgcggaaaatggtgagacaaccctcccgcgagtctactgacggatcaatcaacagttactctagtgagggaaatttgattttcccaggtgtgaggcttggcgccgatagtcagttctctgatttcctcgatggtctaggtcccgctcagctcgtgggaagacagacacttgcgacacctgccatggcaccatatgttaaggtctacttgctcgagaatggagcttgtattgccaaaaaaaaaacaaggatcgcccggaagactctggatccactgtaccagcagtcattagttttcgacgagtcgcctcaaggaaaagttctccaagtgatcgtctggggggattacggaagaatggatcataaatgctttatgggtgtggcacaaattcttctggaggaattagatctcagctccatggtcataggctggtacaagttgttccctccctcctctctagttgaccctacactgacaccacttactcggcgggcatctcagagctcccttgaaagcagcactggcccgccttgtattcgctcttag

SEQ ID NO: 132015 - DNA, 4446 bp, Artificial Sequence
  Description of Artificial Sequence: Synthetic coding sequence
atgagcagcgcagtgggaccccgcggccctcgacccccaacagtgcctccaccaatgcaggaactgccggacctgtctcatctcacagaggaagagcgaaatatcatcatggcggtaatggaccggcagaaagaggaggaagaaaaggaggaagcgatgcttaaatgtgttgtgagagacatggctaaacctgccgcttgtaaaacacctcgtaatgctgagaatcaaccccatcagccttctccccgcttgcaccagcaatttgagagttataaggagcaagtcagaaaaattggggaggaggcgaggcggtaccagggtgagcacaaagatgatgctccaacttgtggcatttgccacaagaccaaatttgccgatgggtgcggacacctctgctcctattgtcgcaccaagttctgcgccagatgcggaggaagagtcagtctgaggtctaacaacgaggacaaggtagttatgtgggtttgtaacctgtgtcggaagcagcaggagattttaaccaaatccggagcatggttcttcgggagtggtcctcagcaaacaagccaggatggcactctatccgacactgcgacgggcgcaggtagtgaagtaccaagagaaaaaaaagcacgattacaggagaggagcagatcccagacacccttgtcgactgccgctgctagtagtcaggacgcagccccacccagcgcccctcctgataggtctaaaggtgccgagcctagccagcaagcgttaggccccgaacagaaacaggcttcaagccgatctaggtccgaacctccgagggaacggaaaaagacccctgggcttagcgaacagaatggaaagggcgccctgaagagtgagcgcaagcgtgttcccaagactagtgctcagcccgtcgagggcgccgtggaggagcgggagaggaaggagcgtagagagtctagaagattagagaagggcaggtctcaggactatccagatacacctgagaagcgagacgaaggaaaggccgcagacgaggaaaaacagcgcaaagaggaggattaccaaaccagatacaggtccgaccccaatctcgctaggtatccagttaaacctcctcccgaggaacaacagatgcggatgcacgccagggtgagtagagctaggcacgagcgtcgccattctgacgttgccctgccacgcacagaagctggagcggctctgccagagggcaaggccggtaaacgtgcccccgcagctgcccgggcctcgcctcccgacagcccaagggcttattccgccgagcgcactgccgagacacgagccccaggagctaagcagctgaccaatcattcaccgcctgcgcccaggcacggccctgtcccagcagaagcaccagagttaaaggcccaggaaccactccgtaagcaatcacgcctggatccctccagtgcagtgctgatgcgcaaggccaagcgtgaaaaggtggagactatgctccggaacgattccctgagctcagatcagtccgaatccgtccggccctccccccctaagccacaccgctccaagcgcgggggcaagaagcgccagatgtctgtatcatcctctgaagaagaaggcgtctcgacacctgagtacacatcgtgtgaagacgtcgaattggaatctgagtccgtgagcgagaagggagacctggactactactggttggatcccgcgacatggcattcacgggagaccagccccatttcttcacaccctgtgacttggcaacccagcaaggagggagaccgcctgatcggtagggtgattctgaataaaagaacaactatgccaaaggatagtggagccctgttggggctgaaggtagtgggaggcaaaatgaccgatttgggaaggttgggcgcattcatcacaaaagttaaaaagggcagtctggccgatgtggtgggacacctccgggcaggtgatgaggtacttgaatggaatgggaaacccctgcctggggcaaccaacgaagaggtgtacaatattattctcgagagcaagagcgaacctcaagtggaaatcattgttagccgccccatcggagatattccccgcatccctgaatcgtcacacccccctctagagagtagctcctcgtctttcgagagtcagaagatggagcgccccagcatctctgtgatttccccaactagccctggggctcttaaagatgccccacaggtcttgccaggtcagctctccgttaagctgtggtatgataaggtggggcaccagctgattgtcaacgtgctgcaagctactgacctccccgctagggtcgatggccgaccgcgaaatccttatgtaaagatgtactttttaccagacagatccgacaaaagtaagcggagaactaagacagtgaagaaaatattggaacccaagtggaaccagacctttgtctactcacacgttcatagacgagattttagagaacgtatgctcgaaataacagtgtgggaccagccacgcgtgcaagaagaggaaagcgagtttctaggggaaattctgatcgaactagaaaccgccctgctggacgatgagccgcattggtataagttgcaaacacacgatgagtcgagtctcccgttgccgcaaccttcaccgttcatgccaaggagacacatccacggggaatccagctccaaaaagttgcagcgatctcagaggattagtgacagcgacattagcgattacgaagtggacgatggaataggggtggtgcctcccgtgggctaccgcagtagtgctagggagtcaaagtcaactaccttgactgtgcccgagcagcagcgaacgacgcaccaccgttcgagatctgtgagccctcatagagggaacgaccagggaaagccacgaagcaggctgcccaatgtgccactacagcggagcctggatgaaatacaccccactagacgttctcgcagccctaccagacatcatgacgcttcccgtagccccgtagaccatcgcactagggacgtagactcacaatatctttcagaacaggactcggaactgttgatgctcccacgagcaaaaagaggccggtctgcagagtgccttcacactacctccgaattgcaacccttcctggacagggctagatctgcgtctaccaactgcctgcgaccagatacatctttacattccccagagcgggaacggatgcaccggcaacgcagtcctacccagtctccacccgctgacacttccttttcttctcggcggggacggcagctgcctcaggtgcctgtgaggtcaggaagcatcgagcaggcgagcctggtagttgaagaacgcactaggcagatgaagatgaaagtacatagatttaagcagacaacaggcagcgggagttcccaggagcttgaccgcgaacagtactcgaaatacaatatccacaaagatcagtatcgctcctgtgacaacgtcagtgcaaagagttccgactccgacgtcagtgacgttagtgctattagcagaacttccagcgctagccgcctttcgtccacatcatttatgtccgagcaaagcgaacggcccagaggccggatctccagtttcacgcctaaaatgcagggaagacgcatgggaaccagcggtaggagtatcatgaagtccacttcggtgagtggggaaatgtacaccctagagcataacgatggatcccagtctgacaccgctgtgggcactgtcggagcaggagggaaaaagcggaggtcttctctctccgctaaggtggtggccatagtatcccggaggagcagaagtacttctcagttaagccagacagagtctggccacaagaagctgaagagcaccattcagcggtctacggagacaggcatggccgcagaaatgagaaagatggtgagacagccatctcgagaaagtacagatggtagcatcaactcctactcgagcgagggtaatttgatcttccccggcgtgaggcttggggcggacagtcaatttagtgatttcttggatgggctcggtcctgcccagctcgtggggcgacagacgttggctactccggctatggctccctacgttaaggtctacctgttggagaacggagcttgtattgccaaaaagaagacccggatcgctaggaagactctggaccccttgtatcaacagagcctggtatttgacgagagccctcaggggaaggttctgcaggtaatcgtgtggggcgactatggcaggatggaccacaaatgtttcatgggtgtcgcacagatccttctagaagagctggatctttcatccatggtgatcgggtggtacaagctttttccaccatcaagcctggtggatcctaccctcactcctttgactaggagagcctcccagagtagtctggaatcatcaacgggacccccctgcattcgaagctag

SEQ ID NO: 132016 - DNA, 5079 bp, Artificial Sequence
  Description of Artificial Sequence: Synthetic coding sequence
atgagcagcgccgtgggaccgaggggtcctcgtccacccacggttccccctccaatgcaggagctgccagatctttcccatcttacagaggaggagaggaatataattatggccgttatggaccgacaaaaagaagaggaggagaaggaggaagcaatgttgaagtgcgtggtgagggacatggctaagccagcagcttgtaagactccacggaacgccgaaaaccagcctcatcagccttctccccggctgcaccagcagttcgaatcatacaaagaacaggtgcggaagatcggtgaggaggcacgccgctaccagggagaacacaaggatgacgcgcctacttgtggtatttgtcacaagaccaaatttgctgacggatgtggccatctctgctcgtattgcaggacaaagttctgtgcacggtgtggggggagggtaagtttaagatctaacaatgaggataaagtggtcatgtgggtgtgcaatctctgtcggaaacagcaagagatcttgacaaagtcaggcgcctggttctttggctccggccctcaacagacttcccaagatggcaccctatccgacactgcaactggagcaggcagcgaggtgcctagggaaaagaaggccagactgcaggagcgttctcgcagtcagacacccctcagtacagccgctgcatcctcccaggacgccgccccccctagcgcccccccggaccgcagtaaaggcgctgaaccaagccagcaggcactgggccctgaacagaaacaggcctccagtagaagccgttctgaacccccccgagaaaggaaaaaaacccctggattgtcagaacagaacggaaagggggcgttgaagtccgagagaaaaagagtgccgaaaacatcagcgcaacctgtcgagggcgcagtggaagaaagggaaagaaaagaacggagagagtcaagacggcttgaaaagggccgctcccaggactaccctgacacaccagagaagagagacgaaggcaaggcagctgacgaagagaaacagaggaaagaagaggattatcagactaggtatcgaagtgacccaaacctggctagatatccagtgaagcctccccctgaagaacagcagatgaggatgcacgcaagagtgagtcgcgcccggcacgagcgtcgccattccgacgtagcactgccccggaccgaggccggcgctgccttaccggagggaaaagccggaaagagggctcccgccgcagctcgcgcatccccaccagactctccacgagcttacagtgccgagaggacagctgaaacccgtgctcccggggctaagcaactgactaaccactctcctccagctccaagacacggcccagtccccgctgaggcacctgaattaaaggcgcaggaaccgctgaggaagcagtctcggctggatcccagttcagcagttctgatgagaaaagcgaaaagggaaaaagttgagaccatgctgagaaacgatagcctgagctcggaccagtccgaaagcgtgaggccttcaccaccaaaaccccaccgcagcaaacgcggcggcaaaaagaggcaaatgtctgtttcttcttccgaggaggagggggtgtccacccccgaatacacctcatgcgaagacgtggaattggagagcgaaagcgtctcagagaaaggagacttggactactattggttggaccccgcaacatggcactccagagaaacctctcctattagttcacacccggtgacctggcagcctagcaaggagggtgacaggttgatagggcgcgttatcctcaacaaaaggaccacaatgcctaaggactcaggcgctctcctggggcttaaagttgtcgggggcaagatgacagacctagggcgccttggagccttcattactaaagtcaagaagggttcactcgctgacgttgtgggccatctgcgggccggcgatgaggtgttggaatggaacgggaagccacttcctggggcaacaaacgaggaagtgtataacatcattctggagtctaagtccgaaccacaggttgaaatcatcgtgagcaggcctattggggatatccctcgcattccggagagttcccacccgcctctcgaatcctcatcctctagctttgagtctcaaaagatggaaaggccgtctatttctgttatatccccgacgtctcccggggccctcaaggacgcccctcaggtgctgcctggacaactgtctgtgaaactgtggtatgacaaggtcggccaccagcttattgtaaacgtcctgcaggctacggacttgccagctcgagtggacgggcgcccccgtaacccctatgtcaagatgtatttcctacccgataggagcgacaaaagtaagcggcgcaccaagaccgtgaaaaagattctggagccgaaatggaatcaaaccttcgtctactcacacgtccaccggagggattttagagaacggatgctcgaaatcacagtttgggatcagccacgcgtacaggaggaggaaagcgagttccttggcgagattctgatcgagctggagaccgcccttctagatgacgaaccacattggtataaactccagacgcacgacgaatcctctctgccactgccacagccttcgccattcatgcccagacgccatattcacggcgagtcgtcttcaaaaaagctgcagcgttcacagagaattagtgactctgacatttccgactacgaagttgatgacggcattggagtggtgcccccagtgggctataggtcctctgcccgcgagtctaaatctactacactcacagtccccgagcagcaacgcacaacccatcaccgtagtaggagcgtgagtcctcacagaggaaatgatcagggaaagcctcggagcaggctgcctaacgtgcctttacagcggagcctggatgagatacaccctacgcgccgctcgaggtctccaacccgacaccacgatgcaagtcggagtcctgtggaccacaggacccgggatgtagactcccaatatctcagcgaacaagattccgaactccttatgcttccacgggctaaaaggggtaggtctgcagagtgcctgcataccaccaggcacctcgtcaggcactacaagacgctgccgcctaaaatgccccttttgcagtcaagctcgcactggaatatctactcatcaatcctgccagcccataccaagacaaagtcggtgacacgacaggatattagcctgcatcatgagtgttttaatagcaccgtcctccgatttactgatgagatcctcgtgtctgaactccagccttttctggaccgggctaggtcagcctctaccaattgtctgcgtccagatacttcattgcatagccctgagcgagaaagggggagatggtcccccagcctggatagacgacgccctccctcgccgcggatacagatccagcacgcttcgcccgagaacgatcggcactctagaaagtcggagagatcctccatccaaaagcaaacgagaaaaggtaccgcctctgatgctgagcgggtcttgccaacatgtttgagccgcagggggcacgccgcacctcgggccactgatcagcctgtcatccgcgggaagcacccagccagatcgcggagcagtgaacactctagcattagaacgctctgctctatgcaccatctggtccccggtgggtccgcccccccctcaccactgttaacacggatgcaccgacagcgatcccccacgcaatccccgcctgctgacacttccttctcctctcgcagagggaggcagctcccccaagtgccagtgaggagcgggtctatagagcaagcgagtctggtggtcgaggaaaggactcgacagatgaagatgaaagtccatcggttcaagcagacaacggggagtggctcttcccaggagctcgacagagaacagtacagtaagtataatatacataaggatcagtatagatcgtgcgataatgtgtccgctaagtccagtgattccgatgtttccgacgtcagcgcaatttcaagaactagttctgcgagtaggcttagcagtacctccttcatgtccgaacagtctgaaagaccgagagggcggataagctccttcactcctaaaatgcagggacggcgaatgggcacatccgggcggtctatcatgaaaagtacaagcgtttccggagagatgtacaccttggagcacaatgatgggagccagtcagataccgcggtcgggacagtcggggcaggtggtaaaaagcggcgcagtagcctctctgcgaaggttgtggcaattgtctcacggaggtccaggtctaccagtcagctaagccagactgaatctggccataaaaagttgaaatctaccatccagagaagcacagaaactggaatggctgctgaaatgaggaaaatggtgagacaaccgtcacgagaatccacggacgggagtatcaacagttatagctctgagggtaatctgattttccccggagtgcgcctcggggccgattcccagttctctgatttcctggacgggctgggccctgcccaacttgtgggcaggcaaaccctggcaaccccggcaatgggcgacattcagataggcatggaagacaagaaaggccagctcgaggtcgaggtgattagggcgagatccttgactcaaaagccgggaagtaagtctacacccgcaccgtacgtcaaagtgtacctgctggaaaatggcgcttgtatcgcaaaaaaaaagactcggatcgctcggaagacccttgaccccctgtatcagcaatctcttgtgttcgacgagagcccccagggcaaagtgctgcaggtgatcgtctggggggactacggccgtatggaccataaatgctttatgggcgttgcgcagatactgcttgaggagttggacttaagttccatggtcatcgggtggtataagctattcccgccaagttctttagtagacccaacgttgacacctttaacccgccgtgcctcccagagcagtctggaaagctctacaggtcccccgtgcatccgctcttag

SEQ ID NO: 132017 - DNA, 1497 bp, Artificial Sequence
  Description of Artificial Sequence: Synthetic coding sequence
atgttacctagggctaaaagggggcgatcggcagagtgtctccacactacccgacattctcgcaaatcagagaggagtagcatacaaaaacagaccagaaaaggtaccgcgagcgatgcagagcgaatgcataggcagcgaagtccgactcagagtccccctgccgacactagtttttcaagccggcgcgggcgacagctccctcaggttccagtgcgctcaggatccattgaacaggaacaggagaagtataatagctcgaccaaagcctcgctggtggtggaagagcggaccaggcagatgaagatgaaagtgcaccgctttaagcaaaccactggtagtggcagctctcaggaactggaccgcgagcagtacagcaagtataatatacacaaagatcaatatagatcgtgtgataatgtgagtgccaaatcgtcagatagtgatgtcagcgatgtgagcgctattagcaggactagcagcgcttcccgcctctcttcgacgtctttcatgtctgagcaatccgagcgccccagaggccggatctcaagttttacgcctaaaatgcaaggaagacggatgggaacgtcgggtcgttccataatgaagagtacttcggtttcaggagagatgtacaccttggaacataacgacggttctcagtccgacaccgccgtggggacggtcggggctggaggaaaaaagcgcaggagctccctctccgcaaaagtcgtggcgatcgtgagccgtaggagtagatccacttcccagttgtcacagactgaatcagggcataagaaactgaaatcaaccattcaaaggtcaactgagacgggtatggccgcagaaatgagaaaaatggtgagacagcctagtcgggagagcacagatggtagcattaattcctacagcagcgagggcaaccttatcttcccgggagtcaggttaggcgccgactcgcaattctccgacttcctggacggtcttggacccgcgcagcttgtggggcggcaaaccctcgccaccccagcgatgggagatatccagatcggaatggaggataaaaagggacagttagaggtcgaggtgatccgcgcaaggtccctgacacagaagcctggatctaagagtactcctgcgccgtacgttaaagtttatctgcttgaaaacggagcatgcatcgcgaaaaaaaaaactagaatcgcaagaaaaacactggatcctttgtatcagcagtctctggttttcgatgaatcaccacagggcaaagtgttgcaggtgattgtatggggcgattacggccgtatggatcacaaatgttttatgggagtggcccagattctcctggaggagcttgacctgtcctccatggtcatcgggtggtataagctttttcctccttcttcgcttgtagaccccacactgaccccactgactagacgggccagtcagtcctccctggaatctagcaccgggcctccctgtatccgctcttag

SEQ ID NO: 132018 - DNA, 3039 bp, Artificial Sequence
  Description of Artificial Sequence: Synthetic coding sequence
atgtgcgccccaggcatccatgttagcagtgaaggttgggaggaggtacggtcagtcgatagtgaggagggcactatcgaggcgcggcgagccgtagcgggcgatctcgactactactggctcgatccagcaacatggcacagtcgggaaactagtccaattagctcacatcctgttacatggcaaccgtctaaggaaggcgacaggctgattggtcgggttattctcaacaagcggacgaccatgcctaaagattcaggcgctctgcttggccttaaggtcgtgggggggaagatgaccgatcttgggcggctgggggcctttataacaaaggtgaaaaaggggtcactggcagatgtggtgggccacttgcgcgcgggcgacgaagttcttgaatggaacggaaagcctttaccaggcgctaccaacgaggaggtgtataatatcattctggaatctaaaagcgagccgcaggtggagatcatcgttagcagacctattggagacattcctcgaatccccgagtcaagccaccctccattggagtccagttcttctagcttcgagtctcagaaaatggaaagaccttccatttcagtgatctcacctacctcgccaggtgccttgaaagacgccccccaggtactacccggccagctaagtgtcaagctgtggtacgacaaagtgggacaccagttgatcgtaaatgtcctgcaggcgactgacttgcctgcacgggtggacggaagaccgagaaatccatacgtcaagatgtatttcctcccagaccggtctgataagtctaagcgccgaaccaagaccgtaaaaaaaatactcgagccaaaatggaatcaaacttttgtctattcacacgtgcaccgccgagattttcgcgagcgcatgctcgaaatcacagtttgggatcaaccaagagtgcaggaggaagagagtgagttcctgggagagatcctgatagagctggagactgctctgttggacgacgagcctcattggtacaagctacagacgcacgatgagtcaagcctgccattacctcagccttctcctttcatgccccgtaggcacatccacggggaatcgtcctctaagaagctacagaggtcgcagagaatcagtgacagtgatattagcgactatgaggtggatgatggaattggcgtggtgcccccaggatatcgatcatctgcaagagaatccaagtccacaaccctaactgttcctgaacagcaacgcacgacacaccaccggagccgctccgtgtcgccacaccggggaaatgaccaaggcaaaccccggagccggctcccaaacgtgccacttcaacggtcactggacgagatacacccgacacgccggagtagatcccctaccagacaccacgatgcctccagatctcctgtggatcatcgtacacgagatgtggattcccagtacctgtccgagcaagatagcgaattactgatgttgcctcgtgctaagcgcggaagatcagctgaatgtctgcacacgaccagtgagctacaaccctttctggatcgcgcccgtagtgccagcacaaactgccttcgtccagacacatccctccactcacctgagcgcgaacggcatagccgcaaatccgagcgcagcagcatccaaaaacagacgcggaaaggcacagccagtgacgctgagaggatgcatagacagcgctctccaacccaatccccacccgccgacacctccttcagctcaaggcgaggtcgccagcttccccaggtgcctgtaagatctgggagtatcgaacaggcaagccttgtggtggaagaacggacccgacagatgaagatgaaggtgcacagattcaagcagaccacagggagtggaagcagccaagaacttgaccgcgaacagtactccaagtacaacatccataaagaccagtaccgcagctgcgacaatgtctccgcaaagtcttctgattctgatgtgagcgatgtgtctgccatatcaaggacttcctcagcatcaagattgagcagtacctctttcatgtcagagcagtccgaaaggcctcggggtaggatcagctcatttaccccaaaaatgcaaggccgtaggatgggaacttcagggaggagtataatgaagtccacctccgtgagtggcgaaatgtatacgctggaacataacgacgggtcacaaagcgacactgccgtggggacggtcggcgctggcggcaagaagaggagaagtagcctgagcgccaaagtggttgcgattgtctcacgcagatcccgctctaccagccagctctcccagacagagagtggccataagaaactgaagtctactatccagcggtctacagagactgggatggccgcagagatgagaaagatggtgcgtcagccaagtcgtgagagtaccgatggctctatcaatagttattctagtgaaggaaatctgatcttcccaggagtcagactgggggccgactctcaattttctgacttcttggatgggctgggtccagcccagctcgtgggcagacagacacttgctacccctgctatgggggacattcagatcggaatggaggataaaaaaggacagctggaagtggaggtcatcagggcgagaagcctcactcagaagccaggctctaagtccacccctgcgccttacgtgaaagtgtacttgttggagaatggggcttgcatcgccaagaaaaagactcgcatcgcgcgaaaaaccctcgatccactgtatcagcagtctcttgtttttgacgagagtccacagggtaaggttctgcaggtcatcgtatggggcgactacggtagaatggaccataagtgcttcatgggcgtggcccaaattctcttggaggaattagatctgtcttctatggtgattggatggtacaaactgttcccacctagctcactcgtggatccaactctgactccgctcactcggcgggcctctcagagtagcttggagagtagcaccggaccgccttgtatccgttcatag

SEQ ID NO: 132019 - DNA, 660 bp, Artificial Sequence
  Description of Artificial Sequence: Synthetic coding sequence
atggccgctgaaatgagaaaaatggtgcgacagccatcccgcgaatctaccgacgggtctattaattcttattcctccgaaggcaacctgatctttccaggggttcgtcttggagcagatagccagttctctgactttctcgacggccttggccctgcacagctagttgggagacaaactctggcaacaccagctatgggtgacattcagatcggcatggaggacaagaaaggccagcttgaagtagaggtgatcagggccaggtccttgactcagaagcctggctcaaagtcaacccctgcgccttatgtgaaagtgtatctgctcgagaatggggcttgcatagcgaagaaaaagaccagaatagctcggaaaacactcgaccctctgtatcagcagagcctggtgtttgacgagtctccccaggggaaggtgttgcaggttatcgtctggggagattacggccgcatggaccacaagtgtttcatgggggtggcccagatcttactcgaggaactggatctctcttccatggttattgggtggtataaactgttcccaccatcaagcttggtggatcctacgttgactccactgacccgacgagcctctcagtcatccctcgagagttccacgggtcctccgtgcatcaggtcctag

SEQ ID NO: 132020 - DNA, 2283 bp, Artificial Sequence
  Description of Artificial Sequence: Synthetic coding sequence
atgccgaaagacagcggtgcgttgctcggcctgaaggtggtcggcggcaagatgaccgacctgggcagacttggtgcatttatcacaaaggttaaaaagggaagcctggcagacgtcgtcggacatctgcgcgccggggatgaagttctggagtggaacgggaagcccctccctggagctactaatgaggaggtctataatattatcttggaatctaagagcgagccacaggtggagattattgtgagtcgccctatcggtgacatcccaagaataccagaatcctcacaccctcctctagagagctcctccagctctttcgaaagtcagaagatggagcgaccttccatcagtgtcataagtccgacaagtccaggggcccttaaagatgctcctcaggtgttgccaggacaactgagcgtgaagctatggtatgacaaggtcgggcaccagctgattgtgaacgtcttacaggccacagacctgccggctcgcgtggacggccgccctcgcaatccttacgtcaagatgtattttttgccggatcgcagcgacaaatctaagaggaggacaaagactgtcaagaaaatcctggagccaaaatggaatcagactttcgtttacagccatgtacaccggagggatttcagggaaagaatgctggagatcactgtgtgggatcagccaagggtacaagaagaagagtcagagtttctaggggaaattctgatcgagctcgagacagcactactggatgacgaaccacattggtataaacttcagacccatgacgaatcttcattacccctgcctcaaccaagtcctttcatgccacgaagacatatacacggcgaaagctcttccaagaagttgcaacgcagccagagaattagcgatagcgacatctccgactacgaggtagacgatgggattggcgtggttcccccggtcgggtacagaagctctgcgagagaatccaagtccaccacactcaccgtaccggaacagcaacgcaccacccaccaccggtcacggtcggtgtcgccccataggggcaacgaccagggcaagccacggtcccgcctgccaaacgtcccacttcagagaagtttggatgagatccaccctacgcggcgaagtcgtagtcctaccagacaccacgatgcttcaagatcccctgtcgatcacagaaccagagacgtggatagccaatatctcagcgaacaggacagtgaactgctgatgctcccaagagcaaagagaggtaggagtgcagagtgcctacatacgacctcagaacttcaaccattcctagacagagccaggtcagcctccacgaattgcctgcgccccgatacctcactgcactccccagagcgggagcggcactctcgcaaatccgagaggtccagcattcagaagcagacgaggaagggcacagcctcagatgccgagcgcatgcaccgccagaggtcgcccactcagtctcccccagctgacaccagtttttcatccagacggggccggcaactgccgcaggtcccagtccgtagtggatctatcgaacaggaaagcggacataagaagctaaaatcaactatacagaggagtacagagaccggcatggcggcagagatgaggaagatggtacgccagccttctagagagagcactgacgggagcattaatagttactcctctgaaggcaatttgatctttcccggtgtcagactgggcgccgacagtcagttctccgattttctggatggtctcggacctgcgcagctggtcggacggcagacacttgctacacctgcaatgggcgatattcaaatcggcatggaagacaagaaaggccagctggaggtcgaagtaatcagagcgcggtcactgactcaaaaaccaggctccaagagcaccccagcaccttatgttaaggtatatctgttagaaaatggcgcctgcatcgcaaaaaaaaagacacggattgcccgtaagacacttgaccctctctaccaacagagcttggtctttgacgaaagcccccaagggaaagtattacaggtcattgtgtggggagattatggtcgtatggatcacaaatgttttatgggtgtggcacaaattctcctcgaagagctcgatctctcctcgatggtcatcggttggtataaacttttccctccaagctccttggtggacccgactctgacccccttaactagacgcgcctcacaatcctccctagagagtagcactggtcccccttgtatcagaagctag

SEQ ID NO: 132021 - DNA, 2481 bp, Artificial Sequence
  Description of Artificial Sequence: Synthetic coding sequence
atgttcgccggattcttgcagtttctgctgctccacacactacattcaggtactggcgatctcgactactattggcttgaccccgcaacttggcattccagggaaacgtctcctatctcatcgcaccctgtcacatggcaaccgtcaaaagagggtgacaggctgatcggtcgcgtgatcctcaataaaaggaccactatgcccaaagactctggagccttgcttggcttgaaggtagtgggaggaaaaatgaccgacttggggcgtctgggcgcgttcattactaaagtgaaaaagggaagtctagctgacgtggtgggccatctgagagctggtgacgaggtccttgagtggaacggcaaacctctccccggagctacaaacgaggaggtgtataacatcattctggagtcaaaatctgaacctcaggtggaaattatcgtgtcaagacccattggcgatattccgcggataccagagagctcccatccaccattggaatcatcctcatcatccttcgaaagccaaaaaatggaaagaccgtctatcagcgtgattagccccacctcccccggtgccctgaaggacgccccccaagtgctccccgggcagctgtccgtaaagttgtggtatgataaggttggtcaccagctgattgtgaatgtgcttcaggcaaccgatctccccgctcgggtcgacggaagaccaaggaatccctatgtgaaaatgtacttcttaccagaccggtccgataagtccaagcggagaaccaaaaccgtgaagaagattctggagcctaagtggaatcaaacattcgtctactcccacgtgcaccggagggactttcgcgagcgaatgcttgaaattacggtgtgggaccagcccagggtccaggaagaggagagcgaattcttgggggagatcttaattgagttagagactgcccttttggacgatgagccacactggtataaactgcagacccacgatgaatcaagcctccctcttccccagccgagtccttttatgccacgccggcatattcatggggagtcttccagcaaaaaactgcagcgctcccagcgtatttctgatagcgacatttcagattacgaagtggacgacgggataggcgttgttccccccgtggggtatagatcctcggctcgtgaatctaagagcacaactctgaccgtgcctgaacaacagcgcactacgcatcaccgctctaggtcggtctctccccatcgtggcaacgaccagggcaaaccacgctcgagattgcccaatgttccattgcaacgttctcttgacgaaattcatccgacacgtcgcagccggtcacctacacgccaccatgatgccagccggtctccagtggaccacaggactagagatgtcgacagccagtacctctccgagcaggattccgagctgcttatgttgcctagagctaagagaggcaggagtgccgaatgtttgcataccacctccgaactgcagcctttcctcgatagagcaaggagcgcttcgaccaattgtcttcgtccggacactagcctgcattcacctgagcgagaacggcactcccggaagagcgagaggagctctattcagaaacagaccagaaaaggcaccgcgagcgacgcagaacgcatgcaccgccaacgaagccctacgcaaagtccacctgccgatacgagtttcagcagtagaaggggccgtcagctgcctcaggtgccggtcaggtccggaagtatcgaacaagagagcggtcataaaaagctgaagtctacaatacagcgcagcacagagaccggaatggccgcagaaatgcggaaaatggtgcgccagccttcccgcgagtccaccgacggttcaataaactcctacagcagcgagggcaatcttatttttcctggggtgcgtctcggagcggactcccagttttccgactttctcgatgggctcggtcccgctcaactcgtaggacgccagactctggcgaccccggcaatgggggacatacagatcggcatggaagataaaaagggacagcttgaagtcgaggttatcagagcacgaagccttacgcagaaaccaggcagcaagagtaccccagcaccttacgttaaagtttatctcctggaaaatggagcttgtatagccaaaaagaagacccgcattgcgcggaagactctcgaccctctgtatcagcagagtctcgtgtttgatgagagtcctcagggtaaggtgctgcaagttatcgtgtggggagattatggcagaatggaccataagtgtttcatgggcgtcgcacagatccttctcgaggaactggatctgagctctatggtcattggctggtataaattgttccctccctcatcactggtcgacccgaccctgaccccactgacccgccgcgcttcacagagcagcttggaatcgagcaccgggcctccctgtattcggtcgtag

SEQ ID NO: 132022 - DNA, 2454 bp, Artificial Sequence
  Description of Artificial Sequence: Synthetic coding sequence
atgtgcgctccaggtatacatgtgtccagtgaaggatgggaggaagtgcggtcagtcgattcggaggaaggtactatcgaggcgcgcagggctgtagccggagacctggactactattggctcgatcccgcaacttggcactcccgggaaacgtcccccatcagcagtcatccagttacttggcagccatccaaggaaggtgatcgcttgattggaagggttatactgaataaaagaaccaccatgcccaaagacagcggggctctcctgggactgaaagtggtcgggggaaagatgactgatctggggcggctcggtgctttcataaccaaggtaaagaaaggatcccttgccgatgtggtgggccatctcagagctggggacgaagtcttggagtggaacgggaagcctttgcccggggctacgaatgaggaggtatataatatcatcctggaatcaaaaagcgagccgcaagtcgaaatcatcgtgtcaaggcccatcggagatatacccagaatcccggaatcatcgcacccgccgctggagtcaagtagttcaagttttgagagccaaaaaatggaacggcccagcattagtgtgatctccccgacctcccctggggctctgaaggacgcaccccaagttcttcctggacaactttcagtaaaactctggtatgataaagttggacaccaattaattgtcaacgtcctgcaagccaccgatttgcccgctcgagtggacggaaggcccagaaatccttacgtgaagatgtactttctgcctgataggagcgataagagcaaacgccgtacgaaaactgtcaaaaagattttagaaccaaaatggaaccagactttcgtgtatagccatgtacataggcgggattttagggagcgcatgttggagattactgtatgggaccagcctcgcgtgcaggaggaagagtctgagttcctgggagagatcctcatcgaacttgagaccgccctcctggatgatgaacctcactggtataagctgcagactcatgatgaaagctcactgccactgccgcagccatccccgttcatgccgaggagacatatccacggagaatccagtagtaagaaattgcagcgcagtcagcgaatttctgactcagacattagcgactacgaggttgacgacgggattggcgtggtgccgccagttggctacagatcaagcgccagggagtctaagtctaccaccctcacggtgcccgagcagcagcgtactactcatcaccgctcaagatccgtctcaccgcatcggggtaacgaccagggcaagccaaggtctcgtttaccgaacgtgcctctacagcggtcgctagatgagatccaccctacgcggaggtccagatcccccacacgacaccacgacgctagtcgatccccagtagatcaccgcacaagagatgtcgatagtcagtatttgtcagaacaggatagcgaactgctgatgcttccccgcgctaagaggggacgctccgcagagtgtcttcataccacctctgaattacaacctttcctggaccgcgcaaggagcgccagtaccaactgtctacggcccgatactagcctgcacagcccagagagagagcgcatgcaccgccagaggtcccccactcaatcgcctccagcagatacctccttttctagtcggaggggacggcagcttcctcaagtgcctgtccggtctgggtctatcgagcaagaatcaggccacaaaaagttaaaaagcacaatccagcgcagtaccgagacaggtatggctgccgaaatgcgcaagatggtccgacagccaagccgcgagtctacagacggtagcattaatagttactcctccgagggtaatcttattttccccggggtgcggcttggtgctgactcacagttctccgactttctggatggactggggcccgcccagttggtcggccgccagacactggccacaccagcaatgggggacattcagataggtatggaagataagaaaggccagttggaggtggaggtgatccgagccagatccttaacacagaaaccggggagtaagagtacaccagccccttatgtcaaagtgtacctgctcgagaacggagcatgcatcgccaagaagaaaacccggatcgctcggaaaactctggatcccctgtaccagcaatccttagtctttgacgaatcgccgcaggggaaggtcctgcaggtgatcgtctggggagactatggacgcatggatcacaaatgcttcatgggcgtggcgcagatattactggaagaacttgacctcagtagtatggtgattggatggtataaactattcccacctagtagtctcgtcgatcctaccctgactcctctgactagacgagcgtctcagagtagccttgaatcatctacaggccccccctgcattagatcctag

SEQ ID NO: 132023 - DNA, 3567 bp, Artificial Sequence
  Description of Artificial Sequence: Synthetic coding sequence
atgcaattcgaaacgctgcgacaagtatgtaactctgtgttgagtcacttccatggagtcttcagctcaccccctaacatcctacagaacgagttatttgggcagacactcaataatgctcggaaacgcagtccctccgtttcccgagatcaaaaccggaggtacgaccaacgcgaggaacgagaggagtactcccagtatgcgacgtctgacaccgccatgcccaggagtccatctgattatgctgataggcggtcacaacatgagcctcagttctatgaggacagcgatcacctgtcataccgtgactcgaataggaggagccacaggcattccaaagaatatatcgtcgacgacgaagacgtcgagtctagggacgagtacgaacgccagcggcgtgaggaggagtatcagagtaggtaccgcagcgatccgaaccttgcgcgttatcccgtgaagccacagccatacgaggagcagatgcgaatccatgccgaggtgagccgggcaagacatgagcgtagacactcagacgtgtctctcgccaacgccgatcttgaggattctagaatctctatgttgaggatggaccgtccttcgagacagaggtcaatcagcgagaggagagcagcaatggagaaccaacgcagttactccatggagaggactcgtgaggctcagggaccctctagctacgcccagcgcaccacgaaccactcgccccctactccaagaagaagtcctttaccaatagaccgtcccgatctgcgacgcacagattccctgagaaaacagcaccacctagacccatcctccgccgtgcggaaaaccaaacgtgagaagatggagactatgcttcggaacgactctcttagcagcgaccagagtgaaagtgtaagacccccaccccctaaacctcacaaaagtaagaaggggggcaaaatgcgccagatttccttaagcagctcagaggaggaactggcttctacacctgagtacacatcatgcgatgatgtcgaaattgagagcgaatctgtgagtgaaaaaggtgatagtcagaaagggaaaaggaaaacgtccgaacaggctgtccttagcgactccaatactaggagtgaacgtcagaaagagatgatgtattttggggggcactcccttgaggaggatctggagtggtccgagccccaaatcaaagactccggtgtggatacgtgcagttctactaccctgaatgaggaacactcccattccgataaacatcccgttacctggcaaccaagcaaagacggggacagactgatcggaagaattttgttgaataaacgtttaaaggatgggtcagtgccccgtgactccggagctatgcttgggctcaaggtcgtgggcggcaagatgaccgagtctggtaggctctgcgccttcattacaaaggtcaagaaagggagcctggctgatactgtgggtcacctccgccccggtgatgaagtgctggagtggaacgggcgactgctccaaggcgcaacctttgaagaagtttacaacatcatcctcgagagcaaacctgaaccccaggtcgaactcgtggtgagtcgacctattggagacatacctagaattcccgactctactcacgcccagctggaaagcagctcatccagctttgagagccagaagatggatagaccgtcgattagtgttacatctcccatgtccccgggaatgctgcgagacgttcctcagttccttagcgggcagctttctattaagctgtggtttgacaaagtcggccaccagctgatcgtgacgattctgggagccaaggacctgcccagccgagaagacggcagaccgagaaacccttatgtgaaaatctacttccttcccgaccggtcggacaagaataaaagaagaactaagaccgtgaagaaaaccctcgagcctaaatggaatcaaacttttatatactccccagtccaccgacgcgaattccgagagcggatgctggaaattactctatgggaccaggctagggttcgcgaagaggagtctgagtttttgggggaaattctgattgaacttgaaacagcactactcgatgacgagcctcactggtacaagctgcagactcatgatgtttccagtctgcccttgccccaccctagcccttatatgcccaggcggcagctgcatggggagtcccctacaagaaggctgcagcggagtaagcgcatttcagatagcgaagtcagtgattacgattgcgacgacggcatcggcgtcgtctcggactataggcacgacgggcgggaccttcagagctcaactctcagcgtgccagagcaggtgatgagcagcaaccattgttcccccagcggctcccctcatagagttgatgtcattgggagaacccgttcctggtctcccagcgtcccgccacctcagagtaggaatgtggagcaagggctgcgtgggacacggactatgaccggacattacaacaccatttctcggatggacagacacagagttatggacgatcattacagcccagaccgggatcgggactgcgaggctgcggacagacagccttatcaccggagccggagcaccgaacagcggcccttactagagagaactacaacacggagccggtctacagaaagacctgatacgaacttaatgcggagcatgccttccctgatgactggaaggagtgccccccccagccctgccctgagtcggtcccatccccggacgggatctgtgcagacaagtccctctagcacgcctgtggccggtcgcaggggtcgtcagctcccacagctacctcccaaagggacattggacaggaaggccggaggcaagaagctgagatccaccgtgcagcgctcgaccgagaccgggctcgctgtggaaatgcggaactggatgactcgacaggcctccagagagagcaccgatgggtccatgaactcctactcatccgagggcaatctgatctttcctggcgtgagactggccagtgacagtcagttctccgatttcctggacggattgggccccgcacagctcgtggggagacaaaccctggcgactccagccatgggcgacatccaggtgggcatgatggacaagaaaggccaattggaggtcgaaataattcgggccagaggactggttgtaaaacccgggtcgaaaacgctgcccgctccgtacgtcaaggtgtaccttctggataacggcgtctgtattgctaaaaagaagacaaaggtggctagaaagacactcgaacctctctaccagcagctgctatctttcgaggagtccccacagggtaaggtgttacagatcattgtttggggggattacggccgaatggaccacaaatcattcatgggcgtcgcacagatactgctggacgaactggaactttccaatatggtcattggctggtttaaactttttcctccctcttcccttgttgatcctacactagcccctttaacgagacgggctagtcagagttctctagagagctctacaggcccgtcctatagtaggtcatag

SEQ ID NO: 132024 - DNA, 4161 bp, Artificial Sequence
  Description of Artificial Sequence: Synthetic coding sequence
atgtctgctcctgtaggcccacggggcaggctggcccccattccagctgccagtcagccgcccttacagcccgagatgcctgatctctcccacctcacagaggaggaacggaagattatcctggctgttatggacaggcagaaaaaggaagtcaaagaagaacataaaccacagctaacgcagtggtttccattctctgggattactgaactagttaataatgttctgcagcctcagcagaagcaacagaatgagaaagagcctcagactaagttgcaccagcagttcgagatgtataaggagcaggtcaagaaaatgggggaggaatcacagcaacagcaggagcaaaaaggagatgcaccaacttgcgggatctgtcataagacaaaattcgccgatggatgtggccacaactgctcatactgtcagactaaattctgcgctcgctgtggggggagggtctcccttcgcagcaacaaggttatgtgggtctgcaatctctgtcgcaagcagcaggagattctgaccaagtctggggcttggttttataacagtgggtcgaacacgccgcagcagcccgatcagaaggttctgcggggcctgagaaatgaggaagctccccaggaaaagaagcctaagctgcatgaacagacacagttccagggcccatccggcgacctcagtgtcccagccgtggaaaagtcacggagccatggccttactcgtcagcactcaatcaaaaacggcagcggtgtgaagcaccatatcgcaagcgatattgcatctgaccggaagcgttctcctagcgtttcccgagaccaaaataggagatatgatcaaagagaggaacgcgaggagtattctcaatacgccacttccgatacagcaatgcccaggtcgccttcagactacgctgacagacgcagccaacatgagccccaattctatgaggacagcgaccacttgtcatatcgggacagcaacaggcgcagtcaccgccactccaaagaatacattgtggacgatgaggatgtggagtcccgggacgaatatgaacgccagcgccgagaggaggaataccagtcccggtacaggagcgaccctaatttagcacgctatccggttaagccacagccctacgaggaacagatgcggatccacgcggaggtgagtcgagcacgccatgagaggaggcattccgacgttagtctggccaatgcggaccttgaggacagtaggattagcatgttgagaatggacaggccctcccggcagcgaagtatatccgagcggagggccgctatggaaaatcagcggtcctattccatggaaaggactcgcgaagcgcaaggaccttcctcgtacgcccagcgaaccacaaatcactcgcccccaacccctagacgaagtccattgcctatcgataggccagatttgagaaggacagattctttgcggaagcagcaccacttggatccgtcctccgcagtcagaaaaaccaagagggagaagatggagaccatgttgcgtaatgactctctatccagtgaccagtcggaatctgtgaggccccccccacccaagccacataagagtaagaagggcggcaagatgagacagatctctctcagcagctcagaggaggaactggcctctactccagaatacaccagctgtgacgacgtagaaatcgaatctgagagcgttagcgagaagggggatatggactataattggctcgaccacacctcttggcactcatcagaagcctcccctatgtctctgcatcctgtcacgtggcaaccctcaaaagacggcgaccgactgataggcagaattctgctcaacaagcgcctgaaggacggcagtgtgcctagggactccggcgccatgctgggtcttaaggttgtcggtggcaagatgactgaatctggcaggttgtgcgcgttcattactaaggttaaaaaaggatctctcgccgacaccgtaggccatctccggcctggtgatgaggttctagagtggaatgggaggctcctacagggggcgactttcgaggaagtgtacaatattatcttggagtccaagcccgagcctcaggtggaactcgtagttagcagaccaataggtgacatacccagaatcccagactctacccacgcccaattagaatctagctcctcctcattcgagagtcaaaagatggaccgcccttcaattagtgtgacatcaccgatgtcacccggcatgctacgggacgtgccacagttcctctccggccaattaagtattaaattgtggtttgacaaggtgggacaccagctgattgtcactattcttggcgcaaaggatctcccatcgcgagaggacggtcgacctcgaaacccgtatgtgaagatttacttcttgcccgatcgcagtgacaagaataagcggcgaaccaaaacggtgaagaaaaccctggagcccaaatggaaccagaccttcatttatagtcccgtgcacaggcgcgaattccgtgagaggatgttggagatcaccctttgggaccaggctagggtaagggaggaagagagtgaatttctgggcgaaattctaatcgaactggagaccgctctgctggatgacgaaccccactggtacaaactgcagacccacgatgtatcctctctcccgctgccccatcccagcccttacatgcctcgccgtcagctgcacggagaaagcccgactagaaggctccagcgcagtaaacgtatttcggactccgaggtgagcgactacgactgcgatgacggaataggcgtggtcagtgactaccgtcacgacggccgggatttgcaatcttctacactaagcgtgcctgaacaggttatgtcttctaaccattgcagtccctccggctcaccccatcgtgtggacgtgattggacggacccggagctggtcccctagtgtaccaccaccacagtcaagaaatgtggaacaaggcctgagagggacccggactatgaccggacactacaataccatatctcgcatggaccgacacagggtcatggatgatcactactcgcccgatagagatagccacttcttgacgttgccaagatcccgttattcccagaccatcgatcaccaccaccgcgatggtcgtgattgcgaggcagccgacagacagccttatcataggtccagatctaccgagcagaggccactcttggagcgtacaaccactcgaagtcgcagtactgagagacctgacaccaacttaatgaggtcgatgccgtcccttatgaccgggagatctgcccctccatccccagccttgtctagaagtcatccgcggaccggctccgtgcaaactagcccctcttcgactccagtcgcgggacgaagaggccggcagctgccacagcttccgccaaaggggacactcgaccggaaagccggtgggaaaaagctgagaagtaccgtgcagcgtagcactgaaactggcttggcagtcgaaatgagaaactggatgacacgtcaggcctcccgggagtcaacagacggaagtatgaacagctactcttcagaaggaaatctcatatttccaggggttcgactcgcgagcgacagccagtttagtgattttctcgacggtttaggccctgctcagctggtcgggaggcaaaccctcgcaacaccagcaatgggggacattcaagtgggaatgatggacaaaaagggccagctcgaggtggaaatcattcgggctcgaggcctagtggtgaagccgggcagtaagactctacccgctccgtacgtgaaagtgtatcttctggacaacggcgtctgtatcgctaagaagaaaacaaaggtggccagaaagacgctagagcctttataccagcagttactgagcttcgaagagtcgccacagggcaaagtgctgcagatcatagtgtggggtgactacgggaggatggaccacaaatctttcatgggcgtggcccagatacttcttgacgaattggagctctccaacatggtgatcggctggtttaaactgtttccgccatcttctctcgtggaccctaccctggcccctctcactcggcgtgcatcacagagctctctcgaatcttctaccggaccctcctactcccggtcctag

SEQ ID NO: 132025 - DNA, 858 bp, Artificial Sequence
  Description of Artificial Sequence: Synthetic coding sequence
atgggacgccagggtctcggcggggcgtcagccgcaggtaggagcatgcagcgttcccagtccaggagttcactgtcagccagttttgaagctcttgcaggctattttccatgcatgaacagccttgaagaagaggagggagaagcagggggaaagaaactccgaagcaccgtgcagaggtccactgaaactgggctggctgtcgaaatgaggaactggatgacccgccaggcatcacgtgagtcaaccgatggtagcatgaactcttattctagtgaggggaatctcatttttccaggtgtacgattagctagcgactcccagttctctgattttctagatggtctcggcccagctcaactggtgggccgccagaccctggcaacacctgccatgggggatatccaagtggggatgatggataagaagggacagctagaggtggagatcatacgtgctaggggactcgttgtcaaaccaggcagtaagacattaccagcgccctacgtgaaagtctatcttctggacaatggtgtttgcatcgcgaagaaaaagactaaggtggctaggaaaacattggaacccctctaccagcagttactttcctttgaagaatcaccacagggtaaggttctgcagattatagtgtggggagactatggacggatggaccacaaaagctttatgggcgtcgcacagattctcctggacgaactggaactctccaatatggtgatcggctggttcaaactgttcccaccttcgtcactcgtagatcctactcttgcgcctctgacgcgccgggcctctcagagcagccttgagtccagcacagggccgtcctacagtcgctcatag

SEQ ID NO: 132026 - DNA, 384 bp, Artificial Sequence
  Description of Artificial Sequence: Synthetic coding sequence
atgactgagtccggacggctgtgcgcctttattaccaaggtgaagaaaggaagtctggctgacaccgtgggccatctccgacccggggatgaagttctagaatggaatggcagactcctgcagggtgccaccttcgaagaggtgtataacattatactggagtcaaaacctgagcctcaggttgaactggttgtttctcggcctattggggacattcctcggattcccgactctacccacgctcaattggagtccagtctgcccggactcgcctggtggttgacccgggtcattccagcactatgggaggccgaggccggaggtagccgcgggcaggagatcgagactatcctggccaatacagtcaaaccccgcttatactag

SEQ ID NO: 132027 - DNA, 4236 bp, Artificial Sequence
  Description of Artificial Sequence: Synthetic coding sequence
atgtcagctccggtggggccgcgcggccggctggctccgattcccgccgcctcccaaccacccctgcaaccagagatgcccgacctgagccatttaacagaggaagaacgaaagataattctcgctgtgatggaccgtcagaaaaaggaagtgaaagaagagcacaagcctcagcttactcaatggtttcctttttctggaatcaccgagctggtgaataacgttcttcagcctcagcagaaacagcaaaatgagaaagagcctcagactaagctccatcagcagttcgagatgtataaagaacaggtgaaaaagatgggagaagagtcccaacaacaacaagagcagaagggagacgcccctacctgcggaatatgtcacaagactaagttcgctgacggctgcggccataactgcagctactgccagactaagttctgcgcccgttgcggaggccgcgtcagccttcgctccaataaggtgatgtgggtctgcaatctctgtcgcaaacagcaagagatccttacaaagtctggcgcctggttctataacagtggtagtaataccccgcagcaacccgatcaaaaggtcctgaggggtctgcggaacgaggaggccccacaggagaagaaacctaaactccatgaacagacacagtttcagggacccagcggcgatctgtctgtgccagcggttgagaagagtcgctcacatggcctgacgcgacagcattccatcaagaatggttccggcgtcaagcatcacattgcctccgatattgcctctgatagaaagagatccccctcagtcagcagagatcaaaatcgccgatatgaccaaagggaggaaagagaggagtactcccagtatgctaccagtgacacagctatgcctcgttccccttctgactacgccgacagacggagccaacacgagccccagttctatgaggatagtgaccacttgtcatacagagattctaacagacgcagtcatcgacactctaaagagtacattgtggatgatgaggatgtcgagtccagagatgagtatgagcgccagagaagggaggaggaataccagtctcgctaccgatccgaccccaacctggcccgataccccgtgaagcctcagccttatgaggaacaaatgagaatccacgctgaggtgagtcgcgccagacacgagcgcaggcactctgatgttagtcttgccaacgccgaccttgaggactctagaatcagtatgctgcggatggatcgcccgagcagacagagatccatatctgagagacgtgccgctatggaaaatcagcgatcttactccatggaaaggaccagggaagcacagggaccctctagctacgcccagcgcacaaccaaccacagcccccccactcctcggcgctcacctctccccatcgataggcctgatctacggaggactgacagcctgcggaaacagcaccacctggacccttcttctgctgttcggaaaactaaacgggagaaaatggaaacgatgctccgcaatgacagcttgagctcagaccaaagcgaatccgtgaggcctcctccccctaagcctcataagagtaaaaagggcggtaaaatgcgtcaaatatccctctccagtagcgaggaagagctggcctcaactcccgaatatacgagctgcgacgatgtggaaattgagtctgaatccgtttctgaaaaaggggatagtcagaagggaaagagaaagactagtgaacaggcagtgttatctgatagtaatactagaagcgagcgccaaaaagagatgatgtattttggaggccattctctggaagaggacttagagtggtcagagccccagataaaggactccggcgtggatacttgcagctcaaccactctgaatgaggagcattcccattccgataaacaccccgtcacatggcagcctagcaaagacggagataggctgattggccgcatcctgctgaacaaaagacttaaggatggctcagtaccaagagatagcggtgctatgctgggtttgaaggtggtggggggcaagatgacagaatccggacggttgtgcgccttcatcaccaaagtaaaaaaggggagccttgcagacactgttggacacttaagaccaggcgacgaagtcctcgaatggaacggaaggctgcttcagggcgcaacatttgaggaagtgtacaatatcattctggagagcaagcccgaacctcaagtagagctggttgtttcccggcctatcggcgatattccccgcattcccgactctacacacgctcagctcgaaagcagttcttctagctttgaatcacagaagatggataggccttccatcagtgtgacaagtcccatgagcccaggcatgcttcgcgacgtcccgcagttcctaagcggtcagctgagcataaaactctggtttgataaggtgggacatcagctcatcgtgaccatacttggtgcaaaggatctgccaagtcgggaagacggccgcccacggaacccttacgtgaagatttacttcctccccgaccggagcgacaagaacaaaaggcgcactaaaacagtgaagaagactctcgagccaaaatggaaccagaccttcatctatagtccagttcaccgccgcgagttccgtgagcgtatgctggaaatcacgctgtgggatcaggcaagggttagagaagaagagagcgaattcctgggcgaaatcttgatagagcttgaaaccgcactgttggacgacgagccccactggtataagctgcagacccatgacgtgagttctctgccactgcctcatccatcgccgtacatgccccgccggcagctccatggggagagtcccacccgcagactccagagatctaagcgcatctcagatagcgaagtgagtgattatgactgcgatgacgggatcggagtcgttagtgattaccgccatgacgggcgggatcttcagtcttccaccctctctgtcccggagcaggtgatgagcagcaatcactgcagccccagcgggtctccccaccgcgttgacgtgatcggacgtactcgctcttggtcaccttccgtgccgcccccccagagtcgaaacgtagaacaggggctgcgaggcacccgcactatgaccggacactacaatacaatctcccgtatggatagacatagggtaatggatgaccattacagtcctgatcgcgaccgcgactgtgaagcagccgacagacagccctatcaccgaagtagatctacagagcagcggcctctactggaaagaactacaacacgatctagatccacagagcggcctgacacaaacctcatgcgctccatgccttccctgatgactggacggtctgcccctcccagcccagccttatcaagaagccacccacgcactggctccgtgcagacatcaccttcctctactcctgtggctggccggaggggcagacagttgccccagcttccccccaagggaacccttgatagaaaagccgggggaaaaaaattgcgctcaaccgtacagcgctccactgaaacgggtctggccgtggagatgaggaactggatgacgcggcaggcctcacgggaaagcacagacggaagcatgaactcctactctagcgaaggcaacttgatctttcccggcgtcagactggccagcgactcacagttttcagattttttggatggactgggtcctgcacagctggttggtcgccagactttagccaccccagccatgggcgatattcaagttgggatgatggacaagaaaggtcagctggaagtggagattatccgcgcacgcggcctggtggtcaagcccggaagcaagaccttgcctgctccatatgttaaggtgtatttactcgataacggagtgtgtatcgccaaaaagaaaaccaaagtcgcacgaaagacacttgaacccctatatcagcagctcctctcatttgaggaaagtccccagggcaaggttctgcaaataattgtgtggggggattacggccgcatggaccataaatcctttatgggcgtggcccagatcctgttggatgaacttgaactttcaaatatggtaatcgggtggttcaaactctttccaccctcatccctggtggacccaaccctagctcccctaaccaggagagccagccagtcctcccttgagagctccaccggaccatcctattcccgatcatag

SEQ ID NO: 132028 - DNA, 4050 bp, Artificial Sequence
  Description of Artificial Sequence: Synthetic coding sequence
atgtctgcacccgtcggccccaggggacgtttggcaccaattccggctgctagccagccccctctacagccagaaatgcccgacctgtcccatctcaccgaggaagagcggaagatcatactagcagttatggaccgtcaaaagaaggaagaagaaaaggagcaatctgtcctgaagaagctgcatcagcagtttgagatgtacaaggagcaggtgaaaaaaatgggtgaagagagccaacagcaacaagaacagaagggtgacgccccgacctgtggaatttgtcacaagacgaagttcgctgatgggtgcggtcacaactgtagctattgtcagactaaattttgcgcgcggtgcggcggccgagtaagcctaaggtcgaataaggtgatgtgggtctgtaatctgtgtcgcaagcagcaggagattctgacgaaaagcggggcttggttttataattccggatcaaacacccctcagcaacctgaccagaaggtcctcaggggcttaaggaacgaagaggccccgcaggagaaaaaaccgaagctccacgagcagactcagtttcaaggcccctccggcgatctgtccgttcccgctgtagagaaaagcagatctcacggcctcaccaggcagcattccatcaaaaatggctcaggtgtgaaacatcatattgcttcagacatcgcctcagaccgcaaaagatccccttccgtgtctagggaccaaaaccgacggtatgatcagcgcgaggaacgcgaagagtattcccagtacgccacgtcagataccgctatgccaaggtcacccagtgattatgcagatcggaggagtcaacatgagcctcagttctacgaagactcagaccacctctcctatagagactctaaccgcagaagccaccggcatagcaaggaatacatcgtggatgacgaggatgtggagagtagggacgagtacgaaagacagagacgcgaggaggagtatcagtcacggtatcggtctgatcctaatctcgctcggtaccccgtcaagccccagccatacgaagagcagatgcgaattcatgctgaggtcagtcgcgccagacacgaacggcggcactcagacgtgagcttagccaatgctgacttggaggattctcggatctccatgttgagaatggatcgtccgtccagacaaaggagtattagcgagcgccgggctgccatggagaaccagcgcagttattcgatggagcggacccgcgaggcgcagggtccatcatcttacgctcaacggaccacaaatcacagtccaccaacacccaggcggagtccgttgcctattgatcgtccggacttaagacggacagacagcctgcgcaagcagcatcacctcgatcccagctcggctgtgaggaaaacaaagcgcgagaagatggaaaccatgcttagaaatgacagccttagtagcgaccagagtgaatcggtgaggcctccgccaccgaagcctcataagagcaagaagggcggcaagatgaggcagattagcctctcctctagcgaggaggaactggccagcacccccgagtacaccagttgcgatgacgtggagatagagagcgagagtgtgtccgagaaaggcgatatggattacaattggctggaccacacctcttggcactcctctgaggcatctcccatgtcccttcacccagttacttggcagccatccaaggacggcgaccggttgattggacgaattctgctaaataaaagactcaaagacggcagcgtgcctagagattctggcgccatgcttggactcaaggtggtgggaggcaaaatgacagagtccggccgactgtgcgccttcataactaaagtgaagaagggaagcctggccgacaccgtagggcaccttagaccaggggatgaggtcctggaatggaatggcagactgctacagggggccacattcgaagaagtatataacattatactggagtcgaaacccgagccacaggtggagctcgtggtctctcgcccaattggagacattccccggatccccgacagcacacacgcccagcttgaatcaagctctagtagctttgagtctcaaaaaatggataggccgagcataagcgtgacaagcccaatgtccccaggcatgctccgggatgtccctcagtttttgtctggacagttaagctcacagtcgctgtcccggcgaacgactccattcgtgccaagggtgcagatcaaactttggttcgacaaggtggggcaccagttgatcgtgactattcttggggccaaagacctgccttcacgggaagacggacggccccgaaatccatacgtcaagatttacttcctgccagaccgaagcgacaagaacaaaaggcgaaccaagacagtgaagaagacattggaacccaagtggaaccaaacgtttatctacagcccagttcatagacgcgagtttcgagagaggatgctggagattacgctctgggatcaggcgcgagttagggaagaggagagcgaatttctcggtgaaattctgatagagttggaaaccgccctgctggacgacgaacctcactggtacaagctgcaaacccacgacgtctcctctctgcccttgccccaccctagtccctacatgccacgccgtcagctgcacggtgaaagccccacaaggagactgcagcggagtaaacggattagcgattccgaggtgagcgactacgactgtgacgacgggatcggagtagtcagcgactaccgacatgacggcagggatctacagtcaagcactctgtctgtacctgaacaggtaatgtcgagcaaccattgtagcccaagcggatccccacatagagtagacgttattggccggactagaagttggtctccatcggttccacccccacaatcacggaacgttgagcaggggttgaggggaactcggactatgactggccactataatacgatttcacgcatggaccgccatcgggtgatggacgatcactattcccccgaccgggaccgagactgcgaggcagccgacaggcagccataccaccggtcacgcagtaccgagcaacggccactgctggagcggaccacgacgaggtcccgatccaccgaacgccccgataccaacctgatgaggtccatgcctagcctgatgactggacgttccgcgccccccagccctgcgctgtcccggagtcatccgcgcacaggctcagtgcagacgtcacccagctcgacccccgtggccggcaggagagggaggcagttgcctcagctgcccccaaaagggacactagacagaaaggccggtggtaaaaagctcaggtctacagtgcaacgttctacggaaactgggctcgctgtggaaatgcggaactggatgaccaggcaggcatccagagagtctactgatggctccatgaattcctattcatctgaaggaaacctaattttccctggcgtgcgcttggcctcagacagtcagttctctgattttctagacggcctcgggcccgcccaactggtgggccgtcagactttagcaactcctgccatgggagacatccaggttgggatgatggataaaaagggccagctcgaggtggaaatcattagggcaaggggactcgtcgtcaagcccggttccaagacactgcccgctccatacgtcaaggtctatctgctggacaacggggtctgcatcgccaagaaaaaaacaaaggtggcccggaagactctggagccattgtatcaacaacttctaagtttcgaggaaagccctcaaggcaaagtgctgcagattatagtatggggagactatgggagaatggatcataaaagttttatgggcgtggcccagatacttctggatgaattagagttgagtaatatggtaatcggttggtttaagctcttccctcctagctcacttgttgatcctactcttgccccccttactcgtcgcgcgtcccagtcatccctcgagtcctctactgggcctagctacagcagatcctag

SEQ ID NO: 132029 - DNA, 3492 bp, Artificial Sequence
  Description of Artificial Sequence: Synthetic coding sequence
atgcagttcgaaaccctcagacaggtgtgcaactcagttcttagccatttccatggtgtgttttcatctcctcccaatattctacagaacgaactgtttggccagaccttgaataacgccaggaaaagaagcccatctgttagccgtgaccagaacagacggtatgatcagcgggaggaacgcgaggaatactcacagtacgccactagtgatacagctatgccacgttctccctccgattatgcagacagacggtcccagcacgaaccacaattctatgaggattccgatcatttgagctaccgagactcaaaccggcggagccacagacactcaaaagaatatatagtggacgacgaagacgtggaaagccgggatgaatacgagcggcagcgcagagaggaagaatatcagagtagatatcgaagtgacccaaatctggccagatatcctgttaagccacaaccatacgaggagcagatgagaatccacgccgaagtatcaagagcccgacacgagagaaggcactctgacgtaagcctggccaacgcggatctagaagactctaggattagtatgctgcgtatggacaggccttcccgccagcgctctatttccgaaaggagagcagccatggagaaccagaggagttatagcatggagcggacacgcgaggcccagggcccaagcagctacgcccagcggacaacaaatcactctccccctacaccacggaggagcccattacccatagataggcccgaccttcggaggaccgatagtctcagaaaacagcatcacttggaccccagttcggcagtgcgaaagaccaagcgggagaagatggaaactatgctcaggaacgacagtctgtcttctgaccaaagtgagtctgtgaggccgcctcccccaaagcctcataaaagcaagaaagggggaaagatgcgtcagattagtctatccagctccgaggaggagctggcgagcacgcccgaatacacctcatgtgatgatgtggagatcgaatctgagtcagttagtgagaagggcgacatggactataactggctggatcacacctcctggcactctagcgaggcttccccaatgagcttgcaccctgttacttggcagcctagcaaagatggcgaccggctcatcggccgtatattactgaataagcggctaaaagacggttcggtaccacgggacagcggagcaatgcttggtctcaaggttgttgggggaaagatgactgagtccggacgcctgtgcgcgtttatcacgaaggtcaagaaggggagccttgctgatacagtgggtcatctgaggcccggtgatgaggtgctagagtggaacgggcgcctactccagggggccacttttgaggaggtgtacaatatcatcctagagtccaagccggagccgcaggtcgaactggtagtttcgaggcccattggtgatatccctagaattccagactccacgcatgcacagcttgaatcaagctcttccagctttgaatcacagaaaatggaccggccatccatctccgtcacatcccccatgtcccctggcatgctccgagatgtgccacagtttttaagcggtcagctttccatcaaattatggttcgacaaagtgggacatcagctgatcgtcaccatcctgggcgccaaagacctccccagtagggaagacgggcggccccggaacccttatgtgaaaatatacttcttacccgacagatcagataaaaacaagaggcgtaccaagactgtgaagaaaaccctggaacccaagtggaaccagactttcatttactcccccgtccataggagggagttcagagaaagaatgctagagattacgctctgggaccaggcaagggtgcgcgaagaggagagtgagtttctcggtgagatcttgatcgaactggaaactgctttgctggatgacgaaccacattggtacaagttgcagactcatgacgtgtcaagcctgccgttaccccacccctcaccatacatgccgagacgtcaactccacggtgagtcgccaacaagaagactccaacgtagcaaacgcataagcgattctgaggtgagtgactatgattgtgatgatggcattggcgtggtgagcgactataggcacgacgggagggacctgcaatcttctaccctgtccgtgcccgaacaggtcatgtcctcaaaccactgctcccccagtgggtccccccaccgggtcgacgtgatcgggaggactcgttcctggtcaccgtctgtgccacccccacagagcagaaatgtggagcagggtttgcgtggtacacgcacaatgaccgggcactacaacaccatctctaggatggatcgacaccgcgtcatggatgatcactattcccctgaccgggattctcactttcttacacttcccaggtctaggtatagccagaccatagaccatcaccacagagacgggcgagattgtgaagcagctgacagacaaccttaccatcgatctaggtctactgaacagcgccctcttcttgagcggactactacccgcagcaggtctactgaacgccctgacaccaatctcatgaggagtatgccttcgctcatgaccggacgtagtgccccacctagcccagccttgtcaagatcccatcctcgcacgggcagcgttcagaccagtccatcctcgacacctgtggccggccgcagaggccgacaactcccgcagcttcctcctaagggaactctggatcggaaagcaggtggaaaaaaactgcgtagcactgtccagaggtctacagagaccgggctcgccgtggaaatgcgtaattggatgacccgtcaagcctctagagagagtactgatggctccatgaacagctattcttctgaggggaacctaatcttcccgggcgtccgcctggcgtccgactcacagttctccgactttctcgatggccttggccccgcacaactggtggggcgccagacccttgccacacccgcaatgggagatattcaggtgggtatgatggacaaaaagggccaattggaagttgaaattataagagcacgagggctcgtggtcaagccgggctctaaaacactgcctgccccttacgttaaagtttacttgttggataacggggtatgcattgctaaaaagaagaccaaggtggcacgcaaaacgctagaacctctataccaacagctgctgtcctttgaggaatcacctcagggcaaggttctacagattatcgtttggggcgactacggaaggatggatcacaagtcttttatgggagtggcccagatacttctcgatgaactagaattatctaatatggtgatcggttggttcaaactctttcccccatcgagtctcgtcgaccccacactggccccccttacacggcgcgcctctcaaagtagcctcgaatcttccacagggccttcctattccaggtcttag

SEQ ID NO: 132030 - DNA, 927 bp, Artificial Sequence
  Description of Artificial Sequence: Synthetic coding sequence
atgtttaatggagaacctggaccagcctctagtggcgccagtaggaatgtcgtcagaagctcatctatcagcggagaaatctgcgggtcccaacaagctggcgggggcgctggcacaaccaccgccaagaaacgaagatcttcattaggcgccaagatggtagccatcgtcggcctgacgcagtggagtaaaagcactcttcaactgccccagcctgagggagctaccaagaagcttcggagcaacatcagacgtagcactgaaaccgggattgcagtggagatgcgctcccgcgtcacccgacagggatcacgagaatcaactgatggatcaaccaatagtaatagcagtgatggaaccttcattttccccactacccgcctgggcgctgagtcccagttctcagacttcttagatgggctgggcccagcccagatagtggggcgccagacgctcgcgaccccaccaatgggagacgtgcatattgctataatggaccgcagcggtcagctggaagtagaagtgatagaggctcgcgggctcactccaaagccggggtctaagtcccttcccgccacgtatatcaaagtgtacctgctcgagaatggtgcctgcctggctaagaagaaaacgaagatgaccaaaaagacgtgcgaccccttataccagcaggcgttgctgttcgacgagggaccgcagggaaaggtactgcaggtcatcgtgtggggcgactatgggcgcatggatcacaagtgcttcatgggaatggcacaaattatgctggacgaattagatctctccgctgccgttacaggatggtacaagctattccctacttcctccgtggccgactcaactctaggttcactaactaggcgactgagtcagagtagccttgagagcgccacttccccctcttgtagttag

SEQ ID NO: 132031 - DNA, 927 bp, Artificial Sequence
  Description of Artificial Sequence: Synthetic coding sequence
atgtttaacggagagcctggcccagccagttccggcgcttccagaaatgtcgtccggagcagcagcatctctggcgaaatttgcggatcccaacaagccggcggtggcgccggcacaacaactgcaaagaagaggcggagttctctgggagctaagatggtggctatcgtcggcttaacccaatggagcaagtctacactgcagctaccccagcctgaaggcgccaccaagaagctccgcagcaatattagacgctctacggaaaccggcatagcagtagaaatgcgttctcgagtgactcgccaaggcagcagagagtccaccgatggatcaacaaatagcaattctagcgatgggaccttcatttttccaaccacaagactgggcgccgaatctcagttttccgattttctagacggccttggccctgctcagattgtgggccggcagaccctagctactccacctatgggagacgtgcatattgctattatggataggtctggacagctcgaggtggaggttatagaggctaggggcctgacacctaagccgggcagcaagtccctgcccgctacatatattaaagtgtatctgctcgagaacggagcttgtctcgcgaaaaaaaagactaagatgaccaagaaaacatgtgaccccctctatcagcaagccctcttgtttgatgaaggtccacaaggtaaagtgttacaggtgatcgtttggggggattatgggaggatggaccacaagtgctttatggggatggcacagatcatgctggatgagctggatctatccgccgccgtaacggggtggtacaaactgtttcccacaagcagtgtggctgattcaaccctcggcagcctgacaagaagactcagccagtccagtcttgagtccgccacaagccctagctgctcttag

SEQ ID NO: 132032 - DNA, 810 bp, Artificial Sequence
  Description of Artificial Sequence: Synthetic coding sequence
atggaacgaagccaatcccggttgtctttaagcgcaagtttcgaggcactggccatctatttcccctgtatgaatagcttcgatgacgaggatgctggcgactctcggcgtcttaagggggcaatacaacgatctaccgagaccggactcgccgtggagatgccatcgcgtacactccgacaagctagtcatgaatcaatcgaagattctatgaatagctatggctccgaggggaatttaaactacggcggggtctgtcttgctagtgacgcccagttctctgattttcttggttctatgggtcccgcccagtttgtagggaggcagacactggctacaacaccaatgggggacgtcgaaatagggctacaggagagaaacggacagctggaagtggatataatccaggcacggggtctaactgcaaagccaggctccaagactctgccggcagcgtatatcaaggcatatctcttggagaatgggatttgtatcgcaaagaagaaaactaaagtggcgcggaaatccttagaccccctgtacaaccaggtcctgctgtttcccgagagcccccagggaaaggtgctgcaggtaattgtctggggaaactatgggcggatggaacgcaaacagttcatgggcgtcgcgagagttttgctagaagagctagaccttactacactggccgtcggctggtataagctgttcccaaccagcagtatggtggatcctgccactggccctctgctgaggcaggcctcgcaactctcactcgaatctacagttggaccctgtggggagcgtagttag

SEQ ID NO: 132033 - DNA, 813 bp, Artificial Sequence
  Description of Artificial Sequence: Synthetic coding sequence
atggaaagaagccagtctcggcttagcctctctgcctcttttgaagcactcgcaatttactttccttgtatgaattcattcgacgacgaggacgctgaaggagattcacggagactgaagggcgcaattcagcgatcaaccgagactggactcgccgtggagatgccttcacgcacgctccggcaagcctcacacgaatctatcgaagatagcatgaattcatacgggagcgaggggaacctgaattatggcggagtctgcttagcaagcgatgcccaattcagtgacttcctgggatccatgggccctgcacaatttgtcggaaggcagacgttggctaccacacccatgggggacgtggaaatcggccttcaagaaagaaacggccagctcgaggtggatatcatccaggccaggggtcttactgcaaaacctgggtccaaaacccttccggccgcctatataaaggcctaccttttggagaatggaatttgtatcgccaagaagaagactaaggttgcacgtaagagcctagatcccctttataaccaggtcctgctgttcccagagagcccgcaaggtaaggtcctgcaggtcatagtctggggaaattacggtcggatggagcggaagcagttcatgggggttgctcgggtgctgctcgaagaactcgatttgacaaccctggctgttgggtggtataaactcttccccactagctcaatggtcgaccctgccaccggccccctgcttagacaggcttcgcagctttcccttgagtccactgtggggccttgcggcgagagaagttag

SEQ ID NO: 132034 - DNA, 759 bp, Artificial Sequence
  Description of Artificial Sequence: Synthetic coding sequence
atggaggacggtgtcgcgggtccacagttaggcgccgccgctgaggccgcagaggctgccgaggcacgggctaggcctggagttacacttaggcctttcgcaccactgtctggtgccgccgaagcagatgagggagggggagattggagctttattgactgcgaaatggaggaggttgatctgcaagacttgcccagtgccactatcgcatgtcacctcgacccacgagtgttcgtcgatggcctctgtcgtgcgaagtttgaatcccttttcagaacctatgacaaggacatcacattccagtacttcaagtctttcaagcgggtgcggattaatttcagcaaccccttttcagctgccgacgctcgccttcagctgcataagaccgaatttttgggaaaggaaatgaaactatatttcgcgcagacacttcacattgggtcctcacacttggcgccacctaaccccgacaaacagtttctgatatccccccccgcttccccccctgtgggatggaaacaggtggaagacgccacacctgtgattaattatgaccttctgtacgctataagtaaactggggccaggagaaaagtacgaactccatgccgctaccgatacaacccccagtgtggtagtgcatgtgtgtgaatcagaccaggaaaaggaagaagaagaggagatggagcggatgcgccgtccaaagcctaaaatcattcagactcgccgaccagagtatactcctattcatctaagttag

SEQ ID NO: 132035 - DNA, 594 bp, Artificial Sequence
  Description of Artificial Sequence: Synthetic coding sequence
atgcacttccgaaactttaactacagttttagttcattgatcgcatgtgtggctaattcagatatattctccgaatcggagaccagggccaaattcgaatccctgttccgaacctatgataaggatattacatttcagtattttaagagcttcaaacgcgtccgcataaacttctctaatcccttctcagccgccgatgctcgcctgcaattacataaaacggagtttcttggaaaagagatgaaactgtatttcgcacagacccttcatatcggatcttcccacttggcaccccctaaccccgacaagcaattcttgatcagccctcctgcatcaccacctgttggctggaagcaggtggaagacgccactcccgtgatcaactacgatttgttgtacgccattagcaaactcggccccggcgagaaatatgagctgcacgccgctactgacacaactccatccgtagttgttcatgtgtgcgagtccgatcaggaaaaggaggaggaagaggaaatggagcgcatgcgccggccaaaacccaaaataatccagaccagaagacctgaatacaccccaattcatctgtcatag

SEQ ID NO: 132036 - DNA, 729 bp, Artificial Sequence
  Description of Artificial Sequence: Synthetic coding sequence
atgcagggcgagcagggtcggcgtctctttagactgctgctgaacgacctgcctggcagggatcggcttccgtgttcatatccacaaccacacgtagagcaggcttctacctcagcgtctcccaggctgctagcggtcaacatacctgaggatacactcctgtcctatcctgagtcttcactgcccctgcaacggcattgtgccttccacaggttctccaaggccaaattcgaatcacttttccggacttatgacaaagacatcaccttccaatactttaagtctttcaagcgagtgcgcattaacttttctaatccgttttcagcagctgacgctagattacagcttcataaaaccgaattcctgggaaaagagatgaaactgtacttcgcgcagacccttcacataggctcgagtcatttggcacccccaaatcccgacaagcaattcttgatatctcccccggccagcccccccgtgggttggaaacaagtggaagacgccacccccgtaattaactatgatcttctctatgccatctctaagttaggcccaggggagaaatatgagctccacgccgctaccgacacgacacccagtgtagttgttcacgtatgcgaaagtgatcaggaaaaggaagaggaagaagaaatggagcggatgcgaagaccaaaaccgaaaatcatccagaccaggaggcctgaatatactcctattcacctgtcgtag

SEQ ID NO: 132037 - DNA, 354 bp, Artificial Sequence
  Description of Artificial Sequence: Synthetic coding sequence
atgaaactgtacttcgcccaaacactgcacattggaagctctcatctggcccctcctaacccggacaagcaattcctcatcagccctccggcctcccctccggttgggtggaagcaagtagaggatgccacaccggtgatcaattacgatctgctgtatgccatctcaaagctgggaccaggagagaagtatgagttgcatgctgccaccgacacaacgccaagtgtcgtcgtgcacgtctgtgagagtgatcaggagaaagaagaggaagaggagatggagcgcatgaggcggccaaaacctaagatcattcagacgcgccgccctgaatacacaccaatacacttatcttag

SEQ ID NO: 132038 - DNA, 354 bp, Artificial Sequence
  Description of Artificial Sequence: Synthetic coding sequence
atgaagctctacttcgctcagactctgcacataggctcttcccacctggcacctcccaaccccgataaacagtttcttatctcaccacccgcctccccccctgtgggctggaagcaggtcgaggatgctacgccggtgattaattacgacttactgtacgccatcagcaagctcgggccaggcgaaaaatatgaactacacgcagccaccgacactacccccagtgtggtggtccacgtttgtgaaagtgaccaagagaaagaagaggaggaggaaatggaacgtatgagaaggcctaagccaaagataatccaaacaagaaggcctgaatacactcccatccacctaagctag

SEQ ID NO: 132039 - DNA, 354 bp, Artificial Sequence
  Description of Artificial Sequence: Synthetic coding sequence
atgaaactgtactttgcacagaccctgcacattggatccagtcacttagcaccaccaaaccctgacaaacagtttcttatttcgccacccgccagtccaccagtcggatggaaacaagtggaagatgcaaccccagtaattaactacgatctgctctacgccattagcaagctgggtccaggagaaaagtatgagctccatgcagcgactgatacaacaccttccgtggtagtgcacgtgtgcgagtcagaccaggagaaagaggaggaagaagaaatggagagaatgaggcgccccaagccaaagattatacagacccgccgccccgagtacacgccaattcatctcagttag

SEQ ID NO: 132040 - DNA, 732 bp, Artificial Sequence
  Description of Artificial Sequence: Synthetic coding sequence
atgaggggggagtcgtacttcattggtatgcgatctcccggccagcaaggacacgtgcctgaggatggcgggttgttcttgctgtgctgtatcgatagagactgggctgtcacaagatgttttgctgaggaagcttttcaagctataaccgatttcaacgacctaccaaactccctttttgcgtgcaacgttcatcagtccgttttcgagggggaagaatctaaggaaaagttcgagggtctgtttagaacctatgacgattgcgtcacatttcagctgtttaaatccttcagaagggtgaggattaacttctccaatcccaagtccgccgccagggcgaggatcgaattgcacgaaacccagtttcggggtaagaagcttaaactgtatttcgctcaggtgcagacacctgagaccgacggtgacaagctgcacttggctcctccccagcctgcaaaacagttcctcatatctccaccctccagcccaccagtcggctggcagcccatcaacgatgccacccctgtcctgaactacgatctgctctatgccgtggctaagctgggacccggagagaaatacgaactacatgcaggaactgagagtacgccctccgtggttgtgcacgtctgcgactctgacatcgaagaggaggaggacccaaaaacgtccccgaagccaaaaattatacagacaagacgccccggcctcccgccttcagtgagtaactag

SEQ ID NO: 132041 - DNA, 594 bp, Artificial Sequence
  Description of Artificial Sequence: Synthetic coding sequence
atgcctgcaccttctatggattgcgacgtgagtacgctggttgcctgtgtggtggacgtcgaggtcttcactaaccaggaggtcaaagagaaattcgaaggtctttttcgcacttacgatgactgtgttaccttccaactgttcaaatccttcagacgagtacggatcaacttcagtaacccgaaatcagccgcacgcgctagaattgagttacacgagacccagttccgcggcaagaagttgaagctctattttgcccaggtgcagacccccgaaacagatggtgataagttgcacctggcacccccccagccagcgaagcagtttttaattagccccccctctagcccacccgtcggctggcagcccattaacgacgctactccagtactgaattatgatctgctgtatgcagtggctaagttaggacccggtgaaaagtacgagctgcatgctggcacagaatccactccatctgtggtagtccacgtctgtgacagtgacattgaggaggaagaggacccgaagacaagccctaaacccaagattatccagaccaggcggccgggcctgcccccatccgtctccaattag

SEQ ID NO: 132042 - DNA, 732 bp, Artificial Sequence
  Description of Artificial Sequence: Synthetic coding sequence
atgcggggagaatcctacttcatcggcatgcgatcacccggacagcaaggccacgttcctgaggatggcgggctcttcctgctctgttgtatcgacagggactgggcagtgacacggtgcttcgctgaagaagccttccaagcgatcaccgatttcaacgacctgcccaacagtctcttcgcctgcaatgttcaccagagtgttttcgaaggcgaggagtcaaaggagaagttcgaggggctgtttagaacatatgatgactgtgtgacctttcagctgttcaaaagctttagaagggttaggataaacttcagcaaccccaaaagcgctgctagagctcgaatcgagctgcacgaaactcaattccgggggaaaaagctcaaattgtactttgcacaggtccagacccccgagacggacggagacaagctgcaccttgctccaccccagcccgctaaacaattcctgatatctcctccatcttccccacccgttggttggcagcctattaacgacgccacgcctgtgcttaactatgaccttctatatgccgtggcaaagctgggccccggggaaaagtacgagttacacgctggaaccgaatctaccccgtcagtggtagtgcatgtctgcgactctgatatcgaagaggaagaggaccccaagactagtccaaagccgaagatcattcagacacgtaggcccggcttgccaccttctgtgagcaattag

SEQ ID NO: 132043 - DNA, 732 bp, Artificial Sequence
  Description of Artificial Sequence: Synthetic coding sequence
atgaggggggaatcctactttatcggtatgagatcccctggccagcagggacatgtccccgaagatggaggcctgtttctcctgtgctgcatcgaccgcgactgggctgtcaccagatgcttcgctgaagaagcctttcaagcaatcacagacttcaacgacttgccaaactccctatttgcttgcaatgttcatcaaagtgtcttcgaaggagaagagtccaaagagaagtttgaaggcctgttcagaacttacgatgactgcgttacgtttcaactgtttaagtcgtttcgtcgggtgaggattaattttagcaatcccaaatctgccgctagggcgcgaattgagctgcatgagacacagtttcggggaaagaagttgaaactatactttgcacaggtgcagactcccgagacagacggggataagctgcatctcgcccctccccaaccagccaagcagtttctgatttccccccctagcagtcccccggtgggctggcaaccaattaatgacgctactcctgtcttgaactacgacttgctctatgcggtcgccaagttggggccaggtgaaaagtacgaattgcacgcaggaacagagtccactcccagtgtagtggtccatgtttgtgacagcgacattgaggaggaggaagaccccaagactagtccaaagccaaagattatccagactcgaagaccaggattgcccccaagcgtgagcaactag

SEQ ID NO: 132044 - DNA, 1596 bp, Artificial Sequence
  Description of Artificial Sequence: Synthetic coding sequence
atggttgatgtggggaagtggcctatcttcacattgctgagcccacaagaaattgcctccattcgtaaagcttgtgtctttggcactagtgcgagcgaggccctgtacgtcaccgataatgatgaggtcttcgtgttcggccttaactactccaattgcttaggcactggcgataatcagtcaaccctagttccaaagaagctagagggcctgtgcggcaaaaaaattaagtccctgtcatatggatcagggccacacgtcctgttaagtaccgaggacggagtggtgtacgcctggggtcataatggttactcccaattgggaaatggaactaccaatcagggaattgcccctgtccaggtttgtactaacctcctgatcaaacaggttgtggaagtggcctgtggtagccatcactccatggccctggccgccgacggggaagtgttcgcgtggggttataataactgtggacaagtcgggagcggctcaacagcaaaccagcccaccccgagaaaggtcaccaactgccttcacatcaaaagggttgtagggatagcctgtggccagacaagctcaatggcggtcctagacaacggagaggtgtacggctggggttacaatggaaacgggcagttagggctgggcaataacggaaatcaattaaccccagtgcgagttgcagccctgcactcggtctgtgttaaccaaatcgtttgcggatatgctcatactctggccctgacagatgagggcctgctctatgcttggggagccaacacgtatggccagttgggaaccggaaacaaaaataatctgttgtccccagctcacatcatggtcgaaaaggagagggtggtggagattgcagcctgccacagcgcgcacaccagcgcagctaagacccagggcggacatgtctatatgtggggacagtgccggggtcagtcagtgattctgccccacctcactcacttttcctgcactgatgacgtctttgcatgtttcgccacccctgctgtctcctggaggctcttgagcgtggagcatgaggatttcctgacagttgccgagagcctgaaaaaagagtttgactcgccggagaccgcagacttgaagtttagaatcgacggtaaatacattcatgtccataaggcagtactaaaaatccgatgcgaacatttcagaagcatgttccaatcctattggaacgaagatatgaaagaagtaattgaaattgaccagttctcatatcccgtgtatcgggcctttctccagtacctctatacagatactgttgatcttcctcccgaagatgccattgggttgcttgatttggcaacctcgtattgtgagaatcgtttgaaaaagttatgtcagcacataatcaaacgtggcatcacggtcgagaatgcattctctttgttcagcgcagccgtgcggtacgacgctgaagacttagaggagttttgcttcaaattttgcataaatcacttgaccgaggtcacccaaaccgcagccttttggcagatggatggcccactcctcaaagaattcattgccaaagcttccaagtgcggggcctttaagaattag

SEQ ID NO: 132045 - DNA, 1596 bp, Artificial Sequence
  Description of Artificial Sequence: Synthetic coding sequence
atggttgacgtgggtaagtggcccatttttaccctcctgagtccgcaggagatcgcttccattagaaaggcatgcgtgttcggcacctctgcgtctgaggccctatatgtgactgacaacgatgaagtgtttgtgttcggcctgaactattctaattgcctcggtactggagacaaccagagcacactcgttcctaagaagctggaaggcctgtgcgggaagaagatcaagtccctctcgtacggtagcggcccgcatgttctgttgtccactgaggatggagtagtttacgcttggggccacaatggctacagccagctgggtaatggaacaacaaaccaggggattgccccagtccaggtatgcacaaaccttctcatcaagcaagtggtggaggtggcctgcgggtcccaccactccatggcattagctgccgatggcgaagtgtttgcttggggctataacaattgcggacaggtcggctcaggatcgacagccaatcagcccacccctagaaaagtaacaaactgtctgcacataaagagagtggttggtatcgcttgcggccagacaagctccatggctgtgctcgacaatggggaagtgtatggatggggttataacggcaacggccagctggggctgggcaataatggcaaccagctgacccccgtgcgcgtggcagccctgcattctgtgtgcgtgaatcaaatagtttgtggatacgctcacactctcgctcttacagacgaaggcctgctgtacgcttggggggctaacacatacggccagctgggcacgggaaataaaaacaatctcctgtctcctgcgcacataatggtggaaaaagaaagagtcgtggaaatcgcagcatgccactctgcccacacatccgcagccaaaacccagggaggccatgtctatatgtggggacagtgccggggccagtccgtgatcctgccgcatctgactcacttcagctgtaccgatgatgtttttgcatgctttgctacaccagccgtctcttggaggttactttctgtcgagcacgaagatttcctgaccgtggccgaatctctcaagaaagagtttgattcccctgagaccgctgacctgaagtttagaatagacggaaaatacatccacgtgcacaaagctgttctgaaaatccgatgcgagcattttcgctccatgttccaatcttactggaacgaagatatgaaggaagtgatcgaaatagaccagtttagttacccagtgtaccgggctttccttcagtatctctacaccgatacagttgatcttcctcccgaagacgccatcggactgctcgacctcgcaacttcctactgcgaaaatagactgaagaagctgtgtcaacacataatcaagcgaggaattaccgttgaaaatgcattctctcttttcagtgcagccgttagatatgacgcagaggatctggaggagttctgcttcaagttctgtatcaaccacctaaccgaagtgacgcagacagcagccttttggcagatggatggtccgctgctgaaagagtttattgctaaagccagtaagtgcggtgcatttaagaattag

SEQ ID NO: 132046 - DNA, 1068 bp, Artificial Sequence
  Description of Artificial Sequence: Synthetic coding sequence
atggtggatgtggggaagtggcccatcttcaccctccttagcccgcaggagattgctagtattcgtaaagcatgtgtctttgggacgagtgcgtctgaagctctgtatgtcaccgacaatgacgaagtgtttgtgttcggtcttaactacagtaactgcctgggaacaggtgacaaccaatcaaccctcgtcccaaagaaactcgaaggtctctgtgggaagaaaattaaatccctcagctatggttctgggccgcacgtgctgcttagtacagaagatggtgtggtgtacgcctggggacataacgggtacagccaactggggaatggaaccacgaatcagggcatcgctcccgttcaagtctgcaccaatcttctgatcaagcaggtggtcgaggttgcttgcggctctcatcactcaatggctttagccgcggacggagaggtattcgcctgggggtataacaactgtgggcaagttggttcaggatctacggctaaccagcccaccccacggaaggttactaattgtctccatatcaagcgcgttgttggaattgcgtgcggccagacctcctccatggccgtgctggataatggggaagtgtatggttgggggtacaatggcaatggacagctcgggctcggaaataacggaaaccagctcacacccgtcagggtggctgcacttcactctgtgtgcgtgaatcagatcgtttgtggctacgctcacaccttggccctgacagatgagggcctcttgtatgcatggggcgccaatacctatggtcagctgggaactggaaataagaacaacctactgtctcccgcccacataatggtggagaaagagcgggtagtggagatagctgcctgtcacagcgcccacacatcagcagcaaagacgcagggcggccacgtgtatatgtgggggcaatgtagaggccagtcggttatcttaccacacctgactcacttttcatgcactgacgatgtttttgcttgttttgctacaccagctgtgagctggaggctgctgagcgtggtgtcaatagtcatcggtaaatag

SEQ ID NO: 132047 - DNA, 1656 bp, Artificial Sequence
  Description of Artificial Sequence: Synthetic coding sequence
atggaggaggaactcccactgttctccggcgattctggaaaacctgtacaagccacactctccagcttgaagatgctcgatgtaggaaaatggcccatattttctctgtgtagtgaagaagagctgcaactaatacgccaggcttgcgtgtttggaagtgcaggtaatgaggtgttgtacaccacagtgaatgatgaaattttcgtgttaggaaccaattgctgcgggtgcctgggcttaggggacgttcaaagtacaatagagccgagacgccttgactctctgaacggcaaaaagattgcctgtctaagttatggatcaggccctcacattgtgctggcaactacggagggcgaggtgtttacctggggtcataatgcatattctcagcttgggaacggcactaccaatcacgggctggtcccctgtcatataagtaccaatctgtcaaataagcaagtcatcgaagtggcctgtgggagctaccactcactcgtactgactagtgatggggaagtattcgcttggggctacaacaattcgggccaagtgggaagcgggtcaaccgtcaaccaacccattccgcggcgtgtcacaggatgtctgcagaataaggtggttgtgaccatcgcttgcggccaaatgtgctgtatggcggtagttgacactggggaggtgtacgtatggggctacaacggaaacgggcagctcggattgggcaacagtgggaatcagccaacaccctgccgggtcgcggctttacagggcattcgggtgcagagagtagcgtgcggctatgcccacaccctggtcctgaccgacgaagggcaggtttatgcatggggcgctaacagctacggccagttgggaaccggcaacaagagcaatcagagttatccaaccccagtgacagtcgagaaagaccgtattatcgagatcgcagcgtgccactcaacacacacatccgcggcgaagacccaggggggtcacgtatatatgtgggggcagtgcagaggtcagagcgtcatactgccacacctgacccacttcagctgtacagacgatgtgttcgcttgtttcgccacacccgccgttacctggaggctgctgagcgtcgagcctgatgaccaccttacagtggcggaaagcctgaaacgggaattcgacaatcccgataccgccgatctgaagtttttagtggatggtaaatacatctatgctcacaaggtgcttctgaaaatcaggtgcgaacactttcgctccagcctagaggacaatgaagatgacattgtggagatgagcgagttttcttatccagtatacagggccttcctggaatatctgtataccgactctatatccctatccccagaagaggctgttgggctgctggacctggccaccttttatagggagaatagactgaagaagctgtgtcagcagacaattaaacagggaatctgcgaggaaaacgctatagctctgctctcggctgctgttaaatacgacgcccaggatctggaagagttctgctttcggttttgcatcaaccatctgaccgtggtaacccagacttccgggttcgcagagatggaccacgatttgctaaaaaacttcatctctaaagcgtcccgcgttggcgcattcaaaaattag

SEQ ID NO: 132048 - DNA, 1671 bp, Artificial Sequence
  Description of Artificial Sequence: Synthetic coding sequence
atgagcgcccttccccgagatctggagctgagcaatcccagagaaaagctgacaaagccggtacaagctaccttgtcctcattaaaaatgctcgatgtggggaagtggcctatttttagtctgtgctccgaagaggagctacaattgatcagacaggcgtgcgtgtttggctctgcagggaatgaagtgctgtacaccacagtgaacgatgaaatcttcgtgctcgggacaaattgctgtggttgcttaggcttgggtgacgtacagtccacaatcgaaccccggaggttagactcactgaatgggaaaaaaatcgcatgcctgagctatggatccgggccccacattgtccttgccaccaccgaaggcgaagtgtttacatggggccacaacgcttactcacagctcggaaacggaaccacgaaccatggcttggttccctgccatatctcaaccaatctgagcaacaagcaggtgatcgaagtcgcatgcggatcataccacagtctcgtcctcacctctgatggtgaggtgtttgcatggggctacaataactctggacaggtggggagtgggtccactgtcaaccagcccatccctagacgggtgaccggctgcctgcagaataaagtggtggtgaccattgcttgtggacagatgtgctgcatggctgtggtggataccggggaggtgtatgtgtggggctacaacggcaatggacagttgggtctaggcaactccggcaaccagcctacgccctgcagggtcgccgctctgcagggcattagagtccagagagtagcgtgcggctatgctcacactctcgtgctgactgacgaaggccaggtctacgcgtggggtgccaactcttacggacagttgggcaccggaaacaaatctaaccagagctaccctactccagtcactgtggagaaggacaggatcattgagatcgcggcatgccacagcacccacacttcagctgcaaaaacacagggtggccacgtctacatgtggggtcagtgccggggacagtcagtgattttgccacatctcacgcatttctcctgcaccgacgacgtgttcgcctgctttgccaccccagccgtaacctggcgactgctctccgtggagcctgacgaccatctcaccgtagcagaatcccttaaaagagaattcgataatcccgacactgctgacttgaaatttttagtggacggaaaatacatatacgcacacaaagtcttactgaaaattaggtgcgagcatttccgatcttccctggaagacaacgaggacgatatcgtggagatgagtgagttttcctacccagtgtatagggctttcctcgaatatctttatacggactcaatttcactgagccccgaggaggccgtggggctgcttgacctggcaacgttttaccgggagaatcgcctaaaaaaattgtgccaacagacgattaagcaggggatctgcgaagaaaacgcgatcgcattattgtctgcagccgtgaaatatgacgcgcaagatttagaagaattctgcttcaggttctgcattaatcaccttacggttgtaacacaaaccagcggttttgccgagatggaccacgacctgctgaaaaacttcatttctaaggctagtcgcgtgggagcctttaagaattag

SEQ ID NO: 132049 - DNA, 1512 bp, Artificial Sequence
  Description of Artificial Sequence: Synthetic coding sequence
atgctgcaggacggcagctgtaagcagatgctgctgatgctactgatcgtacagcccgttcaagcgactctctcttcactgaaaatgcttgacgttgggaaatggcctattttttccctgtgcagcgaggaagaactgcaactgatccggcaagcatgcgtgttcggaagtgctggaaacgaagttttatacactacagtcaatgacgagatctttgttttaggcacaaactgctgtgggtgtcttgggcttggagatgtgcagagtaccattgaacccagaagactcgacagtctgaacgggaagaagatcgcctgtctcagttatggcagtggtcctcacatcgtgctggcaactactgagggagaggtcttcacatggggacataacgcttacagccagctgggcaacggaacaaccaatcacgggctggtaccctgtcacatttctacaaacctgagcaataagcaagtaatcgaggtggcgtgtggttcctatcacagtctagtcctgacaagcgacggagaagtctttgcttgggggtacaataactccgggcaggttggctccggctccaccgtcaatcagcctatcccacgtcgggtcaccggttgccttcagaacaaggtcgtagtcacaattgcctgcggacagatgtgttgcatggccgttgtggatactggagaggtatacgtgtggggttacaatgggaacggccagttaggactggggaacagcggcaatcaaccaacgccttgtagagtggcagcactccagggcattcgggtgcagcgagtggcttgcgggtatactcacactagcgccgccaagacgcagggggggcacgtgtatatgtgggggcagtgccgcggccaaagtgtgattctccctcatctcactcattttagttgtactgacgatgtgttcgcctgcttcgccactcccgccgtgacctggcgtctgctttccgttgaaccagacgatcacctgacagtggctgagtcactaaaaagggagttcgataatcccgacaccgcggatctgaaattcctggtcgatgggaagtatatatacgcccataaggtgttgctgaaaatcaggtgtgagcacttcaggagtagcctcgaagacaatgaggacgacatagtagagatgagtgagttctcttacccggtgtaccgggcgttcctcgaatatttgtacactgactcaatcagccttagtcctgaagaggcagtgggtctgctggatctcgccactttttatagagagaacagactcaagaagttgtgtcagcagacaatcaaacaaggcatatgtgaagagaacgccattgccctcctgagtgctgcagtcaagtatgacgcccaggacctcgaggagttctgctttaggttctgtatcaatcatctcacagtcgttacccagacatctggcttcgccgaaatggaccacgacctcctcaaaaactttattagtaaagccagtcgggtgggagccttcaaaaactag

SEQ ID NO: 132050 - DNA, 1671 bp, Artificial Sequence
  Description of Artificial Sequence: Synthetic coding sequence
ccctgtagcaatcgctacccgggcgggggcgctgacaaagctccagcttgcgaagagcccgtccaggcaactttgtcgagtctcaagatgctcgacgttggcaagtggcctatcttctccctctgtagtgaggaggagcttcagctgattaggcaagcatgtgtcttcgggagcgcggggaacgaggtgctgtatactaccgtgaacgatgaaattttcgtgctgggcacaaattgctgtggttgcctaggactcggcgacgtgcagtctacaatcgaaccccgaagactcgattcactgaacggaaagaaaatagcctgcctgagttacgggagtggccctcacatcgtgctggccactaccgagggggaggtattcacttggggccataacgcctattcacagctgggcaacggaaccacaaaccatggtctggtcccttgccacatcagcaccaacttaagcaacaaacaggtgattgaagtcgcttgtgggtcataccacagcctagtcctgacatcagacggcgaggtgttcgcgtggggctataacaacagcggccaggtcgggtcaggatctacggtgaatcagccaatccctcgacgagttaccggatgtcttcaaaacaaggttgttgttaccatcgcctgtggacaaatgtgttgcatggccgtggttgacactggagaggtctacgtatggggctataacgggaatggccagctcggtctgggaaactccggcaaccagcccacgccctgcagagtcgctgccctgcagggaattcgggtacaacgtgtggcctgcgggtacgctcatacgctggtgcttaccgatgagggccaggtatacgcgtggggagccaattcttatggccagctgggaacaggcaataagagtaaccagtcttatccaactccagtaaccgtggaaaaggaccgcattatcgagatagctgcctgtcattcaacacatacatcagcggcaaagacccaggggggccacgtctatatgtgggggcagtgtagaggccagtccgttatactaccccacctgacacatttctcttgtacagatgacgtgttcgcctgtttcgcaacacctgccgttacgtggcgattgctcagtgttgagcccgatgaccaccttaccgtggccgaatcattaaaacgcgaattcgataatccggatactgccgatcttaagtttttggtggatggcaaatacatttacgcgcataaagtgctgcttaaaattcgctgcgagcacttccgctcgagcctagaggacaacgaggatgatatcgtagaaatgtcggaattctcttatcctgtttaccgcgctttcttggagtacctgtacactgacagtattagtttgagtcctgaggaggcagttggtctcctagatctggctacattctacagagagaataggttgaagaaactgtgccagcagaccattaagcaggggatttgcgaggagaacgcaattgcccttctgagtgctgctgttaagtacgatgcacaggatctggaggagttttgcttccgtttctgcattaaccatctgactgtagtgacgcagacgtctggattcgccgagatggatcacgatcttcttaagaatttcatttcaaaggctagcagagttggtgcatttaagaactag

SEQ ID NO: 132051 - DNA, 834 bp, Artificial Sequence
  Description of Artificial Sequence: Synthetic coding sequence
atgtctggcgtgactactgaaacaggtagtttggattctgcaacagtagcaactagccagcctctggcagaatggcagctgtgtaaagcctcagtgtcacgaggaattatcgaaatcgctgcttgccacagtacacatacatctgctgctaaaacacagggtggacacgtatacatgtggggccagtgtagaggacagtcagtgatcctaccacatctgacacacttttcttgtacagacgatgtctttgcctgctttgccaccccagctgtgacgtggaggctcctgtcagtcgaacctgacgatcacctgactgtggccgagtctctaaaacgcgaattcgacaatccagatacagcggaccttaaattcctggttgacgggaaatacatatacgcacataaggtcctcctcaagattagatgtgaacatttccgctcatctctcgaagacaacgaagacgacatcgtggagatgtcagagttctcctatccagtgtacagagccttcctggaatacctctacacagacagcatctctctgtctccggaggaagcagtcggactgctggatctggctacattctacagagagaacagacttaagaaactctgccagcagaccattaagcaaggcatttgtgaggaaaatgccatcgccctgctgtctgctgctgtcaagtacgacgcccaggatctggaggaattctgttttcgtttttgcattaaccaccttactgtcgttacccagacatccggctttgcggagatggatcatgacctactcaagaactttatctcaaaggcttcccgcgtcggagctttcaagaattag

SEQ ID NO: 132052 - DNA, 846 bp, Artificial Sequence
  Description of Artificial Sequence: Synthetic coding sequence
atgttagatgtgggcaagtggccaatatttagtctttgtagcgaggaagagctgcagctcattcgacaggcatgtgtctttgggtcagccggcaatgaggttttgtatacgacggttaacgatgaaattttcgtgttgggaaccaactgctgcggttgcctgggactcggagatgtgcagagtacaatcgaacctcgtcgactcgacagtctcaatggaaagaagattgcttgcctgtcttacggatccggacctcacatcgttctggcaaccacagaaggcgaggtttttacatgggggcacaatgcatactcacaacttgggaatggaacaaccaaccacgggttagtcccgtgccatatcagcactaacctctctaataaacaggtgatcgaagtggcgtgcggcagttaccacagtctggtgctgacttccgacggagaagtctttgcctggggctacaacaactccggccaggtcgggagcgggtccacggttaatcagcccataccaagacgagtgactggctgcctgcagaacaaggtggtggtcacaattgcctgcggccagatgtgctgcatggccgtagtcgacacaggggaagtgtacgtttgggggtacaatggcaacggccagttgggcttgggtaactcgggaaatcaacccactccatgccgcgttgcagctctacaaggtattagagtgcagagggattaccgcgattgcagtctgtccctgcacactcacgtgtgcggtcaggatgccggttgggccagggtacatgttggcccagtgccaggtagcgtgagggacccaccagctccacaccccttgctgctgcactag

SEQ ID NO: 132053 - DNA, 1359 bp, Artificial Sequence
  Description of Artificial Sequence: Synthetic coding sequence
atgtcaccaaagcgcatcgcgaagaggcggtctccccctgcagatgcgatccccaagtccaaaaaagtgaaagatacccgggctgctgcttcgagacgcgtccctggggccagaagttgtcagggtgcatgtgggccttccccacctgatcagaagactagaccggtctcacacaggtcgcacagcacggagccaggactggttctgacacttggccaaggggatgtgggccagctgggtctcggggagaacgttatggaacggaaaaagccagcactggtgagtatcccggaggacgtcgtccaggccgaggccgggggtatgcacaccgtgtgcctttccaaatctggacaggtctattctttcggctgcaacgatgagggggccctcggccgggatacatccgttgaggggtctgagatggtgcctggcaaagttgagctccaggaaaaggtagttcaggtctccgccggcgactctcacactgccgcactgacggatgatggccgcgtattcctctggggcagtttcagagacaacaatggtgtcatagggctgctcgagcccatgaaaaaatccatggtgcccgtgcaggttcagctggatgtgcccgttgtgaaagtggcctctggtaacgaccacctggtcatgctgaccgccgacggcgatttatatacgttaggatgtggcgaacagggacagcttggtcgtgtgcctgagttatttgccaatcgcggcggtcggcaggggctcgagcgattgctggtccccaagtgcgtgatgctgaaatcccggggatctagaggccatgtaagattccaggatgccttctgtggggcatatttcacatttgcaatatcccatgaaggccatgtgtatggctttggtctttccaattatcatcaattgggcacacccggcacagaatcctgtttcattccgcagaacctaacgtcattcaaaaattcgaccaaaagctgggtgggatttagtggtggccaacatcacacagtgtgtatggatagcgagggcaaagcgtactcactgggccgcgctgagtatgggcggctcggcctcggtgagggcgctgaggagaaaagtatccctactttaatctcacgcctcccagctgtttcatctgtggcctgcggggcctcagtcggctacgccgtaactaaagatgggcgggttttcgcctgggggatggggacgaattaccagctagggactggtcaggacgaggacgcatggagcccggtagaaatgatggggaaacaactcgagaacagggtcgttttatccgtgagctctggagggcaacacacagtcctgttagtcaaggacaaagaacagagttag

SEQ ID NO: 132054 - DNA, 1266 bp, Artificial Sequence
  Description of Artificial Sequence: Synthetic coding sequence
atgagccctaaacggatcgccaagcggagatctccccctgcggatgcaatcccaaagtccaagaaagtgaaagtgtctcatcgctcccactctacagagccggggttagtactgacgctggggcagggagacgtgggtcaactcggactcggcgagaacgtgatggagaggaaaaagccggcccttgtgagtattccagaggacgtggtgcaagccgaggccgggggtatgcataccgtctgcctaagcaaatccgggcaggtctactcatttggctgtaatgacgagggggcgctgggaagagacacgagcgtcgagggctcagagatggtgcctggtaaagtcgaactccaagaaaaggtggtgcaggtgagcgccggagacagccataccgcagccctaacagatgatggccgggtctttttatggggatcgttcagagacaataacggggtcatcgggctcctcgagcccatgaaaaaatctatggtgcctgtgcaggtgcaacttgacgttccagtggtgaaggtcgctagcgggaatgatcatctggtgatgctgaccgcagacggagacctgtacaccctgggctgcggtgaacagggccaactgggtcgcgtcccagagctgtttgcaaatagggggggacgccaggggttagaacgcctactggtacccaaatgcgtaatgctgaagtcccggggtagcagaggtcacgtgcggtttcaagacgctttctgtggcgcgtacttcaccttcgcaatttcccacgaaggtcacgtctatggtttcggtctaagcaactatcatcagctcggcactcctggcacagagtcgtgcttcattccgcagaaccttacaagctttaaaaacagcactaagtcttgggttggattctcaggagggcaacaccatactgtttgcatggattctgagggaaaggcgtactccctggggcgcgctgagtatggccgcctggggttgggcgaaggcgccgaggaaaaatccattcctaccctcatttcaaggcttccggccgttagtagtgtcgcatgtggagcctccgtgggctatgctgttaccaaagacggaagggtgttcgcttggggaatgggaacaaattaccagctgggaacaggacaggatgaggatgcctggagtcctgtggaaatgatggggaagcaactggagaaccgggttgttctgagcgtatctagcggaggacaacatactgtgcttctggtcaaggacaaagagcagagttag

SEQ ID NO: 132055 - DNA, 1266 bp, Artificial Sequence
  Description of Artificial Sequence: Synthetic coding sequence
atgagccctaaacgcatagcgaaacgacgctccccacctgctgacgccatcccaaaatctaaaaaggtgaaggtgagccatagatcccatagcacagagcctgggctggtcttgactctaggccagggagacgttgggcagttaggattaggggagaacgtcatggagcggaaaaagccggctttagtctctattcctgaggatgtggtgcaggcagaggccggcggaatgcacaccgtgtgtctctccaaatccggccaggtatactctttcggctgcaacgacgaaggagctctgggcagggacaccagcgtcgagggcagtgagatggtgccgggaaaggtagaattgcaggagaaggtggtccaggtgtctgccggggattcgcataccgctgcattgaccgatgacggaagggtgtttttgtgggggtcttttagggacaataacggagtgataggcctgctggagccaatgaagaaatcaatggtaccggtacaggtgcaattggatgtcccagttgtgaaggtagcttcgggaaacgatcacctcgtcatgctgaccgcagacggggacctctacacactcggctgtggcgaacaggggcagctgggacgagtgccagaacttttcgccaaccgtggggggcgccaggggctcgagaggctgctcgtgccaaagtgcgttatgctgaagagccgagggtcaaggggccacgtccgtttccaagatgccttttgtggggcctatttcacattcgctatttcccacgaaggtcacgtctatggtttcggattatctaattaccaccagctgggaaccccaggcacagaaagctgcttcatcccccagaacttgaccagctttaagaattctaccaaatcttgggtgggcttctccggggggcagcaccacaccgtatgtatggattctgagggcaaagcatacagtctggggagagctgagtatggaaggctcggcctgggcgaaggcgctgaagaaaaatcaattcccacactgattagcagactcccagcagtcagttccgtggcatgcggagccagcgtgggctacgctgtgacgaaggacggtagggtgttcgcctggggtatgggaaccaactaccagctgggtaccggccaggacgaggacgcttggagtccggttgaaatgatggggaaacagctggaaaatagggttgtcctttctgttagctccggtggacagcatacagtgctattggttaaggataaagaacagtcatag

SEQ ID NO: 132056 - DNA, 1266 bp, Artificial Sequence
  Description of Artificial Sequence: Synthetic coding sequence
atgtcacctaagagaattgctaaaaggcgatctcctcctgctgatgcaattccgaagagtaagaaagttaaggttagtcatagaagtcacagtacagagcccggacttgtacttacacttggtcagggggatgtcggacagctgggcctgggagagaacgtcatggagagaaagaagcccgccctagtatccatccctgaagatgtcgttcaagcagaagctggtggaatgcataccgtatgcctgagcaaaagcggccaagtctacagctttggttgcaatgatgagggggctctcggccgcgatacatccgtcgaaggaagcgaaatggtgcctggcaaagtagaactccaagagaaagtcgtacaggtgtcagccggtgatagccacacagccgcactgaccgacgacggacgggtttttctctggggatcatttcgcgataacaacggggtaataggattacttgagcctatgaagaagtccatggtgcccgtacaagttcaactggacgttcccgtggtgaaggtggcctcaggcaatgatcatctcgtaatgttaacagcagatggggatctctacactctggggtgtggcgagcaggggcagttgggaagggtgccagaactcttcgctaatagaggcggtagacagggacttgaacggttgttggtgccgaagtgcgtcatgcttaagagtagaggcagccgagggcacgttcgttttcaggacgcattctgcggcgcttacttcacgttcgctatatctcatgagggacacgtgtacggcttcggactatccaactaccaccagttggggacgcccgggaccgagagctgcttcattccccagaacctgacctccttcaaaaacagcacaaagtcgtgggtaggattctcaggggggcagcatcacacagtgtgcatggattccgagggcaaagcctacagcctgggtcgggcggaatacggccgcctgggcctgggcgaaggagctgaagaaaagtcgatccccacactaatttcacgccttcctgctgtttcatctgttgcgtgcggggctagtgtagggtatgccgtgactaaggacggaagagtattcgcgtggggcatgggtacaaattatcaacttgggaccggacaggatgaggatgcctggtcacccgtggagatgatgggcaaacaacttgaaaaccgcgtggtgctgtccgtgagctccggtggccagcacaccgttctcctggtcaaagataaagaacagagctag

SEQ ID NO: 132057 - DNA, 693 bp, Artificial Sequence
  Description of Artificial Sequence: Synthetic coding sequence
atgtcccctaagagaatcgctaagcgaagatccccaccagcggatgctatcccaaagagcaagaaggttaaggtgagccaccgtagccatagcaccgagccgggtttggtgttaacactgggtcagggagacgtaggccaactgggcctaggtgagaacgtgatggagcgcaaaaaacctgcactggtgagcattcctgaggacgttgtgcaagctgaggccggcggcatgcataccgtgtgcctgtcaaagagcggccaggtgtactcattcggatgcaatgatgagggcgccctggggcgagacacttctgttgaagggagcgaaatggttccaggaaaagtggagctgcaagaaaaggtggttcaggtgagtgctggtgacagccataccgctgcgctcaccgacgatggacgggtgtttctctgggggtcctttagggataataacggagtgattgggctcctcgaacccatgaagaagagcatggtccccgtgcaggtgcagcttgatgtccctgtggtgaaggtggcctccggcaatgatcatctagtgatgttaacggccgacggggatctgtacaccctaggctgcggcgagcagggtcaactggggagggtgcctgaattgtttgctaacaggggaggcagacagggcctggagcgccttctggtgcctaagtgcgtaatgtag

SEQ ID NO: 132058 - DNA, 852 bp, Artificial Sequence
  Description of Artificial Sequence: Synthetic coding sequence
atgtcgcctaaacgtattgccaagcgccgcagcccccccgctgatgcgattcccaaatcgaagaaggtgaaagtgagtcataggtcacattctactgaaccagggttggttctcaccttgggtcagggagatgttggtcagctgggcctgggtgagaacgtaatggagcgaaaaaagcctgcactcgtgagtatccctgaggacgtggtgcaggccgaagccggcggtatgcatactgtatgcttgagcaagagcggacaggtctacagttttggttgcaacgatgagggcgcactcggccgggacacgagcgtggagggctctgaaatggtccccgggaaagtcgaactgcaggagaaggtcgttcaagtctccgcgggagacagccacacggcagccctgacggacgacggccgagtcttcttgtggggaagcttccgcgataataatggggtaattggcctgctggagcccatgaagaaatccatggtgcctgtgcaggtacagttagatgtcccggtggtcaaagtagccagtggcaacgatcatctggtgatgttaactgccgacggcgatctctacacactcggctgcggcgagcagggtcaactagggcgcgtgccagagctgttcgcaaataggggaggaagacagggtctggagagattactggtgcctaagtgcgtgatgctgaagtcgaggggttccaggggacatgtccggttccaagacgccttctgtggagcttacttcacatttgctattagtcacgaagggcatgtgtatggtttcggactgtctaattatcatcagctcggaacccctggaaccgaatcctgttttattccatag

SEQ ID NO: 132059 - DNA, 708 bp, Artificial Sequence
  Description of Artificial Sequence: Synthetic coding sequence
atggccagagaagaatgcaaggcattgctggatggcctcaataagaccacagcgtgctaccaccatctggtgctgaccgtgggtggttctgccgactcccaaaacctgcgccaggagctacagaaaacgcggcaaaaagctcaggagctggcagtcagtacctgcgcgcggcttacggcggttctgagggataggggtctggcagccgacgagcgcgctgaatttgagcgactctgggtagcattctcaggctgtctggacctgctagaggccgacatgcgcagagcccttgaattgggggctgcgttcccactgcacgcccctagaagacctctggttagaacaggggttgccggcgcctcgtccggggtggccgctcgggctctatccactaggtcacttcgcctggaggcagaaggcgattttgacgtagccgacctccgagaactcgaacgggaagtcctgcaagtgggcgagatgatcgataacatggaaatgaaggtgaacgtccctaggtggactgtccaggcccgccaggcagcaggcgctgagctgctgtctaccgtttctgcaggccccagttctgttgtttcccttcaagagagggggggagggtgcgacccacgtaaagcccttgcagcaattctatttggagcagtactattggctgcagtggctctggccgtctgcgttgccaagctgagctag

SEQ ID NO: 132060 - DNA, 630 bp, Artificial Sequence
  Description of Artificial Sequence: Synthetic coding sequence
atgcgcgcagccgctattagtaccccaaagctcgacaagatgccagggatgtttttcagcgcgaatccaaaggagttgaagggaacgactcactcattgctggatgacaaaatgcagaaacgtcgccccaagaccttcggaatggatatgaaggcctatctgagatctatgatcccccatctggagtcaggcatgaaatcctctaagtccaaggacgtgctgagtgccgctgaggtcatgcagtggtctcagtcgttagagaaactcttggcaaaccagaccggacagaacgtctttggtagcttcctgaagtcagagttctcggaagaaaatatcgagttctggctggcctgtgaagattataaaaagactgaaagcgatttgctgccttgcaaggccgaagagatttacaaagcgtttgtgcacagcgatgctgctaaacagattaacatagacttccggactcgagagagcacagccaagaagatcaaggctccaactcccacctgcttcgatgaggcgcagaaggttatctacacactaatggaaaaagacagctatcctcgattcctcaagagcgacatctacttaaatttgttgaatgacttacaagctaactcattgaagtag

SEQ ID NO: 132061 - DNA, 1044 bp, Artificial Sequence
  Description of Artificial Sequence: Synthetic coding sequence
atgccagggaagccaaaacatctgggtgtgccaaatgggagaatggtattagcagtgtctgatggcgaactctctagtacaactgggcctcaaggccagggagaagggaggggctccagcttgtctattcactccctccccagcggtccatcttctccattcccgactttcgtgtcatcaaaatctgagagtcatagaaagagccttggcagtaccgagggagagtctgaatccaggcccgggaaatattgttgcgtttaccttcctgatggtactgccagtcttgccctcgctcgaccagggctgactatacgcgatatgctcgctggcatatgcgagaaaaggggcctgtctctgccagacataaaagtgtatctggtggggaatgaacagaaagccctggtcttggatcaggactgtacagttctggccgatcaagaggtgcgccttgagaatcgaataacattcgagctcgagctgacggcgcttgaaagggtggtgcggatctctgccaagccaacaaagaggttgcaggaggccctgcagccgatcctcgaaaaacacggcctgagtccccttgaggtggtgctgcatcggccaggcgaaaagcagcccctggacctcggcaaactagtgtcctcggttgccgcccagagactcgtcttagacaccttacccggtgtgaagatatcaaaagctcgtgataagagtccttgccggtcacagggctgcccccctcgaacccaggacaaagccacccatcccccgcctgcatcgcccagctctctcgtcaaggttccctccagcgcaacaggaaaacggcagacctgcgacatcgaaggactggtggagctccttaaccgggttcagagttccggcgcccatgatcagcgcggacttctaagaaaggaagacttggttctgccagagttcttgcagttaccggctcagggaccaagctccgaagaaacacctccgcagaccaagagcgccgcgcagccaatcgggggcagcctgaattctaccacggactctgctttgtag

SEQ ID NO: 132062 - DNA, 1701 bp, Artificial Sequence
  Description of Artificial Sequence: Synthetic coding sequence
atgccaggtaaacctaagcatctaggtgtgcccaacggccggatggtgctcgctgtctcagatggggaactttcatccacaactgggccccaggggcagggagagggtaggggtagtagtttgtctattcactccttgccctctgggcccagcagccccttcccgacagaggagcagccggtagccagctgggcgctatcgtttgagagactgctgcaggacccactgggccttgcctatttcacagaattccttaagaaggagttctctgcagagaatgtcaccttctggaaagcatgcgagaggtttcagcagatacctgctagcgatactcagcagcttgcccaagaagcccgcaatatttaccaggaattcctgagcagccaggctctgagcccagtcaatatcgacaggcaggcatggcttggagaggaagtgttagcagaaccaagacccgatatgttccgggcccagcagttgcagatattcaatctgatgaaatttgacagttatgcccggttcgtcaaaagcccactgtaccgagagtgtcttctggcagaagctgaaggaagacctcttagggaaccaggctcttctaggctgggctccccagacgctacgaggaaaaagcccaagctgaagccagggaaatctctaccactaggcgtggaagagttgggccaactccctccagtggaggggcctggcggaagacccctgcggaagtccttccgccgcgaactgggaggaacggcaaacgcagccctgaggcgagaatcccagggtagtcttaacagctccgctagcttagatctggggttcctagcttttgtgtcttccaaaagtgagtctcacagaaaatctctcggtagcactgagggcgagtctgagagtcgcccagggaagtattgttgtgtgtatctgcctgacggaactgctagtctcgcactggcgaggcctggcctcacaatccgggatatgctggcaggtatctgtgagaaacgaggcttaagtctgccagatatcaaagtgtaccttgtggggaatgagcaggcacttgtcctggaccaggactgtaccgtccttgccgatcaggaggtccgactggaaaatcgcatcactttcgaactggagctgaccgctctcgagcgagtggtgcgaattagcgccaagcccacaaagcgtctgcaagaggctctgcagcctatccttgaaaagcacggacttagcccactcgaagtcgttctgcatcgtcctggggagaagcaacctttggacctggggaaactggtgagtagcgtggcggcacaaagactcgtgctggatacactcccaggtgtaaaaattagcaaagcccgcgacaagtctccttgtcgctcccaagggtgtccacctaggacccaggacaaagctacccaccctccacccgcttcaccatctagtctggtgaaggttccgagtagtgccacaggtaaacgccagacctgtgacattgaggggctcgtcgagctgctgaacagagtgcagagtagcggcgcccatgaccagcgcggcctgctcaggaaagaagaccttgtgctgcctgaattcctgcaactccccgcccaaggcccttcatcagaagaaacaccaccacaaactaaaagtgcagctcaacctatcggcgggtcgcttaacagtaccactgattccgctttgtag

SEQ ID NO: 132063 - DNA, 1314 bp, Artificial Sequence
  Description of Artificial Sequence: Synthetic coding sequence
tagagtcccgtgaacatagatagacaggcctggctgggcgaggaggtcctcgctgagccccgccccgacatgttccgggcccagcagttacaaatattcaatttaatgaagtttgactcatatgccagattcgtaaagtcccccctttacagagaatgcctgctggcagaggccgagggtcgccctctgagagagccgggctcctcccgactaggctcccctgacgcgacgcgaaagaaacccaagctgaaaccaggcaagagcctgccactgggcgtggaagagctgggacagctgccacccgtcgagggccccggcggaaggcccttacgtaagagcttccgcagggagcttgggggcacagctaacgctgcactgcggagggagagtcagggatctctgaattcatccgcaagccttgacttgggtttccttgcctttgtctccagcaagtctgagtcccatcggaaaagtttaggcagcacagaaggagagagtgaatctcgccccggaaaatattgttgtgtgtatctgcccgacggtaccgcctcacttgccctggctcgccctggcttgactatcagagacatgctcgctggaatttgcgagaagagaggcctcagtctgcctgacattaaagtctatctcgtggggaacgagcagaaggctctcgtactggaccaggactgcacggtgttggcggaccaagaagtgcggctggagaacagaattacattcgagctggaactgacagcccttgagagagtggtgcgaatatctgccaaacccacgaaaagattgcaggaagcattgcagcccattctagaaaaacacggtttaagtccactggaggtagtgctgcatcgcccgggggaaaagcaaccattggatttgggcaagttggtcagtagtgtggcggcacagaggctggtactcgacaccttgccgggcgtgaaaattagtaaagctagggacaagagtccttgtcggtctcagggttgcccgcccagaacacaggacaaggccactcaccccccaccggcttcccccagctccctcgtcaaggtcccttctagcgcaaccggtaaacggcagacctgtgacatcgaggggctagtggagttactgaatcgagtacagtcctcgggcgcccacgatcaaagaggccttctgcgaaaagaagatctggtgctccctgaatttctgcaactgccagctcagggtccttcctccgaggaaacccctccccagactaagtcggccgcacagcctattggcggctcactgaattccaccactgactccgccctttag

SEQ ID NO: 132064 - DNA, 609 bp, Artificial Sequence
  Description of Artificial Sequence: Synthetic coding sequence
atgtgccgcacgctagcagcttttcccaccacgtgtcttgagagggctaaggagttcaagacgagacttggaatcttcctgcacaagagtgaattggggtgtgatacgggttctaccgggaaatttgagtggggctcaaagcatagtaaggagaaccgcaatttctccgaagacgtcctggggtggcgcgaatctttcgatctcctcctctccagtaaaaatggcgtggccgccttccacgcattcttaaagacggaatttagtgaagagaatttagagttctggctcgcctgcgaggagtttaaaaaaatcagatccgcaacgaaactggcttctcgggcccaccagatttttgaggaatttatttgtagtgaggctccgaaggaagttaatatcgaccatgaaacccacgagctgacacggatgaacctccagaccgcaacagcaacgtgcttcgacgcagcgcagggtaaaaccagaactctgatggaaaaggactcctatcctcgcttcctgaaatccccagcttacagggacctcgctgctcaagcatccgccgcttcagctaccttatcctcttgtagcctcgatgagccttcccatacatag

SEQ ID NO: 132065 - DNA, 459 bp, Artificial Sequence
  Description of Artificial Sequence: Synthetic coding sequence
atgcccgtcaaatgttgtttctataggagtcccaccgcagaaaccatgacttggtcagagaacatggatacccttctggccaaccaggccggtttggacgcttttcgcatatttctgaaatctgagttcagcgaggagaatgtcgagttctggcttgcctgcgaagactttaaaaaaacaaaaaacgcggacaagatcgccagcaaggctaaaatgatctattccgaattcattgaagccgacgcgcccaaggagataaatatcgattttgggacaagagacctgatcagcaagaacatcgcggaacccacactgaagtgcttcgacgaagctcaaaagttgatttactgtctcatggcaaaggatagcttccctaggtttctaaaatcagaaatatataaaaaattagtgaacagccaacaggtccccaaccataagaagtggcttccattcctgtag

SEQ ID NO: 132066 - DNA, 1809 bp, Artificial Sequence
  Description of Artificial Sequence: Synthetic coding sequence
atggagagatccctgcaccgcgtgagtctgggctctcggcgcgcgcatcccgatttatcattctatttgacaacttttgggcagctgcgcttgagtatcgacgctcaggaccgcgtactgttacttcatataattgagggcaaaggcttaatatccaagcagcctggcacctgcgacccgtacgtcaaaataagtctcattccggaggacagccgcctcaggcatcaaaaaacacaaacagtacccgattgccgggaccccgcattccacgagcattttttcttcccagtccaggaggaggatgatcaaaagaggttacttgtgacggtgtggaatcgcgcttctcagtccagacagtctgggctgatcgggtgtatgtcatttggagtgaagtcgctgctgacgcctgacaaagagattagtggctggtattaccttctgggtgaacacctgggaagaacaaaacacttgaaggtggccaggaggcggctgaggccgttacgggatccactgctcaggatgccaggcgggggagatactgaaaatgggaagaagctgaaaattaccatccccagagggaaggacggttttggctttacaatttgttgcgatagtccggtgcgagtccaggccgtcgacagcgggggccccgcagagcgcgctgggcttcagcagctggacaccgtgcttcagctaaacgagaggcctgtggagcattggaaatgcgtcgagctcgctcacgaaataaggtcatgtccgtcagaaatcattctacttgtatggagaatggtcccacaggttaagcccgggcccgatggcggcgtgctgaggagagcctcctgcaagagcactcatgacttgcagtcacccccaaacaaaagagagaaaaactgcacacacggagttcaggcgcgaccagaacagagacacagctgtcacctggtctgtgattccagcgacggattgcttttaggaggttgggagcgatacacagaggtggcaaagcggggtggccagcatacgctgcccgccctcagccgtgctactgcgcccacggatccgaactacataattctagctcccctgaatcccggctcacagttgctgcggcctgtctatcaagaggacacaatccctgaggagtcaggaagcccaagcaagggcaagtcttacactggtcttggcaaaaaaagccgtcttatgaaaaccgtgcagactatgaaggggcacggcaactaccagaattgcccggtggtccggccccacgcgactcattccagctatggaacatatgtgaccttggcccccaaggtcctcgtattccctgtcttcgttcaacctctggacctctgtaaccctgctcggacgctcctcctgagcgaggagctactgctgtatgaaggtagaaacaaggccgccgaggtgactctatttgcttactccgacctactgctgttcactaaagaggacgaaccaggaagatgtgacgtacttcgaaaccctctgtacctgcagtccgtgaaactgcaagagggaagctccgaggacctcaaattttgcgtcctgtatcttgccgaaaaggccgaatgcctgtttacacttgaggcacacagccaggaacaaaagaagagggtgtgttggtgcctctctgagaatattgcgaagcaacaacaattggctgcttctccaccagacagcaagaagttgcaccctttcggctctcttcagcaagaaatgggacctgtgaatagcactaacgctacgcaggaccgcagtttcacttcccccgggcagaccctcattggctag

SEQ ID NO: 132067 - DNA, 507 bp, Artificial Sequence
  Description of Artificial Sequence: Synthetic coding sequence
atgaagaataaactggggatttttaggaggagaaacgaatctcccggtgcccccccggccgggaaagcagataaaatgatgaaaagtttcaaaccgaccagtgaggaggctctgaaatggggcgagtcactggagaagcttctggtgcataagtatggactcgccgtctttcaggcctttctgcgcacagagttttctgaggagaacctggaattttggcttgcctgtgaggattttaagaaggtgaaaagccaatccaagatggcatcaaaagcaaagaaaatctttgcagaatacatagccattcaagcgtgtaaagaggttaacctcgactcctacaccagagaacatacaaaggataacttgcagagcgtgacgcgaggctgctttgacttagctcagaagagaatattcggactgatggagaaggacagttaccccaggtttctgagaagcgacctctacctagacttgataaatcagaagaaaatgagccctcctctttag

SEQ ID NO: 132068 - DNA, 2754 bp, Artificial Sequence
  Description of Artificial Sequence: Synthetic coding sequence
atgaaccgtttcaacggcctgtgtaaagtgtgttctgagagacgataccgacagattaccattccgcgaggcaaggacggcttcggattcaccatatgttgtgacagcccagttcgagtgcaagcagtggacagtggtggacctgcagaacgcgcgggcctacaacagctcgacacggttctccagcttaatgagcggccagtggagcattggaaatgcgtggagctggcgcacgagatcagatcgtgcccatctgagattattctcctcgtatggcgaatggtgccccaggttaaaccaggtcctgacggcggggtgctgcgcagagcgtcttgtaaatccacccatgacctccaaagtccaccgaataagagggaaaagaactgtacacacggagtgcaggcacgtcctgaacagcggcattcctgccatctggtctgtgattccagcgatggacttctcctgggcggatgggaaaggtacactgaagtcgctaagcggggaggccaacacaccctgccagcccttagccgagcaacagcacctaccgaccccaattatataattcttgccccgctaaaccccggctcccaattattgagacctgtgtaccaggaagatacgatccccgaggaatccgggtccccctccaagggtaaaagttacaccggtctggggaaaaagagcagactgatgaaaaccgtgcaaactatgaaaggccacggaaattatcagaattgcccagtggtgaggcctcatgccacgcacagtagttacggaacatacgtgactctggcaccaaaggtgctggtctttccagttttcgtccagccgctcgacttatgcaaccctgctagaactttgttgctctcagaagaactgctgttgtatgagggccgcaataaagctgcggaggtgaccttatttgcatactctgatttactgctcttcacaaaagaggacgagcccggccggtgcgatgtgctgagaaacccattgtacttgcaaagcgtgaagctgcaagaagggtccagcgaggaccttaaattctgcgtgctttacctagccgaaaaggcagagtgcttgttcaccctggaggcccattcgcaagagcagaagaaacgagtgtgttggtgcttatccgagaatattgccaaacagcagcaactggcggcctcaccccccgattcaaagatgttcgagactgaggctgatgagaaacgcgagatggcgctcgaggaaggaaagggccctggcgcggaggacagtcctccttcaaaggagccctcaccagggcaggagctccctcccgggcaggacctccctccaaataaagattctccctcaggccaggagcccgccccttcccaagaacctcttagctctaaagactcggcaacgtctgaggggagtccccctggacccgacgccccaccttccaaagatgtccctccatgtcaggaaccaccgcctgctcaagacctgtcgccctgccaggatctcccggccggccaggagccccttccacatcaggaccccctgctgactaaggacctgccggctatccaagaatccccaacaagggatctgcccccttgtcaggatctgccaccctcccaggtcagtctgcccgccaaggctctgacagaggatacgatgtccagcggggacctgttggcagcgactggagacccaccagctgcacctaggcctgcatttgtcattcccgaagtccggcttgactctacatacagtcagaaggcaggggccgagcaagggtgtagtggagacgaggaagacgcggaggaggcagaggaagtggaggagggcgaagagggcgaggaggatgaggacgaggatacctctgacgataactacggcgagaggagcgaagcgaagcgctccagcatgattgagaccggacagggcgccgagggcggattatccttaagagtccaaaactctctcaggcgccggacccatagcgaggggagtctcttgcaggaacctagggggccgtgctttgcctcagacaccactttgcactgcagtgacggagaaggggccgcgtctacttggggaatgccttcacccagcacattaaagaaagagttgggacggaacggcggatccatgcaccatctctccctgttctttaccgggcacaggaaaatgtccggggcagacacagtgggcgacgacgatgaggcctcaagaaagagaaagtctaagaatcttgcgaaggatatgaagaataagctgggcatctttcggagaaggaatgagtctcccggcgctcccccagctggcaaagccgataaaatgatgaagtctttcaaaccaacttcagaggaagctttaaaatggggagagtcacttgaaaagttactggtgcacaaatacggattagctgtcttccaggcattcctccgtaccgagttttcagaagaaaaccttgaattttggctggcgtgcgaggatttcaagaaagtcaagagccagagtaaaatggcatccaaggcgaagaagatctttgctgagtacattgcaatccaggcctgcaaagaggtcaatctcgattcatacactcgagagcataccaaagataaccttcaaagcgttacccgggggtgttttgacttagcacaaaaaaggatcttcggcctcatggagaaggattcctaccccaggtttctcaggtctgacctatacctggacctcattaatcagaagaaaatgtctcctccactgtag

SEQ ID NO: 132069 - DNA, 3597 bp, Artificial Sequence
  Description of Artificial Sequence: Synthetic coding sequence
atgcctgtgattcccgctctttgggaggtcgagatgggaagaagtcagggccaggagattgagactattctcgcgaatcgaagtcacagcgattccacccctttaccaaacttcttgagcggctcccaccggcctgaatgttgcacgtgccggctgttgaccgcctctggggctcaagactctcttccatttggaagacgtttgtattctggcccctggaggagctgtgaggaggtgtgtcatgtctctgtgctgtccgtcctgtccactagttgcggactgagcctttctttaccaatctttcccggttggatggaatggctaagccccgacattgcccttccgcgacgagatgaatggactcagacttcccctgctcgcaagcgcattacacacgcaaaagtccaaggcgccggacagcttaggctttctatcgatgcccaggacagagttctcctactgcatattatagagggaaagggactgatttcaaagcaaccaggcacatgcgacccctacgtgaagatttccctgatccccgaggactcgcggcttcgtcaccagaagacacagacagtaccagactgccgagatcctgctttccatgagcactttttcttccctgtacaggaggaggacgaccagaagaggcttctggtgaccgtgtggaatcgcgccagtcagagccgtcaatctggactcattggatgtatgtcgttcggggtgaagtcattgcttacccccgataaagagatatctggatggtactatttgctaggtgagcatttgggaagaaccaagcacctgaaagtcgcaaggcgcaggctgagacccctgagggatcccctgctgcgaatgcctggaggcggtgacaccgaaaatggcaaaaagctcaagatcactatcccacgcggaaaggacggctttggctttaccatctgctgcgactcacccgtgagagtgcaggctgttgactctggagggccagctgaaagagccggactgcagcagcttgacactgtgctgcagctcaacgaacggcccgtcgagcactggaaatgcgttgagttggcccacgaaatccgttcctgtcccagtgaaattattctcttggtctggaggatggtgccgcaggttaagccagggcccgacggcggggttcttcgtcgtgcaagctgcaaaagcacgcatgacttacagtctcctcctaacaagcgcgagaaaaactgcacgcatggggtccaggccaggcccgagcagaggcatagttgccatctggtttgtgattccagtgacggcctcctgcttggtggatgggagaggtacaccgaagtggcaaagcggggcggccagcacacgctccctgcactgtctcgcgccactgctcctactgaccccaactatattatcctcgcaccacttaatcccgggtcacagctcctacgcccagtgtaccaagaagacaccatccctgaagagagtggcagccccagcaaggggaaatcctacactggattgggtaagaaaagcaggctgatgaaaacggttcaaaccatgaagggccacggcaattatcagaattgcccggttgtccgccctcatgccacccacagcagctacggaacctacgtcacgctcgcccctaaagtgcttgtcttcccagtatttgtgcagccactggacctctgtaaccctgcccgaactctgttactcagtgaagaattgcttctgtacgagggacggaacaaggcagccgaagttacgctgtttgcctattcagatctgctgttattcaccaaggaggacgaacccggacgctgtgacgtgctccgaaacccgctctacctgcaatccgtgaagctccaggagggtagctccgaagacctaaagttttgtgtgctttacctggccgaaaaggctgagtgtctgtttaccctcgaagctcactcacaggagcagaagaaacgcgtgtgttggtgcctctcagaaaacatcgcaaagcaacaacagctggccgcatcaccgccggacagcaagatgtttgaaacagaggcagacgaaaagagggaaatggccttggaggagggaaagggcccgggtgccgaggattcccctcccagtaaagaaccttctcctggtcaggaactgccgcctggacaggatctgcccccaaataaagattcaccaagtggacaggaaccagcaccctctcaagagccattatcgtcaaaggactcagccacatccgagggctccccgcccgggccagacgcacccccgagtaaagacgtacccccttgccaggaaccgcctcccgcgcaggacttgtctccgtgccaggatctgcccgccgggcaggagccactgcctcaccaagatccccttctgaccaaggacctgcctgcgattcaagagtcccctactcgggacctgcctccctgccaagacctccctccgtctcaagtgtccctgcctgcgaaggcgttgactgaggatacaatgtcttccggcgatctgctagccgctacaggagatccccccgcagctccaaggcctgcatttgtcattcccgaggtccggcttgattctacctactcccaaaaggccggcgcagaacaaggatgttcgggtgatgaagaagacgccgaggaagccgaggaggtggaagagggggaggaaggggaagaggatgaagatgaggatacatccgacgacaattatggggaacggtctgaagctaaacgtagttccatgatcgagacaggtcagggcgccgaggggggtctgagtttaagggtccaaaattctttgcgtaggcgcacccactctgaagggtccctgttacaggaaccccgcggcccatgtttcgcatcggacactacactgcattgcagcgatggagagggggccgcttcgacatggggcatgccttctccctccacactgaagaaagagctgggacggaacggcggcagcatgcaccatctgtccctgtttttcaccgggcataggaagatgagtggagcagatacagtgggagacgacgacgaggcctcccgtaaacgcaagtcaaagaaccttgctaaggacatgaaaaacaaactcgggatattccgcagaaggaacgagagccctggcgctccacctgcagggaaggccgataagatgatgaagagcttcaaacccacctccgaggaggccttgaaatggggtgagagccttgagaaactactggtgcacaaatacggactcgcggtcttccaggcattcctacggacagaattctcagaggagaatttggagttttggttggcctgtgaggactttaagaaggtgaagtcccaaagtaaaatggcatctaaagcaaaaaaaatcttcgctgagtatattgctattcaagcatgcaaggaggttaaccttgatagttacactcgcgaacatacgaaagacaatcttcagtcggtcactcgcggctgtttcgatcttgctcagaagcgtatcttcggcctaatggagaaagatagttatccaagatttttgaggagcgacctttaccttgaccttatcaaccagaagaagatgtctcctccgttgtag

SEQ ID NO: 132070 - DNA, 1560 bp, Artificial Sequence
  Description of Artificial Sequence: Synthetic coding sequence
atgtttgagaccgaggccgacgagaagcgggaaatggccctcgaggagggtaaaggccccggcgcagaggactctccgcccagcaaggaacctagtcctggacaggaactgccgcccggacaggacctgcctccaaataaagatagcccatctgggcaggagcccgcccccagccaggagcctctgagctcaaaggacagcgccacctccgaaggatcgcccccaggtccagatgcaccgccctccaaggacgtgccaccttgccaagaaccgccaccagcccaggatttgtccccgtgccaagacttacctgccggccaagagccccttcctcaccaggatcccctgctgacaaaagacctcccggcaatccaggagagccccactcgggacctgcccccatgtcaggatctgcctccatctcaagtgagcctgccagccaaagcacttactgaggacactatgtcgtctggtgaccttctggccgctacaggagaccccccagctgcgccaaggcctgccttcgtaataccagaggtgcgacttgactcaacatactcacagaaagccggggctgaacagggctgtagcggcgacgaagaagacgccgaggaggccgaggaggtggaggagggtgaagaaggcgaagaagacgaagacgaagatactagtgacgataactacggagaacgcagcgaggccaaacgctccagcatgattgaaaccggacagggagccgaaggcggattgtcgctgcgggtgcagaattctttgcgacgccgaacacattctgaagggtcgttgctccaggaaccaagggggccatgtttcgccagtgacaccaccctccactgttcagacggcgaaggcgctgccagcacctggggcatgccaagtccttctacacttaaaaaagagctggggcggaatggtggatccatgcaccatctttcacttttttttactggacatcggaagatgtctggggccgatactgtgggggacgatgatgaggcttcccggaaaagaaaatccaagaatctggctaaagatatgaaaaataaactgggtattttccggcgtaggaatgagagccctggggccccccccgctggcaaggcagataaaatgatgaaatcattcaaacccacttctgaagaagcactgaaatggggtgagtccctcgagaagcttctggttcacaagtacggcctggccgttttccaagctttcttgagaacagaattctcagaagagaatcttgagttctggctggcctgtgaggattttaagaaagttaaatcccagagtaaaatggcttctaaggcaaaaaagattttcgctgaatatattgccatccaagcgtgcaaggaagttaatctggactcctacacaagagaacacaccaaagataacctgcagtccgttacccggggatgttttgatctcgcgcagaaaaggattttcggcttaatggagaaagactcctacccgagatttctgaggtcggacctgtatcttgatctgattaatcaaaaaaagatgtcgccaccgctttag

SEQ ID NO: 132071 - DNA, 3597 bp, Artificial Sequence
  Description of Artificial Sequence: Synthetic coding sequence
atgccagtgatcccagccctgtgggaggtggagatgggaagatcccaaggacaggagatcgagacaatcttggctaacaggtctcacagcgactccacaccccttccaaacttcctgagcggctctcacaggcctgaatgctgcacttgtaggctgctaacagcctcgggagcccaggacagcctcccctttgggaggcggttgtactccggaccatggagatcttgtgaagaggtgtgtcacgtttcagttctgagtgtcttatctactagctgtgggctgtcactgtctttgccaattttccctggttggatggagtggctttctccagacatagcattgccacggagagacgagtggacgcagacttcacccgcgcggaagcgcataactcatgctaaagtgcaaggagcgggtcagctacggctcagtatcgatgcgcaggatagggtcctgcttctgcatatcattgaggggaagggcctgatctcgaagcagcccggcacttgtgatccttacgtcaaaatcagcctcattccagaggactcgcgactgcggcaccagaagacacagacagttcctgattgccgcgacccagcatttcacgagcatttcttcttccctgtccaggaagaagacgaccagaaaagactgttggtaaccgtgtggaacagagctagccagtcaaggcagagcggcctgattggctgcatgtccttcggcgtgaagagccttcttactcccgataaagaaatatctggatggtactatctgcttggcgaacatctcggccgtaccaagcacctgaaggtagccaggcgaagactgaggcctcttcgggacccccttttaaggatgcctgggggcggagataccgagaatggcaagaagctgaagattacaattcctagggggaaggacggtttcggctttacaatatgttgcgactctcctgtgagagtgcaggccgtggatagtggtggccctgccgaaagggcgggcttgcagcagctcgatacagtgctacagttgaacgagaggcccgtggagcattggaaatgcgtggagctcgctcacgaaattaggtcgtgcccaagcgaaattatcctgctagtgtggagaatggtgccccaagtgaaacctggacctgacggcggagtactgcgtcgggccagttgcaagtcaacacacgacctccaatcaccaccgaacaaacgtgagaaaaactgtacccacggtgtgcaagcaaggccagaacaaaggcatagttgccacctggtgtgtgactcgtcagacggacttctcctgggtgggtgggagaggtacactgaagtcgcaaaacgcggcggacagcataccttgcccgctttaagcagggctactgctccaaccgatcccaattacatcatcctcgcccccctgaatccaggatctcagttgctgcgccccgtataccaggaggacaccattccagaggaatctggaagcccctctaagggcaaatcctatactggcctgggaaagaagagtagattaatgaaaaccgtgcaaaccatgaagggccacggcaattatcaaaattgcccagttgtgcgtccgcacgccactcatagctcctacggaacctacgtcacattagcgccaaaggtgctggttttcccagttttcgtccaaccactcgacctgtgcaatccagcaaggaccctgctcctgagcgaggaactcctattgtacgagggccgcaacaaggctgccgaagttactctgtttgcctactccgaccttctcctgtttactaaggaagatgagcccggccggtgcgacgtattgagaaatcccctgtatctacagtcagtgaagctgcaggaagggtcttctgaggacctgaagttttgcgttctttacctggctgaaaaggctgagtgcctttttactctggaggcgcacagccaggaacagaaaaaaagggtgtgttggtgtctctctgagaatattgctaagcagcaacaactcgctgcctcacctcctgattccaagatgtttgaaactgaggcagacgagaagagggagatggccctggaggaaggcaaagggcccggagctgaggatagcccaccaagtaaagagcccagcccagggcaagagcttccccctggccaggatcttcctcctaacaaagactcgccgtccgggcaggaaccagccccatcccaggagcctctttcttccaaagactcagctacctctgagggctcgccccctggacctgatgctcccccaagcaaagatgtgccgccgtgccaggaacctcccccggcccaggatctttctccatgtcaggaccttccagctggtcaagagcccctgccgcaccaggaccctttgttaaccaaggacctgcccgccattcaggagagtccaacccgggatctgcccccatgtcaagatttgccaccaagccaggtgtctctgccagctaaggctttaacagaggacaccatgtcatcaggtgacctactagctgccacaggggaccctcccgccgcaccccgccctgctttcgtgatcccggaagtgcgcttggactccacatattctcagaaggcaggcgccgagcagggatgctccggcgacgaggaggacgccgaagaggccgaggaagtggaggaaggtgaagagggcgaggaggatgaagacgaggacacctccgacgataactatggcgagcgcagtgaagccaagcgttcttctatgattgagacagggcaaggtgcagagggaggactctctctgagggtgcaaaattctctgaggcgacggactcattcggagggctcactactgcaagagccccgggggccttgcttcgccagcgacactactttacactgttcagatggagaaggtgcggcctctacctgggggatgccaagcccctccacacttaaaaaagagctgggtcgaaacggtggcagcatgcatcatctttcattgttttttaccggacatagaaagatgtccggtgctgatacagtgggagacgatgatgaagcttcacgcaagagaaagagcaaaaaccttgccaaagatatgaagaacaagctgggaattttccgcaggcgcaacgagagtcccggcgctcccccagccggcaaagcagataagatgatgaaatccttcaaacccacttccgaggaggcgctgaaatggggggagtctctggagaagcttctggtacataaatatggactggcagtttttcaggcattcctgaggacagagttttcggaggaaaacctcgaattttggctggcctgtgaagatttcaaaaaagtaaaatctcagtctaaaatggcaagcaaggccaagaagatcttcgctgaatatattgccattcaggcctgcaaggaggtgaatctggatagctataccagggagcacacaaaggataacctccaatcggtgactaggggttgtttcgacctagcgcagaagaggattttcggacttatggagaaggattcctatccccggttcctccgcagtgatctctacctagatctgatcaaccagaaaaagatgagtccccctctgtag

SEQ ID NO: 132072 - DNA, 1776 bp, Artificial Sequence
  Description of Artificial Sequence: Synthetic coding sequence
atgaatcgatttaacggactctgtaaagtgtgctctgaacgaagataccggcaaatcactatcccaaggggtaaagacggctttgggttcacgatatgttgcgactcaccagtaagggtccaggcagttgatagtgggggtcccgcagaaagggccggcttgcagcagctggatacagtgctgcaactgaatgagagacctgtggaacactggaagtgtgtggaactggcccacgaaattagatcctgcccttccgaaattatccttctggtgtggcgaatggttccccaagtaaaaccaggcccagatgggggtgtgctgaggcgggccagttgtaaatctacacacgaccttcagtcaccacccaacaaaagggaaaaaaattgcactcacggggtccaagctaggccagagcagcgccattcatgtcacctcgtctgcgattcaagcgatggcctcctgttaggaggctgggaaaggtacactgaggtagcgaagaggggaggacagcacaccctcccagccctgtcgagagcgactgctcccactgatccaaactatatcatcttggccccgctgaaccccggtagtcagctgcttcgtccagtgtaccaagaggataccatacccgaggagtctggcagccctagtaagggtaaatcgtacaccgggctggggaagaaaagcagactgatgaagacagtacagacaatgaaagggcatggtaattatcagaactgtcccgttgtccgaccacatgccacgcactcctcatacgggacctacgtcacccttgcccctaaagttcttgtcttccccgttttcgtccagccactggacctttgcaaccctgctagaacacttttgctatctgaggagctgctgttatacgagggcaggaataaggccgccgaggtcacgctgttcgcctactctgacctcctgctgtttacgaaagaagacgaaccagggcgctgcgacgtgcttcgcaatccactgtatctccaatccgtgaagctgcaagagggttctagcgaggatttaaaattttgcgtgttgtatctggccgagaaggcggaatgtctctttactctagaagcacactcacaggagcagaagaagcgggtgtgttggtgcttgtcagaaaacattgctaagcagcaacaactggccgctagtccaccagactccaagatgtctggagctgacaccgtgggagacgatgacgaggcgagtcggaagagaaagtctaagaacctggcgaaggacatgaaaaacaagctcggtatatttaggcgacgaaacgagtctcctggcgcaccccctgccggcaaagccgataaaatgatgaagagtttcaagcctaccagtgaggaagcattgaagtggggggaaagtctggagaaactcctagtgcataaatatgggctggctgtgttccaggcgttcttacgaactgagttctctgaggaaaatctggagttttggctggcttgcgaagatttcaagaaggtcaagagccagtccaagatggcctccaaggctaagaaaatcttcgcagaatatattgcaatacaggcttgtaaagaggtcaacctggactcttacacacgggagcacacaaaggataacctgcaatctgtgaccagaggctgcttcgacctcgcgcagaagaggatcttcggattaatggaaaaggacagttatcctagattcctgcggagtgacctctacctcgatctgatcaaccagaagaagatgagccccccactgtag

SEQ ID NO: 132073 - DNA, 1560 bp, Artificial Sequence
  Description of Artificial Sequence: Synthetic coding sequence
atgttcgaaaccgaggccgacgaaaaaagggaaatggctctggaagaaggaaaagggccaggggctgaagacagcccaccatctaaagagccatcaccaggacaggaattaccacccggccaggatctcccacctaacaaggactcccctagcggccaggagccggcacctagccaggaacccttgtcgtctaaagactcagccacgtccgagggatctccccccggccccgatgcacctcctagtaaagacgtccccccttgccaggagccccctcctgcacaggatctctcaccctgtcaggacctgcctgccggtcaggagccactgcctcatcaggaccccctcctgaccaaagacctccctgctattcaggagagccctaccagggatttgcctccgtgtcaggacctgcctccaagtcaagtgtctctacccgctaaagctctgaccgaggacaccatgtcctctggcgatcttttagcggcgactggggaccccccggctgccccacgccctgcatttgttatccccgaagttagactcgactctacgtactcacagaaggcaggcgctgagcaaggctgctccggcgatgaagaggatgccgaggaagccgaagaggtggaggaaggcgaagagggagaggaagacgaagacgaagacacctcggacgacaactacggggagcgttccgaagccaagcgttcctccatgatagagactggccagggagcagagggtggattgtctctccgggtacaaaactcactcaggcgccggacacactctgaaggctccctactccaagagcctaggggcccgtgcttcgcctctgacacaacactgcactgcagcgatggagagggcgccgcttctacgtggggcatgcctagtccctcgaccctcaaaaaggagttggggaggaatggcggatcaatgcatcacctgtccctgtttttcaccggacatcgaaagatgtccggggctgacaccgtgggggacgacgatgaagcctcaaggaagaggaagtccaagaacctggctaaggatatgaagaacaaactcggtatcttccgaagaaggaatgagtcccccggcgcccccccagcgggcaaagccgataaaatgatgaagtcatttaagcccacatccgaggaggccctgaagtggggggagtcgttggaaaaacttcttgttcataagtacggccttgcggtgttccaggcattcttgcgcacggagttcagtgaggaaaacctggaattctggttggcttgcgaggacttcaaaaaagtcaaatcacagtctaaaatggcctctaaagccaagaagattttcgcggagtacatagccatccaagcatgcaaggaggttaacctcgactcatatacacgggaacacacgaaagacaacctgcagtcggtcactaggggatgcttcgatttagcccagaaaagaatatttgggctgatggaaaaggatagctatcctcggtttctaagaagcgacctatatcttgacctgattaaccagaaaaagatgagcccccctctgtag

SEQ ID NO: 132074 - DNA, 936 bp, Artificial Sequence
  Description of Artificial Sequence: Synthetic coding sequence
atggtcacccgccgaccagtcacaaacagctgggactggctgccggccggcgctgcgccagaggctgtgccttgccgtcatatgcccctctcccggttacccttgcgcgtggggcagaaagaattcttcttccctctgcctcttctggtccctcctatctcctggttgttgttgtcagagagccaaccgcgcttggtccccggatccccagttatccggcccggctttcagcgcgcttgtgtcgctgccgcgtgcacagtggctgcgcggtgtcccggcaggggcgtcggagaccggtcccagtctggagcctcttatcggcctatctgtggccccaaagtgggcggcccaactgagatgcttcggggaatgtatctgaccaggaatggaaatttgcagcgtcgacacaccatgaaagaagccaaagacatgaagaacaaacttggaattttccggaggcggaacgagtcaccaggggcaccccccgccggaaaagccgacaaaatgatgaagtccttcaaaccaacctcggaggaggcattgaagtggggagagtcactcgagaagttgttggtccacaaatatggactggccgtgtttcaagcgttcttacggacagagttctctgaggagaatctcgaattctggttggcatgcgaagacttcaaaaaagtcaagagccagtcaaaaatggcatctaaggctaaaaaaattttcgccgagtacatagccattcaagcctgcaaggaagttaatctcgatagctatacccgggagcacacaaaggacaatctgcagtctgtcactagggggtgtttcgacttagcccagaaacgaatctttggactgatggaaaaagacagctatccacggtttttgcggtccgatctgtatttagaccttataaatcagaagaaaatgtcccctcctctttag

SEQ ID NO: 132075 - DNA, 564 bp, Artificial Sequence
  Description of Artificial Sequence: Synthetic coding sequence
atgaagcacaggctcggctttttgctgcagaagtctgattcctgtgaacacaattcatcccataataaaaaagacaaggtggtgatttgtcagagggtctcccaagaggaagtgaaaaagtgggctgaaagcctcgaaaaccttatctcccacgagtgcggcctggcagccttcaaggccttcctcaagagcgagtactcagaagagaatatcgacttttggatatcctgcgaagaatacaaaaaaatcaaaagccctagcaaactttccccaaaagccaagaagatttacaatgaatttatcagcgtccaggctactaaggaggtgaacctggattcttgcacccgggaggagaccagccgaaatatgctggaacctaccataacatgctttgatgaagcccagaagaagatcttcaacttaatggaaaaggactcttatcgacgtttcctgaagtctcgattctatctcgacctggtcaatccaagcagctgtggagctgagaaacaaaagggggcgaagagctccgctgattgcgccagtctggtgccgcagtgcgcatag

SEQ ID NO: 132076 - DNA, 282 bp, Artificial Sequence
  Description of Artificial Sequence: Synthetic coding sequence
atgtgcaaggggttggccgggctgcccgcatcttgcctgagatctgctaaggatatgaaacaccggcttggcttcctgcttcagaaatccgactcttgcgaacacaattcctcccacaataagaaagacaaagtggtgatttgccagcgcgtttcacaggaagaagttaagaaatgggcagagtccctagagaatcttatttcacatgaatgcgagcctggatttctgcaccagggtagagacaagcctgagcacgccagagcctacaacaacctgctgtag

SEQ ID NO: 132077 - DNA, 618 bp, Artificial Sequence
  Description of Artificial Sequence: Synthetic coding sequence
atgtgcaaaggactggcaggcctgccagctagctgcttgagatctgccaaggatatgaagcacagactcggttttttattacagaaatccgactcttgcgagcataattcgagccataacaagaaggataaagtcgtcatatgccagagagtaagccaggaggaagtgaagaagtgggccgagtctctggagaatctgatcagccacgagtgcggtttagcagcatttaaagcttttctgaagagtgagtacagcgaggagaacatagacttctggatttcctgcgaagagtataagaagatcaagagcccgtccaagctgtcgcctaaggcaaagaagatttacaatgagtttatatccgtgcaggctactaaggaggtgaatttagattcttgcacacgggaggagactagtcggaacatgttggagccgacgatcacctgcttcgatgaagctcagaaaaagatcttcaacctaatggagaaagacagctatcggcgctttctgaagagcagattttacctagacctggttaatccgtctagttgtggggctgagaagcagaagggggccaagagctctgcagactgtgcctcccttgttccacagtgcgcgtag

SEQ ID NO: 132078 - DNA, 909 bp, Artificial Sequence
  Description of Artificial Sequence: Synthetic coding sequence
atgtacaatatgatgttactcattcagaagcgaaagggtatcggctctcagttattaagggccggcgaggctgagggagaccggggggcagggactgccgagaggagcagcgattggcttgatggaaggtcatgggcgattaaggaaacgccaaccggtctagcaggcaggcgcagcgaggattcggataacattttcaccggagaagaggcaaagtacgcccagagccgcagccatagttcctcttgcaggatcagtttcctgctagccaactccaagctccttaacaagatgtgcaagggtctcgctggattgccagcctcttgtttgcggtcagccaaggacatgaagcacagactgggtttcctactgcagaaatccgacagctgtgagcacaactcctctcacaacaaaaaggacaaggttgtcatctgtcaacgtgtctctcaggaagaagtgaagaaatgggccgaatcgctcgaaaacctaatttcacatgagtgtggcttagctgcattcaaggctttcctgaagtctgagtattccgaggaaaatatagatttctggatttcatgcgaagagtataaaaagatcaagtccccctcgaagctctcacccaaggctaaaaaaatatacaatgagttcatcagtgttcaggcgacaaaagaggttaacttggactcatgtacacgggaagaaacctccaggaatatgctcgagcccactatcacctgctttgatgaggcccagaagaaaatcttcaacttaatggaaaaggacagttaccgcagattcctcaaatcccgattctacctggacctggtcaatcccagctcctgcggtgctgaaaagcagaaaggtgccaaaagtagcgccgactgtgcaagcctcgtgccccagtgcgcctag

SEQ ID NO: 132079 - DNA, 564 bp, Artificial Sequence
  Description of Artificial Sequence: Synthetic coding sequence
atgaagcacaggttaggattccttctacagaagtcggactcatgtgagcataatagtagccacaacaagaaagacaaggtagtgatctgtcagcgggtatctcaggaggaggtaaagaaatgggccgaaagcttggagaatctgatctcccatgaatgtggcctggccgccttcaaagctttccttaaatccgaatatagtgaggagaacatagatttttggatttcatgcgaagaatataagaaaattaagagcccctcaaaactgtcgcctaaagccaaaaagatttacaatgagttcatatccgtccaggctaccaaagaggtcaatctggactcgtgcaccagggaggaaacaagcagaaatatgttagaacctactatcacctgtttcgatgaagcacaaaaaaaaatttttaacctgatggagaaagacagctacagaagattcctgaaatccagattctacctcgatttagtaaatccgagctcttgcggagccgagaagcagaagggtgcgaaatcatctgctgattgcgcatccctggttccgcaatgtgcctag

SEQ ID NO: 132080 - DNA, 432 bp, Artificial Sequence
  Description of Artificial Sequence: Synthetic coding sequence
atgaaacaccgattgggcttcctactccagaagagcgattcatgcgagcacaatagctcccacaataaaaaagataaggtcgtcatatgtcagagagtgagccaggaggaggtcaagaagtgggctgaaagtctcgagaacctgatctcccatgagtgcggattagccgcctttaaggcctttttgaaatccgagtactcagaggaaaacatcgatttctggatcagctgtgaggaatataagaaaataaaatctccgagtaagctgtcaccaaaggccaaaaaaatctacaacgagttcataagtgttcaggccaccaaagaggtgaaccttgatagctgcaccagagaagaaacctctagaaatatgttagaacctaccattacttgttttgacgaggctcagaaaaaaatattcaacctcatggagtag

SEQ ID NO: 132081 - DNA, 546 bp, Artificial Sequence
  Description of Artificial Sequence: Synthetic coding sequence
atgtgtaaaggattggctgctctcccccacagttgtctcgagcgagccaaggagataaaaatcaaattagggatcctgcttcagaaacctgatagcgtgggtgatctggtcatcccgtacaacgagaaaccagagaaacccgcaaagacccaaaagacgtccttggacgaggccttacagtggcgggattccctggataaactgctgcaaaataattatgggctggcttcgtttaagagttttctgaagtctgagtttagcgaggagaaccttgaattctggatcgcatgcgaggattacaagaaaattaagagcccagcgaaaatggcagaaaaagcaaagcagatttacgaggagttcattcagaccgaggcaccgaaggaagtgaacatagatcacttcacaaaggacatcactatgaaaaacctggtggagccaagcttatcctccttcgacatggctcagaaacgaatacacgccttgatggaaaaggattcgttgcctcggtttgtgaggagcgaattttaccaggagctcatcaagtag

SEQ ID NO: 132082 - DNA, 606 bp, Artificial Sequence
  Description of Artificial Sequence: Synthetic coding sequence
atgtgcgctagaaatatcagccaggatatactcatcctgcaaatgcacagtgcgcattggcacatcaatgggaaatacgaggagaaaagtaacctgatgttctgggccaaggagataaagattaagcttgggatactgctccagaagcctgatagtgttggtgatttagtgatcccgtacaacgagaagcccgagaagccggccaaaacccaaaaaacctcgttggatgaggcactgcagtggagagactccttggacaagttgctccagaataactatggcctggcttcctttaagagctttctcaagagcgagttctcagaagagaacctcgagttttggatcgcttgtgaggactataagaaaatcaaatcccccgcgaagatggcggaaaaggctaaacagatctacgaagagtttatccagaccgaggctcctaaggaggtcaatatcgatcacttcaccaaagacattactatgaagaacctcgtggaaccctctttgtcctcattcgatatggcgcaaaagcggattcacgcattgatggagaaagacagcttgccccggttcgtaaggtctgagttctaccaggaattgatcaagtag

SEQ ID NO: 132083 - DNA, 222 bp, Artificial Sequence
  Description of Artificial Sequence: Synthetic coding sequence
atggctgagaaagccaaacagatctatgaggaatttatccaaacggaagcaccaaaagaagtaaatatcgatcattttactaaagatattacaatgaaaaatcttgtcgaaccatctctctcatcgtttgacatggctcagaaaagaatacacgccctgatggagaaggacagtctccctaggttcgtgcggtccgaattctaccaggagttgattaagtag

SEQ ID NO: 132084 - DNA, 1362 bp, Artificial Sequence
  Description of Artificial Sequence: Synthetic coding sequence
atggctcaggggagtggagaccagagagctgtgggcgtggcggatccagaagaaagctccccaaatatgattgtctactgcaagatcgaggatataattactaagatgcaagacgataaaacggggggcgtgccaattagaaccgtaaaatccttcttgtcaaaaattccttctgtggttaccggtaccgatatcgtgcaatggctcatgaaaaacctttctatcgaagaccccgttgaagccattcatctcggctctcttattgcggcccaaggatatatttttcctataagcgaccacgttctgaccatgaaggacgacgggaccttttatcgcttccaggctccgtacttctggccatctaactgttgggagccagaaaatacagattatgctatctacttgtgtaagcgaactatgcagaacaaagcccggctggaactcgctgactacgaggccgagaatctcgcaagactacaacgagccttcgcccgtaaatgggagttcatatttatgcaggccgaggcccaggtcaagatcgaccggaaaaaggataaaacagagcggaaaattttggacagccaggaacgtgcattttgggatgtccatagacctgtgcccggatgcgtaaatacaactgagatggacatcaggaaatgtcgcagactgaaaaatccacaaaaggtgaagaaatccgtgtacggagttacagaagagagccaggctcagtcccccgtgcatgttttgagtcagccaatccggaaaactaccaaagaggacatcaggaaacagattacatttttaaacgcccagatcgaccgacattgcctgaagatgtcaaaagtcgccgagagcaaagaaccctctcagcagcgggttaagcgctggggattcagctttgatgagatcctcaaagatcaggtcggacgggaccagtttctacgattcctcgaaagcgaattctcctcagaaaacctccggttctggcttgccgttcaggatctgaagaagcagcccctgcaggacgtggccaaaagggtggaggaaatatggcaggagtttctcgcacccggggccccatccgccattaacttggatagtcactcctacgaaataaccagccagaatgtcaaagatgggggccgctacacgttcgaagacgctcaggagcatatctataagttgatgaagtccgacagttacgcaagatttctgagatctaacgcctaccaggatctgctgcttgccaagaaaaagcccgaatcggagcagggtaggcgaacaagcctggaaaaattcacacgaagcgtgggtaagtcacttgcaggaaagcgtctgacaggtttgatgcagagtagctag

SEQ ID NO: 132085 - DNA, 1383 bp, Artificial Sequence
  Description of Artificial Sequence: Synthetic coding sequence
atggcccagggtagtggtgaccaacgagcagtcggtgtggctgaccctgaagaatcctctcctaacatgattgtgtattgtaagatcgaggatatcattaccaaaatgcaggacgataagacaggcggtgtgcctatcagaactgtgaaatctttcctgtctaaaattcccagcgtcgtgaccggcactgatatcgtgcaatggttgatgaagaatctctccattgaggatcccgtggaagctattcatctcggcagcctaattgcagcccagggctacatcttccccatctccgaccacgtcctcactatgaaagacgatggaaccttctatagatttcaggccccctatttttggccttccaactgctgggaacccgagaatactgactacgccatctatctctgcaaaagaactatgcagaacaaggcaagactggagttggctgactatgaagcagaaaatttggcaagactgcagagggcgtttgctcgcaagtgggagtttattttcatgcaggcagaggcccaggtgaagatcgatcggaaaaaggataagacggagagaaagattctcgactcacaagaacgcgccttttgggatgtgcaccggcccgttccaggctgcgtcaacacaacagagatggatatccgaaaatgccgtaggctcaagaatcctcagaaagtaaaaaaatccgtctacggagtcacagaggagtctcaggcacagagccctgtacacgtcctgtctcaaccaatcaggaaaacgacaaaagaagacattaggaagcagattaccttcctgaatgcccagattgataggcactgtttgaagatgtctaaagttgctgagtctttgatcgcttacaccgagcagtacgtggagtatgatccactgatcaccccagcagagccgtcaaatccttggatctctgacgatgtggctctgtgggacatcgaaatgagcaaggagccctcacagcagcgagtaaagaggtgggggttttctttcgatgagatactcaaggaccaggtgggtcgcgaccagttcttgcgtttcctggaaagtgagttttctagtgagaacctgcgcttttggcttgcagtccaggacctaaaaaaacagcctttgcaggacgtggctaagcgagtggaagagatctggcaggagttccttgctcctggcgcccctagtgccattaaccttgactcccattcatacgaaatcacaagtcagaatgtcaaagacggtggcaggtacacctttgaggatgcccaggagcacatctacaaactgatgaagtccgattcctacgctagattcctcagaagcaacgcttatcaggatctactgttagcaaagaaaaaggtgtggctcctctag

SEQ ID NO: 132086 - DNA, 1419 bp, Artificial Sequence
  Description of Artificial Sequence: Synthetic coding sequence
atggcccagggttccggtgaccagagggccgtcggtgtggctgacccggaggagagcagccctaatatgattgtttattgcaagatagaagacatcatcactaagatgcaggatgataaaaccggcggagttcctattcggactgtaaaatcatttctaagcaaaatccccagcgtggttactggaactgacatcgtccagtggctgatgaaaaatctgtctattgaagatccagttgaggcaatacacttgggtagtctcattgctgcccagggatatatattccctatttccgaccacgttctgacaatgaaggacgatgggacattctatagatttcaagcaccatacttctggccttcaaactgctgggagccagaaaataccgattacgcgatttacttgtgcaagagaacaatgcagaacaaagcccggctggagcttgcagactatgaggctgagaatctggccagactccagagggctttcgcccgaaaatgggagttcatttttatgcaggctgaagcacaagtgaaaatagaccgcaaaaaagataaaacggaacgaaaaattctggactcgcaggaaagggccttctgggatgtacacagaccagtgcctggttgtgtgaacacaaccgaaatggatattagaaagtgtagaaggctcaagaacccccagaaagtcaaaaaatccgtgtacggggtgaccgaggagagccaggcgcaaagccctgtgcacgtgcttagccagccgatccggaaaactacgaaggaggacattcgcaaacagatcacattcctgaacgctcaaatcgaccgacattgtctcaagatgtcaaaagtggctgaatctctgatcgcttacacagagcaatatgtcgaatatgatcccctaatcacccctgccgaacccagtaacccatggattagcgatgacgtggctctctgggacattgagatgagcaaggagccaagccagcagcgggtgaaaagatgggggttctcctttgatgagatcctcaaggatcaggtagggagggaccaattcctgagattcctggagagcgagttctcatccgaaaacctccgcttctggctggccgtacaggacctaaaaaagcagccacttcaggacgtcgctaagcgagttgaagagatttggcaggagttcctcgctcccggggcaccatctgccattaacttagactcacattcatacgaaatcacgagccagaacgtaaaagacggcggtcgttatacctttgaggatgcccaggagcatatttataaactaatgaaatccgacagttacgctagattcctccggagcaacgcttatcaggatcttctcctggctaagaaaaaaggcaaaagcctggccgggaagcggctcaccggcttaatgcagagtagctag

SEQ ID NO: 132087 - DNA, 1443 bp, Artificial Sequence
  Description of Artificial Sequence: Synthetic coding sequence
atggcgcagggttctggtgaccagcgtgcagtcggtgtcgccgaccccgaagagtcctcccccaacatgattgtgtattgcaagatcgaggatatcattactaaaatgcaggacgacaagaccgggggtgtcccaatcaggacagtcaagagcttcttgtccaagatcccgtcagtggttaccggaaccgacattgttcagtggttgatgaagaacctttctatcgaggaccccgtcgaagccatccatctgggctccctgatcgcagctcagggatacatcttccctatttccgaccacgtgctgacaatgaaggacgacggaacgttctataggtttcaagccccatatttctggccttccaactgttgggagcccgagaataccgactatgccatctatctgtgtaaacgaaccatgcagaacaaagctcggctggagttagctgattatgaggccgaaaatctggccaggctgcaacgcgcttttgcaaggaagtgggaattcatttttatgcaggcagaggcgcaggtgaagattgataggaagaaggataagactgagaggaaaattctagacagccaggaacgggcattttgggacgttcatcggcccgttccagggtgcgtcaatacaactgagatggatataagaaaatgccggcggctgaagaatccacaaaaggtgaaaaagtcagtgtacggcgttactgaagagagccaggctcagtctcctgtgcacgtcctctcacagccaattaggaagactacgaaggaggacattcgaaaacagattacatttttaaatgcccaaattgataggcattgcctaaagatgtcaaaggtggcagagtccctgatcgcctacactgagcagtatgtggagtatgatcccctcattacccctgccgaacccagtaacccctggatttccgatgatgtcgccctctgggacatcgaaatgtctaaagaaccgtcccagcagcgtgtgaaacgctggggcttctcattcgacgagatcctgaaagaccaggttgggagggaccagtttctacggtttctcgaatctgagtttagctctgaaaaccttcggttttggttagcagttcaggacttaaagaaacagcccctgcaggatgtggccaagcgggtcgaggagatctggcaggagtttctagcccccggcgccccaagtgcaatcaacctggattctcatagttatgaaattacgagccaaaatgtgaaagacggcgggagatacacgtttgaggatgcccaggagcacatatataagttaatgaagtctgactcttacgcacgttttcttcgcagcaatgcctaccaagatctcctgctcgcaaaaaaaaaaccagagagcgagcaggggaggcggacctccctggagaagtttactcgcagtgtgtgcctgcagctactcttctag

SEQ ID NO: 132088 - DNA, 1428 bp, Artificial Sequence
  Description of Artificial Sequence: Synthetic coding sequence
atggcgcaaggatcaggcgatcagcgggccgtgggcgtggccgatcctgaagagtcttctcccaacatgatcgtgtactgcaagattgaggatatcattacgaaaatgcaggacgataagactggtggcgtgcccatacggacggttaagagcttcctgtcaaaaataccttctgtcgtaacagggaccgatatcgtccagtggctgatgaagaacctgagtatcgaagatccagtggaagcaatccatcttggctccctgattgccgctcaaggatatatcttccccatttctgatcacgtgttgacaatgaaagatgacggcactttctatcgcttccaggctccctacttttggcccagcaattgttgggagccagaaaatactgactatgcgatctacttatgtaagagaactatgcagaataaagccaggctggaactcgcagattacgaagcggaaaaccttgcccgtttgcagcgagcgttcgcccgtaaatgggagtttatttttatgcaggccgaggcccaggtcaagatcgaccgaaaaaaagacaagacagaaagaaagattttggattcacaagagcgagcgttttgggacgtgcatcgccccgtgccaggatgtgtcaacaccaccgaaatggacatcagaaagtgccggcggctcaaaaatcctcagaaagtgaagaagtctgtttacggcgtgacagaggagagccaggcacagagtccagtgcatgtgctctcccagcccattagaaagacgaccaaagaggacattcgcaagcagattacctttctgaacgctcaaattgacagacactgtctgaaaatgtctaaggtagcagagagcctcatcgcctacactgagcagtatgtcgagtatgacccacttattactccagccgagccatctaatccttggatcagcgacgacgtagctctgtgggatatcgagatgtctaaggaaccgagccagcagagagtcaagagatggggcttctcgttcgacgagatactcaaagaccaggtcggccgcgatcaattccttcgcttcctggaatccgagttttccagcgagaacctgcgtttttggctcgctgtgcaggacctaaagaagcagccactgcaggatgtggctaaacgtgtcgaagaaatttggcaggagttcctggctcccggtgcaccgagcgctatcaatctcgattctcacagctatgaaatcacttctcagaacgtgaaggatggcggaagatacaccttcgaggacgcccaggagcatatttataagctaatgaagtcagattcctatgcccgtttcctacgatccaacgcctatcaagatctgctcctggccaaaaaaaagccagaaagtgagcagggaaggaggacatccctcgagaagttcactcgttccgtcggatag

SEQ ID NO: 132089 - DNA, 1434 bp, Artificial Sequence
  Description of Artificial Sequence: Synthetic coding sequence
atggcccagggtagtggagaccagagggcagtgggtgtggctgatccggaagagagtagcccaaatatgatcgtatattgcaagattgaggacatcattactaaaatgcaagatgataaaaccggaggagtcccaatcaggacggtcaagtcattcctgagtaagataccgagtgtcgtcacgggcacagatatcgtgcagtggttaatgaagaatctgtccatagaggatcctgtcgaggctatccacttggggtcactgattgccgcgcaggggtacatttttcctatcagtgaccacgttcttaccatgaaagatgacggcaccttttataggttccaagccccatacttctggcctagcaactgctgggagccggaaaatactgattacgctatttatctatgcaaacgcaccatgcaaaataaagcgagacttgagctcgctgattacgaagcagaaaacctcgcccgtttgcagcgtgccttcgctcgtaaatgggaattcatctttatgcaggcagaggctcaggtgaaaatcgaccggaaaaaggataagactgaacgtaagatactagactcccaggaacgagctttttgggatgtccataggcctgtgcctgggtgcgtgaatacgaccgaaatggacatccgtaagtgtagacgactgaagaacccacagaaagtgaaaaagtcggtgtacggagtaactgaagaaagtcaggcccagagccctgtccatgtgctctcacagcctattaggaagactaccaaggaagacattcgcaagcagattactttcctaaacgcccagatcgaccgccactgtctcaagatgtctaaggtcgctgaaagccttatcgcttataccgaacagtacgtggagtatgacccactcatcacccctgctgaaccatctaatccgtggatttccgatgacgtcgccttatgggacattgagatgagcaaggaaccaagccagcagcgcgtaaagcgttggggattctccttcgatgagatcctgaaagatcaggtaggaagggaccaatttctgaggtttctcgagtcggaatttagttctgaaaatctgcgcttctggttggccgtgcaggacctgaagaaacagcctctgcaggatgtggcaaaacgcgttgaggagatttggcaagagttcctggctccaggggccccttctgctattaacctggacagccattcatacgaaatcaccagtcagaacgttaaggatgggggccggtacaccttcgaagatgcacaagagcatatttataaacttatgaagagtgacagttacgctaggtttctgcgaagcaatgcgtatcaggatctccttctggctaagaagaaacctgaaagcgaacagggccgacggacgtcactcgaaaagtttacgaggtccgtcctgctgttttag

SEQ ID NO: 132090 - DNA, 1620 bp, Artificial Sequence
  Description of Artificial Sequence: Synthetic coding sequence
atgaagaacctctccatcgaagatcccgtcgaggccatacatctgggcagcttaatcgccgcccagggatacatttttcccatttccgatcatgtcttgacgatgaaagatgacggaactttctatcgcttccaagcgccatatttctggccatctaactgctgggaaccggagaacactgattatgccatatatctgtgcaagcgaacaatgcagaataaggccaggctggagctggccgactatgaggccgagaacctcgcaaggctgcaaagagcattcgccaggaagtgggagtttatctttatgcaggcggaagcccaggtcaagattgatcggaaaaaggacaagaccgagaggaaaatccttgactctcaggaacgagccttctgggacgttcacagacctgtgccgggatgcgtcaatacgacagagatggacatccgaaagtgtcggcggttgaagaatccccagaaagtcaaaaaatcagtgtacggggtgactgaagagtcccaggcacagtcacctgtgcacgtgctgtctcaacccatccgaaaaacaacaaaagaggacatccggaagcagataactttcctgaacgcccagattgaccgacactgcctgaaaatgtcaaaggtggccgaatccttgattgcttacaccgagcaatacgtggaatacgatcccctaataacacctgccgagccatccaatccttggataagcgatgatgtggcgctttgggacattgaaatgtctaaggagccttcccaacagagggttaaaaggtggggcttcagcttcgatgagatcctgaaggaccaggtgggaagggatcagttcctcaggttcctggaatccgagttttcatctgaaaacctccggttttggctcgctgttcaggacctgaaaaaacagccacttcaagacgtggccaaaagggtcgaagaaatctggcaggaattcctggctccaggcgccccctctgccattaatctggacagccatagctacgaaatcactagtcagaacgtgaaagacgggggaaggtacacctttgaggacgcccaagaacatatctacaagttgatgaagtccgattcctatgcacgttttctgcggtcaaacgcctaccaagatctgcttctcgctaaaaagaagcctgagtccgagcaggggaggcgtacctccctcgaaaagttcacccgctccgtcaacgtccagaacacacggcccgctggcgcttggagcatattcatggccgctctgccgatggccgtgtggctacgtactcctcggtcttgtcacgggttaagcgagtcaagactcttggggttaccaagcctgcacgacggcctgcgggaagggcagtctctgcctcagagctgtccaggttcttctagcaccgctgctgagggtgctcgggaacgcgcctccaatggccgaagcctcgcccgaagacagcattgccagtgccatggacagggcgaggagacgcaactgtgcctgtggtcgcggttggaatcaagtaagcgtagtcagcgcgcatcatccctgcgaacaagtaaggcaaagaaaaaacgtcagactgtgaagcaaggtccaaaggcttggccgtag

SEQ ID NO: 132091 - DNA, 1299 bp, Artificial Sequence
  Description of Artificial Sequence: Synthetic coding sequence
atcgaagatatcatcacaaaaatgcaggacgacaagaccggtggtgtgcctatacggaccgtgaaatcctttttgtcaaagataccttctgtggtcactgggaccgatatcgtccagtggctaatgaagaacctgagcattgaagaccccgtggaagccatacacctgggcagtctgattgctgcacaggggtatatcttcccaatctccgatcacgtccttacaatgaaagacgacggcacattttataggtttcaggctccttacttctggccctccaattgttgggaacccgaaaacacagattacgccatttacctgtgtaaacgaactatgcagaataaggctcgactcgaattagccgactacgaagcagaaaacctagctcgcctgcagcgcgctttcgcaaggaagtgggagttcatctttatgcaagccgaggcccaggtgaaaatcgaccggaaaaaagacaagaccgaaaggaagattctcgattctcaggagcgggcattctgggacgtacatcgacctgtccccggctgtgtaaacacgaccgagatggacatccggaagtgccgtagattaaaaaatccacaaaaggtgaaaaaaagtgtctatggagtgaccgaagaatcacaggcccaaagtcctgtgcacgtcctgtcccaaccaattcgcaagactacaaaagaggacatcagaaagcagattaccttcctgaatgcccagattgaccgccactgcctgaaaatgagcaaggttgcagaaagcctcatcgcatatacagaacagtatgttgagtatgaccccctgatcactcctgcggaacctagtaatccgtggattagcgacgatgtggcactgtgggatattgagatgtccaaggaaccatcccagcaaagggttaaaagatgggggttctctttcgacgaaatcctgaaggatcaggttggccgcgaccagttcctgcgattcctagaatcagagttctcttcagaaaatctgcggttctggctggcagtccaagacctcaagaagcaacccctacaggatgtggctaagcgagtggaagaaatttggcaggagttcttggcccctggtgcgcctagtgccattaacctggacagtcattcttatgaaatcacctctcagaacgttaaagacggaggtcgctatacatttgaggacgcacaagaacatatttataagctgatgaagagtgactcctatgctcgttttttgcggtccaatgcttaccaagatctgctgctggcaaaaaagaaagtctggctcctgtag

SEQ ID NO: 132092 - DNA, 1041 bp, Artificial Sequence
  Description of Artificial Sequence: Synthetic coding sequence
atgcagaacaaggcccgcctggagttggccgactatgaagcagagaacctggccagactgcagagagccttcgctcgcaagtgggagtttatattcatgcaagccgaggctcaggtgaagattgaccggaagaaagacaaaactgaacggaaaatactggacagtcaggaacgcgccttttgggatgtgcatcgtcctgttcccgggtgcgttaatactacagagatggatatacggaagtgccgcaggctgaaaaatccacaaaaggtgaagaagagcgtatacggagtgactgaagaaagccaggcgcagtctcccgtccacgtgctgagccaacccatcaggaagactacgaaagaggacattcggaagcagatcacctttcttaatgctcaaattgataggcattgccttaaaatgagcaaggttgctgagtcattgatcgcatatactgaacagtacgtggaatacgaccctttaattaccccagccgagccaagtaacccatggatttcagatgatgtcgcactttgggatattgagatgagtaaggagccatcccagcaaagggtgaagcgctggggctttagcttcgacgagatcctgaaggatcaagtcgggcgtgatcaatttctgcgctttctagagtcagaattctcgtcagagaatttacgtttctggctggccgtccaggacctgaaaaaacagccgcttcaagatgtagccaagcgcgtggaggagatctggcaagaatttttagcccctggcgcaccctctgccatcaacctggacagccattcatacgagatcactagccagaacgtgaaagacgggggcaggtacactttcgaagatgcacaggagcacatttataagttgatgaagtcagatagttacgcacggtttctgcgatctaacgcctatcaagatctcctgcttgccaaaaagaagcctgagtctgaacaaggcaggcggacctccctggaaaagttcactagaagcgtgctatggctgctgttccccctgggaaagagaccatag

SEQ ID NO: 132093 - DNA, 1473 bp, Artificial Sequence
  Description of Artificial Sequence: Synthetic coding sequence
atggcgcagggttccggtgatcagagagctgtaggcgtcgccgatcctgaggagagcagtccaaacatgatcgtctattgtaaaatcgaagatattatcactaagatgcaggatgacaagactgggggagtaccaatcagaaccgttaaatcatttctgtccaaaattccatcggtagtgacaggcacagatatcgtgcagtggcttatgaagaacctgagcattgaagatccagtggaagccatccatttaggctctctcattgccgcccaaggatacatatttccaatttccgatcatgtattgaccatgaaagacgacggcaccttttaccggttccaagctccttatttttggcctagcaactgctgggagcctgaaaacacggactacgcaatttacctctgcaagcggactatgcagaataaggcaaggctggaactggccgactacgaggcggaaaatctggcacgcctccagcgtgcgtttgcccgaaaatgggagtttattttcatgcaggccgaggcacaggtaaaaatcgaccgcaaaaaggacaagactgagcgtaagatcctagatagccaggagcgggctttctgggacgtccaccgcccagtccctggttgtgtaaacaccactgagatggacatccgcaagtgtcgaaggctgaagaaccctcaaaaagttaagaagtctgtatatggggtcaccgaggaaagccaagctcagtctccagtccatgtccttagccaacctatcagaaagactactaaggaggatatacggaaacagattacatttctgaacgctcagattgaccgtcattgtctgaagatgagcaaggtggccgaatcgctgattgcgtacactgagcagtacgttgagtacgaccctctcatcacacccgccgagccatccaacccatggatctctgacgacgttgcactgtgggacattgaaatgtccaaggaaccatctcagcagagggttaagcgatgggggttcagcttcgatgaaattttaaaggaccaggtgggaagggatcagttccttcgattcctggaaagcgaattcagctccgaaaatctgaggttctggcttgccgtgcaggacctgaaaaagcagccactgcaggatgtggcgaagcgtgtcgaagagatctggcaggagttcctcgcccctggggccccgtccgctatcaacctcgattcgcatagctacgaaatcaccagccaaaacgtcaaggacggcggtcgctatacctttgaggacgcccaagaacacatctacaaattgatgaaatcagactcttacgcccggttcctcagatctaacgcctatcaggacctgctgctggctaaaaaaaagcctgagtcggagcagggaagacgtacgtcattggaaaaattcacaaggtcggttggaaaatctcttgcagggaagcggctaactggcttaatgcagtcgagctag

SEQ ID NO: 132094 - DNA, 1419 bp, Artificial Sequence
  Description of Artificial Sequence: Synthetic coding sequence
atggcccagggttctggggatcagcgggcagtcggcgtcgcagacccagaggagagctctcccaatatgatcgtctattgcaaaattgaagacataatcacaaaaatgcaagacgataaaaccggcggggtgccaatacgcacagtgaaatccttcctgtctaagattccgagcgtggtgacgggaacagatattgtgcagtggctaatgaaaaatttatctatagaagaccctgttgaggccatacaccttggcagtctgatcgcggcccagggatacattttcccaatctcagaccacgtcctgacaatgaaagatgacggaactttttaccggtttcaagctccatatttttggccatctaactgttgggagccagaaaacaccgactatgctatttacttgtgcaagcgcactatgcagaacaaagccagactcgagctagctgattacgaagctgagaatctagcgcgactgcagcgggcatttgcccgcaaatgggagttcatctttatgcaggcagaggctcaggttaagattgaccgcaagaaggataagacggagcgaaaaatcctggacagtcaagagagggcattttgggacgttcacaggcctgtgccgggttgcgttaatactacagagatggacattagaaagtgcaggagactgaagaatccccagaaggtgaagaagtccgtgtatggagtcactgaagaaagtcaggcacagagtccagtacacgtcctatcccaacctattcggaaaaccaccaaagaggacattaggaagcagattacatttctgaatgcacagatcgaccggcactgtctaaaaatgagtaaggtggctgaatctctgatcgcctacaccgagcaatatgtagagtatgaccctcttattacacctgccgagccctccaacccttggattagcgacgacgtggcactctgggacatcgagatgagcaaagagccttcccaacaaagagtgaagaggtgggggttctcattcgacgagatcctgaaggaccaggtggggagagaccagttcctgagattcctggagtccgagttttcttccgagaacctccgcttttggctggccgttcaggatttaaaaaagcagcctctgcaagatgttgccaaaagggtcgaggaaatctggcaggagttcctggcccctggcgccccatccgctattaacttggattcacactcttacgagatcacctctcagaacgtgaaggacggagggcggtataccttcgaggatgcccaggagcatatctataagctcatgaaatctgattcttacgcccgcttcctgaggtccaatgcataccaggatttgcttctggccaagaaaaagggcaagagcttagctggaaaacggttaactggattgatgcaatccagctag

SEQ ID NO: 132095 - DNA, 1041 bp, Artificial Sequence
  Description of Artificial Sequence: Synthetic coding sequence
atgcagaacaaagctagactggaattggctgattacgaggcagaaaatttggcccgcctacaaagagctttcgctcgaaaatgggagttcatcttcatgcaagctgaggcccaagttaagattgaccgtaagaaagacaaaactgaaagaaaaatcttggactcccaggaacgcgcattttgggatgtccataggccagtccccggttgcgtgaacactaccgagatggatatcaggaagtgccgaaggctcaagaatccccagaaagtcaagaagtcagtttacggagtgacagaggagtcacaggcacagtcccccgtccacgtgctcagtcagcctatccggaagacaaccaaggaagatatacgtaagcagataaccttcctgaatgcccagatcgaccggcactgtttgaagatgagcaaggtcgctgagtctttgattgcctacactgaacagtacgtagagtacgatcccttaattacccctgccgagccttcgaatccttggattagtgacgatgttgctctttgggacatcgagatgagcaaagagccttctcagcagcgagtcaagaggtggggcttctcattcgacgagattctgaaagaccaggtcggaagggaccagtttctgagattcttggagagcgagttttcttccgaaaatctgaggttttggctcgccgtccaggacctgaagaaacaacccctccaggacgtcgctaaacgcgtggaggagatatggcaggagttcctggcgcctggtgctccctctgccatcaatctcgactctcattcatatgaaataacatcacagaacgtgaaggatgggggccggtatacattcgaggacgcccaagaacacatttacaagctgatgaaatccgacagttacgcacgcttcctccgctcaaatgcctaccaggatttgctgctcgctaagaagaaaccagagtctgagcagggacggagaacaagtctagagaaatttactcgctccgtcctctactccaacacccctctcgcaaaaagaccttag

SEQ ID NO: 132096 - DNA, 1419 bp, Artificial Sequence
  Description of Artificial Sequence: Synthetic coding sequence
atggcccaggggagcggcgaccaacgcgcagtcggtgtggcagacccagaggagtcctctcctaacatgatcgtttactgcaaaattgaggatataataacaaaaatgcaggatgacaaaaccgggggcgttccaatccgcactgtgaaatcgttcctctccaaaattccctccgtggtgactggaaccgacatcgtgcagtggctgatgaaaaacctctctatagaagatcccgtggaggccattcacttaggcagtttaattgctgcccaaggatacatcttcccaatctcagaccatgtgctcacaatgaaggacgacggaaccttctatcgctttcaagcgccatatttttggccatctaactgttgggagcctgagaatacagactacgccatctacttgtgtaagagaactatgcaaaacaaagccaggttagaactcgcagactatgaagcagagaatctcgcaagattgcagagggctttcgcaaggaagtgggagttcatattcatgcaggcagaagcccaagtgaaaatcgataggaagaaggataaaaccgagcgcaagattctcgactcgcaggaaagagcattctgggacgtacatagacctgtaccagggtgcgtgaacacaacagaaatggacatacgaaagtgcagaaggctgaagaacccgcagaaagtgaagaaatccgtgtatggcgtgaccgaggagtctcaggctcagagccctgtccacgtgctcagccagcctataagaaagactacgaaggaggatattcggaaacaaattacattcctcaatgctcagattgaccgacactgcctgaaaatgtcaaaagtcgctgaaagtctcatcgcatacacagaacagtatgtggagtacgatcccctcatcacccctgccgaaccctccaacccctggatttccgacgatgtggcgctatgggacattgagatgagcaaggagccatctcagcaacgcgtgaagcgctggggcttctcctttgatgaaatcttgaaggatcaagtcggaagggaccagttcttgcggttcctagagtctgagttcagttccgagaacttaaggttttggttggcggtgcaggatctgaaaaaacaaccccttcaggatgtggccaaaagagtcgaggagatatggcaagaattcctggcccctggagcccctagcgccatcaacctcgattctcactcctacgaaattactagtcagaatgtgaaagacggggggcgatacacctttgaagacgcgcaagagcacatctacaagctgatgaagtcagattcctatgccaggtttctcaggtcgaacgcctatcaggatttgctactcgcaaagaaaaaggggaagtctctggctggcaaacgcttgaccggcctaatgcagtcaagctag

SEQ ID NO: 132097 - DNA, 1473 bp, Artificial Sequence
  Description of Artificial Sequence: Synthetic coding sequence
atggcccagggctcgggagaccagcgcgccgtcggagtggctgatccagaagagagtagccctaacatgatcgtttattgtaagatcgaggacatcattacaaagatgcaggatgacaagaccgggggtgtgcccattcgcaccgtgaagtcttttcttagcaaaataccctcggtggtgactggaacggacatcgtacagtggctgatgaagaacttatctatcgaggaccctgtggaagccatacatctgggctccttgatagcagcacagggatacatcttcccaatctcagatcatgtgctcaccatgaaagacgacggcaccttttatcggttccaggccccttacttttggcccagcaactgttgggagccagagaatactgattatgccatttacttgtgcaaacgcacaatgcaaaacaaggctcgcctggagctggccgactatgaggctgagaatctggcccgcctgcaaagagcctttgcccgtaagtgggaattcattttcatgcaggcagaggcgcaagtcaagattgaccgaaagaaagacaagaccgaaagaaagatcctggatagccaagagagggccttctgggacgtgcacaggcccgtccctgggtgtgtgaacactactgagatggacatccggaaatgcaggcgactcaagaacccccagaaggtgaagaagtctgtttatggcgtgacagaagagtcccaggcacagagtcctgtgcacgtgttgtcacagcccattcgcaagacaaccaaagaagacattaggaagcagatcacatttctgaacgcccagattgacaggcactgtcttaaaatgtcgaaagttgcagagtcgctcattgcctatactgagcagtatgtcgaatatgatcctctcatcacacctgctgaaccctctaacccttggatttctgatgatgtggctctttgggacattgaaatgtcaaaggagcctagccagcagcgagtaaaaaggtggggcttctcctttgacgagatcctcaaagaccaggtgggcagggatcagttcctccggttcctcgagtcggaattctcctcggagaacctgcgcttctggctggcggtacaggatctgaaaaagcagcccctgcaggatgttgccaagcgcgtggaagagatctggcaagagttcctcgcaccaggtgccccatccgctattaatctcgactctcactcctatgaaatcacaagccagaacgtgaaagacgggggccgctatacttttgaggatgcacaggagcacatttacaagctcatgaagtccgattcgtacgcgagattcttgcgctctaacgcttaccaggacctgttgctcgcgaagaagaaacctgaatcagaacagggaaggagaactagcctcgagaagttcacgcgatccgtgggtaaatcactcgccggaaaacgtctgaccggattgatgcagtctagttag

SEQ ID NO: 132098 - DNA, 1398 bp, Artificial Sequence
  Description of Artificial Sequence: Synthetic coding sequence
atggctcaggggtcaggagaccagcgggcggtgggggtggctgacccggaggagtcaagcccgaacatgatagtgtactgcaagatagaagatataatcactaagatgcaagatgacaaaacaggcggtgtgcccattcgcaccgttaagtccttcctctcaaagattccatctgtcgtcacaggaaccgacatcgtgcagtggctaatgaaaaatctgagcattgaagatcctgtggaagcgatccacctgggcagcttgatcgccgcccagggctacatttttcccataagcgaccacgtgcttaccatgaaagacgatgggacattctatcgcttccaagcgccctacttctggccctcaaactgctgggaacctgagaacaccgactatgccatatacctgtgtaagcgtaccatgcaaaataaggcgagactcgaactcgcagactacgaggctgagaacttggcgcgactgcagagagcattcgcccgcaagtgggagttcatctttatgcaggctgaggctcaggtcaagatcgacagaaaaaaagacaagaccgagaggaaaatactagactcccaggaaagggcgttttgggatgtccaccgcccagtgcccggctgcgtgaatactaccgagatggacataagaaaatgtcggcggctgaagaatccccagaaggttaagaagagtgtgtacggtgttactgaggagagccaggcccaatctcccgtccatgtgctttcacagcccatccgaaaaactaccaaagaagatatacggaagcaaatcacttttcttaacgcccaaatcgatcgacactgcctgaaaatgtcaaaggtcgctgaaagcctgatcgcatacaccgagcagtatgtggaatacgatcctttgatcaccccagccgaaccaagtaatccatggatttccgatgatgtggcactgtgggatatcgagatgagtaaggagccctcgcagcagagagtcaagcgttgggggtttagctttgacgaaatcctgaaagatcaggtggggcgcgatcagttcctcaggttcctcgaaagcgaatttagctctgagaacctgaggttttggttggctgtacaggatctgaaaaagcaaccactccaggacgtggccaagcgcgtggaggagatctggcaagagttcttagcacccggggcaccttctgctattaaccttgattcacacagttacgaaattacgtcccaaaacgttaaagacggcggtcggtacacattcgaagacgcacaagagcatatatacaagctgatgaagtcagattcatatgctcgattcttacggtcaaacgcataccaggaccttctgctggctaaaaagaaaaaagtgagcaaggttgtggagctgccttag

SEQ ID NO: 132099 - DNA, 1356 bp, Artificial Sequence
  Description of Artificial Sequence: Synthetic coding sequence
atggaagatgtgatagccagaatgcaggatgagaagaacggaattcctatcagaactgtgaagagcttcctatccaagatccctagtgtgttctcaggaagtgacatcgtgcagtggctaattaaaaatctcaccatcgaagaccccgtggaggcgttacacctgggtaccctaatggccgcgcacggctacttctttcctattagcgaccacgttctgacactgaaggacgatggaactttctacaggtttcaaaccccctatttctggccttctaactgttgggagcctgaaaatacggactacgcagtctacttatgcaagagaacaatgcagaacaaagcaagactcgagctcgccgactatgaggccgagtccttggcccggctgcagagagccttcgcccgtaagtgggagttcatctttatgcaggcagaggcccaagccaaggtggacaagaagagggacaagattgagcggaaaatccttgactcacaggaaagggcattctgggacgtgcataggcccgtgcccggatgtgtcaacaccaccgaggttgatatcaaaaaaagctcaaggatgcggaacccccataagaccagaaaaagcgtttacggtcttcagaatgacattcgaagccatagcccgacccacacaccgacaccggagaccaaaccacctacagaagacgaactccaacaacagattaaatactggcagatccagctggaccgccataggctcaaaatgtccaaagtggcggatagcttgctgagttacaccgaacagtacctcgagtacgatccatttctgcttccccccgaccccagtaatccatggctgtccgatgacacaacattctgggaactggaagcatccaaggagccgtctcaacagagagttaagaggtgggggttcggtatggacgaagccctgaaggatcctgtcggacgggaacagtttctaaaatttctcgagtcagagttctctagcgagaatctgagattctggttggcagttgaggaccttaaaaagcgtcctatcaaggaggtgccctcccgcgtgcaggagatctggcaggaattcctggcccccggagcccctagcgctatcaacctggattcgaagagctatgacaagaccacccagaacgtaaaagagccgggcagatacactttcgaagacgctcaagagcatatctacaagttaatgaaaagcgacagttatcctcggttcattagatcctccgcatatcaggagctcttacaggcaaagaagaaggggagaaacatccccatcttcccttgccacaagaactgcacaccaacgctgcgtgccagtactaatttactgtag

SEQ ID NO: 132100 - DNA, 1275 bp, Artificial Sequence
  Description of Artificial Sequence: Synthetic coding sequence
atggcacagggtaacaactacggccaaacctcgaacggggttgctgatgagtctcctaatatgctcgtttaccgaaagatggaggatgtgatcgctcgcatgcaggatgagaagaacggcattccaattagaaccgtgaaaagcttcttatcgaaaataccttcagtcttcagcggtagcgacatcgtacagtggctgatcaagaacttaactatcgaggaccctgcagtgtacctctgtaagagaacaatgcagaacaaagcgaggctggagctggcagattatgaagccgagtctttggccaggctccagagggctttcgctcgaaaatgggaatttatcttcatgcaggcggaagcccaggcaaaggtggacaagaagagggacaaaattgagaggaagattctcgactcccaggagcgcgcattctgggacgttcaccgcccagtgcccggctgtgtaaatactaccgaggttgacataaaaaagtcttctcgtatgcggaatcctcacaagacccgcaaatctgtctacggcctgcagaacgacatccgcagccatagtcccactcatactcctactccagagactaagccccccacggaggatgaactacagcaacaaataaagtattggcagatccagctggatcgccaccgcctgaagatgtcaaaggtagctgacagtttactcagctacacagaacagtatctagagtatgacccatttcttctccctccagatccatccaacccttggttgtccgatgacacgaccttttgggaactggaagcaagtaaagagccgtcacaacagagagtgaagcgatgggggttcggcatggacgaggcactgaaagacccagtggggcgggagcagttcctcaaatttttagagtccgagtttagtagcgagaacctgaggttctggcttgcagtggaggaccttaaaaagcgcccaataaaggaggttccatcacgggtgcaggagatctggcaagagttcctggctccgggcgctccatcagctatcaaccttgactccaaaagttatgataagacaacgcagaatgtcaaagaaccgggacggtatacctttgaggacgcacaggagcacatctataaactgatgaaatcagattcttatccccgatttatcaggagtagtgcgtatcaagagttgctccaggctaagaaaaaagggagaaatattcctattttcccttgccataagaattgcactccaaccctgcgcgcttcaactaaccttctctag

SEQ ID NO: 132101 - DNA, 1410 bp, Artificial Sequence
  Description of Artificial Sequence: Synthetic coding sequence
atggcccaggggaataactatggccaaacctccaatggggtggctgatgagtcccccaacatgcttgtgtatagaaagatggaggatgtaatcgcaagaatgcaggacgaaaagaatgggattcctattcgaacagtcaagagctttttgtcaaagatcccctctgtcttctcgggctccgacatcgtgcagtggctgatcaagaatctgaccattgaggatcccgtggaagctttgcacttggggaccttaatggccgcgcatggctattttttccccatctctgatcacgtcttaactctcaaggacgacgggacattctatcgttttcagaccccttacttctggccctcgaactgttgggaacctgaaaatactgattatgcagtctatctgtgcaagagaacaatgcagaataaagcgcggttggagctcgccgactatgaggctgagtcactggctaggctgcaaagggcttttgccagaaagtgggaatttatcttcatgcaggcggaggcccaggcaaaggtcgacaaaaaaagggacaaaattgagcggaagatcttggactcccaggaacgagctttctgggacgtgcaccgcccggttcccggatgcgtaaatacaactgaagtggatatcaaaaagagcagcagaatgagaaatccacataaaactaggaaaagcgtatacggactccagaacgacatcagaagccacagccccactcatacacccaccccagaaacaaagccgccaaccgaggatgagttgcaacagcagattaagtattggcagatacaactagatagacacagactgaagatgagcaaggtggcagatagcctcctgagttacaccgagcagtaccttgaatacgaccccttcttacttccgccagaccctagcaacccctggttgagtgacgatactacgttttgggagctggaagcatctaaggagccctcccagcagcgggtaaaaaggtggggatttggaatggacgaggccctgaaagatcctgtgggcagagagcagttcctgaaattcctagagagcgaattttcctctgagaatctccggttttggctcgccgtggaggatctgaagaagcgacctattaaggaggtgcctagcagagtacaggaaatttggcaggaattcctagctcctggcgccccttccgcaatcaacttagattccaagagctatgacaaaactactcagaatgtgaaagaacccgggcgctatactttcgaggacgcccaggaacatatctataaacttatgaaaagcgattcttatccaagatttattcggtcgtcggcctatcaagaattgttgcaggcgaaaaagaagggcaagagtctcacctccaaaaggctgacctcccttgcccagagctactag

SEQ ID NO: 132102 - DNA, 1434 bp, Artificial Sequence
  Description of Artificial Sequence: Synthetic coding sequence
atggcgcagggaaacaactacgggcagactagcaatggcgtcgcggatgagtcgccaaatatgttggtgtacagaaaaatggaagatgtgattgctaggatgcaggacgaaaagaatgggatccccattcgcaccgtaaagtcatttctctccaagattccctccgtgttctcaggcagcgacattgttcagtggctgatcaaaaatcttacgatcgaggaccccgttgaggccctgcacctgggcacactgatggcggcccacgggtatttctttccaatttcggaccatgtcctgaccttgaaagatgatgggacgttttatcggtttcagaccccttacttttggccgagcaattgttgggaacccgaaaacacggattacgctgtgtatctgtgtaagagaactatgcagaataaggctcggctcgaactcgccgactatgaggccgaatccctggcccgcctgcaaagagctttcgccagaaagtgggagtttatctttatgcaggcggaagcacaagctaaggtggacaaaaaaagagacaagatcgagaggaagatccttgattcccaggagagagccttctgggatgtccatcgccctgttcccggctgcgtgaacactaccgaagttgacattaaaaaatcttcaagaatgaggaatcctcataaaaccagaaaaagcgtttatggccttcaaaatgacattcggagccatagtcctacccataccccgactccggagacaaagccgccaaccgaggatgaactgcagcagcagatcaaatactggcagatccagctggacagacatagactgaaaatgtccaaggttgccgacagtctgttgagctatacggaacagtacctggaatacgaccccttcttgctgccacctgaccctagcaacccgtggctctcagatgatacaacattttgggagctcgaggcatccaaggagccatcacagcagcgggtgaagcgctggggctttggaatggatgaggcactgaaagaccccgtcggtcgcgagcagttcctaaaattcctggagagcgaattctcgtctgaaaacttacgcttttggctagctgtggaagacctgaagaaacgccctattaaagaagtcccaagcagagtgcaagagatctggcaggaattcctggcccctggcgctccctctgccataaaccttgacagcaagagttatgataaaacaacccagaatgtgaaggagccaggaagatatacatttgaagacgcccaagagcatatctacaaattaatgaaaagtgattcctaccctcggttcattcgcagttccgcgtatcaggaactcctgcaagcaaaaaagaaagggagaaacattcccatcttcccttgccataagaactgtactcccacactgcgggccagcaccaacctcctctag

SEQ ID NO: 132103 - DNA, 1410 bp, Artificial Sequence
  Description of Artificial Sequence: Synthetic coding sequence
atggcccagggcaataactacgggcagaccagcaacggggtcgcggacgaatccccaaatatgctggtgtaccgaaagatggaagatgttattgctcggatgcaagacgaaaagaatggaattcccatccgaaccgtaaaaagtttccttagtaagatccccagtgtattttcgggctctgacatagttcagtggctaatcaagaatctcaccattgaggatcctgtggaggccctgcatctgggtacactgatggctgctcacggctacttctttccgatctctgatcatgtactgaccctgaaggacgatggaacattttaccgatttcagacaccctacttctggccctccaattgctgggagcctgaaaatacggactacgctgtgtatctatgtaaaaggaccatgcagaataaggcccggctcgagttggcagattacgaagctgaaagccttgctagactgcagcgtgcttttgcacgcaaatgggagttcatctttatgcaagctgaggcccaagctaaggtcgataaaaagagagataaaattgaaaggaaaatactggattctcaggaacgggccttttgggacgtacacaggccagtgccaggatgtgtgaatacaactgaagtggacattaaaaagagtagtcggatgcgcaaccctcacaagacgaggaagtcggtgtatggtctgcaaaatgatatcaggagccattctcctacacatactccaacaccagaaacaaagccacctactgaagacgaacttcagcaacaaatcaagtattggcagattcagttggatcgtcatagactaaaaatgtccaaggtggcagattcgctactcagctatactgagcagtacctggaatatgatccatttctattgcctccagatccgagtaacccttggctgtctgacgatacaaccttctgggaattggaagcaagtaaggaaccaagccagcagagagtaaagaggtggggcttcgggatggacgaggctttaaaggatcctgtgggaagagaacagtttcttaagtttttagaatctgaatttagctctgaaaatctgcgattttggttggctgtcgaagatctaaagaaacggccgataaaggaggttccctctagggtacaggagatatggcaggaatttcttgcccccggcgccccgtctgcaattaatctggacagcaaaagctatgacaagaccacccagaatgttaaggagcctggccgctacacatttgaggatgcgcaagagcacatctataaactgatgaaatccgatagctaccctaggttcattagaagcagcgcatatcaggaactactgcaagcaaagaaaaagggtaagtccctcacttctaagagacttacgtccttggcccagagctattag

SEQ ID NO: 132104 - DNA, 1464 bp, Artificial Sequence
  Description of Artificial Sequence: Synthetic coding sequence
atggcccaggggaataactatgggcagaccagtaatggcgttgctgacgaatcccctaatatgctggtttaccgaaaaatggaagacgtcatcgcccgtatgcaagatgagaagaacggcatccctatccgcaccgtcaagagtttcctgtcaaaaataccttccgtgttcagcggtagtgatatcgtgcaatggctaattaaaaatcttacgattgaggatccagttgaggcactgcacttggggacattgatggctgcccatgggtattttttccctataagcgaccacgtgctgactctgaaagacgacggtactttttaccggtttcagacaccttatttctggcctagcaactgttgggaacccgagaatactgattatgcagtctacctgtgtaagcgcaccatgcagaacaaggcccggttggaactggccgactatgaagctgaatcactggcacgcttgcagagggccttcgctaggaagtgggaattcatctttatgcaggctgaagcacaggctaaagtcgataaaaagagagacaagattgagagaaaaattttggactctcaagagagagcattctgggatgtccaccgtcccgtccctgggtgcgtgaacacaaccgaagtcgatataaagaagagcagcagaatgcgaaacccacacaaaacacggaagtcagtgtacgggcttcagaatgatatacgatctcactcgccaactcacacgcccacacccgagaccaagcccccaactgaagatgagctgcaacagcagattaagtattggcaaattcagctagataggcatcggctgaaaatgagcaaagttgcggatagcctactgtcatacacggaacaatatcttgagtatgatccattcctgttacctcctgacccatccaacccctggctgtctgacgacactactttctgggagctggaagcatctaaggaaccttcacagcagcgagtgaagcgctggggatttgggatggatgaggcacttaaagatccagttggcagggaacagttcctgaaattccttgagtcagaattctctagtgaaaatctgcggttttggctggcagtagaggatctgaaaaagagacccataaaggaagtgccatccagggtgcaggaaatctggcaggagttcctggcccccggagccccaagtgccattaatctcgacagcaagtcctatgataaaacaactcagaacgtcaaagaaccgggcaggtacacctttgaggacgctcaagagcatatctataagcttatgaagagtgactcctacccgagattcatccgcagctccgcataccaagagctgctgcaagccaaaaaaaagagcggaaacagtatggacagacgcactagtttcgaaaaattcgcacagaacgtgggaaaatcacttactagtaagcgactgacaagtttggcccagtcctactag

SEQ ID NO: 132105 - DNA, 1275 bp, Artificial Sequence
  Description of Artificial Sequence: Synthetic coding sequence
atggctcagggcaataattacggccagacatccaatggtgttgctgacgaatcccccaacatgttggtatatcggaagatggaggacgttattgcacggatgcaggacgaaaagaacggcatccctattaggacagtgaaatcatttttatctaagatcccatccgtgttctcaggtagcgatatagtgcagtggctgattaagaatctgactatcgaagatcccgccgtgtatctatgtaaacggacaatgcagaataaagccagactggaattagccgattacgaggctgagagcttagctcggcttcaacgggcctttgcaaggaaatgggagttcatctttatgcaggccgaagcccaggccaaggtagataaaaagagggataagattgaacggaaaatactcgacagtcaggaacgtgccttttgggacgtgcatagaccagtgcccgggtgcgttaacacaaccgaggttgatataaaaaagagtagccgaatgagaaacccccacaagacccggaagagtgtgtatggtctgcaaaacgatattcggagccattcccccacccacactccaactccagagactaaaccccccactgaggatgaacttcaacaacagattaagtattggcagatccagctggaccgtcacaggctgaagatgagcaaagttgccgacagtctgctgagttatacggagcagtacctggagtatgatccattcctcctccctccagatccctcaaatccgtggctgtccgatgacaccacattctgggagttggaggcaagcaaagagcctagccagcaacgagtaaagagatggggcttcggaatggacgaagccctcaaggatccggtggggcgcgagcaatttctgaaatttttggaaagcgaattctcaagcgagaatctacggttctggctggcagtggaggacctgaagaagaggcccatcaaggaggtcccctctagagtgcaggagatatggcaggagttcctggcgcccggcgccccctccgccattaatttggactcaaaaagctacgataagaccacccagaatgtgaaagagcctggtagatatacatttgaagacgcgcaggagcatatctacaagctaatgaagagtgatagctacccaaggttcatccgcagttctgcttatcaggagctactgcaagcaaagaaaaaggggcgaaacattccaattttcccttgccataagaactgtacccctaccctgagggcctccaccaacctgttgtag

SEQ ID NO: 132106 - DNA, 1488 bp, Artificial Sequence
  Description of Artificial Sequence: Synthetic coding sequence
atggctcagggcaacaactacgggcagacaagcaacggagtcgcggatgagagcccgaatatgctggtttacagaaaaatggaggacgtcatcgccaggatgcaagatgagaagaacggaataccaatccgaactgtgaaaagctttttgtctaaaatcccatccgtgttcagcggatctgacattgtgcagtggctgatcaagaacctaaccatcgaggacccggttgaggccctgcatcttgggaccctcatggccgctcacggttactttttcccgatcagcgaccacgtcctaactctcaaggatgatggaactttttacagatttcagacaccgtatttttggccctccaactgttgggaacccgaaaacaccgattacgcagtatatctatgtaagcgcactatgcaaaacaaggctcgcctcgaactggctgactacgaggcggagtctctggcccgtttacagcgggccttcgccagaaagtgggagtttatttttatgcaggctgaagcgcaggctaaagtggataagaagagggataagattgaaaggaaaattttagactctcaggaaagagcattttgggatgtgcaccgacctgtgccgggctgcgttaataccactgaggtggacataaagaaatccagtagaatgcgcaacccgcacaagactcgcaagagcgtgtatggcctgcagaatgatattcgcagtcattctcccactcacacaccaacgccagagaccaaaccgcctactgaggatgagttgcagcaacagatcaaatattggcagatccagttggacaggcaccgcttgaagatgagtaaggtcgcggacagcttgctttcgtacacggagcagtatttagaatatgacccattcctgttgccacccgacccctcaaacccatggttatctgatgacaccaccttctgggaactggaggccagcaaggaaccttcgcagcagcgggtcaaaaggtggggttttggcatggacgaagccctgaaagaccccgtgggtcgcgagcagttcctcaagtttctagagtccgagttcagcagcgaaaacctgagattttggttagccgtggaagatttaaagaagcggccaatcaaggaggtgccttctagagtccaagaaatttggcaggagtttctagccccaggcgcgccctccgccatcaatctcgatagcaagtcttatgacaagacaactcagaacgtgaaagagcctggacgctacaccttcgaggatgcacaggagcacatctataaactgatgaagagcgactcctatccccgattcattcggtcgagcgcctaccaggagctgctccaggctaaaaaaaagagcgggaattcgatggacagacggacctccttcgagaaattcgcacagaacgttggccgcaacatcccgatcttcccctgccataaaaactgcacaccaacgctgcgagcctccacgaatctgctttag

SEQ ID NO: 132107 - DNA, 981 bp, Artificial Sequence
  Description of Artificial Sequence: Synthetic coding sequence
caggcggaagcacaggctaaagtggataaaaaacgtgataaaatcgagcggaagatacttgattcccaggagcgggccttttgggacgtgcaccgacccgtgccaggctgtgtcaacacaaccgaggtcgatattaaaaagtcctctagaatgcgtaacccacataagacacgtaaaagcgtgtacggtctgcaaaatgacattagatctcactcaccaactcacactcctaccccagagactaagcctcctaccgaggatgaactgcagcaacaaatcaaatactggcagatccagctggaccgccacaggttgaagatgagcaaagtcgctgattcgctgctgtcatacaccgagcaatacttggaatacgatccttttttattaccacccgatccctctaacccttggctctctgacgacactacgttctgggaacttgaggctagtaaggaaccatcacagcagagggtgaaacgttggggatttggcatggacgaggcactgaaagaccccgtggggcgagaacagttccttaagttcttagaatccgagttctcgtcagaaaatctgaggttctggttggctgtcgaggatctcaagaaacgcccgattaaggaagttcctagccgggtacaggaaatctggcaagaattcctagctcccggtgccccatcagcaatcaacttggactctaagagctatgacaagaccacccaaaacgtcaaggaacctggtcgttacacttttgaggacgctcaggaacatatttacaaactcatgaagagtgattcttatcctagatttattagatcttcagcataccaagaactgcttcaggcgaaaaaaaagagcggcaactccatggatcgtcggacctcatttgaaaagttcgctcagaacgtcgggaggaatatccccatcttcccttgtcataaaaattgtaccccaacactgagagcttcaactaatttgttatag

SEQ ID NO: 132108 - DNA, 1182 bp, Artificial Sequence
  Description of Artificial Sequence: Synthetic coding sequence
atggcggcgcacggctatttcttcccaatttccgatcacgtcctgaccctgaaggatgacgggacgttttaccgattccagaccccgtacttctggccatcaaactgttgggaacccgagaacactgattatgcggtgtacctttgcaaacggaccatgcagaacaaggcaaggctcgagctggcggactatgaagccgagtcactcgccaggttgcagcgagctttcgcgagaaaatgggaatttatttttatgcaggcggaagcacaggccaaggtagataaaaaacgggacaagattgaacgcaagattctggacagtcaagagagagccttctgggacgttcacagacctgtgccagggtgcgtgaacactaccgaggtggacataaagaaaagcagtaggatgcgcaacccccacaagacccggaaaagcgtctatgggctgcagaacgatattcgctcgcactcgcctacccatacccccacccctgagaccaagcccccaacagaagacgaacttcagcaacagattaagtactggcagattcagctggaccggcatcgactgaagatgagtaaagtcgccgattcactgctgtcttataccgaacagtacctggagtacgacccttttctgttaccccccgacccaagcaatccctggctcagcgatgacacaacgttctgggaactcgaggccagcaaggaacccagccagcagcgggtgaagcgttggggtttcggcatggatgaagctctgaaggatccagttggacgcgagcagttccttaagttcctggaaagtgagttctcttccgaaaatctgagattttggctggcagtggaggaccttaaaaaacgccctataaaggaggtgccctcacgggtgcaggagatctggcaggaattccttgctccaggtgcaccctccgcgattaacttggattcaaagagttatgacaagactacgcagaatgtgaaagagcccggacgatacacttttgaagacgcccaagagcacatctataaactgatgaagagtgatagttacccccggtttatcagatcatccgcctaccaagaactgttacaggccaagaaaaaaggaagaaatatcccaatatttccctgtcacaaaaactgtaccccgaccttaagagcatcgaccaacctgctctag

SEQ ID NO: 132109 - DNA, 774 bp, Artificial Sequence
  Description of Artificial Sequence: Synthetic coding sequence
atgagcagcgcccccaatggtcggaaaaaacgccccagccgcagcacaagaagtagcatttttcagatctcaaagccgccactccagtcaggggattgggaacggcgagggagcgggagtgagtcggcacataagactcagagagctctggacgactgtaaaatgctcgtgcaggaatttaacacacaggttgcactctatcgcgagttggtgatcagcatcggcgacgtgtctgtaagctgtccttccctgcgggcggaaatgcacaaaacaagaacaaagggttgtgagatggcgagacaggctcaccagaagctagctgcgatctccggacctgaagacggcgagatccatcctgagatttgtcggctctatattcagctccaatgttgtttggaaatgtataccaccgagatgctaaaatcaatctgtctattgggatcgctccaattccacaggaaaggtaaggaaccagggggcggcacgaaatcactggattgtaaaatcgaggaatcagcagagacaccagcactggaggatagttctagcagtcccgtggattcccagcaacacagttggcaagtgagcacagacatcgagaacactgagagagacatgcgggagatgaaaaacctcctatctaaacttagagagacaatgcctctgccgctcaaaaatcaagacgatagttcactgcttaacctgacaccatatccacttgttaggagacgcaagagaagattcttcggactttgttgtttgatttcttcatag

SEQ ID NO: 132110 - DNA, 2025 bp, Artificial Sequence
  Description of Artificial Sequence: Synthetic coding sequence
atgacgattagacaccaaggacaacaatacagacccaggatggctttcctccagaaaattgaagcccttgtcaaggacatgcaaaacccggaaactggagtccggatgcagaatcagcgcgtactggtgacgtctgtgccccatgctatgactggtagtgatgtacttcagtggatcgtgcagcgactgtggatcagctctctggaggctcaaaatcttgggaatttcatcgtccgatacgggtatatctatcctcttcaggatccaaagaacctaattctcaaacccgatgggtccctctaccgcttccagactccttacttctggcctactcagcagtggccagccgaggatacagactacgcgatttatctggctaaacggaatatcaaaaagaagggaattctggaggagtacgaaaaggaaaactataactttctcaaccagaagatgaactataaatgggatttcgtgatcatgcaagctaaagagcagtatagggcaggcaaagagagaaacaaggccgatcgatatgccctggattgtcaggaaaaagcttactggttggtgcatcgatgcccccccggtatggacaacgtgctcgattatggtctcgatcgtgtaaccaaccctaatgaagtgaaagtgaaccagaaacagactgtggtggccgtcaaaaaggaaattatgtactatcagcaggccctcatgaggtcaaccgtaaagtctagcgtgagtttgggaggaatcgttaaatactccgaacagttctcttccaatgacgctattatgtctgggtgtttgccgtctaacccttggatcaccgatgacactcagttttgggacctgaacgccaaattagtggagatcccaactaaaatgcgcgtcgaacgatgggccttcaatttcagtgagctcatccgtgatccaaaaggccgccaatcctttcaatactttctcaaaaaagagttctccggtgagaacttagggttctgggaagcctgcgaagacctaaagtacggagatcagtccaaagtgaaagagaaagcggaagaaatatataagctctttctggctccaggggccaggagatggatcaacattgatgggaaaacaatggatataacagtcaaggggttgaaacatcctcaccgatatgtcctcgacgccgcacagacgcatatctacatgctcatgaaaaaggactcgtatgcccgatacctcaagtcacctatttacaaggacatgctcgcaaaggccattgagccacaggaaacgaccaagaaaagcagtaccctccccttcatgcgccgacacctgagaagctccccctctccggtgattctccgccagcttgaggaagaggccaaggcacgggaagccgcaaatacagtcgacatcacccagcctgggcagcatatggcccctagcccgcatctgactgtgtatactggtacttgtatgccgccgtcaccttcttcgcccttttcttcatcctgccgctcaccgaggaagccattcgcatctccaagtcgtttcataaggcggccgagtaccaccatttgtccctccccaatcagagtcgcccttgagtcttcctcaggtctggagcagaaaggtgagtgctccggtagtatggccccacgaggaccgagcgtgaccgaaagctcggaagccagtctggatacatcatggcccagaagccgaccacgcgcacctccgaaggcccgaatggccctgtcatttagtcgattcctcagaagagggtgcctcgcctctccggtctttgcccgcctctcaccaaagtgcccagctgtgtcccacggtcgagtgcagccgctcggagatgtgggacagcagctgccacgtctgaagtccaagagggtcgcaaatttcttccaaattaaaatggacgttcctactggttctggcacttgcctgatggattctgaagatgccggcactggggagtcaggagacagggcgaccgagaaagaggttatttgtccttgggagagtttatag

SEQ ID NO: 132111 - DNA, 2016 bp, Artificial Sequence
  Description of Artificial Sequence: Synthetic coding sequence
atgaccattcgtcaccagggccagcaatatcgaccaaggatggcgttcctccagaaaatcgaagcactggtaaaggacatgcagaacccggaaaccggcgttcgcatgcagaaccagcgagtgctcgtgacctccgtgcctcacgccatgaccggcagcgatgtgcttcagtggatcgttcaaaggctatggatcagctctctcgaggctcagaaccttggtaatttcatcgtgcgctacggatacatttaccctctccaggaccctaagaatctcattctgaaacccgatggcagcttgtaccgctttcaaacaccctacttctggccgacccaacaatggcccgctgaagacacggattatgccatctacctagctaaacgtaatattaagaagaaagggatcctggaggagtatgaaaaagaaaattacaattttctgaaccagaagatgaactacaaatgggacttcgtgatcatgcaggcaaaggagcagtatcgggcaggcaaagagagaaacaaggccgaccgctatgctctggactgccaagaaaaagcttattggttggtgcacaggtgtcctcccggtatggacaatgtgctggattatggcctggaccgagttactaatcctaatgaagtgaagaaacagaccgtcgttgcggtaaaaaaagagatcatgtattaccagcaggcccttatgcgctccaccgttaagtcctccgtgtcgctcggaggaattgttaagtactctgagcaattctccagcaacgacgccataatgtccggctgtctcccgagcaacccatggatcaccgacgatacacagttctgggatcttaacgccaaactggtcgaaattccaaccaagatgcgcgtcgagaggtgggcgtttaatttcagcgagctcattagagaccccaaggggcgtcagagctttcaatacttcctgaagaaggaattttctggcgagaacctgggattctgggaggcctgtgaagacctgaagtacggcgaccagtctaaggttaaggagaaggccgaagagatatacaagctgtttctggcgccaggcgcgaggcggtggatcaacatcgatggaaaaactatggacataacagtcaagggcctgaagcaccctcataggtatgtgctggacgcagctcagacccacatttacatgcttatgaaaaaagattcatacgcaaggtatctgaagtctccaatctataaagatatgttggcaaaagccattgagccccaggagacaacaaagaaaagcagcacacttcctttcatgcgaaggcacctgcgatcctcaccctctcccgttatactccggcaattggaggaggaagccaaagcgagagaagccgccaatacggtagatataacacagccgggccagcacatggccccctctccacacctgactgtatacaccgggacgtgtatgccccccagcccatcaagcccattcagtagctcttgcagatctcccagaaagccattcgcttcgccaagcaggtttatcagacgcccctctaccaccatctgtccttcacctatcagggtcgcactggaaagtagctccgggctggaacagaaaggcgagtgctcaggctctatggccccgagagggccctcagttacagaaagctcagaggcctccctggacacatcatggccgcggtcccgccctcgcgcacctccaaaggctcggatggcgctgagcttttctcgttttctgcggagagggtgcctagcttcccccgtcttcgcaagactctcacccaaatgccccgccgttagtcatggcagagtgcaacccctgggagacgtcgggcagcagcttcctcgcctgaaatcgaaacgggtggccaattttttccagatcaagatggacgtccctacaggctctgggacttgtttgatggacagcgaagatgccggaactggtgaatccggggatcgggccacagagaaagaggttatttgtccgtgggagtcactctag

SEQ ID NO: 132112 - DNA, 4008 bp, Artificial Sequence
  Description of Artificial Sequence: Synthetic coding sequence
atggaatccgagatgctgcaatcccccttgcttggactaggagaggaggatgaggcagatctcaccgactggaacctgcccctggcttttatgaagaagaggcactgcgagaaaatcgagggcagtaaatcgctggcccagtcttggcggatgaaggacagaatgaagaccgtttcagtcgcactcgtgctctgtctcaatgtcggggtggacccccctgacgtcgttaagactacaccttgtgctcggctggaatgttggatcgatccattgtctatgggaccccaaaaggcactggaaaccataggagccaacctacagaagcagtacgagaattggcagcctcgggctcgttacaagcagagccttgacccaaccgtggacgaagtcaaaaagctctgcacttcacttagacgcaatgccaaggaggaacgcgtgctgtttcactataacggccacggagttcctcgccccacagtgaatggtgaggtttgggtgtttaacaaaaattatacacagtacattcctttgtccatctatgatctgcagacctggatgggatcaccatcgatttttgtgtatgattgctccaacgccggcctgattgtcaaatccttcaagcagtttgcactccagagggagcaagaacttgaagtggcagccataaatcctaatcaccctctagcccagatgcctctacctccttcaatgaagaattgtatccagttggccgcatgcgaagcaactgaactgcttccaatgatccccgatctccctgcagatctattcacttcttgcctaaccacacctatcaagattgccctgaggtggttctgcatgcagaagtgcgtgtcactcgttcccggagtgacattagacttgattgagaaaataccgggcaggttgaatgataggcgaacacctcttggagaacttaattggattttcaccgctattactgacacgatagcttggaacgttctgccccgagacttgtttcagaagctgttcaggcaggatctgcttgtggcttctctctttcggaattttctgctggctgagagaatcatgagaagttataactgtacacctgtgtcatcccctagacttccgccaacatacatgcacgccatgtggcaggcgtgggatctcgcagtcgatatttgtctgagtcaactgccgactattattgaggaagggacagccttccgacattcacctttctttgcggaacagctgacggcctttcaagtctggctgacaatgggcgtggagaatcgcaacccacctgagcagctcccaattgtcctgcaagtgctgttgagccaggtccatcggcttagggctttggacctattgggtcgcttcctggacctcggaccatgggcggtaagtctcgcactgtccgtgggcatcttcccctacgttttgaagttgcttcagagctccgcaagagagctacgcccgctgctggtgttcatttgggctaaaatcttggccgtggacagcagttgccaggccgatctggtcaaagacaatgggcacaagtactttttgtcggtcttagctgacccatacatgccagcagaacaccgcacgatgactgcctttatcctcgccgtgattgtcaactcgtaccataccggacaagaggcatgtcttcaggggaacctgatcgctatttgtttggagcaactgaacgacccacacccactcctgcggcagtgggtagctatctgcctgggccgaatttggcagaactttgacagcgctagatggtgtggcgtgcgagattccgcccatgagaagctgtacagcctcttgtctgaccctatccccgaggtgaggtgcgccgctgtgtttgctctcggaacttttgttgggaacagcgccgaaaggactgatcattccaccactatagaccataatgtcgcgatgatgctggctcaactggtgagcgatggcagcccaatggttcgcaaggaactggtggttgccttaagtcacctcgtagtacaatacgagtctaatttttgcaccgttgccctgcaattcattgaagaggagaagaactacgcactgccgtcccccgcaaccacggagggagggagtctgacacccgtgcgagactctccatgcacccctcgactgaggtctgtgtcctcctacggcaatatccgcgccgtggccactgctcgctccctgaataaatctctccagaacttgagtttgacggaggaatctgggggcgcagtggcgtttagccccgggaacctctctactagctcctctgcatcttccactctgggatccccagagaacgaggagcacattctgagctttgaaactatcgataagatgcgacgcgcctcctcgtactcatctcttaacagtctgataggagtcagcttcaactcagtgtatactcagatttggcgtgttttgctgcatctcgctgccgatccataccctgaggtgagcgatgtggcaatgaaggtgctgaactccatcgcttacaaagcgaccgttaacgctagacctcagcgggtgcttgacacctcatccttaacccagagcgcacccgccagtccaacaaataagggagtgcatattcaccaggccggtggctccccccccgcaagctcgacatcctcatcaagtcttaccaatgatgtggcaaaacagcctgtgtcacgcgatctgcccagtgggagacccggtacaacagggcccgcgggcgctcagtatacacctcacagccaccaattcccacgtacaagaaagatgttcgacaagggcccagaacagaccgctgacgatgcggatgacgccgcaggtcataaatcgtttatcagcgctaccgtgcagacaggcttttgtgactggtctgcgcgttacttcgctcagcccgttatgaaaatccctgaggagcatgatttagagtctcagattcgaaaagaacgcgagtggcggttcctccgcaattcccgagtgcgccgccaagcgcagcaggtgatccagaaaggcatcactcggctggatgatcagatcttccttaacaggaaccctggcgttccatccgtggtgaaattccatcccttcactccatgcattgccgtggctgacaaggactctatttgcttctgggattgggaaaaaggcgaaaagctcgactatttccacaatgggaaccctcgctacacacgcgtcacagctatggagtatttaaacgggcaagactgcagtctgctacttaccgcaacagatgacggagcgattcgagtctggaaaaactttgccgacctcgagaagaaccctgagatggtcaccgcctggcaggggctgtccgatatgctccccactacccggggcgccggtatggtggtggactgggagcaggagactggcctcttaatgagctccggagacgtccgcattgttcgcatttgggatacagatagagagatgaaggtgcaagacatcccgaccggggctgactcgtgcgtcacttctctttcttgtgattcccaccgttccttaatcgttgcgggactcggagacggatccatccgtgtgtacgataggagaatggccctttctgaatgccgagtcatgacttatagagagcataccgcctgggtcgtaaaggcttccctccaaaaaaggcccgatggacacatcgtctcggtgtctgtgaatggagacgttagaatatttgatcccagaatgccagaaagcgtgaatgtgctccaaatcgtgaagggacttacagctcttgacatccacccgcaggccgacctcatcgcttgtgggtcggtgaatcagtttacagccatctacaattcttccggagagctcattaacaatataaaatactatgatggatttatgggtcagcgggttggggccatctcctgtctggcattccacccccactggccccatctggccgtggggagcaatgactactacatttccgtctatagcgtggagaagcgagtgagatag

SEQ ID NO: 132113 - DNA, 990 bp, Artificial Sequence
  Description of Artificial Sequence: Synthetic coding sequence
atgggaagtcctagcatctttgtgtatgactgcagcaatgccggtctcatcgtgaagtcgtttaagcagtttgccctgcagcgggagcaggagctggaagtagccgcaatcaatcccaaccaccccctcgcccagatgcctctccctcctagcatgaaaaattgcattcagctggccgcctgcgaagccacggaactgctgcctatgattcccgacctgcctgcagacctctttacctcgtgtctcactacccccattaaaatcgctctccggtggttttgcatgcagaagtgtgtgtccttagtccctggcgtgaccctggacctaattgagaagattcccggcaggctcaacgatcgcaggacacctctgggtgaactcaattggatcttcacggccattactgatacaatcgcctggaatgtattgccaagagacctcttccagaagcttttccgacaggatctgcttgtggcctcattgttccggaatttcctgttggccgagcgtatcatgagatcgtataattgcacacccgtcagcagtcccagattgccaccgacctacatgcacgcaatgtggcaggcctgggacttggctgttgacatctgcctgagtcagctgccaacaattatcgaggagggcaccgcatttaggcatagtccattctttgctgagcaacttacggcttttcaggtatggctgaccatgggcgtcgaaaatcgtaatccacccgagcagctgcctatcgtgctgcaggtgctcctctcccaggtccatcggctgcgcgccctcgatttattggggcgattccttgatctgggcccatgggccgtcagcctggctctgagtgtcgggattttcccatacgtgctgaagctcctccagagttccgctagagaattgcggcctctcctcgtctttatctgggccaaaatcctggcagtggacagtgtttctattcctgctctgctccccagggtaatgtag

SEQ ID NO: 132114 - DNA, 3534 bp, Artificial Sequence
  Description of Artificial Sequence: Synthetic coding sequence
atggaaagtgaaatgttacagtcaccactcctaggattgggggaggaagacgaagccgacctgaccgactggaacctgcctctcgccttcatgaagaagcgccattgtgaaaagattgagggatctaaaagcttggcccagagttggcgtatgaaggatcggatgaagaccgtgtccgtcgccctggttctgtgcctcaacgtgggcgtcgaccctcctgacgtcgttaaaaccacaccttgcgctcgactcgaatgttggatcgaccctctgagtatgggtcctcagaaagccctagagaccatcggtgctaacttgcaaaagcagtacgagaattggcagccgagagcacgatataagcagtcattggaccctacagtggacgaggtgaaaaagctctgtaccagcttgcgtcgaaatgcaaaagaggagagagtgttgtttcactacaacggtcacggtgtgccaaggcctaccgttaatggagaggtgtgggtgtttaataaaaactacactcaatatatccccttaagtatttatgacctccagacatggatgggcagccctagcatctttgtgtatgactgtagtaacgcggggcttatcgtgaaatccttcaagcagtttgctctccagagagagcaggagctagaagtggctgccatcaaccctaaccaccccttggcccagatgccactccccccatctatgaagaactgcatccagctggcagcctgtgaagctactgaactcttgcccatgatccctgacctccccgctgatctgttcaccagctgcctgacgaccccaatcaagatcgcgttaaggtggttttgtatgcagaaatgtgtttccctcgtacccggggtaactctcgacctgattgaaaaaattcctggtaggctgaacgatcgaagaacacctctgggagaactgaattggatatttaccgcaattacagataccatagcctggaatgttttacctagggacttgtttcagaagctgttccgacaggaccttctcgtggcgagtctatttcgcaacttccttttggcagaacgaataatgcggagctataattgtactccagtctcctcccccaggctcccgccaacatacatgcacgctatgtggcaggcgtgggacctagccgtcgatatctgcttatctcagttgcccactatcatcgaggaaggaaccgctttcaggcactctcccttcttcgctgaacagctcaccgcctttcaagtgtggctgaccatgggcgtggagaatagaaatccaccagagcaactgcctatagtgctccaagtgctgttaagccaggttcacaggctaagggcacttgacctgttgggaagattcctagatcttgggccttgggctgtgagcctcgctctttcagtcggcatctttccatacgtgcttaagcttctccagagcagcgctagggaacttcggcccctccttgtgttcatatgggccaagatcctggctgtcgatagtgagctggtcgtggcgttatcacacctggtggtccagtatgagtcgaacttttgtactgttgcgcttcagttcattgaagaggaaaagaattatgcactccccagccctgccactaccgaaggaggctcccttacacccgtgcgagattcgccttgcaccccccggctgcgaagcgtgtcatcctatgggaatataagagccgtagcaactgcgagatccctgaataagtcactgcagaatctgagcctgacggaggaatcagggggggccgtggcatttagcccaggtaatttgtccaccagttcttccgccagttccacacttggaagccctgaaaacgaggagcatatcctctcgtttgaaactattgacaagatgagacgtgcttcctcttactctagccttaacagcctgattggcgtgtcatttaacagcgtatatacccagatatggcgggtgcttctccatctcgcggctgacccctaccctgaagtgtctgatgtagcgatgaaggtgctcaattctatcgcttacaaggcaaccgtaaacgctagacctcaaagagtcctggacacaagctcactgactcagagcgcccctgcgtcgcccaccaataaaggcgtacatattcatcaggcaggggggagtcctcccgcctcatctactagctcctcttctctgacaaacgatgtagccaagcagccagtttcccgcgatctcccctcgggtcgaccaggtactacaggaccagccggtgcacagtacaccccacactcccaccagttccctcgaaccagaaaaatgttcgataaaggacccgagcaaacggccgacgatgcagatgatgcagcaggacataagtctttcatctctgccacagtccagaccgggttttgcgattggtctgcgcggtatttcgcacagcccgtcatgaagattcccgaggaacacgatctggagtctcaaatacgtaaagaacgggaatggcggtttctgcggaacagccgggtacgtcgccaggcccagcaggttatccagaagggcatcacaaggctcgacgatcaaattttcttaaaccgtaatcccggagtgccctctgtcgttaaatttcatccttttaccccttgtattgcagtagccgacaaggactctatatgcttttgggattgggaaaagggagagaagctagactattttcacaacggtaaccccagatatacccgggtaaccgccatggaatatctgaacggccaggattgttcgctgctcttaactgctacggacgacggtgccatcagagtgtggaagaactttgcggaccttgaaaaaaaccctgagatggtgactgcatggcagggcctatccgacatgctccctacgacgcgtggggctggtatggtggtggactgggagcaggagaccggccttctgatgagttccggggatgtgcgaatcgtgcggatctgggacaccgatagggaaatgaaggttcaggatatccctaccggagctgatagctgcgttacttccctgtcgtgtgatagccaccgctcactgatcgtggcgggcctcggggacgggtctatcagagtttacgaccggagaatggcactcagcgaatgtcgtgtaatgacctatcgagagcacaccgcctgggtggtgaaggcttccctccaaaagagaccggacggtcacatcgtcagtgtctccgtaaacggcgatgtcagaatcttcgatccacgcatgcctgaatccgttaacgtacttcaaatcgtgaaaggcttgaccgccttagatattcatccacaagctgatcttatcgcttgtggctccgtgaaccaatttaccgcaatatacaactcatccggtgaactgatcaataacattaagtactatgacggcttcatgggacagcgcgtgggggccatcagttgtctcgcattccaccctcattggccacatctcgctgtcggttccaatgactattacatctccgtatactctgtcgagaaacgcgtgcgatag

SEQ ID NO: 132115 - DNA, 2097 bp, Artificial Sequence
  Description of Artificial Sequence: Synthetic coding sequence
atgcaaaacagcgaagggggcgccgattcccctgccagcgtggctctgcgcccttcagcagctgctccgcccgtccccgctagcccacaacgggtgctggtgcaggctgcttcatctaatcccaaaggagcccagatgcagccgatatctctccccagggtccagcaggtgccccagcaggtacagcctgtgcagcacgtctacccagcccaggtacagtatgtggaaggtggggacgctgtgtacactaacggcgcaatccgaacagcatacacttataaccccgagccgcaaatgtacgctccctccagcacggctagctacttcgaagctccaggtggcgctcaagtcacagtcgccgcgtcgtctccacccgccgtaccatcccatagcatggttgggatcaccatggatgttggcggtagtcccatcgtgtctagcgccggagcctacctcatacacgggggtatggactcaactcggcactctttggctcacacctctagatcatcaccggcaacacttcagtggctgttagataactacgaaactgccgaaggcgtctccctgcccagatcctccctatataatcactacctgagacattgccaggaacataagctggatccagtcaatgccgccagctttgggaagttgatcagatcagtgttcatgggcctcagaacaagacggcttggaacgcgtgggaattctaagtaccactactacggcatcagacttaagcctgattcccctctgaatcgcctgcaagaagacacgcagtacatggccatgaggcagcagcctatgcatcagaagccaaggtatagacccgctcagaagacagattccctcggggactctgggagccactctgggcttcattcaactccagagcaaactatggcagttcagtcacagcatcaccaacagtatattgacgtcagccacgtcttcccggagtttcctgctcctgatctcgggagttttctacttcaggatggcgtgactctccacgacgtgaaggcactgcagttggtgtatcgccgtcactgtgaggcaaccgtcgatgtggtcatgaacctgcaattccactatattgaaaagctgtggctgagcttctggaattcaaaagcctccagcagtgacgggcccaccagcctccctgcttctgacgaagatccagaaggagcagtcctccccaaggacaaactaatctccctgtgtcagtgcgacccaattctgaggtggatgagatcatgcgaccacatcttataccaagctttggtggagattctgatcccagatgtcctgaggccggtcccgtctactcttacccaagccattaggaattttgcaaagtcgctggaaggatggctgaccaacgctatgagcgattttcctcaacaagttatccagacaaaggtgggcgtggtatctgccttcgcccagactttacggcggtacacttccttaaatcacctcgcccaagctgccagggcggtcctgcagaatacctcccaaattaaccagatgctctctgacctcaaccgtgtggacttcgcaaacgtccaagaacaggcttcctgggtctgccagtgtgaagaaagcgtggtgcagcggctcgaacaggatttcaagctaacactgcagcagcaatccagcctagaccaatgggcctcgtggctggactctgtggttacacaggtgctgaagcagcatgctgggagtccttcttttccaaaggcagcacggcaatttttgttgaagtggtcattttatagcagtatggttatccgtgacctgacactgaggagtgccgctagtttcggatcatttcatcttatcagactgttgtatgacgagtacatgttttatctggtagagcaccgggtggctgaagccaccggtgagacaccgatcgccgttatgggtgaattcaatgacctcgcatctctcagcctgactttactagataaggacgacatgggtgatgagcagcgaggctcagaagccggacccgacgcccggagccttggggaaccgttggtgaagagagagagatccgacccaaaccactccctgcagggcatctag

SEQ ID NO: 132116 - DNA, 2940 bp, Artificial Sequence
  Description of Artificial Sequence: Synthetic coding sequence
atggctacacaggcctacaccgaacttcaggctgctcccccaccttctcagccacctcaagctccaccccaggcgcagccccaaccaccccccccgcctccccctgccgcgccacagccccctcagcctccaactgctgccgctactccgcagccacaatacgtgactgagctgcagtctccccagccacaagctcagccgcccggggggcagaaacaatatgtgaccgagctgccagctgtccccgccccttcccagcccactggcgcacctacaccttcccccgctcctcagcagtacatcgtcgttacggtttcagaaggtgccatgagggcttctgagaccgtgagcgaggcaagccctggcagcaccgcttcccagacaggggtgcctacacaggtggtccaacaagtgcaggggacgcagcagaggctgctggtccagaccagtgttcaggctaaaccaggacacgtctccccactccagctgacgaatatccaggtgccacaacaggcccttcctacacagcgcctcgttgtccagtccgccgcccccggatccaaaggaggacaggtctccctgacggtgcacggcacacagcaggtccactctcccccggaacagtcccctgtgcaagctaattcttcttcttctaagactgccggcgctccaaccggcacggtgcctcagcagcttcaggtgcacggcgtccagcagtccgtgccagtgactcaggaacgctcggtggttcaggctacccctcaagcacctaagcccgggcccgtacagcctctgaccgtacaaggcttgcagcccgtccatgtggcccaggaagtccagcaactgcagcaagtgccagttccccacgtgtatagcagtcaggtgcagtatgtggagggtggtgatgctagttataccgcttccgccatacgatcttcaacatactcttatcctgaaacacccctgtatacacagacagccagtacatcgtactacgaggccgctggaactgccacccaggtgagtacccccgccaccagccaagccgttgcaagctctggcagtatgcccatgtacgtgtccggcagccaggtggtcgcgagctctacaagtacaggggctggcgcatctaactccagtggcggtggtggcagcggcggaggcgggggtggcggaggcgggggcggtggagggggctctggctctacgggcggcggtgggtccggtgctggcacatatgtaatccaaggaggttacatgttgggctccgctagccagtcttattcacatactacaagagccagtcccgccaccgtacaatggctgctggacaactatgagacagccgagggcgtcagtctccctcgttcaactctctattgccactatctgctgcactgccaggaacagaagttagagcctgtgaatgcagctagctttgggaaactgatccgatccgttttcatggggcttaggacacgcaggttggggacaaggggcaacagtaaataccattactacgggctgcggatcaaggcctcttccccactgttgcgactcatggaggatcagcagcacatggccatgcgtgggcagccattctcacagaagcaaagactcaaacccatacagaagatggagggcatgaccaatggggtggcagttggtcaacagccctcgaccggcttgtcagacatcagcgcccaagtccagcagtaccagcaatttctggacgcttctcggtcactccccgactttaccgagctggatcttcaaggaaaggtcttgccagaaggtgttgggccgggtgatatcaaagcatttcaggttctgtaccgggaacattgcgaggccattgtggacgtgatggtcaatcttcagtttaccctggtagaaaccctatggaaaactttctggcgatacaacctatctcaaccgtctgaggccccccccctcgcagtgcatgatgaagccgagaagcgcttgccaaaagccatcctggttctgcttagcaaattcgagcccgttctgcagtggaccaagcactgcgacaatgttctctaccaaggtcttgtggagatcctgatccctgacgtcctgcgccccatcccctctgccctcacccaggccattcgcaatttcgcaaaatccttagagagctggcttacccatgccatggtgaacattcccgaggagatgctgcgcgtgaaggtcgctgccgccggagcttttgcacagaccctgagacgctacacttcactcaatcaccttgcacaggcagcccgcgctgttttgcagaatactgctcagatcaatcagatgttgtccgatcttaacagggtagacttcgccaacgtccaggagcaggcttcttgggtgtgcagatgtgaggaccgtgtcgtgcagcgcttagagcaggattttaaagtaaccctccagcagcagaacagtctggagcagtgggcggcttggttggatggagttgtatctcaggtgctgaagccctatcagggcagcgctggcttccccaaggccgcaaaattgttccttcttaagtggtcattttacagttccatggtgatacgggatctgacactgcgctctgcagcctcctttgggtcctttcatctaattcgtctcctctacgatgaatatatgtattacctgatcgagcatagggtcgcacaggccaaaggcgagactcccatcgctgtcatgggcgagtttgctaatctcgcaacgagtctcaaccctcttgatcctgacaaggacgaggaagaggaggaggaagaagaatctgaagatgagctcccacaagatatatctctggctgccgggggagaatctccggcgttggggcctgagaccctggagcccccggcgaaactggcgcggacggacgctcgagggctcttcgttcaggccttgccttcttcctag

SEQ ID NO: 132117 - DNA, 2172 bp, Artificial Sequence
  Description of Artificial Sequence: Synthetic coding sequence
atgcagaattctgaagggggagcagactcccccgcatctgtggccctgaggccgtcagccgcagctccacccgtccctgctagtccacagcgtgttctcgtccaggcagcctcctctaatcccaagggagcccagatgcaacccatctctctgcctcgggtgcagcaagttccacagcaggtacagcccgttcagcacgtctacccggcacaggtccagtatgtggaggggggagatgccgtctacactaacggagctataaggaccgcctacacctacaaccccgaacctcagatgtacgcaccatcctccaccgcaagctatttcgaggccccaggtggagcacaggttaccgtggcagcctcctctccacccgctgttccaagccactctatggtcgggataacaatggatgtcggcggatctcccattgtttcctcagccggggcatacctcatacacggtgggatggattccaccaggcactcccttgcacacacgagcaggtcgtctcccgccactttggagatggccatcgagaacctccagaagtccgaaggcatcacaagtcataagagcggtcttttgaactcgcatctgcagtggctcctggacaactacgagacggccgagggtgtttcattgcctagatcatcactgtataatcattatctgagacattgtcaggagcataaactggatccggtgaacgccgcttcctttggtaagctcattcgatccgtgttcatggggctgcgaactcggagactgggaacacgcggaaactcaaagtatcattattacgggatcagactgaagccggactcccccctgaataggcttcaggaagacacccagtatatggcgatgagacagcagcccatgcaccagaaacccagataccgccctgcccagaaaactgattcacttggtgattcggggagccattccgggctgcactccacccctgagcagaccatggccgtgcagagccagcatcatcagcagtacatcgatgtctcacatgtttttcctgagttcccagcccccgacctcggatctttcctcttgcaagatggtgtcaccctccatgacgtgaaagcactccaattagtgtaccgcaggcactgtgaagccacagtggatgtggtgatgaacctgcagttccactacatcgagaaactttggctcagcttttggaattctaaggccagctcatcagatggtccgacatccctgccagcaagtgacgaggatcctgagggcgccgtattgccgaaggacaaactgatttcattatgtcagtgtgaccccatcttaaggtggatgcgttcctgcgaccatatcctgtatcaagcactggtcgagattctgatacctgacgtgctgcgccccgtgccgtcaaccctgacacaggcaataaggaatttcgctaagtccctggaagggtggttgaccaacgccatgtctgatttccctcagcaagtgattcagactaaagtgggcgtcgtatccgcttttgcccagaccctccggaggtatacatcactgaatcacctggcacaggcagctagagccgtgctgcagaacacttcacagatcaaccagatgctatccgatttaaacagggtggacttcgccaatgtgcaggagcaagctagctgggtatgccagtgcgaagaaagtgttgtccagaggctcgaacaggactttaagctgaccctgcagcagcagtcctcccttgatcagtgggcttcatggttagactccgtggtgacccaagtgctgaagcagcacgccggctctcccagtttccccaaagccgcccggcaatttctgctcaagtggagtttctattcttccatggtgattagagacctgaccctccgctccgctgcaagcttcggctcctttcatctcatccgccttctgtatgacgagtacatgttttacctggtcgaacaccgcgtcgccgaagccactggagagactccaattgccgtaatgggagagttcaatgacctcgcatccctcagtcttacccttctggacaaggatgacatgggggatgaacagagagggtcagaggccggaccagacgctcgctcgctgggggaacctctggttaagcgcgagaggtctgatcccaatcatagcctccagggcatctag

SEQ ID NO: 132118 - DNA, 2097 bp, Artificial Sequence
  Description of Artificial Sequence: Synthetic coding sequence
atgcagaactccgaaggtggggccgactctcccgcctccgtcgcccttcgaccttccgccgctgcgccccccgtccctgccagcccgcaaagagtccttgtccaggccgcctcaagtaaccctaagggggcccaaatgcaaccaatctctctccccagggtgcagcaagtgccgcagcaggtccagccagtgcaacatgtttatcccgctcaagtacaatatgtggaggggggagatgccgtgtacaccaacggggccatccggaccgcatacacatacaacccagagccacaaatgtacgctccctcctccaccgcctcttactttgaggcaccgggaggagctcaagtcaccgtagccgcctcctccccccctgccgtaccctcccattccatggttggcataacaatggacgtcggcggctcccccatagtatcttcagcaggagcatatctgatccatggaggaatggactcaacacggcactccctggctcacacctcacgcagtagcccagcaactttgcaatggctcttggataactatgagactgccgagggcgtgagcctgccacgcagcagcctttacaatcactacctgagacactgccaggaacataaacttgaccctgtgaatgcagcaagcttcggaaaattgatcaggagtgtgtttatgggactcaggaccagaaggcttggcacacgcgggaactctaagtaccactattatggaatacggttgaagcctgatagcccattgaaccgtctgcaggaggacacacagtacatggcgatgcgccagcagccaatgcaccagaagccccggtatcggcccgctcagaaaacggactctcttggggactccggatcacatagcggactccattcgacaccagagcagaccatggctgtccagagtcagcaccatcagcagtatatagacgtgtcccacgtgttcccggagttccccgcgcccgatttgggatcgttcctgctccaggacggggtcacgctgcacgatgtgaaggctctgcagcttgtttataggagacactgtgaagccacagtagacgttgtcatgaatctccagttccattatatcgagaaactttggttgtccttttggaattctaaggcaagcagctctgatgggcccacttcgctcccggcctccgatgaggaccccgagggtgctgtgctgccaaaagacaaactgatctcactttgccagtgcgacccgatcctacggtggatgcgatcttgtgatcatattctgtatcaggccttggtggaaatcctgattcccgacgtactgaggcccgtgccttccactctcactcaggccattcgcaacttcgccaaatcattggaagggtggctcaccaatgctatgagcgacttcccccagcaggtgattcagacaaaggttggtgtggtgtctgcttttgctcagaccctgcgccgttatactagtcttaaccacttggctcaagcagctagggccgtgctccagaatacctcacagattaaccagatgctatcagatctgaaccgcgtagatttcgcaaatgtacaggagcaagcttcctgggtttgccagtgcgaagagagtgtggttcagcggctggagcaggactttaagctgaccctccagcaacagtcgtcccttgaccaatgggcctcatggcttgactccgttgtgactcaggtgctgaagcaacatgccggcagtccatccttccccaaggctgctcgacaatttctgctgaagtggtctttttacagtagtatggttatccgggatttaaccctgagaagtgccgcttcttttgggtctttccacctgatccgcctgctgtatgacgaatacatgttctatttagtggagcacagggtggccgaggcaacaggagagacccccatcgctgtgatgggcgaatttaacgatctcgcttctctttctctgactctgttggataaagatgatatgggagacgagcaacgcggaagcgaagctggcccagatgctagatcactcggtgagccattagtgaagagggagagatctgaccctaatcacagtctccaggggatttag

SEQ ID NO: 132119 - DNA, 1851 bp, Artificial Sequence
  Description of Artificial Sequence: Synthetic coding sequence
atggccgaggacgaaccagacgcaaagagcccaaagacaggtggaagagcacccccaggcggcgcggaggcgggggaacctacaacactactccagagactgcggggcaccatctccaaagctgtgcaaaacaaggtagaaggaattctgcaggatgtccagaaattctccgataacgacaagttatacttatatctacaacttcctagtgggcccaccacaggagataagagttctgagccaagtacactgtcgaacgaggaatacatgtacgcctacaggtggatcagaaaccatttggaggaacacacggatacttgtctgcccaagcagtctgtctatgatgcgtaccgcaaatattgtgaaagcctcgcctgttgtcgacctctgtcaacagcaaattttggaaagatcattcgtgagatcttccctgacatcaaggcacgccgccttggaggacggggtcagtccaagtactgctactccggtattagacgtaaaaccttggtctccatgccacctctgcccggcctggaccttaaggggagtgagagcccagagatgggaccggaggtcacacctgccccacgcgatgagcttgttgaggccgcatgcgcccttacctgtgactgggctgaacgaattcttaagagatctttctcttccatcgtggaagttgcgaggtttctgctgcaacagcacttgataagcgcccggtcagcccacgcacatgttctgaaagccatgggcctggccgaagaggacgaacacgctccacgcgagcggagtagcaagcctaagaatgggctagagaatcctgagggcggagcacataaaaagccagagaggttggcccaaccccctaaggacttggaagccaggactggggccggccctctagctaggggggaacgcaagaagagtgtagtagagtcaagcgcgcccggcgcgaacaacttgcaggtgaacgcattggtcgcacgactgcctctgcttctgccacgggccccccgatcattgatcccacctattcctgtcagcccccccatcctggcacccaggctgagctctggcgcattgaaggtggccacccttccactctcgagccgggctggtgccccccccgctgccgtaccaatcattaatatgatccttcccactgtaccagcccttccaggcccaggacctgggcctgggcgggctcctccaggcgggctgacacagccacgaggaaccgaaaacagagaagtcggcatcgggggcgaccagggtccacacgacaagggtgtgaagaggactgctgaggtgccagtgtctgaggccagcggtcaagctccccctgcgaaggccgcaaaacaggacattgaggacacagcttctgatgccaagagaaagcggggcagacctcggaagaaatctggcgggtccggagaaaggaacagcaccccactgaagtccgcagcggcaatggagtctgcacaaagctcccgactgccgtgggaaacttgggggtccgggggggaggggaattcagcaggcggcgccgagaggcccggccccatgggagaagccgagaaaggcgcagtcctcgcgcaaggtcagggggatggtaccgtgtcaaaggggggtcgaggacccggatctcaacatacgaaagaagccgaggataaaattccattagtgcccagcaaggtcagtgttataaagggtagcaggtcccagaaagaggcattcccattagcgaagggtgaagtggacaccgcccctcagggtaataaggatctgaaggagcatgtcctgcagtcttctttgtcccaggaacataaggatccgaaagctaccccaccatag

SEQ ID NO: 132120 - DNA, 1851 bp, Artificial Sequence
  Description of Artificial Sequence: Synthetic coding sequence
atggcggaggacgagcctgacgccaagtcacctaagacaggtggtcgggctcctccaggaggagctgaggccggagagcccaccacacttttacaacgcttgcgaggaacaatcagtaaggcggttcagaataaggtggaaggcatcctgcaggatgtgcaaaagtttagtgacaacgataagttatacctgtacctgcaacttccctcaggacccactaccggcgataagagctctgagccgtcgacgctgagcaacgaggaatacatgtacgcctataggtggatccgcaatcatcttgaagagcataccgatacatgtcttccaaagcagtctgtgtatgacgcctacagaaagtattgtgaatccttggcttgttgtcggcccctgtccacagcaaacttcggaaaaatcatacgggaaatctttccagacattaaagctagacgactgggaggacgtgggcaaagcaagtattgctatagtgggataaggaggaaaacactcgtgtccatgccaccgctgccaggccttgatttgaaagggtcagagtctccagagatgggccccgaggtgactccagcaccacgcgatgaattggttgaggctgcttgcgcattaacctgcgattgggcagagagaattctgaagcggtcatttagctctattgttgaagtggcaagatttttactgcaacagcacctgatcagcgctcgcagtgctcacgcccacgtactcaaggccatggggctggctgaggaagacgaacacgctccgcgcgagcgctcgtccaagcccaaaaatggactggagaatcctgaaggcggcgcacacaagaagccagagagactggcccagcccccaaaagatctcgaggcaagaaccggcgcgggccctttggctcggggagagcgcaaaaaaagcgttgtcgaatcatcagcccctggggcaaacaatttgcaagtaaatgcactggttgcaagactgcccctgctactcccaagggctcccagatctctcattccgccaattcccgtctcgccacccatcctcgccccccggctgtcaagcggagccctgaaggttgcaaccctgccccttagcagtagggctggggcccctcccgctgctgtccctataatcaacatgattcttcccactgtgcccgccttgcctgggccgggccccgggcccggcagggctccccctgggggcctcacgcaacctcgaggcacagaaaaccgggaggtgggtattggcggtgatcagggcccgcacgacaagggagttaagcggactgccgaagtacccgtgtcagaggcttcaggacaagctccaccagccaaagccgccaagcaagatattgaggatacagcatcagatgccaagagaaaaagaggcaggcccagaaagaaaagcggagggtcaggagaaagaaattccactcctctgaagtctgcggcagccatggaatcagcacagtcctctcggctgccgtgggaaacctggggaagtggtggcgagggaaactctgcggggggcgccgagagacctggccccatgggagaggccgagaagggcgcagtactcgcccagggtcaaggggatgggacagtgtctaaggggggacgcgggcctggatcccagcacaccaaggaggccgaggataagatacccctggtgccctccaaggtgagtgtcattaagggcagccgcagccagaaagaggcctttcctctggccaaaggcgaggtagacaccgccccgcaggggaacaaagatctgaaagagcacgtattacaaagtagcctgtcccaggagcacaaggaccccaaggcgacacctccatag

SEQ ID NO: 132121 - DNA, 1791 bp, Artificial Sequence
  Description of Artificial Sequence: Synthetic coding sequence
atggccgaagatgagccagatgccaaaagtccaaagaccggagggagagcgccacccggcggggccgaggcaggcgaaccaacgactcttcttcaacggttgcgaggcaccatcagcaaagccgttcagaacaaagtggaagggatccttcaggatgtgcagaagttttctgataacgacaagctgtacctgtatctccagttgccctcaggacctactactggcgataagtcctccgagccaagcaccctttccaatgaggagtacatgtatgcctatagatggattcgcaatcacctcgaggagcatactgatacctgtctgccgaagcagtcggtgtatgacgcttatagaaaatactgcgagtcactggcgtgctgccgtccactgagcactgctaattttggaaagatcattcgggaaatatttcccgatatcaaggctcgaagattgggaggaaggggccaaagcaagtactgttattccggaattcgtagaaaaacacttgtttccatgcctcccctcccaggcttggaccttaaaggcagtgagtcaccagagatggggccagaagttaccccagccccccgagacgagctggtggaggcggcctgtgcgctaacatgtgattgggccgaacgcatcctgaaacgcagcttttctagtatcgttgaggtcgcccggtttctgctgcaacagcacctgatttctgcaaggagtgctcacgcgcacgttctgaaggccatgggtcttgctgaggaggatgaacacgccccccgagagagatcttcaaaaccaaaaaatggcctggagaatcctgaaggcggggcccataagaagcccgaacgcctggcgcagccaccaaaagacctcgaggcccgtactggggcaggaccgctggcgcgcggcgagagaaagaaatctgttgtggagagtagtgcccctggcgcaaataatctacaggtgaatgcactcgtggctcgcctccccttgctcctgcctagggctccccgctcactgattccacccattcccgtgtcacctcccatactagccccccgacttagcagtggcgctctgaaagtggccacactgcccctgagcagcagagccggggcacccccggccgctgtgccaattatcaatatgatcctccctactgtccccgcacttccagggcccggcccagggcctggcagagctccccccggagggctgacccaaccaaggggcaccgagaaccgcgaggtaggcataggaggtgaccaggggcctcacgacaaaggggtcaaacggactgcagaagttccggtgtcagaggcatctggacaagccccccctgctaaagcagctaagcaggatatcgaggacacagccagtgacgcaaaacgtaagcggggacgacctcgtaaaaagagcggcggaagtggggaaagaaactctactcccctgaaaagtgctgcggccatggaaagtgcccagtcctcacggctgccatgggagacctggggttcaggaggagagggtaacagcgcagggggcgctgagagaccagggcccatgggtgaggccgagaaaggagcagtcttagcccaggggcagggcgatggcacagtgagtaaagggggtagggggccaggttcccagcatacaaaggaggccgaagacaagattcccctggtacctagtaaagtcagcgtgattaaagggtcacgatcccagaaagaggcctttcccttggcaaaaggggaagtggatacagccccccagggaaacaaagacttgaagtag

SEQ ID NO: 132122 - DNA, 357 bp, Artificial Sequence
  Description of Artificial Sequence: Synthetic coding sequence
atggctgaggacgaaccagatgccaagtcccccaagaccggcggacgagcgcctcctggaggcgccgaggctggagaaccaaccactctgctgcagagattgcggggtaccatctctaaggcagtgcaaaacaaagttgagggcatactccaggacgtgcagaagttctccgataacgacaagctgtatttatatctgcagctccccagcgggcctaccaccggcgacaagagctcagagcctagtaccttgtcaaacgaggagtatatgtacgcctaccggtggattagaaaccacctcgaagaacacaccgatacgtgccttcctaaacaatcagtgtatgacgcctaccgatag

SEQ ID NO: 132123 - DNA, 693 bp, Artificial Sequence
  Description of Artificial Sequence: Synthetic coding sequence
atggcggaggatgagcccgatgctaaatcacctaaaacaggggggcgcgcaccacctggtggcgctgaggccggtgaaccaaccaccctgctccagagacttagaggaaccataagcaaggcggttcagaataaggtcgaggggattctgcaggacgtccagaagttcagtgataatgataagctgtatttgtacctacagcttccatccggccctacaactggcgacaaaagcagtgaaccgtcgactctttccaacgaggagtacatgtatgcatataggtggattcggaatcacctggaagaacataccgatacttgtctgccaaagcagtctgtgtatgacgcttacaggaagtattgtgaaagcctagcctgctgccgacccctgagcacggccaattttgggaaaattataagggaaatattccctgacatcaaggcccggcgcttaggtggcagaggacagtctaagtactgctactccggcataagacggaaaactctcgtctcaatgcctcctttaccgggcctcgacctaaaaggcagcgaatcccccgagatgggacccgaagtcactccagctcctcgcgacgaactcgtggaggctgcctgcgcgcttacgtgtgactgggcagagcgaattttgaagaggtcattttcctctatcgttgaggttgcccgattcctctag

SEQ ID NO: 132124 - DNA, 372 bp, Artificial Sequence
  Description of Artificial Sequence: Synthetic coding sequence
atggcggaagacgaacctgatgcaaagtcccctaaaacgggcggtcgggctccccccggaggggccgaggcgggggagcctaccactcttctccagcgcctccggggcacaatttctaaagccgtacaaaataaggtcgagggcattctgcaggatgttcagaaatttagcgacaatgacaagctgtacttgtatctacagcttcccagcggccccacaactggggataagagttcggaacccagcacgctgtcaaacgaagaatacatgtacgcttacagatggatccggaatcatttggaagagcacacagacacatgtctgccaaagcagtctgtatatgatgcatatcgcaagtattgcgagagctag

SEQ ID NO: 132125 - DNA, 291 bp, Artificial Sequence
  Description of Artificial Sequence: Synthetic coding sequence
atggctgaagatgagcccgacgctaagtcaccaaaaactggcggccgcgcgccccctggcggcgccgaggccggagaacccaccaccctgcttcaacgcttgcggggaactatttctaaagcagtacagaataaggtggagggaatactgcaggatgtgcagaagttctctgataacgataaactttacttgtacctgcagctgccgtctggaccgactactggagacaaaagttcggagcctagcaccctgtctaatgaggagtacatgtacgcctacaggtggatttag

SEQ ID NO: 132126 - DNA, 321 bp, Artificial Sequence
  Description of Artificial Sequence: Synthetic coding sequence
atggccgaggacgaacctgatgccaagtcacctaaaacaggcggccgcgccccaccagggggcgcagaggctggcgagccaactactctcctgcagcgtctccgaggcacaatctccaaagccgtgcagaataaggtggagggaatcttacaggacgttcagaaattcagcgacaacgacaagttatacttgtacctccagctgccctccgggccgacaacaggcgacaagagcagcgaaccttccactctgtccaacgaagaatatatgtacgcgtacaggtggatcaggaaccacctggaggaacacacagacacctag

SEQ ID NO: 132127 - DNA, 555 bp, Artificial Sequence
  Description of Artificial Sequence: Synthetic coding sequence
atggccgaggatgaacccgatgctaaatcccccaaaactggcggtagagccccacccgggggcgcggaagccggcgagcctacaactctgttgcaacgcctgcgggggacaatttccaaagctgtccagaacaaagtagaggggatcctgcaggatgttcaaaagttcagcgacaatgataaactctacctgtacctgcagctgcctagtggacccactaccggcgataaatcttccgagccctccactctgtcaaacgaggaatacatgtacgcttatcggtggatcaggaatcatttggaagagcacactgacacctgcctgccaaagcagtccgtatacgacgcttatcggaagtactgtgagagtcttgcctgctgtaggcccctgtcgactgcgaacttcgggaagatcatccgggaaatatttccagacatcaaggctaggcgtctcggtggaaggggtcagtcgaagtactgttattccggtatccgccgtaaaacactggtctccatgcctcccctgcccggccttgatttgaagggtagcgagtag

SEQ ID NO: 132128 - DNA, 1731 bp, Artificial Sequence
  Description of Artificial Sequence: Synthetic coding sequence
atggccgaagacgagcccgacgccaagagccctaaaactgggggcagagccccacccggaggcgcagaagcaggtgagcccacaactcttctgcagagattacggggcacgatcagtaaagctgttcagaataaggtggagggaatactccaggacgttcagaaattttccgacaacgacaaactgtacctgtatcttcagttaccctccggcccaacaacaggggataagagaaaatattgtgagtcactcgcatgctgccgacccctgagcacagcgaacttcggcaagattatcagggaaatctttcctgacatcaaggctaggaggctgggcgggcggggtcagtcaaaatactgctattccggaatcaggcgaaaaaccttggtaagcatgccccctcttccaggcctggatctaaaagggtcagagtctcccgaaatgggccccgaagtgactccggcaccccgggacgaactggttgaggcagcatgtgctttaacatgtgactgggctgaacgcatactgaaacgatccttctccagtattgtcgaagtagcccgattcctccttcagcagcatctgatatccgcaagatccgcgcacgctcacgtgcttaaggcgatgggcctggctgaggaggatgagcatgccccgcgggagcgctcctctaaacccaagaatgggctggagaaccccgagggcggagctcacaagaaacctgagaggctggctcagcccccaaaggatctggaggctagaactggcgcgggccctctggccagaggcgagcgcaaaaaatccgtggtagagtcaagtgcacccggcgctaataaccttcaagtgaacgctctggtggcccggctgccccttcttctcccccgcgctcctcgatccttgattcccccgatacccgtcagtccacctattctagcgccgcgcctgtcctcaggtgctttgaaagtggccacacttccgctgtctagcagggccggggccccaccagctgctgttcccatcatcaacatgattctgcctaccgtgcccgccctcccggggccgggtcccggcccaggacgggctccacccggcggcctcactcagcccagggggacggaaaatagagaggtcggaatcggcggtgatcaggggcctcacgacaaaggagtcaagagaacggctgaggttccagtcagcgaggctagcggccaggcccccccagctaaggcagctaagcaggacatcgaggacacagcctcagacgcaaagagaaagagaggcaggccccgtaaaaaatccgggggctctggcgagagaaatagtacacctttgaagtctgccgccgccatggagagtgcccagagcagcaggctcccctgggaaacgtggggcagcggaggtgaggggaattccgccgggggcgctgaaaggccggggcctatgggcgaggcggagaagggagccgtgctcgcccaaggccagggcgatgggaccgtctctaaagggggccgaggccctggttcccagcataccaaagaagctgaagacaaaatccccctggtgccatcaaaagtgtctgttatcaagggaagtcggagtcagaaggaagcttttcctctcgctaaaggggaggtggataccgcaccgcagggcaataaagatctcaaggagcatgtgctacaaagctctttaagccaggaacataaggacccaaaagcaacacctccatag

SEQ ID NO: 132129 - DNA, 1851 bp, Artificial Sequence
  Description of Artificial Sequence: Synthetic coding sequence
atggccgaggatgagccagatgcaaagagcccaaaaactgggggccgcgctcctccgggcggcgctgaggcaggagaaccaacaactctgctgcaacgcttgcgtggaacgatttccaaggccgtccagaataaagtggagggaattctccaggacgtccagaagttcagtgataatgataaactttacctgtatcttcagcttccatccggaccgactacgggcgataagtcgtccgagcccagcaccctcagcaatgaggaatacatgtacgcttaccgatggatccggaatcacctcgaggagcataccgacacgtgtcttccaaagcaatccgtttatgacgcttatagaaagtattgcgagtctttggcctgctgcagacctctatccacagccaacttcgggaaaattatccgcgaaatcttccctgacattaaagctcgccggctcggcggcaggggacagagtaagtattgctacagcggaattcgcagaaagacattagtgtcaatgcccccactgcccggactcgacctcaagggctccgagagccctgagatgggcccagaagttacccctgcccctcgcgacgagcttgtggaagcagcatgcgctctgacatgtgactgggccgaacgtatcctgaaacgatctttcagtagcatcgttgaagtcgctaggttcctgcttcaacaacacctgatcagcgctaggtcagctcatgcacatgtgttaaaagctatgggattggctgaggaggatgaacacgcacctcgcgaaaggtcctccaaacccaagaacggtttggaaaaccccgaaggaggggcccacaaaaagcctgagagactagcacagcccccaaaggacctggaggctaggaccggagccggaccactagcccgtggggagagaaagaaatcggttgtggaatcctcagcacctggggccaataacttgcaggtaaacgccctggtggccaggctccctctcctactccctagagcacctagatctcttattcccccaatccccgttagcccgcctatcctggctccgcgactcagttctggggccctgaaggtagctaccctcccactctcatcacgggctggagccccaccagccgctgtgccaattatcaatatgatactgccaacagtgcctgcactgcccggacctggccccggtccaggaagggccccccctggcggactcactcagccccggggcacagaaaacagggaagtgggcatagggggcgaccagggccctcatgataagggtgtgaaacgcactgcagaggtgcctgtgtcggaagcgagcggacaagcccctcctgcgaaggcagcaaaacaagatatcgaggatacggccagcgacgctaaaagaaaaaggggtcggcccagaaagaaatccggggggtctggagaacggaacagtacacctcttaagagcgctgctgccatggagtccgctcagtcaagtcgattgccgtgggagacatggggctccggcggcgagggtaactccgcgggcggcgctgaacgccccggcccgatgggcgaggccgagaagggtgctgtactggcccagggacagggagatggcaccgtgtcgaaggggggccgtggccctggttctcaacacacgaaggaagccgaggataagatccccttggtacccagtaaagtctctgttatcaagggctctcgcagccagaaggaagccttcccacttgcaaagggcgaagtcgataccgcccctcagggcaacaaggaccttaaagaacatgtgctacagagttcactatcacaggaacataaggaccccaaggctacacccccttag

SEQ ID NO: 132130 - DNA, 498 bp, Artificial Sequence
  Description of Artificial Sequence: Synthetic coding sequence
atggccgaggacgaacccgacgcgaagagccctaagactggtgggcgagcaccgcccgggggggccgaagcgggcgagccgaccaccttgcttcagcgtcttcgaggcacgatctccaaagcagtgcagaataaggtcgaggggatattacaggacgtgcaaaaatttagcgataacgacaaactttacctgtatctgcagttgcctagcgggccaaccaccggtgataaaagttcagagccaagcaccctctctaatgaggagtacatgtatgcctatcgttggattcggaatcaccttgaggagcacaccgacacatgcctgcctaaacagagtgtgtacgacgcgtataggaagtattgcgagagtttggcgtgttgtcggccactgtccaccgccaactttgggaagattattcgtgagattttccccgacattaaggctagacgtttaggggggaggggccaatccaagtattgctatagcgggatccggtag

SEQ ID NO: 132131 - DNA, 2787 bp, Artificial Sequence
  Description of Artificial Sequence: Synthetic coding sequence
atggccaaggtgcctgagctggaagatactttcctgcaggctcagcctgctccacagctttcaccagggatccaggaagattgctgtgtccaacttctgggtaagggattgctcgtataccctgaggaaacggtctatctggccgccgagggccagccaggcggtgagcaaggagggggtgagaagggagaggatccagaattgccgggagccgtgaaatcagagatgcatctgaacaacggtaatttttcttcggaggaggaggatgctgacaatcacgactccaagactaaagcagcagatcaatacttaagtcagaaaaagacaatcactcagatcgtgaaagacaagaagaagcaaactcagctcaccttacagtggctcgaggagaattatatcgtgtgcgagggcgtctgtctcccccggtgtatactgtacgcccactacctggatttttgcaggaaagaaaagctcgagcccgcatgcgcggccacttttggtaaaacaatccggcagaagtttccgttattaacaacccggcggctgggaacccgcgggcacagcaaataccactactacggcatcggaatcaaagaaagcagtgcctactaccattccgtctatagcggcaagggtctcacacggttctcgggttctaaattaaagaacgagggggggtttaccagaaagtactccttatcctcaaagactggcacgctccttcctgagttcccaagcgctcagcacctggtgtaccaggggtgtatttcaaaagacaaggtcgacaccctcattatgatgtataagactcactgtcagtgcatcctcgataatgccattaacggaaactttgaggagatccaacacttcctgctccatttctggcagggcatgcctgaccacctcttgcccctgttggagaaccccgtgattattgacatattttgtgtgtgtgactctatcctttacaaggtgctgaccgacgttctgattcctgccactatgcaagaaatgcctgagagcttgcttgccgatattcggaactttgccaagaactgggagcagtgggtggtcagttcgctcgagaatctgcccgaggcacttaccgacaagaagattccaatcgtgaggcgatttgtgtcttctctgaaacgccaaacttctttccttcacctcgcccagattgcccggccagcactgttcgaccagcacgtggtgaattctatggtttccgatattgagagggttgacctgaactctataggttctcaggcactgttaaccatttcagggagcactgacacagagtcgggcatctacacagagcatgactctatcaccgtcttccaagagctgaaagacctgttgaaaaagaatgcaaccgttgaggccttcatcgaatggctcgacaccgtggtagaacaacgcgttataaagactagtaagcagaacggcaggagtttaaagaaaagagctcaggactttctcttgaaatggtccttttttggggcgagggttatgcacaacctcacacttaataacgcctcctcgttcgggtctttccatctcatcagaatgctgttggatgaatacatcctgctcgcaatggagacacagtttaacaacgacaaagagcaggaactccagaacctcctggataaatacatgaagaacagcgatgctagcaaagctgctttcactgccagccctagctcatgttttctggccaaccgcaacaagggatctatggtgtcatcggatgcagttaagaatgagtcccacgtggagaccacctacctgcccctcccatcttctcagcccggtgggttagggccagcactacatcagttccctgcgggcaacactgacaacatgccgctgactgggcagatggagctgtctcagatcgccggtcacttaatgaccccacctatttcccccgctatggcctcacgcggcagcgtcattaaccaggggccaatggcagggaggcccccttccgtgggcccagtactgtcagcgccatctcattgtagtacctaccctgagccaatctaccccaccctgcctcaagctaatcacgacttctacagcaccagctcaaactatcagactgtgtttcgggctcaacctcactctacaagcggactgtatccccatcatactgaacatgggaggtgcatggcttggacagagcagcagctgagccgagactttttcagtggaagctgtgccggatccccatacaatagtaggccccccagtagctacggtccatcactccaggcccaggacagtcacaacatgcagttcttgaatacagggtcttttaattttttgtctaacacgggggctgcttcatgccagggagccaccctcccaccgaattcccctaacggttattatggcagcaacataaattatcctgagtcacataggctggggagcatggtcaaccagcacgtgagtgtgatatcctccattagaagcctaccaccatatagcgacattcatgaccccttgaacatcctcgatgacagcggcagaaagcagactagctcattctatactgatactagctctcccgtggcctgccggacgcccgtcctggctagctctctgcaaacaccaatcccgtcctccagtagccagtgcatgtatggcaccagcaatcagtacccagcccaggaaaccctcgactctcatgggacgtcctcacgagagatggtctcatcactgcctcctattaacaccgtgtttatgggaaccgctgccggaggcacctag

SEQ ID NO: 132132 - DNA, 4122 bp, Artificial Sequence
  Description of Artificial Sequence: Synthetic coding sequence
atggcggaggaacaacagcagccgcccccccagcagccggacgctcatcagcagctccctccgtctgcgcccaacagcggagtggctcttcccgccctggttccgggtctgccgggtaccgaggccagcgcgctccagcataaaatcaagaactcaatctgtaagaccgtgcagtccaaagtggattgcattctgcaggaagtggagaagttcaccgatctcgagaaactctacctctacctccaactacctagcgggctttccaacggggaaaagtccgaccagaacgcaatgtcgagcagccgagctcagcagatgcacgccttctcatggatcaggaatacacttgaggagcatcccgaaacctccctacccaaacaggaggtttacgatgagtacaagtcatactgcgataacctggggtaccacccccttagcgcggcagacttcggcaagattatgaagaacgtgttccccaatatgaaagcaaggcgactgggtacacgcggaaagtccaagtattgctactccggactacggaaaaaagcctttgtgcacatgccaactctccccaatcttgacttccataagaccggcgatggtcttgagggagcagagccaagcgggcaattgcagaatatagatgaagaagttatatccagcgcatgcaggcttgtttgtgagtgggctcagaaggtcctgagccagcccttcgataccgtgctggagttggcccgatttctggtgaaatctcattatattggcacaaaatcaatggccgccctcaccgttatggcagcggcacctgcagggatgaagggtattactcaaccttccgcctttatcccaacagccgagtccaattcttttcagccgcaggtgaagacgctgccttctccaatcgatgcaaaacagcagctccagcggaagatacaaaagaagcagcaagaacagaagctgcagtcccccctacccggagagtctgcggctaaaaaatccgagagtgcaacctctaatggagtcacaaatttaccaaacggaaacccgtccattctgtctccgcagcctataggcatagtggttgccgcagtgccaagcccgattcccgtccagaggacgagacagctggtgacaagtccctcacccatgtcctcctccgatgggaaggtgcttccgctcaatgtacaggttgtgacccagcacatgcagagcgtgaagcaggctcccaaaacaccacagaatgtccccgcctccccaggaggtgatagatccgctcgccacaggtacccccagattctgcccaagccagccaatacctccgcactcaccatccggtcgcccaccacggtcttgtttacttcatcgccaattaagacggccgtggtccccgcctcccatatgtcttcccttaacgtcgtaaagatgacaaccatttctctgactccatcaaactctaatacccctcttaagcacagcgccagcgtcagctcagcaacaggcactaccgaggaatcccgttctgtacctcagattaaaaatgggagcgttgtttcgctgcagtcacctgggagtcgctccagctctgccggcggcacgtccgctgtcgaagttaaagttgagccagaaacttcatcggatgagcatcctgttcagtgtcaggagaattcagatgaggccaaagcccctcagacaccatccgctctccttggccagaagagcaatacagacggggcactgcagaaaccctccaacgaaggggtgatcgaaattaaggccacgaaggtctgtgatcagaggactaagtgtaagtctcggtgcaatgagatgttgcccggtacctctactggcaacaaccaatcaacgatcactctttccgtcgcttcccagaatctcaccttcactagtagctcttccccccctaatggcgactcgatcaacaaagaccccaaattgtgtactaaatcacctcggaaaagactttccagcaccctccaagaaacccaggtccccccagtgaaaaaaccaatcgtggagcaactcagcgccgcaacaatcgaggggcagaagcaggggtccgttaaaaaggatcaaaaggtaccccacagcggcaagactgagggtagcaccgccggagctcagattcccagtaaggtgtcagtgaacgtatcgtcccatattggagccaatcagcccctgaattcatctgcactcgtcatcagcgactctgccctcgaacagcagactactcccagttcttcaccagacattaaggtgaaactcgagggcagtgtcttcctcctggacagcgacagtaagtctgtcgggagctttaatcctaacggctggcagcagataacgaaagattctgagttcataagcgcctcttgcgagcagcagcaggatatctcagtgatgacaatcccagaacactccgatattaatgacctggaaaagtccgtctgggaactggagggcatgccacaggacacatactctcagcagctgcattctcagatccaggaatctagcctgaatcagatacaagcccattccagtgaccagctccctctgcagtccgagcttaaagagtttgaaccgtccgtaagccagacaaacgagtcctacttcccgtttgacgacgagttaacacaggacagcattgtggaggagctcgttttgatggagcaacaaatgtctatgaataattctcattcttatggaaattgtctgggaatgaccctgcagtctcagtccgttacacccggagcaccgatgagctcccacacaagtagtacccacttctaccatccaattcacagcaatgggacaccaatccatactccaaccccgacaccaacacctacccctactcctacccctacacccacgccgacgagcgagatgatagcaggaagccagagcctgtcccgtgagagtccctgtagccggctggcccagaccactcccgttgactcagccctgggtagttctaggcacacccctattggaaccccccactcgaattgtagcagttccgtgccgcccagtcccgtcgagtgcagaaatcccttcgctttcacccccatatcgagttcaatggcatatcacgacgccagtatcgtgtcttcttccccagttaagccgatgcagaggcccatggccacgcatccagataagaccaaactcgaatggatgaacaatgggtatagtggcgtcggcaacagctccgtctctgggcatggtatcctcccaagctaccaggaactggtagaagacagattccgcaaaccccatgcattcgccgtgcccggtcagagttatcagtcacagtcacgacaccatgataccaactttggacgtctcactccagtgtctcctgtacaacatcagggtgccacagtaaacaacacaaacaagcaggaggggtttgcggtgcctgctcctctcgacaacaagggaactaatagctcagcttcttcgaacttcaggtgccgtagcgtttcaccggcggtgcaccgccagaggaatctgtccgggagcaccctctaccctgtcagcaatattcccaggtccaacgttactccctttgggtcccccgtaacacccgaggtccacgtgttcacaaacgtgcacaccgacgcctgtgcaaataatatagcacagaggtcacagtctgtacccttgactgtgatgatgcagacagcgttcccaaacgcactccaaaagcaggccaattccaaaaagatcacaaacgtgctgctctctaaacttgactctgataacgacgatgctgtgcgcggcttaggcatgaacaacctaccttcgaactacaccgcacgaatgaatctgacccaaatcctggaaccctctaccgtgtttccgtcagccaatccgcagaacatgatcgattcctccacgagtgtgtacgaatttcaaactcccagctacctgactaagagcaattccactggacagattaacttcagccccggcgataaccaggctcagagtgagattggcgagcaacaactcgattttaattccacagtgaaggatttgttgagcggcgattctctgcagactaaccagcagctgaaataccctgacgtcctcggggagtag

SEQ ID NO: 132133 - DNA, 3846 bp, Artificial Sequence
  Description of Artificial Sequence: Synthetic coding sequence
atgtcctcgagtcgggcccagcagatgcacgccttctcttggattaggaacacacttgaggagcatcccgaaacctcattgcctaagcaagaggtctacgacgaatataaaagctactgcgacaatctgggctaccatcccctctccgctgcagactttggcaagatcatgaaaaatgtcttccccaatatgaaggctcgcaggctgggaacccgagggaaatctaaatattgttatagtgggcttcggaaaaaagcgtttgtgcacatgcctactcttcctaatctagactttcataaaaccggggacggtctcgaaggcgcagagccctcgggacagctgcaaaatattgacgaggaagtaatctccagtgcttgccgactcgtttgcgagtgggcccagaaagtgctgtcgcagcccttcgataccgtgcttgaactcgcccgttttctcgtgaaatctcattacataggtactaaatctatggccgccctgaccgtgatggccgccgcgcccgccggaatgaaggggattacacagccgtctgcctttattcccacagctgagtccaatagcttccagcctcaggtaaagactctgccgagccctatcgatgctaaacagcaattgcagagaaagatacaaaaaaaacagcaagagcagaaactgcagtcacctcttccaggggagtcagcggctaagaagtccgagagcgcgacatcaaatggagtgaccaacttgccaaatggaaacccttcaatcctctcaccacagcctattggaatcgtagttgctgcagtgccaagtcctattccagttcagcgtactcggcagttggttactagtccctctcccatgagtagttcagacggtaaggtgctgccactaaatgtccaggtcgtgacgcaacatatgcagtctgtaaaacaggcacccaagactccccaaaatgtccccgcatctcctggcggggataggtccgcgcggcatcgctatccgcagattctccccaaaccagcgaataccagcgccttaactatccgctcccccaccacagttctcttcacctcttcgccaattaagactgctgtggtccctgccagccacatgtcctcattgaacgtggtgaagatgaccaccatttctctcacaccttcaaattctaacacccccttaaagcatagcgcatcagtctcctcggccacaggaaccactgaagagagtagaagcgtgcctcagataaagaacgggtcggtcgtatccctacaatcaccagggagccgctcttcatcggctggaggaacctctgcagtcgaagtcaaagtggaaccagaaaccagtagcgacgagcacccagtacagtgccaagagaactccgacgaggccaaggctccccagaccccctccgccctattggggcagaagagcaacacagacggagccttacagaaaccctccaatgagggggtgatagagataaaggccaccaaggtctgcgaccagagaacaaagtgtaaaagccggtgtaatgaaatgctgccaggtacctccaccggaaacaaccagtctaccatcaccctgagtgttgccagtcaaaacctgacctttacctccagctcctctcctccaaacggcgatagcataaacaaagatcctaaactgtgtaccaagtcccccagaaagcggctgagcagcaccctacaggaaacccaggtacccccagtcaaaaagcctatcgttgagcagctgtccgccgctaccatagaagggcagaagcaagggagtgtgaagaaagatcagaaggtgcctcattccggaaagacggaaggctccactgctggcgcacagatccccagcaaagtgtctgtgaatgttagctcccacattggagcaaaccagccgctgaactcgtccgcattagtcatttccgatagcgccctagagcagcagactaccccgtcttcttccccagacataaaggtgaagctggaagggtctgtttttttactggacagtgactctaagtctgtcggttccttcaacccgaatggctggcagcagattaccaaggacagtgagtttatcagcgcttcttgtgagcagcagcaggatatctctgtgatgacaattcccgaacattcagatataaacgatctcgagaagtcagtttgggaattggaggggatgccacaagacacctactctcagcagctccatagtcagattcaagagagcagcctaaatcagatccaggctcattcaagcgaccagctccctctgcagtccgagctgaaggagttcgagccttctgtgtcccagactaatgaaagctacttcccgtttgatgatgagctcactcaagactcaatcgtagaggagctcgtgctcatggaacagcagatgagcatgaacaatagtcacagctatggaaattgcttaggcatgactctccaaagtcagagcgttacacctggggcgcctatgtcatcacatacttcttcgacacacttttaccacccaattcacagtaacggaacccccatccatacacctactccgactccaaccccaacccctacacccactccaacacccacaccgacaagtgaaatgatcgccggaagccaaagcctgtctagggagtccccgtgcagtagacttgcacagaccactcctgtcgacagcgccctgggctctagccggcatacccctatcggtacaccacactccaattgttcctcttctgtccccccttcacccgtagagtgccgcaacccatttgctttcacacctatttcaagctcaatggcctaccacgacgcttcaatcgtaagctccagccccgtgaagccaatgcagcggccgatggcaacacacccggacaaaacaaagctcgagtggatgaataacggctatagcggcgttggaaattcatctgtgtcaggccacgggattctcccctcctaccaggaactcgttgaagatcggtttcggaaaccacacgccttcgctgttcccggtcagagctatcagtcgcagagtagacaccacgatactaactttgggaggttaacccctgtctcgcccgtacagcaccagggcgctacagtgaataacacaaacaagcaggaagggttcgccgtcccagcccccttggataataaggggaccaacagctccgcctcctctaacttccgttgcaggagcgtttcaccagccgtgcatcgccaacgaaacttaagcgggtctaccctgtatccggtgagcaacatcccacgatccaatgtgacaccctttggaagccccgtaactcccgaagtgcatgtctttacaaacgtccataccgacgcctgcgcaaacaacatcgcccagcgcagccagtctgtgccacttactgtgatgatgcagaccgctttccccaatgcattgcagaagcaggcaaatagtaagaaaataactaatgtcctattgagtaaactggactctgataatgatgacgccgtcagaggattgggaatgaacaacctccctagtaactatacagcccgcatgaacctcacgcagattctagagccatcaactgtctttcccagcgcaaacccacaaaacatgattgatagtagcacttctgtgtatgaattccaaacgcctagctatttaacaaaaagtaatagcaccgggcagatcaatttctctcctggcgataaccaagcccagagcgagatcggcgagcagcagctggattttaactcaactgtgaaagatctgctcagtggtgactctttgcagactaatcagcagttatgctcatgtcctagctcgcttcttgccggaatgcagatgtag

SEQ ID NO: 132134 - DNA, 4383 bp, Artificial Sequence
  Description of Artificial Sequence: Synthetic coding sequence
atggctgaggaacaacagcaacctccaccgcagcagccagacgcccaccaacagttaccaccatcagctcccaactccggtgtagccctcccagcccttgtgcctggtttgcccggtaccgaagcaagcgcccttcaacacaaaatcaagaattcaatctgcaagacagtacagagcaaggtcgactgcatactccaggaggtggagaagttcacagacctcgaaaagctgtacctgtacctgcagctgccctctggtctgtctaacggtgaaaagagcgatcagaatgctatgagcagctcccgagctcagcagatgcacgcattctcgtggattcggaacacgctcgaggaacaccccgaaacttcactacctaaacaggaagtgtatgacgagtacaagagctattgcgataacctcgggtatcacccgctgtctgctgctgatttcggtaaaataatgaagaacgtctttcctaacatgaaagccagacgcctcggcacaaggggaaaatccaagtattgctactccggtctacggaagaaagcctttgtgcatatgcccacactcccaaacctcgacttccacaaaaccggcgatggactagaaggagccgaaccgagcggtcagctgcagaatattgacgaggaggtaatatctagcgcctgtcgcctcgtctgcgagtgggcgcaaaaagtcctgtcgcaaccatttgacaccgtcttggaactcgccagatttttggtgaaatcccactatatcgggacaaagagtatggcagcattgaccgttatggcagccgctccagccggaatgaaaggtataacccaaccaagcgccttcatcccaacagccgaaagtaactccttccaaccacaggtcaaaacccttccctcaccgattgatgctaagcaacagctgcagagaaagatccagaaaaagcaacaggaacagaagctgcagagcccccttccaggagaatcagccgctaagaaatccgagagtgccacatctaatggggtgacgaatctcccaaacggcaaccccagtatactgagtccgcagcctatcggcatcgtcgtcgctgcagtgcccagtcctatccctgtacagcgcactagacaattggtgacctcaccttcacctatgagctctagtgacggcaaagtcctccctcttaatgtgcaagtcgtcacgcaacatatgcaatcagtcaaacaggctcccaagacccctcaaaatgttccagcatctccgggtggcgatcgatcagcacgccataggtacccccaaatcctgccaaaacccgctaacacaagtgcactgaccatccgtagcccaactacggtcctgtttacctcgtctcctatcaaaaccgccgtggtgcccgcctcccacatgtcaagccttaatgtagtgaaaatgacgactatatccctgactccctctaattcgaacactccactaaagcatagtgcctccgtttcttctgccactggtacaacggaggagagtaggtccgtaccgcagatcaaaaatggaagtgttgtgagtctgcaatctcccgggagtcgcagttcatctgccggtggcacctccgctgtggaggtgaaggtagaacccgagactagtagcgatgagcaccctgtccagtgtcaggaaaatagcgatgaggcaaaagcccctcagactccgagcgcactcctggggcagaagagcaacacagacggagccctgcagaagccctctaatgaaggagttatcgagattaaagccacgaaagtgtgtgaccagcgtactaaatgcaagtctcgttgtaatgagatgttgcccggcacctctaccgggaataatcaatccaccataaccctgagcgtagcatctcaaaacctgacctttacatcctctagttcacctccaaacggagattctatcaacaaagacccgaaattgtgtaccaaaagtcccagaaagcgcctcagctcaacactgcaagagactcaggttcctcctgttaaaaagccaatcgtcgaacaacttagcgccgccacaatagagggccagaagcagggtagtgtcaaaaaagaccagaaagtaccccacagcggcaaaacagaaggttccacagcaggggctcaaattccttcaaaagtctcagttaatgtctcctcccatattggcgcaaatcagccgttaaactcatctgctctcgtgatcagtgattctgcactggagcagcagacaactccttcaagtagtcccgatatcaaggtaaagttggaagggtcagtgtttcttctcgatagtgacagcaagagcgttggatcgtttaatcccaacggttggcagcagattaccaaagactcagagtttatctctgccagctgcgaacaacagcaggacatttcagttatgactatcccagagcatagcgacattaatgacctcgaaaagagcgtgtgggaacttgaaggcatgccccaggacacatattcccagcagctgcactcccagatccaagagtcaagtctcaaccaaatccaggcccatagctctgaccagttgcccctgcagagcgagctaaaagagttcgaaccatcggtgagccagactaacgaatcttatttccccttcgatgacgagctgacgcaggattccattgtagaagagttagtcttgatggaacagcagatgagcatgaataactcacattcttacgggaattgcctgggtatgacgctgcagtcacagtctgtcacccctggtgctcctatgagttcccacacctctagcacccacttctatcatcccattcactccaacggtacacccatccacacccccacgcccacccccactccaacacctactcccaccccaacccccacacctactagcgagatgattgccggtagccaaagcttgagtcgcgaatcaccatgttcccggctggcgcaaactactcccgtagatagtgcattggggtccagccggcataccccaatcgggacccctcattcaaattgcagctcatcagtgccaccctccccagtggagtgtagaaatccctttgcctttactcctataagctcctcgatggcttaccacgatgccagcatcgtatccagcagtccagtgaagcctatgcaaaggcctatggcaactcatcctgacaaaactaagctggagtggatgaacaatggttacagtggagttggtaacagctccgtgtccggacacgggatccttcctagttaccaagagttggttgaggaccggtttcggaagccgcacgcttttgccgttcctggacagtcataccagtcccagagtcggcaccacgacacaaacttcgggagattaaccccagtaagccctgtgcagcatcaaggcgccactgtcaacaatactaataagcaggaaggcttcgccgtgccagccccgctggacaacaagggtaccaacagctccgctagtagcaacttccgctgcaggagtgtgtcaccagcggtccataggcagcggaatctttcaggttctacactgtaccctgtatcgaatattccccgttcaaacgtaacaccattcggcagccccgtcacacccgaggtgcacgtgttcacgaatgtccacacagacgcctgcgctaacaatatagcccagcggtcccaaagtgtcccattgaccgtgatgatgcagaccgcgttccctaacgctttacagaagcaggccaattcaaagaagattaccaatgtactgctgtcaaagctcgactccgacaatgatgatgcggtgcgagggctgggcatgaacaacctcccctctaactacaccgcaaggatgaacctgacacagatcctcgagccttcaaccgtattcccctccgctaacccacaaaatatgatagactcctccacttccgtgtacgagttccagactcccagctacctcaccaaatccaactctacagggcagattaacttttctccaggggataatcaggctcagtctgaaatcggcgagcaacagctggacttcaacagtacagtcaaggacctgctttcaggcgacagccttcagacgaatcagcagctagttggacagggagcctccgaccttacgaacaccgcctctgactttagcagtgacatacgcctgtcgagcgaattatcagggtctatcaatgacctgaacacccttgatcccaacctgctcttcgaccccggccgccagcaaggccaggatgatgaggccaccttagaagagctgaagaatgatccactcttccagcagatctgttccgaaagcatgaattcaatgacttcaagcgggtttgagtggatcgaatctaaggatcatcccacagtggaaatgttaggttag

SEQ ID NO: 132135 - DNA, 4092 bp, Artificial Sequence
  Description of Artificial Sequence: Synthetic coding sequence
atgtcctctagtcgggcacagcaaatgcacgccttttcatggatccgtaatacacttgaagaacaccctgaaacatccctgcctaaacaggaagtgtacgacgaatacaaatcctactgtgacaatcttggttatcatcctctgagtgctgccgactttggtaagattatgaaaaatgtctttcccaacatgaaagctcgtcgactcggaacgagagggaagtctaaatattgctactcgggcctgcggaaaaaggcattcgtgcacatgccaaccttaccaaacctggactttcataaaaccggagacggccttgaaggagctgaaccaagcggccagctccagaacatcgatgaggaagttatcagcagtgcctgcagattagtgtgtgaatgggcacagaaagtcctgtcccagccctttgatactgtgttggaactggcccggttcctggtgaagtcacactatattggtacgaagagtatggccgccttgactgtgatggcagccgcaccagctggcatgaagggaattactcagccttcagcatttattccaacagccgagtccaacagttttcagcctcaggtgaaaacacttccaagtcccattgatgctaaacagcagctgcagcgcaagattcaaaaaaaacagcaggagcagaagctccagtctcctttaccaggagagtccgcagccaagaagagcgagtcagcaaccagcaacggggtgacaaaccttcccaacggaaatccttccattctctcacctcaacctatcgggatagtggtcgcagctgtgccctcacctatccccgtgcaacgcaccagacagctcgtgactagccctagccctatgtccagttctgatggaaaagtgctgcccctgaacgtgcaagtggtgacccagcacatgcagagcgtgaagcaggcgccgaagacaccccaaaatgtcccagcttcccctggtggtgacagatctgcccggcatcggtatcctcaaatcctgcccaaacccgccaatacctctgccctcaccattaggtccccaactacagttctctttacgtcgtctccgattaagactgccgtcgtaccggcttcccatatgagtagcctgaatgtggtcaaaatgacgactattagcctaacgccgagcaactccaatacacctctaaaacattcagcctccgtgtcgagtgccacaggaactacagaggagagtaggtcagttccgcaaatcaagaacggaagcgtagtatcgctccagtccccgggtagcagaagctctagcgccggcggaacctcagccgtcgaagtgaaggtcgaacctgagacctctagcgacgagcatcccgtgcagtgccaggagaacagtgacgaagccaaggccccccaaactccttcagccctgctaggccagaagtccaatacagatggtgcattacagaagccaagtaatgagggtgtgatcgagattaaagccaccaaggtgtgcgaccaacgcactaaatgcaaatcgcgctgcaatgagatgctaccaggcaccagtaccggaaacaatcagtccacaatcacattatctgtggcttcccagaatctgacatttaccagcagtagtagcccacccaacggcgactccatcaataaagacccaaaactctgcacaaagtcgcccaggaaacgtctgtcttctacacttcaggagactcaggtgcctccggtgaagaaacccatcgtcgaacaattgagcgctgcaacaatagagggacagaaacaagggtcagtgaaaaaagaccaaaaagttccacactcaggcaaaaccgagggctctaccgctggcgcgcagatccccagtaaggtgagtgtgaacgtttcttcccacatcggtgcgaatcaaccgctaaacagcagtgcccttgtgattagcgatagtgccctggaacagcagactacgcccagcagctctcccgacatcaaggtgaagcttgaaggctctgtgtttctgttggattccgatagcaagtcggtggggtcgtttaatccaaacggatggcagcagataacaaaggactccgaattcatctcagctagctgtgaacaacagcaggacataagtgtcatgaccataccagagcacagcgatatcaacgatctggagaaaagcgtgtgggagcttgagggaatgcctcaggacacttattcgcagcaactacattcacagattcaagagtcaagtctcaaccagattcaggcccacagttccgatcagctccctttgcagtcggagcttaaggaatttgaaccaagcgtgagtcagacaaacgaaagttattttccctttgacgacgagctgacacaggactcaattgtcgaggaactagtacttatggagcagcagatgtcgatgaataattcacacagttatgggaattgcctgggtatgacactccaatcccagtccgtaactcctggagccccaatgtcttctcacactagctcgactcacttctatcatcctatacattccaacggcacgcccatccataccccgacgcctactcccaccccaactccaacaccaacccccactcccactccaacttctgaaatgattgctggcagccaatctttaagcagagagtctccatgttcccggctagcccagacaactcctgtggatagtgccctcggatcttcgagacacactcctattgggacaccccactctaactgttcatcctcagtgccccccagcccagtagagtgcaggaatccattcgctttcacacccatttcgtcctcaatggcctaccacgatgccagcattgtgtcaagcagtcctgtgaagcccatgcagagacccatggccacacacccagacaaaacaaagttagaatggatgaacaatggatactctggcgtcggtaactcatcagtgtcgggtcatggtatactgccgtcctaccaggagctggtagaggatagatttaggaaaccccacgcctttgctgtccctgggcagtcctatcagtcacagagtagacaccatgacaccaacttcggcagactgactccagtgtccccagttcagcatcaaggcgcgacagtgaacaatacgaacaagcaggagggatttgctgtgccagccccgcttgacaacaaaggaaccaacagtagcgcttcctcaaacttccgatgccggtcggtgtctccagccgttcataggcagagaaacttgtccggatcaaccttatacccagtatccaacatacctcgctctaacgtgactccttttggaagccctgtgactcctgaagtgcatgtcttcaccaacgtgcatacggacgcatgcgccaacaacatcgctcaacggtctcagtccgtgcccctgactgtgatgatgcagactgcattcccgaacgcactgcaaaaacaggccaatagtaaaaagatcacgaatgtgctgctcagtaaattagatagtgacaatgacgacgccgtgagagggctcggtatgaacaacctgcccagcaattatacggcacgcatgaatctgacccagatcctggaaccctccaccgtgtttccatccgcgaacccacagaacatgattgatagttctactagtgtgtacgagtttcagactccatcctacctgactaagagcaattctacgggccagatcaatttcagccctggggacaaccaagcacaaagtgaaatcggagagcaacagctggatttcaactctaccgttaaggatctgctcagcggggactctcttcagacaaaccagcagctcgtgggtcagggagcttctgacctcacaaacactgcctctgatttttcatctgacatccgtttgtcgtctgaactgtccggaagtattaacgatctcaacactctggatccgaatcttttgtttgaccccggcaggcagcagggccaggatgatgaggccacattggaagaactcaaaaacgaccctttatttcagcagatctgctctgaatctatgaatagcatgacatcctcaggatttgaatggatcgaaagtaaagatcatcctacagtggagatgctcggatag

SEQ ID NO: 132136 - DNA, 783 bp, Artificial Sequence
  Description of Artificial Sequence: Synthetic coding sequence
atggagttgacgcagcccgcggaagacctaatccagacccagcagacacctgcttccgagttaggcgatcctgaggatccaggggaggaagctgccgatggttccgataccgtggtgctctccctctttccctgtactccagagccagtgaatcctgagcccgatgcgtccgtgagtagtccacaagctggatccagtctgaagcatagcaccacactcaccaacagacagaggggtaacgaggtgagtgccctcccggccaccctggatagtctgtctatccaccagcttgcagcgcagggggagcttgatcagttaaaggagcatttgcgcaagggagataatctcgtgaataaaccagacgagcgcggcttcactcccctgatttgggcctccgcctttggagaaatcgaaactgtacgcttcctcctcgagtggggtgccgatccgcacatactcgccaaggagcgtgaatctgcattgagcttggcctctactggaggttacacagacatcgtcggcctgctattagaaagagatgtggatattaatatctacgactggaacgggggaacgccactcctgtacgctgttcgcggcaatcacgtcaaatgtgtggaggctctgttggcacggggcgctgacctgacgactgaagccgacagtggctatacccccatggatttagcagttgctctggggtataggaaggtgcagcaggtgattgagaaccacattctaaagcttttccagagcaacctggttccggccgatccggagtag

SEQ ID NO: 132137 - DNA, 714 bp, Artificial Sequence
  Description of Artificial Sequence: Synthetic coding sequence
atggagctcacccagccagctgaagaccttatccaaacccagcagacgccagcctcagagctgggcgatccagaggatcccggagaagaggccgcggatgggtcagatacagtggtgctctccctattcccatgtaccccagaacctgtgaacccggagcctgacgctagcgtctctagcccccagggcagtagcctaaaacactcaaccacactgacaaacaggcaaagaggcaacgaggtcagtgcattacccgctacattagactgcgataaccttgtgaataagcctgatgaaaggggcttcacccccctgatttgggcgtccgcctttggggagatagagaccgtgaggttcttgctggagtggggagccgatccacatattctcgccaaagagagggaaagcgcgttgtcactagcatctacgggtggctatactgatatcgttggattgttgctggaaagggatgttgacattaacatctacgattggaatggaggcactcccttattgtacgcagtccgcggtaatcacgtgaagtgcgtggaggctttactcgctcgaggagccgatttaaccactgaggcagactccggttataccccgatggatctcgcggtagctctgggataccgcaaggtgcaacaggtgatcgaaaaccacatcctcaagctatttcagtccaacctggttccagccgatcctgaatag

SEQ ID NO: 132138 - DNA, 192 bp, Artificial Sequence
  Description of Artificial Sequence: Synthetic coding sequence
atggaactgacgcagcccgctgaggatctgatccagactcagcaaactcctgcttccgagctgggagatcccgaagatccgggagaagaggccgcggatgggtcagacaccgtcgtcctttctttgtttccttgtacaccagagccagtgaatccagagcctgatgcctccgtgtcttcccctcaggcgtag

SEQ ID NO: 132139 - DNA, 717 bp, Artificial Sequence
  Description of Artificial Sequence: Synthetic coding sequence
atggagctgacccagccagcagaagatctaatccaaacacagcagacccctgcatctgagctgggggatccggaagaccccggcgaagaagcagcagatgggtccgacaccgttgtgttgtcattattcccatgtacacccgagcccgtgaaccctgaacctgatgcttccgtgagcagcccccaagctggttcatccctgaaacactctacaacactgacaaatagacagagaggaaacgaagtctcagcactgcccgcgacccttgattgcgacaatctcgtgaataagccagacgagaggggcttcactccactgatttgggcctcagcctttggagagattgagacggtccgctttttactggaatggggcgccgaccctcacatcttagccaaggaaagggagtcagcactgtctcttgcaagtacagggggatacacagatatcgtggggctcctactggagcgcgacgttgatattaatatttacgattggaacggcggtactcccctgctctacgcagtccgcggcaaccacgtgaagtgtgtggaggctctgctggccagaggagccgatctcaccactgaagctgactctggatatacacctatggacctggctgtcgcactcggctatcggaaggtgcaacaggtgattgaaaatcatatccttaagctgttccaatctaatctcgttcccgccgacccagaatag

SEQ ID NO: 132140 - DNA, 819 bp, Artificial Sequence
  Description of Artificial Sequence: Synthetic coding sequence
atggaagcccagggcgttgctgagggtgccggtccaggggcggcaagcggagtgccccatcccgccgctttggcccctgccgcggcccctaccctcgccccggctagtgtcgccgccgctgcctcccagttcactctcctggtgatgcagccgtgtgccggccaggacgaggcagcagcgcctggagggagcgtgggggcaggcaaacctgtaaggtatctgtgtgaaggagccggcgatggcgaagaagaagctggcgaggatgaagcggatttgctggatacgtccgaccctccagggggtggcgaatctgccgcctctcttgaagatttggaggacgaggagactcactctgggggcgagggatccagcggtggggcacggaggcgcggatcgggaggggggtcaatgtccaagacgtgtacctacgaagggtgcagcgagaccactagtcaggttgctaagcaacgcaaaccatggatgtgcaagaagcaccgtaacaaaatgtacaaggacaagtataaaaagaagaaatccgatcaggctctaaattgcggcggcactgccagcaccgggtccgcggggaatgtcaagctcgaggaaagcgcagacaacatcttatccatcgtgaagcagaggacagggagcttcggagaccggcctgccaggcccaccctcctcgagcaagtcttgaaccaaaagaggctctctctgcttcgatcccctgaggtggtccagttcctgcagaagcagcagcagctcttgaaccagcaagtactagagcagcggcagcagcagtttcctggaacatcaatgtag

SEQ ID NO: 132141 - DNA, 1854 bp, Artificial Sequence
  Description of Artificial Sequence: Synthetic coding sequence
atgagtagcttgccaacatctgacggctttaatcatcccgccagaagcagtggccagtcccctgacgttgggaaccctatgtcccttgcaagatcagtctctgccagcgtttgccctatcaagccttcagactccgatagaatcgaacccaaggcagtcaaagcattgaaagctagtgctgagtttcaactcaattctgagaagaaggagcatctgtccttgcaggatttgtccgatcatgcgagttcagcagaccacgctccaaccgaccagtcgcctgcaatgcccatgcagaacagtagcgaggagatcacggtggccgggaacctagaaaaaagcgcggaaaggtcaacacaggggctgaagtttcatttacacacccgccaggaagcctcattgagcgttacctccaccagaatgcacgagcctcaaatgttcctgggcgaaaaggattggcaccccgagaatcagaatttgtctcaggtcagtgacccccagcaacacgaagaacccgggaatgagcagtatgaggtagctcaacagaaagcctcccatgaccaagaatacctgtgcaatatcggagacctggagctcccagaagaacgacagcagaatcagcacaagatcgttgatctggaggccacaatgaaaggtaatggcttgcctcagaacgtggacccaccttcggctaagaaatccattccctctagtgagtgttctgggtgcagcaacagcgagacttttatggagatcgacaccgcacagcagtctctcgtgaccctgttaaactctacgggacggcagaacgcaaatgtaaagaacataggagcacttgatttgactttggacaacccacttatggaggttgaaacaagtaagtgtaatcctagtagcgaaattctgaatgattccatttctactcaagacctgcaaccgcctgagactaatgtcgagatccctggcaccaacaaggagtacggccactatagcagtcccagtctctgcggcagttgccagccaagtgtcgagtcagcagaggaatcttgtccatctattactgcagcattgaaagagcttcatgagcttctggtggtcagttctaaacccgcttcagaaaatacctccgaggaggtcatctgtcagagcgagacaatagccgagggccaaacgtctattaaggatctgagcgagcggtggactcagaatgagcaccttacacagaatgagcaatgcccccaggtttcttttcatcaggctattagcgtcagcgtcgaaacggagaaactgaccggaacttcttctgacaccgggcgcgaggccgtggaaaatgtaaattttaggtctctgggagatggtttatccaccgataaagagggggtaccgaagtcacgggagtcaatcaacaaaaaccgctctgtaactgtcacgagcgccaagactagtaatcaattacactgtactcttggggtggaaatctcgccaaaactgctggcaggcgaagaggacgctttaaaccaaacgtccgagcagacaaaatccctgagttccaacttcatactggtcaaagatcttggccaagggattcagaactctgtgaccgatagacccgagacccgcgaaaatgtgtgccctgatgcttctagacctctgctggaatacgaacctccgacctcacatccttcttccagccctgccatcctgcctcccctgatcttcccggctacggatattgatagaatattacgagcaggatttacactgcaggaagctctgggggctttgcaccgagtgggggggaacgctgacctggccctgttagttctcttggcaaaaaacatcgtggtgccaacttag

SEQ ID NO: 132142 - DNA, 657 bp, Artificial Sequence
  Description of Artificial Sequence: Synthetic coding sequence
atgtctagtggggccgcttctggtactggacgagggcgaccccgtggtggcggacctggaccaggagacccacccccatcagagacccataagctggtggttgtgggaggcggtggcgtcggaaagtcggctttaaccatccaatttatccagtcttacttcgtttcagactatgatccaactatcgaggattcctacactaaaatttgttcagtggatgggattcccgcacgcctagatatcctggataccgctggccaggaagagttcggcgccatgcgtgagcagtatatgagggcgggtcacgggtttttgttggtatttgctattaacgaccgccaaagctttaacgaagtaggtaaactgtttactcagatcttacgggttaaagacagagatgattttccggtagttcttgttgggaataaggcagacctggagtctcagagacaggttccacgcagtgaagcatctgccttcggggcctcacaccatgtggcttactttgaggcctccgccaagctgcggctgaatgtggatgaagcgtttgaacaactggtgcgcgcagttcgcaagtatcaggagcaggaattgcctccgagcccgcccagtgccccccgaaaaaagggagggggctgcccatgcgtcctcctttag

SEQ ID NO: 132143 - DNA, 615 bp, Artificial Sequence
  Description of Artificial Sequence: Synthetic coding sequence
atggccgcggcgggatggcgagatgggagcggacaggagaaatacaggctggtcgtcgtcgggggaggtggcgttggaaagtcagccttaacgatccagttcatccagtcttattttgtcactgactacgaccccaccatcgaggattcctacacaaagcagtgcgtgatcgacgatcgcgcggcaagattggatattttggacaccgctggccaagaggaattcggcgcaatgagggagcagtacatgcggaccggggaaggctttctgctggtcttctctgtgaccgatcgaggctcgtttgaggaaatctataagtttcaacgccagatcctgagggtgaaagatagggatgagtttccaatgattttaattggcaataaggcagaccttgatcatcaaagacaagtaacacaggaagagggccagcagctggcaaggcagctcaaggtgacatacatggaggcttcggccaagatacgcatgaacgttgaccaggcttttcacgaattggtgagagttatccgtaagttccaagaacaggagtgtcccccatctccagaacccacccgcaaagagaaggataagaaaggatgccattgtgtgatcttctag

SEQ ID NO: 132144 - DNA, 384 bp, Artificial Sequence
  Description of Artificial Sequence: Synthetic coding sequence
atgcgggaacagtatatgcgcacaggcgaggggtttctacttgtgttttccgtgacagaccggggctcttttgaagaaatctacaagtttcaaaggcagatcttgagagtgaaagatcgggatgagttccccatgattctgatcggtaataaagccgacctggaccatcagaggcaggtgacccaagaagagggtcagcagctagctagacagttgaaggtgacgtacatggaggctagtgctaagatacgcatgaacgtggaccaggcattccatgagttggtgagggtaattagaaaattccaggagcaggagtgccccccttcccctgagcctacacggaaggagaaagacaagaaaggctgccattgcgtcatcttctag

SEQ ID NO: 132145 - DNA, 384 bp, Artificial Sequence
  Description of Artificial Sequence: Synthetic coding sequence
atgcgcgagcagtacatgcgaacaggagaaggattcttgctggtgtttagcgtgactgaccgcggtagcttcgaagaaatttacaaattccagcgacagatcctgagggtcaaggaccgcgacgagttccccatgatacttatcggcaacaaggcagatctcgaccaccagcgacaggtgactcaagaggagggccaacagctggcaaggcagctcaaagtgacctatatggaggcttccgccaagatccgcatgaacgtggatcaggccttccacgagcttgtgcgggtgattcgaaaattccaggagcaagagtgtcccccctctcccgagcctacgcgcaaagagaaggacaaaaaaggatgccattgcgtgattttctag

SEQ ID NO: 132146 - DNA, 384 bp, Artificial Sequence
  Description of Artificial Sequence: Synthetic coding sequence
atgagagaacagtacatgagaaccggggagggttttctactcgtattcagtgtcaccgaccggggaagttttgaagaaatttataaattccagcgccagatcctgcgcgttaaggatcgggatgagttccctatgattttaatcggaaacaaggccgatctggaccaccagcgccaggtcacccaagaagagggtcaacagttggcaaggcagctcaaggtgacatatatggaggcatcggctaagattcgcatgaatgtggaccaggcatttcacgaacttgtgcgagtgattaggaaattccaggaacaagaatgccctcctagtcccgaacccactaggaaggagaaagataagaagggttgtcattgcgtgattttttag

SEQ ID NO: 132147 - DNA, 210 bp, Artificial Sequence
  Description of Artificial Sequence: Synthetic coding sequence
atgcgggagcagtatatgagaaccggcgagggtttcctccttgtgttcagtgtcacggatagaggttcattcgaagaaatttacaagttccaacgtcaaatactgcgggtgaaggaccgcgatgagtttccaatgatcctgattggtaacaaagccgatctggatcatcaaaggcaggtcacacaggaggaagggcagcaactggcttag

SEQ ID NO: 132148 - DNA, 384 bp, Artificial Sequence
  Description of Artificial Sequence: Synthetic coding sequence
atgcgggaacagtatatgcgcacaggcgagggattcctgctggtgtttagcgtcaccgaccggggttcattcgaggagatatacaaatttcagaggcagattctccgagtaaaagacagagatgaattccctatgattctaatcggaaataaggccgacctcgatcaccagcgacaggtaactcaggaggagggccaacagctggcccgacagttgaaagtcacatatatggaggccagcgccaaaatccgcatgaacgtggaccaagcttttcatgagctggttcgagtcataagaaagtttcaagaacaggaatgtcctccatcccctgaaccaacccggaaggagaaagataaaaagggttgccactgtgtgatcttctag

SEQ ID NO: 132149 - DNA, 384 bp, Artificial Sequence
  Description of Artificial Sequence: Synthetic coding sequence
atgagagagcagtatatgcggacaggagaaggctttctcttggtgttttccgttaccgaccgaggcagctttgaagaaatttacaagtttcaacggcagatcctcagagtgaaggacagagatgaatttcctatgattctgattggcaacaaggccgatctggatcaccaaaggcaggtcacccaagaggaaggacaacagctggccagacagctgaaggtgacctacatggaagcttcagctaaaatccgcatgaacgtagaccaagcattccatgaactggtaagagtgatcagaaaattccaggagcaggagtgtccgcccagccccgagcctactaggaaagaaaaagacaaaaagggctgccattgcgttatattctag

SEQ ID NO: 132150 - DNA, 510 bp, Artificial Sequence
  Description of Artificial Sequence: Synthetic coding sequence
atgtcttacttcgtcactgattatgaccctacaattgaggacagttacacaaagcagtgtgtgattgatgatagagcagcccggctcgatatacttgacaccgccggtcaggaggagttcggcgctatgcgtgagcagtacatgagaacaggtgagggatttctgcttgtgttctcagtgacggaccgtggatcattcgaagagatttacaagtttcaacgccagattctgagggttaaagaccgcgacgagttccctatgattttgatcggaaacaaggcggacctcgatcaccagcggcaggtcactcaggaggaggggcagcagttggctcggcagctcaaagtgacatacatggaggccagcgctaagatccggatgaacgtcgatcaggcgttccacgagcttgtgagggttatccgcaaatttcaggagcaggaatgtccacccagccccgagcctaccagaaaagagaaagacaaaaagggttgtcactgtgtcatcttctag

SEQ ID NO: 132151 - DNA, 633 bp, Artificial Sequence
  Description of Artificial Sequence: Synthetic coding sequence
atggctgcagcagggtggcgcgacggaagcgggcaggaaaagtaccgcctggtggtggtcggcggcggaggggtgggaaagagcgctcttaccatccaattcatccagttcttccttttcctgcaatcatactttgtgacagattatgacccgactatcgaggacagctacactaagcagtgtgtaatcgatgacagagccgcaagactcgatatcctggatacggccggacaggaggagttcggagccatgagagagcaatacatgcggaccggcgaaggtttcctcctggttttctctgtcaccgataggggctcatttgaagagatctacaaattccagcgacagatcctgagggttaaagacagggacgagttccccatgatactgatcgggaacaaggccgatcttgatcaccagagacaggtcacacaggaagagggccagcagctcgcccggcagctaaaagtcacgtacatggaagcttctgccaagatccggatgaacgtcgatcaggcgttccatgaattggtcagggtaattagaaagttccaggagcaggaatgcccccctagcccagagccaaccaggaaagaaaaagataaaaagggatgtcactgcgtaattttttag

SEQ ID NO: 132152 - DNA, 633 bp, Artificial Sequence
  Description of Artificial Sequence: Synthetic coding sequence
atgggttgctgctcttcctccgacccgagacgcgaggacgacctgagggctcgagaaaagctcaaaaaaaccaagattatttttgtggtgggagggccaggttccgggaaagggacccagtgcgaaaagattgtccagaagtacgggtacacccacttatccacaggcgacctgctacggtccgaagtgtcttctggctctgcacgggggaaaaaactcagcgagataatggagaaagggcagttggtaccgctcgagacagtgctggacatgttaagggacgccatggtagcgaaagtcaacactagcaagggattcctaattgacggctacccccgagaggttcagcaaggggaggagttcgaacgccgaatcggtcaaccaaccctattgttgtacgtggatgcaggtcctgagacaatgacgcagcggctactgaaacgcggggaaacctctggcagagtagacgacaacgaagaaaccattaaaaagcgcctggaaacctattacaaggctacagaacccgtgatcgctttttatgagaagcggggcattgttcggaaagtgaacgctgagggctccgtcgatagtgtgttcagtcaggtgtgcactcacttggatgccctcaaatag

SEQ ID NO: 132153 - DNA, 354 bp, Artificial Sequence
  Description of Artificial Sequence: Synthetic coding sequence
atgccccgcctgttcctcttccatttgctggaattctgcctgctactcaatcagttttctcgtgctgtagctgccaagtggaaggatgatgtgatcaagctttgcggacgcgaactcgtaagagcccaaatcgccatctgtggaatgagtacctggagtaagcggagccttagccaggaagatgctcctcaaactccccgccccgtggctggagattttatacagacagttagcttaggtatcagccccgacgggggtaaagctttgcgtacaggcagttgttttactcgcgagttcctgggtgccctctcaaaactgtatcacccaagtagcacaaagatccaaaaactgtag

SEQ ID NO: 132154 - DNA, 429 bp, Artificial Sequence
  Description of Artificial Sequence: Synthetic coding sequence
atggctaggtacatgcttctcctccttctcgcagtctgggtgctgacaggtgagctgtggcctggggccgaagctcgagcggcaccgtacggagtccggctttgtggtcgcgaattcattcgcgcagtgatcttcacctgtggaggctcacggtggcgcagatccgacattctggctcacgaggctatgggcgatacttttccagatgccgacgcagacgaggacagccttgccggtgaactggatgaagccatggggtcttccgaatggctcgcgttgactaaaagcccccaggccttctaccgggggaggccctcatggcaaggtacccctggtgtgcttcgagggtctcgagacgtccttgctggattgtcatcctcctgttgcaagtggggatgcagtaaaagtgagatctccagcctgtgctag

SEQ ID NO: 132155 - DNA, 1293 bp, Artificial Sequence
  Description of Artificial Sequence: Synthetic coding sequence
atgaagccgtcactgctttgccgccccctcagttgctttctgatgctcctgccttggccactggcaaccctcacgagcactacgttatggcagtgccctccaggggaagaaccggacctggacccgggtcaagggacactgtgccgaccttgccctcctggcaccttttccgcggcctgggggtcctcaccctgccaaccgcacgctaggtgttcgctctggagaagactggaggctcaggtcgggatggccacacgggacactttgtgtggcgactgttggcctgggtggttcggaccgtggggagtgcctcgggtcccttgtcaaccttgctcatgggcacccctgggaacacacgggtgcgacgagtggggacgaagggctcgacgtggagtggaggtggctgccggggctagtagcggcggagagacacgtcaaccagggaacggcactagggcggggggtcccgaagagaccgctgcacaatacgccgttatagcgatcgtgcctgtcttttgccttatgggcctcctcggaatcctcgtctgcaacctcctgaagagaaaaggataccactgtactgcacacaaagaagtgggtccaggtcccggtgggggcggtagcgggatcaacccagcatacaggactgaggacgctaatgaagacaccataggggtgttggtacggcttattactgagaagaaggaaaacgctgccgccctggaagaactcctaaaagaataccactccaagcagctggttcagacctcccacagacccgtgtccaagctccccccggcccctcccaacgtccctcatatttgcccacataggcatcacctgcatacggttcagggtttagcaagcctctcaggtccatgttgttctaggtgctctcagaagaaatggcccgaggtgctcctgtcgcctgaagcagttgccgccaccactccggtccccagtctgttgcctaatcctacacgcgtccccaaagcgggggccaaggcaggtcggcagggcgaaattacaatactgagcgtgggaagattccgagtagcccggattccagaacagaggaccagtagtatggtgagcgaagttaagacaatcaccgaagccggtccgtcctggggagaccttccagacagtccgcagcccggccttccccccgagcagcaggccctgctgggtagtgggggatcacgaacaaagtggctgaaaccccccgcggaaaacaaggcagaagagaatcggtatgtggttcgcctgtctgaatcaaacctggttatatag

SEQ ID NO: 132156 - DNA, 1293 bp, Artificial Sequence
  Description of Artificial Sequence: Synthetic coding sequence
atgaagcctagccttctgtgtaggccactttcctgtttcttaatgctgctcccgtggcccctggcgacacttacttccacaaccttgtggcagtgtcctcccggagaggagcccgacctggatccagggcaagggacactctgtagaccatgtcccccgggcaccttctcggcagcgtggggtagcagtccttgtcagccacacgccaggtgttccctgtggagacgcttagaggcccaagtcggcatggctaccagagataccctctgcggagattgttggccagggtggtttggcccctggggagtgccccgggtgccctgccagccttgttcatgggcacctctgggaacccacgggtgcgacgaatggggccgcagggccaggagaggagttgaggtcgcagcgggagcaagctctgggggcgagacaaggcagccaggtaatggtacgcgggccggcggccccgaggagacagcagcccagtatgccgttattgcaatagtaccggtgttttgtctgatgggccttcttggaatactggtatgcaatttactgaagagaaaagggtatcattgtaccgcccacaaggaagtaggtcctggccccggcggaggagggagcggcatcaatcccgcttaccgcaccgaggatgctaatgaagatacaatcggagtgttggttaggctgataacagaaaaaaaagaaaacgcagccgcactggaggaacttctcaaagaataccactcaaaacagctggtccaaacctctcaccggccagtgtccaaactgcccccagcacctccaaacgttcctcacatttgcccccacagacatcacctgcataccgtgcagggtctcgcctcactgagcggaccctgctgcagtagatgcagccagaagaagtggcccgaagtgctactgtcacccgaggcggtggcagcaacaacccccgtgccctcccttctccccaaccccacgcgtgttcctaaggccggtgctaaggcggggaggcagggcgaaataaccattctgagcgtgggacgttttcgcgtcgccagaatccccgagcagaggacttcttctatggtgtcagaggtcaagacgataactgaggcgggaccctcttggggagaccttccagacagccctcagcccggattgcctcctgagcagcaagccctcttggggagcgggggttccagaaccaaatggcttaagccaccagctgagaataaagcagaggagaatagatacgttgtccgcctcagtgaaagtaacctggtcatatag

SEQ ID NO: 132157 - DNA, 897 bp, Artificial Sequence
  Description of Artificial Sequence: Synthetic coding sequence
atgcatcccgggtgctgggtgcaggaggctctagtgttaaatcacgagggtgacatgggcttctccgagcctggttcgcacatttgtcgagccctaggtggcctttctcctaagtgtacttgttctggccctcttaggagacctgggctgccctcagccggccggtcttggttcagctctggcgtgcgattacccccgagtcctggcagcggcccctttagcagtccaggaataaaccccgcttatcgaacagaagacgcaaatgaggacaccatcggggtgctcgtcagactaattaccgaaaaaaaagagaatgcagccgctctagaagaactgctgaaagagtatcactccaagcagctcgtccagacctctcacagaccagtatctaaactgccaccggcccccccaaacgtgccacacatttgcccccataggcaccatcttcataccgtccagggcttggcctcactaagtgggccttgctgctcgagatgctctcaaaagaaatggcccgaagtgttgttgtccccagaagccgtggctgctactacccccgtgccgtctcttctccccaatcccacaagagtccccaaggccggtgcaaaagcaggccggcagggagaaatcacgatcctttccgtgggtaggtttcgcgttgccagaatccccgaacagcgcacgtctagtatggtcagcgaagtaaaaaccattactgaggcaggcccttcctggggtgacctccctgactcccctcagcccggcctgccacccgagcagcaggcactgcttgggtctggcggaagcagaacgaaatggctaaaaccgccagctgaaaataaggctgaggaaaatcggtatgtggtgcgcctgtccgaatctaacttggtaatttag

SEQ ID NO: 132158 - DNA, 306 bp, Artificial Sequence
  Description of Artificial Sequence: Synthetic coding sequence
atgaagcccagcctgctgtgtcgccccctctcttgcttcctgatgctgctcccatggccactcgcgacactgacatcgacgacgctgtggcagtgcccccctggcgaggagccagatctggatcccggccaaggcaccctgtgccgaccttgtccacccgggacctttagcgcagcttgggggtcatcaccctgccagcctcatgctagatgttccttatggagaaggcttgaagctcaagtgggaatggcaacccgagataccttgtgtggagactgctggccaggctggttcggaccatggtag

SEQ ID NO: 132159 - DNA, 4326 bp, Artificial Sequence
  Description of Artificial Sequence: Synthetic coding sequence
atggccacagctgctgccgcagccgccgtcatggcaccacctgggtgtccaggttcctgcccaaacttcgccgtcgtatgcagcttccttgaacgatatggccctcttttggaccttcccgaactcccctttccagagttggagcgtgttctccaggctccccctccggacgttggtaatggggaagtgccgaaggaactagtggagttacatcttaagctgatgagaaagatcggcaagagcgtgaccgcagaccgctgggagaaatacctaattaagatttgccaggagttcaactctacatgggcttgggagatggaaaagaaggggtatttggaaatgtcagttgaatgcaaactggctttattgaagtacttatgcgaatgtcagtttgatgacaaccttaagtttaaaaatatcataaacgaagaggatgccgatactatgcgactgcagcccattggcagagacaaagacggcctgatgtactggtaccagctcgatcaagaccacaatgtccgtatgtatattgaggagcaggatgatcaagatggttctagctggaagtgtatcgtcagaaaccgcaatgaactcgctgagacactcgcattgttgaaagctcaaatcgaccccgtgttgctgaagaacagctcccagcaagataactccagccgagagagcccaagtttggaggatgaagaaaccaaaaaagaagaggaaactccgaagcaggaagagcagaaagagagcgaaaaaatgaaaagcgaagagcagccgatggacttagagaaccgaagtactgcgaatgtcctcgaagagacaaccgtgaaaaaagaaaaagaggacgagaaagagctggttaaacttccggtcatagtgaagttggaaaaaccattacctgagaacgaggaaaaaaaaattatcaaagaggaatccgatagtttcaaagaaaacgtgaaacccataaaggtggaagtgaaggagtgtcgggcagaccctaaagacaccaagagttccatggaaaagccagtggcgcaagagccggaaagaatcgagtttggcggtaacatcaaatccagccacgagatcactgaaaagtctactgaagagaccgagaagctgaagaacgaccaacaggcgaaaatacccttgaagaagcgggaaataaaactcagcgacgacttcgacagccccgtgaagggacccctgtgtaagagtgtgaccccaacaaaagaattcctgaaggacgagattaagcaagaggaagaaacttgcaagagaatctcaactataactgcattggggcacgaagggaagcagctcgtaaacggcgaagtttcggatgaacgagtggcccccaattttaaaacagagcctatcgagactaaattttacgaaacaaaggaagaaagctactctccatctaaggatcggaatattatcaccgagggaaacggcacggagagtctgaactctgtcattacctcaatgaaaacgggcgagttggaaaaggaaaccgcacctctccgaaaggacgccgactcttcaatcagcgtgctagagatacattcacagaaagcgcagatagaagagcccgacccacctgaaatggagacatcacttgattcatccgagatggctaaggatctgtcgagcaaaacggccctatcctcaacagaatcatgtaccatgaaaggcgaggaaaaatcgcccaaaaccaagaaggacaagcggccgcccatactcgagtgtctggagaaactcgagaaaagcaaaaagacctttctcgacaaggacgctcagcgtctatctcctatccctgaagaggtgccgaagtccacactggaatccgagaagccaggttcaccagaggctgctgagacctccccaccctccaatatcattgaccattgcgagaaactggcctcagagaaggaggtcgtggagtgccaaagcaccagtacagtgggcggccagtcagtgaaaaaagttgacttagagaccctcaaggaggactccgagttcactaaggtcgagatggacaatctggacaatgcgcagaccagtgggattgaagagccctctgaaaccaagggatccatgcagaagagtaagtttaaatacaagctggtgcctgaagaagagactaccgcctcagagaataccgaaatcacctctgaacggcaaaaggaggggatcaaactgaccatcagaatctcttcaagaaagaaaaagcccgattctcctcctaaagttctggagcccgagaataaacaggagaagacagagaaggaagaagagaagacgaacgtgggcaggactttgagacgatcgccacggattagccgccccacagccaaggtcgcggaaataagggatcagaaggctgacaagaagaggggagaaggtgaggatgaggttgaggaagagtccaccgctcttcaaaaaacagataagaaggaaatccttaagaaatccgagaaggacaccaacagcaaagtcagcaaagtgaagcccaagggcaaggtgagatggaccggctctaggactcgcggaaggtggaaatacagttctaatgatgaaagtgaaggctcaggaagcgaaaaaagctccgcagcgtccgaggaggaggaagagaaggaatccgaggaggctatcttggccgacgatgacgagccatgcaaaaagtgtgggttgcctaatcaccctgaattaattctgttatgcgactcttgcgacagcgggtaccacaccgcctgcttgagacctcccttgatgatcatacccgacggggagtggttttgtcctccctgtcagcacaagctgctctgcgagaaattggaagagcagctgcaggatcttgatgtcgccttgaaaaagaaagagagggccgagcgccgcaaggagagattagtgtatgtgggaatctctatagagaatatcattccaccacaggagcctgatttttcagaagatcaggaggaaaaaaaaaaagattctaaaaagtcaaaagccaatctcctcgagcggcgatctacaagaaccagaaaatgcatcagttaccggtttgacgagttcgacgaggccattgacgaggctatcgaagacgatattaaggaggccgatggaggcggagtggggaggggcaaagacatatccacaatcaccggtcatagaggaaaagacatttctaccatcctcgatgaagaaaggaaagagaacaaacggccccaacgcgccgctgcggcccgccggaaaaaacgcaggcgccttaacgacctcgactctgactccaatcttgatgaggaagaaagcgaggatgaattcaagattagcgacggctcacaggatgaattcgtagtgagcgatgagaacccagacgaatccgaggaggaccccccgtcaaacgacgacagcgacaccgacttctgctcccgaagacttagacgccatccctctagaccgatgagacagtcgaggcgcttgaggagaaagaccccgaaaaagaagtattccgacgacgacgaggaggaagaatcagaagagaactctagagattccgagagcgatttctctgacgatttctctgacgacttcgttgagacaagaaggcgcagatcaaggagaaatcaaaagaggcagattaactataaagaagactctgagtccgacggatcacagaaatccttgcgccgtggcaaggagataaggagggtgcacaaacgccggctgagttcctcggaatccgaggagtcatacctttcgaagaactctgaggacgatgagcttgcgaaagaatcaaaaagatccgtccgtaagcgcggccggagcactgacgaatattccgaagcagacgaggaggaggaggaagaggagggcaagccgtccaggaagcggctacacaggatagagaccgatgaggaggaatcctgtgacaatgctcacggagatgccaaccagcctgcacgtgacagccagccgcgggttttacccagtgaacaggaatccacgaagaagccctatcgcattgagtcggacgaagaagaggattttgagaatgtcggcaaagtgggatccccactagactattcactggtagacctgccaagtacgaatggacagtcacctggaaaggcgattgagaacctcatcggcaagcccacggaaaaaagccaaaccccgaaagacaattcgacggccagcgcatctctggctagcaatggcacttctggcggccaggaagctggggccccagaggaggaagaagacgagctgcttagggttacagatctcgtcgactatgtttgcaattctgagcagctgtag

SEQ ID NO: 132160 - DNA, 4233 bp, Artificial Sequence
  Description of Artificial Sequence: Synthetic coding sequence
atggcaaccgctgcagctgccgcagccgtgatggcaccccctgggtgcccaggatcatgtccaaatttcgccgtcgtgtgcagctttctagagaggtatggccctttgctagacctgcctgagcttccattccctgagttggagcgcgtgctgcaggccccaccaccggatgttgggaacggtgaagtgcctaaagaattagtggaactgcatctaaaattaatgcggaaaatcgggaaatccgtgaccgcagatcgctgggagaagtacctgattaaatacctttgtgagtgccagttcgacgataacctgaaatttaaaaacatcatcaatgaagaagacgccgataccatgaggctacagcctatcggcagagataaggatggtcttatgtattggtaccagcttgatcaggatcacaatgtgcgcatgtacatcgaggaacaagatgatcaggacgggagcagctggaagtgtatcgtgcgaaatagaaacgaattggcagaaaccctggccctgttgaaggcacagatcgaccccgttttactgaagaactcttcacagcaggacaactcctctcgcgaaagccccagcctggaagacgaagagaccaagaaagaggaagagactcccaagcaggaagagcaaaaggagagtgaaaagatgaaatcagaggagcagccgatggacctggagaaccgctcaacagccaatgtgctagaggagactacagtgaaaaaagaaaaggaagatgaaaaagagcttgtgaaactgcctgtcatcgttaagctagagaagcctctgcctgagaacgaggaaaaaaagatcatcaaggaagagtctgattcttttaaagagaacgtgaagccaatcaaggtggaagttaaggaatgtagagcagaccccaaagacactaaatctagcatggaaaagcccgtcgcccaagaaccggagcgtatcgagttcggcggcaatatcaaatcctctcatgagatcactgagaaaagcactgaggagactgagaaactcaaaaatgaccagcaggcgaagatcccactgaaaaagagggagatcaagcttagcgacgattttgatagccccgtgaagggaccactttgtaagagcgtcacacccaccaaagagtttttaaaggatgagataaaacaggaagaagagacttgtaaaaggatcagcactatcacggccctaggacacgagggtaagcagcttgttaacggtgaggtgagcgatgagcgggtggccccaaactttaagacggagccgattgaaaccaagttttatgagaccaaggaggaatcctattcccctagcaaagaccggaatattattactgagggtaacggtacagagtctctaaactccgttatcaccagcatgaagaccggagagttggagaaagaaactgccccgctgcgtaaagacgcggatagcagcatctcagtgctggagattcattcccaaaaagcccagatcgaagagccagatccgcctgaaatggaaacatcgctcgatagttcagaaatggcaaaggacctgtcttccaaaactgcactaagttccacagagtcctgtaccatgaagggggaagaaaagtctcccaagaccaaaaaggacaagcgcccaccaattctcgagtgtttggaaaaactggaaaaatccaagaaaacatttctggataaggacgcccagagactctcacccataccagaggaagtgccaaagagtaccttggagagtgagaaacctggaagtcctgaggccgcagaaaccagtcccccttcaaacatcattgatcactgtgaaaaactggcatcagaaaaagaagtggtggaatgccagagcaccagtactgtgggaggccaaagcgtgaaaaaagtagatctggaaaccctaaaggaagattcagagtttactaaggtcgagatggataatctggacaacgcccaaacgtccggtatcgaggagccctcagagacgaagggcagtatgcagaagtctaaattcaagtacaagctagttcctgaagaggagactacagcgtcagaaaatacagagattacctccgagcgtcaaaaagagggaattaaactgacgatccgaataagctcaaggaaaaagaagccagactcaccacctaaggttttggagcctgagaacaaacaggaaaagacagagaaggaggaggagaagaccaacgtggggcgtaccttgcgtaggtctccaagaataagtagaccaacagccaaggtggcggagatccgtgaccagaaagccgataagaagcggggagagggcgaggacgaagtggaagaggagagcactgcgcttcagaagaccgataaaaaggagattctgaagaaaagcgagaaagatacgaattccaaggtgtcaaaagtaaaaccgaagggtaaagttaggtggacgggatcccgtaccagaggcagatggaagtattcatcgaatgacgagtccgagggttctggtagcgaaaagtcatcagccgcgtcagaagaggaggaggagaaggagtccgaggaggccatcctggcggacgatgatgagccttgtaaaaagtgtggcctgccaaaccatcctgaactgatccttctgtgtgattcttgtgattccggctatcacacagcatgcctgaggcctcccctgatgatcatccccgatggagaatggttttgccctccctgccagcacaagctcctgtgcgagaagctagaagaacagctgcaggatcttgacgtggccctgaagaagaaggaacgcgctgagaggcgcaaggaacgcctggtatacgtaggaatctccattgaaaatatcatcccaccacaagaacctgatttcagtgaggaccaggaggagaagaagaaggatagcaagaaaagcaaggctaacctgctagaacgccgcagcactcgaactcggaaatgcatatcttatcggtttgatgagtttgatgaggccattgatgaagctattgaggacgatattaaggaagccgatggcggtggagttggccggggaaaagacatcagcacaatcacaggccacaggggaaaggacatctcaactatactggatgaggaacgcaaagaaaacaagcgcccccaaagggctgcggccgcccgtcgaaagaaaaggagacgcctgaacgacctcgattctgactcaaacctggacgaggaggagagtgaggacgaattcaagattagcgatggttcacaggacgagttcgtagtttcggacgaaaaccccgacgagtctgaggaggatccaccgagtaatgacgactctgacaccgatttttgcagcaggcgcttaagacggcacccctctcggcctatgcgccagagcaggagactcaggcgaaagactcccaagaagaagtattctgacgatgatgaagaggaagaatccgaagagaatagcagggactccgagtcggactttagtgatgacttcagtgatgacttcgtggagacccgccgtcgacggtcacgaagaaaccagaaaaggcaaattaattataaggaagactccgaatctgacggctctcagaagtccttacgcaggggaaaagagatccggagagtgcataaaaggcggctgagctctagtgaaagtgaggaatcttacctatccaagaattccgaagacgacgaactggccaaagagtctaaaagatcagtccggaagcggggcagatctacggacgaatatagtgaggctgatgaggaggaagaggaggaggagggaaaaccttctagaaaaagattacatagaatcgaaactgacgaggaagaatcctgtgacaacgcccatggtgacgctaaccaacctgctagagattctcagccacgcgtgttgccttcggaacaggagtctactaaaaaaccttaccgcattgaaagcgatgaggaagaagattttgagaacgtgggtaaggttggttcccccctggactacagtctagttgacctgcccagtaccaatggccagtcaccaggtaaagccattgaaaacctgattggcaaacccaccgagaagtctcagacgcccaaggacaactcaactgcatcagcttctctggcctctaacgggacatctggaggacaagaagccggcgcaccagaagaggaagaagatgagctactacgggtgacggaccttgttgattacgtatgtaattcagaacagctttag

SEQ ID NO: 132161 - DNA, 3570 bp, Artificial Sequence
  Description of Artificial Sequence: Synthetic coding sequence
atgaagtcagaagagcaacctatggacctggagaaccgcagtaccgccaatgtgctggaagaaactacggtgaagaaagagaaagaagatgaaaaagaactggtcaagcttcccgttattgtcaaattagaaaagcctcttcccgagaatgaagaaaaaaaaataatcaaagaggaatctgattcatttaaggaaaatgtgaagcctataaaggtggaggtaaaggagtgcagggcggatccaaaggacactaagtcctcaatggagaaacccgtcgcccaggaaccagaaaggatcgaattcggggggaatatcaaatcaagccacgagattaccgagaagagcacggaggaaacagagaaattgaagaatgatcagcaggctaagattcccctgaagaagagggaaattaagttaagcgacgattttgatagtcccgtaaaagggcctttgtgcaagtcagtgacaccaactaaagaatttctgaaggacgaaattaagcaggaggaggagacatgcaaacggatcagcaccattactgctctgggccacgaaggcaagcagcttgtgaatggggaagtgagcgacgaacgcgtcgcgccaaacttcaaaacagagccaatcgagactaagttctacgagacaaaggaagaatcgtatagcccatccaaggatcgcaatattatcacagagggtaacggaacggagtcccttaacagcgtgatcacttcaatgaaaacgggcgagcttgagaaggagaccgcaccattgcgaaaagatgccgattcctccattagtgttttagagatccactcacagaaggctcagatcgaggagcctgaccctcccgaaatggagacatcgctcgacagctctgaaatggccaaggatctaagttccaagaccgcattgtctagcactgaatcttgtacaatgaaaggagaggagaagagtcctaagactaaaaaggacaaaaggcctccgatactcgaatgcctggagaagctagagaaatcaaagaaaactttcttagacaaagacgcgcagagactgtcccccatccctgaggaagttccaaagagcacgctcgaaagcgagaagccagggagtcctgaagctgcagagactagtcccccaagtaacatcatcgaccattgtgaaaagctggcatctgagaaggaggtggtagaatgccagagcacctccaccgtgggcggacaaagcgttaaaaaagtggatctggaaacccttaaagaagattccgagtttactaaagtggaaatggataacctggataacgcgcagaccagtggtattgaggaacccagtgagactaaggggtccatgcaaaaaagtaagtttaaatataaactcgtgcctgaggaagagaccaccgctagcgaaaacaccgagattacatctgaacggcagaaagaaggcatcaaactgactatacggatcagcagtcgcaaaaaaaaacctgacagtcccccaaaggtgctggagccggaaaacaagcaggaaaaaacagaaaaagaagaggagaaaactaacgtggggaggacattacgcaggagtcccaggatcagccgaccgactgccaaagtggccgaaataagggatcagaaggctgataaaaaaagaggcgagggtgaggacgaggtggaagaggagagtacagcactgcagaagaccgacaagaaagaaatcctcaagaagtccgagaaagacacgaactctaaagtttcaaaggtgaagcccaagggaaaggtgcgttggacgggctcgcgcacccgaggcaggtggaaatactcttctaatgatgagagcgagggtagtggttccgaaaaaagcagcgctgcctcagaggaggaggaggaaaaagagtccgaggaagccatactggccgatgacgatgaaccgtgcaagaaatgtggcctgccgaatcatccagaactgatcctgttgtgtgacagttgtgatagcggctatcacaccgcgtgtctaagaccacctctgatgatcatccctgacggcgagtggttttgccctccatgtcagcacaagctgctgtgcgaaaaactggaagagcaacttcaggacttagatgttgctcttaagaagaaggaacgggccgaacggcgaaaggagaggctcgtctatgttggcatatcaattgaaaacattatcccccctcaggagcctgacttcagtgaggaccaggaggaaaaaaagaaggactccaagaagtccaaggcaaatctcctggagcgacggtccacgaggacccggaaatgcataagttataggtttgatgaattcgacgaggctatcgatgaggctatagaggacgacattaaggaagccgacggcggcggcgttggcagaggtaaggatatctcaaccatcaccgggcatagaggcaaagatatatcaacgatactggatgaggagagaaaggagaataaacgaccgcagcgggccgctgcggcacgcaggaaaaaacgaagaagacttaacgatctcgattccgatagcaatctggacgaggaagagagcgaggacgaatttaaaatctcagatgggtctcaagacgagtttgtcgtgtctgacgaaaacccagatgaatcagaagaggaccctccatccaacgacgatagtgatacggacttctgttctagaagattgcggagacacccttctcgcccaatgaggcaatctagaaggcttcgtcgtaagacccctaagaagaagtacagcgacgatgatgaggaagaggagagcgaggaaaacagtagggacagcgagagtgacttttcagatgacttctcggacgatttcgtggagacgagaagacgaaggtccaggcgaaaccagaaaaggcaaattaattacaaagaagatagtgagtccgatgggtcgcaaaagagtctgagaagagggaaggagataaggcgggtccataaacgacgtctttcgtcatcggaaagcgaggagtcgtacctttccaagaacagtgaagacgatgagctggccaaagaatccaagcggtccgtaaggaagagaggaagatccactgacgagtattcggaggctgatgaagaagaggaagaggaagaggggaagcccagccggaagcggttacacaggatcgagactgacgaggaggagtcatgtgacaacgctcacggtgatgccaatcaacctgctcgcgattcccagcctagggtgcttcctagcgaacaagaaagcacaaaaaagccctatcgtatcgaatcagatgaagaggaggactttgagaatgtggggaaggtggggtcgccactggactacagtctcgtggaccttcccagcactaatggacagagcccaggaaaggcaatcgaaaatctcatcggaaaacccactgaaaaatcacagacacccaaggacaacagcacagctagcgcgagcctggcaagtaacgggacttccggcggacaagaagctggagccccagaagaagaggaagatgagctcctccgggtgacagatctggtggactatgtgtgtaattctgaacagctgtag

SEQ ID NO: 132162 - DNA, 2412 bp, Artificial Sequence
  Description of Artificial Sequence: Synthetic coding sequence
gaaacccttgctttgttgaaggcacagattgacccagtacttcttaaaaattcctcccagcaggataacagtagcagggaatcaccatccctggaagatgaggagaccaagaaagaggaggaaaccccgaaacaggaggagcagaaagaaagcgagaagatgaagagcgaggagcagccaatggacctggagaacaggtctacagccaacgtgttagaagaaacaaccgtcaaaaaggaaaaagaagatgagaaagaactcgtcaaactgccagtaattgtgaagctagagaaacctctgcctgagaacgaggagaagaagattatcaaggaggaatccgattcctttaaggaaaacgtcaagcctattaaagtggaggtcaaagaatgtagagccgatccaaaagacaccaagagctcaatggagaagcccgtagcccaagaacccgagaggattgagtttggaggaaatatcaaaagctcacatgaaatcactgaaaaatccaccgaggaaaccgaaaagcttaaaaacgaccaacaggctaagattccgcttaagaaaagggaaatcaagttgagcgacgacttcgactcaccagtcaagggcccgctttgcaagagcgtcaccccaaccaaagagtttctaaaggacgagatcaaacaagaagaagagacatgcaagagaatatctaccattacggcattgggacacgagggaaagcaactggttaatggcgaagtgtctgatgagcgcgtcgcacctaatttcaagactgagcctattgagacaaaattctatgagaccaaggaagaatcttattctccatcaaaggataggaatataatcaccgaaggcaatgggactgagtccttgaattccgtcattacgagcatgaaaacaggtgaactagaaaaagaaaccgcaccactcagaaaagacgcagacagctcgatctctgtcctggaaattcattcccagaaggctcaaattgaggagccagacccgcccgaaatggagacatccctggactccagcgaaatggccaaagatctgtctagcaagacagcgctatcttccacggagtcttgcaccatgaagggcgaggagaagagcccaaaaacgaaaaaggacaagaggccacctattctagagtgtttggagaaactggaaaaaagcaagaagactttcctcgacaaagatgcccaaagattgtctcccatacctgaggaggtccccaaatctacactggagtccgaaaaaccagggagcccagaagctgccgagactagtccaccttccaatattatcgatcactgcgaaaaactggctagcgagaaagaagtggtcgagtgccagtccaccagtaccgtcggcggccagtctgtaaagaaggtggaccttgaaacactcaaagaggactcagagttcaccaaagtggagatggacaacctcgataacgcacagactagcggaattgaagagccttctgagacaaaaggatcaatgcagaaatcgaagttcaaatataagcttgttcccgaagaagagaccacagcgagtgaaaacactgagatcacatccgaacggcagaaggaaggcattaaactgactattagaatctcctcccggaagaaaaagcctgacagtccccctaaggtactcgaaccagagaacaagcaggaaaagacagaaaaggaggaagagaagactaatgtcggtcgtacgctacggcgctctcctcggattagcaggcccacagccaaggtggccgagatccgggatcagaaagccgacaaaaaacggggagaaggtgaggatgaagtagaggaggagtccacggccttgcagaaaactgacaagaaggagattttgaagaaatccgagaaggacacaaacagtaaggtttccaaggtgaaacccaagggcaaagtacggtggaccggctcacgaacacgtggaaggtggaagtactcttccaacgatgagtccgaagggagcggttctgagaaatcaagtgccgcttctgaagaggaggaagagaaagaatcagaggaggctattctcgccgacgacgacgagccttgcaaaaaatgcggactgcctaaccatcccgaactcattctcttatgtgactcctgcgattctggttaccacaccgcttgtctccgccctccactgatgattatcccagacggggagtggttctgtcccccatgccagcacaagctcctttgcgagaagctagaggagcaactgcaggacctggatgtggctcttaaaaagaaggagcgagctgaacgccgaaaggagcgtctggtctatgtggggattagcatcgagaatatcattccccctcaggaacccgatttcagtgaagaccaggaggagaaaaagaaggactctaagaaatag

SEQ ID NO: 132163 - DNA, 2109 bp, Artificial Sequence
  Description of Artificial Sequence: Synthetic coding sequence
gcaaccgcagcagcagccgccgctgtgatggccccaccaggctgtcccggctcttgtcctaatttcgcagtggtctgttctttcttggaaaggtacggccctcttctcgacctgcccgagctgccttttccagagctcgaacgcgttctccaggcaccgccaccggacgttgggaatggtgaggtcccgaaggaactggtagagttgcacctaaagctgatgcgcaaaattggtaaatcggtgactgctgaccggtgggagaaatatctgattaaaatctgccaagaattcaacagcacctgggcatgggaaatggagaagaagggatatctggagatgagcgtggaatgcaagcttgccttactgaaatacttgtgtgaatgccaattcgacgacaacctgaaattcaagaatatcattaacgaggaggatgccgatacaatgaggctgcagcctataggacgtgacaaggacgggctgatgtattggtatcagctcgaccaggaccataatgtgcgcatgtatattgaggaacaagatgatcaggatggctctagctggaagtgtattgtgagaaatcgaaacgagctggctgagactctggccctactcaaagcacagattgaccccgtcttactgaagaactcgagtcaacaggacaactcctcccgagaatcaccatccctcgaggatgaagagacaaaaaaagaggaggagacccccaagcaggaggagcagaaagagagcgaaaagatgaagagcgaggagcaaccaatggaccttgaaaaccgatcaacggctaacgttctcgaggagacaacggtaaagaaagaaaaggaagacgagaaagagttggtgaagttgccagtcattgttaagttagaaaaacctctgccagagaacgaggagaagaaaatcatcaaggaagagtccgacagctttaaggagaacgtgaagccaattaaagttgaggtgaaggaatgcagagcggatcctaaagacaccaagagctctatggaaaagcctgtcgcccaggagcccgagaggatagaattcgggggcaatattaagtcaagtcacgaaataacagaaaagtctaccgaagagaccgaaaaacttaaaaatgaccaacaggctaaaattcctctgaagaaacgtgagattaagctgtcagatgattttgactctcccgtaaagggcccattgtgcaaatcggtcactcctaccaaagaattcctgaaggatgagattaaacaagaagaggagacttgcaagcgcatctctacaattaccgcactggggcatgaaggaaagcagcttgttaatggagaggtctcagatgagagagtggcccccaacttcaagacagaaccaattgagactaaattttatgaaactaaggaggagtcttacagcccaagtaaggataggaatattattacggaaggcaacggaaccgaaagcctcaattcggtcataacatctatgaaaaccggggaactggaaaaggagaccgctccactacgtaaagacgcagacagctcaatcagcgtgctcgaaatccacagtcagaaagcccagatagaggagcccgaccccccggaaatggagacctcccttgacagttcagagatggccaaggatctgtcatcgaagacagccctcagctctaccgagtcctgtaccatgaagggcgaggagaagagccctaagaccaagaaggacaagcggccacccattctcgaatgcctggaaaaacttgagaaatcaaaaaaaacatttctggacaaagatgctcagagactctcccccatccccgaggaggtcccaaaatccaccttggagagtgagaagccaggctcaccagaggcggccgaaaccagcccccctagtaatattattgatcactgcgagaagctggccagcgaaaaggaggtcgtggaatgtcaaagcaccagtaccgtgggtggacagagcgtcaaaaaggttgacctggaaaccctgaaggaggacagtgaattcaccaaggtcgagatggataacttagataatgcgcagacctctggcattgaggagccaagcgagaccaagggctcgatgcaaaagtag

SEQ ID NO: 132164 - DNA, 831 bp, Artificial Sequence
  Description of Artificial Sequence: Synthetic coding sequence
gaaccctgcaagaagtgcggcttgccaaaccaccccgagcttatactcttatgcgactcctgcgattccggctaccacacagcctgtctccgccctccactcatgattatcccagatggcgagtggttctgcccaccgtgccagcataaactgctgtgtgaaaaacttgaggagcagcttcaggacctggacgtggctctgaaaaaaaaggagcgagcagagaggcgcaaagagcggctggtgtacgtggggatcagcattgaaaacatcattcccccccaagagcctgacttttccgaagaccaggaggagaagaagaaagattccaagaaaagcaaagccaacctgctcgaacgaagatcaaccagaacacgcaagtgtatttcctaccggttcgacgaattcgacgaagccatcgacgaggcgatcgaagacgatataaaagaagctgatggcggaggggtggggcgaggcaaagacatatccacgatcactgggcacagggggaaggacatttcaactattctggacgaggagaggaaagagaataagcggcctcagcgcgcagctgcagcgcgccggaaaaaaaggagaagattgaacgaccttgactccgactcaaacctcgacgaggaggaaagtgaagatgaattcaagatttccgatggttcacaggatgagttcgtagttagcgacgagaatcctgacgagtccgaggaggatcctccctctaacgacgatagcgatacagatttctgttcccgtcgcctgcggagacaccccagcaggcctatgcgccagtctaggaggctgcgccggaaaacaccatag

SEQ ID NO: 132165 - DNA, 1029 bp, Artificial Sequence
  Description of Artificial Sequence: Synthetic coding sequence
atggcacaggtgttgatcgtgggtgccggaatgacaggatccctctgcgcagccctactccggcgccagacttccggacctctctatctcgccgtatgggacaaggcagaggactcagggggcagaatgaccacagcatgtagcccacataacccgcagtgtaccgctgacctcggggctcagtatatcacttgtacgccacattacgccaaaaagcatcagaggttctatgatgagctgttggcatacggcgtgttgagaccgctctcgagtcctatcgaaggcatggtgatgaaggaaggagactgcaacttcgtggccccacaggggatcagcagcatcataaaacattatctgaaggagtccggagccgaggtttactttaggcatagagtaacgcagattaacctgagggacgataaatgggaagtgagtaaacagacaggaagtcctgagcagttcgacctgatagtgctgacgatgcctgtcccagagatcctgcagctccagggcgacatcacaactctcatctcggagtgccagagacagcagctcgaagctgtgagctatagtagtcgctacgccctgggattattctacgaagctggaactaaaatcgacgtgccgtgggccggccaatatataacctcaaacccatgtattcgtttcgtgtcgatcgacaacaaaaagcgcaacatcgaatcatcagaaattggaccgtctttggtgatccatacaacggtaccttttggggtcacctatttggagcatagcatagaggacgtgcaggagctggtgtttcagcaactggagaatatcctgcccggattgccccagccaatcgccactaaatgccagaaatggcgccattctcaggttactaacgctgcggccaactgccctggccaaatgacactgcatcacaaacctttcctggcctgtggaggagatggctttacgcagtccaatttcgatggatgtataacttctgccctgtgcgtgttggaggcattgaagaattacatttag

SEQ ID NO: 132166 - DNA, 948 bp, Artificial Sequence
  Description of Artificial Sequence: Synthetic coding sequence
atggcccaagtgctaatcgtaggagccgggatgacgggaagcctgtgcgctgccctcctgcgcaggcagacgtctggaccactgtaccttgccgtttgggataaggcagaggactccggcggccggatgacaaccgcctgctctccacataacccccagtgcacagccgacctgggggcccaatacattacttgcacccctcactacgctaagaaacaccagagattctacgacgagttattagcttatggcgtgctcaggccattgtcaagtccaattgaagggatggttatgaaggagggagattgtaacttcgttgccccacagggcatctcatctataataaagcattacttgaaagagtctggagctgaggtctacttccgacaccgggtgacacagatcaatctccgggacgacaaatgggaggtgagtaagcagaccggctcccctgaacagtttgatctgatagtgctcacaatgcccgtcccagaaatactgcagcttcagggcgacatcaccactctcatcagtgagtgccagcggcagcagctcgaggcagtatcctacagctctagatatgcccttggactattctacgaggccggtacaaagatcgacgtcccttgggcaggacagtatatcacgagcaacccctgcatccggtttgtgtccattgataataagaaacgcaacatcgaaagtagtgagatcggccctagtctggtcatccacaccaccgtaccctttggggtaacttatctggaacactctatcgaagacgtgcaagaacttgtcttccagcagctggagaacattctcccaggattaccacagcctatcgcaacgaagtgtcaaaagtggaggcactctcaggttcccagtgcgggagtcattctagggtgtgctaagtccccatggatgatggccattggcttccccatttag

SEQ ID NO: 132167 - DNA, 699 bp, Artificial Sequence
  Description of Artificial Sequence: Synthetic coding sequence
atggcccaggtgcttatcgtaggtgccgggatgacgggctcactctgtgcagctctcctgcgccggcagacatccggcccactctacctggctgtttgggacaaggcagaggactctggtgcggaggtctacttccgccatagggtaacccagatcaacctgcgcgatgataagtgggaggtatcaaagcagaccgggagccctgaacagtttgacttaattgtcctaacgatgccagttccggagatactccagctgcagggggatatcaccaccctcatcagcgagtgccagagacagcagctggaggcggtctcctatagcagtaggtatgccttgggactcttttacgaggcaggaaccaagatcgatgtcccctgggctggacagtacataacaagtaatccctgtatcaggtttgtctctattgacaacaagaaaaggaatatagagagtagcgaaattgggccctcactggtaatccacactacagtaccctttggagtgacctatttagagcactctattgaagatgtgcaagaattggtatttcagcaactcgagaatatcctgccaggcttgccccagcccattgccaccaaatgccagaaatggagacatagccaggtaccctccgctggagtaatcctcggatgcgccaaaagtccatggatgatggcgatcggcttcccaatatag

SEQ ID NO: 132168 - DNA, 1221 bp, Artificial Sequence
  Description of Artificial Sequence: Synthetic coding sequence
atggatggatggcgcagaatgccgaggtggggtctgcttctgttgctttggggatcctgtactttcggtctcccgacagacacaaccaccttcaagaggatctttctgaaaagaatgccaagtattcgagaatccctgaaggaaaggggcgtggacatggcccgccttggacctgagtggagccagcctatgaagcggctcacactgggaaacacaacatcgtccgtcatattgactaactatatggatacacagtactacggggagataggaattgggaccccaccacagacattcaaggtcgtgttcgatactgggtctagtaacgtctgggtaccatcctctaagtgttcaaggttgtatactgcttgcgtgtaccacaagctttttgacgcctctgattcaagttcttataaacacaacgggaccgagctgacactacgctacagtactggaaccgtgagcggcttcctgtcacaagatattataacagtgggcggcattactgtgacccaaatgttcggggaagtgacggagatgccagctctgcccttcatgctcgctgaattcgatggggtagtgggtatgggcttcattgagcaggccattggcagagtcacacctatctttgacaacattattagtcaaggggtgctgaaggaggacgtcttcagtttctattataaccgcgattccgagaactctcagtctctcggcggtcagatagtcttgggcggttcagatccacagcactacgagggcaattttcactacatcaatttaattaaaacgggagtctggcagattcagatgaagggagttagtgtaggttctagtactctgttatgtgaggatggctgcctggcccttgtcgatacaggcgcctcatacatcagcggcagcacaagctcaattgaaaagctgatggaagcattgggcgccaagaaaagattgttcgactacgtcgtcaagtgtaacgaagggcccaccctgccagatattagctttcatttgggaggaaaggaatacaccctcacgtcagcggactatgtgtttcaggaaagttatagctccaaaaagttgtgcacgctggctatccatgccatggatatcccccctcccactggccccacatgggcgcttggcgccacatttatccggaagttttatacagagtttgatagacggaataacagaatcggtttcgctcttgcaaggtag

SEQ ID NO: 132169 - DNA, 1212 bp, Artificial Sequence
  Description of Artificial Sequence: Synthetic coding sequence
atggacgggtggcggcgaatgcctaggtgggggctgctgctcttactgtggggtagttgcacattcggcttacccacggacacaacgactttcaagaggatttttcttaagcgcatgccgtctattagagaatctctaaaagagagaggtgttgatatggctcggcttggtcccgaatggtcccagcctatgaagagattgacacttgggaacaccacaagtagcgtgattctgaccaattacatggatactcagtattatggggaaatcggcatcggcacccccccccagacgttcaaggtcgtgtttgatactggctcttcaaacgtttgggtgccaagtagcaagtgcagccgcttgtacactgcttgcgtgtatcacaagctgttcgacgcgtcggactctagcagctataagcacaatggtacagagctgacccttcggtatagcaccggaacagtgtccggttttctttcacaggatatcatcactgtgggtggtattactgtgacacagatgtttggcgaggtaactgaaatgcccgccctgcccttcatgctggctgagttcgacggagtagtgggtatggggttcatcgagcaggctataggaagggtcacccccatatttgataatattatctcccagggggttctcaaggaggacgttttttccttttactacaacaggaattctcaatctctggggggccagatagtgctgggaggaagcgacccccagcattatgagggtaactttcactatattaatctgattaagactggtgtgtggcagatccagatgaaaggcgtgagtgtgggtagttccacgctgctgtgcgaggatgggtgtttagccctggtcgacacaggtgcatcctacattagtggaagtacctcgtcaatagaaaaattgatggaggccctgggcgcaaaaaaaagacttttcgactatgtcgtcaagtgtaacgaaggtccaactctgccagatattagcttccaccttggtggcaaagaatatacactgacgagcgccgattacgtcttccaggaaagctattctagtaaaaaactgtgcacgttagcaatccacgcgatggacataccacctccaaccgggcccacctgggctctcggagccacttttattcgtaaattctacacagagtttgaccggcgaaataatcggatcgggtttgcgctggccagatag

SEQ ID NO: 132170 - DNA, 978 bp, Artificial Sequence
  Description of Artificial Sequence: Synthetic coding sequence
atggacacccagtattatggggagattggaatcggaacccccccgcagactttcaaagtagtcttcgacaccgggagctctaacgtttgggttcccagttcaaaatgttccaggctctatactgcatgcgtgtaccacaaactctttgacgcttctgactcttccagttataagcacaacgggacagagctcactctgagatattcaacagggaccgtgtctggcttcctgtctcaggacatcatcaccgtggggggaatcaccgtaacccaaatgttcggagaggtgactgaaatgcccgccctgccctttatgttggccgaattcgacggcgtggttggcatgggatttatcgaacaggctatcgggagggtgacccccatatttgataatatcattagccagggcgtcctgaaagaggacgtgttcagcttctactataaccgggacggtgagaatagtcagtcacttggaggacagatcgtgctgggaggcagtgacccccaacactatgagggtaacttccactatataaatctgatcaaaactggtgtatggcagatacagatgaagggggtctccgtgggctcctcgactctgctctgcgaagacgggtgcctcgctctcgtggacaccggagcctcctatatttccggaagcacaagctccatcgaaaagctgatggaggcgttaggtgcgaaaaagcggctgtttgactacgtggtcaaatgcaacgaaggtccgacattgcccgacatcagttttcatctaggggggaaggaatacacgcttactagcgcggattatgtgttccaggagagttacagcagcaagaagctgtgtacactggcgattcacgcgatggacattccgccccccaccggcccgacttgggccttgggggcaactttcattcgcaaattttatacagagttcgataggcggaataataggattggatttgctctggccagatag

SEQ ID NO: 132171 - DNA, 1284 bp, Artificial Sequence
  Description of Artificial Sequence: Synthetic coding sequence
atgtctaaagggctcccagccaggcaggatatggagaaggagcgcgaaactctgcaggcttggaaggaacgagtaggccaggagttagatagggttgtggccttttggatggagcattcacatgatcaggaacatgggggcttctttacatgtctcggcagggagggcagggtttatgacgatcttaaatacgtctggcttcaaggacgacaggtttggatgtactgccgcctgtacagaactttcgaacgctttaggcacgctcagctcctagatgctgcaaaagcagggggcgagttcttgctccggtatgcccgggtagcaccaccgggcaagaaatgtgcgttcgttctgacaagagacggccggcccgtaaaagttcaaaggacgattttctccgagtgcttttacactatggctatgaacgaactgtggcgagcaacaggagaggtaagatatcagacagaagccgtggaaatgatggaccagatcgtgcattgggttcaggaggacgcatctgggctgggaagaccgcagttgcagggtgcacctgcagctgagccaatggcagtgccaatgatgttgcttaacttggtggagcagctgggtgaagcagatgaggaattggctggtaagtacgcggagctcggcgactggtgtgcgcggcgtatcctccagcacgtccaaagagacgggcaggctgttcttgaaaatgtctccgaagggggaaaggagctgccaggatgtctcgggcgccagcagaatcctggacataccctggaagccggctggtttctgctgagacactgcattcgtaaaggggatccggagctgagggcccatgtgatagataaattcctgctgctcccttttcatagcggctgggatccagatcacggtgggcttttctacttccaggatgcagataacttttgcccaacccaactggagtgggcaatgaagctttggtggccccatagtgaggccatgattgcctttttaatgggatattcagattcaggagatcccgtgctgctgcggttattttaccaggtggcagagtacacatttagacaattcagagatcctgaatacggcgagtggttcggctacctttctcgagagggcaaagtggccttaagcataaaaggcggaccatttaaaggctgcttccacgtcccccgatgcctggccatgtgtgaggagatgctgggtgcgctgttgtcacgtcctgctccagcacctagcccagcgcccacccccgcttgccgtggcgcggagtag

SEQ ID NO: 132172 - DNA, 765 bp, Artificial Sequence
  Description of Artificial Sequence: Synthetic coding sequence
atgagcaaaggcctgccggccaggcaggatatggaaaaagagagagagactctgcaggcttggaaagaacgtgtgggtcaagagctcgatcgggtggtcgcgttctggatggagcattcccacgaccaagaacatggagggttcttcacatgtctggggcgggaggggcgcgtgtatgatgatctcaagtacgtttggctgcaggggagacaggtttggatgtactgccgtttgtaccgcacgttcgagaggtttagacacgcacaactacttgatgctgcaaaggcaggaggagaatttctcctgagatacgccagggtagcgcctcctggtaaaaagtgtgctttcgtactcacacgcgatggtaggcccgttaaagttcagagaacaatattcagcgaatgcttctacacaatggccatgaatgagctgtggcgggccacgggcgaagttcgataccagactgaagccgttgagatgatggaccagattgtccactgggtacaggaagatgcctccgggctggggagaccacaactgcaaggagctcccgccgctgagcccatggcggtccccatgatgttattgaatttggtggaacaattgggggaagctgatgaggagcttgccggcaagtacgccgaattgggagactggtgcgcaagacgcattctgcagcacgtccaggccaccaggtggaagccggccggattttgcagtgttatagccttcgggaaggccaccccaaacttcgaacctacatag

SEQ ID NO: 132173 - DNA, 2355 bp, Artificial Sequence
  Description of Artificial Sequence: Synthetic coding sequence
atggcacagttgctgaacagcatcctgtccgttattgatgtttttcataaatatgctaagggcaatggagactgtgcactgctgtgcaaggaggagctcaagcagctgctgctcgccgagtttggcgacattctgcagcgacccaacgaccctgagaccgtcgagaccatcttgaatctcttggaccaggatagagacggacacatcgattttcacgagtatctgctcctggtctttcagttggtgcaggcctgctatcacaagttagataataaatctcacggaggccgcactagtcaacaagagagaggacaagagggggcccaggattgtaaatttccgggcaatacaggaagacagcacaggcagcggcacgaagaagagagacagaactcacaccactcacagcctgagcgccaagatggcgattcacatcatggtcaacctgagcgccaagatagagattcgcaccacggccagtcagagaaacaggatagggattctcaccactctcaaccagaacgccaggacagggacagtcatcataaccaaagcgagcgacaggataaggacttcagcttcgatcagagcgaaaggcaatctcaagattcttctagcgggaagaaggtgtcacacaaatccacgtctggccaggccaaatggcagggacacatctttgccctgaatcgttgtgagaagccgatccaagacagccattatggacagtcagaaagacatacacagcagagcgaaacacttggccaggcatcgcacttcaaccagactaaccaacaaaaatccggcagctactgtggtcagtcagagagactggggcaagaactcggctgcgggcagacagatagacaggggcagtcctctcattatgggcagactgatagacaggaccagtcatatcactacggtcagacagatcggcagggacagtcctcccactactctcagacagacaggcagggacagtcaagccactattcccaaccagatagacagggtcagagctcccactacgggcaaatggataggaagggccaatgttatcattacgaccagactaatagacagggtcaggggtcccactattcccaacccaatcgacaggggcagagctcccactacggacaacccgatacacaggaccaatccagtcattacggccagaccgataggcaggatcagtctagtcactatggtcaaacagagagacagggccaatcttcgcattactctcagatggaccgacagggtcaggggagtcattacggccagacagatcgtcagggacaaagctcccactatggacagcccgaccgtcaaggacaaaactcccactatgggcagactgatagacagggccagtcttcacactacggtcaaaccgaccggcaagggcagtcctcccactattcgcaaccagataaacaggggcagtcttctcattacggcaagattgacaggcaggatcagtcctatcattatggtcagcctgacggacaaggacagagtagtcactatggacagactgaccggcaaggacaaagctttcattacggccagccagaccgccaggggcagtcaagtcattatagccagatggatcggcaaggacaaagctcccactacggccagacagataggcagggccagtcatcccactatgggcagacagatagacagggtcagtcttatcactatggccaaacagaccggcagggccaatcatcccattacatccagtcgcagaccggggaaatccagggccaaaacaaatatttccaaggtacggaagggacaaggaaggcgtcttatgtcgagcagtcagggagatccggaaggttatcccagcagaccccaggccaggaggggtaccagaaccaaggccagggcttccaaagtagagattcacagcagaatggccaccaagtgtgggagccagaagaagatagtcagcatcaccagcataagctgctcgcacaaattcagcaggaacgcccgttgtgccacaagggacgagactggcagtcctgctcgtccgagcaaggtcatcggcaggctcagacccggcagtcacatggggagggcctgtcccactgggcagaagaggagcagggacatcagacatgggacagacactcccatgagagccaagagggcccctgtggaacccaggacaggaggacacataaggatgaacagaatcatcagagacgtgacaggcagactcacgagcacgaacagtcccaccagcgaagggacaggcaaacccacgaggacaagcagaacagacagagaagggacagacaaacacatgaggatgaacagaatcaccaacggtag

SEQ ID NO: 132174 - DNA, 1320 bp, Artificial Sequence
  Description of Artificial Sequence: Synthetic coding sequence
atggatagaaaggggcagtgttatcactatgaccagacaaaccgacagggacaggggtcacattattcacagcctaaccgccaaggccagagtagtcactacggacaacccgatacgcaggaccagtcctctcattacggtcagaccgaccgccaggaccagagttctcactacggccagacggaacggcagggccagagttcacactacagtcaaatggacaggcagggccagggctcgcattatggacaaactgataggcagggacaatctagccactatgggcagcctgacagacagggccagaattcgcactacgggcaaactgaccgccagggccagtcaagccactatggccagaccgatcgtcagggacagagttcacattattcccagccagacaagcaggggcaatcctcgcattacgggaagattgatagacaggaccagtcttaccactacgggcagccggacggccagggtcagtcatcgcactacggccaaaccgaccggcaaggtcaaagcttccactacggacaacccgaccggcaggggcaatcttctcattacagtcagatggacagacaaggccaatctagccactacggccagaccgatagacaaggacagtcaagtcactatggccagactgatcgtcaaggccagtcttaccattacggccagacagaccgccaaggacagtcatctcattatatccagagccagacaggcgaaatccagggtcagaacaagtactttcagggcacggaggggactcggaaagcatcttacgtggagcaatcaggaaggagtggccgtctgtcacaacagacccccggccaggagggttatcaaaatcagggccagggattccagtcgcgcgactcccagcagaacggccaccaggtttgggagccagaagaggacagccagcaccatcaacacaagttgctggcccagatacagcaggagaggcccttgtgtcataaaggccgcgactggcagagctgctcgtctgagcagggccaccggcaggcccagactcgccagtcccatggagagggccttagtcattgggccgaggaagagcaaggccaccagacatgggaccgccactctcacgaaagccaggaaggaccatgcgggactcaggaccgaagaacacataaggatgaacagaaccaccaacgccgggaccgccagactcacgaacatgagcaatcccaccagaggcgcgatagacagacacacgaggataagcagaaccgccagcgtcgagataggcagacccatgaagacgagcaaaaccaccaacgctag

SEQ ID NO: 132175 - DNA, 1065 bp, Artificial Sequence
  Description of Artificial Sequence: Synthetic coding sequence
atggaggtagaggcagtgtgtgggggggctggcgaggttgaagcccaggactctgaccctgccccagcatttagcaaggctccagggtctgccgggcactatgagctgccctgggtggaaaagtaccggcctgtgaaactgaatgagatagtcggcaacgaagacactgtcagccgacttgaggtattcgctcgggaggggaacgtgccaaatatcataattgcagggccccctggaaccggtaagacaacgagcatactgtgccttgctcgagccttactcggccccgctttgaaggatgccatgctcgaactgaatgccagcaacgaccgggggatcgatgtcgtcagaaacaagataaaaatgtttgctcagcagaaggtgaccctccctaagggcaggcataaaatcattatactcgatgaagcagatagtatgaccgacggagctcagcaagcgctgcgccgcaccatggagatttattcaaagactacccgctttgccctcgcctgcaacgcctccgacaagattatcgagcctatccagagtcgatgtgctgtgcttcggtacaccaaactgaccgacgcgcaaatcctgactagactgatgaacgtgattgaaaaggaacgggtgccttataccgacgatggtctggaggccatcattttcacagcccagggtgatatgcgccaggctttaaacaatctgcaatctaccttctccgggtttggattcattaattccgaaaacgtgtttaaagtttgcgacgaaccacacccgctgctagtcaaggagatgattcagcactgtgtgaacgccaacattgatgaggcctacaaaattctggctcatttgtggcacctgggatactcccccgaggacatcatcggtaacatcttccgggtttgtaaaacattccaaatggcggaatacttgaaactggaatttattaaggagatcggatacacccatatgaaaatcgcagagggggtcaactcgctgctacagatggcaggactgctggcacgactctgccaaaagacgatggctcctgtggccagctag

SEQ ID NO: 132176 - DNA, 963 bp, Artificial Sequence
  Description of Artificial Sequence: Synthetic coding sequence
atggaagtcgaggctgtgtgcgggggggctggggaggtggaggcccaggactctgaccctgcacccgccttctccaaagcccccgggagtgctgggcactacgagttgccttgggttgagaaatacagacctgttaaattgaacgaaattgttggtaatgaagataccgtgtcccgcctcgaggtttttgcacgtgaagggaacgtgccgaacattattatcgccggtccccccggaaccggcaaaacaactagcattttgtgtttggctcgggccctgctgggtccagctctgaaggatgctatgcttgaactgaacgccagtaacgacagtatgaccgacggcgcccaacaggccctacgaagaaccatggagatttactcaaaaaccacccggtttgcattggcctgtaatgcctctgacaaaattatagagcctattcagtcgagatgtgcggtactgagatacaccaagctcaccgacgctcagatcctaacacgcctgatgaacgtgatcgaaaaggagcgcgttccctatacagacgacggtctagaggctattatctttaccgcccagggagacatgcgccaggcacttaataacctgcaatctacattctccggctttgggtttatcaacagcgagaatgtttttaaggtgtgtgacgagccacaccctctcctagtgaaggagatgattcagcactgtgtgaatgcaaatatagacgaggcctataagatccttgcccacctgtggcatctcgggtattcacccgaggacataatcgggaatatcttcagggtgtgcaagacctttcagatggctgagtacctcaagctggagtttattaaagagatcggctacacacatatgaagatcgcagaaggcgtaaattctctgcttcagatggccggcctgctggccaggctttgccagaaaaccatggcacccgtggccagctag

SEQ ID NO: 132177 - DNA, 1071 bp, Artificial Sequence
  Description of Artificial Sequence: Synthetic coding sequence
atgtctttgtgggtggataagtacaggccctgctccctgggaaggctagactatcataaggaacaggctgctcagctacgtaacctggtacagtgtggcgatttcccccatttgctggtgtacgggccaagcggcgcaggtaagaaaacacgcatcatgtgtatcctgagagagttatacggcgttggggtggagaagttgcgaattgaacatcaaacaattactacgccctccaagaagaagatcgaaatctccactatcgcatcgaattaccatttggaggtgaacccttctgacgccgggaactctgaccgagtcgttatccaggagatgctaaagacagtggcccagtctcagcagttggaaactaattctcagagggatttcaaggtcgtactcctgactgaagtggacaagctaacaaaggatgcgcagcacgccttgcgtcggacaatggaaaagtatatgtctacgtgtcgtctcattttatgttgcaacagcacatcgaaggtgataccccccattcgctccaggtgtctggccgtccgagtccccgcgccaagcatagaagatatctgtcacgtgctgtctaccgtgtgcaaaaaagaagggctgaacctgccctctcagctagcacaccggcttgccgagaagtcctgtagaaatctgagaaaggccctgctgatgtgcgaagcctgccgcgttcagcagtacccgttcaccgccgatcaggaaataccggagacagattgggaggtgtatctccgagagactgctaacgcaattgtgtctcagcaaacaccccagaggttgctggaggtgagagggcgcctgtatgagctgctgacgcactgtattcctcctgagataattatgaaaggactcctgtcggaactgctccataactgcgatggacagttaaagggtgaggtagcccagatggccgcgtactacgaacaccggcttcagctgggcagcaaagcaatctaccacttggaggcatttgtggctaagtttatggctttatataagaaattcatggaggatgggcttgaagggatgatgttctag

SEQ ID NO: 132178 - DNA, 918 bp, Artificial Sequence
  Description of Artificial Sequence: Synthetic coding sequence
atgagtctgtgggtggacaagtatcgaccgtgttccctgggcagactcgattaccataaagagcaggcagcccagctgagaaacttagtacagtgcggcgatttcccccacctcctcgtgtacggtccatcgggcgcgggcaagaagactcgaattatgtgcatccttcgcgaactctacggggtcggagtggaaaaacttagaattgagcaccagacaataactaccccatccaagaaaaaaattgaaatctctactattgccagcaattaccacttagaggttaacccttctgacgccggcaattctgacagggtcgtgatccaggagatgctcaaaacagttgcccagtctcagcaattggagacaaacagccagcgggattttaaagtggtgctcctgacagaagtcgataaactcaccaaagacgcacaacacgcactccgacggacaatggagaaatatatgtctacgtgtaggctcatcctgtgctgcaactcgacgtcaaaagtaattccccccatacgcagcagatgtctcgctgtacgagtccctgcaccctccatcgaggacatttgtcacgtcttgtccaccgtctgcaagaaagagggcctaaaccttccctctcagttggcacacaggctggcggaaaaaagctgccggaacctgagaaaggccttattgatgtgtgaggcttgccgtgtgcagcaatatccattcacagcagatcaggaaatccctgagactgattgggaggtgtatctgcgtgagactgcaaatgccatcgtatcccagcagacacctcaaaggctattagaagttagaggcagactctacgagctgttgacacactgtatcccgccggaaataatcatgaaggcctgcaaagaggaatctcggtcttgtgatatcttttag

SEQ ID NO: 132179 - DNA, 1092 bp, Artificial Sequence
  Description of Artificial Sequence: Synthetic coding sequence
atgcaggcattccttaagggaacttccatctccactaaacctccgttgacgaaagatcggggagttgcagcctcagctgggtcctcgggagagaataaaaaggctaagcctgtcccttgggtggagaaatacaggcccaagtgcgtcgatgaggtggcgttccaggaagaagtggtagctgtgctgaaaaaaagcttggagggtgcggatctgccgaacctactcttctacgggccacctggtaccggcaagacctcgaccattctggctgctgcccgtgagttgtttggaccagagctgttccgcctccgtgtgttagaactgaatgcatcagatgagagggggatacaagtggtgcgcgaaaaggttaagaactttgcccaactaactgtgtctgggtcgaggtcagacggtaaaccctgccccccatttaagatagtgatacttgacgaagccgacagcatgacttcggccgcacaggccgccctgcggcggaccatggagaaggagagcaagacaactcggttctgcctgatttgcaattatgtctcacggatcattgaaccactcacctccaggtgttccaaatttcggtttaagcctctttcagataagattcaacagcaacgactcctggatatcgcaaaaaaagagaacgtgaaaatcagcgatgagggcattgcttaccttgttaaagtgtccgagggggatcttcgcaaggcaatcacattcttacagtccgccacgcggttaacgggcgggaaagagatcaccgagaaagtaatcaccgatatcgccggcgtgattccagccgagaagatcgatggggttttcgccgcttgtcagtcagggtctttcgacaaacttgaggctgtcgtgaaagacttgattgatgaaggccatgctgccactcagcttgtgaaccaactgcacgatgtggttgtggagaacaatctgtctgacaagcagaaaagcattattacagagaaattggccgaggtggacaagtgtctggccgacggggccgatgagcacctgcagctgattagcttgtgcgccacagttatgcagcagctcagtcagaactgctag

SEQ ID NO: 132180 - DNA, 1092 bp, Artificial Sequence
  Description of Artificial Sequence: Synthetic coding sequence
atgcaagcatttcttaagggtacttcgatctccacgaagccaccgttaactaaagatagaggggtggccgcaagcgccggcagcagcggggaaaataaaaaagcaaagccagttccatgggttgagaagtatcggcctaagtgtgtcgatgaggtagccttccaagaggaggtggttgccgtcctgaagaagagtctggaaggtgctgatctgcctaacctgcttttttatggccctccgggcacaggaaagacctcaactatcctggccgctgcccgtgagctcttcggacccgagcttttcaggctgagagtgcttgaactgaatgctagcgacgaaagaggaatacaggtcgtgcgcgagaaagtaaagaattttgcccagcttactgtcagcggcagcagaagtgacggcaaaccctgtcctccgtttaagattgtgatcctggacgaggccgattccatgacatctgccgcacaagccgccctccgacgtaccatggaaaaggaaagcaaaactacacggttttgcttgatttgtaattacgtttcgagaatcatcgaaccactcacatcccggtgttcaaagtttcggttcaagcccctcagcgataagatccagcagcaaagactgcttgacatagcaaaaaaagagaacgtcaaaatctcagacgagggaatcgcttacctggtaaaagtcagtgagggggatctgcgtaaggccataacgtttcttcagtccgcaactagactgactgggggcaaagagattaccgaaaaagtgattaccgatatcgccggtgtgatccctgccgagaagattgatggggtctttgccgcctgtcagagcggttccttcgacaaactggaggcagtagtgaaggaccttattgatgaagggcacgcagcaacccaactcgttaaccaactgcacgacgttgtggtagagaacaatctctcggacaaacagaaatcaattatcaccgaaaagctggccgaggtggacaaatgcttggctgacggtgccgacgagcaccttcaactgatctctctctgtgctacagtcatgcagcaactctcacagaattgttag

SEQ ID NO: 132181 - DNA, 132 bp, Artificial Sequence
  Description of Artificial Sequence: Synthetic coding sequence
atgcaggcgttccttaaggggacctcaattagtactaagcccccgctgaccaaggataggggcgtcgccgctagcgccgggtccagcggcgagaataagaaggctaagcccgtaccctgggtggagaaatag

SEQ ID NO: 132182 - DNA, 645 bp, Artificial Sequence
  Description of Artificial Sequence: Synthetic coding sequence
atgcaagcctttttaaaggggacttctatctctaccaaacccccgctgactaaagacaggggtgtggcagctagcgccggaagtagcggcgagaataaaaaggccaagcctgtaccctgggtggagaagtacaggcctaagtgtgtggatgaggttgcatttcaggaggaagttgtagctgtgttgaaaaaaagcttagagggcgcagacctgccaaacctccttttctacggcccccctggaactggtaaaacttctaccattttggccgctgctagggagctatttgggcccgaattgttccggctgagagttctcgaactgaatgcgtccgacgagcgaggcatacaggtggttagggaaaaagtcaagaacttcgcacagttaactgtgagcggatctaggagtgatggcaagccatgtccgcctttcaagattgtaatactggacgaggctgacagcatgaccagcgccgctcaggccgccctgcgtaggacgatggagaaagagagcaaaaccacgcgcttttgcctcatttgcaactatgtttccagaatcatagaaccattgacatctcgatgcagtaaattcaggttcaagccactgagcgataaaattcagcagcagagacttcttgacatttag

SEQ ID NO: 132183 - DNA, 372 bp, Artificial Sequence
  Description of Artificial Sequence: Synthetic coding sequence
atgcaggccttccttaagggtactagtatttctacaaagcctccccttacaaaggatcggggggtggcagctagcgccgggagctccggcgaaaacaagaaggctaaacccgtcccttgggtggaaaagtacagaccaaagtgtgtcgacgaggtggcatttcaggaggaagtggtggctgtgctgaagaaatctctagagggagcagatctgcctaatctgctcttttacgggccacctggaactgggaagacgtctacaattctggctgcagccagagagctgttcggaccagagttgttcagacttcgggtgctcgagctgaacgcgtccgacgagcgcgggattcaggtggttcgcgaaaaggtctag

SEQ ID NO: 132184 - DNA, 504 bp, Artificial Sequence
  Description of Artificial Sequence: Synthetic coding sequence
atgcaggcatttttgaaaggcactagcattagtaccaaaccgccactcaccaaagatcgcggggtggccgcgtctgctgggtcaagcggtgagaataagaaggccaagcccgttccctgggtcgagaagtacagacccaagtgtgtggacgaagtggcattccaagaggaggttgtcgcggtcctcaagaagtccctggagggcgccgacctgcccaatctgctattttacgggcctcccgggactggtaaaacatctacgatccttgcagcagctagggagctgttcggtcccgagctcttccgcctgagggtgttggagttgaatgcgagcgacgagagaggcatccaggtggttcgggagaaggtcaagaactttgctcagctgactgtcagtggatccagatctgatgggaaaccatgcccacccttcaagatcgtaattctggacgaggccgacagcatgacatcagcagcccaagccgcacttcggcgaaccatgtag

SEQ ID NO: 132185 - DNA, 288 bp, Artificial Sequence
  Description of Artificial Sequence: Synthetic coding sequence
atgcaagccttcctcaaaggcacgtctatctccacaaaacctcctctcactaaggatagaggagtcgccgcatcggctggatcttcgggggaaaacaagaaggctaagccagttccttgggtggagaagtatagacctaagtgcgtcgatgaagtcgccttccaggaagaagtggtcgccgtgctgaaaaaaagtctcgagggcgcagatcttccgaacctcctgttttatggacctcccggcaccggtaaaacatcgacgattcttgctgcggcccgggagctgtag

SEQ ID NO: 132186 - DNA, 1746 bp, Artificial Sequence
  Description of Artificial Sequence: Synthetic coding sequence
atgcaaaggcctggtcctaggctgtggctcgtgctccaggttatgggaagctgcgctgctatcagcagcatggatatggaacggccaggagacgggaaatgtcagcccatcgagattccaatgtgcaaggatataggatacaatatgacacggatgcctaatctgatgggacacgagaatcaaagggaggctgccattcagctgcacgagtttgcaccactagtggagtatggttgccatggccacctgcgcttttttctctgttcactgtacgctcctatgtgtacggaacaggtgtcaacacctattcccgcgtgcagagtgatgtgtgagcaggccaggctgaagtgtagccccatcatggagcaattcaactttaaatggcccgactccttggattgccgcaagctacctaacaaaaatgaccccaattatctgtgtatggaagcacctaataacggttccgatgagcccacccggggtagcggcctgttcccacccttgtttcggcctcaacgcccacattctgcgcaagaacatccattgaaggacggaggccctgggaggggtgggtgtgataatcctgggaaatttcatcacgtcgagaaaagcgccagctgtgcccccctctgcactcccggggtggacgtgtactggagccgagaggacaaacggtttgcagttgtgtggctcgccatctgggccgtgctttgcttttttagctcagctttcacggttcttacctttctaatagaccccgcacgtttccgttaccccgaaaggccaatcatctttctgtcaatgtgctactgcgtgtattcagttggttatttgatccgcctgtttgccggcgcagaaagcatcgcctgtgaccgagacagcggacaactctatgtcattcaggaaggcttagagtccactggctgcacgctggttttcctagtactttactacttcgggatggctagtagcttatggtgggtcgtactgaccctgacgtggtttttggcagctggcaagaagtggggccacgaggcaattgaggccaatagctcctattttcatctcgctgcttgggccataccagcagtaaaaactattttaatcctggtaatgaggagggtcgctggggacgagctgaccggagtatgttacgtgggcagtatggacgttaacgcgttgaccggatttgtcctcatcccattggcctgctacctcgtcattggaacgagtttcatcctgtccggcttcgtcgctcttttccacatccgaagggtgatgaaaaccgggggcgagaatacagacaaacttgagaagctcatggttcgcatcggcctgttttccgtgttgtacaccgtacctgcgacctgtgtgattgcttgttacttctacgagcggctcaatatggactactggaagattctcgccgcgcagcacaagtgcaagatgaataatcaaaccaagactctggattgtctgatggccgcgagcatccctgctgtagagatttttatggtcaagatcttcatgcttctggtagtcgggatcacttccgggatgtggatctggacttccaagacattgcagagttggcagcaggtgtgtagtcggagattgaaaaaaaagagccggcgaaaaccagcgagtgttatcacctcaggcggaatctataaaaaagcccaacatccacagaaaacccatcacgggaaatacgagatcccggcacaatctccaacctgtgtgtag

SEQ ID NO: 132187 - DNA, 960 bp, Artificial Sequence
  Description of Artificial Sequence: Synthetic coding sequence
atggtggagaagtatcgccctcagaccctgaatgacttaatctcccaccaggatattctgagcaccatccaaaagtttattaacgaggatagattaccacaccttctgctctatgggccccctggaacagggaagaccagcactattctggcctgtgcaaagcagctgtataaggacaaggagttcgggagtatggtgctcgagttgaatgcttcagatgaccgaggcatcgacatcattcgaggtccaatcttgagttttgcttctactcggacaatctttaaaaagggctttaagttggttattttggacgaggccgacgccatgactcaggatgcgcagaatgccttgcgccgggtgatcgagaagtttactgaaaacacgcgattttgcctcatatgtaattacctgagcaaaatcattcctgccctgcaaagcagatgcaccagattcagattcggacctctgacacccgagctcatggtcccaagacttgagcacgtcgttgaggaggagaaggtggacatttctgaggacggcatgaaagccctggttacattgtcttccggagatatgcggcgtgctttgaatatacttcagtctaccaacatggcgtttggcaaggtgaccgaggaaactgtctatacctgcaccggccatcccctgaagtccgatatcgcaaacattctggattggatgctgaatcaggactttaccacggcttatcggaacattaccgaactgaagacactcaaaggcttagccctgcatgatattttgactgagatccatctgtttgtgcaccgcgtagacttccccagctccgtgcgtatccatttgttgacaaagatggcggacatagaatacaggttaagcgttggtaccaacgaaaagatccagctgagctctctgatcgccgctttccaagtgactcgagatctgatcgtcgccgaggcgtag

SEQ ID NO: 132188 - DNA, 315 bp, Artificial Sequence
  Description of Artificial Sequence: Synthetic coding sequence
atggtggagaaatataggccgcaaacccttaacgatctgatttcccaccaggacattctctccacaatccagaagttcataaatgaagaccggctgccgcatctactgctctacggccccccaggcaccggaaaaacatccacaattctcgcctgcgctaaacagctttataaagacaaggagtttggctccatggtgctggaattgaatgccagcgatgaccggggaatcgatatcatccgtgggccaatcctgagctttgcttctacgcgcacaattttcaagaagggatttaagctggtaatactggattag

SEQ ID NO: 132189 - DNA, 1023 bp, Artificial Sequence
  Description of Artificial Sequence: Synthetic coding sequence
atggagactagcgctttaaaacaacaggagcaacccgccgcaactaaaatacgcaaccttccctgggttgaaaagtataggccccaaacgctgaacgatcttatcagtcaccaggatatattgtcaaccatccagaaatttatcaacgaggatagactgccccatctcttgttgtacggcccccccggaacaggcaaaacttcaaccatactggcttgcgctaagcagctctacaaagataaggagtttggctccatggtgctggaactcaatgcatctgacgaccggggtatagatataatccgcggacccatattgtcgtttgcaagcacacggactatctttaaaaagggcttcaagctggtgatcctggacgaagccgatgccatgactcaagatgcacagaatgcgcttcggcgagtcatcgagaagtttaccgaaaacacccgattctgtctgatctgtaattatctgagtaagatcatccccgctctacagtcccgctgtactcgtttccgattcggccctttgactccggaactcatggtgcctaggctggagcacgtcgtcgaagaggagaaggtcgatattagcgaggacggcatgaaggcccttgtcactctgagctccggtgatatgagaagggccctaaacatccttcaatctaccaacatggcatttgggaaggtgacagaagagacagtgtatacttgtaccgggcaccccctaaaatccgacattgctaatattcttgactggatgctgaatcaagattttaccacagcttaccggaacatcacagagctgaagactttgaagggccttgccctccacgacattctgaccgagattcatctttttgtccacagggtcgacttcccctcttctgtacgcatccacttgcttacaaaaatggccgacatcgaatacaggctctccgtcggcaccaacgagaagatccagctctcatccctcatcgccgcatttcaggtgacgagagatctaatcgtggctgaagcctag

SEQ ID NO: 132190 - DNA, 192 bp, Artificial Sequence
  Description of Artificial Sequence: Synthetic coding sequence
atggtcgagaaatatcggcctcagacccttaacgatctaatttcccaccaagacattcttagcactattcagaaattcattaacgaggatagactgccacatctactgctgtatggtcctccggggacaggcaagacaagtacaattctcgcgtgcgccaaacagctgtacaaagacaaggaattcggttag

SEQ ID NO: 132191 - DNA, 1077 bp, Artificial Sequence
  Description of Artificial Sequence: Synthetic coding sequence
atgtggaacagtaacgacggaggggcgggatggagacgcaagcggatcgcaggcggtttttcaaagagagcatcactcgggtctgaaagaagagtggtagccggagaagaggggcgggaacgctcctggggcgtgtgggggtcccccgccggtcgccgacgagggaggctgggaagactgggacagtgcctgaaagggaggtcactgagagagcccgctggtttttctgaagcatgggatgtggctcaggcccttattttactcttcaaaacagggggcttcgagtcctacggcagctccagctacggcggcgctggcggctatacccagtctcctggaggcttcggctctcctgccccatctcaggcggaaaaaaaatctcgagctcgtgctcagcatatagtgccatgtaccatcagccagctgctaagtgcaacgctggtggacgaggtcttccggattggcaacgtggagatatctcaggtaactattgtgggcatcatccggcacgccgagaaggctcccacgaacatagtctataaaatagacgatatgaccgcggctccaatggatgtgagacagtgggtggacacagacgacaccagctccgagaatacggtcgtgccccctgagacttatgtgaaagttgccggccaccttaggagttttcaaaacaaaaaaagtctcgtagcctttaagataatgccgctggaggacatgaacgagttcaccacccacattctcgaggttattaacgcccatatggtactgagcaaagcaaacagccaaccctctgccggtcgcgcccccatctcaaaccctggaatgtccgaggccggtaatttcggtggtaactcttttatgcccgccaatggtctcacggtggctcagaatcaagtcctcaatctgattaaggcttgtcccaggcctgagggcttgaacttccaggacttgaagaatcaactcaagcacatgagtgtgagcagcattaaacaggccgttgactttttaagtaatgaggggcacatctacagcaccgtggatgacgaccactttaaatcaacggatgccgaatag

SEQ ID NO: 132192 - DNA, 837 bp, Artificial Sequence
  Description of Artificial Sequence: Synthetic coding sequence
atgggaaggggtgacaggaataagagaagcattcgcggctttgaatcttacggctcatccagctacggaggtgccggtggatacactcaatcacccggcgggtttggttccccggcaccatcacaggccgagaagaagtccagagcccgcgctcagcacattgtgccttgcactatttcccagctcctgagcgccactctcgtggatgaagtgttcaggatagggaacgtagagatatcacaagtgaccatcgtgggtatcatccgccacgctgagaaggcacccactaacattgtgtacaaaatcgacgacatgaccgcagcccctatggatgtgcgacaatgggtggacacagatgacaccagcagcgagaatacagtggtgcccccggaaacctatgtcaaggtggccggacatcttagatcattccagaataaaaaaagcttggtggccttcaagattatgcccttggaggacatgaatgagttcaccactcatattttggaggttatcaatgcccacatggtgcttagcaaagcaaacagtcagccctccgccggtagggctcctatcagtaacccgggcatgagcgaggctggaaacttcggtggcaactcatttatgcctgcaaacggcttaacagttgctcagaaccaggtgttaaatcttatcaaggcatgccctagacccgaggggctgaattttcaggacctcaagaatcagttaaaacacatgagcgtgtcttcaattaaacaggccgtggattttctgtccaatgaggggcacatttattctaccgtggacgatgaccactttaagagcacggacgctgagtag

SEQ ID NO: 132193 - DNA, 813 bp, Artificial Sequence
  Description of Artificial Sequence: Synthetic coding sequence
atgtggaattctgggtttgaatcctacggttcttcatcctatggaggcgcaggggggtacacgcagtcaccaggtgggtttggaagtcccgctccctcgcaggcagagaagaagtccagggctagagctcagcacatcgtgccctgtaccatcagccagttgctgtcggctactctggtggatgaagtcttcagaatcgggaatgtggaaatcagccaggtgactatagttgggatcatccggcatgctgaaaaggcccctacaaatatcgtttataaaattgatgacatgaccgccgctcccatggacgtccgccagtgggtcgacactgatgataccagttcggaaaacacagtggtgcctccagaaacctatgtaaaagtcgccggccacctgagatctttccaaaacaaaaagtctctcgtggcatttaaaataatgccgctggaggatatgaacgagtttacgacccacatactggaagtgataaacgcacacatggtactttctaaggcaaattctcagccttccgccggccgggctccaattagcaacccaggcatgagtgaagccgggaacttcggaggcaactcctttatgccggccaatggtctgacagttgctcagaatcaagtgttaaacctaatcaaagcttgtcccagaccagaaggcttgaactttcaagacctgaagaaccagcttaaacacatgtctgttagctcgattaaacaggcagtggattttctgtctaacgaagggcacatttacagtacagtggatgacgatcacttcaagagcacagatgcagagtag

SEQ ID NO: 132194 - DNA, 369 bp, Artificial Sequence
  Description of Artificial Sequence: Synthetic coding sequence
ctcgaagacatgaacgagttcactacacacatcctggaagtgataaacgcgcacatggtgctttcaaaggccaactcccaaccctcagctggtcgagccccaatatctaatcctggcatgtccgaagctgggaacttcggaggcaattcgtttatgcccgctaatgggcttacagtggcccaaaaccaagtgctcaatctgattaaggcctgcccccgcccggagggactcaacttccaagaccttaaaaaccagctcaagcatatgtcggtgtcctccatcaagcaagccgttgacttcctatcgaatgagggtcacatatactctacggtggacgatgaccatttcaagagcaccgacgcagaatag

SEQ ID NO: 132195 - DNA, 540 bp, Artificial Sequence
  Description of Artificial Sequence: Synthetic coding sequence
atgtggaattcaaacgacggcggtggcttcgagagctacgggagcagctcctatggaggggccggaggttacactcaatcccccggcggctttggcagtcccgcgccaagtcaagccgagaagaagagtagagcccgagcacagcacattgtaccatgcaccattagccagctgcttagcgccacacttgttgacgaagtgtttagaatcggaaacgtggagatatcgcaggtgacaattgtcggaataataaggcatgctgaaaaggctccaaccaacatcgtgtacaagatcgacgacatgacggccgcccctatggacgttagacaatgggtggacactgatgacactagcagcgaaaatacagtggtgcccccagagacgtacgtgaaggtagcaggtcacctgaggagcttccagaacaaaaaaagcctggtggcttttaaaataatgcctctcgaggatatgaacgaattcaccacacacatcctcgaagttatcaacgcacacatggtgctatccaaggctaacagtcaatag

SEQ ID NO: 132196 - DNA, 786 bp, Artificial Sequence
  Description of Artificial Sequence: Synthetic coding sequence
atgtctaagtccgggtttggcagttacggtagcatcagcgcggccgacggcgcctccggaggcagcgatcagctttgtgagagggatgctactccagctatcaaaactcaacgcccgaaagtgcgcattcaggatgttgtaccgtgtaacgtgaaccagctccttagctcaacagtctttgaccctgtgtttaaagtgcgcggcataattgtgtcccaagtgagcattgtaggagtgatccgcggcgcggagaaagcgtccaaccacatctgctataagatcgacgatatgaccgctaaacccattgaagcccgccaatggtttgggagggaaaaggtgaaacaagtgactcccctgagcgtgggcgtttacgtaaaagtcttcgggatcctaaagtgccccactggaactaagagtctagaggtacttaagattcatgtgttagaggacatgaatgagtttaccgtacatattctggaaaccgtgaatgcacatatgatgctggataaggctagacgagataccacggttgagtccgtgccagtgagcccttcagaagtcaatgacgcaggggacaatgacgagtcacacaggaactttattcaagacgaagtgctgagactgatacacgagtgccctcaccaggaggggaagtctattcatgagttaagagcccagctgtgtgacctcagcgtgaaggcaataaaggaggccatcgattatttgacagttgaagggcatatctatcctactgtggaccgcgaacactttaaatccgcggactag

SEQ ID NO: 132197 - DNA, 330 bp, Artificial Sequence
  Description of Artificial Sequence: Synthetic coding sequence
atgaatcctgccctcggcaatcagactgatgtcgcagggctgtttctggctaattcttctgaagctttggaaagagcggttcggtgttgtacccaagctagcgtcgtcacagatgatggttttgccgaaggcgggcccgacgaacggtctctgtatattatgcgggtcgtgcagatcgcggttatgtgtgtgctgtcactaacagtggtttttggaattttcttcctgggctgtaatctgctcatcaaaagcgaaggaatgattaattttctggtgaaggaccgccgcccatccaaggaggtcgaggcagtggtagtcgggccctactag

SEQ ID NO: 132198 - DNA, 1893 bp, Artificial Sequence
  Description of Artificial Sequence: Synthetic coding sequence
atgcagggaagctcactgtggctctccttaacctttaggtctgctcgtgtgctaagtagagcccggtttttcgaatggcagtctcccggcctgccaaacaccgctgccatggaaaacggaacaggtccatacggagaggaacggcctagggaagttcaggagacaacagtaactgagggcgctgcaaaaattgctttcccatctgctaacgaggtattttacaatcccgtgcaagagtttaatagggacctgacatgtgccgtgataaccgaattcgccagaattcaactcggagccaaaggaattcagattaaagtgcctggtgaaaaagacacacagaaagtcgtggtggacttatccgagcaggaagaggaaaaggtagaattaaaagagagcgagaacctggcttccggggatcagcccagaacggccgctgtgggcgaaatttgcgaagaaggattacacgttctggagggcctcgctgcctcaggcttaaggagtattcgcttcgcattagaggtacctggactaagatccgttgtggccaacgacgcctcaacaagggccgtcgatttgattaggcgtaatgtgcagttgaatgatgtcgctcatcttgtgcagccatcccaggctgatgccagaatgttaatgtaccagcatcagcgggtcagtgagcgattcgatgtcatcgatctggacccttacgggtcccccgcgacctttctggatgcggcagtgcaggctgtgtctgagggcggcttattgtgcgtgacatgtaccgacatggcggtgctggcagggaactccggtgagacatgctacagcaaatatggcgcaatggctctaaagagtcgcgcgtgtcacgagatggctctgcgcatcgtcctccactcgcttgatttacgtgctaattgttaccagcggttcgtagttcctctgctgtccatctctgcagacttctacgtccgcgtttttgttcgtgtgtttactgggcaggcaaaggtgaaggcgagcgccagagccaagttctcggctgcgtgcggtccacccgtgacaccagaatgcgagcattgcggccagcgtcatcagctgggcgggccaatgtgggctgagccgatacatgacttggactttgtaggccgggtcttggaggcagtgtctgccaaccccggaagattccatacctccgagaggattcgcggtgtactatccgtgatcacagaagaattaccagatgtccccttgtattatactttggaccagctatccagcactatccattgtaatacaccttccctgctccaactgcggtccgctctgctgcacgctgattttagagtgtccctgtcccatgcctgtaaaaatgcagtgaagaccgatgcaccagcaagcgccctgtgggacatcatgaggtgttgggagaaagaatgccccgtaaagcgggaaaggctgtctgaaacttcacccgcctttagaattctctccgtggagccaagattacaagctaacttcactatcagggaagacgctaatcctagttcccggcagcggggcttaaagcgtttccaggctaatccggaggccaactgggggcctcgtcctcgcgctcggccaggcggcaaggcagccgacgaggccatggaagagcgtcggcggttgcttcaaaataaaaggaaggaaccacccgaggacgttgctcagcgggcagcccgtttaaaaaccttcccttgcaaaaggtttaaagagggcacctgtcagaggggcgaccaatgctgctactcccactcacccccgacccctcgtgtgagtgctgatgctgccccggattgtccggaaaccagtaatcagaccccccctggccctggggctgctgccgggccggggattgactag

SEQ ID NO: 132199 - DNA, 249 bp, Artificial Sequence
  Description of Artificial Sequence: Synthetic coding sequence
atgaaagctctgtgtctgctgctgcttcccgtgctgggcctcttggttagcagcaagacattatgctcaatggaggaagctatcaacgaaagaattcaggaggtggctggtagcctgagctttgctgttacagggtgcacgtgtgggagcgcatgtggcagttgggacgtaagggccgagaccacttgtcattgccagtgtgcggggatggattggactggtgcccgatgctgtcgtgttcagccctag

SEQ ID NO: 132200 - DNA, 954 bp, Artificial Sequence
  Description of Artificial Sequence: Synthetic coding sequence
atgaaaagactgagcctcgtgactactaatagactcagtccacatggcaacttccttccgctctgtactttcccgttagccgtcgatatggccgccctgttccaggaggcatcaagctgccctgtctgtagtgactacctcgagaaaccaatgagcctagaatgcggttgcgccgtttgctttaaatgtataaattccctgcagaaagaaccacacggcgaggatctgctctgctgctgttgttccatggtttcacagaagaacaaaattcgacctagttggcagttggaacgtttagcctctcatattaaggagctcgagcctaagctcaaaaagatccttcagatgaatccccggatgcggaaatttcaggtggatatgactctcgacgccgacacagcgaacaactttctactgatctccgacgatctccgctccgttagatctgggtgtataacgcagaaccgtcaggacctggcagaacgattcgatgtgtctatttgtattcttggatccccacggttcacatgcgggcgccattattgggaagtcgacgtcgggacgagtactgagtgggatttgggagtgtgtcgggaaagtgtccatcgcaaggggcgaatacatctgacaacagagcgcggtttttggacagtgtcactacgagatggatccagactgtccgctagcacggtgcccctgaccttcctgttcgttgatcgcaagcttcagcgcgtgggcatcttcctggatatggggatgcagaacgtgtcattctttgacgccgaaggtggtagccatgtttacactttcagatctgtgtcagcggaggaaccactgcatcttttcttcgcccctccctcacctccgaacggggacaagagcgtgctatcgatttgtccagtgattaatcctggaaccactgatgcccccgttcaccccggtgaggcgaagtag

SEQ ID NO: 132201 - DNA, 954 bp, Artificial Sequence
  Description of Artificial Sequence: Synthetic coding sequence
atgaagaggctctctctggttactactaatagattaagcccccatggcaactttttcacactttgtacgttcccccttgcggtggacatggcagcgctgtttcaagaagccagttcctgtcccgtctgcagcgactacttagagaaacccatgagtctagagtgtggctgcgccgtgtgtctgaagtgtatcaatagcctccagaaggagccacatggcgaggacctgctctgttgctgctccagtatggtcagtcgaaagaacaaaattagaaggaatcgccagctggaaaggctcgcttcccacattaaggaattggagcctaagctgaagaagattctgcagatgaatcctcgtatgcgcaagtttcaggttgatatgacactagacgccaacaccgccaataatttcctgttaatctcagacgatctccgatctgtgaggtctggcaggattagacaaaataggcaggatctggctgagcgattcgatgtgtcagtctgtatacttggcagtccccgtttcacgtgcggcaggcactgctgggaggtcgacgtggggacaagtactgagtgggatttaggggtgtgtagagagagcgtacacagaaaggggagaattcagcttaccaccgagctgggcttttggacagtgagcttaagagatggaggtcggctcagtgccaccaccgtgccactgaccttcttatttgtggaccgcaagcttcagcgcgttggtatcttcttggatatgggcatgcaaaatgtgtcattcttcgacgccgaatctggctcacacgtgtatacattccggtcggtctccgccgaggaacctctcaggccattcttggcacctagcgttccgccaaatggcgatcagggagtcctctctatctgccccctgatgaattccggtacaactgacgcccctgtccgaccaggagaggccaaatag

SEQ ID NO: 132202 - DNA, 867 bp, Artificial Sequence
  Description of Artificial Sequence: Synthetic coding sequence
atggctgcattattccaggaagcctcctcctgtcctgtgtgtagcgattatctggagaaacctatgtcgctggagtgtggctgtgctgtatgcttgaagtgcataaattcacttcagaaggagccccacggcgaggatctgttatgctgttgctcaagcatggtgagcaggaagaacaaaatccggagaaacagacaactagagagactcgcgagtcatattaaggagcttgaaccaaaactcaaaaaaatcctacaaatgaatcctcgcatgagaaagtttcaagtggacatgaccctggatgctaacacagctaacaactttcttctaatcagcgacgaccttaggtcggttcgcagcgggcgaatccggcaaaatcgccaggacttggcagagagattcgatgtctccgtatgcattctgggctcaccaaggttcacctgcggaaggcactgttgggaggtcgacgttgggacatcgaccgagtgggatttaggtgtttgtagagagtccgtgcaccggaaagggcggatacagctgaccactgagctaggattctggactgtgtcactccgagatggcggtaggctgagcgccaccaccgtcccactgaccttcctcttcgtggatcggaaactgcagagggtgggtatatttcttgatatgggcatgcaaaacgtgtctttctttgatgcagagtcaggctctcatgtgtacacatttcgcagcgtgagtgccgaggagccccttcgaccctttctcgctccaagtgtgccacccaacggcgatcaaggagtattatctatttgtcccctcatgaattctggcactaccgatgccccagtcaggcccggcgaggcaaagtag

SEQ ID NO: 132203 - DNA, 867 bp, Artificial Sequence
  Description of Artificial Sequence: Synthetic coding sequence
atggctgccctgtttcaggaggctagctcctgtccggtctgttcagactacctggagaagcctatgagccttgaatgtggctgcgcggtgtgcctgaagtgtattaactccctgcagaaagagccacacggggaagatctgttatgctgctgttcctccatggtgtctaggaaaaataaaattagacggaaccggcagctggaaagactggcatcccatattaaggaacttgaaccaaaactaaagaaaatccttcagatgaatccgcgaatgcgaaagttccaggtggacatgacactggacgctaacacagcgaacaattttctgctaatttctgacgacttgaggtccgtgcgatctggcagaatccggcagaatcgccaggatcttgccgaacggttcgatgtttccgtgtgtatcttaggatccccacggttcacttgcgggcggcactgttgggaagttgacgtcggaacttctacagagtgggacttaggtgtctgccgcgaatctgtgcatcgaaaggggcgaatccagctcaccaccgaactcggcttctggactgtgagcctccgagatggcggtagactaagtgccacaacggtccccctcacattccttttcgttgacaggaagctccagagggtgggtatttttttagatatgggcatgcagaatgtaagtttctttgatgcagagtccggctcacatgtgtatacttttagaagcgtctccgccgaggagcccctacgcccttttctggcccctagcgtcccccccaatggcgatcagggtgtcttatccatatgcccactgatgaacagcgggaccacggacgcaccggttcgccccggggaggctaagtag

SEQ ID NO: 132204 - DNA, 1137 bp, Artificial Sequence
  Description of Artificial Sequence: Synthetic coding sequence
atggaggtcgccgaactgggattcccggagacagccgtgtcccagtcccggatctgcctatgtgcagtgctgtgtggccattgggactttgccgatatgatggttattagatctttatcactcatcaggttggagggagtcgagggccgggatcccgttggaggcggcaatttgactaacaagcgaccatcatgcgcaccctctcctcaggacctcagcgctcagtggaagcagttagaggaccgtggggcttcgagcaggcgcgtagacatggcagccctcttccaggaagcatcctcatgtcccgtttgctccgactatctggagaaacctatgtctttggaatgtggatgtgccgtgtgcctgaaatgtatcaacagcctccaaaaagagccacacggggaagatctgttatgctgctgttccagcatggtttcaaggaaaaataagataaggagaaaccgccagctggagcgcctggcatcccacataaaagaacttgagccaaagcttaagaagattctgcagatgaatcctcggatgcggaagtttcaggtggacatgacactcgatgccaacacggctaacaattttctcctgatatcagatgatctgcggagtgtgcgaagtggacggatcaggcagaatagacaggatctggccgaacggttcgatgtgagcgtgtgcatcctgggctcccccagattcacctgtggccgtcattgctgggaagtggatgtcggtaccagtaccgagtgggacctcggggtctgcagagagtctgttcaccgaaagggccgtatccaactgacaaccgaattgggattctggaccgtcagtctacgggacggaggacggctgtccgcaaccaccgtgcccctgacttttctgttcgtcgaccggaaacttcagcgagttggcatctttctggacatgggcatgcagaacgtgagctttttcgacgcggagtccgggagccatgtatacacatttagaagcgtctccgcagaagagcccctgcgtccattcttggcacctagcgtgccacccaatggtgaccagggagtcctctcgatctgccccttgatgaatagcggcaccaccgatgcccctgtacgccctggcgaggcgaaatag

SEQ ID NO: 132205 - DNA, 954 bp, Artificial Sequence
  Description of Artificial Sequence: Synthetic coding sequence
atgaaacggctctcccttgttaccacaaaccggctaagtccacagggaaatttcctgcctctgtgtaccttcccgctcgccgttgacatggcagccctgtttcaggaggctagctcctgccccgtgtgcagtgactacctcgagaaacctatgtcactggaatgtgggtgtacagtgtgtctgaaatgcataaactcattgcaaaaggaaccgcatggtgaagatctgctatgctgttgctgctcaatggtgagccagcgcaacaagattaggccgaaccgtcagctggaaagactcgtgtctcatatcaaggaattggagcctaaactaaaaaaaattttgcagatgaatcctcgcatgcggaagttccaggtggacatgaccctcgacgcagacacggcaaataactttctgttaatctctgacgacctgagatctgtaaggagtggactcatcacacagaatagacaggaccttgccgagcgcttcgatgtgtcagtgtgcatactggggagcccacgatttacatgcggcagacactactgggaagtggatgtcggcacaagtaccgaatgggacctgggcgtatgcagagagtcagtgcactgcaaagggaaaatccagctcaccacagagttaggtttttggacagtttcccttcgcgacgggagtagactctctgcatccacagtgccactgaccttccttttagtggaccgcaagctacagcgggtaggtattttcctggatatggggatgcaaaacgtaagtttctttgacgcagagtctggaagtcacgtatacacatttaggtctgtgagcgctgaggagccgctcaggccattcttggcacctagtattcctccaaacggcgatcagggtgtgctttcaatctgccccctgatgaacagcggcacaacagacgccccagttcgccccggtgaggccaagtag

SEQ ID NO: 132206 - DNA, 867 bp, Artificial Sequence
  Description of Artificial Sequence: Synthetic coding sequence
atggctgctctgtttcaggaggcaagttcctgccctgtgtgctccgattatctggagaagcccatgtccttggagtgcgggtgcacagtgtgcctgaagtgcatcaattcactgcagaaagaaccacatggtgaagacttgttatgctgctgttgctccatggtgtctcagaggaacaaaatcagacccaataggcaactggagaggctcgttagtcacatcaaggagctcgaacccaagctgaagaagattctgcagatgaaccccaggatgaggaaattccaggtggacatgaccctcgacgcagatacggccaacaactttttgctgatatctgacgacctgcgcagtgttcggagcggactaatcacccagaaccggcaggatctggctgaacggttcgatgtttcggtttgcattcttggatccccgcgattcacctgcggacgccattattgggaggttgacgttgggacatcaaccgaatgggaccttggcgtgtgccgggagtctgttcattgcaaggggaaaatccaattaaccaccgagcttgggttttggacagttagcctgagagacggatccagactgagcgcgtcaactgttcccttaaccttccttttggtggacagaaaacttcaaagggtgggtatattcctcgacatgggaatgcagaatgtgtcattttttgacgcagagtctgggtctcacgtatatacgttcagaagcgtgtcagccgaagaaccgctcagacccttccttgctccaagtattcctcccaatggtgatcagggcgtcctgagcatttgtcctctgatgaattctgggacaaccgacgcacccgtgcgccccggcgaagccaaatag

SEQ ID NO: 132207 - DNA, 867 bp, Artificial Sequence
  Description of Artificial Sequence: Synthetic coding sequence
atggctgctctttttcaagaggcctccagttgccctgtgtgttccgactatctcgaaaagcctatgtctcttgaatgcgggtgtaccgtgtgtctgaagtgtattaactccctgcagaaagagccccatggggaagatctgctctgctgctgctgttcaatggtttcacaaagaaacaagatacggcccaataggcagcttgaaaggctcgtatcacacatcaaggagctggaacccaagctcaaaaaaatcctccagatgaatcctcgcatgcgaaagttccaggtggatatgacgctggacgccgatacggctaacaattttttgctcatttcagacgatcttcggagcgtgaggagcgggctcattacacaaaacaggcaggatctggccgagaggttcgatgtgtctgtttgcatcctgggaagtccaagattcacttgcggaaggcattactgggaagtggacgttggtaccagcactgaatgggatctgggggtctgcagggaatcagtccactgcaaagggaagatccagctgacaactgaactcggtttctggaccgtgagcctgcgggatggaagcagactctccgcctcgacagtgcctttgacatttctccttgtggatagaaaactacagcgcgtggggatattccttgacatgggcatgcaaaacgtgagcttctttgacgcagagtccggcagccatgtctatacctttagaagtgtttctgctgaagagcctctacgtccctttctggcacccagcataccccctaacggcgatcagggggtgctctcaatctgtccccttatgaatagcggaactaccgatgcacccgtccggccaggcgaagccaagtag

SEQ ID NO: 132208 - DNA, 3219 bp, Artificial Sequence
  Description of Artificial Sequence: Synthetic coding sequence
atggctaaggctacgtctggagcggccggcttacggttgctgctgctgctgctgctgccacttctgggcaaggttgccctgggactttatttttcacgggatgcctactgggagaagttgtacgtcgatcaggcagccggaacaccacttttgtatgtccatgctctgagagacgctcctgaagaagtgcccagttttcggctagggcagcatctctacggcacctaccggaccaggctgcacgagaacaactggatctgtatacaagaggatacaggactgttataccttaatcgatccctagatcatagtagctgggagaaattgagcgtgcggaatcgtggatttcctctcctgacagtgtatctgaaggttttcttgtcgcccacctcattgcgggaaggcgaatgccaatggcctggctgcgctagagtttatttttccttctttaacacctccttccccgcctgtagcagcctaaaacctcgggaactttgcttcccagagacgcggccttccttcaggatcagagaaaaccgaccccccggcactttccatcagtttcggttgttgcctgtgcagttcctgtgcccgaatatttccgttgcgtatcgtcttctggaaggcgagggccttccattccgatgcgcaccagacagccttgaggtttcaacccggtgggccttggaccgcgagcagagagagaaatacgagctagtcgccgtctgtacggtccacgcgggggcacgtgaagaggtggtgatggtccctttccctgtcacagtgtacgatgaggacgattctgctccaacattcccggcaggcgtggacactgcatcagccgtagtcgagttcaaaaggaaggaagataccgtggtggcgaccctgcgcgtctttgacgctgatgtggtgcccgccagtggtgagctcgtgcgcagatacacaagtacgctactccctggtgatacttgggctcagcagaccttcagagttgaacattggcccaacgaaacttccgtgcaggccaacgggtccttcgttcgggcaaccgtgcatgactacaggttggtcctgaatcggaacctttcaattagcgaaaatcgcaccatgcagctggcagttcttgtgaatgactctgattttcagggaccgggtgccggagtcctcttactccactttaatgtatcagtgctaccagtatccctccacctaccgtccacttactccctttctgtgagtaggagggctagacggtttgcacagattggcaaagtgtgtgtagagaactgccaggccttttccggtatcaatgttcagtacaaattgcacagctcaggagcgaactgtagcactctgggggtcgtgacttctgccgaagacacaagtggaatccttttcgtaaacgacacaaaagcattacgacgtcccaaatgtgcagaacttcactacatggtcgtagcgacagatcagcagacctctcggcaggcacaagcgcagctgctggtcacagttgagggtagttatgtcgctgaagaagcaggctgtccactcagctgcgcagtgtccaagcgtaggctggaatgtgaggagtgtggcggtcttgggtcgccaacgggcaggtgcgagtggagacagggagacggcaagggcattacccgaaatttctctacctgcagcccaagtacgaagacatgccccgatggacactgtgacgtcgtcgaaacgcaggatatcaatatctgcccccaagactgcctgcgaggatcaattgttggagggcacgaaccaggggaaccaagagggatcaaagccgggtacggtacttgcaattgctttcctgaagaagagaagtgtttctgtgagcccgaggacatccaggaccctctgtgtgacgagttatgccgtacagtaatcgcggcagccgttctctttagtttcattgtgtctgtgcttctgagcgcattctgcatacactgctaccataaatttgcccataagcctccaatcagctcagccgaaatgacctttcggcgccctgcccaagctttcccagtgtcctatagtagctccggggcgagacgtccttctttagatagcatggaaaaccaggtgtccgtcgacgctttcaagatcttggaagacccgaaatgggagtttcctcggaagaacctggtgctgggtaaaaccctgggcgaaggagagtttggtaaggtggtcaaggcaactgcatttcatctgaaagggagggctggatacactactgtcgcagtgaagatgctcaaagaaaatgcgtccccctcggagttaagggatcttttgagcgaatttaatgtgctcaaacaggtcaatcaccctcacgttattaaactttatggagcttgttctcaggatggtccccttctgcttattgtggagtacgcgaaatacggctctctgcgtggttttttacgcgaatctcgcaaggtgggacccggttacttgggttcggggggatctcgaaatagttcctccctggaccacccagatgaaagagccttaaccatgggggatttgatcagctttgcctggcagatttctcaggggatgcagtatctcgccgagatgaagctggttcatcgggacctggccgctcggaacatccttgttgccgagggaagaaagatgaaaatcagcgacttcggtttatctcgggacgtgtatgaagaggattcctacgtcaaaagaagtcagggacggatccccgtgaagtggatggcaatcgagtccttgtttgaccatatctatactacccagtccgacgtgtggagcttcggggtcctgctttgggagatcgtcactctggggggcaacccttatccagggatcccgcccgagagattattcaatctgctgaagacaggccatcggatggaaaggcccgacaattgtagtgaggaaatgtacagacttatgttgcaatgctggaagcaagagcccgacaaacgaccagtgtttgcggatatctccaaggacctggagaaaatgatggtgaaaaggcgagattacttggacctggctgccagcaccccatccgattcgctcatttacgacgatgggctgagcgaagaggagacacctctggtcgactgtaacaacgccccactgcctagagcccttccaagtacctggatcgaaaacaagctgtacggccgcatcagccacgcctttacgcgtttttag

SEQ ID NO: 132209 - DNA, 3345 bp, Artificial Sequence
  Description of Artificial Sequence: Synthetic coding sequence
atggctaaagctacctccggagccgcgggtctgagactgctcctgcttctgctgctcccgttgctgggcaaagtggcattgggcctatacttcagtagggacgcatattgggaaaaactgtacgtcgaccaggcggccgggaccccacttctgtatgtgcatgccttaagagatgcccctgaggaggtccccagcttcaggttggggcagcatctctacggaacgtaccgaacaagactccacgagaacaactggatatgtatccaagaggacaccggcctgctgtacctaaatcggtcactggaccattcatcctgggaaaaactcagcgttaggaatcggggatttcctctcctcaccgtgtatctgaaagtcttcctgagtcccaccagcctgagagagggcgagtgccagtggccgggctgtgcccgcgtgtacttttcgtttttcaatacctctttccctgcttgtagttctttgaagccgagggaactctgctttcccgaaaccagacccagtttccgaatccgtgagaaccgacccccaggcacattccaccagttccggctgctgcctgtccaatttctgtgtcctaatatttcagtagcataccgtctgctcgaaggggaggggttgccattccgatgcgcccctgattctctcgaggtatccacaagatgggctctggatcgagagcagcgcgaaaagtacgagttagtcgccgtctgcacagtccacgctggtgccagagaagaggtggtcatggttcctttccccgtcactgtctacgatgaagatgatagcgccccgacgtttcccgcgggggtggacacagcctcagctgttgtagaatttaagcgcaaggaggacacagtggtggccaccctgcgagtgttcgatgcagatgtcgtccccgcaagcggcgagctggtgcgccgctacacgagcacactcctccccggcgacacctgggcccagcaaacgttccgcgtggagcactggccaaacgaaaccagcgtccaggcaaatgggtctttcgttagagctactgttcacgactaccgcctggtcttaaaccggaacctctccatctcagaaaatcgcacaatgcagctcgctgtcttggtcaatgattctgactttcagggtccaggagccggcgtgctcctattacactttaacgtctcggtgctgcctgtgtcactgcacctgcctagcacatacagcctttctgtcagcaggagagcgcgtagatttgctcaaataggcaaggtatgcgtagaaaattgtcaagccttttccggcattaacgtgcaatataaattgcactcctccggagccaactgtagcacactgggcgtggttacatctgcagaggatacatccggtattctttttgtgaatgatacaaaggctcttcggaggcccaagtgtgcagaactgcactatatggtggttgccactgatcagcagacatcacgacaggcccaggctcaactgcttgtgaccgtcgaaggcagctatgttgcagaagaagccggctgcccgctatcttgcgcagtttccaaaagaagattggagtgtgaggaatgcgggggtcttggctctccaacgggacgttgtgagtggcgccagggagatggaaaggggatcacccgtaacttctccacatgttcaccttcaacgaagacatgccctgacgggcactgtgatgtggtggaaactcaagacatcaacatatgtcctcaggactgcctgcgcggttccattgtcggcggtcacgaaccaggagagccacggggcatcaaagcagggtacggcacatgcaattgtttccctgaggaggaaaaatgtttctgcgagccggaggatatacaggacccactttgtgatgaactctgccggaccgtcatcgcagcagccgtgcttttttccttcattgtgagcgtcctcctgagtgccttttgtatccactgttatcataagttcgctcataaaccccccatttcaagtgcagagatgacgttcaggagaccagcccaggccttccctgtgtcctacagcagctccggcgcccgtaggcctagtcttgacagtatggaaaaccaggtcagcgtagatgcctttaaaatcctcgaagatcccaagtgggaatttccaaggaaaaacctggtgctgggcaaaactcttggcgagggagaattcggtaaggtggtgaaggctaccgcctttcatctgaaagggagagcaggctacactaccgtcgccgtgaaaatgctgaaagagaatgcgagtcctagcgagctccgcgacctcctctccgaatttaacgtgttgaaacaagttaaccatccccacgtaattaagctttacggggcctgtagccaggatggacctctcctgctgatcgttgaatatgccaaatacggaagcttgagggggttcttgcgggaaagccggaaagtcggacccggttacctggggtcgggtggaagcaggaacagttccagcctggaccaccctgatgagcgggcattaactatgggcgacctgatctccttcgcctggcaaatttcccaaggcatgcagtatcttgcagaaatgaaactcgtccatcgtgatttggctgctcggaacattcttgtagctgaggggcgtaaaatgaaaatcagcgatttcggattgtcaagggatgtgtacgaggaggattcttacgtgaagaggtcacaggggcgtatccccgtgaaatggatggccatcgaatcattattcgatcacatatataccacccagtccgacgtgtggtctttcggggtcctgctctgggagattgtgacactgggcggcaacccctaccctggaataccccccgaacgattgtttaatcttctaaaaaccggccacagaatggagcgcccagacaactgtagtgaagagatgtataggttgatgctgcaatgttggaagcaggagccagacaaaaggccagtgttcgccgacatcagtaaagatcttgagaagatgatggtcaagaggagggattacctcgacctggcagcgtccacaccgtcggactccctgatctacgatgacggactgagcgaggaggagacccctctagtggactgtaacaacgccccactgccgagggccctgccttccacgtggatcgagaacaaactgtatggcatgtctgatccaaattggcctggcgaatcgcccgttccactaacaagggcggacgggactaacaccggattccctaggtatcccaatgactcggtgtacgctaattggatgttatctccctctgccgcaaagctgatggacacgttcgattcctag

SEQ ID NO: 132210 - DNA, 1377 bp, Artificial Sequence
  Description of Artificial Sequence: Synthetic coding sequence
atggctaaggccacttctggggcagcggggttaaggttgttgctgttgctgctccttcctctgcttggcaaagtcgcactcggtctgtatttcagccgggacgcctactgggagaaactgtacgtggatcaggcagccgggactccactcctatacgtccatgccctgcgcgacgcccctgaggaggtgccttcattccggttaggacagcacctgtatggaacttaccgaactcgcctgcacgagaataactggatttgcatccaggaagacacagggctgctttatttaaatcggtcattggaccactccagctgggagaaactgtccgttaggaaccgcggcttccctctgttgaccgtgtacctcaaggtttttctgtcccccacgagtctgagggaaggagaatgtcagtggccaggatgtgcccgcgtttatttctctttcttcaacacatctttccctgcatgttccagtctgaagccacgagaactgtgttttcccgaaactcggccctcgttcaggattcgggaaaacaggcctcctggaactttccaccaatttagactgctgcctgttcagtttctctgccccaacatttccgtggcttacaggctgctcgagggcgaaggcttaccctttcgctgcgctcccgactccttagaagtttccactcgatgggctttggaccgtgaacagagggagaagtacgaattagtggccgtctgtaccgttcacgcaggggcccgtgaagaggtagtgatggtcccgttccccgtcacagtgtacgacgaagacgactcggctcccacttttcccgccggtgtggataccgcttcagctgtggtggagttcaagcggaaggaagacactgtagtggcgaccctgagggtttttgatgccgacgtggtccccgcctccggcgagctggtgaggcgatataccagcacactgttgcccggcgatacctgggcccagcagacattccgggtagagcactggcctaacgagacatccgtccaggcgaatgggtcatttgtgagagctaccgtgcacgactacaggttagtgctgaatcgaaacctgtccatatctgagaaccgcaccatgcagttagccgtgttggttaacgatagtgactttcaagggcccggtgccggggttttactccttcactttaacgtgtctgtgttgccggtctctctgcatctgcccagcacttactccctttctgtctctcggcgagcccggcgcttcgcccagatcggaaaggtctgcgttgagaattgcctggctgacctgactggagatgctgtgtctggtcgcgatgaggcacgcagctccggactcggatctcagaagcaccctggctcgtag

SEQ ID NO: 132211 - DNA, 786 bp, Artificial Sequence
  Description of Artificial Sequence: Synthetic coding sequence
atggacgaggcgctggaaactcagctgaaaacgagcaggggcaggtttagcgccacagaatcactgcctacattggagctgctcagtcaagtggatatggattgtagggtgcacatgcgcccaatcggactcacctgggtgctccagctcacattggcgtggattcttttagaagcatgtggcggcagtagacccttacaagctcggagtcagcaacaccacggcttggcagcggacctgggcaagggaaagctgcaccttgctggtccatgttgtccatccgaaatggacactaccgagactagtggccccgggaatcaccctgagcgctgcggggtcccatctcccgagtgtgagtcatttctggaacatctgcagagggccctgcgaagccgatttagattaagactgctgggtgtccgacaggcccagcccctctgcgaagaattatgtcaggcttggttcgccaactgtgaggatgatattacatgtggccccacatggctgcctctctccgaaaaacgcggttgcgaaccaagttgcctcacctacggtcagacgtttgccgacggtactgacctgtgtaggagcgctctgggccatgcactgccagtggccgcccccggcgcccggcattgctttaatatctccatttctgccgttccccgtcctcgtcccggaaggagggggcgagaagcccccagccggcggagtagaagcccacgcacgtctatacttgatgccgctggttccggatccggatctgggtccggctctggaccttag

SEQ ID NO: 132212 - DNA, 675 bp, Artificial Sequence
  Description of Artificial Sequence: Synthetic coding sequence
atgggctggcagctcatttgggcaaaagcatcatgcacttggcaagatttggtcgtgcctcagcgctggacacagcagcgacatcgcgcactagagaccatccaaaacgccgtggagtgtcgggccctgaatgctaacccaagctggaacacatcgaatgtcccttttgctgtcgcgagtgcatgcggatattggggctatgctcggcactcccgctcagctcggagctcagcaagaccagggtctccaacggctaaaatgatttctccagcggctcgccttggatctcatagccagaaaaaaggcgccgtgtcccccgctgctcttcctatggataggcttgagtgcagcggcgctatctctgccagatgtaacctgcgcttaagggggagcagcgactcacctgcagctacatctcgcatcgccgggatttctggcgcgtgccaccatgcccagcttatttttgttttcctcgtagagagtgcatttcaccatgtgggccaggccggattcgagctgttgacaagtggcgacccacccacatccgccagtcagtctgtgggcatcacaggggtaagtcacaggcctagacctccaccatcatccttcctaccctgtctagatccccgtgacaggatcggcactcctcaggtcccagcgcctacgttaccgtag

SEQ ID NO: 132213 - DNA, 690 bp, Artificial Sequence
  Description of Artificial Sequence: Synthetic coding sequence
atggactgccgggtgcacatgagaccaatcggcctcacctgggtgcttcaactgacattagcatggatactgttagaagcatgcggcgggtctagaccactgcaggctagaagtcaacagcatcatgggttggcagctgacctggggaaggggaagctacacttagctgggccttgctgtcccagcgaaatggacacgacagagacatccggccccggtaaccaccccgaacgatgtggagtgccatctcctgagtgtgagagctttttggaacacctccagcgcgcgctgcgttcacggtttcgcctgcgtcttctgggtgtccgtcaggctcaacctctttgcgaagagttgtgccaggcctggttcgctaattgcgaggacgacattacgtgcggccccacctggctccctttgtctgaaaagcgtggatgcgagccatcgtgtcttacatatggccaaacattcgctgacggaaccgatctctgcaggagcgcactcggccacgccctgcctgtcgccgctcctggcgcgcgtcactgcttcaacatatcgataagtgccgtcccccgcccacgtccggggcgcaggggtagagaagcccctagcaggcggtctcgcagccccagaacatctattttggacgctgccggctccggctcagggagcggttccggctcaggtccatag

SEQ ID NO: 132214 - DNA, 618 bp, Artificial Sequence
  Description of Artificial Sequence: Synthetic coding sequence
atggatgaagctctagaaacccagctgaaaacctcacgcggacggttcagcgctacagaatcccttcccacactcgagctcttgagccaggtggatatggactgtcgggtccacatgcgacctatcggtctgacctgggttctgcaactgacacttgcatggatattactggaggcttgcggaggcagccgccctcttcaggccaggagtcagcagcaccatgggcttgccgccgaccttggcaaaggcaagctgcacctggccggaccatgttgtcccagcgaaatggatacaacagagacttctggtccaggaaaccaccctgagagatgcggggtcccctccccagagtgcgaatctttcttggagcaccttcagagggcgctgcgctcacggtttagactgcgcctgctaggtgtgagacaagctcagcctctgtgtgaggaactttgtcaagcctggtttgctaattgtgaagacgacatcacttgtggacccacctggctgcctctgtccgagaaaagggggtgtgagcccagctgcctgacctacggacaggccggagtgcagtggcgtgacctgagcagtatgcagcctcccccacccggattcaagtag

SEQ ID NO: 132215 - DNA, 720 bp, Artificial Sequence
  Description of Artificial Sequence: Synthetic coding sequence
atggcgcgccagctcctgtcacaggtagacatggactgccgtgtccatatgagacccatcggcctcacctgggtgctgcagctgaccctcgcctggatcctgctggaagcatgcggagggtcacggcctctccaggcacgatctcaacagcaccatggcctagcggccgaccttgggaagggcaaactacacttggcaggtccttgttgtccatctgaaatggacaccactgagacatctgggcctggaaaccacccagagcggtgcggcgtgcccagtcccgagtgcgagagcttcttagagcacttgcagcgggccctgaggagtcgttttagactgaggttactgggggtgcggcaggcgcagccactatgcgaggaattgtgtcaggcctggttcgcaaactgcgaggatgacatcacatgtggccctacctggctaccattaagcgaaaagaggggctgtgaaccaagttgtcttacatatggtcagacattcgctgatggaaccgatctgtgtcgatctgctctagggcacgccctgcctgtcgctgcaccaggagcaaggcactgttttaacatttctatttccgccgtcccccgtccgcgccctggacgccggggccgagaggccccatctcgccgcagcagaagtcctcggacttctatactcgatgctgccggctccgggtcaggctctgggtcaggcagcgggccatag

SEQ ID NO: 132216 - DNA, 996 bp, Artificial Sequence
  Description of Artificial Sequence: Synthetic coding sequence
atggctcgcggaggacggggacgacgtctggggcttgcattgggccttctcttagccctggttttggcccccagggttctgcgggctaagcctaccgtccggaaggaacgcgttgtacgcccagacagcgaactgggcgagcgccctccagaggacaaccaatcttttcaatatgaccacgaggcatttctcggcaaagaagacagtaaaactttcgatcagctcacaccagacgaatccaaggagagactcggaaaaattgtggaccggatcgataacgacggcgatggcttcgtgaccacagaagagctgaaaacttggatcaaacgggtgcagaaacgctacatttttgataatgtggccaaggtatggaaggactacgaccgcgacaaggatgacaaaatcagctgggaagaatacaaacaggcaacatacggatactatctcgggaatcctgccgagtttcatgactcctcagatcatcacactttcaagaagatgttaccgcgggacgagagacggtttaaggctgctgatcttaacggcgatctgacagccacacgggaggaattcaccgcttttctgcacccagaagaattcgaacacatgaaagagatcgtggttctggaaactctggaggatatcgacaaaaacggcgatggatttgtggatcaggacgagtacattgctgacatgttttctcacgaagaaaatggccctgagcctgactgggtcctgtctgagagggaacagttcaacgaattcagagacttaaataaggatgggaagcttgataaggatgagattaggcactggattctgccccaggactatgaccatgcacaggcggaggccagacacctggtgtacgagtccgacaagaataaggacgaaaaactaacaaaagaggagattctggaaaattggaatatgtttgtgggatctcaggccactaattacggtgaggacctgactaaaaatcacgatgagctgtag

SEQ ID NO: 132217 - DNA, 87 bp, Artificial Sequence
  Description of Artificial Sequence: Synthetic coding sequence
gagatactggagaactggaacatgtttgtcgggtcacaggccaccaactatggcgaggatctcactaaaaaccatgatgaactgtag

SEQ ID NO: 132218 - DNA, 954 bp, Artificial Sequence
  Description of Artificial Sequence: Synthetic coding sequence
atgaggctcggacccagaaccgctgctctaggcctgctgctcctttgcgctgcggcggctggagcaggcaaggcggaggagctccattatccactgggggagagacgaagcgactacgatagagaggcgctgctgggagtacaagaggacgtcgacgagtacgtgaaactggggcatgaggaacagcagaaacgtctccaggccattatcaaaaagattgacctggacagtgatggcttcctgacagagtctgagctctccagttggatccagatgtcgtttaagcactacgctatgcaggaagccaaacagcagtttgtagagtatgataagaactctgatgatacagtgacatgggatgagtataacattcaaatgtatgatagagtgatcgatttcgatgagaatacagccctggatgacgccgaggaagagagctttcgcaagttgcatcttaaagataaaaagcgatttgagaaagcaaaccaagactccggtccaggcctcagcttggaagaattcattgcctttgagcaccccgaagaagtcgactacatgacggaatttgtgatccaagaggcactggaggagcacgacaagaacggagatggcttcgtcagcctcgaggaatttctgggcgactatcgctgggatcctaccgctaacgaagacccagagtggattcttgttgaaaaggacaggtttgtgaacgattatgataaagataacgatggcagactcgacccacaggagctgctgccctgggtggtgcctaacaaccagggaatcgcacaggaggaggccctgcatcttatcgatgagatggatttgaatggcgataagaagttgagcgaagaagagattctggaaaaccccgatctctttctcacttccgaggccacagattacggaaggcaactgcacgacgattatttttaccacgatgaactctag

SEQ ID NO: 132219 - DNA, 2331 bp, Artificial Sequence
  Description of Artificial Sequence: Synthetic coding sequence
atggccgcccccggtgacccccaagatgaactgctgcctctggctggtccaggatcccaatggctgcggcataggggcgaaggagaaaatgaagctgtgacaccaaagggagcaacccccgctccacaggctggtgagccatcgcctggacttggagcacgcgccagagaagccgcaagcagggaggccggtagcggacccgctcgtcaatccccagtggccatggagaccgcttcaaccggcgtcgctggagtctcaagtgcgatggaccacaccttttcaaccacatcaaaggacggggagggatcctgctacacttctctcatctccgatatttgctaccctccgcaagaggattccacatattttacaggaattctgcagaaggaaaacggtcatgtgacaatttctgaaagtcccgaggagctggggacgcctggtccatctctgccggatgtccctggaattgaatccaggggcctgtttagctccgatagcgggattgaaatgacccccgctgaaagcactgaagtcaataagattctcgccgacccactggatcaaatgaaagccgaagcttataaatatatcgatataacacggcctgaggaggttaagcaccaggagcagcatcacccggagcttgaggacaaagacttggacttcaagaataaggacaccgacataagcataaagcctgagggtgtcagagaaccggataaaccggcacccgttgagggcaagatcatcaaagaccacctcctagaagagagtacttttgccccatatatcgatgacctgagcgaggagcagcgccgggcgccacaaattactacacccgttaaaattactctgaccgaaattgagccgagtgttgaaacaactacccaggaaaaaactcccgagaagcaggatatatgtctcaagccctcccctgacaccgtgcccactgtgaccgtgtcagagccagaggacgatagtcctggctcaattacacctccatctagtgggaccgaaccgagcgcagccgagtctcaaggcaagggtagcatctcagaagatgagctcataaccgccatcaaagaagccaaaggtttatcttatgagaccgcggaaaatcccaggcccgtaggccagctcgccgatcggcccgaggttaaggcccgtagcggtcccccaaccattccatctcccttggaccacgaggccagtagtgcggagtctggggactcagagatcgagttagtcagtgaggacccaatggccgccgaagatgccttgccttctggatacgtgagtttcggccacgtgggaggtcctcctcctagtccagccagtcctagcattcagtacagcattctgcgtgaggagagggaagccgaactggacagcgaactaatcatcgaatcttgtgatgcaagttcggcaagtgaagaatcaccaaagcgtgagcaggattctcctccaatgaagccaagcgctctggatgccatacgcgaagaaaccggagtgagggccgaagagagggctccctcgcgcagaggcctggccgagcctggttcctttctggactatccgagtacagagccccagccaggcccagagctgccacccggtgacggggcattggagcctgagacaccgatgcttccccgtaagccggaggaagatagctcaagtaaccagagccctgcagccaccaaggggccaggccccttggggccaggtgctccaccaccgctgctctttctcaacaaacaaaaagctattgatctgctttactggagggatattaaacagactgggatagtatttggaagctttctcctgttattgttctcattgacccagtttagcgtggtgtctgttgtggcttatctagccctggccgctctatcggctacaatctctttccgtatctacaagtctgtcttgcaggctgtgcagaaaacagacgaaggccacccatttaaggcttatctggaactagaaattacactctcccaggaacaaatccagaagtacactgactgtctccagttctatgttaacagcacacttaaagagctgcgacggttgttcctggttcaggatctggttgactccctcaaattcgcagttttgatgtggctgctcacctatgtgggcgccctgtttaacggattgaccttgctgctcatggccgtcgtgtccatgttcactctgcctgttgtttacgtcaagcaccaggctcagatcgaccagtacctgggcctcgtccggacacacatcaacgcagttgtggcgaaaatccaggccaaaattcctggggccaaacgccacgccgagtag

SEQ ID NO: 132220 - DNA, 627 bp, Artificial Sequence
  Description of Artificial Sequence: Synthetic coding sequence
atgcaagctacagcggattccactaagatggattgcgtgtggagtaactggaaatcccaggccattgacctcctgtattggcgtgatatcaagcaaacaggcattgtctttgggtcttttctgctgttgctgttcagcctgacacagttctctgtggtttcagtggtcgcttacttagctttggctgctttgtccgccacgatatctttccgcatttacaagtctgtcctgcaagctgtccaaaaaacagatgaggggcaccccttcaaagcctacctagagctggagatcactttgtctcaggaacagatacaaaaatacaccgactgccttcagttttacgttaactctaccctcaaagaactgcgccggcttttcctggttcaggacctggttgactccctgaaatttgctgtacttatgtggctcctaacctacgtaggagccctttttaatggcctgaccctgttactgatggctgtggtcagcatgttcacactgcccgtggtatacgtcaagcaccaggcacagatagatcaatacctgggattggtgagaacacatataaatgccgtggttgctaagatccaggcaaaaattcccggagctaaaaggcacgccgaatag

SEQ ID NO: 132221 - DNA, 1071 bp, Artificial Sequence
  Description of Artificial Sequence: Synthetic coding sequence
atggccgcggaggatgccttacccagcgggtacgtgtcttttggccatgttggtgggccacctccctccccagcctctccctccatccagtactctatcctacgagaggaacgcgaggccgagttagatagtgaactaatcatcgagtcatgtgacgcctcatctgcctcagaagaatccccaaaaagagagcaggatagccctccgatgaagcccagtgccttggacgccataagagaagaaaccggcgtgcgggctgaggaacgcgcccccagtagacggggcctggcagaacctggctcatttctggattacccgagtaccgagccacaacccggcccggagctacctcctggtgacggagctctcgagcctgagacacccatgctcccaaggaagcctgaagaagattcatcttccaatcagtcccctgcggctacgaagggtcctggcccccttggaccaggggccccccccccactgctgttcctgaataagcagaaggctatcgacctactttattggagggacattaagcagaccggaatcgtgttcgggagttttctgctactactgttctcacttacccagttctcagtagtgtctgttgtggcctatctggccctggcagcacttagcgcgacaataagcttcaggatttacaagagcgtgttgcaggccgttcagaagaccgatgagggacaccccttcaaggcttatttagagcttgagataactctttctcaagagcagatacaaaagtatacagactgcctgcagttttatgtaaactccacactgaaggaactcaggaggctatttctcgtacaggatctggtggatagtttgaagtttgctgtactcatgtggttattgacatacgtgggcgccctatttaacggcctcactttactgcttatggcagtggtctccatgttcactctgccagttgtctacgtgaagcatcaagcccaaatagaccagtatctgggtcttgtgcggacacacatcaacgcagtggtggctaagatacaggccaaaatacccggagccaagcgccatgcggaatag

SEQ ID NO: 132222 - DNA, 2109 bp, Artificial Sequence
  Description of Artificial Sequence: Synthetic coding sequence
atggaaactgcctctacgggcgtggctggagtcagctcggctatggaccatacattttcaacgacatccaaggacggagaaggctcatgctacacatcccttatatccgatatctgctaccctccgcaggaagattctacctattttaccgggatactgcagaaggagaacggccacgtgacaatctctgagtcccctgaggagttgggcacacctggaccatcattgccagatgtgcctggcattgagagcaggggactgttttcaagtgatagtgggatcgaaatgacccctgctgagtctactgaagtaaataagatattagcagaccccctggaccagatgaaggctgaagcgtacaagtacattgatattacccggccagaggaagtaaaacatcaggagcaacatcaccccgaactagaggataaggacttagatttcaaaaataaggatactgatattagtattaaacccgaaggagtgagagaacccgataagccagcaccagtcgaagggaagataataaaggatcatttactggaagaatctacatttgccccctacattgacgacctcagcgaggagcagcgacgtgctcctcagatcacgacgccggtgaaaatcacactaacggaaatcgagccttcagtcgaaactaccacccaggaaaaaactcctgagaaacaagacatttgtcttaaacccagccctgatacggtgcctacagtaacagtgagtgagcctgaggacgacagccccggaagtattacacctccatcttcaggtaccgaaccatctgcggctgagtctcaggggaagggcagtatctcagaggatgaactgatcacagccatcaaagaagccaaaggactgtcatatgagactgccgagaaccctaggccagtgggacagctagcagaccgcccagaggtcaaagcacggagcggtcctccaaccatacctagtccactggatcacgaggcttcttcagcagagtcaggagacagcgagattgagctggtaagtgaagaccctatggccgcagaggatgctttgccctctggctacgtgtcgttcggccacgtggggggtccccctccctccccagcttctccgtctattcagtattctatactgagggaagaacgcgaggccgagctcgattcagagctaattatagagtcctgcgatgccagttctgcctccgaagagtcccccaagagagagcaggattcccctcccatgaaacccagcgccctagatgcgattcgggaagaaaccggggtgagagcagaggagcgcgctccatcacgtagagggcttgccgagccaggaagttttctggactatcccagcaccgagcctcagcctgggccagaactgcccccaggggatggtgccctggaaccagaaacacccatgctccctagaaagcctgaagaagatagctcatcaaaccagtcacccgctgccaccaaagggcccggaccactgggccccggagccccgccgcccctgctgtttctgaataaacagaaggccatagatctgttgtattggcgcgatattaagcagaccggcatcgtgttcggctccttcttgctgcttttgttcagcctcacgcagttcagcgtagtgtctgtcgttgcctatctggcgctggcagccctgagtgccacgatctccttccgcatctacaaatcagtcttgcaagcggtccaaaagacggacgagggacacccgtttaaggcctacttagagcttgaaatcaccttatctcaagagcaaatccagaagtataccgactgcttgcagttctacgtgaacagcaccctgaaggagctgcgccgcctttttctcgttcaggacctagtcgactccctgaaatttgcggtacttatgtggctgctgacctacgtgggcgcactcttcaatggcctgacgttgctcctgatggcggttgtgtctatgtttactctgcccgtggtgtacgtaaagcaccaggcccaaattgaccagtacctgggccttgttagaactcacatcaatgccgtggtggcgaagattcaggccaagattccaggggcaaaacggcatgcagaatag

SEQ ID NO: 132223 - DNA, 1638 bp, Artificial Sequence
  Description of Artificial Sequence: Synthetic coding sequence
atgggccaagtcctccccgtgtttgctcattgtaaagaggcccccagcactgcttcatcaaccccggacagtacggaaggaggtaatgacgactcagacttccgcgagctccacaccgcccgcgaatttagcgaagaagatgaagaggaaaccaccagccaggattggggcactccaagggagctgaccttttcttatatcgctttcgacggcgttgttggttccggaggaagaagagacagcactgctcgccgtcccaggccacagggacgttcagtctctgagccccgcgaccagcacccacagccctccttaggggactccctggagagcattccatccctatcacaatcaccggaaccggggaggagaggggatccagacactgctccaccatccgaacgtccattggaggatctgaggttgcgacttgaccatctgggctgggtggcaagggggacaggctcaggcgaagattcaagtacatccagctctactcctctggaggatgaggagccacaagaaccaaaccgcctagagaccggggaggcaggagaagagctggacttaagactgaggttggcacagcctagctcccctgaagttttgacaccacagttgtctcctggctctgggacacctcaagcgggtaccccctccccgtctcggtctagggattcaaacagcggtcctgaggagcccctcctggaggaggaagagaaacagtggggcccccttgagcgagaacctgtacggggccagtgcctggacagcaccgaccagctggagttcacagttgaacctagactgcttggaaccgccatggagtggctgaaaacctcccttttactggctgtctataaaacggtcccaattcttgagctcagcccacctttgtggacggctattgggtgggtccagcgcgggccaacccctcctactcctgtcttgcgggtcctgctgaagtgggccaagagcccacgatcaagcggagtgcctagcctctccctgggcgcagacatgggctctaaagtggccgatctgctgtactggaaagacaccaggacctcaggagtggtgtttacaggcctgatggtgtcccttctctgcctgttacacttctcaattgtttcagtggccgctcatttggccctgctgctcctctgcgggactataagcctgcgtgtgtacagaaaagtgttgcaggctgtgcataggggggacggtgccaaccctttccaagcctatctcgacgttgatctgacgctgactcgcgagcaaaccgaaaggctctcccaccagattacgtctcgtgttgtgtccgctgcgacgcagcttaggcacttctttctggtggaagacctggtggactccctgaagctggccttgcttttttatatcctgacttttgtgggggccattttcaatggcttaacactccttattctcggcgtaattggcttgtttacaatcccccttttataccgacaacatcaagcacagattgatcaatatgtagggctggtgactaaccagctgtcccacatcaaagccaaaattagggccaagatccctgggaccggggctctggctagcgccgctgcagccgtttccggctcgaaggccaaagctgagtag

SEQ ID NO: 132224 - DNA, 1419 bp, Artificial Sequence
  Description of Artificial Sequence: Synthetic coding sequence
atgggtcaagttctccctgtgttcgcacactgtaaagaggcccccagcactgcttcctctacccccgacagtactgagggtggaaacgacgactccgattttcgcgaattacatacggccagggaattcagtgaagaagatgaggaagaaacaaccagtcaggattgggggaccccaagggaacttacattctcgtacattgccttcgacggggtcgtgggaagtgggggccgtagagactccactgctcgacggccacgcccccaaggacgatctgtgtccgaaccgagagatcagcacccccaaccctccctcggtgactccctggaatcaattccaagcctctcacaatcacctgagcctggcagaagaggggaccccgacactgctccacctagtgaaagaccactcgaagacctgcgcttgcgcctcgatcatcttgggtgggttgcgcggggaacgggctcaggcgaagattccagcacgtcttcctccacgcctctggaagacgaggagcctcaggagcccaatcgattagagacaggcgaggctggagaggaattagatttgcgtctccgccttgctcaaccgtcatcccccgaggttttgacccctcagttatctcccggatcgggaacgccgcaagctggtacaccctccccaagtcgcagccgcgactcgaacagcggaccagaggagcctctgctggaggaggaggagaagcagtgggggccgcttgagcgagagccagtaaggggccaatgcctcgactcaaccgaccagctggaattcaccgtcgaaccccgcctattggtcgcagacctcttgtattggaaagacacacgcacctccggagttgtgttcacaggcctgatggtatctcttctctgtctgctgcacttctccatcgtgtccgttgctgcccatcttgcgctgctgctgttgtgtggcacgatttccctgcgagtgtaccgcaaagtgctgcaggcagtccacaggggggacggcgctaacccctttcaggcttacctcgatgtagatctaaccctgacacgggaacaaacagaacgactgtctcaccagatcacctcgagggtggtttctgctgccacccagctcaggcattttttcctcgtggaggacctcgtggattccctcaagctggccctgctgttttatattttgaccttcgtgggggccattttcaatggcctgacgctgttgatcctgggcgttattgggctgtttacgatcccactgctttaccggcagcatcaggcccagatcgaccagtatgtcggcctggttaccaatcagctttcccacatcaaagcaaaaatcagggcgaaaatccctggaactggcgcgttggcaagtgccgctgccgctgtgtccgggtcaaaggcaaaggccgagtag

SEQ ID NO: 132225 - DNA, 618 bp, Artificial Sequence
  Description of Artificial Sequence: Synthetic coding sequence
atggggtcgaaggtcgctgatcttctgtattggaaggatacgaggacctccggggttgtgtttactgggctgatggtgtccctgctttgtctgctgcatttttcaatcgtgagtgtcgcagcacatctggcgctgctactgctgtgcggcacaatttctttacgggtatatcgcaaggtgcttcaagccgtccatcggggagatggcgcaaacccattccaggcctatttggatgtcgatctcacattgacccgcgaacagacggagaggctgagccaccagataaccagcagagtggtgagtgctgccacccagctccgccatttctttctcgtggaggacttggtggacagcttgaagttagcccttcttttttatattttaaccttcgttggagctatctttaatggactgacgttgctaattctgggggtgattggtctgttcaccatccctctgctttatcgccagcatcaggctcagattgatcagtacgtgggactggttacaaaccagctgagccatatcaaagctaagattagggccaaaattccaggaacaggagccttagccagcgcagcagccgccgtctccgggtccaaagccaaggccgagtag

SEQ ID NO: 132226 - DNA, 3042 bp, Artificial Sequence
  Description of Artificial Sequence: Synthetic coding sequence
atggcagaacccagcgcagccacgcagtcccattcaataagcagcagttccttcggtgcggaaccgagcgctcccgggggcggcggtagcccgggagcttgtcccgcactcgggactaagagctgctcttcatcatgcgcagagggcctcagttccctgtgctctgatgagccttcctccgaaattatgacaagctctttcttgagctccagtgaaattcacaacacgggtttgacaatcctgcatggagagaagtcccacgtccttggcagccagcccattctggctaaggaaggaaaggaccacttggacctcttggatatgaagaagatggaaaagccccagggcacgagtaataatgtgtcagacagctccgtctccctggctgcaggggtgcactgtgaccggccttccattcccgctagcttccctgaacaccccgcctttctgagtaagaagatcggccaggttgaagaacagatagacaaggagactaagaaccccaacggcgtgtccagcagggaggccaagaccgcgctcgatgcagacgatcgattcactctgttgaccgcacagaagccccctacagagtattccaaggtggaaggaatctacacttactctctgagccctagtaaggtatcaggggatgatgtgatcgagaaggattcccccgaatcacccttcgaggtcattatcgataaagcggcattcgataaggagtttaaagattcctataaggaatcgactgacgatttcgggagctggagcgtgcataccgataaggagtcctctgaagatatctcggaaactaacgataaactgttccccctcaggaacaaggaggccggcaggtaccctatgagtgctctgctcagccggcaattttcacacacaaacgcggcactggaagaagtctcccgttgcgttaacgatatgcataacttcactaatgagattctgacatgggatctggtgccacaggtaaagcagcaaaccgataaaagctcagattgtataactaaaacaaccggactggatatgtcggaatacaactcggaaatcccggtagtgaacttaaaaactagcacccaccagaagacacccgtgtgtagcattgatgggtctacccctatcaccaagtctacaggagattgggctgaggcctctctgcaacaagagaacgctattaccgggaagccggtgccagacagcctgaattcaaccaaggagttctcaataaagggagtgcaaggcaacatgcaaaaacaggatgacacattggctgagctcccgggttccccgcctgaaaaatgcgacagtctcgggagtggagtggcaacagtgaaggtcgtgcttcccgatgaccatctgaaagatgagatggactggcagtccagcgccctgggcgaaatcaccgaggccgactcctcaggagagtcagacgacacagtgatagaggacattaccgctgacactagtttcgaaaataataagattcaggcagagaagccggtgagcattccatctgccgtcgtgaagacaggcgagagagaaataaaagaaattccatcctgtgagcgggaagaaaagacaagcaagaactttgaggagctggtctcagactctgaactccaccaggaccagcccgatatcttgggaaggagtccagcttctgaagccgcatgtagcaaggtaccagacacgaatgtctctctagaggacgtgtccgaagtggccccagagaagcccataacaactgaaaatcctaaactgcccagcaccgtctctccgaacgtcttcaatgagacagaatttagcctgaatgttactacctccgcttatctggagtctctccacggtaagaatgtgaaacacattgacgattcatcgcctgaagatctgattgccgctttcacggagactcgggacaagggtatagtcgatagtgagcgcaacgcgttcaaagcgatctccgagaagatgacggatttcaaaacaactcctcccgtggaggtcttacacgagaacgagagtggcggctcagaaatcaaagacatcgggtccaaatactccgagcagagcaaagagacaaatggctccgagcccctcggggtttttccaacacaaggaacaccggtggccagccttgatctagagcaggagcagctcactattaaagccctgaaggagctcggggagaggcaagttgagaagtctacctcagctcagagggatgccgaactcccaagcgaggaggtcttaaagcagacctttaccttcgccccagagagttggcctcagcggtcttacgatatcttggagcggaatgttaaaaatgggtcagacctgggcatctcacagaagcctataaccatcagggagactacacgcgttgatgcagtgtcttccctgtcaaaaacagaactcgtgaaaaaacatgttctggccaggctcctcactgactttagcgtccatgacctgattttttggcgggacgtgaagaagactgggtttgtatttgggaccacgctgattatgctcttgtccctggccgcattctcagtgatcagcgtagtttcctacctgatactcgctctgttatctgtgactatatcttttcggatttacaagtccgttatccaggccgtgcagaagagcgaggagggccacccatttaaagcttatctggatgtcgacatcaccctcagtagcgaggcctttcacaactatatgaatgcagccatggttcacattaatagggcactcaagctcattatacggctgtttctcgtagaagatcttgtggatagtctcaaacttgcagttttcatgtggctgatgacatacgtgggtgctgtgttcaacggcataacattgctgatcctagccgagctcttgattttctcggtgcctattgtgtacgagaaatacaagacccagatcgaccactatgtggggatcgcacgtgaccagaccaagagcatcgtggaaaaaattcaggcaaaacttcctgggattgcgaagaaaaaagccgaatag

SEQ ID NO: 132227 - DNA, 726 bp, Artificial Sequence
  Description of Artificial Sequence: Synthetic coding sequence
atggcagaaccatctgctgctacccagtcacactctattagcagcagctctttcggggctgagccatcagctcccggcggaggaggctcccctggtgcatgcccagctcttgggaccaagagttgtagcagctcctgtgctgtgcatgacctgattttctggagagatgtaaagaagactgggttcgttttcggcaccacactaatcatgctgctgtcactggctgctttctctgtgatctcagtggtgtcttatttgatcctggctctgctgagcgttacgatcagtttccggatttataagtccgtgatccaggccgtacagaagtcggaagaaggccacccctttaaggcctacttggatgtcgatattacactgagttctgaggccttccacaactatatgaatgccgccatggttcatataaatcgggctctgaagcttattataagactattcttggtagaggacttggtagattccctcaaattagccgtcttcatgtggttaatgacttatgtaggtgcagtctttaatggaattacactgctgattctcgctgaactgctgatattttccgtgcctattgtgtacgagaagtataaggaccccagcaaaaccccttggaacaggcaaaaaaaaggccgcatatccacctggaaacccgaaatgcagcagctgcttaagcaccatctcattgtcatcactagtctcctggttctgtag

SEQ ID NO: 132228 - DNA, 645 bp, Artificial Sequence
  Description of Artificial Sequence: Synthetic coding sequence
atggcagaaccaagcgcagcaacccagagccatagcatttcttcgtctagctttggtgccgagccttccgccccagggggaggtggctctcctggcgcttgtccagctctcggaactaaatcttgcagttctagctgtgctgtgcacgacctgatcttctggagggatgttaagaagaccggatttgtctttgggacaacattgatcatgcttctctcactcgcggctttttcagtgatttcagtagtgtcctatctcatcttagcacttctctctgtgaccatttccttccgcatatacaaatctgtcatccaagcagtacagaaaagcgaggagggccatcccttcaaaccccggttaataaccatgctggcctccccagagatacggccgagccaactgctgaaaaggagcaaacaaaatagcttggagtcccctaagaagcggcaaaacaaatatatggagactaggaatgccactgttaccaaaacgccttttaatagctataatgtcgtaacctgcactatgaaggaaaacactcaatgtcagctggagcccgcattccaggccttctttctgatctggtgtttccttccttctttccccttcaaccctcaataccaagcccagaagcttatggattag

SEQ ID NO: 132229 - DNA, 768 bp, Artificial Sequence
  Description of Artificial Sequence: Synthetic coding sequence
atggctgaacccagcgctgccacacaatcacacagtatcagttcttccagtttcggcgccgaaccaagcgcccccggcggcggcgggtccccaggagcttgcccggcattgggcactaagagctgtagttcgagttgtgctgacagttttgtgtcaagtagttcaagccaacctgtgagcttatttagtacaagccaggtgcacgatcttatcttttggagggacgtcaaaaaaactggctttgtcttcggaaccactcttatcatgctactgtcattggcagccttctctgtgataagcgtcgttagctatttaatactggcgctgctgtccgttaccatcagttttaggatttacaaaagcgtgatccaggctgtacaaaaatcagaagaagggcaccctttcaaggcctatctggatgtagatattacactctctagcgaggctttccataattatatgaacgctgccatggttcatattaaccgagctctaaagcttattatcaggttgttcctggtggaggacttggtggactccctaaaactagccgtcttcatgtggctcatgacatacgtcggcgcggtattcaacggtatcacgctcttgattctggccgagctcctcatcttcagtgtcccaatcgtctacgaaaaatataaaacccagatcgatcactatgtgggcatagcacgagaccagaccaagagcatcgttgaaaaaattcaggcaaagctacctggcattgctaagaagaaagccgaatag

SEQ ID NO: 132230 - DNA, 3099 bp, Artificial Sequence
  Description of Artificial Sequence: Synthetic coding sequence
atggcggagcccagcgctgcaacccaatcacacagcatatcttcaagcagcttcggagcagaaccgtcagcgccaggtggaggcggctcaccaggcgcatgcccggccctcggtactaaaagctgttcttctagttgcgcagattcgttcgtttcttcctcctcatcccagcccgtgtcactcttctcgacctcccaagaaggcctgtccagcctgtgctcagacgaaccatcgagcgagattatgacatcgtccttcctgagctcctccgaaattcataacacaggattaacaatcttacacggggagaagtctcacgtgctcgggtcgcagcctattttggcaaaagagggcaaggatcatcttgatctgctcgatatgaagaaaatggagaaaccacaggggacgtccaacaatgtttcagacagttcggtgtctctggcagccggcgttcattgcgaccggccttctattcctgccagcttcccagagcatcctgcttttctatctaaaaaaatcggtcaagttgaggagcaaattgacaaggagacgaaaaacccaaatggagtgtcaagccgcgaggccaagactgcactggacgctgatgacagatttactctactaacagcccagaagccacctactgaatactcgaaagtcgagggaatatacacctatagcttgagcccaagtaaggtttcaggagatgatgtgatcgagaaagatagccctgagtcaccctttgaggttatcattgataaggcagcttttgataaggaatttaaggattcctacaaagaaagtacagacgactttggatcttggtctgtacacacagataaagaatcgtccgaagacatttcagaaaccaatgataaactgtttcccctccgcaataaggaggccggcagatacccaatgagtgccctgctttccagacagttttctcacaccaacgccgcacttgaggaggtgtcccggtgcgttaatgatatgcataacttcaccaatgagatcttaacctgggacctggttcctcaggtcaagcagcagaccgacaagtccagtgactgtattacgaagacgaccggtttggatatgagcgaatataattccgagattcctgtggtgaatcttaaaaccagcactcaccagaaaaccccagtctgcagtattgacggctccaccccgatcacaaaaagcaccggcgattgggccgaggcatcactgcagcaggagaatgcaatcaccggaaagcccgtccctgatagtttgaacagtactaaggagtttagcattaagggcgtccagggaaatatgcagaagcaggacgacaccttggccgaacttcctgggagtcctcccgagaaatgtgatagtcttgggtctggagtggctaccgtgaaagtagtgttacctgatgaccatctaaaggatgaaatggactggcagtcctccgctctcggcgagatcacggaagcagattcctccggcgagtccgacgacaccgttatagaagacattactgccgatactagcttcgaaaacaataagatacaagcagagaagccagtcagtattccttctgctgtggttaagacaggggaaagagagattaaagaaataccatcctgcgagagagaagaaaagacctcaaaaaatttcgaggagctggtgtctgactctgagctgcatcaggatcaacctgatatattgggacggagtcccgcctctgaggcggcttgctccaaagtgccggacactaacgtgagcctggaggacgtttccgaagtcgctcctgaaaagcccattacaactgagaaccctaagcttcctagcactgttagtccgaacgtctttaatgagaccgagttctccttgaacgtaacgacttctgcatacttggaaagtcttcacggaaaaaatgtgaagcatattgatgattcctctcctgaggatcttatcgctgccttcaccgaaacaagagataaagggattgtcgacagtgagagaaatgcttttaaagccatttccgaaaaaatgacagatttcaaaaccacaccacctgtggaagttctccacgaaaatgaatctgggggctccgaaatcaaggatattggatccaagtactcagaacagagtaaggagaccaacggctctgagcctctcggagtgtttccaactcaggggactcctgtagcgtccctggacctggaacaggagcaactgactattaaagcccttaaggagctgggggagcgacaagtcgaaaagtcgacttctgcacagagagatgccgaacttccttcagaagaggtgctcaagcaaacattcacgttcgcacctgagtcttggccacagagaagctacgatatcctggaacggaacgtgaagaatggatctgatctgggtatatcccaaaagccgatcaccattcgggaaactacgagggttgacgcagtgagcagcctctcgaagactgaacttgttaaaaagcacgttctcgcccgcctcctgactgatttcagcgtgcacgatttaatattctggcgagatgtcaagaaaactggctttgtcttcggaaccactctaattatgctcttgtcccttgccgccttctccgttatctcagtcgtgtcttacctgatcctggcgctgctgtctgtaacgatctcattccgaatctacaaatccgtgatccaggcagtccaaaagagtgaggagggccacccatttaaagcctacctggacgtggacatcactttgtcctctgaggcatttcacaactacatgaacgctgccatggtccatatcaatagagctctgaaattgataatcagattatttctagtagaggatctggtagattcgctgaagctagccgtttttatgtggttaatgacttacgtcggggctgtgttcaacgggataaccctgcttattctggctgagctcctcattttttcagtgcccattgtctacgagaagtacaagactcagattgatcactacgttggcatagcacgagatcagaccaaatctatcgtggagaagatacaggcgaaactgccagggattgctaaaaaaaaggctgagtag

SEQ ID NO: 132231 - DNA, 372 bp, Artificial Sequence
  Description of Artificial Sequence: Synthetic coding sequence
atggcagaaccatctgccgccactcagtcgcactccatttcgagcagttctttcggtgcagagccaagcgcacccggcggagggggctcccccggtgcgtgcccggccctgggaactaagtcatgttccagttcatgtgccgtccacgatctgatattctggcgcgacgtgaagaaaacaggttttgtattcggcaccaccctaataatgctgctatcactcgctgccttttcagtgatttcagtggtatcatatctgatccttgccctgttatccgtgacgatctcctttaggatttataagagcgtgatccaggcggtgcagaagagcgaggaaggacacccatttaactggctgagttcctgcgggtag

SEQ ID NO: 132232 - DNA, 711 bp, Artificial Sequence
  Description of Artificial Sequence: Synthetic coding sequence
atggccgagcctagtgccgccacccagagccactccatttcttcctctagcttcggggctgaacctagcgccccgggtggcgggggcagccccggggcttgcccagcgctaggcacaaaatcatgcagcagctcttgtgcggtgcatgacctgatcttttggcgggacgtgaagaagaccggcttcgtattcggaacaaccctgattatgttgctgtccttagctgcattctcagtcatcagtgttgtctcatacctgattctagctctgctgagtgtgactatcagctttaggatttacaagagtgtgatacaggccgttcaaaaatccgaggagggacacccatttaaggcttatctcgacgtggacattactctaagttctgaagcttttcacaactatatgaatgccgcgatggtgcatattaacagggccctgaagctgatcatccgcctgtttctggtggaagacctggtggatagccttaaactcgcagtgttcatgtggctaatgacttacgtgggcgcagtgttcaacggtatcactttgctcatcctagctgagctcttgatcttcagtgtgcctattgtgtacgagaagtacaagacccagattgatcactacgtcggtattgcccgagaccagacgaaatcgatcgttgaaaagatccaagcaaagctccccgggatcgccaaaaagaaagctgagtag

SEQ ID NO: 132233 - DNA, 1122 bp, Artificial Sequence
  Description of Artificial Sequence: Synthetic coding sequence
atggaggacctagaccagtctcccctggtgtcttcctctgatagccctccccgccctcagcctgcctttaaatatcagtttgttcgcgaacctgaggacgaggaagaggaagaagaggaagaagaagaagacgaagatgaggacctggaagagctggaagtactagagaggaagcctgctgctggcctttcagccgcacctgttcccactgccccggcagccggggcccctctgatggacttcggcaatgacttcgtgccccctgccccaaggggtcctcttcctgccgccccccccgtggctcctgaacgacagccctcctgggatccaagccctgtgagttcaaccgtcccagcccccagcccactgtcagccgcggctgtctccccctcaaaactaccagaggacgatgagcctccagcccggcctccacccccacccccagctagtgtgtccccgcaggctgagcctgtgtggacacctccagcacctgcacctgctgcgcccccctccactccggcagccccaaaacgtcgtgggtcctcaggatctgttgtggttgatctcctatactggcgcgacataaagaaaacgggagtggtttttggtgcctccttattcctgcttttatcgctcactgtgttcagcatcgtgtccgtgacggcctatatcgctttagcattgctgtccgtgacaatctcattccggatctataagggcgtgatccaggccatccaaaagtctgacgagggccaccccttccgcgcctacctggaaagcgaggttgcaatctccgaggaactggtccaaaaatacagcaattctgcccttggccacgtgaattgcaccatcaaggagctccgtcggcttttcttagtcgacgaccttgtcgactcactgaagttcgcagtgcttatgtgggtatttacgtacgttggcgccttatttaatgggctcactctgcttattctggccctcattagtttattcagcgtccccgtgatctacgagcgccatcaggctcaaatcgaccattacctcgggctagcgaacaagaacgtgaaggacgccatggccaagatccaagcgaaaatccccggtcttaaacgcaaggctgaatag

SEQ ID NO: 132234 - DNA, 3579 bp, Artificial Sequence
  Description of Artificial Sequence: Synthetic coding sequence
atggaggatcttgatcaatcacccttggtcagttcctcagacagcccgccgcgtccacaacccgcttttaaatatcagttcgtgcgcgaaccggaggatgaggaggaagaggaggaggaggaggaggaggatgaggacgaagacctggaggaactggaagtccttgagagaaaacccgccgccgggttatccgcagcacctgttccgactgctcctgcggccggcgcaccacttatggatttcggtaatgattttgtcccacccgcgcctagagggccattaccggccgcccctcctgtagccccggaaaggcagccttcatgggacccatctcccgtttctagtacggtccctgccccctcccccctgtcagcagctgccgtgtccccttctaaactgccggaggatgatgagccccctgcccgacctccacctcccccacccgcaagtgtaagtccacaggccgaacccgtgtggaccccaccagcccctgcacccgccgcaccaccgtcaactccggctgctcccaagaggcgtgggtcttctgggagtgtggatgaaaccctgttcgccttgcccgcagcatcggagccagttataaggagcagcgctgagaatatggatcttaaggagcagccaggaaataccatctctgccggccaggaggatttcccgagcgtcctgcttgaaaccgctgccagccttccgagcttaagtcctttatccgcagctagcttcaaggaacacgagtacttgggcaacttgtctacagtgctacccacagaagggaccctccaggagaacgtcagcgaggcctcaaaagaggtcagcgagaaggccaaaacgctcctgatcgatagagatcttaccgaattctctgaactggaatactctgaaatgggtagttccttttctgtgagcccaaaagcagaatctgccgttattgttgctaaccccagggaggagatcatcgtgaaaaacaaagatgaggaagaaaagctggtctctaataatattctgcataaccagcaagaattgccaactgcactgacaaagctcgttaaagaggatgaagtggtctcctcggagaaagccaaagactcctttaatgaaaagagggtcgcggtggaagcccctatgcgcgaagagtacgccgatttcaagcctttcgaacgtgtgtgggaggtgaaggatagtaaggaagacagcgacatgctggctgcggggggaaaaatcgagagtaacctggagagcaaggtggataaaaagtgtttcgctgactccctagagcaaacaaaccacgagaaagatagcgaatcctctaatgacgacaccagttttccttcaactcccgagggtatcaaggatcgaagcggcgcctatattacatgtgcccccttcaaccccgccgctactgaaagcatcgccacaaatatctttcctctgctcggcgacccaacgagtgagaataagaccgatgagaagaaaattgaggaaaagaaagcccaaattgtgactgagaaaaatacttctacaaagacatcaaacccttttctggtcgcagctcaggatagcgaaactgactatgttacaacagacaatcttacaaaagttacagaggaagtcgtagcaaatatgccggaagggctgacacccgatctggtgcaggaagcctgtgaatccgagctgaatgaggtgaccggcactaagattgcatacgaaactaagatggatcttgtccaaaccagtgaagttatgcaggagagtctgtaccctgccgctcagctctgccctagttttgaagaaagtgaagcaactccatcacccgtgttgccagatatcgtcatggaagccccactgaactcagccgtgccaagcgctggagcaagtgtcatacagccttcctcatctcctcttgaagcttccagtgtgaactacgaatccatcaagcacgagcccgagaatcctcccccctacgaagaggcaatgtcagtgtcactgaagaaggtttctggtatcaaggaggagataaaggaacctgagaatataaacgcggctctgcaggagaccgaagcaccatatattagcatagcatgtgacctcataaaagaaacaaaactgagcgccgagcccgcccctgatttttcggattactctgagatggcaaaggtggagcagcccgtccctgaccactcagaactggtagaggatagctcaccagattccgagcctgtggaccttttctctgacgattctattccagatgtaccgcagaaacaggacgagactgtgatgctggtgaaggagagcctcacggaaaccagttttgagtccatgatcgagtatgagaataaggaaaagttgagcgcattgccccccgagggaggcaagccttatctggagtcttttaagctgagcctggataacactaaggataccctcctgcccgacgaagtatcaaccctctccaaaaaagagaagatccccctgcagatggaggagctctccaccgcggtctactctaacgacgacctgttcattagtaaggaagcgcagatcagagaaaccgagacattcagcgattccagtcccatagagatcatcgatgaatttccaactctgattagttctaaaacagatagtttctctaaactggcccgagaatataccgacctggaagtctcccacaaaagtgaaatcgctaatgcgccggatggcgcaggcagtctgccgtgcactgagctgccccacgatctctcactgaagaacatccaacccaaagttgaggaaaagatcagcttttcagacgacttttctaagaatggttccgccacatcaaaggtgctcctgttgccccccgacgtctccgcactggcaacccaagctgaaatcgagagcatagttaaacctaaggtactagtaaaagaagccgagaagaagcttccttcagacacagaaaaagaggataggtcaccttcagccatcttttccgctgagctgagcaagacaagcgttgtggacctcctgtattggagggatatcaagaaaactggtgttgtcttcggggcttccctgttcctgctcttgtctctgactgtctttagcatcgtgagcgtcaccgcctacattgccctcgctctactgagtgtaactatctcctttaggatctataagggggtcattcaggccattcaaaagtcagacgaaggtcatccatttagagcgtatttagagtccgaggtagccatctcggaggagctggttcagaaatatagcaattctgccctaggccacgtgaattgcaccatcaaggagttaagacgactgttcctcgtggacgatctcgtcgattcattgaagttcgctgtactcatgtgggtcttcacttacgttggagccttgttcaacggcttaacactgctaatattggcgctgatctcactcttcagcgtgccggtgatctatgagcggcatcaggctcagatcgaccactacttggggctggccaacaagaatgtcaaggatgcaatggccaagatccaggccaagatccccggcctcaaaagaaaggccgagtag

SEQ ID NO: 132235 - DNA, 2883 bp, Artificial Sequence
  Description of Artificial Sequence: Synthetic coding sequence
atggaggacctcgaccagtctcccctggtgtcctcatccgattcgccacccagaccccagcccgcttttaagtaccagtttgtacgcgagcccgaggatgaggaggaggaggaggaggaggaggaggaagacgaagacgaggatctggaagagcttgaagtgttggaacgcaagcagttctctgaacttgagtactcagagatggggtcttctttttcggtttcccccaaagccgaatcggccgtcatcgtggcaaatcctagagaggagattatagtgaaaaataaagatgaggaagaaaaactcgtgtccaataacattctccataatcagcaggaattaccaaccgcgttgaccaaacttgtgaaggaggacgaagtggtctcgtcagagaaagctaaggactcctttaatgagaaaagggttgctgtggaggctcccatgcgggaggagtatgcggactttaaacctttcgagagagtttgggaggttaaagactcaaaggaggatagtgacatgcttgcagcaggaggtaagatcgagagtaacttggaaagcaaggttgataagaaatgtttcgccgactcgctggagcagacaaatcacgagaaggattctgaatctagtaatgatgacacctcctttccgtctacccctgaagggataaaagatcgctcgggtgcatacattacttgcgccccatttaatcccgcagcaacggagtctatagccaccaacatatttcctttgttgggtgacccaacgagtgagaataaaactgatgagaagaagatcgaagagaagaaagcccagatcgttacagaaaagaacacctcaacaaaaacaagcaatcctttcctggtggccgctcaagattccgaaaccgattatgtgaccaccgataatctgaccaaagtgaccgaagaggtcgtggcaaacatgccagaagggctcacccccgatctagtccaggaagcctgcgagagcgagctgaacgaggttacagggactaaaatcgcatacgagacgaaaatggatcttgtacagacatctgaagtcatgcaagagtcattatacccagccgcccagttatgtcctagcttcgaggaatcagaggccaccccctctccggttctcccggacatcgtcatggaggcaccccttaatagcgccgttcctagcgccggggcttccgtaatccaacccagctccagtcccctggaggcgagtagcgtgaactacgagtcaataaagcacgagcccgagaatcctcccccatatgaagaagctatgtcagtgagcttaaaaaaagtatcaggtataaaagaagagattaaagagccagaaaatataaacgccgcgttgcaggagacggaggccccatacataagcatcgcttgcgatttaatcaaagaaaccaagctctcagcggaaccggccccagacttttctgattatagcgaaatggcaaaagtggagcagcccgttccagatcactctgagctggtggaggacagttctcccgacagcgagcctgtcgacttgttctctgacgatagtattccagatgtccctcaaaaacaggatgaaaccgtcatgctagtcaaggagtcactcactgagaccagctttgaaagcatgatcgaatacgagaacaaggaaaaactttcggccctccccccagaaggcgggaaaccctatctcgagtcttttaagttgtccctagataatacaaaggacaccctcctgcccgacgaagtctctaccctcagcaaaaaggagaaaatacccctgcagatggaagaactgagcaccgccgtttactccaatgacgacctgtttatatccaaagaagcacaaattagggagaccgaaacttttagcgattcctctcccattgagataatcgatgaatttcccacattgatttctagtaagaccgacagcttcagcaagctagcgcgcgagtacacagacctggaggtgagccataaatccgagattgccaatgcacctgatggtgcaggaagcctgccctgcactgaactcccccacgatctttctctcaaaaacatacagcccaaagtggaggagaaaatcagtttttccgatgacttctccaagaatgggtccgccacaagcaaagttttgctgcttccccccgacgtttctgcgctggcaacacaagccgaaatcgaatccatcgtaaagcctaaagtgctggttaaggaggccgaaaagaaacttccaagtgatacagaaaaggaagatcggagtccttctgccattttttccgcggagttatctaaaacctccgtcgtcgacttactgtattggagggatataaaaaagaccggcgtagtcttcggcgcctccctatttttgctgctttcactgacggttttcagcatcgtgtccgtgaccgcatatatcgcactagcccttctcagcgttacgatcagctttcggatctacaaaggagtgattcaggccatccaaaagagcgacgaaggtcatcccttccgggcttaccttgagagcgaagtggccatctccgaagagttagtgcagaaatactccaatagtgcactgggacatgtgaactgtacgataaaagagctgcgcagacttttcctggttgatgatcttgttgatagcctgaaattcgctgtcttaatgtgggtattcacatatgtgggcgccttattcaacggccttacattgctgatactcgctctgattagtctgttctcagtgcccgttatctacgaacgccatcaggcacagatcgatcactaccttgggctggcaaataagaatgtgaaggacgctatggctaaaattcaagccaagataccgggtctgaagaggaaggccgagtag

SEQ ID NO: 132236 - DNA, 2961 bp, Artificial Sequence
  Description of Artificial Sequence: Synthetic coding sequence
atggacctcaaagagcagcccggtaacactataagtgcagggcaggaagattttccaagcgtgttactagaaactgccgccagccttccatctctgtcacccttatcagccgcctcatttaaggaacacgagtacttgggcaacctgtcgacagtcctgccaaccgaagggacactccaggagaacgtaagtgaagcctccaaagaggtttcagaaaaagctaagactttgctgatagaccgggacctgaccgagtttagcgaacttgagtactccgaaatgggatccagcttcagcgtgtctcccaaagccgaaagcgcagttattgtggccaacccccgcgaagagattattgtgaaaaataaagacgaagaagagaagttagtctcaaataacatattgcataatcagcaagagctgcccacagcactaacgaaactggtgaaagaagacgaggttgtcagcagcgagaaggctaaggattctttcaacgaaaagagagttgccgtcgaggctcctatgagagaagaatacgccgacttcaaaccctttgaacgggtgtgggaagttaaggatagtaaagaagatagcgatatgctggccgcaggaggcaagatcgagtccaatctggaaagcaaggtggacaagaagtgctttgcagatagcttggagcagacgaaccatgagaaagatagtgagagctccaacgacgatacctcatttccgagcaccccagaaggcattaaggatagatctggcgcatacattacctgcgctccttttaacccagcggccacagagtcaatcgccaccaatatcttccccttgctcggggatcccacaagtgagaacaaaacagacgagaaaaagatagaagaaaagaaagcccaaatcgtgactgaaaaaaatacctctacgaagacttcaaacccctttttggtagcagcccaagacagtgaaacagattacgtaacaacggacaatctgacaaaggtcacagaagaggtggtggccaacatgcctgaaggtctgaccccagatttggtacaggaggcatgcgaatctgagctgaatgaagtcaccgggacaaagatcgcgtacgaaacgaaaatggacctggtacagactagtgaggtgatgcaagagagcctctatccagccgcccagctctgtccaagcttcgaagaaagtgaagctaccccaagtcctgtgctgcctgacatagtcatggaagccccactgaatagtgccgttccctctgctggcgccagcgtgatccagccctcctcttccccgttggaagcctcatccgtgaattacgagagcatcaagcacgagcctgagaatccgccgccttatgaggaagctatgtcagtgtcactgaaaaaggtgtctggcattaaggaagagatcaaagaacctgagaacatcaacgcggcgttgcaggagaccgaagccccatacataagtatcgcttgcgacctaatcaaggaaacaaaactgagcgccgagcccgcaccagatttcagtgactactccgagatggcaaaagtcgaacagcccgtaccagaccatagcgagctggtggaagactctagtccagatagcgagcccgttgatctcttctccgatgactcgatccctgacgtcccccagaaacaggacgagacagtgatgcttgttaaagaaagtctcacagaaactagcttcgaatctatgattgagtacgaaaacaaagagaagctgtctgcccttccgccagaaggcggcaaaccttacttagaatcattcaaactgagcttagacaacacaaaagacaccttgctccctgatgaagtcagtactttgtcaaagaaggagaaaattcccctgcagatggaggaactgtccaccgcagtctactccaatgatgatctcttcatatctaaggaggctcagattagggagactgaaacctttagcgactcttcacctatcgaaattattgacgaatttcccacactgatatcttcgaaaaccgacagcttctctaaactggcacgggaatacacggatctggaagtaagccacaaaagtgagatcgctaacgctccagacggcgccgggtccctgccctgcactgagttaccccatgacctgagtcttaaaaacattcagcctaaagtggaggaaaaaatatctttttcggacgatttcagcaaaaacgggtcagccacttctaaggtgcttcttctgcccccagatgtttccgcattggcaacacaggcagaaatcgagtccattgtgaaacctaaggtgcttgtgaaggaagccgaaaaaaagctgccctcagatacagagaaggaggaccggtccccaagtgccatcttcagtgccgagctgagtaaaacgagtgtggtggacctcctttactggcgagacattaaaaaaactggggtggtgttcggagcctcactgttcctgctgctctccctgactgtgttttccattgttagtgttaccgcgtatattgctctcgctctcctctctgtgacaataagtttccggatctacaagggggtgatccaagctattcagaagtccgatgaaggccacccttttcgcgcatatttggagagtgaggtggccatctctgaagaattagttcagaaatatagcaactccgctctcgggcacgtaaattgcaccatcaaggaacttcgaagactcttcctggttgatgatctcgttgattcattaaagttcgccgtactaatgtgggtgtttacttatgtaggagcgcttttcaacggcctgaccctcttgatcctcgccctgatcagcctgtttagcgtgcctgtaatatatgagcgacatcaggcacagatcgatcactatctggggcttgccaacaagaacgtcaaagatgccatggcaaagatacaggcgaaaattccggggctgaagcggaaagccgaatag

SEQ ID NO: 132237 - DNA, 1179 bp, Artificial Sequence
  Description of Artificial Sequence: Synthetic coding sequence
atggaagacctggaccagtcgcccctggtctcctcctccgactccccacctcgcccccagcctgccttcaaataccagtttgtcagggagcccgaggacgaggaagaggaggaggaagaggaggaagaggatgaagacgaagacctggaggagctagaggtcctggaacgcaaacctgctgctggcctgagtgccgcaccagtaccgactgcgcctgcggccggcgcaccactgatggatttcggcaatgactttgtacctcccgcgccgcgaggccctttacccgccgcaccaccggttgccccggagaggcaaccatcttgggatccctctccagtatcatcaaccgttcccgccccgtcccctctatccgccgcagctgtgagcccctctaagctgccagaggatgacgaaccgcccgcacgccccccccccccaccaccagctagcgtgtctcctcaagccgagccagtgtggaccccgcctgctccggctccagccgcccctccaagcacgcccgccgcgcctaagcgtcgcggcagtagcggctcagtggatgagaccctctttgccctgccagcagcatccgagcctgttattaggtcaagtgcagttgtggatttgctttactggcgggacattaagaagacgggagtcgtgttcggagcaagcctgttcctgctcctgagcttgaccgtcttcagcattgtgtctgtgacggcctatatcgcattggcactcctttccgtgactatttcgttcaggatctataagggcgtaatacaggccatccagaaatctgacgaggggcatcccttccgcgcatatttggaatctgaggttgcaatttctgaagagctagttcagaagtattcgaacagcgcccttggacacgtgaactgtaccatcaaggagctgcggcgcctgtttctagtggacgatctggtagactcattaaaatttgcagtactcatgtgggtttttacttacgtgggggcccttttcaacggtctgactctcctgattcttgcattgatcagtttattcagcgtgcccgtaatctatgaacgccatcaggcgcagatcgatcactacctcggccttgccaataagaatgtcaaggatgcaatggctaaaatccaggccaaaattccagggttaaagcggaaagctgagtag

SEQ ID NO: 132238 - DNA, 600 bp, Artificial Sequence
  Description of Artificial Sequence: Synthetic coding sequence
atggacgggcagaaaaagaattggaaagataaagtggtggatttactatattggagagatattaagaagacaggtgttgtctttggagctagcctctttctgttgttaagtcttactgtgtttagcatagtatctgtgaccgcctatattgcattagctctgttatcggtcactatctccttcagaatttataagggtgttattcaggcgattcaaaaaagcgatgagggccatccttttagggcttacttagagagtgaggtggcaatctctgaagaactcgtgcagaaatattcaaatagcgccctgggtcatgtcaattgcaccataaaggaattacgtaggctgtttctggtcgatgatttggttgattcactgaaattcgcagtgctcatgtgggtttttacctatgttggcgcactgttcaacggcctgacgctcctcatcctggcactaatctccctgttctccgtgccagtcatctacgagaggcatcaagcacagatcgatcactacctgggcctcgcaaacaagaatgtaaaagacgctatggccaaaattcaggccaagattcctggacttaaaaggaaagcagagtag

SEQ ID NO: 132239 - DNA, 2961 bp, Artificial Sequence
  Description of Artificial Sequence: Synthetic coding sequence
atggacctaaaggagcaacctggaaacaccataagcgccggccaagaagattttccaagcgtactactagaaactgccgcaagtctgccctcactgtcccctctgagcgcagcttcatttaaagagcacgaatatctcggcaatctctcaacagtgctgcccaccgagggcacactccaggagaacgtgtcagaagcttccaaggaagtgtcggagaaggccaaaaccctactcatcgacagagacctcacggagttctccgagctggagtacagcgagatgggcagcagctttagtgtgagcccaaaggccgagtccgccgttatcgtagctaaccctcgagaagagattattgtgaagaataaggatgaggaagagaagctggtgtctaataacatcctgcacaaccagcaagaactgcctaccgcactcaccaaactcgtcaaggaagacgaggtggtgtcatccgagaaagctaaagatagctttaatgagaaacgggttgcggtagaagctccgatgagggaagagtatgcagatttcaaacccttcgagcgcgtttgggaagtgaaggactccaaggaagactccgacatgctggctgccggaggcaaaatcgaatctaatttagagagcaaggtggacaaaaagtgttttgccgacagcctggagcagactaaccatgagaaagattcagagagttctaatgacgacacgtcatttccctcaactcctgaaggaatcaaggacaggagtggcgcctacattacttgcgccccattcaatccggccgctacagaaagcatcgccaccaatatctttcctctccttggcgacccgacatctgagaacaaaaccgatgagaagaagatcgaagagaaaaaggcccaaattgttaccgaaaagaacacttccacaaaaacgagcaacccttttctggtggccgcgcaagatagcgagacggactatgtgaccacagataacctgacaaaggtgacagaggaggtggtggcaaatatgcctgaggggctgacccccgatttggtgcaggaagcctgcgaatccgaattgaatgaggtcaccggcacaaaaatcgcctacgagaccaagatggatctggttcagacctcagaagtgatgcaagagtccctgtacccagctgcccagttgtgcccatcatttgaggaaagcgaggcgaccccaagccctgttctccctgatattgtaatggaggccccactcaacagcgctgttcccagcgccggtgcttcggtgatccagccatcaagcagtcccctcgaagcatcatccgtgaattatgaaagcatcaagcatgagccggagaaccccccgccgtatgaagaagccatgagcgtgagcttgaagaaagtcagtgggattaaagaggagatcaaggagcccgagaacatcaacgcagcactccaagagactgaggcaccctatattagcattgcgtgcgatttgatcaaggagactaaactgagtgcagaaccagcgcctgattttagcgattactcagaaatggccaaagttgagcagccagttcccgaccactcagaactggtcgaggattccagtcccgattccgagccagtggacttattcagcgatgacagcattcccgacgtgccacagaagcaggatgaaaccgtcatgctggtgaaggaatcgctgactgagacctcttttgaaagcatgattgagtacgaaaataaggaaaaactgtctgctctccccccagagggcgggaagccatatctggagtcattcaagctaagcctggataataccaaagatacgctcctccctgacgaggtgtctactttgagcaagaaggaaaaaatcccactccagatggaggaactaagcacagcagtgtactctaacgatgatctgtttatatcgaaagaggcccagattagagagaccgaaacatttagtgattctagccctatcgaaattatagatgagttccccaccctgataagcagcaaaacagacagcttctccaaattagctagagaatacaccgatctggaagtgagccacaagagcgaaatcgctaacgccccagatggcgccggaagtctcccttgcaccgagcttcctcatgatctgagcttaaagaatatccaacccaaggtggaggaaaaaatctcattttcagatgacttcagcaaaaacggatctgccacaagcaaggtgctgctgctcccgcctgacgtgtctgccctcgccacgcaagccgagatcgagtcaatcgtcaaacccaaggtgctagtgaaggaggcagagaaaaagcttccatctgatacggagaaagaggatagatcaccctctgcgatcttctccgctgagctctctaagacctctgtggttgatttgctatactggcgagacattaagaagaccggggtcgtctttggagcttcccttttcctgctactgtctctgacagtgttttccatcgtctccgtgacggcctatattgccctggccctgctcagtgttactatctccttccgaatttataaaggcgttatacaagctatccaaaagagcgacgaggggcatccatttcgagcttaccttgaaagtgaggtggcgatctccgaggaactcgtgcagaagtatagtaactctgcgctggggcacgttaattgcaccattaaggagctccgtagactttttctggtcgacgacctggtggattccttaaagttcgcagtcctgatgtgggtgttcacttacgttggagccctgttcaatggcttgacgttacttattttggccctgatttccttgtttagtgtgccagtgatttatgaacggcatcaagcacagatagatcactacctgggattggctaacaagaacgtaaaggacgccatggcgaaaatccaagccaagattcccggcctaaagcggaaagctgagtag

SEQ ID NO: 132240 - DNA, 1038 bp, Artificial Sequence
  Description of Artificial Sequence: Synthetic coding sequence
atggagcccgaggacgaagaggaggaggaagaggaggaggaggaggacgaagatgaggacctggaagagctggaagtcctggagcgaaaacccgctgctgggctgagcgctgcacccgtcccaactgcaccagctgccggcgctccgctgatggatttcgggaatgattttgtgccgccagcaccccggggacccctgccagccgcccctcctgtggcacctgagcggcagccatcctgggatcctagtcctgtcagttccacagtgccagccccttccccactgagtgcagctgcagtcagtcctagcaaactgcccgaagatgacgagccccccgcaaggccccccccaccaccacccgcttctgtgtcacctcaggcagaacccgtctggactcctcccgcacccgcccctgccgccccccctagcactcctgccgccccaaagcgcaggggcagttcgggcagtgtggtcgttgaccttctatactggcgtgatattaaaaaaacaggcgtagtcttcggtgcgagcttgtttttactgttaagcctgacggtgttttccatcgtgtctgttaccgcctatatcgcgcttgcattgttatccgtgacgattagcttccgtatatataagggcgtgatccaagctatacaaaagtcagatgagggccatcctttccgggcctatctggagagcgaagtggctatttctgaggaactcgtccagaagtacagcaatagcgccctgggacatgtaaattgcaccatcaaggaacttcgaagactgttcctcgtggatgatctggtggactcgctcaagtttgccgtactaatgtgggttttcacttacgtgggggccctgtttaacgggctgaccctgcttatattggcactaatctccctctttagcgtccctgtcatctatgaaagacaccaagctcagatagatcactatctgggcttagcaaataaaaatgtgaaagacgccatggcgaagatccaggccaagattcccggattgaagagaaaggcggagtag

SEQ ID NO: 132241 - DNA, 2961 bp, Artificial Sequence
  Description of Artificial Sequence: Synthetic coding sequence
atggatctcaaagagcaaccgggcaataccatctccgcaggtcaagaggatttcccatccgtgttgctcgagactgctgcatccttaccgagcctgtctccgttgagcgccgcttcctttaaggaacacgaatatctgggcaatctgtccacggtgctgcctaccgaggggaccttacaagagaacgtctccgaggcaagcaaagaagtcagcgagaaggctaagacactgctaatcgacagagatctcactgaattcagtgaactagaatactcagaaatgggcagttccttttccgtgtctcccaaagccgaatcggcagtgattgtcgccaaccctagggaagagattattgtcaagaataaggacgaagaggagaagctggtgagcaataatatactccacaatcaacaagagctgcctacagctttaacaaaactcgtgaaagaggacgaggtggtatcaagtgaaaaagccaaggacagctttaatgagaagcgggtggccgtcgaggccccaatgcgcgaggagtatgctgatttcaaaccttttgagcgagtatgggaggtgaaggactcaaaagaggattccgatatgttggcagcaggcggcaaaatcgagtccaatctggaatccaaggtcgataagaagtgttttgccgactcactcgagcagacaaaccacgagaaagattctgagagcagtaatgatgatacgagcttcccctccacgcccgagggtatcaaagatcggagcggagcctatataacgtgtgctcccttcaaccctgcagccaccgaatctatcgccacaaacatcttcccactgctgggcgaccctacctcagagaataagaccgacgagaagaaaattgaagaaaagaaggctcaaatagtgaccgaaaagaatacttccacgaagactagcaaccctttccttgtcgccgcccaagactctgaaactgattatgtcactactgataacctcaccaaggtgactgaggaagtagtggctaacatgcccgaaggacttaccccagaccttgttcaggaagcgtgtgaaagcgagttaaacgaggtgacaggaactaagattgcctatgagaccaagatggacctggttcagacttctgaggtgatgcaggaaagtttgtacccagccgcgcagctttgcccatcgttcgaagagagtgaggccactcccagccctgtcctacctgatatcgtgatggaagcacctttgaacagcgctgtccccagtgcaggcgcctctgttatacagccatcttcttcccccctcgaggccagcagtgtgaattatgaatctatcaaacacgagcccgagaatccgccaccttatgaggaggccatgagcgtctctctcaagaaggtgtccggcataaaagaggagatcaaggagccagagaatattaatgccgcactacaggagactgaagccccctacattagcatcgcttgcgatctgatcaaggagaccaagctctcagctgaacccgcaccagacttcagtgactacagtgagatggccaaggtggagcaaccagtgcccgaccattctgaactcgtggaggactcctctccagacagcgaaccggtggaccttttcagcgatgactctatccctgatgtaccccaaaaacaggacgagaccgtgatgctggttaaggagagcctgactgaaaccagctttgaaagtatgatcgaatacgagaataaagagaagctgagcgcccttccccctgaaggcggcaagccatatctggaatctttcaagctgtcgctcgataatactaaggacactctgttgcctgacgaagtgtcgacactgagcaagaaggaaaagattcccctacagatggaggaactgtccactgccgtgtatagcaacgatgatctgtttatttccaaggaggcgcaaatcagggaaactgagacttttagcgactcatcccctatcgagatcatcgatgaatttcctaccctgatttcctcaaagaccgactctttctccaaactggcaagggagtatacagacctggaggtatcccataaaagcgaaatcgctaacgcccctgatggggctggaagtctcccgtgtaccgaactgcctcacgatctgagtctgaaaaatatccagcccaaagtggaggagaagatctccttctccgacgacttttccaagaatggcagcgccacatctaaagtcctgctccttccacccgacgtgagcgccctggctacccaggcagagattgagtctatcgttaaaccgaaggtgctcgtcaaggaggcggagaagaagcttccctcagatacggagaaagaagatcggagcccctcagccatcttcagtgctgagctctccaagacgagtgtggtggacttgctgtactggagggatatcaagaaaacgggcgtggtctttggagcatcactattcctgttactctcattgactgtgttcagcatagtgagcgtgacagcctatattgctctggcactgctgtccgtgacaatttccttccgaatctacaaaggagtgatccaggctattcagaagtccgacgaggggcacccatttcgggcctatctggagagtgaggtagcaatcagcgaggagctggtgcagaagtactcaaatagcgccctgggccatgtgaattgcacaatcaaggagctgcgaaggttgttcttagttgacgatctggtcgacagtttgaagttcgccgtcctcatgtgggtctttacgtacgtcggagccctgttcaacgggcttacactactgattctggccttaatcagcttgttttcagttccggtaatctacgagcggcaccaggcacaaatagaccactatcttgggctcgccaacaagaatgttaaagacgccatggcaaagatccaggctaagatacccggacttaagcggaaagcagaatag

SEQ ID NO: 132242 - DNA, 2961 bp, Artificial Sequence
  Description of Artificial Sequence: Synthetic coding sequence
atggacttgaaggagcagccagggaatactatctccgcaggccaggaggacttcccatcggtccttctggagaccgctgcatctctgccctctctgtcccctctatctgccgcatcttttaaagagcacgaataccttggtaacttgagcactgtcctgccaaccgaaggtacgcttcaagagaacgtgtccgaagcgtccaaagaggtttctgagaaagccaagactctactgattgatcgcgaccttactgaattttctgagctagaatacagcgagatgggctcttctttctccgtgagtcccaaagccgaaagcgccgtcatcgtggccaacccaagagaggagattattgtgaagaataaggacgaggaggagaagctggtgtcgaacaacatcctgcacaatcaacaggagctcccgactgcacttaccaaactggttaaggaggatgaggtggtatccagcgaaaaggctaaggattcgtttaacgaaaagagggtggctgtggaggcccctatgcgggaggagtacgcggactttaaaccatttgagcgcgtgtgggaagtgaaagattccaaggaagatagtgacatgctagctgctggaggcaaaattgagtccaatttagagagcaaggtggacaaaaagtgtttcgcggactcgttggagcaaacaaaccatgagaaagacagcgagtcaagtaatgacgataccagcttcccttcaactcctgagggaatcaaggaccgaagcggagcctacattacatgtgccccattcaacccagctgctaccgaatcaatcgcaaccaacatttttcctttgctgggggatcctacttccgaaaataagacagatgaaaaaaaaatcgaggagaaaaaggcccagattgtgaccgaaaagaacaccagtaccaaaacgtcaaatcccttcctggtggcagcccaggactccgagacggattatgtgacaactgacaacctgacaaaggttaccgaagaggtggttgcgaatatgcctgaaggcttaacccccgacttggtgcaggaagcctgcgagagcgagctcaacgaggtgactggtacaaagatcgcatatgagacaaagatggatctggtccagacatctgaagtgatgcaggagtcattgtatccagccgcccagttgtgtccatcttttgaagagtctgaggccaccccctcacctgtcctcccggatatagttatggaagctcctctcaacagtgcggttcccagcgcaggagcctctgtcattcagccaagtagctcccccctggaagcatcttccgtgaactacgagtcaattaagcatgaaccagaaaatccccccccatatgaagaggccatgtccgtgtccctgaagaaagtctcaggcataaaagaggaaattaaggagccggaaaatattaacgcagccctgcaggagaccgaagcaccttacatttctatcgcttgtgacctgattaaagaaacaaagctgtcagccgagcccgcccctgacttcagtgactattcagaaatggccaaggtcgagcaaccagtgccagaccattcagagctagtggaggattcatccccagactccgaacctgtggacctcttctcagatgatagtattcctgatgtcccacagaaacaggatgagacagtcatgttagtgaaagagagtctgaccgaaacctccttcgagagcatgatcgagtacgaaaataaggagaagttgagtgcactgccaccagagggcgggaaaccatatcttgagtcattcaagctgtccttggacaataccaaagacactttgttgcccgacgaggtgagtaccctgtcaaagaaggagaagattccactgcagatggaagaactgagcacggccgtgtattctaacgatgaccttttcatatccaaagaagcccagattcgagaaaccgaaactttttcagactcttcacccatagagattatagatgaatttcctaccttgatctcatccaaaactgactccttcagtaagctagccagggagtacaccgacctggaggtaagccacaagtccgaaatcgctaacgcccctgatggcgccgggtcccttccctgcactgagttgccccacgatctgtctttgaagaacatccagcctaaggtggaagagaagataagtttcagcgacgacttttccaaaaacggctcagcaacgtctaaggtactactgctcccacctgatgtatctgccctcgccactcaggccgagatcgagagcatcgtcaaacctaaagttctggtgaaggaggccgaaaagaagctgccctctgacacagagaaggaagatcgctccccatcggcaattttcagtgcagaactgtccaaaacatccgtcgtggatctgctctactggcgtgacatcaaaaagacgggtgttgtgtttggggcgagtctattcctactgctctcattaactgtgttctccatagtgagtgttactgcttatatagccctggccctgttgtcagtcaccatttcatttaggatttacaaaggagttattcaggctatccagaaatctgacgagggccacccgtttcgggcatacttggaaagtgaggtggcaatctctgaagagcttgtccagaaatactctaattctgcactgggccatgttaactgcactattaaagaactacgacgattgtttctcgtggatgacctcgtggatagcctcaagttcgccgtgctgatgtgggtgttcacatacgtgggagccttgtttaacgggttgactttactgatcctcgccctgataagcctattctcagtcccagtcatttatgagcgacatcaggcccagattgaccactatctgggacttgccaacaaaaatgtgaaagatgccatggcgaagatccaggctaaaattccaggcctaaaacggaaggctgaatag

SEQ ID NO: 132243 - DNA, 276 bp, Artificial Sequence
  Description of Artificial Sequence: Synthetic coding sequence
atggacctgaaggagcaacccggaaacacaatctctgcggggcaggaagacttccccagtgtactactcgagaccgccgcctcattaccctcattaagccccctaagcgcagccagttttaaggaacacgagtatctggggaaccttagtacagtgctgccgacagagggtacactccaggagaacgtgagcgaagcctccaaggaggtttcagagaaggccaagactctgctgattgaccgtgatcttaccgaattctctgagctggaatactag

SEQ ID NO: 132244 - DNA, 1191 bp, Artificial Sequence
  Description of Artificial Sequence: Synthetic coding sequence
atggagtttctgaaaacgtgcgtgttgcggcgaaacgcgtgcactgctgtgtgtttctggagaagtaaggtggttcagaagccttccgtgaggagaatttcaaccacgtccccacggtccaccgtgatgcccgcctgggtcattgataagtacggtaaaaacgaggtgctgaggtttacacagaacatgatgatgccgattatccattaccccaacgaggtcatcgtgaaggtgcatgcggcgtctgtgaacccaatcgatgtcaatatgcgcagtggatacggagccactgcgctcaatatgaagagggatcccttacacgtgaaaatcaagggcgaagaattccctctgaccttagggcgagacgtgtcaggcgtggtaatggaatgcggcttggacgttaagtattttaaaccgggcgatgaagtttgggccgccgtcccaccctggaaacaaggcacgttgagcgaattcgtggttgtgagtggcaacgaggtgtctcacaagcccaagagtttgacacatactcaggccgccagccttccatatgtggccctgaccgcatggagcgcaattaataaggtggggggtctgaatgacaaaaattgtacgggaaaacgcgttctgattctcggtgcgagcgggggcgttggtacgttcgcaatacaggtcatgaaagcttgggatgcgcacgtcaccgcagtgtgcagccaagacgcatccgaactggtccgaaagcttggcgctgatgacgttattgactataaatctggctccgttgaggagcagttaaagagtttgaagccttttgactttatcctggataacgttggaggatccacagaaacttgggctcccgactttctgaaaaagtggtccggcgcaacctacgtaactctcgtgacaccgtttttgctgaatatggatcgactgggaatcgcggacgggatgttacagactggggtgacagtgggcagcaaagccctgaagcatttctggaaaggagtccattatcggtgggctttctttatggcctctggcccctgtcttgacgatatcgcggagttggttgacgctggcaagatcaggccagttattgagcagaccttcccattcagcaaagtgcctgaagccttcctcaaggtagagcggggacatgccagagggaagactgtgatcaacgtggtgtag

SEQ ID NO: 132245 - DNA, 681 bp, Artificial Sequence
  Description of Artificial Sequence: Synthetic coding sequence
atggagttcctgaagacctgtgtcttgcggcggaatgcctgtacagcggtatgcttttggcgtagcaaagttgtacagaagccaagcgtacggcgcatctccactacatccccacggagtactgtcatgcctgcgtgggtcatcgataagtatggcaagaatgaagtgttgcggtttacacagaatatgatgatgcctatcatccattaccccaatgaagtcatagtcaaggttcacgcagctagcgtgaatccaatcgatgtgaacatgcgaagcggctatggggcaactgccctgaacatgaaacgtgatccccttcatgtaaaaatcaagggtgaagagttccctctcacactgggccgcgatgtgtctggagtcgtgatggaatgtggcttggacgttaagtattttaaacctggtgatgaggtatgggcagcagtacctccatggaaacaggggaccctcagtgagtttgtggttgtatcaggaaacgaggtcagtcataagccaaaatcgctcacacacacccaagctgcgtccttgccatatgtggcgctgaccgcttggtctgccatcaataaagtggggggcttaaatgataaaaactgcaccggcaagcggatcagcggcaaggagtcaatcatcgctggacacttctcttggcccgtcgctcacgtgtag

SEQ ID NO: 132246 - DNA, 1422 bp, Artificial Sequence
  Description of Artificial Sequence: Synthetic coding sequence
atgaaaagggcgtcagccggcggctcccggctgttggcttgggtcctctggttgcaggcttggcaggtggcagctccctgccctggagcttgtgtgtgttacaatgaaccaaaagtgacgacctcttgcccccagcagggtcttcaggccgtccctgtggggattccagcggcttcacagagaattttcttgcacggcaacagaatctcccacgtgccagccgcctcattcagagcttgcaggaacctgaccattctctggttgcactcaaacgtattggcacgaattgatgctgctgcctttacaggactcgcccttcttgaacagctcgacctgtctgataatgctcagctcagatcagtggaccccgccacgtttcacggcctcggcaggctgcacacgctgcacttggataggtgtggactacaggaactgggacctgggctcttccgaggactggctgccttgcagtacctttaccttcaggataacgctttgcaagccctgcccgatgatacgttcagagatctgggaaatctgacccacttgttcctacatggcaataggatttcatcagttcccgagcgggcttttcgcggccttcacagcctcgatagactgctcctgcaccagaatcgcgtggcccatgtgcatcctcatgctttccgtgacttgggtagactcatgaccttgtacttgtttgccaataacttgagtgctcttcctactgaggctcttgccccccttcgagctcttcagtacctcaggctgaacgataatccatgggtgtgcgattgtcgagcccgccccctgtgggcatggttgcaaaagttccgcggctcgagctccgaagtaccatgttcattgcctcaacgcctggctgggagggacctcaagcggctggcagccaacgatctccagggttgcgccgtggcaaccggcccttaccaccccatctggaccggtagggcaacagacgaagaaccattgggcctgcctaagtgctgtcagcctgacgctgccgacaaagccagcgtgcttgagcctggccggccggcctctgccggcaatgcattaaaggggagagtgcccccaggagatagccctccgggtaatggttccggccctcgtcacatcaatgattcacccttcggaacgttacctggatctgctgagccacccctgaccgcggtgcgacctgaaggcagtgaaccccctggatttcctaccagcggcccgcgcagacgccccggctgctccaggaaaaatagaacgaggtctcattgccggctcgggcaggctggctctggggggggaggcaccggggattccgaaggaagcggagccctacctagcctgacttgttctctgactcccttggggctggcattggtgctgtggactgtcttgggcccatgctag

SEQ ID NO: 132247 - DNA, 1041 bp, Artificial Sequence
  Description of Artificial Sequence: Synthetic coding sequence
atgcacctgccgggatgtgcgcccgcgatggccgatgggagcttctctctcgccggtcacctcttacggtccccaggggggtccacctctagacttcactccatcgaggccatcttggggttcactaaggatgacggcatactcgggacctttcccgctgaacggggtgcccgcggggccaaggaacgagacaggcgcctcggcgctcgcccagcatgtcccaaagccccagaagagggctccgaaccgtcaccccctcctgcacccgccccggctccggaatacgaggcacctcgcccttactgtcctaaagaacctggggaggcaagaccttctcctggcttacctgtaggacctgctactggcgaggcaaagctgtccgaagaggagcagccaaaaaagaagcataggcgcaaccggaccacttttaccacctaccagctgcatgagcttgagcgggcgttcgagaaatcacactaccccgatgtgtattccagggaagagctggcgggcaaggtgaatcttccggaggtgcgtgttcaggtttggtttcaaaaccgcagagccaagtggcggaggcaggaaaagctggaggtctccagcatgaagctgcaggacagcccgctgctgagcttctcacgctctcctcccagcgcgacactgagtccgctgggagctggcccaggttccggggggggccctgccggtggggcgctgccactagagtcctggctgggacctcccctgccaggcgggggagccaccgcactgcagagcctgcccggattcggcccgccagcacagtctttacctgccagctataccccccccccgcccccaccgccattcttgaactccccgcctctgggacctggcctgcagcccttggcccccccccccccttcctatccatgcggtccggggtttggggataaattccccttggatgaagcggaccctaggaatagcagcatcgcggccctgcgtcttaaggcaaaggagcacatccaagcgattggcaagccctggcaggcgctgtag

SEQ ID NO: 132248 - DNA, 225 bp, Artificial Sequence
  Description of Artificial Sequence: Synthetic coding sequence
atgcacctgcccggctgtgcgccagctatggccgatggctccttttcattggccgggcaccttctgagatcacccggagggagtacgagtcgcttacactcaatcgaggctatacttggattcaccaaagatgatgggattctcgggactttccctgcagagagaggagccagaggggcgaaagaacgggaccgcaggttgggcgcgagacctgcatgcccctag

SEQ ID NO: 132249 - DNA, 588 bp, Artificial Sequence
  Description of Artificial Sequence: Synthetic coding sequence
atgagtctgatttcctggctgcgatggaacgaggcaccgtcccgactttctacaaggtctcctgcagagatggttctagagaccctcatgatggaactgacgggccagatgcgggaagctgaacgccaacaaagagaaagatcaaacgccgtcagaaaggtgtgcaccggtgttgattattcttggctggcttctaccccgcgtagcacctacgatctgagcccaatagagcgacttcagctggaggacgtttgcgtgaaaattcatcctagttattgcggccccgctatcttaaggttcagacagctgttagctgaacaggagccagaagtgcaggaagtttcacagctcttccgtagcgtgttacaggaggtactggagagaatgaagcaggaggaagaggcccacaaactgacacgacaatggtctctgcggccgcggggtagtttggcaaccttcaaaactagggccagaatcagccccttcgcaagtgacatacggaccatcagtgaggatgtggaacgcgacacacccccacccctcaggagctggtccatgcccgagtttagagcgccaaaggccgattag

SEQ ID NO: 132250 - DNA, 762 bp, Artificial Sequence
  Description of Artificial Sequence: Synthetic coding sequence
atggcagagaccagcgccttgcccaccgggttcggcgaactagaggttctggcagtggggatggtcctcttagttgaagccctgagcgggctctctttaaacactctgacaatattttccttttgtaagacaccggagcttcgaacaccttgccacctgctcgtcctgtccctcgccttggccgatagcggtatatcactgaacgccttggtagccgccacttctagtctgctacggaggtggccctacgggagcgatggatgtcaggcacacggtttccagggctttgttacagctctggcatccatttgttctagtgcagccattgcatggggaaggtaccaccactattgcactaggtcccagttggcttggaacagtgccgtgtcacttgtattgttcgtgtggctgtcctctgcattttgggccgctctccccctcctcggctggggacattacgactacgaaccattggggacttgttgcaccctggattacagtaaaggtgatagaaactttacctctttccttttcactatgagtttctttaacttcgcaatgccactttttatcaccattaccagctactcattgatggagcaaaaactgggaaagtctgggcaccttcaagtgcccgcacttattgccaagatggtccccacaataaatgctattaattacgccctgggcaacgagatggtgtgtcggggcatatggcagtgtctgtcacctcagaaacgagagaaggacaggacaaaatag

SEQ ID NO: 132251 - DNA, 888 bp, Artificial Sequence
  Description of Artificial Sequence: Synthetic coding sequence
atggcagaaacaagcgctctccctaccggcttcggtgagctagaagtgttggctgtcggcatggtgctgttagtggaggccctgagtggactgagcttgaatacattaactattttcagcttttgcaagacccccgagctacgcactccatgtcatctattagtactgtccctcgcactggcagattctgggataagcctgaacgccctggtggctgccaccagcagcctgttacgcgtgagtcaccggagatggccctacgggtcggacggatgtcaggcccacgggtttcagggattcgttactgccctggcctctatttgttcctctgccgcgatcgcgtgggggaggtatcaccattactgtacccgcagtcagcttgcctggaattccgctgtaagcctcgtgctctttgtttggctttcgagtgctttctgggcagccctgcccctgctcggctggggccattatgattacgagcccctcgggacttgttgcacgcttgattattcaaaaggtgaccggaatttcacatcgtttttgttcactatgagcttctttaattttgctatgcctttattcattactatcacctcatacagtcttatggagcagaagctcgggaaaagcggccatcttcaggtgaataccaccctccctgccagaactctcctgcttggctgggggccgtacgcaattctttacctttacgccgttattgctgacgtcaccagcattagcccgaaactccaaatggtcccagccctcatcgccaagatggtgcccaccatcaacgcaattaattatgcactcgggaacgaaatggtttgtcgggggatttggcagtgtctgtcaccacagaagcgggagaaggatcgtaccaagtag

SEQ ID NO: 132252 - DNA, 363 bp, Artificial Sequence
  Description of Artificial Sequence: Synthetic coding sequence
atggccgaaactagtgcactcccaacagggttcggtgagctggaagtgttagccgttgggatggtgctgttggtggaggatccgggggcagcggatagtctgcctcccacgggcgcggagttgggctcctgcggacagtgggaccagcccgaatgccctcggtgctcccacatccagcccagcccttgcttgcctcaggctctcgccttgcgccttggccgattgcccgggagtcgtctgcccggcctctgtgatagcgttggtcagcacctgcagcagtgctcgcatcgaatgggcgcccttagccccttgttgcatcccccgaagtgctgccatagaagtcatcattttgagtggagatag

SEQ ID NO: 132253 - DNA, 1056 bp, Artificial Sequence
  Description of Artificial Sequence: Synthetic coding sequence
atggcccccgtcttgccgctggtactaccactgcagcctcggatccggcttgcacagggtttatggctgttatcatggctgctggcactggctggaggagtgattcttctctgttctgggcatcttctcgtccagttgaggcacctgggcactttcctggcacccagttgccagttccccgtcttgccgcaggcagctctggcggcgggcgccgtggcattaggcaccggtttagttggggtgggggcttcgagggcgtctctcaacgctgcactgtatcccccctggaggggcgtgctcggccctttgctggtcgcaggcacagccggaggtggcggattgctcgtggttgggctgggcctcgcactggcccttcccggatcactggatgaggctctggaggaggggcttgtgaccgccctcgcacactacaaagataccgaagtcccaggccactgtcaggccaagcgacttgtagacgagctgcaactacgctaccattgttgcggtcgccacgggtacaaggattggtttggggtgcagtgggtgtcatctcggtacctagaccccggcgatcgagacgtggccgaccggatacagtcaaacgtagagggcctctatttaaccgacggcgtgcccttttcgtgttgtaatccccactcgcctaggccctgtttgcagaaccggctgtctgattcctacgcccatccattgttcgatcctcggcagcctaatcaaaatttatgggctcaaggctgccacgaggtcctcctggaacatctgcaggacttggctggtaccctggggtccatgctcgctgtgacctttttattacaggcactggtgttgcttgggttaaggtatctgcagacagccctggaagggctgggaggcgtcattgatgccggcggcgaaacccagggctacctctttcccagcggacttaaggacatgctcaagaccgcatggctccaggggggcgtggcatgccgccccgcccccgaggaagccccgcctggcgaagcacctcccaaggaagatctgtcagaggcatag

SEQ ID NO: 132254 - DNA, 1602 bp, Artificial Sequence
  Description of Artificial Sequence: Synthetic coding sequence
atgtcaattcaggttgaacatccggccggcgggtataaaaaattattcgagacagtcgaggagctgtcttccccactgaccgcgcatgtgacaggccgcatccctttgtggctcacaggatcactccttcgttgtggcccaggtctcttcgaagtcggatcagagcctttctatcatttatttgatggacaggctcttttgcataaattcgatttcaaagagggccacgtcacctaccatcggcgattcattcgcacagatgcttacgtgcgggccatgacagagaagagaattgtcatcactgaatttggtacctgcgcattcccagatccctgcaagaacattttttcgcgcttcttctcctatttcaggggtgttgaagtaactgataacgcactcgtgaatgtctaccccgtcggcgaggattattatgcctgtaccgagactaacttcattaccaaaattaacccagagactctggaaacaatcaagcaggtggacctctgtaactatgtgagtgtcaacggcgctaccgcacatccgcatattgagaatgacggtaccgtttataacattggcaactgcttcgggaaaaatttttctatagcctacaacatcgttaagataccgccgcttcaagctgataaagaggatcctattagtaagagcgaaatcgttgtgcagttcccttgcagcgatcgatttaagccatcctacgtgcactctttcggattaactcccaactatattgtatttgtcgaaacacctgtgaaaattaatctgtttaaatttctgtcttcatggagtttgtggggagccaattacatggactgttttgagtctaacgaaactatgggagtatggttgcacattgctgacaaaaaacggaaaaagtatcttaataataagtatcgcacaagtcctttcaacttgtttcaccacattaacacctacgaagataacggatttctgatcgtcgacctatgttgttggaagggatttgaattcgtgtacaactacttatacctagcaaatctgagggaaaactgggaagaagtgaaaaagaatgcaaggaaagccccccagccagaggtacggcgctatgtgctgccactgaacattgataaagccgacaccggaaagaatctggtgacccttcctaatactacagccaccgctatactgtgctcagacgaaactatttggctggagcctgaggtgttgttctccgggccccgccaggcctttgagttcccacaaatcaactatcagaaatactgcggcaagccctacacttacgcatacggcctggggctaaaccattttgttcccgatcgcctgtgtaagctaaacgtcaagaccaaagagacgtgggtctggcaggagcctgacagttatccatccgaacccatattcgtgagccaccctgacgcgctggaagaggatgacggtgtcgttttgagcgtggtagtcagcccaggagctgggcagaagcctgcttatctgcttatcctgaacgccaaggatctgagcgaggtggctagggcagaggtggaaatcaatataccagtaacttttcacggactgttcaaaaagagctag

SEQ ID NO: 132255 - DNA, 954 bp, Artificial Sequence
  Description of Artificial Sequence: Synthetic coding sequence
atgtccgagggcgtgggaacctttcgtatggtgccagaagaggagcaggaactcagggcacagttggagcaattaacaacaaaggaccacggaccagttttcggaccgtgtagtcagcttccccgccacacattgcagaaggcaaaggatgagctgaatgaacgagaagagaccagagaagaagcagtgagagaactgcaagaaatggtacaggcccaggccgccagcggagaagagctggctgtcgcggtggcagagcgggtgcaggaaaaagatagtggatttttcctccggtttatcagggctcgcaaatttaacgtggggagagcctacgagcttctcagaggttatgtgaacttccgactgcaatatccagagctgttcgacagtctctccccagaagccgtgcgatgtacaatcgaggcaggatatccaggcgtcttatctagccgtgacaaatatggccgcgtggtgatgctcttcaacatcgaaaattggcagagtcaggaaattacattcgatgagatattgcaggcttattgctttatactggagaaactgctggagaatgaggaaactcagatcaatggattttgcataattgagaattttaagggattcaccatgcaacaggcggcgtccctgcgcacctcagaccttcggaagatggtagatatgttgcaagattcctttcccgccaggttcaaggctatccattttatccaccaaccctggtacttcacaaccacctacaacgtcgttaagccgtttttaaaatcgaagctcttggaacgggtgtttgtgcacggggatgatctcagtggattctaccaggagattgacgaaaacatcctacctagtgactttggaggcacgctcccaaagtatgacggtaaagcagtggcagaacagctgtttggaccacaggcccaggctgagaacactgctttttag

SEQ ID NO: 132256 - DNA, 807 bp, Artificial Sequence
  Description of Artificial Sequence: Synthetic coding sequence
atggctgaactcgatatcgggcagcattgccaggtcgagcactgccgacagagagatttcctcccctttgtgtgcgatgactgctctggcatattctgtttggaacatcgcagtagggagagccacggttgtccagaggtaactgtcattaacgagcgtcttaaaaccgaccagcacacctcttatccctgctcatttaaagactgcgcggagcgggaacttgttgccgtgatttgtccgtattgcgagaaaaacttctgtttaagacatcgacatcagagcgatcacgaatgtgagaagttggagatcccaaagcctaggatggctgctacccaaaaactggtgaaggatatcatcgattccaagaccggagaaaccgcctctaaacgctggaaaggtgccaaaaacagcgaaaccgctgccaaagtcgcactgatgaagctcaagatgcatgcagacggcgataagagtctcccgcagacagaaagaatttactttcaggtctttcttcccaagggctcaaaagaaaagtctaagcctatgttcttctgccacaggtggtccattggcaaggcgattgatttcgccgcttccttggctcgactcaagaacgataacaataagtttacagccaaaaaactgcggctctgccacatcaccagcggagaagctcttccgctcgaccacactttagaaacctggattgcaaaagaggactgccccctctataacggtggcaatattattctggagtaccttaatgatgaagaacagttttgcaagaatgtggaaagttatctggaatag

SEQ ID NO: 132257 - DNA, 2751 bp, Artificial Sequence
  Description of Artificial Sequence: Synthetic coding sequence
atgcaacgcccagtagtgaaattatatgctactgacgggcgcagagtgcctagcctgcaggcagtgatcctgtcctctggtgccgtggtggccgccggccgcgagcctttcaaacccggcaattatgatatacaaaaatatctgttgccggccagacttcctgggatttctcagagagtgtacccaaaaggaaacgctaagagtgaatcaagaaaaagcagtaactggaaggtattcatcattacatctgatctgcccgatgcaggcacgtcatctcaaatctacattatcctatacggtcagcatcgttcttcagctccaatttatctttatggcaccgatggtgcacgattccaggtgggccacgaggacattttcacgatcacagtgggcgatataggagcgctcttcaagatccggattggtcataccaacagcggttcgagcccctcatggcattgtaaagaaattcaactgcacaacatgaattcgggaaagcagttttacgtaccagtccaacgatggctcgccagggatcaggaggatggcgagatttgtcgcgaattccccttgctgtcaaagggacagcccgtgctccccgttaccatctacgaagtgaacgtggcaaccggagagttgtggaatgccgggacagtggctaatgtgtatatctctatccatggcgagaagggggatactggcagccggcagctcttcaggagcaagagcagttttaacttcctgcggggccagaccgatacattcttcctagaggcagtgcacctgggcgacttgtgtaaaatcgtaatcggccatgatggcctagggcctggaaatgggtggttcctggatgatgtggtgataaaggaccccactaccaactatgagtacgcctttttttgccatcggtggttggaccagggcgaggacgattgcaagatcgtgcgcgagctctatgccagagacaattcaattttctcagcgaggcaaaagcttgagcttaagcggaaagagacctggaccgctgagagctggaagttcaccaagggtaatactttgcagttctacaataaactcacggggggctttgtgcggctccatccagatgggacagtggatgcaataggcgaaaaaacagataagtacggagtgttcgacgtgatttttaacaaacgaaatatttgcatctttcagtcacacgaaatgcgccacctgagtctggcgctagataatggaatagtgactggaatggtgtccggtgaagctacgacagagttgcgtgttctgtaccagcccaatcggtgtgccctcctcgagagtgcccttgtgcccggccatacggtcgtgttcgataggcatggcaagatagctgatgcttcaagcgcgggatacgctaacctcagtaaggagttcgtgatctttgtgaagggcgttttcctgaatagtgccgttgtgctgctggctacatcactgtgtcaggccctgtgtctgcagccggacggcagctgcactggagtaggctcccagagcgagaagtcctattggaaggttcacaagatttcttcgggcatctgtatgtttgagtccgttaagaacgctcaaatgtacctgcggatcaaagatgggagatgcgatgggacagggacaggagatgttgactgtcatttcaaaatcaagaagaacctcaagaatgcctctatttccttagaatcaaccaaatctcccggtctgttcgtggggctgcagtccgatggccaggccaagcccatgatctacaccaaagatgagaacgtgtgcttttacccacaagtgatacagttcggccgggagaacccaatggggatgagcgccacaccttcccaagaagaggagaaaatccacgagagcaagaaacagaaaaaaattcccccagagagtgaggcgcgtagccctctgccgtcttcaactgctaaggaaatacgccatttccagagctcggagaccctcttaagtgaggacgaatggaaggtactcgtcctgacaggaaacaccgggactcaggcaaatgtgaccctgtgggtgtatggagataagggagtgacaggccccatcagtcttaggaaagactcctccgaacagttatttttgcctgggcacgaggacgagtttcaggtcgaaatccgaaatactggcaacatctacaaaatcagaattggacacgacggcactagcgagcagccagagtggaacttgcagcgggtgacaatgcagcatatgaagtcgaaaaagatcctggacttcgcagcaaacgtatggctcagtcggattcaggccgacggcgacgtcgtgtgtgagctccctgtggttaaaggtgggcaggccattttcccactcgtccggtatcaggtggacgtgtacacggggcaattaaaacacgccgaaacggagagcgaagttttcctgtgcttgttcggggagagaggcgattctggtctccggcaactgtataaatccaacatgcaggttaaatttcagcgtggacagatagacaagttccaagtagctgctgtctcacttggtaagctccagaaggtgttgctgcggtgcgaagccagcgacaaatctcagtactggtactgtgaacaggtaattgtgcgcgaacctgggacaactagcgagtcgatttttacttgccaaaggtggctcccattcatgagccaagggatcatacacagcgagattgagctttacctccaaggggaagactactag

SEQ ID NO: 132258 - DNA, 7203 bp, Artificial Sequence
  Description of Artificial Sequence: Synthetic coding sequence
atgaacagtacccccaggaatgcccaggcccctagccacagggagtgcttcctccccagcgtggcccgtacaccatcagtcaccaaagtgaccccagccaaaaagattactttcttaaagaggggagacccacgctttgcaggcgtccgcctggcagtgcaccagcgagcctttaagacatttagcgccctgatggacgaactgagccagcgtgtgcccttgagcttcggtgtgcggagcgtgacgacgcctcgcggacttcattctttatccgccctcgaacagcttgaagacggtgggtgctacttgtgctccgataaaaagccccctaaaacaccaagcggcccgggacggccacaagagcgaaacccaacagcacaacaacttagagatgtggagggtcagcgtgaagctccaggaacaagctcctccaggaaatcgctgaaaacccctcggcggattctgctcatcaagaatatggatccacggctgcagcaaactgtcgtcctgtcccataggaatacacggaacttggccgccttcctgggaaaagcaagcgatttactgcggttccctgtgaaacagttgtacaccacgagtggcaagaaggtggatagcctccaggcgctgttgcacagcccttccgtcctcgtgtgtgccggacacgaggcttttaggaccccggccatgaagaacgctcgcagatctgaggctgaaaccctgagcgggctgacttcacggaataagaacggatcctggggaccgaagactaagccgagcgtgattcactccagatctccccccggctcgactcccagactgcctgagcggcccgggccgagcaatcccccagtaggaccagcaccgggccgccatccccaagatacaccagcccagtctgggcccctcgtggcaggggacgatatgaaaaaaaaggtccggatgaacgaggacggttccctgagtgtcgagatgaaggtgcgctttcatctcgtgggagaagacacattgctgtggtcacgtaggatggggagagcaagcgctctgacggcagcgagcggcgaggatcccgtgctcggcgaggtggacccactgtgctgcgtctgggaggggtacccctggggattttcagagccaggagtgtggggcccccgaccctgcagagtcgggtgcagagaggtctttggcaggggaggtcagcctggaccgaagtacgagatttggactaaccctctccacgcatcacagggcgagcgggtggccgcgagaaagcgctgggggcttgcccaacatgttcgctgtagcggcttgtggggccacggcaccgcagggcgggaaaggtgctcgcaggatagtgccagcccagctagcagtactggactccctgaagggtcagagccagagagcagctgctgccctcggacacctgaagacggagtggattctgcatccccaagcgcgcagatcggcgctgagaggaaagccgggggctccttgggtgaggaccccggtttgtgcatcgacggagcggggctggggggccctgaacagggtgggcgactgacgcctcgggccagatccgaggagggggcttcatcagacagttccgcatctacaggtagccatgaaggatcttccgaatggggaggaaggcctcaagggtgtcctggaaaagcccgcgctgagaccagtcagcaagaggcctcagaagggggtgaccctgcgagtcctgcactgagcttgtccagtctgagaagtgacgatctccaagccgagactcagggacagggtaccgagcaagccaccggcgcagccgttaccagagagcctctggttctaggcctcagttgtagctgggactctgagggagcctcaagtacacccagcacgtgcacaagtagtcaacaggggcaaaggcgccacagatctcgggcaagcgccatgtcatcccccagcagcccgggcctgggacgagtggcacccagaggccaccccaggcacagccattaccgcaaagatacacactccccactggatagcagcgtgacaaaacaggtgccgcggccccctgagagaaggcgagcttgccaggacggatcggtgccccggtatagcggatcatctagctcaacgagaactcaggcaagcggtaatttaagaccgccaagctcaggatccctgccgagtcaggatttgcttggaacttcgtcagccacggtcactccagcagtgcatagcgatttcgtgtcaggtgtttcccctcataatgcacctagcgccggttgggcaggtgatgcgggctccaggacctgctcccccgctcccatcccgccacatacatctgatagctgttccaagagtggtgcagcctccctgggagaagaggctcgggatacacctcaacctagcagtcctctggtcctgcaggtcggacgcccagagcaaggggccgtcggcccacaccgctctcactgctgtagccaaccaggtacccaacctgcacaggaagcacagcgaggcccatcacccgaagcgtcctggctgtgcggacggtactgccccactccgccgcgtggccggccgtgtcctcagagacgttcatccagttgtgggtctaccggtagcagccaccagtccaccgctcgcggaccaggcggtagcccccaggaggggacgaggcaacccggccccaccccctccccaggtcctaactccggcgcatcccgacggtccagcgcctctcagggagcaggaagccgaggtctgagcgaagaaaagactctgaggagcggtggtgggccccagggtcaggaggaagcctccggcgtgagcccatcgagcctccccagaagttcacctgaggcagtcgtgagggagtggctggacaacatccctgaggaacccatcctgatgacctatgagctcgccgatgaaaccactggggctgcgggcggaggactccgtggtcccgaggtcgatccaggagatgatcacagcctggagggcttaggagaaccagcacaggccggccagcagtccctggaaggggatccaggccaggaccctgagccagaaggggccctgcttgggtcaagcgatacaggcccccagtccggcgaaggcgtgcctcagggcgcagcccctgaaggagtaagcgaggccccagcagaagcaggcgcggacagagaggctccagcagggtgtagggtaagcctccgcgctctacccggacgcgtctctgcttccacccaaatcatgagagccctaatgggttcaaagcagggtcgcccttcctcagtacctgaggtttcacgtcccatggccaggcgtctctcctgctccgcgggtgccctaataacatgtctcgcctcgctccagctattcgaggaagacctgggatcacccgctagcaaggtgcggttcaaggatagtcctcggtatcaagagctgctgtcgatctccaaagatctgtggcccgggtgtgatgtgggagaagaccagctcgactctggactgtgggagttaacgtggtcccaggctcttcccgatctcggaagccacgcgatgaccgagaactttactccaacaagcagcagcggggtggatatctcctctggatctggcgggagcggcgagtcgtccgtgccttgtgcaatggatggaacattggtcactcagggcaccgagttacctttaaagaccagcaaccagaggccagactcccgaacatacgaaagtcctggtgatcttgagaatcagcagcaatgctgtttcccaacctttctcaatgctcgagcctgcgcatgcgctacaaatgaggacgaggccgagagggattctgaggagcagagagctagttcaaatttagagcagctggctgaaaacaccgtgcaggaggaagtgcaactcgaggagacaaaggagggtaccgagggggaaggcttacaagaggaggctgtgcagctggaggaaacgaagaccgaagagggactgcaggaggagggcgtgcaattggaggaaactaaagagacggaaggggaagggcagcaggaggaagaggcccagctcgaggagatcgaagaaacagggggcgaagggctccaagaagagggcgtccagctggaagaagttaaagagggacctgaaggcggcctccagggtgaggctctggaggagggcctaaaagaagaagggttgcccgaggaggggtctgtccatggacaagaactcagcgaagcgtcctctcctgatgggaagggcagccaggaggatgatcccgtacaagaggaggaagccgggcgtgcatccgcttcggcagaaccttgcccggcagaaggtacagaagaacccaccgagcccccgtcccacctgtcggagacagatccgagtgcctccgaaaggcagtccggcagtcagcttgagcctggtctggaaaaacctccaggggctacgatgatgggacaggaacacacccaggcacaacctacccagggcgcagctgagcgcagcagttctgtagcctgttctgctgctctcgattgtgatcccatttgggtctccgtgctcttgaagaagacggaaaaagcctttttggctcatctcgcatctgccgtggctgagttgagagcccggtggggactgcaggataatgatctattggaccagatggcagccgagctccaacaggatgtcgcccagagactccaggattccaccaagagggagctgcagaagttacagggtagggctggtcggatggtattggaaccacctcgcgaagctctaaccggcgagcttttgctgcagacccaacagaggagacaccgacttaggggtctgagaaatttgtctgccttcagcgaacgtacattgggtctcggacctctgagctttactctcgaggacgagcctgctctcagtacagccttggggtcccagctgggggaagaggctgaaggagaggaattctgcccgtgcgaagcgtgtgttcggaaaaaagtgagcccaatgtctcccaaggccacgatgggcgctacccgcgggcccattaaggaagccttcgaccttcagcaaatactccagcgaaaaaggggagaacacactgatggagaagctgccgaggtggctcccgggaagactcacaccgaccccacctcaacaagaactgtgcagggcgcggagggggggcttggaccaggtctctcccaaggcccgggggtcgatgagggtgaggacggcgagggcagccagaggctgaatcgagataaagaccccaaactgggagaggcggagggcgatgcaatggcacaagaacgggaaggcaagacccataattccgagacctctgctgggagcgaactgggagaggcggaacaggaaggagaggggattagcgagcgcggagaaactgggggtcagggcagtggccatgaagataacctgcagggagaggccgcggccggaggagatcaggatcctgggcagagtgacggcgcggaaggtattgaggctccggaggcagagggggaggcacaaccggagtctgagggcgtcgaggcccctgaggctgaaggggatgcacaggaggcggagggggaagctcagcctgaatcagaagatgttgaggcccctgaagccgaaggcgaggcacagccagaaagtgaggatgtggagacacctgaagcagagtgggaggtgcagccagaaagcgagggcgctgaggcccccgaagcagaaaaagaggcgcagcctgagacagagagcgtcgaggcattggagacggagggcgaagatgagccggaatccgagggcgcagaggcccaggaggccgaggaggcagcgcaagaagctgaagggcaaacgcaaccagaaagcgaggttatagaaagtcaggaggctgaagaggaagcccaaccagagtccgaagacgtagaggcattggaggtcgaagtagagacacaggaagctgaaggggaggcccagcccgaaagtgaggatgtggaggctcctgaagcggagggggagatgcaagaggcggaagaagaagcccagcccgagtctgacggcgtggaggctcagcctaaatccgaaggcgaagaagcacaggaggtggaaggtgagacgcagaagacagagggggacgcacaacctgagtctgacggcgtggaagcccctgaagctgaggaggaggctcaggaagccgagggggaagtgcaagaggctgaaggagaggcgcatcctgagagcgaagatgtcgacgcgcaagaggctgagggagaagcacagcctgagtctgagggagtcgaggccccagaggcagagggggaggcacagaaggctgagggtatcgaagccccagagaccgagggtgaggcgcagcccgagagcgaggggatagaggctcctgaggcggaaggcgaagctcaaccagaatcagagggagttgaagcccaggacgccgaaggcgaggctcagccggaatctgagggcattgaagcccaggaagcggaggaggaggcccagccagagctggagggcgttgaagctccagaggcagaaggggaagcccagccggagtccgagggcatagaggcccctgaagccgaaggagaggcccagcccgagttagagggcgttgaggctcccgaagccgaggaggaagctcaacctgagcccgaaggagtggagacccctgaagcagagggggaagcacagcccgagtcagagggcgaaactcaaggcgagaaaaagggatccccacaggtgtcgttgggcgatgggcaatctgaggaagccagtgagagttcttctcccgttccggaggaccgaccgacgccaccgccctctcccgggggcgacactcctcatcagcgcccaggctcccagacaggcccaagctcatcccgcgcatcctcatggggaaactgttggcagaaagatagcgaaaacgatcatgtgctaggcgatacgaggagcccagatgctaaatccacggggaccccccacgctgagaggaaagcaacgcgtatgtatccggagagttctacaagcgaacaggaagaggctcccctgggctctaggacgccagagcagggggcatcggaaggatacgacctccaggaggaccaggccctgggaagcctggcacccaccgaagctgtgggccgggccgatgggtttgggcaggacgatctcgatttctag

SEQ ID NO: 132259 - DNA, 5019 bp, Artificial Sequence
  Description of Artificial Sequence: Synthetic coding sequence
atgaaggtcgatcgcacgaagctgaagaagacccccaccgaagctcctgcggactgcagagccctcattgataagctcaaagtgtgtaacgatgaacagctcctcctcgaacttcagcaaataaaaacatggaatatcggaaaatgcgaactttaccattgggttgatttgctcgacaggtttgatggaatcctagcagatgctggccagactgttgagaacatgtcctggatgcttgtctgtgatagacccgagcgcgaacagctgaaaatgctcttgctggctgtacttaatttcaccgctctcctgattgagtacagctttagccggcatctgtactctagtatcgagcatctgactactctgctggcctcttcagacatgcaggtggtgctggcggtcctgaatctgctctatgttttttctaagaggagcaactatattaccaggttggggtctgacaaacgaacaccactgttaacacgcttgcagcatctagccgaatcctggggcggcaaagaaaacgggttcgggctcgccgagtgctgtcgtgacctgcacatgatgaagtatccgccttccgcaaccaccctccacttcgaattttatgctgacccaggagccgaggtgaaaattgaaaaacggacaacgagtaatacactgcattacatccacatcgagcagctggataaaatttccgagagtccctccgaaataatggagagtcttaccaagatgtactctatcccaaaggataaacagatgctgttatttacccatatccggctcgctcacggcttttccaatcataggaaacgcctgcaggctgtgcaggcccggctgcacgccatatccatcctggtttacagtaatgcactacaagaaagcgcaaactctattctttacaacggattgatagaggagctcgtggacgttcttcagattacagataagcagcttatggagattaaagccgcaagcttacgcacactgacctccatcgttcacctggagcgtactccgaagctttcatcgattatcgattgtaccgggacagcaagctaccacggatttttaccggtccttgtgagaaattgcattcaagcaatgatcgacccgtccatggacccatatccccaccaattcgctactgcactgttcagttttctataccacttggcatcctatgatgccggcggtgaagccctggtctcgtgtgggatgatggaagcactgctcaaggttatcaagttcctgggtgatgagcaggaccagatcacatttgtcacacgcgccgtccgcgtggtagatctgattacaaatctggacatggctgcatttcagtcccactctggtctcagtatatttatctatcgtcttgagcacgaagtggacctttgtcgcaaagaatgtccattcgtgatcaaacccaaaatacagcgacctaacaccactcaggagggagaagagatggaaacagacatggacggggtgcagtgtattccccagcgcgctgctttgctgaagagtatgttgaattttctgaaaaaagccattcaggatccagctttctcagacggtatccgccatgtcatggacggtagtttacctacttccctgaagcacataattagcaatgccgaatactacggtccgtcgctgtttttgctggcaaccgaggttgttaccgtatttgtattccaggagcctagcctgctgtccagccttcaggataatggcctcaccgatgtgatgctccacgccctcctgatcaaggatgtgcccgcaacaagggaggttttggggtccctcccaaacgtattctccgcactttgcttgaacgccagagggcttcagtctttcgtccagtgtcagccttttgagaggttgttcaaggtcctgctctctccagactatctgcctgctatgcggcgtcgtcgctcctccgacccacttggagataccgcaagcaatctgggaagtgccgtggacgaactcatgcggcaccagcctactttgaagacagacgctacaaccgctataatcaaactgcttgaggaaatttgtaacctcggccgggaccctaagtacatttgtcagaagccaagcattcaaaaggcagatgggaccgctactgccccccccccccgaagcaatcatgcagcagaggaggcatcatcagaggatgaggaagaagaagaggtccaggcaatgcagagtttcaattcaacacagcaaaatgagactgaaccaaatcagcaggtggtcggcacggaggaacggatccccattccactgatggactacatcctgaacgtgatgaaattcgtggaatccatactgtcaaacaacaccactgacgatcattgtcaggaatttgtcaaccagaaggggttactacctttggtcaccatcctgggcctaccaaatctcccaatcgactttccaactagcgccgcatgtcaggccgtagcaggggtctgcaaaagtatccttaccttgtcccatgagcccaaggtgctgcaggaaggcctgctacaactcgacagcatcctgtcatccctggagcccctacataggcccattgaatctccaggaggcagcgtgctcctgcgtgagctggcttgcgcggggaacgtggcggatgccaccctcagcgcacaggcgaccccgttgctgcacgctttgactgccgcgcacgcctacatcatgatgtttgtgcatacctgcagagtgggccaatccgagatccggtcaattagcgtaaatcagtgggggagccagctagggctgagtgtcctctctaagctgtcacagctgtattgctccctggtttgggagagtacagttctcctttcactttgcactccaaactcccttccttccggctgcgagtttggtcaagcggacatgcagaagctcgtgcccaaggatgagaaggcagggaccactcagggcgggaaaagatcagatggtgaacaagacggcgccgcaggctcaatggatgcttccactcaagggctgctggaagggattgggttggatggcgatactcttgctcctatggaaacagacgagcccactgcgagcgactcaaagggtaagtcaaagatcacaccggcgatggcagcccgcatcaaacagatcaagccccttctctcagctagcagtcgtcttgggagggccctcgccgaattattcggactacttgtgaaactctgtgtcggctcccctgtgcggcagcgccggtctcaccatgctgcgtctacgaccacagctcccacaccagctgctcggtcgacagccagcgccctgaccaagctgctcaccaagggtttgtcgtggcagccccccccatacactccaacaccacgcttccgtctgactttttttatctgttctgtaggctttacgagtccaatgttatttgacgagaggaagtatccttaccacctgatgctccagaagtttctgtgctcaggtggccataacgctttatttgagacgtttaattgggctctgtccatgggaggcaaggtgcctgtgtccgaaggactggagcacagtgatctgcccgacggtacaggcgaattcttagatgcctggctgatgttggtggaaaagatggtgaatcccacaacagtgttggagagcccacactccctccccgctaaacttcccggcggcgttcagaactttccgcagttttcagcactccggttccttgtcgtgacccaaaaggccgctttcacctgtatcaaaaacctatggaatcggaaacctcttaaagtctatgggggtcggatggctgagtcgatgttggcaatcctgtgccacatcctgcgcggggagcctgtgatcagggagcgtttatctaaggaaaaggagggttcgcgcggtgaggaagataccggccaggaggaggggggaagtcggagagaacctcaggtgaaccagcaacagttgcagcaacttatggatatggggtttacccgagagcatgctatggaagccctgctgaatacatcgaccatggagcaggctacagagtatttattgacccatcccccccccatcatgggtggcgtggtcagggatctgagtatgtcagaggaggatcagatgatgagggcaatcgcaatgagcttgggacaagatatccctatggaccaaagagcagagtcccccgaagaggtggcctgccgtaaggaagaggaggagcggaaggcccgggagaagcaggaggaagaggaggcaaagtgtttggaaaaatttcaagatgccgatccgttggagcaagatgagttgcacactttcaccgacaccatgttacctggctgttttcacctactggacgaactaccagacactgtctacagggtgtgtgatctaatcatgacggctatcaaaagaaatggagccgactaccgggatatgattctgaaacaggtcgtcaaccaggtgtgggaagctgccgatgtcttgatcaaggccgcccttcctttgacgaccagtgacactaaaaccgtcagcgaatggataagccagatggctactttaccccaggccagcaacttggcaacccgcatcctactattgacattgctgttcgaggaactcaagttaccttgcgcatgggtggtggagagtagtggcatcctgaatgtcttgatcaagctgttggaggtagttcagccttgcctacaggccgctaaggaacaaaaagaggtgcagaccccaaagtggatcacacctgtactacttcttattgacttctacgaaaagactgcaatttcttctaaacggcgcgcccagatgaccaaataccttcaaagtaactcaaacaattggagatggtttgatgacagatctggtcgctggtgctcctattcagccagcaacaactcaaccatagattccgcgtggaagtctggggagacctcagtgagattcactgcgggcaggcgccgctacaccgtgcaattcaccacgatggttcagggaacgtccgctgagtag

SEQ ID NO: 132260 - DNA, 666 bp, Artificial Sequence
  Description of Artificial Sequence: Synthetic coding sequence
atgagttctcggccaggacgggaggatgttggtgccgcgggcgccagaagaccgcgcgaacctcccgaacaggagctgcaacgcagacgggaacaaaaacgtcggagacatgacgctcagcaactccagcaactgaagcacctggagtcattctatgagaagccaccccctgggctgatcaaagaagacgagactaagccagaagattgcattcccgacgtacctgggaatgaacacgcacgcgagttcctggcacatgcgccgactaagggcctgtggatgcccttagggaaggaggtgaaagtgatgcaatgttggagatgcaagcgctatgggcaccggaccggcgataaagagtgtccgttctttataaaaggaaatcagaaactggagcagttccgggtagctcacgaggatcccatgtatgacatcattcgcgacaataagagacatgaaaaagacgtcaggatccaacaactgaagcagctgctagaggattcaaccagcgatgaggatcgctcatcatcatccagcagtgaaggaaaggaaaaacataaaaagaagaagaaaaaggagaagcacaagaagcgaaagaaggagaagaagaagaagaagaagaggaaacataaatcgtcaaagtctaacgaaggcagtgacagtgagtag

SEQ ID NO: 132261 - DNA, 2262 bp, Artificial Sequence
  Description of Artificial Sequence: Synthetic coding sequence
atgcgcgagcccgaagagttgatgccggactccggcgctgtgtttacctttggcaaatcaaagttcgcggaaaacaaccccggcaagttttggttcaaaaatgacgttcctgtccacctctcctgtggggatgaacattccgcggtggtcactggcaacaataagctgtatatgttcggcagtaacaattgggggcagctgggtcttggcagcaagtccgctatttctaaacctacttgtgtgaaagctctaaagcccgagaaggtcaagttagccgcctgtggtcgaaatcacaccttggtgtcaaccgagggcggcaacgtgtacgctaccggcgggaacaacgaggggcagcttggcctgggcgacacagaagagcgaaatacctttcatgtcatttcatttttcacatcggagcacaaaatcaagcagctgagcgccggatccaatacaagcgcagcgttaaccgaggatggccgactgtttatgtggggagataacagcgagggacaaattggattgaaaaacgtgagtaacgtctgcgtccctcagcaggtgactattggcaagcctgtgagctggatttcatgtgggtactaccatagtgcttttgtaactaccgacggggagttgtatgtatttggagagcccgaaaatggtaaattgggcctgcccaaccagctactgggcaatcacaggacgcctcagctggtttcagaaataccggaaaaagtaattcaagttgcttgtggcggcgagcacaccgtggtgcttactgaaaatgctgtgtatacttttggtctcgggcagtttggacagcttgggcttggaaccttcttgttcgaaactagtgaacctaaggtgatcgagaatatcagagaccagacaataagttatatttcttgcggcgaaaaccacactgctctgatcactgatatcggactgatgtatacatttggcgacggccggcacgggaaacttggcctgggtcttgagaacttcacgaaccacttcatccccacactctgctctaattttttgagattcattgtgaaacttgagcgatcacctgatagcttttccatgcgaagaacgctgcctcccattgaaggcactctcggtctatctgcatgcttcctccccaacagtgtgtttccgcgctgtagcgagcgtaacctgcaggaatcggtgcttagcgagcaggacttaatgcagcccgaagaaccagattatttgcttgacgagatgactaaggaggctgaaatcgacaatagcagcacagtggaatctttgggcgagaccactgatattcttaacatgactcacatcatgagtctcaatagtaatgagaagagcctgaaactgagtcctgtgcagaagcagaagaagcagcagaccataggagaacttactcaagacacagcactgaccgaaaacgatgacagcgacgaatatgaggagatgtcagagatgaaggagggcaaagcttgcaaacagcatgttagccaaggcattttcatgactcagcctgcaaccactatcgaagctttttccgacgaggaggtggagattcctgaggagaaagagggcgcagaagattccaagggcaacgggatagaggagcaggaagtggaggcaaacgaagaaaacgtaaaggtgcacggcggcagaaaagagaagactgaaattctgtccgacgatttgacagataaggccgaggaccatgagtttagcaagactgaagagctgaagctggaagatgtggacgaagaaatcaacgccgagaacgtcgagtccaagaagaagacagtgggagacgatgaatcggtgcccactggctaccatagcaagactgagggcgccgagcgcaccaacgacgactcctctgcagagacaatcgagaaaaaggaaaaggcgaatctcgaggagagggcaatctgtgagtataacgaaaatccaaaagggtacatgctggacgacgccgacagcagttctctggaaatcctggaaaacagtgaaaccacgccaagcaaggatatgaagaaaaccaagaagatcttcttattcaaaagagtgccatctattaaccagaagatcgtgaaaaacaacaacgagcccctgcctgaaattaaaagcatcggcgatcaaatcatccttaagagtgacaataaagacgccgatcaaaaccatatgtctcagaatcaccaaaatatccctcccacaaatacagagaggcggtccaagtcttgcacgatcctgtag

SEQ ID NO: 132262 - DNA, 2448 bp, Artificial Sequence
  Description of Artificial Sequence: Synthetic coding sequence
atgcgggagcctgaagaactgatgccagactcaggcgcagttttcacattcggcaagtccaaattcgccgaaaacaatccagggaagttttggttcaagaatgatgtgccagtgcacctatcatgcggtgatgagcacagcgctgtggtaactggcaacaataagctgtacatgtttggctctaataattgggggcaactaggcttggggtctaaaagtgcgataagcaaacccacttgcgtgaaagctctgaagcccgagaaggtgaagcttgccgcatgtggaaggaatcacaccctggtcagtaccgaaggtggtaacgtctatgccaccggcggcaataacgaagggcaattgggattaggtgatactgaggagagaaacaccttccatgttattagctttttcacttctgagcacaaaattaaacagttatcagcagggtcaaacacctccgccgctttgacagaagacggcaggctgtttatgtggggggataacagtgaaggacaaattggtctcaaaaacgtgagtaatgtgtgcgtgccccagcaggttaccattggaaagcctgtttcatggatctcctgcggctactaccattcagccttcgttacaacagacggagagctttacgtgttcggggagccagagaacgggaagctgggcctgcctaaccagttgctaggtaatcaccggactcctcagctagtcagtgaaatacctgagaaagttattcaggtggcctgtgggggtgagcacaccgtggtgttgaccgagaacgctgtctacacctttgggctgggccagtttgggcagctgggactggggacattcctctttgaaacaagcgaacccaaagtaatcgaaaatattcgtgatcagacgatcagctacatctcctgcggggaaaatcatacagccctgattaccgatataggcctcatgtacacatttggcgatgggcgacatggaaaactgggccttggcctggaaaactttactaaccacttcattccaacactgtgttccaactttctccggttcatcgtgaaacttgtggcttgcgggggttgccacatggtagtgtttgccgctccccaccggggggtggccaaggagatcgagttcgatgagatcaatgacacttgcctcagcgtagcgacctttctgccctattcctcattaacaagcggtaacgtgctgcagagaaccttgagcgccagaatgcgccgtcgcgagagagaaaggtcaccagactcttttagtatgcgtagaaccctgccgcctatcgaggggactcttggcctgtcagcctgtttccttccaaattctgtattcccccgctgttccgagagaaaccttcaggagagcgtgctctcagagcaggatctcatgcagccggaggagcctgactacttgctcgacgagatgacaaaggaggccgagatagataactctagcacagtggagtcactgggagaaacaacagatattctaaacatgacccacattatgtcactaaacagtaatgaaaagtcactgaagttgtcgcctgtgcagaagcagaagaagcagcagaccatcggggaactgacacaggacacagcactgacagagaacgacgattcagacgagtatgaagaaatgagtgagatgaaagagggcaaggcttgcaagcaacacgtgtctcagggcattttcatgacacagccggccacaacaatcgaagctttttccgatgaggaagtagaaatccccgaagagaaggagggcgccgaggactccaagggcaatgggatagaggaacaagaagttgaagccaatgaggaaaacgtgaaagttcacggcggacgcaaggagaagacggagattctgtcagacgatctgaccgacaaagcagaggatcacgaattcagcaagactgaggagctgaagttggaggatgttgacgaagagattaacgccgagaatgtggaatctaagaaaaagacagtgggggacgatgagtctgtaccaaccgggtaccattctaagaccgagggagcagaaaggactaacgatgattctagcgctgagacgatcgagaaaaaagagaaagccaatctcgaagagcgcgccatctgtgagtacaatgagaatcccaagggatacatgcttgatgacgctgatagtagcagcctggagatcttagaaaattctgaaactaccccgtcgaaggatatgaagaaaacaaaaaaaatcttcctgttcaagcgggtcccttcgatcaatcagaagattgtgaaaaacaacaacgaacccctgccagagataaagagcataggagatcagatcattctcaaaagcgataataaggacgccgatcagaaccacatgagccagaaccatcagaatatccctccaacgaatactgaacgcagaagcaagtcatgtacgatattgtag

SEQ ID NO: 132263 - DNA, 1443 bp, Artificial Sequence
  Description of Artificial Sequence: Synthetic coding sequence
atgagagagcctgaggaactaatgcctgactccggcgcggtcttcacatttggcaaatctaagttcgctgaaaataaccctggaaaattttggttcaaaaacgacgttccagttcacctgtcttgcggggacgaacactctgctgtggtgaccggaaataataagctctacatgttcggcagtaataactggggccaactgggcctcggatcaaagtccgccattagcaaaccgacatgtgtgaaggcactgaagccggaaaaggtgaaactcgccgcatgcgggcggaaccacacactggtttctacggaagggggtaatgtgtacgctaccgggggcaacaacgagggtcagctggggctgggagatacagaagagcgcaacactttccatgtgatctccttttttacgagcgagcataagatcaagcagctgtcagccggatcgaatacgtccgccgctcttacagaagacggccgcctctttatgtggggagacaactcagagggccagatcggactgaagaatgtgtccaacgtgtgtgtaccacagcaggtaacgattggcaaacccgtcagctggattagttgcggatactatcacagcgcttttgtgaccactgatggggaactgtatgtcttcggagaacctgagaacgggaagttggggcttccgaatcagctcctcgggaaccatagaaccccgcagctggtaagtgagattcccgagaaggtgatccaggtggcttgtggtggtgagcatacagtggtcctaaccgagaacgctgtttacaccttcggcctcggacagtttggccagctgggactgggcacttttctgtttgagactagtgaacccaaggtgatcgagaacatacgcgatcagaccatcagctatattagctgcggggaaaatcatactgctctgataacggacattggtctcatgtatacatttggggatggacggcacggcaaactcggccttgggctcgagaatttcacaaaccactttattccaaccttatgcagcaatttcctgcgattcatcgtcaagctggtggcgtgcggaggttgccacatggtggtgttcgctgcgccccatcgcggtgtggctaaagagatcgaatttgatgagattaatgacacatgtttgtcagtggcaaccttccttccttacagttcactgacttcaggtaatgtactccagaggactctttccgctcgcatgcgccgccgagagagagaaagatcaccagatagcttctctatgaggcggaccctcccacccatcgaggggactttgggcctgtctgcctgctttcttcctaactctgtgtttccgagatgtagtgagcgcaatcttcaggagagcgtgctgagtgaacaagacctcatgcagccagaggagcccgacacgcaccacgagcctgagtttcagtag

SEQ ID NO: 132264 - DNA, 3063 bp, Artificial Sequence
  Description of Artificial Sequence: Synthetic coding sequence
atgcgagagcccgaagaattgatgccggatagcggggcagtgtttactttcggcaaaagtaagttcgccgagaataaccccggcaaattttggttcaaaaatgacgtcccggtacacctaagctgcggagacgagcactccgccgtcgtgacgggcaataataagctttacatgttcggctcgaacaactggggccaattagggcttggatccaaaagtgccatatctaaaccaacgtgtgttaaggccctgaagcctgaaaaggtgaaactggcagcctgtggaagaaaccacacgctggtctccaccgaaggagggaatgtgtacgctacaggaggtaataatgagggacagcttggacttggcgatactgaagagcggaatacattccacgtgatcagctttttcactagtgagcataaaattaaacagttgagcgccggctccaacaccagcgcagctctgacagaggacggtaggctgttcatgtggggcgacaatagcgagggacagatcggcctgaagaatgtgtcgaatgtgtgcgtgccccagcaggtgacaattggaaaaccagtatcctggataagttgcggttactatcattccgccttcgtgactaccgacggcgaactgtacgtttttggcgagcctgagaacgggaaactgggtttgcctaaccaactcctaggtaatcacaggacaccacagttagtgtccgagatccctgaaaaggtgatccaggtggcctgcgggggcgagcataccgttgtgttgactgaaaatgcagtctatacatttggtcttgggcagtttggtcagctgggactcgggacctttttgttcgagacgtctgaacctaaggttatcgagaacattcgcgaccagactatttcatacatttcctgcggagagaatcacactgccctgatcaccgacatcggattgatgtatacatttggcgacggtcgtcatgggaaattaggtctgggcctggagaacttcaccaaccatttcattcccacgttgtgcagcaattttcttcgcttcatagtgaagctggtggcctgcggcgggtgtcacatggtcgtatttgcggctccccacagaggagtggccaaagagattgaatttgacgagattaatgatacttgtctgtcagtggcaactttcctgccctattccagcttgactagcggaaatgttctgcagaggaccctcagtgccaggatgcgcaggagagaaagagagaggagccccgattcattttccatgaggcgcacacttccacctattgagggcactctaggattatctgcatgcttcctgcccaacagcgtatttcctaggtgttcagaaagaaacctccaggagtcggtgctgtccgagcaggacctgatgcagcctgaagagccggattatcttcttgacgagatgacgaaggaagccgaaattgataacagctctactgtggaaagcctcggcgaaacaaccgatattttgaacatgactcatatcatgtctctgaactcgaatgagaaatctctaaagttgtccccggtccagaaacagaaaaagcaacaaaccattggggagctgacccaggataccgctcttaccgagaacgatgattcagatgagtacgaagaaatgtctgaaatgaaggaaggaaaagcctgcaagcagcacgtcagccagggcattttcatgacccagccagccaccacaattgaagctttttctgacgaggaggtaggtaatgataccgggcaagttggcccccaagctgataccgacggggagggtcttcagaaggaagtttaccgacacgagaataataatggcgtagaccagctcgacgcaaaggaaattgagaaggagtctgatggtgggcactcacagaaggagtctgaggcagaagagatcgattctgagaaagagactaagctggcagaaatcgccggtatgaaagatctacgcgagcgcgagaagagtaccaaaaaaatgtcgccttttttcggaaacctgccggaccgcggaatgaatactgaatctgaggagaacaaggacttcgtcaaaaagcgggagtcttgcaaacaggacgtgatctttgacagtgaacgggaatcggtcgagaaacccgactcatacatggagggtgcatccgaaagccagcaggggattgcggacggcttccaacagccggaggccattgagttcagtagcggcgagaaagaggacgacgaggtggagacagaccagaatataaggtatggcaggaagctgatagagcagggcaacgagaaagagactaagccaatcattagcaaaagtatggcaaaatatgactttaaatgcgatagattgtccgagatacccgaggagaaggaaggcgctgaagattctaaagggaatggtatcgaagagcaagaggtagaggccaatgaggaaaacgtgaaagtgcacggagggcgtaaagagaaaaccgaaatcctttcagacgacctcaccgataaggccgaagaccatgaatttagtaagaccgaggagctgaagctagaggatgtagatgaagaaattaatgccgagaacgtggaaagcaagaagaaaaccgtgggcgacgacgaaagcgtgccgacaggctatcattctaagaccgagggcgctgagcgaaccaatgacgacagctccgcggaaactatcgaaaagaaagagaaagccaatctcgaagagcgggccatctgtgagtacaacgagaaccctaaagggtacatgctcgacgatgctgactcttcttcactagaaatcttagaaaattccgagactacacccagtaaagacatgaaaaagacaaagaagatcttcttgttcaagagagtcccaagcataaatcaaaagattgtgaagaacaataacgagccgctgcccgagatcaaatcaattggcgatcagattatcctaaaaagcgataataaggatgctgaccagaaccacatgtcacagaatcaccaaaacataccccccacaaataccgaaaggcgctctaagtcttgcactatcctatag

SEQ ID NO: 132265 - DNA, 1941 bp, Artificial Sequence
  Description of Artificial Sequence: Synthetic coding sequence
atgcgagagccagaggaattgatgccagatagcggggcggtgtttacctttggtaaatcgaaatttgccgagaataaccccgggaagttttggtttaagaacgatgttcctgttcatttaagttgtggcgatgagcactccgccgtcgtgacaggcaataataagctgtacatgttcggtagtaacaattggggacagctcggactggggtctaagagtgcaatctctaagcccacatgtgtcaaggcgctgaaaccagagaaggttaaacttgccgcatgcgggagaaaccataccctcgtgtccacagaaggaggcaacgtctatgccacgggaggcaataacgaagggcaacttggtttgggagacactgaggaaagaaatacctttcatgtgatttcattctttacatctgaacacaaaattaagcagctgtccgctggctctaatacatccgcagctctgactgaggacggcagactgttcatgtggggagacaattctgagggccagattggcctgaaaaatgtcagtaacgtctgtgtgccacagcaggttactattggaaagcctgtctcctggatttcctgtggatactaccatagcgctttcgtgacaactgacggggaactctacgtcttcggtgagccagaaaatggcaagctgggtctcccaaatcagctcctgggcaaccaccgaacaccccagctggtgtccgaaattccagaaaaggtgatccaggtcgcatgcggaggcgagcataccgtagtgcttacggaaaacgcagtctataccttcggccttggtcagtttggacagttgggtctgggaacatttttatttgagacgtcagaaccaaaagttatagagaatattcgagaccaaaccatttcttatatatcatgcggtgaaaaccatacagcattgataacggatatcggattaatgtatactttcggtgatggacggcatggtaagcttggtctgggcttagagaattttaccaatcacttcatacccacgctttgctctaactttcttcggtttatcgtgaaacttgtggcatgtggcggatgccacatggtggtgtttgctgctccccatcgaggcgttgccaaggagatagaattcgatgagataaacgatacctgcttatccgtggcgacttttctgccttatagttccttgacctctggaaatgtgctccagagaactctcagcgctagaatgaggagacgggagcgcgagagaagccctgactcttttagtatgcgtcgcacgctcccccccatcgaggggaccctcggcctaagcgcctgctttttgcccaacagtgtatttcccaggtgctctgagcggaacctgcaggagagtgttctttccgagcaagacttaatgcagcctgaggaacctgactaccttttggatgagatgacgaaggaggccgaaatagacaactcctcgactgtggagagtctaggtgaaaccaccgatatcctgaacatgacacacatcatgtccctcaatagtaatgaaaaaagtctgaaattgtcccctgtccagaaacagaaaaagcagcaaaccatcggggagctcacccaggatacagcattgaccgaaaacgacgactcagatgaatacgaagagatgagcgaaatgaaggaaggcaaagcctgcaaacagcatgtatctcaaggcatcttcatgacacagccggccaccaccattgaagcgttctctgacgaagaggtggagatccctgaagagaaggaaggtgccgaagatagcaaaggcaatggaattgaagaacaagaggtcgaggcaaatgaagaaaacgtgaaggttcacggcggtcggaaggagaaaaccgagatccttagcgatgatctcaccgacaaagccgaatattccgcgagtcattcccagattgtatccgtgtag

SEQ ID NO: 132266 - DNA, 3459 bp, Artificial Sequence
  Description of Artificial Sequence: Synthetic coding sequence
atgcgcgagcctgaagagctaatgcctgattccggcgctgtatttacctttggaaaaagtaaattcgctgaaaataatccaggtaaattctggtttaaaaatgatgtgcctgtgcatctgtcatgcggagacgaacatagtgccgtagtaaccggcaacaacaaactctatatgttcggctctaataactggggccagctgggattggggtccaaatcagcgataagtaaacccacttgtgtgaaagctctgaagcccgagaaggtgaaactcgctgcttgcggacgcaatcatacacttgtgagcacagaaggagggaatgtgtatgcgaccggtggtaacaacgagggccagttgggcctaggggatacagaagagagaaacacatttcacgtcatctcatttttcacatccgagcacaagatcaagcagctttcagcagggagcaacacatccgctgccctaactgaggatggtcgtctgttcatgtggggggacaatagtgaaggacaaatcgggctgaagaacgtttctaacgtgtgcgtcccccagcaagtcactatcggaaagccagtatcatggatcagctgcggatactatcacagcgcatttgtgaccaccgacggggaactctatgtctttggcgagcccgaaaacggaaagctgggcctgcccaatcagctgctgggcaaccaccgcacaccacaactggtttccgagatacctgagaaggtcatccaggtcgcctgtggcggagaacacaccgtggtcttgacagaaaatgcagtgtatacctttgggttaggccaatttggtcagttgggacttggcacctttctgtttgaaacctcagagccaaaggtcattgagaatattcgcgatcagaccatttcctatatcagctgtggggaaaaccatacggcccttatcacagacatcggcctaatgtataccttcggagacggtcgacacgggaagctgggcttgggtctggaaaacttcaccaatcattttattcccaccttatgttctaattttctgagatttatagtgaagttggtggcatgcggagggtgccacatggtcgtcttcgcggcgccccatcgcggcgtggcaaaggagatcgagtttgacgagattaacgatacctgcctgtcagtggccacctttctcccgtactccagcttaaccagtggcaatgttctccagaggacgctaagtgctcggatgcgcagacgcgagagggagcgctcacccgattccttttctatgcgacggacactgcccccaattgagggaacccttggtctgagcgcctgcttcttgccgaattcggtttttcctaggtgttccgagaggaatctccaggagagcgtgctgagcgaacaggaccttatgcaacccgaagagcctgactacctgttagacgagatgaccaaggaggccgaaatcgacaactcctctacagtggagtcactaggggagaccaccgatatcttgaatatgacgcatattatgtctctgaactccaatgagaaatcactgaagctttcccctgtgcagaagcagaaaaagcaacagactatcggagaactgacacaggacaccgctttgaccgaaaacgatgactccgatgaatacgaagagatgagcgagatgaaagagggcaaagcctgcaagcaacatgtgtctcaggggatatttatgacccagccggccacaacaatagaggcattctctgacgaagaggtcgaaatccccgaggagaaggaaggggccgaagactctaaaggtaatggcatcgaagagcaggaagtggaagctaatgaagaaaacgtgaaagtgcacggcggaagaaaagaaaagaccgagatactgagtgacgaccttacagataaagcggaagtgtctgaagggaaggccaaaagtgtgggagaagctgaagatggacccgagggcagaggggatggcacctgcgaagagggctcctcaggagctgaacactggcaagacgaggagcgggaaaagggcgagaaagacaaagggcgcggcgagatggaaaggccaggcgaaggagaaaaggaactggcagagaaagaggaatggaaaaagcgcgacggagaagagcaggagcagaaggagagagagcaggggcaccagaaggagcgcaatcaagaaatggaggaaggtggcgaagaggaacacggtgaaggagaggaggaggaaggtgaccgggaggaggaagaggaaaaagaaggcgaagggaaggaagagggagaaggggaagaggtggagggggagcgggagaaggaggaaggcgagcggaagaaagaggagcgggcaggtaaggaagagaagggtgaagaagagggcgaccagggggagggcgaggaagaagagacagagggccgcggagaagagaaagaagagggcggtgaagtcgaagggggtgaagtcgaggaaggtaagggagagcgagaggaggaggaagaagagggcgagggggaggaggaggaaggcgagggagaagaggaagagggcgagggagaggaagaggaaggcgagggaaaaggcgaagaggaaggcgaagaaggcgaaggggaagaggaaggggaggagggagagggcgagggggaagaagaagagggcgagggcgagggcgaagaggaaggcgagggcgagggcgaagaggaggagggggagggagaaggagaagaagagggcgagggggaaggtgaagaggaggagggcgagggaaagggagaggaagaaggagaggaaggcgagggcgagggagaggaggaggagggggagggtgagggcgaagacggtgagggcgagggagaagaggaggagggagagtgggaaggagaggaggaggagggagagggcgagggtgaggaggaaggtgagggagaaggggaggagggggaaggagagggcgaggaagaggagggcgagggggagggagaggaagaggaaggagaagaggaaggcgaagaagagggcgagggggaggaggaaggggagggggagggtgaggaggaagaggagggcgaggtcgaaggtgaagtggagggtgaggaaggcgagggcgagggcgaagaagaagaaggcgaggaggagggagaggaacgcgagaaagaaggagaaggagaggagaataggcgcaaccgggaagaggaggaggaagaagaaggtaagtaccaggagacgggagaagaggagaacgagagacaggatggagaggaatacaaaaaagtgtcaaaaattaagggctctgttaagtacggcaagcacaagacatatcagaaaaaaagtgtgaccaacactcagggaaatgggaaggagcagaggagtaaaatgcccgttcagtcaaagcgactcttgaaaaacgggccatcaggctcaaagaaattctggaacaatgtacttccacattacctagagttaaagtag

SEQ ID NO: 132267 - DNA, 2121 bp, Artificial Sequence
  Description of Artificial Sequence: Synthetic coding sequence
atgaacgagagcaaaccaggtgattctcagaacttggcatgcgttttctgcaggaaacacgatgattgcccgaacaagtacggggagaagaaaaccaaggagaaatggaacctaaccgtccactactactgccttctgatgagtagcggcatatggcagcggggcaaagaggaagagggcgtgtatggcttccttatcgaggacatccggaaggaggtgaatcgcgctagtaaattgaagtgctgcgtctgtaagaagaacggcgcttcaatcggatgcgttgcgccccgatgcaaaagaagctaccactttccctgtgggttgcaacgcgaatgcatcttccaattcaccggaaattttgcttccttttgttgggatcatagacccgtccagataattacaagtaacaattaccgggagtccctcccctgtactatatgtctggagttcatagaaccaattcctagttacaacattctaagaagcccctgttgtaaaaatgcgtggtttcacagagactgcctgcaggtacaggctataaatgccggcgtttttttcttcagatgcactatttgcaacaattctgatattttccaaaaggaaatgctgcggatgggtatacacatacccgaaaaggacgcctcctgggagctggaggagaacgcataccaagagctcctgcagcattatgagcgttgtgatgttaggcgttgccgctgcaaagagggccgtgattacaacgctcccgatagtaagtgggagatcaagaggtgccagtgttgcggctcctctggtacacatctcgcatgttcatctcttcgttcctgggaacaaaattgggaatgtcttgagtgtcgcgggatcatttataatagcggcgaatttcagaaggctaaaaagcacgtgctgcccaatagcaataatgtcggcatcacggactgccttttagaggagtccagtccgaagctgccacggcagagtcccgggagccagtctaaggatttgctgagacaagggtccaaattccggaggaatgtatctaccctgctcatcgagctcggcttccaaatcaagaaaaaaactaaaaggttgtacatcaacaaagccaatatttggaattctgctctggatgcatttcgtaaccgaaacttcaacccgagctacgctatcgaagtggcatacgtgattgaaaacgataactttggcagtgagcaccctgggagcaaacaggagttcctgtcccttctgatgcagcacctagaaaatagctcattattcgagggctctctgagtaaaaatctttctctaaacagtcaggctctcaaggaaaatctgtattacgaggcaggaaaaatgttagcaatctccctcgtgcacgggggtcccagtcctggattctttagcaaaaccctctttaattgcctagtgtatggcccagaaaacacccagcctatcctggatgatgtgagtgactttgatgtagcccagattattattagaatcaacactgctacaactgtggccgacttaaagagcatcatcaatgaatgctacaactatctggagctgattggctgtctgaggttgatcacaactctcagcgacaagtacatgctggtcaaagacatcctgggataccacgttatccagagagtgcacacacctttcgaatctttcaaacaagggctgaagacactcggggtgcttgagaagatccaggcctaccctgaggcattttgctctattctgtgtcataagcctgagagcttatctgcgaaaattttgagcgaactgttcacagtccacactttacctgatgtgaaagcccttgggttttggaacagttatctgcaggccgttgaagatgggaaatccactaccactatggaagacatcttaatcttcgcgacgggatgctcaagcattcctcccgccggtttcaaaccgactccttccatagagtgtctgcatgtggatttccctgttgggaataaatgtaataactgccttgcaatccctataacgaacacatataaggagttccaggaaaatatggatttcacgatacgcaacaccttgagactcgagaaggaggagagcagtcactacataggccattag

SEQ ID NO: 132268 - DNA, 1938 bp, Artificial Sequence
  Description of Artificial Sequence: Synthetic coding sequence
atgctgctcatggcacctgatcgctgtcgatacgtgtggaaacattgtcagcctatggagatgaggattaagtggattttcctctgttgtatacgtccactctacgattttacatctcagtatgtcatggaaacagactctctgttcctccactacctacaggaggcctctgccagactggacatacaccaggccatggccagcgaacacagcaccctcgccgccggctggatctgtttcgatcgtgttctagagacagtcgagaaagtacatggactggcaactctgattggtgcaggtggtgaggaattcggtgtgcttgagtactggatgcgacttaggtttccgattaagccctctcttcaagcttgcaataaacggaagaaagcacaggtgtacttgagcactgacgtgttaggcgggaggaaggcacaggaggaggaatttcgttctgagtcctgggagcctcagaacgagctgtggattgagataactaagtgttgtggccttcgtagcagatggctggggacgcagccatcaccttatgccgtatatcgattctttacgtttagcgaccatgatactgctattatacccgcttccaacaacccatatttcagggatcaggctcgctttcctgtcctcgtgacatccgacctggaccactatctgcggagagaggctctatccattcatgttttcgatgatgaggatcttgagcccggctcctacctcggccgagcgcgcgttccactcttgcccctggcaaaaaatgaaagcatcaaaggtgattttaacttgactgatccggcagagaaaccaaacggttcaattcaggtacagctggattggaagtttccttatataccccccgagtctttcctgaagcctgaggcgcagaccaaaggaaaggacactaaggactcatccaaaatctctagtgaagaggagaaagcctcttttccctcccaagatcagatggcctcaccggaggtgcccattgaagcaggtcagtatcggtccaaacgtaagccgcctcatgggggagaaaggaaggaaaaagagcaccaggtagttagctattcgcgaagaaagcacgggaaaagaataggtgtgcagggcaaaaatcggatggagtatctgagtttgaacattctgaatggcaatacaccagagcaggtgaactatacagaatggaagttttccgaaactaacagttttattggcgacggcttcaaaaatcagcatgaggaagaggagatgactttatctcactccgccctgaagcagaaggaaccactgcaccccgtaaatgacaaggagtcctctgagcaggggtccgaggtgagtgaggcacaaaccactgatagcgacgacgtgatcgtgccacctatgtctcagaagtatcccaaggctgattcggaaaagatgtgtattgagattgtttctttagccttctatccagaggcagaagttatgagtgacgagaatattaaacaggtttatgtcgagtataagttctacgacctgcctctgtccgaaaccgaaactcctgttagcctgaggaaaccacgggcaggggaggagattcatttccatttttccaaggtcattgatctggacccccaagagcagcagggtcgcagacgtttcctgtttgacatgttaaacggacaggatcccgatcaaggacatctgaagttcaccgtggttagcgacccccttgatgaggagaagaaagagtgtgaagaagtgggctatgcctacttgcaactttggcagattctggaaagcggacgtgatattctggagcaggagctggacatcgtctcgccagaagatctagctactccaattggcaggctgaaagtgtctttgcaggccgctgccgtgctgcacgctatttataaagagatgaccgaagacttgttttcttag

SEQ ID NO: 132269 - DNA, 1839 bp, Artificial Sequence
  Description of Artificial Sequence: Synthetic coding sequence
atgttaaagctggataacaaagacgtgatcagccatcctctgggatacccttcagagtccttgctatccattgccagtatgctggattctagcgactcatcgtctcaacctcactggtcaaacgagctgatagctgaacagcttcagcagcaagtctctcagctgcaagatcagctggatgccgaactcgaagataagcgcaaagtactactcgaactttctagggaaaaagcccagaatgaggatctcaagctggaagtcaccaacattctgcaaaagcacaagcaagaggtagagctgctgcagaacgctgccactatctctcagcctccagataggcagtctgagcctgcaacccatcctgcagtgttacaggagaatactcagattgagccctcggagccgaagaatcaggaggagaaaaagttgtcgcaggtccttaatgaactgcaggtgtcccacgctgagacgaccttggagttagagaaaacgcgtgacatgctgattctgcagaggaaaatcaacgtgtgttaccaagaggaactagaagctatgatgactaaggcggataacgacaacagggatcataaagagaaactggaacggctgacgcgcctgctggatctgaagaacaatcggatcaaacagttggaaggcattcttcgatcacacgacctgcccacgagcggcgattttaatcttacggatccggccgagaaacctaatggaagtattcaggtccagctggactggaagtttccctatattccaccagagtccttcctgaagcccgaagctcaaacaaaagggaaagacactaaagattctagtaagattagtagtgaagaggagaaagctagttttcctagccaagaccagatggcctctcctgaggtccccatcgaagccggtcagtaccgtagcaagcgaaaacccccccacggaggtgaaaggaaagagaaggaacatcaggttgtcagttattcccggcgaaaacatgggaaacggataggcgtgcaaggcaaaaatcggatggaatatctgtctttgaacatcctgaacgggaacacccctgagcaggtgaattatacggagtggaagttctctgagaccaactcctttataggagatggcttcaaaaatcagcatgaagaagaagaaatgaccctcagtcactctgcccttaaacaaaaagagcctctccaccctgttaacgacaaggagtcctcagagcagggttcagaggtgagcgaagcccagacaactgacagcgatgacgtaatcgtgccacctatgtcccagaaatacccaaaggccgatagtgagaagatgtgtattgagatcgttagtctggcgttttatcctgaggccgaggttatgtcggatgagaacatcaagcaagtgtatgttgagtacaagttctacgacctgccattgagtgagactgaaacacctgtgagcctgcgaaaacctcgcgctggtgaagaaattcattttcacttttcaaaggtgattgacctggatccacaggagcagcagggacggaggaggtttctgtttgacatgctgaacggccaggatcccgatcagggacacctgaagtttactgttgtgtcggatccactggatgaagaaaaaaaggaatgtgaggaggttggctatgcttacctgcagctgtggcagattctggaaagcggcagggacatccttgaacaggagctggacatcgtgtccccagaggatcttgctactcctatcgggaggctcaaggtgtcccttcaggcagccgccgtattacacgccatctataaggaaatgactgaagatctgttttcatag

SEQ ID NO: 132270 - DNA, 3861 bp, Artificial Sequence
  Description of Artificial Sequence: Synthetic coding sequence
atgagtcatctggtcgaccccacgagcggcgatctccctgtgcgggatattgacgcgattcctctggtgttgccagcatcaaagggtaaaaacatgaagactcagccacccctgagtcgcatgaacagagaggagctggaggatagcttcttccgcttacgggaagatcatatgctggtgaaggaacttagctggaaacaacaggacgaaattaagagactgagaaccacgctgctaaggctgactgctgcaggcagggacctgagggtggctgaagaggctgctcctctgtccgagaccgctaggagaggccagaaggctgggtggagacagcgactgtccatgcaccagcgccctcagatgcatcggctccagggccactttcactgcgtaggtccagccagtccacggcgagcccagcctagggtccaggtcggacatagacaactgcacaccgccggcgctcctgtgcccgagaagccaaagcggggcccacgagaccggctgtcttataccgctccaccctctttcaaggagcacgccactaacgagaatcgtggcgaagttgccagtaaaccttccgagttggtgagcggctccaactccataatctccttctcgtcagtcatctcgatggctaagcctataggattatgtatgccaaatagtgctcacatcatggcctctaacacaatgcaagtggaggagccgccaaagtctccagagaagatgtggcctaaggatgagaattttgaacagcgaagcagtctcgagtgcgcacagaaggctgccgaactacgcgcatcaataaaggaaaaagtggagctgatcaggctaaaaaaactactgcatgagcgcaatgcctccctggtcatgaccaaggctcagctgactgaagttcaggaagcctatgaaacactgttgcaaaagaatcaggggattctgtccgcagctcatgaagcattactcaaacaggtcaacgagctacgggccgagctgaaggaggaaagcaagaaggctgtttctctgaaatcccagttagaagacgtttctatcctccagatgacactaaaagagttccaagagcgcgttgaagacctggagaaggagcgaaagcttctgaatgacaactacgataagttgctcgaatcgatgcttgacagcagtgatagctcctcgcagccacactggtcgaacgagctgatcgctgagcaacttcagcagcaggtctcacagctgcaggatcagctggatgccgaattggaggacaaacgtaaggttttgcttgaacttagtagggagaaggcacagaatgaggacctaaaattagaggtgaccaatatactgcagaagcataagcaggaggttgagctcttacaaaacgctgccacaatttcacaaccaccagacaggcagtcagaacctgcaacacaccccgccgtgctgcaggaaaacacccagatagaaccgtctgagcctaagaaccaagaagaaaagaaactgtcccaggtgttgaacgagttgcaggtctcccacgctgaaacgaccctagaactggagaaaacccgcgacatgctgattctacagcggaaaatcaacgtctgttaccaggaagaactagaagctatgatgactaaagctgataatgacaacagggatcacaaggagaagttggaacgcctcaccagactgctagacctcaagaacaaccgcatcaagcagttggaagggatccttcgatcccatgatctgcccacttctgagcagctcaaagatgtggcctacggcacacggcccttgagcctctgtttggaaacgcttccggcccacggggacgaggataaagtcgatatctctctgctgcaccaaggtgaaaatctgtttgagctgcatattcatcaagcattcttgacctcagccgccctggcccaagccggcgacactcagccaacaaccttctgtacatattccttttatgactttgaaacgcattgcacacctctgtcggtgggccctcaacccctgtacgacttcacatcacagtacgtgatggaaacagatagcctttttcttcattacctccaggaggcatcagcccggcttgatatacatcaggctatggccagtgagcacagcaccttggcggccgggtggatctgttttgatcgagttctcgagacggttgagaaagtacacggtttagccacactgattggcgcagggggagaggagttcggcgtgctggaatactggatgcgactgcgatttcctattaagccctccctccaagcctgtaacaagaggaaaaaagcccaggtatacctatcaacagatgtcctgggggggaggaaggctcaggaggaggaattcaggagcgaatcgtgggagccccaaaacgagctctggatcgaaatcactaaatgctgtgggctgagatcccgttggctggggacccaaccgtctccctacgccgtgtatcggtttttcacttttagcgatcatgacacagccatcattcccgcctctaacaacccttattttcgggaccaggccagatttcccgtccttgttactagcgacctcgaccattacctgaggagggaggcgctgagcatccatgtgtttgacgacgaagacttggagcctggctcatatttaggcagggcaagggtgccattgctccccttggccaaaaacgagagtataaagggagattttaacctgacagatcccgcggaaaagcccaatggtagcatccaggttcagcttgactggaagtttccttacataccaccagaatcgttcctgaagcccgaggcacaaacaaaaggtaaagataccaaagatagcagtaagatctcctctgaagaggaaaaggccagttttccctcccaagaccagatggcatcacccgaggtcccaatcgaggccgggcagtaccggtctaaaaggaaacctccacacgggggtgagcgtaaagagaaggaacatcaggtagtctcatactctcgccgcaaacacggtaagaggattggcgttcaggggaaaaatagaatggagtatctgtcacttaatatcctgaacggtaatacccctgaacaagtcaattacaccgaatggaaattcagcgaaaccaacagcttcattggggatgggtttaagaatcagcacgaagaagaggaaatgactctctcccatagtgctctcaaacagaaagaacccctgcacccggtaaatgataaggagtcctctgaacagggaagcgaagtgagcgaggcccaaaccactgatagcgatgacgtgatcgtccctcccatgagtcagaaatacccaaaagccgattctgaaaagatgtgcatagaaatcgttagtctcgcgttctatccagaggccgaggtcatgtcagatgaaaacattaagcaggtttatgtggagtacaagttctacgatttgcctctctctgagaccgagacgcccgtgagcctgcgtaaaccaagggctggggaagagatccatttccacttctctaaggtgattgacttagatccacaggagcagcagggcaggcgtcgtttccttttcgacatgctgaatggtcaggatcccgatcaaggtcacctgaagttcaccgtggtcagcgacccactggacgaagagaaaaaggagtgcgaagaagtgggttacgcctacctgcaactttggcagattctggagagcggcagagacattctggaacaggaactggatatagtgtctccagaggatctggctacccctattggtcgcctgaaggtgagtttacaggcggctgccgtgctccatgcaatttataaagagatgaccgaggatctgttctcttag

SEQ ID NO: 132271 - DNA, 1617 bp, Artificial Sequence
  Description of Artificial Sequence: Synthetic coding sequence
atgaacctggaattgttggagtcatttggccaaaattatcctgaggaagctgatggcaccctggactgcatctcaatggccctgacatgcaccttcaacaggtggggcacccttctagctgtgggatgtaatgacgggcgcatcgtgatctgggactttcttactaggggaatcgcaaaaatcattagcgcccatattcatccggtttgtagcctctgttggagtagggatggccataaactggtttcagcctctaccgacaacatcgtatcccagtgggacgtgctctcaggcgattgcgaccagcgattccgctttccatcgccaattcttaaggtgcaatatcacccgagggatcagaataaggtccttgtctgcccgatgaaaagtgcccccgtgatgttgacactgagtgactctaaacatgtggtgctcccggtcgatgatgatagcgatcttaacgttgtggcctcctttgatagaagaggggagtatatatacacaggaaatgctaaaggtaagatcctggtccttaagacagattcccaagatttagtggcttccttcagggtgacgactggaaccagtaacaccacagccatcaaatcgatcgagtttgcccggaaaggctcatgtttcctgataaatactgccgaccgcatcattcgggtgtacgatgggcgtgagatcttgacgtgcgggcgggatggtgagccagagcctatgcaaaaactgcaggacctggttaacaggacaccttggaaaaagtgctgtttctcaggcgacggggaatacatagttgcagggtcagcacggcagcatgccctttacatctgggaaaagtcaattggtaacctcgtgaaaatcctccatggtactcggggagagttactgctcgatgtggcatggcatcccgtaaggccaatcattgctagtatttccagcggagtcgtctcaatttgggcacaaaatcaagttgaaaactggtccgcatttgcaccagatttcaaagagctggacgaaaatgtggagtacgaggagcgtgagtccgagtttgacatcgaggacgaagataaaagtgagccagagcaaaccggcgcagacgccgccgaggacgaggaggtggacgtcactagcgtcgaccctattgcagcattttgttcaagtgatgaagaattggaggattccaaggcgctcctgtacctgcctattgcccccgaggtggaggatcctgaggagaatccctatggaccacctccggatgccgtccaaacctccttgatggatgaaggtgcttcatccgaaaaaaaacgccagtccagcgctgatgggtcccagccacctaaaaagaagcccaaaacaacaaatattgaactacagggcgtgcctaatgatgaagtgcatccactgttgggcgtgaagggcgacggcaaatcaaagaagaaacaggctggcaggcctaagggctcaaaagggaaggaaaaggattctccattcaaacccaagctgtataagggggatcggggactgccccttgagggatccgcgaaggggaaggtgcaggcggagctcagtcagcctttgactgcaggtggcgccatctctgagcttctgtag

SEQ ID NO: 132272 - DNA, 1503 bp, Artificial Sequence
  Description of Artificial Sequence: Synthetic coding sequence
atgaatctggagcttctggaatccttcggacagaattaccctgaggaagctgacggaacgcttgattgcatttcaatggccctgacctgcacctttaaccgttggggcacgttactagcggtgggctgtaacgatgggagaattgtgatttgggatttccttactagaggtatcgctaagatcatttccgcacacattcaccctgtgtgttcgttgtgctggtcccgcgacggtcataagctggtcagcgcaagtactgacaacatagtctcccagtgggatgtgctgtccggagattgtgatcaaagattcaggttccccagccctattttaaaagtgcaataccatccgagagatcagaataaggtgctggtgtgcccaatgaagtccgcacccgttatgctcaccctgtctgactccaaacacgtcgtattacctgtagacgatgatagtgatctgaacgtcgtggcctcattcgaccggcggggggaatatatttatacaggcaacgcaaagggaaagatcctcgtattgaagactgatagccaagatctggtggctagcttcagagtgactactggaacatcaaatactacagccattaaaagcatcgagttcgctagaaagggtagctgcttccttattaatacagccgatagaatcatccgggtgtacgatggccgtgagatcctcacatgcgggcgggacggggagcctgaacctatgcaaaaactccaggacctagttaatcggacaccttggaagaagtgctgcttcagtggggatggcgagtacatcgtcgcagggagcgcaagacagcacgccctgtacatttgggagaagagcatcggaaacttagtgaagatcctacacggaacacgcggggagctgctgttggacgtggcctggcaccctgtccgcccaattatcgcgagcatttctagcggcgtggtcagcatctgggcccagaatcaagtggagaattggtccgctttcgcacctgactttaaggaacttgacgagaatgttgaatacgaagagagggagtccgagtttgatattgaggatgaggacaagagcgagcccgagcaaactggcgccgatgccgccgaagacgaggaggtggacgtcacctcagtagatccaatcgctgctttctgtagctcagatgaggagcttgaggactccaaggccctgctctacctgccgatcgctcctgaggtggaagaccctgaggagaacccttatggtccgccaccagatgccgtccagacctcactcatggatgaaggagccagtagcgaaaagaagcggcagagttcggccgatgggagccagcctccaaaaaaaaagcctaagaccaccaacattgagctgcaaggtgtgccaaatgatgaggtccatccactccttggggttaaaggtgatggaaagtcgaagaaaaagcaggcagggcgccctaagggaagcaaggcaggaggtgccattagcgagcttctctag

SEQ ID NO: 132273 - DNA, 5379 bp, Artificial Sequence
  Description of Artificial Sequence: Synthetic coding sequence
atgtcctgtgtacactacaagtttagctccaagctcaattacgacacagtgaccttcgatggcttgcatatcagcctttgtgatctgaagaaacaaatcatgggccgggagaagctgaaggccgctgattgtgatctacaaatcacaaatgcgcagactaaagaggaatacaccgacgacaatgcactgatacccaagaattcaagcgtgatcgtgaggcggattcccattggcggggtcaaaagtacgtctaagacatacgtgatttcaagaactgagccagctatggcaaccactaaagcaatcgacgatagctcagcctcgatctcactggcacagcttactaagacagctaacctagccgaggcaaatgcctccgaggaggataagattaaggccatgatgtctcaatccggccacgagtatgaccctattaattacatgaagaagccactggggccgcctccccctagctacacatgctttcgttgtggcaagcctggtcactatattaagaattgtcccacgaatggggacaaaaatttcgaaagcggacctcgtatcaagaagagcactgggatacccaggtcatttatgatggaggtgaaggatcccaacatgaagggtgctatgctcacaaacacaggaaagtacgctattcctactatcgatgcagaagcctacgctattggcaaaaaggagaagcctccttttctgcccgaggagccaagcagctctagtgaagaagacgaccccatacctgatgaactgctatgtctaatctgcaaggatataatgactgacgccgtcgtcatcccctgctgtggaaacagctattgtgatgagtgcatccgcacagccctgctagagtccgacgagcacacatgcccaacctgccatcagaatgacgtgagtcccgacgccttaattgccaacaaatttttgcgccaggcagtgaataacttcaagaatgaaactggttacacgaaaaggttacggaagcagttgccccctcctccgccccctatccctccgccgcgcccacttatccagcgaaacctgcagccactgatgcgcagtccaatctcacgccaacaggatcccttgatgatcccggtgactagcagtagtacgcacccagccccatctataagttccctcacttccaaccaatcttcactggcgcccccagtttcaggtaatccttcatctgcacctgcgcctgtgcccgacatcaccgctacagtcagtatctccgtgcactcagagaagtctgatggccccttcagagactcagacaacaaaattctaccggcagctgcactggcctcagaacattctaaaggaacgtcctctattgccatcaccgctctgatggaggagaagggataccaagtgccagtactgggtactccatcccttttgggtcagagcctattgcatggccagctaattccaacgacagggcctgtacgaataaatactgctagacctggaggaggcaggccagggtgggaacattccaataaactgggctatttggtctctcctcctcagcagatacgccgcggtgaacggagctgctacaggagcattaatagaggccggcaccattcagaacggtcacagaggactcagggcccttctcttcccgccacacccgtcttcgttccagtcccccccccaccgctgtatcccccgcctcctcatactttaccacttccacctggcgtgccaccaccacagttctccccccaatttccaccaggccaaccacccccagctgggtactccgtgcctcccccagggtttccacccgctcctgctaacttaagcactccgtgggtgtcatccggagtgcagaccgcccactctaatacaattccaaccacacaggcccctcccctctccagagaagagttctacagagaacaacgcagactgaaagaagaagaaaagaagaagtccaagctggacgagtttactaatgatttcgctaaggagctcatggaatacaagaagatacaaaaggaacggaggcgctccttcagtagatccaagagcccctacagcggcagtagctactcccgcagctcatacacttactccaaatctaggagtgggtccacccgttcacggagttatagccggtcattcagtcgctcgcattctagatcctacagccggtctcctccttatccacgaaggggcagaggcaagagcagaaactacaggagtcgctctcgctcccacggttaccaccgttctcgctctagatccccaccttaccggcgttaccattcccgttcccggtctccccaagcctttcggggacaaagccccaataaaaggaacgtgcctcagggggagactgaacgggaatatttcaatcgatacagggaggtgcctcctccttacgacatgaaagcttattacggacgaagtgtcgattttcgggacccttttgagaaggagaggtatcgggaatgggaacgcaagtaccgggagtggtatgagaagtattataagggttatgccgctggagcccagccccgcccttcagccaaccgagaaaacttttcccccgaaagatttctgccactaaacattcgtaacagcccatttacccgtgggaggcgcgaggattacgtcggagggcagtcccatagatccagaaatatcgggagcaactatccagaaaaactttctgccagagatggacacaaccagaaagataacacgaagtccaaagaaaaagaaagcgagaatgcccccggagatggcaagggtaataagcacaagaagcaccgcaaacggcgtaagggcgaggagtctgagggatttctcaaccccgagctgctggagacctccagaaagtcacgggagcctactggtgtggaggaaaacaagactgactccttgtttgtcctaccatctcgggatgacgcaacccccgttcgcgatgagccaatggatgctgaatctattacctttaagagcgtctctgagaaagacaagcgagaaagggacaagccaaaggccaagggtgacaagaccaagcgtaaaaacgatgggtccgctgtctccaagaaagagaacatcgtgaagcccgccaagggaccccaagagaaggtggatggcgaacgcgaacgtagccccaggtccgagccaccaatcaaaaaagccaaggaggaaactccgaagaccgataacactaaatcaagctcttcttctcagaaggacgaaaagatcactgggacaccgcgtaaggcacactcaaagtccgccaaagagcatcaggagaccaaacccgtgaaagaggagaaagtgaaaaaagactactctaaggacgtgaagtctgaaaagctgacaacaaaggaggagaaagccaagaaaccaaacgagaagaacaagccgttggacaataaaggcgagaagagaaaacgcaaaacggaagagaagggagtggacaaagacttcgaaagcagtagcatgaagatcagtaagctggaggtgacagagatcgtaaagccctccccaaaacgcaagatggagccagatacagaaaaaatggacagaacccctgaaaaagacaagatctcattgtctgcacccgctaaaaaaatcaagcttaatagagagactggaaaaaaaattggcagcacggagaatatcagcaatacaaaagagccatcagaaaaactggaaagcacgagtagcaaggtgaagcaggagaaggtgaaaggtaaggttcgccgcaaagtaacagggactgagggcagtagttctaccttagtcgactacactagtacctcgtcaacgggggggtccccagtaaggaagtcagaagaaaagaccgataccaagcgaactgtgatcaagacaatggaggaatacaataacgacaatacagcacctgctgaagatgtgattattatgatccaggtgcctcaaagcaaatgggacaaggatgatttcgagagtgaagaggaggacgtcaagtctactcaaccgatctccagcgtcggtaagcccgccagcgtgatcaaaaacgtaagcacaaagccttcgaacatagttaagtacccagaaaaggaatcagagcccagcgagaagattcagaaattcaccaaggacgtgagccacgaaatcatccagcacgaggtgaaaagttccaagaattccgcctcttcggagaaaggtaaaaccaaagatagagactacagcgtcctggagaaggagaacccggaaaagagaaaaaacagcacacaacctgaaaaagagagtaatctcgaccggcttaacgaacaaggaaactttaagtctctgagtcagagctccaaagaagccagaaccagtgataagcatgacagtacacgggcctcctctaacaaagacttcactccaaacagggacaagaaaaccgattatgataccagagagtactcgtcatccaaaaggcgcgacgaaaagaatgagttgacccggcgcaaagattccccttcaagaaacaaggactcagctagtggccagaagaacaagccacgggaggaacgcgacctgcccaaaaaaggtaccggcgactctaagaagtctaactcatcaccatcaagggaccgaaagcctcacgaccataaagccacatacgacaccaagcggccaaacgaggaaaccaagtccgtggataaaaatccctgcaaggatagggagaagcacgtcctcgaagcacgtaacaacaaggagagtagcggcaacaagctcctctacattctgaatccccctgaaacgcaggttgagaaagagcaaatcactggccagattgacaagagcactgtcaaacctaaaccccagcttagtcacagctcccgtttgtcctcggacttgactcgagagacagacgaggcagcctttgaaccagattacaatgaatcagatagcgagagcaatgtcagtgtgaaggaggaggagtcctctgggaatatttctaaagaccttaaagataagattgtggagaaagctaaggaaagtctcgataccgccgcagtggttcaagtgggaatttcaagaaatcagtcacattcttctccctcagtgtcccctagccgctctcacagcccatcaggcagccagactaggtcacactcgtcttctgcatccagcgccgaatcacaggactcaaagaagaagaaaaagaagaaggagaaaaagaaacataagaagcataaaaagcacaaaaagcacaagaagcacgcagggactgaggttgaactggaaaagtctcagaaacataaacataaaaaaaagaagtctaagaagaataaggataaagaaaaggagaaggagaaagatgaccagaaagtgaaaagtgtcacggtgtag

SEQ ID NO: 132274 - DNA, 5277 bp, Artificial Sequence
  Description of Artificial Sequence: Synthetic coding sequence
atgagctgcgtccattacaagttcagctccaaacttaattacgataccgttactttcgatggtctgcatatatccctttgcgatctcaagaagcagatcatgggaagagagaagctcaaggcagccgattgcgatctgcagatcaccaatgcccagactaaagaagagtacacagatgacaatgctcttatccccaagaatagctctgtgatcgtgaggcgcattccaataggcggggtcaaatctacgtccaaaacttatgttatttcccgcacagaacctgcaatggctaccactaaggccattgacgattcatccgcctcaatctccctggcccagctgactaaaacggccaatttggccgaggccaacgccagtgaggaagacaagatcaaggccatgatgtcccagagtggacacgaatacgatccaatcaactacatgaaaaagcccctggggcctcccccgccttcctatacatgctttcgctgcgggaaacccggtcactacatcaaaaattgcccaactaatggcgataagaactttgaatcaggcccaaggatcaaaaagtctaccggcatacccagatccttcatgatggaggtgaaggatcccaacatgaaaggtgcgatgcttactaacaccggcaagtacgccattcccacaatcgatgccgaggcttacgcaatagggaagaaagaaaaacctcctttccttcccgaagagccgtcctcaagctccgaggaagacgatcccataccagatgagctgctttgtttaatttgtaaggatataatgaccgacgctgtagtgataccctgttgcggcaattcctactgcgacgaatgcatccgcactgctttactggaatctgacgaacacacgtgtccaacgtgccaccagaatgatgtgagccctgacgcgctcatcgctaacaaatttctgagacaggcagttaacaattttaaaaatgagacaggatataccaaaaggctccggaagcagctgcctccaccacctcccccgatcccgccccctagacccctgatccagagaaatctgcagcccctgatgcggagtccaataagtcggcagcaggacccacttatgattcctgtaacctcttcttctacccatcccgctccatcaataagcagccttactagcaatcagtcgtcattggcaccccctgtctccggtaatccaagctccgctccggcaccagttcctgacataacagccaccgtatcaatcagcgtgcatagcgagaaaagcgacggccccttccgagactctgataacaaaatcctgcccgccgccgccctggccagcgagcattctaagggcacatccagtatagccataaccgcactcatggaagaaaaagggtaccaggtcccggttctgggtaccccgtcactcttgggccagtcattactacacggacagctgatccctactaccgggccagtccgcattaataccgcccgtccaggagggggtcgaccagggtgggagcattccaataaactagggtacctggtgtctcccccacagcagataagaaggggagagcggagctgctaccggagcattaaccgtggccgtcaccactcagagagaagccagcggacccagggcccatctctgcctgctacccccgttttcgtgccagttcctccgccacctctgtaccctcctcctcctcatacccttccccttccacctggggtacctcctccacagttcagtccacagttcccccccggccaaccaccacctgccggctactccgttcccccccctgggtttccccctgccccagcaaacctaagcactccatgggtgtcatctggcgttcagaccgcccactctaatacaatacccaccacacaggctccaccactatctagggaggaattttatcgtgagcaacgtaggctcaaggaggaaagcaagtccccatactcgggaagtagctactcacggtctagttacacttacagcaagtctagatcaggaagcacaagatcacggtcctattcacggtcattctccaggagtcatagccgaagctactcccggtcacctccttacccccggagggggcgcgggaagtctcggaattatagatccagaagcaggtctcacgggtatcacagaagtagaagtcgatcccctccatacagaaggtatcacagccgtagccggagcccacaagccttccgcggccaaagccccaacaagcgcaatgtgccacagggcgaaaccgagcgagagtatttcaatagataccgcgaagtgcctcccccttatgacatgaaggcttattatggtcgaagcgtcgactttagggacccattcgaaaaggagcggtacagagagtgggagaggaaatacagagagtggtatgagaaatactataaaggctatgcagccggggctcagccaaggccatcagccaatagggaaaacttctccccggagagattcttgccactgaacatcaggaactccccttttacaaggggacgtagagaagactacgtgggaggccagtctcatcgctctcggaacattggatcgaactatccagaaaagcttagtgccagagacggccacaaccaaaaagacaacactaagagcaaggaaaaggagtccgagaatgcccccggggacggtaaagggaacaagcataagaagcatcgaaagaggaggaagggggaggagtccgaaggatttctgaatcctgagctgctggaaacttctcgcaagtcacgggagccaaccggagtggaagaaaataagacagatagtcttttcgtgttgccaagtagagacgacgctacgccggtgcgcgacgaaccaatggatgccgaatctataacattcaaaagcgtatccgagaaggataagcgagaacgcgacaagcccaaggccaaaggagataaaactaagcgcaagaatgacgggagtgccgtcagtaaaaaggaaaacattgtcaaacccgctaaagggccacaagagaaggtggacggcgagcgggaaaggtcccccagaagcgaaccaccaattaagaaagccaaggaagagacaccaaagactgataacaccaaaagtagcagtagcagtcaaaaggacgaaaagatcacgggtacccctcgcaaagctcattctaagtctgctaaggagcaccaggagactaaaccggttaaggaggaaaaagttaaaaaagactactctaaagacgtcaagtccgagaaactgaccacgaaggaggagaaggcaaaaaaaccaaacgagaagaacaagcccctcgataacaagggcgagaagcgcaagcgcaaaactgaggaaaaaggcgtagataaagactttgagagctcaagcatgaaaatctccaagcttgaagtgactgaaatcgtgaaaccgtccccaaaaaggaagatggagccagatactgagaaaatggatagaacccctgagaaagataagatcagcctgagcgccccggcgaaaaaaattaagctgaatcgcgagacaggcaagaagatcgggagtactgaaaacatatctaacacaaaagagccttcggaaaaactagagtcaaccagctccaaagtaaaacaagaaaaagtgaaaggtaaggtgaggcgcaaagttaccggcaccgaaggttccagtagcaccttggtggactacacctctacaagctctacaggaggaagccccgtgcggaagtctgaggaaaaaacagacaccaagcgcacagtgattaagaccatggaagaatacaataatgacaatacggcccccgccgaggacgtaatcattatgatccaggtgccacagagtaagtgggacaaggacgatttcgagtccgaggaagaggatgtgaaaagcacacaaccaataagctcagtgggtaaaccagcgagcgtcattaagaacgtcagcactaagccttccaacatcgtcaaataccccgagaaggaaagcgagcccagcgagaagatacagaagtttactaaggatgtatcacacgagatcatacaacacgaggtaaagtcttcaaaaaacagcgcttcctcagagaagggcaagacgaaggacagggactactcagtgctcgagaaagaaaatcccgagaaaaggaagaattccacgcagcccgagaaggagtcaaacctggaccgattaaacgaacagggtaactttaagagcctctcccagagttctaaagaagctagaacatccgataagcatgatagtacccgggctagctccaacaaggactttacgcctaatcgagataaaaagactgattacgacactcgagaatactcttctagcaaacgccgcgatgaaaagaatgagctgacacgacgaaaggactcgcccagtaggaacaaggatagtgcctctgggcagaaaaacaaaccaagagaggagagagatctccctaagaaaggcacaggcgattctaagaaatctaactcctcgccgtcacgggaccggaagccccacgatcataaggctacatacgataccaaacgcccaaatgaggagaccaagtccgtagacaaaaacccatgtaaagatagggagaaacacgtgctggaggccagaaataacaaggagtcctcaggcaataagctgctttacatcctgaatccccctgaaacccaggttgaaaaggagcaaatcaccggtcagatcgacaaatccacagtgaaacccaagccccagctttctcattctagcagacttagtagtgacctcactagagaaaccgatgaggcggcatttgagcctgactacaatgagtctgacagcgaaagcaacgtctcagtgaaagaggaagaatcttcgggtaacatttctaaagacctcaaggataaaatcgtcgaaaaggccaaagaatccctggacaccgccgccgtggtgcaggtgggtatctccagaaatcaatcgcatagttccccatcagtgagcccctcaaggtcacattccccaagcgggtcacaaacaagaagtcacagctccagcgcgtcgagcgccgagtcacaggacagtaagaagaaaaagaaaaagaaggagaaaaagaaacacaaaaaacataaaaagcataaaaagcataagaaacacgccgggaccgaggtcgagcttgagaaatcacagaaacataagcataagaagaaaaaatctaagaagaacaaggacaaggagaaggagaaggaaaaggatgaccagaaagtaaaatccgttaccgtgtag

SEQ ID NO: 132275 - DNA, 2859 bp, Artificial Sequence
  Description of Artificial Sequence: Synthetic coding sequence
atgtcctgtgttcattataagtttagttcaaagctgaattatgatactgttacattcgatggactacacataagcctatgcgatttaaagaagcaaatcatgggccgtgagaagttgaaggcggccgactgcgacctgcagattactaatgcacagaccaaggaagaatacacagatgataacgctctgatcccaaaaaattcgagtgtcatcgtcagaagaattcccattggaggagtgaaaagcacctcaaaaacttatgtgataagtcgtacagagccagcaatggccacgaccaaagctattgacgacagctcagccagcatttccctggcccagctgacaaaaaccgctaatcttgcagaggcaaacgccagtgaggaagacaaaatcaaagccatgatgagccaaagcggacacgaatacgatcctataaattacatgaagaagccacttggacctcctccaccttcctatacttgcttccggtgcgggaagccgggccattatattaaaaactgccccactaacggagataagaacttcgaatcaggtccccggatcaagaagtcaaccggaattccccgttctttcatgatggaggttaaggaccccaacatgaagggggccatgctgacaaacacgggaaaatacgcgattcccacaatcgatgcagaggcctatgcaatcggcaagaaagaaaaacctccctttctacccgaagaaccctctagtagtagcgaagaagatgatccaattcctgatgagctgctatgcttaatctgcaaggatatcatgacagatgccgtcgtgattccgtgctgtggtaacagttattgtgatgagtgcattcgcacggccctgcttgagtcagacgagcacacttgccctacgtgtcaccagaatgacgtctcccccgacgctttaatagcaaataagttcctgcgtcaagcagtgaacaattttaagaacgagaccggttacaccaagaggctacgaaagcagttgcctccaccacccccaccaattccccccccccgtccccttattcagcgaaatctgcaaccgctgatgagaagtcccatctccaggcagcaagaccccctcatgatcccagtaacttcctcttcaacacatccagccccctctatttcgagcctgacaagcaaccaatcttcactggccccaccagtgtctggaaaccctagctcggctcctgcccctgtacctgacatcactgccacagtctctattagtgtgcacagtgagaagagtgacggtccttttcgcaccagctctaccggcggcagccccgttcggaagagcgaagaaaagactgacaccaagcgaaccgttatcaagacaatggaagagtataacaacgataatacggcccctgcagaggatgtcatcatcatgattcaggtaccacagtccaaatgggataaggatgatttcgaatccgaggaagaggacgtgaagtccacccagcccatttcttccgtcggaaagccagccagtgtgatcaagaatgtgagcactaagcctagtaatatcgttaaataccccgaaaaagaaagcgaaccctcagaaaagattcaaaaattcacgaaagacgtgagtcatgagattatacagcatgaagttaagtccagcaaaaactctgcttcttccgaaaagggcaagacaaaagacagggactacagcgttctcgaaaaggaaaaccccgagaaacgcaaaaactccacccagcccgaaaaggagtccaatctggaccgcctgaacgagcaaggtaatttcaaatccttgtcacagtcctcgaaagaagcccggacgtctgacaagcacgattctacacgtgcatccagcaacaaagactttacaccaaaccgcgacaaaaaaaccgactacgatacaagggagtactcatcctcgaagcgccgggacgaaaagaatgaactgacccgtaggaaggattctccaagcagaaacaaggactccgcctcaggccagaagaacaagcctagagaggagcgggacctgccaaagaaggggactggcgacagtaaaaagtctaactcaagcccctcaagagatcggaaaccccacgaccacaaagccacctacgataccaaaagacccaacgaagagactaagtccgtggacaaaaatccctgtaaggatcgtgaaaagcatgtgctggaagctcggaataacaaggagagttcaggtaataagctgctctacatacttaatcccccagagacccaagtggaaaaggagcagatcacaggacagatcgataaatccaccgttaaacccaaacctcagctgagtcatagctctagactctcaagcgacctcacgagagagaccgatgaggctgccttcgagccggactacaatgagtccgactcagagtctaatgtttccgtgaaagaagaagagtctagtggtaatatctctaaggacctcaaggacaagattgtcgagaaagccaaggagtcactcgacacagcagcggtggttcaagtggggatttccaggaaccagtcccactcaagcccgtcggtttctccctcccgtagccattctcccagtggctctcagacacgctcccactcctcctcagccagcagcgccgaaagtcaggattcgaagaagaaaaaaaagaagaaggagaagaaaaagcacaaaaagcacaagaaacacaagaagcacaagaagcacgcggggactgaggtggagctcgaaaaatcccagaaacacaaacacaagaagaaaaagagcaagaagaataaggacaaggaaaaagaaaaagaaaaggatgaccaaaaagtcaagtcagtgaccgtctag

SEQ ID NO: 132276 - DNA, 357 bp, Artificial Sequence
  Description of Artificial Sequence: Synthetic coding sequence
atgtcatgcgttcattataagttcagtagtaaactgaactacgatactgtaactttcgacggacttcacatctcattatgtgatcttaaaaagcaaatcatggggcgggaaaagctgaaagcggcggactgtgatttacaaatcaccaacgcccaaaccaaggaagaatatacggatgacaatgctctgatcccaaagaacagtagcgtgattgtgcgtagaatccccattggcggcgtgaagtctaccagcaaaacttatgttatcagtcggacagagccagcaatggcaactaccaaagctgtgtgcaagaatacaatctcacacttcttttatactctcctcctgcccctctag

SEQ ID NO: 132277 - DNA, 1410 bp, Artificial Sequence
  Description of Artificial Sequence: Synthetic coding sequence
atggcagccgaagctggcgtagtgggggcgggggcatccccggatggggactggcgtgaccaggcttgtggcctgttgttacatgtgcacctgagcagtagactcgggagagcggctcctgtgcggaccggccggcaccttcgcactgttttcgaagacaccgtcgaagaacgggtcattaacgaggagtacaagatttggaagaagaatactcccttcctatatgacctagtgatgacccatgcactccagtggccaagtctcaccgttcaatggctgccagaggtaaccaagcctgagggcaaggattacgccttgcactggctggtgttgggtacccacacatcagatgagcagaaccacctcgtcgtggcgcgggtccatatccctaatgacgacgcacagttcgatgcaagccactgtgatagcgacaaaggcgaatttggtggcttcggaagcgttaccggtaagatagagtgcgagattaaaatcaaccacgagggcgaagtgaacagagcaagatatatgccccagaacccccatataatcgccaccaagacaccaagtagcgacgtcctggttttcgactatacaaagcacccagccaagccggacccgagtggagaatgtaaccccgacctgcgactccgtggacaccagaaagaaggttacggcctctcatggaacagcaacctcagtgggcatctccttagtgcatcagatgaccatactgtgtgtctgtgggatatcaatgctgggcctaaggaaggaaagatcgtggacgccaaagccatcttcacaggccactctgctgtggtcgaggacgtagcttggcatctgctgcacgaatcccttttcggtagcgtcgccgatgaccagaaacttatgatttgggatacccgatctaatacgacgtcaaaaccaagtcatctggtcgatgctcacactgctgaagttaactgcctctcgttcaacccctattccgagtttatcctggccacgggatcagctgacaagaccgtggccctttgggacttgaggaaccttaagctgaaactgcacactttcgagtcacataaggatgagatctttcaagttcattggtcccctcacaacgaaacaattctggcatcgtcaggcactgaccgtagactgaatgtttgggatctgtccaaaataggagaagaacagtcagctgaggatgccgaggacgggccccctgaacttcttttcatacacggggggcatacagctaagatctctgatttctcctggaatcctaatgagccgtgggtcatctgtagcgtctccgaagataacattatgcagatatggcagatggcagagaatatttacaatgatgaagaatccgatgtcactacctccgagctggagggacaggggagctag

SEQ ID NO: 132278 - DNA, 1278 bp, Artificial Sequence
  Description of Artificial Sequence: Synthetic coding sequence
atggcttctaaagagatgtttgaggacacagtcgaggaacgcgtcattaacgaagaatataagatttggaaaaaaaacacaccctttttgtatgatctggtcatgacacatgcactgcaatggccctcacttaccgtccagtggctgcctgaagtgacaaaacctgaaggcaaagactacgccctgcattggcttgtgttggggacacatacctctgatgagcagaaccatctcgtggtggctcgggtacatatacctaatgatgacgcacagtttgacgcatcacattgcgatagtgacaagggtgaatttggggggttcggctccgtcaccggaaaaattgagtgtgaaattaagataaaccacgaaggcgaggttaaccgcgccaggtacatgccccagaatccccatatcatcgcaacaaaaacccctagctccgatgtgctagtttttgattacacaaaacaccctgcgaaaccagacccaagtggcgaatgcaaccctgacttgagattgaggggtcatcaaaaagaaggctacggcttatcctggaactctaacctgtccggtcatctgctcagcgcaagcgatgatcataccgtgtgtttatgggacatcaacgctgggcctaaagaagggaagatcgtggacgcaaaggccattttcactggacacagtgcagtggttgaagacgtggcgtggcaccttctacacgagagcctcttcggctcggttgcggacgatcagaaactcatgatatgggacactaggtccaacacaacgagtaaaccgtcccacttggttgatgcgcataccgctgaggtgaactgtctctccttcaatccatattcggagtttatcctggccacaggctccgccgataagaccgttgccttatgggatctccgcaacctgaagctgaaactccatacatttgagtctcataaagacgaaatatttcaggtacactggtctccgcacaacgaaacgattctggctagttctggaacggaccgtcgcctgaacgtctgggatctgtcaaagataggcgaggagcagagtgccgaggacgctgaagacggccctcccgagctgctgtttattcacggcgggcacaccgccaagatttccgatttttcctggaaccccaatgagccttgggtaatatgttcggtgtcggaagacaacatcatgcagatctggcagatggccgaaaacatttataatgacgaagagtcggatgttaccacaagcgaactggagggacaaggctcgtag

SEQ ID NO: 132279 - DNA, 1251 bp, Artificial Sequence
  Description of Artificial Sequence: Synthetic coding sequence
atggcgtctaaggaaatgttcgaggacacagtggaggaacgtgtgatcaatgaggagtacaagatatggaagaagaacaccccgtttctgtacgacttggtgatgacccatgctctccagtggccatcattaactgtgcagtggctccccgaagtgacaaaaccagaagggaaagattatgccctccactggctggttttaggcacacatacgagcgacgagcaaaaccaccttgttgtggctagggtgcatatccctaacgatgatgctcagtttgatgcatctcattgtgactctgacaaaggggggaagatcgagtgtgaaataaaaatcaatcacgaaggtgaggtgaatagggcccgctatatgcctcagaaccctcatattatagcaacaaaaacaccctccagcgacgtgctggtgttcgattacaccaaacaccccgccaagccggacccctccggggaatgtaacccggatctgagattaagaggtcaccaaaaggaaggttacgggttatcctggaactctaatctgagcggacacctgctgagcgcaagcgacgatcacaccgtgtgcctgtgggacattaatgctggtcctaaggagggtaaaattgtggacgccaaagctatctttacgggtcatagcgcagtggtggaggatgttgcctggcacctgctgcatgagagtctctttggatcagtggcagacgatcagaaactgatgatttgggatactcgatcaaataccacgtccaagccctcccacctggtggatgcccatacggccgaagtgaactgtttgtcatttaacccctactccgagtttattctggcgacagggagcgctgacaagactgttgccctgtgggacctaaggaacctcaagctcaagctccatacattcgagtcacataaagacgaaatcttccaggtgcattggagccctcacaacgagaccattctggcctctagtggcacagataggcgtctgaatgtctgggatttatcaaaaattggagaagagcagtccgcggaggatgccgaggatggacctccagaactgctttttattcatggaggccacaccgcaaagatcagcgatttcagctggaaccctaacgagccgtgggtgatctgtagtgtctcagaagacaacatcatgcagatttggcagatggccgagaacatctacaacgatgaagaaagtgatgtaactaccagtgaattagagggtcagggcagctag

SEQ ID NO: 132280 - DNA, 561 bp, Artificial Sequence
  Description of Artificial Sequence: Synthetic coding sequence
atggctagtccaagcaaggccgtaatcgttccagggaacggtggaggcgacgtaactacccacggatggtacggatgggtgaagaaagagctcgaaaagattcccgggttccagtgcctggctaagaatatgcccgaccctatcacagcccgggagtcaatctggctccctttcatggaaaccgagctccactgcgacgaaaagacgattattatcggccacagtagcggagcaattgccgccatgcggtacgccgaaacccaccgggtttacgctattgtgctcgtcagcgcctatacaagtgatctgggagacgagaatgaacgagcttctggttactttacccgtccatggcagtgggagaagattaaggccaactgtccttatatcgtgcaatttggaagcaccgacgatccgttcctgccttggaaagaacagcaggaagtggctgatagactggaaaccaagttacacaagtttacagactgcggccattttcagaataccgaatttcatgagcttatcacagtggtcaagtcactgttgaaagtcccagcatag

SEQ ID NO: 132281 - DNA, 519 bp, Artificial Sequence
  Description of Artificial Sequence: Synthetic coding sequence
atggcctcccccagtaaggcggtgattgtgcccggaaatggaggaggggacgtgactacccacggctggtatggttgggtaaagaaagagcttgaaaaaattccaggatttcagtgcctggcgaagaatatgcccgacccaattactgcccgagagtccatttggttgcccttcatggagaccgagctgcattgcgatgagaaaactattattatcggacacagttcaggagctatcgctgcaatgcgctacgccgagacacacagggtgtacgctattgtgctggtatccgcctacacctcggatttgggtgatgaaaacgaacgtgctagcgggtactttactcgcccctggcagtgggaaaagataaaagctaattgcccatacatagtgcaatttgggtccaccgacgacccatttttaccttggaaggaacagcaggaagtggctgattggaaaccaaactgcacaaactcactgaccgtggccacctttcggactcaatcttttatgaattag

SEQ ID NO: 132282 - DNA, 741 bp, Artificial Sequence
  Description of Artificial Sequence: Synthetic coding sequence
atggccgcggcggccatcccagccttgcttctctgccttcctctcctgtttctgctattcggttggtcaagggcacgccgggacgatccgcattcattgtgttacgacattactgtgatccctaagtttcgaccgggtccccggtggtgtgctgtgcagggacaggttgatgagaagacttttttacactacgattgcggcaacaaaacggtgacgcccgtgagcccattaggtaaaaaacttaacgtcactatggcctggaaagctcagaatccagtactgcgagaggtagtggacatccttacagagcagttactggacatacagctcgaaaactacacgcctaaagaacctctgaccctccaggcccgcatgtcatgcgaacagaaagccgagggccactcctcaggcagctggcagttcagcatcgacggtcaaaccttccttctttttgatagtgagaagcgtatgtggaccacagtccatccaggcgcccgaaaaatgaaagagaagtgggaaaacgacaaagatgtggcaatgtcttttcattacatctcaatgggggactgcattggctggctggaagattttctgatgggcatggactctacactggagccaagtgccggcgctccccttgcaatgagctcaggtaccacacagcttcgagccacagcaactactcttatcctgtgctgcctcctgattattcttccatgcttcattctccctggaatatag

SEQ ID NO: 132283 - DNA, 741 bp, Artificial Sequence
  Description of Artificial Sequence: Synthetic coding sequence
atggccgctgcagccattccagcgttactcctttgcctccccttattattcctgctgtttggatggtcccgagcccgacgcgatgacccccactccctctgttacgacatcacagtgatccccaagttccggcccggcccgcgatggtgcgccgtgcaagggcaggtggatgagaaaacgtttctgcactacgattgcggcaacaagaccgttacacctgtcagccccttgggcaagaaactgaatgtgacgatggcttggaaagcacagaaccccgtgctcagggaggtggtagacattctgaccgaacagctactggacatccaactcgagaactatactccaaaagaacccctaactctgcaagcaagaatgagctgcgagcagaaggctgaaggccatagttcaggatcctggcaatttagtattgatgggcagacattcctgttgttcgactcagagaagcggatgtggacaacagtacaccccggggcgagaaaaatgaaagagaagtgggagaacgacaaggacgtggctatgtcttttcattatatcagtatgggggactgcattggatggctcgaagatttcttaatgggtatggattcaaccctggaaccatctgctggcgcgcccctggctatgagtagcggaactacccagctgcgcgccacagcaacaaccctaatcctgtgctgtcttctcattatcctgccttgttttatcttgccagggatctag

SEQ ID NO: 132284 - DNA, 4923 bp, Artificial Sequence
  Description of Artificial Sequence: Synthetic coding sequence
atgcagtcctttcgggagcgctgtgggttccatggaaagcagcagaattaccagcagaccagccaggaaacatccagactagaaaactacagacagccatctcaagcaggcctctcttgcgataggcagcgtctgctggctaaggattactacaatcctcagccttacccaagttatgagggaggggccggtaccccctcgggcactgccgccgcagtggcagccgataagtatcatcggggaagcaaggcactgcctacccaacaggggctccaaggcagacccgcatttccggggtacggcgtacaagactcttctccttaccccggcagatacgctggggaggagagcctacaggcctggggcgcaccccagccaccccccccacagcctcagcccttgcccgctggtgtagccaagtatgatgaaaacctcatgaaaaaaacagctgtccctccttcccggcagtatgccgagcaaggcgcccaggttccatttagaacccactctttacatgttcagcagccgccgcccccgcagcagccactcgcatacccgaaactccagcggcagaagttgcagaatgatatagcatcccctctgccctttccgcaaggcacacacttcccccagcacagtcagtcttttcctaccagctccacgtattcgtcatccgtgcagggcggtggccagggcgcccactcttataagtcttgtactgccccaacggcacagccccatgatcgccctctgactgcctcgtcgagcctggcccctggtcagcgtgtgcaaaacctgcatgcatatcagtccggccggctttcctacgatcaacagcaacagcaacagcagcagcagcagcagcagcagcaggctctgcagtccagacatcacgcacaagaaaccttgcattatcaaaaccttgccaaatatcagcattacgggcaacagggacaggggtactgtcagcccgatgctgccgtgcgcacccccgagcagtactatcagacattttcgccttcttctagccactcacctgcccgatccgtgggccggtccccgagttactccagcacacccagcccgctcatgccaaatcttgagaacttcccttatagccagcagcccctgagcactggcgcatttccagcgggcatcacggaccactcacactttatgccactgctgaaccccagccctaccgatgccacttcgagtgtcgacacccaggctgggaattgtaagcctctccagaaagacaagctgcccgagaacctgctgagtgacctatccctccaatctctgactgcgctcactagtcaggtggaaaacattagcaatactgtgcagcagctcctgctgtctaaagctgcggtgccacagaagaagggagtgaaaaacctagtctcacgaactccagagcagcataaaagtcagcactgttcacccgaaggctccggatactccgccgaacctgcaggaactccactgtccgagcccccctcgtctacacctcagagtacccacgcagaaccacaggaggctgactacctgagcgggtcagaagaccctctggagagaagcttcctatactgcaaccaggcccgcggctccccagccagagtgaacagtaatagtaaggccaaacccgagagcgtgagcacctgctcggtaactagcccggacgatatgtctacaaagtcggatgacagtttccagagtctccatggtagtttacccctggacagcttcagtaagttcgtcgccggggaacgagattgccccaggctgttactgagcgctctagcgcaggaggaccttgcgtccgagattcttgggctgcaggaagccatcggagagaaagctgataaggcttgggcggaggcaccctccctagtaaaagactctagcaagccccctttctcattggaaaatcatagcgcctgcctcgattcggttgccaagagtgcctggccaagacccggcgaacccgaggctttaccagattcgctccagttagataaggggggcaacgcgaaggactttagccctggattgtttgaagacccctccgtcgcctttgctacaccggaccctaaaaaaacaactggcccactgtcttttggaacaaagcccacactgggggtcccagcccctgaccctaccactgccgcatttgactgcttccccgataccacagctgctagcagcgcagactccgccaacccctttgcatggccggaagagaatctgggggacgcctgtcctcgatggggattgcacccaggtgagctgactaaagggttggagcaagggggcaaagcctccgacggcatcagcaagggggacacccatgaagcatcagcgtgcctgggatttcaggaggaggatcctcccggcgagaaggtggccagcctccctggtgactttaaacaggaggaagtcggcggcgtgaaggaggaggccggtggtctcctgcaatgccccgaagttgcgaaggccgacaggtggctggaggactctagacattgttgttctactgccgattttggggacctcccactgttgcctccaacaagcaggaaagaagacttggaggccgaagaggagtattcctccctgtgcgaactgctggggagtccggaacagagaccaggaatgcaggatcccctgagccctaaagcccctcttatatgtactaaggaagaggtagaggaagtgttggattccaaagctggctggggatcgccatgccatctttctggtgagagtgtcatcttgctaggcccaacagtggggacagaatcaaaggtgcagtcctggttcgaatcttcactgtctcacatgaagcccggcgaggaagggccggatggggagagggctcctggcgacagcacgacatcagatgccagtctggctcagaaacctaacaagccggcagtgcccgaagctcccattgcaaagaaagaaccagtacccagaggaaaatccctgagatccagaagggttcaccgtggcctcccggaagcagaagactccccctgcagagccccagttctgcccaaggaccttttgttaccagagagctgcaccgggcctccacagggacaaatggaaggggccggcgctcccggaaggggagcttctgagggcctgcccaggatgtgtacaagatccctgaccgctttgtcagaaccacgcacaccaggccccccggggcttaccacaactccggcccctcccgataaactgggaggcaagcagagagccgccttcaaaagcgggaagagggtgggtaaaccctctcccaaggcagcctcgtcgccctcaaatccggccgctctgccggttgctagcgattctagtcccatgggaagcaaaaccaaagagaccgattctccatctactccaggcaaggaccagaggtctatgatactgagaagccgcaccaagacgcaagagatctttcattctaagcggcggcgacctagcgagggccgtttgcctaattgtagagcgaccaaaaagctgttagataatagccatctgccagccaccttcaaagtttcctcaagcccccagaaagagggaagagtgagccagagagcccgggtccctaagcccggggctggtagtaagctgagcgacaggccgctgcatgccctgaagcggaaaagcgccttcatggcaccagtacccacaaagaagcggaatctcgtgcttaggtccagatcctctagctcgagtaatgcctctggtaacggaggagacgggaaggaagagagaccagaaggctcacccacgctcttcaaaagaatgtcttccccaaagaaggccaagcccaccaagggtaatggagagcctgccaccaaactaccacctcccgagacccccgacgcctgcttgaaactcgccagtagagccgccttccagggagcaatgaaaacgaaagtactcccaccccgtaagggccgcggactgaagctggaggcaatagtgcagaagataacttctccgtctctgaagaagttcgcatgcaaggctccgggtgcttcacccggtaacccactgtccccaagtcttagcgacaaggatcgcggcctgaaaggtgcaggtggatcgcctgtgggcgtggaagaggggctagtgaacgtcgggaccggccagaaactccctaccagcggcgccgaccccttgtgtcgcaaccctaccaaccgctccttaaagggcaaactcatgaactcaaagaagctttcaagtacggactgcttcaaaaccgaagcctttaccagtcctgaagcattgcagcctggggggacagcattggccccaaagaaacgaagccgcaagggccgcgcaggggctcacggactgagcaagggtcctcttgagaaacggccctacctggggccagcactgctgctgaccccacgtgacagggcctccggcacgcagggggccagtgaggacaactctggagggggcggtaagaaacctaaaatggaagaattggggctggcctctcagcctcctgaaggtcgaccctgccagccacagacgcgcgcacagaaacagccgggtcacaccaactactcgagctacagcaagcgcaaaagacttaccaggggccgggccaaaaataccacatcaagcccctgtaaggggcgagctaagagacgaaggcagcagcaggtactccccctggatcctgccgaacccgagattcgcctgaagtacataagcagttgcaaaaggcttagaagtgattctcgcacccccgcgttctctccgttcgagccaagtctgggagcccagaatccaaggagtggacagaatgccccccctgctcccgccgatgcccgaccgctgtgtacaacacgggatcgccgcgcctatagtgccagagagcaggggcagagatag

SEQ ID NO: 132285 - DNA, 5589 bp, Artificial Sequence
  Description of Artificial Sequence: Synthetic coding sequence
atgcagagcttccgcgagcgatgcgggtttcacgggaaacaacaaaactaccaacagacatcccaggagaccagtagactggaaaattatagacagccaagtcaggctggtctcagttgtgaccggcagcggcttctcgcaaaggattactacaacccccagccgtatccgtcctatgaagggggggctggaacacccagtggcacagctgcggcagtagcggcagataaatatcaccgtgggtccaaggccctcccgacccagcagggcctccagggtagacccgccttccctggatatggagtccaagatagttccccctaccctggacgctatgccggggaagagtcacttcaagcctggggagccccccaaccaccgcctcctcagccgcagccactgccagctggggtcgccaagtatgatgagaacctgatgaaaaagaccgctgtgcctccatcaaggcaatatgcggagcagggggctcaggtgcctttccgcacacattcactgcatgtgcagcaacccccccccccccaacagccgcttgcttaccccaaactgcaacgccagaagctgcagaatgatatagctagccctctaccatttccacagggctggtgggctggccactcctacaagtcatgcacagctccgacagcacaaccacacgacaggcctctcaccgccagctcgtctctggcacctgggcagagggttcagaatctgcacgcgtaccagagtggacggctcagttacgaccaacagcagcagcagcagcagcagcaacagcagcagcagcaggccctgcagtcaaggcaccatgcccaggagacactgcactaccaaaatttagcaaaataccagcactacggacagcaaggacagggctattgtcaacctgatgccgctgtcagaacgccggaacagtactaccaaacattttctccatcctcctcccatagccctgcacggtccgtgggacgtagcccgtcatactcctcaaccccctctcccctgatgcctaatctcgagaacttcccatacagtcagcagccattatctactggcgcctttcccgcgggaattacagatcattctcactttatgcccttgctgaacccaagtcccacagatgcaacctcttctgtcgattctctgactgcactgacatctcaggtggagaatatatcaaatactgtgcagcagctcctcctgtctaaagcagccgtaccccaaaagaagggagtcaaaaatctggtgagtagaacgcccgaacagcacaaatctcagcactgttcgcctgagggatccggatatagcgccgaacctgccggcacacccttgagcgagccaccatcttcaactccccaatccactcacgcagaaccacaggaggccgattacctgagcggctctgaagacccactagagaggtctttcctgtactgcaatcaggctagaggtagtcctgcccgggtgaactccaattctaaggcaaagcctgaatccgtgagcacatgctccgttaccagccctgacgacatgagcaccaaatccgacgatagcttccagtcgctgcatgggtctctgccacttgatagttttagcaagtttgttgccggggagcgtgattgccccagactcctgctctccgcactagctcaagaagacctggcaagcgaaattctgggtctgcaggaggctatcggtgaaaaggctgataaagcctgggccgaagctccaagtcttgtcaaggatagctccaaaccaccattctctctcgaaaaccactctgcttgcctggacagcgtagctaagtcggcatggccacgacccggcgagccagaagcgctgcccgattcattacagctggacaagggaggtaacgctaaggatttttctcctggattgttcgaagatccatccgttgccttcgctacccctgatcctaaaaagacaacaggacctctgtcctttgggaccaaacccacactgggagtgccagctccagaccccaccacagcagcatttgattgcttcccagacactacagccgcttcctccgcagactcggctaatccgttcgcttggcccgaagaaaatttgggggacgcgtgccctcgatgggggctgcaccccggtgagctgacgaaaggactggaacaagggggcaaagcaagcgacggcatctccaagggggacactcacgaggcatccgcctgcctgggtttccaggaggaggatccccccggggaaaaggtggccagcctgcctggcgactttaagcaggaggaagtaggaggcgtgaaggaagaggccggcgggctgctgcagtgccccgaagttgccaaagccgatcgttggctcgaagattcgcgacactgctgtagcacagccgactttggggacctgcccctgctgcccccaacatccagaaaggaggaccttgaggccgaggaagaatactcctcactatgtgaactcctgggtagtcccgagcagcgccccgggatgcaggacccactgtctcccaaagcaccattgatttgtacaaaagaggaagtagaggaggtgctagattctaaggcagggtggggttctccctgtcatctgagtggtgagtcagtcattctattgggacctactgtcggtaccgagtccaaggttcagagctggttcgaaagttccctgagccacatgaagcctggtgaagaaggcccagatggcgagcgcgcgcctggtgatagcacaactagcgacgcttctctcgcccaaaaacctaacaagcctgccgtacctgaggctcccattgcaaagaaagaacccgtgccccgggggaagagcctccgatcacgcagagttcatagagggctccccgaggcagaagattccccctgccgcgcccctgtattacccaaagatctgttgctgccggagtcatgcaccgggccaccccagggccagatggagggggccggcgcgcctgggaggggagcctcagagggccttccacggatgtgcactaggtcactcactgccctgtcagagcctcgtacacctggaccacctggccttaccactacaccggcaccaccagacaagcttggaggtaaacagagggccgcttttaagagtggtaaaagagtgggtaaaccttcccccaaggccgcatccagcccatcaaatcccgcagcactcccagtggcctcagacagcagtcccatgggatctaagaccaaggagacagatagtccgtcgactcccgggaaggatcaaaggagcatgatcctccgctccaggacaaaaacccaggagatcttccattccaagagacgccgtccctcagaaggaagactgcctaactgtcgggctaccaagaagctgctcgacaattctcacctacctgctacctttaaagtgagtagcagccctcagaaagagggtagggtgtcccagagggccagggtgcctaagcccggggctggaagtaagctgtcagataggccgttgcacgccctgaagaggaagagcgcttttatggctcctgttccgaccaaaaagcggaatctcgtactccgctcccgctcttccagctcctccaacgcgtcggggaacggtggcgatgggaaggaggagaggcccgaagggagcccaacactctttaagcggatgtcctcaccaaagaaggccaaacctaccaaaggcaatggagaaccagccacaaaactcccgccaccagagacgcccgatgcctgcctgaagctggcatccagagccgcatttcagggggctatgaagaccaaggtcttacccccccggaaaggcagagggctaaagttggaggcaatcgtgcagaaaatcactagcccaagtcttaagaagtttgcttgcaaggcccctggggccagccctgggaatcctctaagtccaagtttgagcgacaaggatcgcgggttgaagggggccgggggttctcccgtgggcgtggaggaaggtctggtcaacgtgggcaccggccagaagctgccaacatcaggtgccgaccccctatgccgcaaccccactaataggtcactgaaaggaaagcttatgaataaccgcgcgtcaggcacacagggggccagtgaggacaacagtggtggaggtgggaaaaaacctaaaatggaagaactgggcctggccagtcagcctcctgaagggcggccctgtcagcctcagacacgagcccaaaaacagcccggccatactaattacagctcatactcaaaacggaaaagactaactcgaggaagggcaaagaatacaaccagcagcccttgtaaagggcgagccaagcgcaggcgacagcagcaggtcttacccctggaccctgccgaacccgagatcaggttgaagtacatctccagttgtaaaagactgcgttctgacagccgaacccctgcttttagcccatttgtgcgggtggagaaaagggatgcgtttaccaccatatgcacagtcgtgaactcccctggggatgcacccaaaccccataggaagccttccagttccgcttcttcaagctcctcctcatcaagcttcagcttagacgctgccggagctagtctcgccacattgcctggtgggtcaattctgcagccccggccaagcctgccattgtcatcgacaatgcacctgggccccgtcgtgagtaaggctctgagcacgtcatgcctcgtgtgttgtctctgtcagaaccctgctaacttcaaggacctgggggacctgtgtggaccctattacccagaacattgcctacccaagaaaaaacccaaactcaaagagaaggtaagacctgaggggacttgtgaggaagctagcctaccactggagagaactctgaagggccctgaatgcgccgcggccgctacagcgggcaaacccccacggcccgatgggcctgcagatcctgcaaagcaaggacccctcagaacctctgcacgagggctcagccgccgtcttcaaagttgttattgctgtgatggcagggaagacggcggcgaagaagccgcccccgctgacaaagggcactgggtgcacgaagcttgcgccgtctggaccggaggcgtgtatttggtcgctggcaagctgttcggactgcaggaagccatgaaggttgcagttgatatgcacggcgggaccgtggccctggcaccaggcgatttctccttgcccggcctaaggtttgcctctctgtttcaggggccatcatggtgcgactgcccagtgctcgccacttctaccccaagttcttggagcagatgtgtgcccgccgcgaaaaagcctggccctcccctgggtgccgctactaaggacgcttctacgccaacaacaacacgcgtgccagccatgcaggtacgggcacgccccggaaccgggggacattggagcccttccaaacaatcgcgggggaccctccctggacactccagccctaatcccggtcccatctccctgttttcctttccccccctcctaccccagcagttcttttatccttccgtgtgcttagacctgtgttgggccatgcccggtacatggaagtag

SEQ ID NO: 132286 - DNA, 5721 bp, Artificial Sequence
  Description of Artificial Sequence: Synthetic coding sequence
atgcaatcctttagagagagatgtggtttccacggcaagcagcagaattaccagcagacgagccaagaaacaagccgactggagaactatcgacagccttcgcaggcaggtctgagttgtgaccggcagagacttctggccaaagattattacaacccccaaccttacccgtcgtacgaaggtggcgccggtacaccctctgggacggccgcggccgtggcagccgataagtaccatcgggggagcaaagcactccctactcaacaaggtcttcagggaaggccagcttttcctgggtacggagtgcaggattcatcaccctacccaggaagatacgcaggcgaggagtccctgcaggcatggggcgcaccgcagccccccccccctcaacctcaaccactgcctgccggggttgccaaatatgatgagaaccttatgaagaaaaccgccgtgcccccttcccggcagtatgcagagcagggcgctcaggtgccgtttaggacacattccctgcacgtgcaacagcctcctccaccccagcagcctctggcctaccccaagctacagcgccagaaattacagaatgacatcgccagtcccctccccttcccacagggaacacattttccccagcactcccaatctttcccaacatcctcaacttactcttcttctgttcaaggcggagggcagggcgctcactcctacaaatcctgcaccgccccaacagcgcagccccacgatagaccactcacagccagctcatcactggctccgggacagagggtgcagaacctgcatgcatatcagagtggccgactcagctacgatcaacaacagcagcaacaacagcagcaacaacagcaacagcaggcactgcaatcacgacaccatgcacaggagacactccattatcagaacctggccaagtaccagcactatgggcagcagggccagggctactgtcagcccgacgcagcagtaaggacgccagaacagtattatcagacctttagcccatcatccagtcactctcccgctaggagcgtgggtaggtccccttcctactcatctacaccctctccactaatgcccaacctggaaaactttccatactcacaacagcccttatccaccggggcctttccggccggcattacagaccattcacacttcatgccattgttaaacccctctcctactgatgcgaccagctcggtcgacacccaagcaggcaattgtaagcctttgcaaaaagataaacttcctgagaatctcctctcagacctgtctttacaaagtctcacagctctcacatcccaggtggagaacatctcgaacaccgtccaacagctgctgctgtccaaagcggccgtgccccagaaaaaaggcgtaaagaacctcgtgtcacggacacccgagcaacacaagtcccagcactgcagtcctgagggatcaggctattccgcagagcccgcaggaacacccctgtcagagccgccttccagtacacctcagtcaacccacgctgagcctcaagaagccgattacttgtcagggtcagaagaccccctggaaaggagctttctctattgcaaccaagcccgtggcagtccagctcgggtcaactcaaacagtaaagctaagcctgaatctgtatcaacatgcagcgtaacttcaccagacgatatgtcaaccaaatccgacgatagctttcagagccttcacggatcactgcctcttgatagcttctccaagtttgtagccggagaaagagactgcccgaggctgctgctttccgccctggcacaggaggatctcgcaagtgagatcttgggactccaggaggccattggggagaaagccgacaaagcttgggccgaggcacccagccttgtgaaggatagttcgaagccccccttctctcttgaaaaccattctgcttgcctggacagtgtggcgaagtcagcttggcctcgaccaggagaaccagaagcgttacccgactcacttcagctggataagggtggaaacgctaaggatttttctccaggactgtttgaagacccttccgtggccttcgccactccagatcccaaaaagactacaggaccattgagctttggcacaaagccaacactcggggtaccggcgcccgacccgacaaccgcggcttttgactgcttcccagacactactgccgcctcatccgcagattccgccaaccctttcgcttggccagaggagaatctcggcgacgcctgcccacgatggggacttcatcctggggagctgacgaagggcctcgaacagggtggtaaggcttctgatggcatttccaaaggggatactcacgaagccagtgcttgtttgggattccaggaggaggacccgccgggagagaaggtggcatccctacccggcgactttaaacaggaggaagtcgggggagtaaaggaggaggcaggaggactcctgcagtgtcctgaggtggcaaaggctgaccggtggctggaggactcccgccactgctgcagtactgctgacttcggggacctgcctctgctgcccccaaccagcaggaaagaagatctggaggccgaagaggaatattcaagcctctgcgagctgctggggtcaccagagcagcggccagggatgcaggatcccctgagcccgaaggcgcccctgatctgcacaaaagaggaggtcgaagaggttctggattctaaagctggatggggatcaccatgccacttgagcggcgagtctgtaatccttctaggaccaaccgtaggtaccgagtcaaaagtgcaatcatggttcgagagtagcttgagccatatgaaacctggcgaggaggggccagacggtgagagagcacctggtgactctacaacatcagatgcttcactcgcccaaaaacccaacaaacccgcggtgcctgaagcaccaatcgccaagaaagagcccgtgccccgggggaaatcacttaggtccagacgtgtccaccgtggtttgcctgaagcagaagatagtccctgtcgtgcacccgtgctgcctaaggatttgctcctgcctgaatcctgcaccgggccgccccagggccagatggagggagccggggctccaggccggggtgcctctgagggactcccgcgcatgtgcacccgaagtctgaccgctttatcggagccgaggaccccaggcccccctggcctgaccacaactcccgctccacctgataagttaggcgggaagcagagagccgccttcaagtcaggcaagcgggtcggcaaacccagccctaaagctgcctcctcgcccagcaatcctgcagctcttcccgtggcctccgattcctcacctatgggctcaaagacgaaggaaacagattctccctccacacctggaaaagaccagcggtctatgatcttgaggagtaggacgaagactcaggaaatttttcattcaaagaggcggaggccttccgaagggcgccttccgaactgccgtgcgacgaaaaaattactggacaactctcacctcccagcaacattcaaagtttcttctagtccacagaaagagggcagggtatcacaacgagctcgggtacccaaaccaggggcgggatcaaagctgtcggaccgccccctccacgcactgaagagaaagtctgcgtttatggcacccgtccccacaaaaaaacgcaatctcgtactgcgcagccgatcatcctccagctctaatgcgagcgggaatggcggggacggcaaagaagaaagacccgagggtagtccgacgctgtttaaacgcatgtccagcccaaagaaggcgaagccaactaaagggaacggggagcctgccactaaactccctcctcctgagactcccgatgcctgcctcaagttagcctcacgagccgctttccagggcgccatgaaaaccaaagtactaccgccaaggaaaggcagaggcctgaaactggaagccatcgtgcaaaagataacgtctccctctctcaaaaaattcgcttgtaaagcccctggggcttctcctgggaaccctttaagcccgtccctctccgacaaggacagaggactgaagggcgctggtggctcaccggtcggagtggaagagggcctggtgaatgtcggtaccggccagaaactccccacaagcggagctgacccattatgcagaaaccccacaaaccgcagcctaaaaggaaaactgatgaattcgaagaaactcagtagcacagattgttttaaaacagaggctttcaccagtcctgaggctttacagccaggcgggacagcactggcgcctaaaaagcgctctcgtaagggacgagccggagcacatggcttatcaaaaggaccactagaaaaacgtccatacctgggtccagctctgctgcttacacctcgcgatcgggccagcggaacacaaggggcaagtgaagacaacagcggggggggagggaagaagcctaagatggaagaactgggcctggcctctcaaccgccagagggacgaccctgccagccccagacccgtgctcaaaaacagcccggacataccaactactccagctattctaagcgtaagcgcctgacacgcggaagagccaagaatacaacctcatccccatgtaaggggcgcgcaaaacgtaggcgccagcaacaggtgctccccctggaccccgctgaacctgaaattaggttgaaatatatctcttcatgcaagcgtctgcggtccgactctcgtacacccgctttctcacccttcgtgcgtgtcgagaaaagggatgcttttacaacgatctgcaccgtggtgaactcgccaggcgatgctcccaaacctcaccgcaaaccaagtagctctgcttcatcatccagctcaagctcctcatttagcctggacgctgcaggtgcctccctggccacattgcctggcggctcaatactccaacccaggccaagcctgcctctttcctcaactatgcacctcggccccgtagtgtctaaggctctgtcaacaagctgcctggtctgttgtctgtgccagaatcctgccaacttcaaagatttgggcgatctgtgtggtccttattaccccgagcactgcctgcctaagaagaaacccaaattgaaagagaaggtgaggcccgaaggcacctgtgaagaggcatctctacctcttgaacgcacattaaaggggcctgagtgcgccgctgcagcaacagctggcaaacctcccaggccagacggtccggccgatcctgctaaacaagggcccttgcggacaagcgcacgggggctatcacgcagactccagtcctgctactgctgcgatggcagagaagacggcggcgaggaggcagccccggccgataagggccggaagcatgagtgcagcaaggaggcccccgccgaaccgggcggggaggcccaggagcactgggtgcacgaggcctgcgcagtctggacaggaggagtgtacctagtggccggaaagctgttcgggcttcaagaggccatgaaagttgccgtcgatatgatgtgtagttcatgtcaggaggccggagccactatcggctgctgtcataaaggatgtctacatacctaccactatccctgtgcaagcgacgcaggctgtatattcattgaagaaaatttcagccttaaatgccccaaacacaaacggcttccatag

SEQ ID NO: 132287 - DNA, 2901 bp, Artificial Sequence
  Description of Artificial Sequence: Synthetic coding sequence
atgcaaagcttcagagaacgctgtggctttcacgggaaacagcagaactatcagcaaacttcgcaggagacgagcagactcgaaaattatcgccaaccatcccaggccggattgagctgcgaccgccagcggttgctcgctaaagactactataatccacagccctatccgtcctacgaaggcggagccggaacacccagtggaaccgcggctgccgttgcagcagataaataccaccgcggctccaaggcactacctactcaacagggcctgcagggaaggccagcttttcccggctacggcgttcaggactcgtcaccatatcctggtaggtatgcgggagaagagagccttcaggcttggggggcccctcagccgcccccccctcagccacagcccttgcccgcaggggtcgcaaagtatgatgagaacctgatgaaaaaaacggctgtgccaccgtccagacaatacgcggaacaaggcgcacaggtcccctttagaacacacagtttacacgtccagcagccccccccacctcagcagccactagcatacccgaagttgcaacgacagaagttacaaaacgacatagcatccccactgccattcccacagggaacgcacttccctcagcacagccaatcttttcccaccagctctacctattcctcatcagtgcagggtggcggacagggagcacattcgtataaaagttgcaccgcccctactgcacagccacacgatcggcctctgactgcttcctcttctctcgcacctgggcagagagtacagaacctgcacgcttaccagtctgggagactttcctatgaccagcaacaacagcagcagcagcaacaacagcagcagcaacaggcactccagtctcggcaccacgctcaggagactctgcattaccagaacctggccaaataccagcactacggccagcagggccaggggtactgccagcctgatgctgccgttcgaacccctgagcagtactatcagacgtttagcccctcctctagtcattccccagcccgttcggtcggtagatccccgtcatacagtagcacccccagccccttgatgcccaatctcgaaaactttccttattcacagcaacccctgagtaccggggcattccccgcgggaatcacggatcactcacactttatgcccctgctcaatccttcccccacagacgccacatcatccgttgatacgcaggccggaaattgtaaacctctccaaaaggataagctgccagagaacctgctctccgatctctctttgcagagcttaacggccctcaccagtcaggtggagaacatctccaataccgtccagcagctgctgctctccaaagctgccgtcccccagaaaaagggggtgaagaacctagtgtctagaacaccagaacagcacaaatcccaacattgttctccagaggggtccggatattccgccgagcccgccggtactcccctctcagaacctccgtctagtactccccagtccacacacgcagagccccaggaggctgattacctctcaggatcagaggacccacttgagcggtcattcctctactgtaatcaggcacgtggctccccagctcgggtgaactcaaacagtaaggctaaacccgaatcagtaagcacctgttctgtgacttctcccgacgatatgagcacaaaaagtgacgattcattccagtctttgcacggatccctccctttggactcctttagcaaatttgtagcgggagaacgggattgtcccagactgcttctcagcgctctggcacaggaggacttagctagcgagatattgggtctgcaggaggcaattggggagaaagccgataaggcctgggcggaagctccatctctggtcaaagacagttccaaaccgccctttagtctggagaaccattccgcctgtcttgacagcgtggccaagtccgcctggcctcgccctggcgaacccgaggctctgcccgacagtctccagctggataagggcgggaatgcaaaggacttttcgcccggtctgtttgaagatccttcggtggcatttgccacgcctgatccaaagaagactaccggtcccctctcctttggtacaaaacctacactcggcgtgcctgcacccgaccctacaaccgcagcattcgactgctttcctgataccacggccgcctccagcgcggactcggccaacccctttgcatggcccgaagaaaaccttggtgacgcctgcccacgctggggcctgcaccctggcgagctcaccaaaggtctggaacaggggggtaaggcctctgatggtatttctaaaggcgatactcatgaggcctcagcctgtctgggcttccaggaggaagacccgcctggagaaaaggtcgcaagcctgcccggagattttaaacaggaggaggttggcggcgtgaaggaagaagcaggtggtctcttacagtgtcctgaagtggcgaaagccgacagatggttggaggattcccgccactgctgttctaccgctgatttcggagatttgcccttgctgccccccactagccggaaagaagatcttgaggcggaggaggagtacagcagcctctgcgaactcttagggagccctgagcagcgacccggtatgcaggatcctctatctcccaaggcaccactgatttgcacaaaggaagaggtggaagaagtgctggatagcaaagcaggatggggctccccttgccacctgagcggggaaagtgtgattctcttggggcctaccgtcggtacggagtctaaggtgcaatcttggttcgaggccagcctttatagtgtgtacatttgcatccacatccacatttataacatttacgaggactgcaagtgctag

SEQ ID NO: 132288 - DNA, 2829 bp, Artificial Sequence
  Description of Artificial Sequence: Synthetic coding sequence
atgcagagcttcagagaacggtgcgggttccacggcaagcagcagaactatcagcaaaccagtcaggaaacaagcagacttgagaattacagacaaccatcccaagctgggctcagttgtgataggcagaggctcctggctaaggactactataacccgcagccttatcccagctacgaaggaggagccgggacaccttccggcaccgcagccgccgtggctgcggataaataccacaggggtagcaaggcactccctactcagcaggggctccagggacggccagccttccccgggtacggtgtgcaggacagttcaccgtatccaggacgctatgcaggcgaggaatctctacaggcttggggcgcgcctcagcccccacctccacaaccccagccactgcctgcgggtgtcgccaagtacgatgagaaccttatgaagaaaactgccgtgccccctagcagacagtatgcagagcagggcgcccaagtgccttttcgcactcatagcttacacgttcagcagccaccccctcctcagcaaccacttgcatacccaaagctgcagcgccagaagcttcaaaatgacatcgcgagccctctgccatttccgcagggaactcacttcccacagcactctcagagcttcccaacctcgtcaacctacagctctagtgtccagggtggggggcagggtgcacattcttacaagagttgcaccgctcccacagcccaaccacacgaccgacccctcaccgcatcttccagcctggcaccgggccagcgagtgcagaacctccatgcctatcaatccggtcgactctcctatgatcagcaacagcagcagcaacaacagcagcagcagcagcagcaggctctgcagtccaggcaccacgcccaagagacgctgcattaccaaaatctggccaagtaccagcattacggccagcagggtcagggctattgtcagccggatgctgccgtgcgtacacctgagcaatattaccaaacatttagcccttcatcctctcatagcccagctcgctcagtcgggaggtcaccaagctacagctccacacctagccccctaatgccgaatctggagaactttccctattctcagcagccactgtctacaggcgcgtttcctgccggcatcactgatcactctcactttatgcctctcctgaatcccagcccaactgacgcgacttcaagcgtggatacccaagccgggaattgtaagcccctccagaaagataaattgcccgaaaacctcctgtccgacctcagcctacaatctctgacagcactcacttcacaggtcgagaacatcagtaatacagtgcagcaactgctgctttcaaaggcggctgtcccccagaaaaaaggcgtcaagaatctggtctcgcgtacacctgagcaacacaaatcccaacactgcagccctgaggggagcggatatagcgcggaaccagcaggcacccctctgagcgagcccccctcctccacaccccagagcacgcacgccgaacctcaggaagcggattacctgtccggctctgaagatcctctggaaaggtctttcctctactgcaatcaggctagaggttctccagcgcgcgtgaattctaactcaaaggcaaaacctgaaagtgtgtccacctgcagtgtgacgagtccagatgatatgtccacaaaaagcgacgacagctttcaaagcctgcacggtagccttccactcgatagcttcagcaagtttgtggctggcgagcgcgactgccctcgactgctgctgtccgcactggctcaggaggacctggcctctgaaatcctggggttgcaggaggccatcggagagaaagctgacaaggcctgggccgaagcccctagtctcgtgaaagattcctcaaagccaccattttccttagaaaaccattccgcttgtctggactctgtggctaaatctgcttggcccaggccaggtgaaccagaagctctgcctgattcccttcagttggacaagggaggtaatgccaaagacttttccccagggctatttgaggaccctagcgtcgcctttgcaacccccgatccgaagaaaacaacggggcctctgagctttggcaccaagccaaccctgggcgtgccggcccctgatccaacgacagccgcctttgattgcttccccgacaccacagctgcctctagtgctgatagtgcgaatccatttgcttggcccgaggagaatctgggagacgcatgccctagatggggactccacccgggtgagctgaccaaaggccttgagcaggggggaaaagcatccgatggcatttccaagggggacacccatgaagccagcgcttgtctaggcttccaggaagaggatcctccaggggagaaagttgcgtccttgcccggggactttaaacaagaagaagtaggaggtgtgaaagaagaggctggaggccttttacagtgtcccgaggtagccaaagccgaccggtggctagaagatagccgccactgttgcagcaccgcagattttggagatctgccgctgttaccccccacatcccgtaaggaagacctggaagccgaggaggagtattcatcactgtgtgaactccttgggagccctgagcagaggcccggaatgcaggatccgctgtcccccaaggcacccctgatttgcaccaaggaggaagtggaagaggtcctggattccaaggccggctggggctccccttgtcacttgtcaggagaatccgtaatattgctaggccctacagtggggacagaatccaaagtccagtcctggttttag

SEQ ID NO: 132289 - DNA, 5982 bp, Artificial Sequence
  Description of Artificial Sequence: Synthetic coding sequence
atgcagtcttttagggagaggtgtggattccatggtaagcagcaaaactaccagcagacctcccaggagacttcacgactcgaaaactaccggcagccatcccaggcaggactgagttgcgatagacagagattactggcaaaagattattacaatcctcagccctatccctcatatgaggggggggcaggcactcccagtggcacagccgccgccgtggctgcggacaaataccaccgcggttcaaaggctctgcccacccaacaaggcctccagggaagacccgcctttccggggtacggagttcaggatagcagtccttatcccgggcgatacgcaggagaggagtctttacaagcttggggggcccctcaaccccctcccccccagcctcagcctctcccagccggcgtagcaaaatacgatgaaaacctcatgaagaagacagccgttcccccctctcgccagtatgccgagcagggagcccaggtgccatttcgaacccactctctccacgtccaacagcctccaccaccccagcaacccctggcctaccccaaattacagcgacagaagttgcagaatgatattgcctccccgctgccttttccacaggggacacactttcctcagcacagccagagtttccctacaagctcaacttattcctcatctgtccaaggtggcggccagggcgcccattcctataagagctgcaccgccccaactgcacagcctcacgacagacccctcacggcaagcagttcactggccccaggtcaacgcgttcagaacctccacgcgtatcagtctggcaggctttcctacgatcaacaacagcagcagcagcagcaacagcagcaacagcagcaggccctacagtccaggcatcacgcacaagagacattgcactatcagaacctggcaaagtatcaacattatggccagcaggggcagggctattgtcagcctgacgccgcggtgaggacaccagaacaatattaccaaaccttttcgcctagctccagccattcaccggctaggtcagtgggccgctccccctcatacagctctaccccatcccccctgatgcccaaccttgaaaattttccttacagccagcagcctctctccaccggagcctttcctgccgggattactgaccactcccactttatgcccctgctgaatccctcccctacagatgctacctccagcgttgatactcaggctggtaactgcaaaccattacagaaggacaagcttcccgaaaacctcctaagtgacctgtcactgcaaagcctgaccgccctgacttctcaggtggagaatatcagcaataccgtccaacagctcctcctctccaaagcggcagtgccccaaaaaaagggcgtcaaaaatttggtcagtagaactcctgaacagcataagtctcaacattgttccccggagggtagcggatattcggccgagccagctggaactcccttaagtgagcctccatctagtacgccacagagcactcacgctgagccccaggaggctgactacctgagtggtagtgaggacccattagaaagaagctttctgtactgtaatcaggctaggggcagcccagccagggttaactcgaatagtaaggctaagccggagagcgtatctacctgcagcgtcacttctcccgacgacatgagcactaaatccgacgattcctttcagtcattgcatggctccctgccactggatagtttcagtaaattcgtggcaggagaacgcgactgccctcgattgctcctgtctgctctggcacaagaagatctggcctccgaaattttgggtctgcaggaagccattggggaaaaggcggataaagcctgggccgaggcgccatccctcgtcaaggactctagcaagccccctttctccttggaaaaccactccgcttgtctggattctgtggccaagagcgcctggccccgtccaggagaacctgaggccctgccagactctttgcagctcgacaaaggaggtaacgccaaagatttcagcccgggattgttcgaggacccctcggtagcctttgcaacacctgatcctaagaagaccacaggacccctgtccttcggaaccaagcccactctcggagtgcccgctcccgacccaactactgcagcatttgactgcttccccgacaccacagcggcctcatccgctgatagtgcaaaccctttcgcatggccggaagaaaatctcggcgacgcttgtccccgatggggacttcaccctggcgaattaaccaaagggctggagcagggtggcaaagctagtgatgggatttccaagggcgacacacatgaagcttcagcatgccttggctttcaggaggaggatccaccaggtgagaaagtcgcgagcctgccaggagattttaaacaggaggaggtaggcggcgtaaaagaggaggccggaggactgttacaatgtcccgaggtagctaaagctgacagatggctggaggactccagacattgctgttctacagctgatttcggagacttacccctactgcccccgacaagtcggaaggaggacctggaggcggaggaagaatatagtagcctttgtgagttgctgggatctcccgaacagaggcctggaatgcaggacccactgagccctaaagctccactgatctgcacaaaggaggaagtggaggaggttctggacagcaaagcaggatggggatcaccatgccatctgagcggggaatccgtcattctcctggggcccactgtgggaacagaatctaaagtacagagctggtttgagtctagcctgagtcacatgaagcccggtgaggagggtcccgacggggaaagggcccccggggattccacaacctctgatgcttccctggcccaaaaaccaaataaacctgccgtgccagaagcacccattgccaaaaaagagcctgtgccgcgagggaagtccctacgcagtaggagagtacaccgggggttgcctgaggccgaggattctccctgtagggccccagtgctcccaaaagacctgctccttcccgagagctgtacgggaccccctcagggtcaaatggagggggccggcgcccccggaaggggcgcatcggaggggctgccaagaatgtgtactcgaagccttactgccctaagtgagcccaggacacccgggccccctggcttgacgactacacccgcccctccagataagctcggtggcaagcagagggcagcttttaagtctgggaagcgtgtaggtaaaccctcccctaaagccgcctccagtccctccaatcctgccgcactgccagtggcatcagatagcagtcctatgggcagcaaaaccaaggagacagacagccctagtacccctgggaaggaccagagatcgatgattctgcggtcccgaaccaaaacccaggagatttttcacagcaagaggcgccggccgagcgaaggaagacttcctaactgccgagctactaagaaattactggacaactcccaccttccagccaccttcaaggtgtcgagttcaccccaaaaagagggccgggtctcccaacgtgccagggttcctaaaccgggagccgggtcgaagctatctgatcgacccttgcatgctcttaaacgcaagtctgccttcatggcacccgtgcctaccaaaaaaaggaatctggtactgcgcagtaggtcaagttcatctagcaacgcatcaggcaatggcggagacggcaaggaggagcgtcccgaaggaagccctactctgttcaaacggatgtcctcccctaaaaaagccaaacccaccaaaggcaatggagaacccgcaactaaattaccaccacccgaaactccagacgcctgcctcaagttggcgtccagggctgctttccagggggcgatgaagaccaaggtgcttcctccgcgcaaaggaaggggactgaagctggaagccattgtccagaaaataacttctcccagcctcaagaagttcgcttgtaaggcgcctggagcttcccccgggaatcccctgtccccttctttgagcgataaggacagagggcttaagggagcgggcgggtctccggtaggagttgaggaggggcttgtcaatgtggggacaggtcagaaactacctacctccggagcagacccactttgcagaaaccccacaaatagatccctgaaaggaaagctgatgaacagcaaaaagttaagctccaccgattgtttcaaaacagaagccttcacttctcctgaggccctgcagcccggagggaccgcactggcccctaagaaacgtagcagaaagggtagggcaggcgctcacggactctctaaagggcctttggaaaagcgaccatatttaggtccagccctgctcttgacacctagggatcgagccagcggaacccagggggcaagcgaggacaatagcggtgggggaggtaagaagcctaagatggaggaacttggattggcatctcaaccccctgaagggcgtccctgccaaccacagactcgagcccagaaacagccagggcataccaattactcatcttactctaaacggaaacgcttgacccgggggagggccaagaacacaactagttccccttgtaaaggcagggcaaaacgacggcgccagcagcaggttctgcctctggaccccgcagaacccgagattcggctcaaatatatcagtagttgtaagcggctccgatcggactcgcgcacccctgctttctccccctttgttcgcgtcgaaaagcgagacgccttcacaactatttgtactgtcgttaattcaccaggggacgcccctaaacctcacaggaaacccagcagctctgcaagcagctcaagctcatcctcctcctttagtctggatgccgcaggcgcatctttagcaaccctgcccggcggttctattttgcaacctaggccatctctgcctctcagttccacaatgcaccttggtcccgtggtttctaaggcactgtccaccagctgcctggtctgctgcttgtgtcagaacccagccaatttcaaggatctgggtgatctgtgtggcccatactatccggagcactgcttgccaaaaaagaagcccaagcttaaggagaaagtgcgacctgaaggaacgtgtgaggaggccagcctgcccttagaacgcacactgaaaggcccagagtgtgcggccgcagctaccgccgggaaacccccacgacctgatggcccagctgaccccgctaaacaaggaccactccgcacatccgcacgggggttgtccaggcgcctgcagtcctgctattgttgcgatggcagggaagatggaggcgaggaggcagctcctgccgataagggacgcaaacatgaatgttccaaggaagcacccgcggagcctgggggggaagctcaggagcattgggtccacgaagcgtgcgcggtgtggacaggcggcgtgtacctagtagcgggcaaattgttcggactgcaggaggccatgaaagttgcagtggacatgcatggcgggactgtcgccctcgccccaggagatttttccctgccagggctacggttcgcctcactgttccagggaccaagttggtgtgactgccctgtgttagcaacctccactccatcatcctggtctagatgcgtcccggctgccaagaaaccaggtccacctctaggcgccgctacaaaagacgcttcaactccaaccacaacgagagttcccgcaatgcaggtacgagccagacccggtaccggcggtcactggagcccatccaagcagtctcggggcaccttacccgggcacagctcaccaaatcctggtcctatctccctcttcagctttccaccgttactgccccaacagttcttttatccttccgtgtgtttggatctctgctgggctatgcccgggacatggaagtag

SEQ ID NO: 132290 - DNA, 2943 bp, Artificial Sequence
  Description of Artificial Sequence: Synthetic coding sequence
atgaaaagtctcaaagctaagtttaggaagagtgataccaatgaatggaataagaacgacgaccgtctgctccaggctgtggaaaacggagacgccgagaaggtggcctccctgcttggtaagaagggggcttccgccacaaagcacgatagcgagggcaagacggcgttccatttagccgccgccaagggccatgtggagtgcctgcgcgtaatgattacgcatggcgtcgatgtgactgctcaggacacaaccgggcacagcgcgctacatttggccgccaaaaacagccatcacgaatgtatcagaaagctgctgcagtccaaatgccccgctgagtccgttgacagctctgggaaaactgctctccattatgcagcggcccagggatgcctacaggccgtgcagatcctgtgtgagcataagtcccccattaaccttaaagacctcgacgggaacatccctctgctgctggccgtgcagaacggccacagcgagatatgccactttctcctggaccacggagcagacgtaaactctcgcaacaagtccggaaggacagcacttatgctggcctgtgaaatcgggagctccaatgccgtggaggcccttatcaaaaaaggggctgatctgaacctagtggactcgctggggtacaatgctctccactatagtaagctgagtgaaaatgctggtatccagagcctgttgctgtctaaaatatcgcaggatgctgacctgaagactcctacaaagcctaaacaacacgatcaggtgtcgaagatctcttccgaacgtagtggcacacctaaaaagaggaaggcccctcctccccccatcagcccaactcagctcagcgatgtaagttctccaagatctataacatccactcccctgagcggaaaagaaagcgtgtttttcgccgagccacctttcaaggccgagatcagctctatcagagagaataaggacagactgtccgatagcactacaggtgccgactcgctgcttgatatcagttcagaggccgaccagcaagacctgttgtcactgctccaggccaaggtcgctagcttgactttgcataacaaagagctgcaggacaagttgcaagccaaatctcccaaggaagcagaagccgacctttccttcgactcttatcattccactcaaacagacctcggaccatcgcttggcaagccgggagagacaagcccgcccgatagcaagtctagcccatctgtgctgattcacagtctcggcaagtccaccacagacaacgatgtcaggatccagcagcttcaggagatcctgcaggatcttcagaaaaggttagagagttcagaggctgagcgtaagcaactgcaggtggaactgcagagcaggagagccgaattagtgtgtctaaataatacagagataagcgagaactcatccgatctgagccaaaaactgaaagagactcagagcaaatacgaggaggctatgaaggaagttctgtctgttcaaaaacagatgaagctcggtctggtgagtcctgagtcgatggataattacagccattttcatgaactacgagtgactgaagaagaaataaatgtgcttaagcaggatcttcagaacgcactggaagagtccgagcgtaataaagagaaagttagggagctggaggagaaactcgtggaacgcgaaaagggaacagtcataaaacctccagtcgaggagtatgaagagatgaagtcttcttactgttccgtgattgaaaatatgaacaaggaaaaggcattcctctttgagaaatatcaggaagcgcaggaggaaattatgaaactgaaagataccctcaaatcccagatgacacaagaagccagcgatgaagcggaggatatgaaggaagccatgaaccggatgatagacgagctgaacaaacaggtatccgagttgagccagctttacaaggaggcacaggccgagctggaggattacagaaagcggaaaagccttgaagatgtgaccgccgagtacatacataaggctgagcacgaaaaactgatgcaactcaccaatgtgtctagagctaaagcagaagatgctctctcagaaatgaagtctcagtatagcaaagtgcttaacgagctgacgcaactcaaacagctcgtggatgcacaaaaggaaaattccgtgagcatcaccgagcatctccaggtgatcacgaccctccgcacagctgccaaagaaatggaagagaaaatatccaacctgaaggagcatctggcatccaaggaggtggaggtggctaaactcgagaagcagctgctggaggaaaaagcagccatgactgacgcgatggtcccacgctcttcctatgagaaactgcagagcagtctggagtcagaggttagtgtgcttgcctccaagctcaaggagtctgtcaaggaaaaggaaaaagttcatagcgaggtggtccagatccggtcagaagtctcccaggtgaaacgagagaaggaaaatattcagactctgctcaaatcaaaggaacaagaagtgaacgaactgcttcagaagttccagcaggcgcaggaagaactagccgagatgaagcgatatgccgaaagcagcagcaaactggaggaggacaaagataaaaaaatcaacgagatgtccaaagaagtgaccaagctgaaggaagcactcaattcactgtctcaactatcttacagcacttcctccagcaagcgccagagccagcagttggaagccctgcagcagcaggtcaaacagctccagaaccagctcgccgagtgtaaaaagcagcatcaagaagtgatatccgtttaccgaatgcacctgctctacgctgtccaaggacagatggacgaagatgtgcagaaagttctcaaacagatcctgacaatgtgtaagaatcagagccaaaagaaatag

SEQ ID NO: 132291 - DNA, 2922 bp, Artificial Sequence
  Description of Artificial Sequence: Synthetic coding sequence
atggttaagggaaagaccaacgagtggaacaagaatgatgatagattattacaagccgtagaaaatggcgacgccgagaaggtggcttccctgctgggcaagaaaggggcatcagccactaaacacgatagcgagggaaaaacagcctttcatctcgctgcagccaaggggcacgtggagtgcctccgagtgatgataacccatggagtcgacgtgaccgctcaggacacaaccggtcacagcgcccttcaccttgccgcaaaaaattcacatcatgagtgtatcagaaaactacttcagagcaagtgtccagccgagtctgtggactcttccggtaagaccgcgcttcattacgccgcagctcaaggctgtctccaggccgtgcagatcttatgcgagcacaagtccccgattaacctcaaagacttggacggcaacattcctctgttgttagccgttcagaatgggcattcagaaatatgccattttctcctggaccacggcgcagacgtaaattcccgaaacaagagtgggcggactgccctcatgctagcatgcgagattggcagttcgaatgccgtggaggcgctgattaagaagggggctgacctcaacctggtggatagtctcggctacaacgcgctacactactcgaaattatctgaaaacgcaggaatccagtccctcttgttgagtaagatatcccaggacgcagatttaaagactcccaccaagcccaagcagcacgaccaggtatccaaaataagtagcgaacgaagtggtacgcccaaaaaacggaaagcgcctccaccacccatttcaccgacccagctttccgatgtatcatcacctaggagcataacgagtacacctctgtcaggcaaggaaagcgtattcttcgctgaaccgccctttaaggctgaaatatccagcataagggagaataaagatcgcctcagcgattcaaccacaggggccgacagcctgctcgatataagctccgaagcggatcagcaggacctgctgtctttactccaggcaaaggttgcctccctcacactacacaataaggagctgcaggacaagcttcaggcgaagtctccaaaagaagccgaggccgacctcagttttgacagctatcatagcactcagacggatctaggtcctagtctgggaaagccaggcgagactagtcctcccgattcaaaaagcagcccaagtgtcctcatacactctctgggtaaatccacgaccgataatgatgtcagaattcagcagttgcaggagattcttcaagaccttcagaaacgtctggagtcctctgaagcagagcgcaagcagctgcaggtggaattacagagccgacgggctgagctggtgtgtctcaataataccgaaatctctgagaactcctctgacctgtctcagaaacttaaggaaacccagtcaaaatacgaagaagcaatgaaggaggtgctgagcgttcagaagcagatgaagttgggattggtttcaccagaatccatggacaattacagccactttcatgagttacgcgtgactgaggaagaaatcaatgtgctcaagcaagatctccagaatgcacttgaagagagtgagaggaacaaggagaaggtgagggaactcgaagaaaaattggtcgagcgcgagaagggaacagttataaaaccacctgtggaagagtatgaagaaatgaaatcctcatattgctcagtgatcgagaatatgaacaaagaaaaagcctttctgttcgaaaagtaccaggaggcccaagaagaaattatgaaacttaaggatacgctcaaatcgcagatgacccaggaggctagcgacgaagcagaggacatgaaggaggccatgaaccgaatgattgatgagcttaataaacaggtgtcagagctgtcgcagctttacaaagaggcacaggcggagttggaagattatcggaagagaaaaagcctggaagatgtgaccgcggagtacatacataaggcagagcacgaaaagctgatgcagctgactaacgttagccgagctaaggccgaggatgctcttagcgaaatgaagagccagtactccaaggtgcttaacgagcttacccagctgaaacaactggttgatgcccagaaagagaattcagtcagcatcactgaacatctgcaggtgatcaccacgctgcgcacagctgctaaggaaatggaggaaaagatttctaacctaaaagaacacctcgcctctaaagaggtagaggtggccaaactcgaaaagcaattgctcgaagagaaggccgctatgaccgatgccatggtccccaggtcctcctacgagaagttgcagtcttcactcgaatccgaggtaagtgttctggcctccaaactgaaggagtccgtgaaggagaaggaaaaggtacactctgaggtagttcaaatacgctctgaggtatcacaagtcaaacgagagaaggaaaacattcagaccctcctgaagtccaaggaacaggaggtgaacgagctgttacagaagtttcagcaggctcaggaagagctcgctgaaatgaagcggtatgcagaatcgagcagcaagttggaagaggataaagacaagaagatcaacgagatgtcaaaagaggtaaccaagctgaaagaggcactaaattcgctctcacaactttcgtatagcaccagcagcagcaagcggcaaagtcagcaactagaggccctgcagcagcaggtgaagcagcttcagaaccaactcgctgaatgcaagaagcagcatcaggaggttatctccgtctacaggatgcatttgctgtacgctgtgcagggccagatggatgaggacgttcaaaaagttttgaaacagatactcacaatgtgtaagaatcagtcccagaagaaatag

SEQ ID NO: 132292 - DNA, 2943 bp, Artificial Sequence
  Description of Artificial Sequence: Synthetic coding sequence
atgaaaagtttgaaggccaaatttaggaaaagtgatacgaacgagtggaataaaaacgatgaccgccttctgcaggctgttgagaacggcgacgccgaaaaggtggcctcccttttgggcaaaaaaggtgcgtctgccaccaaacatgacagcgaggggaaaaccgcattccacttggccgccgctaaaggccacgtcgagtgccttagagttatgataactcacggtgtggacgtgacagcacaggatacgaccgggcattctgcactgcacctggccgccaagaactcgcatcacgaatgtatccggaagcttcttcagtccaagtgtcccgcagagagtgttgactccagcggtaagacggccttgcactatgcagccgcacagggctgtctccaggctgtgcagatcctctgtgaacataagtcccccataaatttgaaggacctcgacggaaatatacctttgttgttagctgtccagaatgggcactctgaaatctgccattttctactggatcacggcgcagatgtgaactcccgtaacaaatccggaagaacagccctgatgctagcctgcgagataggctcaagtaatgccgtcgaagcccttatcaaaaaaggagccgaccttaacctagtagactctctcgggtacaatgcccttcattactctaagttaagcgagaatgctggtatccagtcacttctgctgtcaaaaatctcccaagacgcagatctgaaaacaccaaccaagcctaagcagcacgaccaggtttccaagataagctctgagcgatccggcactcccaagaaaaggaaggccccgccacccccaattagtcccacacagctgagtgacgtcagctcaccgcggtcgataacgagcacacctctcagcggaaaagagtctgtgttcttcgccgagcccccgttcaaggccgaaatatccagtatccgggagaataaggaccggctgagcgactcaactacaggggcggattctctcctcgacataagctccgaggctgatcaacaggacctgttgtcacttctccaggccaaagtcgctagtttgactcttcacaataaagagctgcaggacaagttgcaggccaagagccctaaggaagcggaggctgatttatcgtttgacagctatcacagtactcagacggaccttggcccatccttagggaagcctggagagaccagcccccccgactctaagtcgtccccctccgtcctgatacactccctgggtaaatctacgactgacaatgatgtccgtattcagcagctgcaggagattctgcaagacctccaaaaacgtctggaaagcagcgaagctgagaggaagcaattgcaggttgaactgcagtcaaggcgtgccgagcttgtgtgcttaaataataccgagatatccgaaaatagcagtgacctgtcccagaagctgaaagagacccagagcaaatatgaggaagcaatgaaggaggtcttgagtgtccagaagcagatgaagctcggacttgtctcaccggaatccatggacaactactcacacttccatgaactacgcgtgaccgaggaggagatcaatgtcctcaagcaggacctgcagaatgccctagaagaatccgaacgcaacaaagagaaggtaagagaactggaagaaaagctcgtggagcgggagaagggaactgtcattaaaccccccgtggaggagtacgaggagatgaaatcttcgtactgcagtgtgatcgaaaatatgaataaggaaaaggctttcttatttgagaagtaccaagaggcccaggaagagataatgaaactgaaggatacgctgaaatcacagatgacccaggaagcctctgatgaagctgaggatatgaaggaagctatgaatcgcatgattgatgagctgaataaacaagtgtctgagctcagccaactgtacaaagaagctcaggccgaactcgaggattatcggaaacgcaaaagtctcgaggacgtgacagcagaatatatccacaaagccgagcacgagaagctcatgcagttgacgaacgtttcccgcgcaaaggcggaagatgccttgagtgagatgaagtcacagtactccaaagttctgaacgaactaacccagttaaaacaactggtggacgctcagaaggagaattccgtttctataaccgaacacctgcaggtgatcactaccctgagaactgccgctaaggaaatggaagagaaaataagtaacttgaaagagcatttagcgtctaaggaggtggaagttgccaaactcgagaagcagcttttggaggaaaaggccgcaatgacggacgctatggtgccacggtcatcctacgaaaagcttcaatccagtctcgaatccgaggtgagtgtgcttgcctccaagctcaaggagtctgtgaaggaaaaagagaaggtgcattctgaggtcgtgcagatcaggagtgaggtgagccaggtgaagagagaaaaagaaaatattcagaccctattgaagagcaaagagcaggaggtgaacgaacttctgcaaaagttccagcaggctcaggaagagctcgcagagatgaaacgatacgccgagtcctctagtaaactggaagaggacaaggacaagaaaatcaatgagatgtcgaaagaggttaccaagttgaaagaggcacttaactccctgtctcagctttcatactcgacctccagttccaaacggcagtcccaacaactggaagcgcttcaacaacaagtaaagcagctccagaaccagctcgccgaatgcaaaaagcagcatcaggaggtgattagcgtatacagaatgcatctgctctacgctgtgcaggggcagatggacgaggatgttcagaaggtgctgaagcagatccttaccatgtgtaaaaaccaaagtcagaagaaatag

SEQ ID NO: 132293 - DNA, 2943 bp, Artificial Sequence
  Description of Artificial Sequence: Synthetic coding sequence
atgaagtccctgaaggcgaagttcagaaaaagcgataccaacgagtggaacaaaaatgacgatagactgctccaagccgtcgaaaacggggacgcagagaaagtcgcctcactgctagggaagaagggtgctagcgccactaagcatgattctgagggcaaaactgcattccacctggcagccgcaaagggccacgttgagtgtctccgagtcatgattacccatggcgtagacgtgacagctcaggataccacgggacatagtgccctccacctggccgctaagaatagccatcacgaatgtatacggaagttattacagagcaagtgccccgccgagtctgttgactcctctgggaaaacggccttgcactacgccgctgctcaaggctgcctgcaggccgtgcaaatcctctgtgaacacaaatcccccatcaacctgaaggacctggatgggaatattcctttgctgctcgccgttcaaaatggacacagcgagatttgtcattttctcctggatcacggcgctgacgttaacagcaggaacaaatcagggcgaaccgctctgatgctggcgtgcgaaatcggcagcagtaacgcggtggaagccctgatcaagaagggagcggacctgaacctagtcgatagcctggggtataacgcactccactactctaaactaagtgagaatgctggcatccagtccctcttgctttccaagatctcccaggacgccgatctcaagacccctactaagccaaaacaacacgatcaagtttccaaaatcagctctgagaggtccggcactcccaagaagagaaaggctcctcctccacctatctccccgacgcagctcagcgacgtgagctcaccacggagtattacttccacccctctctctggtaaagagagcgtcttcttcgccgagcccccattcaaggccgagatctcttccattagagagaacaaggataggctgagcgacagcactacaggggcggacagtctgcttgacattagttccgaggctgaccagcaagacctgttgagccttctgcaagctaaggtggcaagcctgactttacacaataaagagttacaagacaagcttcaagcgaaatccccaaaagaagcagaggccgacctctctttcgactcttaccactcaacccagaccgacctgggtccttcgttaggaaaaccaggcgaaacctcccctcctgacagcaagagctcaccgtctgtccttatccattcccttggaaagtccacgaccgacaacgatgttcgcattcaacagctgcaggaaattttgcaggaccttcagaaacgccttgagagcagtgaagcagaacgaaagcaactgcaggtggagctgcaaagccgcagagctgaactggtttgcctgaacaatactgagatcagcgagaattcatccgatctgagccagaagctgaaagaaactcagtccaagtacgaggaagctatgaaggaggtgctgtccgtgcagaagcagatgaagttaggattggtatcacccgagagcatggataattattcacacttccacgaactgcgagtgacagaggaagaaataaacgttcttaagcaagatctgcagaatgcgcttgaagagagtgagcgtaacaaagaaaaagtccgcgaactggaagagaaacttgtggagagagaaaaggggaccgttatcaagccaccggttgaggagtatgaagagatgaagtcatcttactgcagtgtcattgaaaacatgaataaagagaaagccttcctcttcgagaaatatcaggaagcacaagaagaaatcatgaagctcaaagacaccctcaagtcccaaatgacgcaggaggcctcagacgaagctgaggacatgaaggaggcaatgaatagaatgatagatgaactgaacaaacaggtctcagaattgagccagctgtacaaagaagcccaggccgagctggaggactatcgtaaacggaaaagcctggaagatgtgacagcagaatacatccataaagccgagcacgagaaacttatgcagctaactaacgtgagccgggcaaaggccgaagatgccctcagtgagatgaaaagtcagtacagcaaagttctcaacgagttgacccagttgaaacagcttgtggacgctcagaaggagaacagcgtttctattacggagcatttgcaggtgataacaaccctccgtacagcagccaaggagatggaggaaaagatcagcaacctcaaagaacacctagcttctaaagaagtggaggtggccaagttggaaaagcagctgctggaggaaaaagcagccatgactgatgcaatggtgcccaggtcttcatacgaaaagttacaaagtagtctcgagagcgaggtgtctgtccttgcatccaaactcaaggagtcggtgaaagagaaagagaaagtacattccgaggtggttcagatccggtctgaagtgagccaggttaagcgagaaaaggagaacatccaaacacttctcaaatcaaaggagcaggaggttaacgagttgctgcaaaaattccagcaagctcaggaagagcttgcagaaatgaagcgttatgcggagtctagttcaaaactcgaagaggataaagacaagaaaataaatgaaatgtcaaaggaggtcactaaacttaaagaagcactcaacagcctctcccagctctcatactccacctcaagctcgaaacggcagagtcaacaactggaagctctgcaacagcaggtaaaacaactacagaatcagttagcagaatgcaagaaacagcaccaagaagtgataagcgtctaccgaatgcatcttctgtacgctgtacaggggcagatggacgaagatgtgcagaaggtcctcaagcaaatcctaactatgtgcaagaaccagtctcagaaaaagtag

SEQ ID NO: 132294 - DNA, 345 bp, Artificial Sequence
  Description of Artificial Sequence: Synthetic coding sequence
atgaagtccctcaaagctaaatttcgaaagtctgataccaatgagtggaacaaaaacgatgaccgcctccttcaagcagtggagaatggcgatgccgagaaggtagcttcgctcttaggcaagaagggggcttcagcaacaaaacatgactccgaggggaagacagcgtttcacttggccgctgctaagggtcacgtagaatgcctccgtgtgatgataacacatggcgtcgatgtcactgctcaggacactaccggccactcagcactccatctggcagcgaagaattcacaccacgaatgtattcggaagcttcttcagtctaagtgcccagccgagagttag

SEQ ID NO: 132295 - DNA, 2919 bp, Artificial Sequence
  Description of Artificial Sequence: Synthetic coding sequence
atggaggctaagactaatgaatggaacaagaacgacgatcggctgttacaggctgtggaaaatggtgatgccgagaaggtggctagcttgctgggaaagaagggggcaagcgcgactaagcacgactccgaagggaagactgccttccacctggctgcagccaaaggccacgttgaatgcttgcgcgtcatgatcactcatggcgtcgatgttacagctcaggatacaaccggacacagtgcacttcatctagccgccaaaaattcccaccatgaatgtattcggaaactgctacaatctaagtgtcctgcagaatccgtcgacagcagcggtaaaaccgccttgcactacgcagccgctcagggctgtctccaagctgtgcagatcctctgtgaacacaagagtcccattaacctgaaggatctcgacggcaatattcctttgctgttggcggtgcagaatggtcactctgagatctgccacttcctactcgaccacggggctgatgtgaattccagaaataaatccggtcgaaccgcgctcatgttagcatgcgaaattggtagttctaatgcggtggaggcattgatcaagaaaggggccgatcttaacctggttgactctttaggttataatgcactgcactactcaaagctgtcagagaacgccggcattcagtccctgttgctgagtaagatcagccaggatgctgatttgaaaaccccgaccaaacccaaacaacacgatcaggtgtcgaagatttcatccgagcgctccggaactccaaagaaacgtaaggcacccccccctcccattagccccactcagctcagcgacgttagcagcccccgttcgatcacgtctacccccctttcaggcaaggaatccgtattctttgccgaaccaccttttaaagcagaaatttctagtataagagagaataaagaccgcttatccgattctacaactggtgcggattcactgttagacatatcttctgaggcggatcagcaagacttgctatctctcctccaggctaaagtggcatcattaacgcttcacaataaagaattgcaggacaaactgcaagccaaatcaccgaaagaggctgaggccgatctgtcattcgatagttatcactctacccaaaccgacctgggtccatctctgggtaagcctggggaaacatcgcctcctgactccaaatcgagtccctctgttctgattcactccttgggaaagagcacgacagataatgacgtcagaattcaacagttgcaggaaatcctgcaagatcttcaaaagcgccttgaaagttccgaggcagagcgaaaacagctgcaagtggaactccagagcaggcgtgccgaactcgtgtgccttaacaacaccgagattagcgagaacagttcagacctgagtcaaaagttaaaggaaactcagtccaagtacgaagaggccatgaaggaagtgctatccgtacagaagcagatgaagctgggcctggtgagtcctgaaagtatggataattatagccacttccatgagctgcgcgtgacagaggaggaaatcaacgtattgaagcaggatctccagaatgctctcgaagaaagcgagagaaacaaagagaaggtcagggagctggaagagaagctcgtagaacgcgagaagggaacagtaataaaaccacccgtggaagagtacgaagaaatgaagagcagctactgcagcgtgatcgagaacatgaataaggaaaaggcgttcctcttcgaaaagtaccaagaggcccaggaagagataatgaagctgaaggacacactgaaaagccaaatgacacaggaggcctctgacgaagcggaagacatgaaggaggcgatgaaccgcatgatcgatgagttaaacaagcaggtttccgagctgtcccagctgtacaaagaagctcaagctgagctggaagattaccggaagcgaaaatccctagaagacgttaccgccgagtacattcacaaggcagagcacgaaaagctgatgcagctgaccaatgtcagtagagcaaaggccgaagatgctctgtcagagatgaagtcccagtattcgaaagtactgaacgagctcacccaacttaaacagctcgtggatgcccaaaaggaaaactctgtctccatcacggagcacctgcaggtgatcaccaccctgaggacagcggctaaggaaatggaagagaaaatatccaatttgaaagagcaccttgctagtaaggaggtcgaagtcgccaagctggaaaaacagctgttagaggagaaagccgctatgaccgatgcaatggtgccgcgttcttcctacgagaaactgcagtccagcctcgagagcgaggtgtctgtgctggcatccaaactcaaggaatcagtcaaggaaaaggagaaggtacactcggaggtggtgcagattcggtccgaggtgtcccaggtgaaacgtgaaaaggaaaatattcaaacactgctgaagtccaaggagcaggaggtaaacgaactgctgcagaagttccagcaggcccaggaggagctggcagaaatgaagcgttatgcagagagttcctcaaaactggaagaggacaaggacaagaagattaacgagatgtccaaggaagtgaccaagctcaaagaggccctgaattccctgtcccaacttagctattctaccagctcaagtaagcgtcagtcccagcaactggaggctctgcagcagcaggtcaagcaactacagaatcaattggctgaatgtaaaaaacagcaccaggaggtcattagcgtctatagaatgcacctgctgtatgccgtgcaggggcagatggatgaagacgttcagaaggtgctgaagcagattctgaccatgtgcaaaaaccagagtcagaaaaagtag

SEQ ID NO: 132296 - DNA, 378 bp, Artificial Sequence
  Description of Artificial Sequence: Synthetic coding sequence
atgaagagcctgaaagccaagttccgaaaatccgatactaatgagtggaataaaaacgacgaccggctactccaggccgtggagaacggggatgccgagaaggtggcctcccttctcggaaagaaaggagccagcgccaccaagcacgacagcgaggggaagactgcttttcaccttgcggcagctaagggacacgtggagtgcctaagagtgatgatcacacatggtgtggacgtaaccgcgcaggacaccacaggtcatagcgccctacacttggcagctaagaattcacaccatgaatgtatccggaaactactgcagtcgaaatgccctgcagagtcagtagacagtagcggcaagaccgctctgcactattag

SEQ ID NO: 132297 - DNA, 324 bp, Artificial Sequence
  Description of Artificial Sequence: Synthetic coding sequence
atgaagtcgctcaaggctaagttccgcaaatccgacactaatgagtggaacaaaaacgatgacaggctgctgcaggcggtagaaaacggcgacgcagaaaaggtagccagtctgctgggtaaaaaaggcgctagtgctaccaagcatgatagtgagggcaagacagcgttccatctggcagccgcaaagggacacgtcgaatgtctgcgagttatgatcacccacggagtggacgtcaccgcacaagataccaccggccactctgcacttcacctagctgccaaaaacagccaccatgagtgtattcgtaaactgctgcagtag

SEQ ID NO: 132298 - DNA, 453 bp, Artificial Sequence
  Description of Artificial Sequence: Synthetic coding sequence
atgaagagtctgaaggccaaattccgcaaatccgatacaaacgagtggaacaaaaatgacgacagactgcttcaagccgttgaaaatggggatgccgagaaagtcgccagtctgctcggtaagaaaggcgcttctgccacgaaacacgacagcgaaggcaagacagcctttcatttggcggcggccaaggggcatgtcgagtgtctgagagtcatgatcacccatggggtggacgtcactgctcaggacacaacagggcacagcgctctacacctggctgctaagaatagtcaccacgaatgtatccggaaactcctccaaagcaaatgtcctgcggagtccgtggattcgtccggcaagacggcgctgcactacgccgccgcccagggctgcctgcaagccgttcagatcctctgcgaacataagagcccaataaacttgaaagatttgtag

SEQ ID NO: 132299 - DNA, 381 bp, Artificial Sequence
  Description of Artificial Sequence: Synthetic coding sequence
atgaagtcgctgaaagctaagtttagaaagtccgatacaaacgagtggaataagaatgacgaccgccttctccaagccgtcgaaaacggcgacgctgaaaaggtagcaagcctgctgggtaagaagggtgcttccgccacgaagcacgatagcgagggcaagaccgcatttcacctggccgcggcgaaggggcatgtagaatgtctgagagtgatgattacccacggggtcgacgttactgcccaggacacaacaggccactcagctctgcacttagccgcgaagaatagtcatcacgaatgtatcaggaagctgctgcagtctaagtgtcctgccgagtcagtagactcatcagggaaaaccgctctgcactatgcatag

SEQ ID NO: 132300 - DNA, 315 bp, Artificial Sequence
  Description of Artificial Sequence: Synthetic coding sequence
atgaagagcttgaaagccaaattcagaaagtcggataccaatgagtggaacaagaacgacgaccgccttctccaggccgtggaaaacggcgatgccgaaaaggtcgcgagtctgcttgggaaaaaaggcgcctcggcaaccaagcacgattcagagggtaagacggcctttcatcttgccgcggccaaaggacatgtcgaatgccttagagtgatgatcacccatggcgtagatgtgacggcacaagacacaactggccacagcgctctgcacctggccgccaagaatagtcaccacgagtgtatcagaaagtag

SEQ ID NO: 132301 - DNA, 420 bp, Artificial Sequence
  Description of Artificial Sequence: Synthetic coding sequence
atgaagagcttaaaggccaagttccggaagagtgacacgaatgagtggaacaagaatgacgatcgcttactgcaggccgtagagaatggggacgctgaaaaagtggctagtctgctcgggaaaaaaggcgcttctgccacaaagcatgacagtgaaggaaagaccgccttccacttagcagccgctaagggccatgtggaatgccttagggttatgattacacacggagtggacgtcacagcacaagacaccaccggacactctgcattacatctcgcagccaaaaatagccaccatgagtgcattagaaagctgttgcagagcaaatgccctgcggaaagtgtggacagtagcgggaaaaccgctctgcattatgccgcggcacagggttgcctgcaagccgttcagatattgtgctag

SEQ ID NO: 132302 - DNA, 381 bp, Artificial Sequence
  Description of Artificial Sequence: Synthetic coding sequence
atgaaatctcttaaggctaaatttagaaagtctgataccaacgaatggaacaaaaacgatgacagactgttgcaggcggtggaaaacggagatgccgagaaggtcgcgagcctacttggcaaaaaaggcgcttcagccactaagcatgattctgagggcaagaccgcatttcacctggctgctgcaaagggccatgtcgaatgcctgcgagttatgattacgcatggtgtggatgtgactgcccaggacactactggacattcagctctgcatctggctgccaagaacagccatcatgagtgcattcggaagctgctccagagtaaatgccctgccgaaagtgtcgacagctccgggaaaaccgccttgcactatgcatag

SEQ ID NO: 132303 - DNA, 2952 bp, Artificial Sequence
  Description of Artificial Sequence: Synthetic coding sequence
atgcagcccacatatctgccttggctttctgctaaagagaagaagacgaatgagtggaacaagaacgatgacagactcctgcaggcggtcgaaaatggggatgcggagaaggtggcctcgctgctgggaaagaagggcgcctcagctacaaagcacgacagcgagggaaagacagcatttcacctggcagccgctaaggggcacgtggagtgtcttcgggttatgattactcacggcgtggatgtcacagcccaggacacgaccggccattcggcgctgcacttggccgccaagaacagccatcacgagtgcatcagaaagctgctacagagcaaatgtcccgccgaatctgtggactctagtggtaagactgcactgcactatgccgcggcccagggatgcctccaggctgttcagatcttgtgcgagcacaaatccccaatcaatcttaaagatttagacgggaacatccccctcctgttggccgtacagaacgggcatagcgagatttgccactttttactggatcacggagctgacgtcaactctcgtaacaaaagcggaaggactgccctcatgctcgcctgtgagattggctcctctaatgctgtggaagcccttatcaaaaagggagccgacctgaacctcgttgactctctcggatataatgccctccattactccaagctaagtgaaaacgccggaattcaatcactcctgctctccaaaatctcgcaggacgcggacctgaagacacctacaaagccaaagcagcacgatcaggtcagcaagattagtagcgaacgtagcggaacccctaaaaaacgcaaagcaccaccaccccctatatcaccaacacagctatctgatgtgtccagcccacgatcgattactagcacaccattgtccggcaaggaatctgttttcttcgccgagccaccttttaaggcagagatctctagcatccgagagaacaaggatcgactcagtgactccactacaggcgccgactccctactggacattagcagtgaagctgatcagcaggatctactatctctgcttcaagctaaagtcgcaagcctgacactccataacaaggaactgcaggacaaactgcaggcgaaaagccctaaagaggcagaagcagatctttctttcgattcctatcattcaacgcaaacagatctcggcccatcactcgggaagccaggcgaaacctctcctccagattcaaagagcagtccctcagtcctcattcattcactgggcaaatccactaccgacaacgacgtgcggattcagcagctgcaggagatcctccaagacctacagaagcggctggaatcttctgaggccgaaagaaagcagctgcaggtagaactccagtcccgccgtgcagaattggtctgccttaacaacaccgagatttcagaaaacagcagtgacctgagtcagaaactcaaggagacgcagtctaagtatgaggaagctatgaaggaagttcttagtgttcaaaaacaaatgaagctggggctggtaagccctgagtcaatggacaattattcacactttcacgagctccgcgtaaccgaagaggagattaacgtgctgaaacaggatctgcaaaacgcgctggaagagtctgagcgaaataaagaaaaggttcgagagttggaagaaaagcttgtagagagagagaaaggaaccgtaatcaaacccccggtggaggagtatgaggaaatgaagtcctcctattgctcagtaatcgagaatatgaacaaagagaaggcttttttgttcgagaaatatcaggaagcccaggaggagatcatgaaactgaaggacaccctgaaatctcagatgactcaggaggcttcggacgaagccgaggacatgaaagaggcaatgaacagaatgatcgacgagctaaacaagcaggtgtctgagttgtcccaattgtacaaagaagcgcaagccgagttggaagattatcgcaaacgtaagtctctggaggatgtcacggctgagtatattcacaaggctgagcatgagaagctgatgcaactcaccaatgttagcagggcaaaagccgaggacgctctcagcgaaatgaagagccagtatagcaaggtcttgaacgagttgactcaactgaagcagcttgttgacgcccaaaaggaaaacagtgttagtatcacagaacacctccaggtgattaccaccctaagaacagccgccaaggagatggaggaaaagatcagcaatctgaaggagcacctggcctcaaaagaggtggaggtcgccaaactggagaaacagctgcttgaggagaaggccgcaatgacagacgcgatggtgccccgcagctcctacgagaaattacagtcttcactagaaagcgaggtgtcggtccttgcatctaagctcaaagagagtgtcaaagagaaggaaaaggttcattcagaagtcgtgcaaatcagatcagaagttagccaggttaaaagggaaaaggagaacatccagactctacttaagtctaaagagcaggaggtgaacgagctcctccaaaagtttcagcaggcccaggaagaattagcagagatgaaacggtacgcagagtcctcttccaaattagaagaagataaagacaagaagattaacgagatgtctaaagaagtgacaaagctgaaagaggctctcaactctctatcccaattgagttacagcactagtagctccaagagacagagccagcagctggaagcgttgcagcaacaggtcaaacagctgcagaatcagctcgcagaatgcaaaaaacagcaccaagaggtgatctccgtatataggatgcacctgctttatgccgtgcaggggcagatggacgaagatgtgcagaaggtccttaagcagatcctgaccatgtgcaagaaccagtcacagaaaaagtag

SEQ ID NO: 132304 - DNA, 2856 bp, Artificial Sequence
  Description of Artificial Sequence: Synthetic coding sequence
atgaagagtctgaaggccaagttccgtaagtccgacacaaatgaatggaacaagaatgacgaccggttacttcaagccgtagaaaatggggacgcggagaaagtagccagtctcttggggaagaagggcgcaagtgcgaccaagcatgactccgagggaaagaccgctttccaccttgcggccgccaaagggcacgtggaatgcctgagggtgatgattacacatggggtggacgttaccgctcaggataccactggccactctgccctccatctggcggcaaagaattcccaccatgagtgtatcagaaagttgttgcaatcaaaatgcccagccgagtcagtcgactccagcggaaagaccgccctacattatgctgccgcccaaggctgccttcaggccgtgcaaattttatgcgagcataagtctcctataaatctcaaagaccttgatgggaatatacctcttctactggctgtacaaaatggacactccgaaatatgccattttctgttagaccacggcgcagacgtgaattctagaaataaaagcggtcgcactgccctaatgttggcatgtgaaatcggctccagcaacgccgtcgaggccctaataaagaagggcgccgaccttaacctcgttgacagcctcggctacaacgccctgcattattcgaagctttcagagaacgctggcatccaatccctgctgctgtcgaaaatcagccaagatgccgacctgaaaactccgaccaagccgaagcagctgtccgatgtatcatcccctaggagtatcacgtctacacccttatccggaaaagaatcagtattctttgccgagccgccatttaaggcggagatttcttcaatcagggagaacaaggaccggctctccgactcaacgacaggtgcagactcactgctggacattagctccgaggccgatcagcaggatctcctttcactgctgcaggcaaaagtggcctccctgaccctgcacaacaaggaattgcaggataaactccaggcgaaaagcccaaaagaagccgaagccgaccttagcttcgattcttatcattccacccagacagatctgggtccaagtctggggaaacccggggagacatccccacccgattccaaatcttcaccttcggtgctcatacacagcttaggaaaaagtaccactgacaacgacgtacggatccaacagctacaagaaattctccaagacctgcagaagagactcgaatctagcgaagcggaaaggaaacaactgcaggtggaattacaatcacgccgagccgagcttgtctgtctgaacaatacagagatatccgagaactcaagcgatctgtctcagaagctgaaggagacacagagtaagtacgaggaggctatgaaggaagtgctctccgtgcagaagcagatgaagctgggtctggttagcccagaatcgatggataactattcacatttccacgagctgcgggttactgaggaagaaattaatgtcttgaaacaagaccttcagaacgccctggaggagagtgagaggaacaaggaaaaggtgcgagagctggaggagaagttggttgaaagggagaaaggtaccgttattaagcctcctgtagaggagtacgaagagatgaaaagcagctattgtagcgtcatcgagaatatgaataaggagaaggcattcctgtttgaaaaatatcaagaagcccaggaagagattatgaagcttaaagataccttaaagagccagatgacccaggaggcaagtgatgaggccgaagacatgaaggaggcgatgaacagaatgatagacgaactgaacaaacaggtctctgagctttcccagctgtacaaggaggcacaagccgagctggaggactatcgcaagagaaaaagcctcgaggacgttaccgccgaatatattcataaagccgagcacgagaaactcatgcaactcactaatgtgtctcgggccaaagccgaggatgcgttaagcgagatgaagtctcagtattcgaaggtgctcaatgaactgacccagcttaaacagcttgtggacgctcagaaggagaacagtgtctctattaccgagcatctgcaggttataacaacactgagaacagcagccaaggagatggaagaaaagatatctaacttgaaagagcacctggcctcaaaagaagtcgaggtggctaagctggaaaaacagcttttggaggagaaggctgctatgacggacgcaatggtacctcggtcgtcctacgaaaagctccagagcagtttggaatctgaagtctctgtactggccagtaaactgaaggaaagcgtgaaagagaaggaaaaagttcatagcgaggtcgtgcagattagaagcgaggtctcccaggtgaagagagagaaagaaaatattcagactctactgaagagcaaggaacaggaggtgaatgaactgctgcaaaagtttcagcaggcccaggaggaactggccgaaatgaaacgatacgcagagtcttcatcgaaactcgaagaggataaggataaaaagatcaatgaaatgagcaaagaggtgactaagttgaaagaggccctcaactcactaagccagctctcttattcaacctccagctcgaagcgccagtcgcagcagcttgaggctcttcagcagcaggttaaacaactgcagaatcagcttgccgaatgtaaaaaacagcatcaggaagtgatcagcgtatacagaatgcatctgctgtatgctgtgcagggccagatggacgaggacgtccagaaagtgctgaagcagatcctgaccatgtgcaaaaaccagagtcagaagaaatag

SEQ ID NO: 132305 - DNA, 1593 bp, Artificial Sequence
  Description of Artificial Sequence: Synthetic coding sequence
atggacgatctccagagtcaaaacctttccatggacatgacggatagcccaccagcactggcgaacaaccgattagaaaacgggatggctcagcttataactactgaagcctggaatattaactctactgacctcgtgaagaaggctctcgttactgtccccgcgccctctatccttaatccacccgccgagagtcagtcgggcatggccctgaaagtagctgctacagtgctgcagcccctgtgtctcggtgagagcccagtcgttatgccaattcatatgcaggttgaaggcagctcagctccggagctgaatcctaacgggaatgctacttacgtgatgactacacaggggcccgtgcagctgccggttgtgctggaacaacacgtgttccaacacttaaacagcccgttagtgctcccacaggaagccccctgctcttcatctacaatacacaacaacctcttccagggggcggaagaccccgaggctcagcctcagctgcttgacctcaggatcccatctcagccccaggaacccactctgcccttcgaggccgtgctgcagaacctcttcccttcacagggcacgctgggaccaccaccatgccagcctccacctgggtacgctccagtgcccccacagcctttcagctccccattatctccactagttccccctgccactctgctggtgccctaccccgtgatcgttcccctccccgtaccagtgcccatccccatacctatccctatgccgcagagctccgaatccaagttttcctcctcctttcctaagccccccagttctttcggcctccacccatttaaaggcacccaaacccctttggaaaaggacgaactgaagccttttgacatcttgcagcccaaggagtattttcaactgagtcggcacacagtgataaagatggggtctgagaacgaagccctggacctctcaatgaagtctgtgccctggcttaaagcaggagaagtgtctcccccaattttccaggaggacgccgcacttgatttatcagtcgcagcgcacaggaagtctgaacctcctcctgagaccctgtacgattcgggggctagcgtggattctagcggtcataccgtgatggaaaagctgcccagtggcatggaaatcagttttgcccccgccacaagccacgaggctccagcaatgatggatagccacatttccagctcagacgccgccactgagatgctgtcacaaccaaaccatcctagtggggaggtaaaagccgaaaacaacatcgagatggtgggggagtctcaggcagccaaagtgatagtttccgtcgaggatgcagtccccacaattttctgcgggaagattaagggcctgtctggggtgtctacaaagaacttcagctttaagagagaggatagtgtgctccaggggtacgatattaactcccaaggggaagagagcatgggcaatgcagaacctctccgcaaacccatcaagaatcggtcaattaaattaaagaaggttaactcgcaagaaattcatatgctgcctatcaagaagcagaggcttgcgaccttctttccaaggaagtag

SEQ ID NO: 132306 - DNA, 1593 bp, Artificial Sequence
  Description of Artificial Sequence: Synthetic coding sequence
atggacgatctccaaagccagaacctgtcaatggatatgaccgattccccaccagctctggctaataaccgcctcgaaaatgggatggcccagttaattacaaccgaagcatggaatattaactcaacagacctggttaaaaaggcactcgtgactgtaccggcaccatcaatcctcaatccgccagctgagagtcagtctggaatggccctgaaggtggccgcgactgtgctacaaccgctctgcctgggtgaatctcctgtggtcatgcccattcacatgcaggtggaaggctctagcgcgccggaacttaatcctaatggtaatgcaacctacgtcatgactacgcagggtcctgtccaactgccggtagtgctcgagcagcatgtctttcaacaccttaacagtccgctggtcctgcctcaggaggccccttgctcatccagcaccatccacaataatctgttccagggggccgaagaccctgaagcacaaccacaacttctcgatctcagaattcccagccagcctcaggaaccaactctccccttcgaggccgtgctacagaacctgttcccaagccagggtacactggggcccccgccctgtcagccacctcctggttatgcgcctgtccctcctcagcctttctcttctccgctctcacccctggtgcccccagccaccctgctggtgccgtacccagtgattgtcccattgcccgtgccggttccgattcctatccctattcccatgcctcagagtagcgaaagcaagttctccagctccttccccaaacctccaagctctttcggtctgcaccctttcaagggcactcagactccacttgagaaagatgagctcaaaccatttgacattctgcagcccaaagaatactttcaactgtctagacatacagtaataaagatgggctctgaaaacgaggcactggacttgtccatgaagtccgtaccgtggttaaaggccggggaggtcagtcctcccattttccaagaggacgcagcgctcgacctgtccgtcgctgctcatcggaagagtgagccccctcctgaaaccctttacgattcaggcgcgtcagttgacagctccggccacaccgttatggagaaactgccatcaggtatggaaatctctttcgcccctgcgacaagccacgaggccccagcgatgatggattcccatataagctcttcagacgctgccacagaaatgctcagtcagcctaaccacccctctggggaagtcaaggctgaaaacaatattgaaatggtgggcgaatctcaagccgctaaagtaattgtttcagtcgaggacgccgtgcccaccattttctgcggcaaaatcaagggcctgagtggcgtgtctactaaaaatttttcattcaagcgcgaggacagcgtgctgcaaggctacgacataaatagccaaggcgaagagagcatgggaaacgcagaacccttgcgaaagccaataaagaaccggagtatcaaactgaagaaagtgaactcacaggaaatacatatgctccctattaaaaagcagaggcttgctacctttttcccccgcaaatag

SEQ ID NO: 132307 - DNA, 1443 bp, Artificial Sequence
  Description of Artificial Sequence: Synthetic coding sequence
atggacgatctacagtcccaaaacctgtctatggacatgacagacagtccgcctgcactggctaataaccgcttagagaatggcatggcccaactcatcacaactgaggcttggaatataaacagcactgacttagtggaaggatcttccgctcctgaactaaacccgaacggcaatgccacgtacgtgatgaccactcaggggcccgtgcagcttcctgtggtgcttgagcagcacgtcttccagcatctgaatagccctctggtcctgcctcaagaggccccctgcagttcctccaccatacacaacaacttgtttcagggagccgaagatcctgaggcccagccacaattacttgacctcagaatcccctcacagccgcaagaacccacactgccttttgaagcagtcctgcaaaacctattcccgagccaggggactttgggtcctcctccatgtcaaccgcctccaggctacgcaccagtgccgccgcagccattttcctccccactttcccccctcgtaccgcctgcaacgttattagtgccatacccagtgattgtacccttgcccgtgcccgtgcctatccccatcccaatacccatgccacagtcttcggaatctaaattctcttcgtcctttcctaagccacctagttcttttggtttgcacccttttaaggggacccagaccccattagagaaggatgagctcaaaccatttgacatcctacagcccaaggagtacttccagctgagccgtcataccgtcataaagatgggttccgaaaatgaggcactagatctaagcatgaaaagcgttccttggctcaaggctggcgaggtcagtccacccattttccaagaggacgcagcactggatttgtccgtcgctgcacaccgaaaaagcgagccacctccagagactctgtatgatagcggcgcaagcgttgactcttccgggcacactgtcatggaaaagctgccctccggtatggaaattagcttcgcacccgccacaagccacgaagcccccgccatgatggactcccacatcagctcatcggatgctgccactgaaatgctttcacagcccaatcatcctagcggcgaggtgaaagccgagaacaacattgagatggtcggcgaatcccaggctgccaaagttatcgtaagcgtggaggatgcagtgcctacaatcttctgtggcaaaatcaagggactgtctggggtgtctacaaagaacttctcgtttaagcgagaggacagcgtgctgcagggctacgatatcaacagccagggcgaggaaagcatggggaacgccgaacccctccgcaagccgataaaaaataggagtataaaactgaagaaggtgaacagccaagagatccatatgctgccgataaagaaacagcgactcgctacttttttcccccgaaagtag

SEQ ID NO: 132308 - DNA, 1593 bp, Artificial Sequence
  Description of Artificial Sequence: Synthetic coding sequence
atggacgatcttcagtcccagaatttgagcatggatatgaccgacagccctccggcactcgcaaacaaccggcttgaaaatggcatggcacagctgatcaccactgaagcttggaatatcaactccacagacctcgtaaagaaggccctggtgacagtccctgcccctagtattcttaacccacctgccgaaagtcagagcggcatggccctgaaggttgctgccacagtgctccagcccctctgcttgggggagtccccagtcgtgatgcctattcacatgcaagtggagggctcgtctgcgcccgaactgaacccaaatggtaatgccacctatgttatgacaacccagggacctgtgcaattgccagtcgtgctggaacagcacgtcttccagcatctaaattcgccacttgtcttgccacaggaagcaccgtgctctagctcgactattcataacaacctctttcaaggagctgaggacccagaagcgcagcctcagctactggaccttagaatcccaagccagcctcaggagcctacgttgcccttcgaagctgtcctgcagaacctgtttccaagccaaggcacactgggtccgccaccttgccagcctcctcctggctacgctcctgtacccccacaacccttctcctcacccctatcccccctggtgccaccggcgaccctcctggtcccctaccctgtgatcgtgccactgcccgtgcccgtccctatcccgatcccaatccctatgccgcagtcatccgaatctaagttctctagttcatttcccaaacccccatccagttttggtctacacccttttaaaggtacccaaaccccgctagagaaggacgagctaaagccattcgatattctccaacccaaggagtacttccaactctccaggcatacagttattaaaatgggctccgaaaatgaggctcttgatttgtctatgaagtccgtgccatggttgaaggccggcgaggtatcaccccctattttccaggaagacgctgcgcttgacctctccgtggccgctcaccgcaagagcgagccaccacccgaaacgctgtacgactccggcgcctccgtcgacagtagcggtcatacagttatggagaagttgccaagcgggatggagatctccttcgcacctgctacgagccacgaggcaccagcaatgatggacagccacatatcttccagcgacgctgctacagagatgctctctcagcccaaccatcccagtggagaggtcaaagctgagaacaatatcgagatggtgggagagagccaggcggctaaagtgatcgtctcagtggaggatgccgtccctacaattttctgcggaaaaataaaagggctgtccggcgtctcaacaaagaactttagcttcaaaagggaggattctgtgctccaggggtatgatataaatagccaaggagaggagtctatgggcaatgccgagccattgcggaaaccaataaaaaataggtctataaaactcaagaaggtcaactcacaggaaattcacatgctgcctataaaaaaacagagattagccaccttctttcctcggaagtag

SEQ ID NO: 132309 - DNA, 1593 bp, Artificial Sequence
  Description of Artificial Sequence: Synthetic coding sequence
atggatgatctccagagccagaatttgtccatggatatgactgattctccaccggccctggctaacaacagactggagaacggtatggctcagttgatcaccaccgaggcctggaacattaattctaccgacctggtgaagaaggcgctggtaacagtgcctgcaccctcaattcttaaccccccggccgagagtcagagcggaatggcactcaaggttgccgcgacagtcttacagccgctgtgccttggtgagagcccagtcgtgatgccgatacatatgcaggtggagggaagctctgcacccgagctcaatccaaatggcaacgccacgtatgtcatgacaacacaaggacccgtgcagctgcccgtggtgctagagcagcacgtattccaacacttgaattcccctctggtgctaccgcaggaggcaccctgctcgtctagtacgatacataacaatctgttccagggggctgaggatcctgaagcacagccgcagctgcttgatctccgaatcccttcgcagccccaggaaccaacactgccatttgaggcagtgttgcagaatctctttccaagtcaggggactctcggacccccaccttgccaaccccctcccggctatgcacctgtgcccccacagccattctcctctccactgagccctctggttcctcccgccactctgctggttccgtatcctgtcatcgtccccttacctgtccctgttcccatccctattcccatcccaatgcctcagtcatccgagtctaaattctcaagctcttttcctaaaccgcctagctcattcggcctgcatccctttaagggaactcagaccccattggaaaaagacgagcttaaacctttcgatattttgcagcccaaagaatacttccaactttctcgtcacactgtaatcaagatgggctcggagaacgaagccctggatctatctatgaagagcgtcccttggctgaaggcaggcgaagtgtctccccctatcttccaggaagacgctgccctggatctcagtgtggccgcccaccggaagagtgagcccccacccgaaaccctctacgacagcggggcttccgtggattcatcaggacataccgtgatggagaagctgccatcgggaatggagatcagctttgctccagcaacctcacatgaggcgcctgcgatgatggactcacacatttcatcttctgatgctgccaccgagatgcttagccagcccaaccatcctagcggggaagtcaaagcagagaacaacatagagatggtgggcgaaagtcaagcagccaaggtcatcgtatcggtggaggatgcagtccccaccatattttgcgggaagatcaaaggtttaagcggcgtctctactaaaaatttctccttcaagagggaggatagtgttctacagggttatgatatcaattcacagggtgaagagagtatgggaaacgcagaaccgctgagaaaaccgatcaaaaacagaagtatcaaattgaaaaaagtgaactcacaggagatacacatgttgccaattaaaaagcaaaggctcgccacattcttcccacgtaaatag

SEQ ID NO: 132310 - DNA, 885 bp, Artificial Sequence
  Description of Artificial Sequence: Synthetic coding sequence
atgcagccacgacggcagagactgccagccccctggagcggaccccgggggccccggccaacagctcctctgttagccctactgcttctcctggctcctgtggcagcccccgcaggatcgggcgaccccgatgacccaggtcagccccaggacgcaggagtaccccgccggctgttacagcaagccgctagagcggctctgcacttctttaattttcgctctggctccccttctgccctgagagtccttgccgaggttcaggaagggcgggcctggatcaacccaaaggagggttgtaaggtccatgtcgtgttttcaactgaaaggtataaccccgagtctttactgcaggagggggaggggagattaggtaaatgtagtgcacgagtgttctttaagaaccagaaaccaagacctacaattaacgtgacctgtacacgattgattgaaaaaaagaagcgacagcaggaggattatctgctctacaaacagatgaagcagttgaagaatcctctcgaaatcgtctccatacccgacaaccacggacatatcgaccctagcctacggctcatctgggatttagccttccttggtagcagctacgtcatgtgggagatgacgacacaggtgtcccattattatctggcacagctgacatcagtgcggcaatggaagaccaatgacgacaccattgactttgactacaccgtcctattacacgagctgtctacacaggagatcattccctgtcgtatccacctggtctggtatcctggtaagccgcttaaggtgaagtaccactgccaggaactgcagaccccagaagaggcatcaggtacggaagagggttcagctgtggtgcctacggagttgtccaacttctag

SEQ ID NO: 132311 - DNA, 687 bp, Artificial Sequence
  Description of Artificial Sequence: Synthetic coding sequence
atgcagccacgcaggcaacggctgcccgccccctggtctggacctcgaggtcctcggcccaccgcccccttgttggccctcctcctcctattagctcccgtggccgcgcccgccggatctggagacccagacgacccaggccaaccgcaggatgccggggtcccccgacggttactccagcaggctgcaagagccgctctgcacttctttaatttccggtctggcagcccatctgctttaagagtgctcgccgaggtccaggaagggagggcttggattaatccgaaggaaggctgcaaagttcacgtggtcttttctaccgagcggtacaatccagagtccctgttacaggaaggagagggacgcctcggtaagtgttcagcgagggtgttctttaaaaaccagaagccccgtcccaccattaatgtgacttgcacaagactcatagagaagaagaagcgtcagcaggaagactacttgctgtacaagcagatgaagcaacttaagaatcctctcgagatcgtctcaattcctgacaaccacggacatattgacccctcactgcgcctcatttgggatctcgcgtttctcggctctagttacgtcatgtgggagatgacaacccaagtgagccactactacttggcccagttaacatcagtgaggcagtgggtgcgtaagacttag

SEQ ID NO: 132312 - DNA, 1008 bp, Artificial Sequence
  Description of Artificial Sequence: Synthetic coding sequence
atggtcagacgggataggctgcgaagaatgcgggagtggtgggtgcaggtgggtctgctcgctgtccctcttttggccgcgtacctgcacatcccccctccacagctctcaccggctcttcatagctggaagtcttccggaaagttttttacttacaaaggattgcggattttctatcaggatagcgttggggtcgtaggcagccctgagattgtggttctcctgcacggctttcccacctccagctacgactggtacaaaatctgggaggggctgactctgcggtttcatcgtgtcatcgcactagattttctgggcttcggcttttcggacaaaccgagacctcaccactactctattttcgaacaggcatcgattgtggaagctcttctgcggcatctggggctccaaaaccgacgcattaacctgctaagtcatgactacggagatatcgtggcccaggagcttctctatcggtacaagcagaatcgcagcggaagattgacaattaagagcctatgtttatccaatggaggcatctttcccgaaacacatcgtccgttgttgctccagaagctccttaaggacggcggggtcctgtcacccatcctgacccgactcatgaacttctttgtattcagcagaggattaacaccggtgtttggtccctacactcgtccctcggaatccgaactgtgggatatgtgggcaggcattcgtaataatgatggcaacctggtgatcgatagtttgttacagtacataaatcagagaaagaaattcaggagacgttgggtgggggcactcgcatcagtgaccatccccattcactttatctacgggcctttggacccagtgaatccgtatcccgagtttctagagctctatagaaaaactcttccacggtccaccgtaagcatcttggatgaccacatttcccattaccctcaattagaggatcccatgggttttctgaatgcctacatgggttttattaactccttttag

SEQ ID NO: 132313 - DNA, 492 bp, Artificial Sequence
  Description of Artificial Sequence: Synthetic coding sequence
atgagacggttgttaattcctctcgcactctggctgggagccgtgggagtgggagtggcggagctgacagaagctcagcgcagagggttgcaggtcgccctggaggaatttcataagcacccccctgtgcagtgggcattccaggaaactagcgtcgaaagtgccgtggataccccgtttccagccggtatcttcgtacgactggagttcaagctgcagcagacctcctgtaggaagcgtgactggaagaagcctgaatgtaaggttcgcccaaatggccggaaaagaaaatgcctggcttgcattaaattgggtagcgaggataaggtccttggccgtcttgtgcactgtcctatagaaacacaggtgctgcgcgaggcagaagagcaccaggagacacaatgcctgcgcgtccagcgtgccggtgaagaccctcattccttctacttccccggccagtttgccttctcaaaggcacttccccggagctag

SEQ ID NO: 132314 - DNA, 492 bp, Artificial Sequence
  Description of Artificial Sequence: Synthetic coding sequence
atgcggcggttactgatacccttggcgttgtggttaggcgctgtgggtgttggagtagccgaactgacagaggcccagcgcagaggcctccaggtcgccttggaagaattccataagcacccccctgttcagtgggctttccaggaaacatccgttgaatctgcagttgatacccctttccccgctggaatttttgtgcgccttgagtttaagcttcagcaaacatcctgccgcaaacgggattggaaaaaaccagagtgcaaggtgagacctaacgggcgtaaacgcaagtgtcttgcgtgcattaaactgggtagcgaggacaaagtcctggggaggctggtgcactgccctattgaaacccaggtgcttcgcgaggcagaggagcatcaggaaactcagtgtcttcgcgtccagcgagcgggcgaggatcctcacagcttttactttccgggccaattcgccttcagtaaagcgcttcctcgaagctag

SEQ ID NO: 132315 - DNA, 495 bp, Artificial Sequence
  Description of Artificial Sequence: Synthetic coding sequence
atggcctcaccccaccaggagcccaagccaggggacctgatagagatcttccgcctcggctatgaacattgggctctgtacataggcgacggatacgttattcacttggctccgccatccgaatatcccggggcgggcagctcatccgtttttagtgtgctgtccaactctgccgaagtcaaacgggagagactggaggatgtggtagggggctgttgctatagagtgaacaactctttagaccacgaataccagcctaggccagtcgaggtcatcatcagctctgccaaagagatggttggccagaagatgaagtacagcatagtttcccgaaactgtgagcacttcgtcacacagcttcgatatggcaaatcccgctgcaagcaggtagagaaagcgaaggtggaggttggcgtagctacagcccttggaatattagtggttgctgggtgctcattcgcgatccgtcggtaccagaagaaggctacagcctag

SEQ ID NO: 132316 - DNA, 495 bp, Artificial Sequence
  Description of Artificial Sequence: Synthetic coding sequence
atgggactgccagaaccgaagcctaagcccggcgacctgattgagatctttaggctggggtatgagcattgggctctctacatcggagacgggtacgtcattcatttggctccccccagtgagtaccccggtgcgggaagcagttccgtgttctcggtgctgtccaacagcgcagaggtaaagcgggaaagactagaggacgtcgtcggtggttgttgttatcgtgtgaataattcactggaccatgaataccagcctagacctgtagaggtgattataagcagcgcaaaggaaatggtaggacagaaaatgaaatattccatcgtttctcgcaactgtgagcacttcgttacgcagttgcgctacgggaagtcacgctgcaaacaggtggagaaagcaaaagtcgaagtgggggtggcaactgctctgggtattctagtagtagccggttgttcatttgcgatacgccgatatcaaaagaaagctaccgcctag

SEQ ID NO: 132317 - DNA, 1389 bp, Artificial Sequence
  Description of Artificial Sequence: Synthetic coding sequence
atggcctccaacagttcttcatgtcctacgcctgggggtggacacctcaatggctaccctgtgcctccgtacgccttttttttcccccctatgctgggcggtctgtccccccctggcgcactgacaacgcttcaacaccagcttcctgttagcggttattccactccttctccagccacaatcgagacacagagctcctcgtctgaggagatagtaccatctccgccttctcccccccccctccccagaatttacaagccttgtttcgtctgccaggataagtcatcaggctatcactacggagtatctgcatgtgagggctgtaaagggttttttagacgcagcatccagaagaatatggtgtatacctgtcatcgtgataagaactgcataataaataaagtcacccgtaacaggtgccaatattgccgactccagaaatgcttcgaggtgggaatgagcaaggagagcgtgagaaatgacaggaataaaaagaaaaaagaagtccccaagcccgagtgctctgagtcatacactctgacccctgaggttggggagttgatagagaaggtgagaaaagcccatcaggagacgttccccgccctctgccagctggggaagtacaccacaaacaattctagtgaacagcgcgtttctctggatatcgatctgtgggacaagttctctgagctgtctactaagtgcattattaagacggtggagttcgctaaacagctaccaggattcacaacactcacaatcgcagaccagataacactcctcaaagccgcctgcctcgacattttgatccttaggatttgcacgaggtatacgcctgagcaggacacaatgaccttcagtgacggcttgacattgaatcgcacccagatgcacaatgccgggtttggccccctaactgatctggtgtttgcattcgctaaccagctgttgcctttggagatggatgacgctgagactggcttgctttccgccatttgccttatttgtggcgaccgccaggacttagaacagcccgaccgcgtggacatgctgcaggagcctctgttggaggcattgaaggtgtacgtgcgaaaacggcgcccctcgaggccgcatatgttccccaagatgttgatgaagatcactgatctcaggagcatcagcgcaaagggggcggagagggtgatcaccttaaaaatggagattccagggagcatgccccctttgatccaggaaatgctggaaaattccgaggggctggatactttgagcggacaacccggcggcggagggagagacggcggaggcctcgctccaccacccggtagctgttctccttccctgagtccctcctcaaaccgttcttcacccgctacccattcgccttag

SEQ ID NO: 132318 - DNA, 1902 bp, Artificial Sequence
  Description of Artificial Sequence: Synthetic coding sequence
atgtacgagtcagtggaggtcggcggaccaactcctaacccattcttggtggtcgacttttataaccaaaaccgcgcgtgtctgctcccggagaaggggctgccagcccccggaccctactccacgcccctgaggacccctctttggaatggctctaatcactccatcgagacgcaatcttcaagctccgaggagattgtgcccagccctccttcaccaccacccttgccacgtatatataagccttgtttcgtttgccaagataaatccagtggctatcactacggtgtgagtgcttgcgagggatgcaaaggctttttccggcgcagtatccaaaaaaacatggtgtacacatgtcaccgagacaaaaattgcatcattaataaggtcacgcgcaaccggtgtcagtattgccgcctgcagaagtgtttcgaagtgggaatgtcaaaggagtcagtcaggaatgatcggaataaaaagaaaaaagaggtgcctaaacctgagtgctctgaaagctatacccttaccccagaggtgggtgaactaatcgagtgtgcgaaacgcacccggaagccttcactccctagtgcatcctgggctaataccctgcgaaccacggcgcagaataatgtctcgctgtggacgcttacctctgggacttcaagtgtgaatagccccaagtgtatcatcaaaactgtggagtttgccaagcagctacctggatttaccactctgacaattgcagatcaaattacgctgttgaaggctgcttgcctggatatcttgatcctgcggatctgtacccgatacacacctgaacaggacaccatgacattcagcgacggccttactctcaatcgaacacagatgcataacgctgggttcggccccctaactgatttagttttcgctttcgcaaatcaactgttgcctctcgagatggatgatgccgagaccggcttgctctccgcaatatgtctgatctgcggggaccggcaggacctagagcagccagaccgcgtcgacatgctccaagagcctcttcttgaagctctaaaggtctacgtgcgaaaacgtaggccttcaaggccgcacatgttccccaagatgctgatgaaaataactgatctccgcagtatctctgcgaagggcgccgaaagagtcattacattaaagatggaaattcccggatctatgccccccctgatccaggagatgctggagaatagtgagggcctggataccttaagtggccaacctggcggaggtggccgcgatggaggaggactgcctcgccaggccgccgtcgcacctgcctcggccccagcgcctacagaagctgctaggccacctacgccacgggataggcctagacatatggacaccgctctggcactcagacccgggttttccctgccattttatcggccctgtgatcccgcacccgctctgcctccccctgctctacctggcagcactggagatttgccgtggggaaccggacgcgaggaggcggctactccgtggaccgaagcctgggccttatcaggattgccggcccccactgcttgggccgacgttagaggccgcggacaagagctctcagaagcccccggccccggctcccaggatggctcttgggggccaagagtgcatcaggatacaccactgccttcctccccccacttgcaccaccagcagacaccaggactagggtctcctattttgcggacccacaagccccttctccctagctggggcacctctacttctcctctgccaagacttgtcacagaaggcgtggggcaggggcgtggcgtgcccccagtccatacactgccctaccagccacaggttctgattctggccgggttcgtatttatcctgatctttctgttctag

SEQ ID NO: 132319 - DNA, 1374 bp, Artificial Sequence
  Description of Artificial Sequence: Synthetic coding sequence
atgtacgagagtgttgaggtcggcggccctacgccgaatccattcctggtggtggatttctataaccagaacagggcgtgtctcctgcccgagaagggcctccctgcccctggcccttactccacacctctgcgaacacccctctggaacgggagcaaccactcgatcgagacgcagagttcaagcagtgaggaaatcgtaccttctccaccgtcccccccacctctcccccggatatacaaaccctgtttcgtgtgccaagataagtcttctggttaccactatggggtctccgcatgtgaaggatgcaaggggtttttccgaagatcaatccaaaagaacatggtgtatacctgccatcgggacaagaattgtatcataaacaaagtgacacggaatagatgccaatactgcagactccagaaatgcttcgaagtgggcatgtccaaggagtctgttaggaacgacaggaacaaaaaaaagaaagaggtgcccaagcctgagtgcagcgagagctacacgctgacacctgaagtgggggagcttatcgagaaagtgcgcaaagctcatcaggaaactttccccgccctgtgtcagctgggcaagtacacaaccaacaattctagcgagcagcgggtcagcttagatatcgacctatgggacaagttctctgagctgagcacaaagtgcattattaaaaccgtggaatttgctaaacagctgccagggtttacgacccttactatcgccgatcagatcaccctcctgaaagccgcttgcctagacattttaatcttgaggatttgcacacgttatacaccagagcaggataccatgacattttctgacggcttgacattgaatcggactcagatgcacaatgccggcttcgggccactgactgacctcgtattcgcctttgcgaatcagctgctgccccttgagatggacgatgctgagacaggcctgttaagcgcaatttgtctgatctgcggcgatcgtcaggatctggagcagccagaccgcgttgacatgttgcaagagccgttgctggaggcactgaaggtctacgtgcggaaaagaagaccatctcgcccgcatatgtttcctaagatgcttatgaagattactgacctgaggagcatcagcgctaaaggagcagagagagtcatcaccctaaagatggaaatacccggaagcatgcctccactgatacaggagatgctggaaaacagcgaaggtttagatactctctctgggcaaccagggggcggcgggcgggatgggggcggcctggcccctccacctggatcttgctctccttcactgtccccgtcgtccaatcgatctagtcctgccacacactctccctag

SEQ ID NO: 132320 - DNA, 1437 bp, Artificial Sequence
  Description of Artificial Sequence: Synthetic coding sequence
atgatgagccagactatgacccaggcgggagtatccttcaggcacagtgtccgggcagcccagtgccacactagggtaccaaacacatggcctcgggctaccagaccctacgcgtcatgtagaagatccccgcgtctacgcgggaggtggcccggatccgccggtcagggagcaggtgggcgcgccccccgggccggttggcgggcaggcgatgtgaccggctccgcaattgagacacagtcctctagttcagaagaaatagttcccagtcctcccagcccaccaccactcccacggatctataaaccctgtttcgtgtgccaagacaaatcctccgggtaccattacggagtcagtgcctgcgagggatgtaagggctttttcaggagaagcatacagaagaatatggtgtatacttgccaccgtgacaagaactgtattatcaacaaggttaccagaaaccgctgccagtattgtagactccagaagtgcttcgaagtgggtatgtcaaaggagagtgtaagaaacgaccgcaataaaaagaagaaagaggtcccgaaaccggagtgctccgagtcctacacattgacacctgaggttggcgaactgatagaaaaagtccgtaaagctcatcaggaaacctttcccgccttgtgtcagctaggaaaatatacaacaaataacagctccgagcaacgagtatcactggacattgatctctgggataaattttctgagctgtctactaaatgcataattaagaccgtggagtttgccaagcagctcccaggattcacaactctgacaatcgcggaccagatcaccctcttaaaggctgcatgtctagacattcttatcttaagaatctgtacacgctacaccccggaacaggataccatgaccttcagcgacggattgaccctcaacaggacccagatgcataatgccggcttcgggcctctgacagacctggtgtttgccttcgcaaaccagctgctccccctcgagatggacgacgctgaaaccgggctcctgagtgccatttgcttaatctgcggcgatcgacaggatctggagcagccggatagagtcgacatgcttcaagaacctcttctggaggcattgaaagtctacgtgcggaaacgtagaccatccaggccgcacatgtttcccaaaatgctgatgaaaatcaccgatctgagatcgatctctgcaaaaggggccgaacgcgtaattactctaaagatggaaatccccggtagcatgccccccttaattcaagaaatgttggaaaactcagagggcctagacaccttgtccggccagcctggtggtggaggtcgggacggcggcggtctcgccccaccgccaggtagttgttccccctctctgtcaccctctagcaatcggtcttccccagccactcatagtccttag

SEQ ID NO: 132321 - DNA, 1389 bp, Artificial Sequence
  Description of Artificial Sequence: Synthetic coding sequence
atggccagtaattcctccagctgtcctacccctggcggcggccatctcaacgggtaccccgtccccccttacgcctttttctttccccctatgctggggggcctgtctccaccaggcgctttgacaacattacagcaccagcttccagtgtcaggatattccactccctcaccagcgacgatcgagacgcagtctagctcaagcgaagagatcgtcccttccccaccctcccccccacctcttccgaggatctacaaaccctgtttcgtatgtcaggataagagttccggctatcactacggagtgagcgcctgtgaagggtgtaagggcttttttaggcgcagcatccagaagaacatggtctatacctgccaccgcgataaaaactgtatcattaataaggtgacgagaaatcggtgccagtactgtagacttcaaaaatgcttcgaggtggggatgagcaaggaatctgtgcggaacgatagaaataaaaaaaagaaggaagtgcccaagccagagtgttctgagtcctacacattgacgcccgaggtgggtgaacttatcgaaaaggtgcgcaaagcccatcaggagacgttccctgctctgtgtcagttggggaagtatactacgaataatagctcggagcagcgtgtgtcgctcgatatcgacctgtgggacaaattcagtgaactctcaactaagtgcatcatcaagactgtggaatttgccaaacagctccccgggttcacaactctgacgattgctgaccagataactttgctcaaggccgcttgcctagacattctcatactcagaatatgcacccggtatacgcccgagcaggatacgatgacttttagtgacggactcactctcaaccgaacccaaatgcataatgccggtttcggacctttgaccgacctggtgtttgcctttgcaaatcaactgcttccccttgaaatggatgatgccgagaccggattactgtccgccatctgcctcatctgcggcgacagacaggacctcgagcaaccagacagagttgatatgctacaggagcccttgctagaagcccttaaggtgtacgtacgcaaaaggcgcccatctaggccccacatgttccccaaaatgctgatgaaaatcactgatctgagaagcatttccgctaaaggagctgaacgtgtcattactctcaaaatggaaattcctggcagcatgccacccctgatacaggagatgctcgagaatagcgagggcctcgatacgctgagcggacagccaggcggaggcggtagagatggaggcgggttggcgccaccgcctgggtcttgctccccgagtctctccccaagctcaaacagatctagtccggccacccatagtccatag

SEQ ID NO: 132322 - DNA, 1041 bp, Artificial Sequence
  Description of Artificial Sequence: Synthetic coding sequence
atgggacaagaaatccttccagctcggagccctacgctgagactgggctcgcctaccccccatctcccacaggagctcctgagggcctcacctaagggccccccaggacgcctgcaattaggtgggctcgcagtgcgcaacgaccgcaacaagaagaagaaggaggtgcccaaacccgaatgctcagaaagttacaccctgaccccagaggtcggggaactcatagaaaaggtgaggaaggcccaccaggaaaccttccccgccctctgtcaactgggaaagtataccacaaataactcctccgagcagcgcgtcagtctcgatatagacctttgggacaagtttagcgaactgagtaccaaatgcatcattaagactgtagagtttgcaaagcagctccccggtttcacaacactcaccatcgccgaccaaattacccttctgaaggcggcgtgtctggacatccttatcctgagaatatgcacgaggtatacaccagagcaggataccatgactttcagcgatggcctgaccctcaatagaacccagatgcataacgccggatttggaccgcttacagacctggtttttgcgtttgccaatcaactgcttccgctggaaatggatgatgcggagactggacttctctctgccatttgcctaatctgcggtgaccggcaagacctggagcagcctgaccgtgttgatatgctgcaggaaccgctgttagaagccctgaaggtgtacgtaagaaaacgcaggccatcgagacctcacatgtttccgaaaatgctgatgaaaattactgatttaaggtccatttcagcaaagggggcggagcgggtaatcaccctcaaaatggagattcccgggtctatgccccccctgattcaagagatgctcgagaatagtgaaggcttagacacactttcaggtcagcccggcggaggcggtcgggatgggggcgggctggccccaccgcccgggtcttgttctccatcccttagcccgtcctctaatcgttcctcaccggctacgtag

SEQ ID NO: 132323 - DNA, 1098 bp, Artificial Sequence
  Description of Artificial Sequence: Synthetic coding sequence
atggcttctaactcatcttcctgtccgacgccaggcggcggccatctgaacggataccccgtgcccccatacgcattcttctttccgcctatgctgggcggcctgtccccccccggcgctttgaccactctgcagcaccaactacccgtaagtgggtatagcacaccctcccctgccacagtacgtaatgatcggaataagaaaaagaaagaggtccctaagccagaatgtagtgagtcatatacactgacccccgaggtcggcgagctgatcgagaaagttaggaaagcccaccaagaaactttccccgcactctgccagctgggaaaatacactacaaacaattccagtgagcagcgagtgagcctggacatcgacctatgggacaagttttccgagctgagcactaagtgtataattaaaaccgtggaatttgccaaacaactcccgggttttactacgcttactatagccgatcaaataactctgctgaaggctgcctgtcttgacatccttatcctcaggatttgcacccggtacacccccgaacaagacaccatgactttctctgatggattaactctaaatcgcactcaaatgcataacgccgggttcggccccctcacagacctggttttcgcttttgccaatcagttattgcccctggagatggatgatgccgagactggcctgctgtccgcaatctgtcttatatgcggggatcgtcaggatctagagcagcccgaccgggtggacatgctccaggagcccctgttggaggcgttaaaggtgtatgttcggaagcggaggccaagccgccctcatatgtttcctaagatgctcatgaaaatcaccgatctaagatctattagcgccaaaggtgcggaaagggttattacgctgaaaatggaaattccagggtccatgccccctctgattcaggaaatgctggaaaacagtgaagggctggacacactgtctggacagccgggcggcggaggaagagacggtggcggcctggctccccctccaggctcctgttccccgtcacttagcccctcctccaacagatctagtccagctacacactcaccttag

SEQ ID NO: 132324 - DNA, 1149 bp, Artificial Sequence
  Description of Artificial Sequence: Synthetic coding sequence
atggtgccttcatctccttcaccaccccccccccctcgggtgtacaaaccatgtttcgtttgcaatgacaaatccagtggttaccattacggggtcagcagttgcgaaggctgcaagggattttttcgaagaagtatccagaagaatatggtgtacacatgccatagggataagaattgtatcatcaacaaagtgacccgtaaccggtgtcagtactgccgacttcagaagtgctttgaggtcgggatgtccaaggaggctgtacgtaacgaccgaaacaaaaagaagaaagaagtgaaagaagaaggtagcccagacagttatgagctgagcccccagctggaagagctaatcacaaaggtttcgaaggcacatcaggagaccttcccaagcctgtgtcagttgggtaaatacaccaccaactctagcgctgatcaccgggtgcagctggaccttggtctttgggacaaattcagtgagcttgcgacgaaatgtatcatcaagatcgtggaattcgccaaacgtcttccaggattcaccgggctttctatagcagatcagatcacactcctcaaagccgcatgcctcgatattctgatgctgcggatatgtactcgatacacccccgagcaagacacaatgactttttcagacgggcttaccctgaacagaactcagatgcacaatgcagggtttggcccgttgaccgacctagttttcgcatttgcggggcagctcttgcccttggagatggatgataccgagacaggactcttgtccgcaatttgtctgatttgtggcgaccgaatggatctcgaggagccagagaaggtggacaagctgcaggaaccactgctggaggctcttaggctctatgcccgtcgcagaagacctagccagccgtacatgttcccacgaatgctgatgaaaattaccgatctgcgtggcattagcactaagggggccgaacgcgcaataacactcaaaatggagatccccggtcctatgccgccacttatcagggagatgctggagaatcctgagatgtttgaggatgacagtagtcaacccggaccacatccaaacgcaagctcagaggatgaggtgcctggggggcagggtaaaggtgggctgaagtccccagcctag

SEQ ID NO: 132325 - DNA, 1332 bp, Artificial Sequence
  Description of Artificial Sequence: Synthetic coding sequence
atgtacgattgtatggaaacattcgcacctggcccccgacgcctctacggcgccgcagggccaggcgccggcctgttaagacgtgcaacagggggatcctgttttgccgggctcgagagttttgcctggccccagccagccagtctccagtcggtcgaaacccagtccaccagctcggaagaaatggtacctagctcaccttccccccctcccccaccccgggtgtataagccttgtttcgtgtgtaatgataagtcctctggataccactatggcgtctctagctgcgaggggtgtaagggattcttccgccgcagtatacagaagaacatggtgtatacctgtcatcgggacaaaaattgcatcattaacaaggtgacccgcaacagatgtcagtattgtaggctgcagaaatgcttcgaagtcgggatgtcaaaggaagcagtgagaaatgatcgcaataaaaaaaaaaaggaggtgaaggaagaggggtcaccggattcatatgagctgagccctcaactggaagaactgattacgaaggtctccaaggcacaccaggaaactttcccatcactgtgtcagctcggcaagtatactacgaacagtagtgctgatcaccgagttcaactcgatctgggcctgtgggataagttttcagagctcgcgaccaaatgcatcattaagatcgtggaattcgctaagcgccttccaggcttcactggtctaagtattgcagaccagatcaccctcctgaaagcagcctgtctggacatattgatgctccgcatttgcacacggtatactcctgaacaggatacaatgactttttctgatggtctaacgctgaaccgcacacagatgcataatgcaggattcggtcctttgaccgacctggtgtttgccttcgctgggcagctccttccactagagatggacgataccgagaccggtctcttgagtgccatttgtctcatctgcggggacaggatggacctggaggaaccggaaaaggtggacaagttacaggaaccgctgctggaggcgctccggctctacgctcgcagacgccgaccctcgcagccatacatgttcccccggatgctgatgaagattaccgacttgaggggcatcagcactaagggggctgaacgcgctatcactcttaaaatggagattcccgggcctatgcctcctctgatcagagaaatgcttgagaaccccgaaatgtttgaggacgacagttcccagccaggcccacaccccaacgccagcagtgaagacgaagtgcctggcggccagggaaagggcggtctgaaaagccctgcatag

SEQ ID NO: 132326 - DNA, 1365 bp, Artificial Sequence
  Description of Artificial Sequence: Synthetic coding sequence
atggcaacaaacaaggagaggctgtttgcggcaggagcgctcggccctggctcaggttaccccggcgccggtttcccatttgctttcccaggcgctttaagaggttctcctccattcgaaatgctgtcccctagtttcagaggacttggccaaccagatttgccaaaggaaatggcgtctcttagcgtcgagactcagagcacatccagtgaagaaatggtcccttccagcccatcacctcctcctccacccagggtctacaagccctgcttcgtctgtaatgataagtcctccgggtaccactacggtgtgtcgtcctgcgagggctgcaagggattctttagaagaagcattcaaaaaaacatggtgtacacctgtcacagagacaagaattgcattataaacaaggtcactcgaaacaggtgccagtattgtaggctgcagaaatgcttcgaagttggaatgagtaaggaagccgttcgtaacgacaggaacaagaaaaagaaagaagtaaaagaggagggatcacccgatagctatgagctcagcccccagttagaagaattgattacaaaagtttctaaggcccatcaggagacattccccagcttgtgtcagttgggaaaatacactacaaattcaagcgcagatcaccgagtgcagctggatctggggctgtgggataagttttccgagctggccactaaatgtatcatcaaaattgtggagtttgctaagcgactgcccgggtttacggggctgtctatcgccgaccaaatcaccttactgaaagccgcgtgtctggatatactgatgctgcgtatatgcacccgctacaccccggagcaggacacaatgactttctccgatggactcactttaaacaggacccaaatgcacaacgcaggatttggtccactcacggaccttgtgtttgcattcgcaggacagctgttacccttggaaatggacgataccgaaactgggctgctctccgcgatatgtctgatttgtggagaccgcatggacctggaggagccagaaaaagttgataaactccaggagcccctgctggaagctcttcggctctacgccaggcgacgtcgtccaagtcagccttacatgttcccgcgcatgctcatgaagattactgatctgcggggtatctccaccaagggagcagagcgcgccattactctgaagatggagatccctggccccatgccccccctgatccgggagatgcttgaaaatcccgagatgttcgaggatgactcctctcagcccgggcctcacccaaatgcctcatcagaagatgaagtgcccggtggacaagggaaagggggtctgaagtctccagcttag

SEQ ID NO: 132327 - DNA, 1365 bp, Artificial Sequence
  Description of Artificial Sequence: Synthetic coding sequence
atggctaccaacaaggaacgcctctttgccgctggtgctctggggcctggcagcggctatcctggggccggcttcccctttgcattccccggggccttgaggggcagccccccatttgagatgttatcaccttcttttagaggtctgggccagcctgacttacccaaagaaatggcctcactctccgttgagactcagagcacctcaagcgaggagatggtacctagttcacctagcccaccccctcctcccagggtgtacaaaccatgttttgtctgcaatgacaagtcatccgggtaccactacggggtgagcagttgtgagggatgcaagggatttttccggcgttctatacagaaaaatatggtgtatacctgtcatagagacaaaaactgcatcatcaacaaggtcacaaggaaccgctgccagtactgccggctgcagaagtgctttgaagttgggatgtctaaagaagccgtgcgcaatgataggaacaaaaaaaaaaaagaagtgaaagaagagggatcgcccgacagctacgagttgtctccccagcttgaagagctaattactaaagtatcaaaggcccaccaggaaactttccccagcctatgccagctcggtaagtacacaactaactcatctgctgaccaccgggtgcagttggatctcggattgtgggataaattcagtgaattggccactaagtgtattattaagatcgttgaatttgctaagagactcccaggcttcacagggctttcgattgcagatcagattactctgttaaaggccgcgtgtcttgacatcttgatgttgaggatatgcactcgctataccccagagcaggacaccatgaccttttccgatgggctgacccttaataggactcagatgcacaacgccggattcggccctctgaccgatctagtatttgcgttcgctggacagctgctcccactggaaatggatgatactgaaacgggcctactgagtgctatctgcctcatttgtggcgataggatggacctggaggaaccggaaaaagtggacaagttacaagagccattgctggaagctctgaggctgtacgccaggcggagaaggccttcccagccctatatgtttccccgaatgctcatgaagatcactgacctcagaggcatctccaccaaaggtgccgaacgtgccatcacgctaaaaatggagatcccaggccctatgcctcctctgatccgggaaatgctggaaaacccagaaatgtttgaagacgattcctcacagcccggaccgcatccaaacgcatcatctgaggatgaggtgccaggcggtcagggaaaggggggactgaaaagcccagcgtag

SEQ ID NO: 132328 - DNA, 306 bp, Artificial Sequence
  Description of Artificial Sequence: Synthetic coding sequence
caccaccaggatgaatttgcaaagcgcctgcccggttttaccgggctttcaatcgccgatcaaatcacgcttctgaaagccgcttgcctagatattctcatgttacgcatatgtacaaggtatacccccgagcaggacactatgacattctcagacggactgacgctcaacaggactcagatgcataatgcgggttttggcccactgactgacctggtgtttgcgttcgctggtcagcttttgccgcttgagatggatgatacagagacgggcctgttatctgctatatgcctgatctgcggttag

SEQ ID NO: 132329 - DNA, 1299 bp, Artificial Sequence
  Description of Artificial Sequence: Synthetic coding sequence
atgctggccttgccattacctccatgctggagtggcgcccctcccggggaggagggcgaaagcgcagcaggaccttggtgcttccagcatcccgtgtcccttcaagccggcagcaggtgcaccaccgtgtggaaacgactgcctcgcgtgagagatggctgtacaggccggccgggacccggccccgcttgttgcgcggaaccgcctgcagcccccgtctccccagatctaaacttgttaccaggccgcaatcctcccgcttgtaacgggttcttcaggagaagtatacagaaaaacatggtttacacctgtcaccgggataagaactgcatcatcaacaaagtcacccggaatcgatgccaatattgtagactgcagaaatgcttcgaggtggggatgtctaaggaggcagtgaggaatgatagaaataaaaaaaagaaggaggtcaaggaagagggttcccccgactcctatgagctctcaccccagctggaggaactgatcacaaaagtatccaaggcccaccaggaaacctttccaagcctgtgccagcttggaaaatataccacaaattcttctgcagatcatagggtgcagctcgacctcggcctctgggataagttctcagaattggcaactaaatgcattattaagatagtagagttcgcaaagaggctgccgggtttcactgggctcagcattgccgatcagataactctactgaaggccgcctgtctcgacattctgatgctgcggatttgtacccggtataccccagagcaggatacgatgactttctcggatggcctgactctaaatcgaacacaaatgcacaatgccggctttggtccactgactgatttggttttcgcttttgccggccaactgctcccacttgaaatggatgacaccgaaaccggtctgttgtcagccatctgcctaatctgtggtgataggatggacctggaagaaccggaaaaggtggataagctccaagaacccctgctagaggccctcagattgtacgcaaggaggagacggcctagccagccatacatgtttcctagaatgttgatgaaaataaccgacctccgcggcatttccaccaaaggtgccgaaagagccatcacactgaagatggaaatccctggacccatgccgccactgatccgggagatgctggaaaatccagaaatgttcgaagatgactccagccaacctgggccacaccccaatgccagttccgaagatgaggtacctgggggccaggggaaaggtggcctgaagtcacctgcctag

SEQ ID NO: 132330 - DNA, 1389 bp, Artificial Sequence
  Description of Artificial Sequence: Synthetic coding sequence
atggacaccaagcacttcttgccactggatttcagtactcaggtcaattctagcttgacaagcccgaccggtagaggttcaatggcagccccttccctccacccctctttggggccaggtatcggttctccaggacagttgcactcccccatatccactctcagctccccgatcaacggcatgggcccccccttttctgtgatcagtagtcccatgggaccccactccatgtccgtgccaacgaccccaacactggggttcagcaccggatccccccagcttagctcacccatgaacccagtgagcagctcggaggacattaagcccccactcggtcttaacggagtgttgaaagtgccggcacacccatccggtaacatggccagttttaccaagcacatatgtgccatctgcggagacagaagtagtggcaaacactatggagtctattcctgcgaaggctgcaagggcttttttaagaggaccgtgaggaaggacctcacctacacttgccgagacaataaagattgcttgattgataagcggcagaggaatcgctgccaatactgtaggtatcagaagtgtttagctatgggcatgaaaagggaggctgtgcaggaagaacgccaaagaggcaaggatcgaaacgaaaatgaggtcgagtctacctccagtgccaatgaagatatgccagtcgagagaatactcgaagccgagttggcagtcgaacctaagacagagacatatgtcgaggctaacatgggcctcaacccttcgtcccccaatgatccggtcactaacatatgccaggccgctgataaacaactgtttactttagtcgagtgggccaagcgaattccccacttctctgagctacccctcgatgaccaggttatcttgctgagagcggggtggaacgaactgctgatcgcatcttttagtcatcggtccatcgctgtaaaagatggcattcttctagctaccggcctgcatgttcatcgcaatagcgcccattcagccggcgtaggcgcaatattcgatcgggtactgacagaactggtgtctaagatgcgcgatatgcagatggacaaaactgagctcggttgcttacgagcgatcgtgctgttcaacccggatagcaaggggctcagtaaccctgcggaagtcgaggctctgcgggagaaagtttacgcatcccttgaggcttattgtaaacacaaatacccagagcaacccgggagatttgcaaagctgctgctgcggctccccgccctccgatccatcggattgaagtgtctcgagcacctcttcttcttcaaattaatcggggacacgcctatcgacaccttcctaatggaaatgctggaggctccccatcaaatgacttag

SEQ ID NO: 132331 - DNA, 1098 bp, Artificial Sequence
  Description of Artificial Sequence: Synthetic coding sequence
atgaatcctgtatcaagcagtgaggacatcaaacctccactcggcctgaacggagtgctgaaagtgcccgctcaccccagcgggaatatggctagcttcacaaagcacatctgtgccatttgcggcgataggtcgtctggcaaacattacggggtgtactcatgcgagggatgtaagggtttctttaagcgcacggtccggaaagacttgacatatacctgccgggataataaagactgtctgatcgataagcggcagaggaatcgttgtcagtactgtaggtaccaaaagtgtctggctatgggtatgaagcgggaagccgtccaagaggaacggcagagggggaaggaccgcaatgagaatgaggtggaatccacctcctcagcaaacgaggacatgcctgttgagagaattttagaggctgaactggctgttgagcctaagacagagacatacgtcgaagccaacatgggtcttaatccttcatcccccaatgaccccgtcacaaacatctgtcaggctgccgacaagcagctgtttactctcgtcgaatgggccaagaggatcccacactttagtgagctcccactagatgaccaggtcatccttctgagagccgggtggaatgaactgttgatcgcctctttcagccacaggtcaatagccgtcaaggacggtatcctcctggctacaggcctgcatgtacatcgaaattccgctcacagcgcaggcgtgggtgccatcttcgatcgtgtcctcacagaattagtcagcaaaatgcgcgatatgcagatggacaagaccgagttgggctgtctcagagctattgtcctatttaaccccgactcaaaaggcctctcaaaccccgccgaagtcgaagccctgagggaaaaagtgtacgcttccctggaggcatattgcaaacacaaataccccgagcagccaggacgcttcgctaagctgctcctacgtctgccggctcttagatctatagggttgaaatgtttggaacatcttttcttttttaaactgatcggcgacacgccaattgacaccttcctgatggagatgcttgaggccccccaccagatgacctag

SEQ ID NO: 132332 - DNA, 1602 bp, Artificial Sequence
  Description of Artificial Sequence: Synthetic coding sequence
atgtcgtgggctgctcgccccccctttcttccacagcgacacgccgcaggccaatgtggacctgtgggtgttcgcaaggaaatgcactgcggcgtggccagccggtggcggaggcggcggccttggcttgaccctgcggctgccgccgcggcagcagtggctggcggcgagcagcaaactcctgagccagagcccggagaagctggcagagacggaatgggggactccgggcgggattcccgctcgccagattctagttcacctaatcctttgccacagggagtacccccccccagtccgccaggcccacccctcccaccgtccactgccccatccttaggcggttcaggcgctcctccccccccccctatgcccccccccccgttgggcagtccctttcccgtgatctccagtagtatggggagtccagggctgcctcctccagccccccctggtttctccggccctgtatctagcccacagatcaatagcacggtaagcctgcccggcgggggttctggcccccccgaggacgtgaagcctccagttctgggagtgcggggtctgcactgtcccccacccccgggagggcccggtgccggcaagcgtttgtgcgcgatatgcggagaccggagcagcggcaaacactatggggtgtacagctgtgagggttgcaaagggttcttcaagaggaccattcgaaaggatctaacttactcttgtagggacaacaaggattgtacagtggacaagcggcaacgcaaccggtgccaatactgtcgttatcagaagtgcctcgccactggaatgaagagggaggcagtccaggaagaacgccaaagagggaaagataaggacggagatggcgagggggccggaggcgccccagaggagatgcccgtggaccgaatcctggaggccgagctagcagtcgaacagaaatccgatcaaggcgtggaggggccaggtggtactggtggctcaggttcatccccaaatgacccggttaccaatatatgccaggctgccgacaaacaactgttcacgctcgtcgagtgggccaaaagaattccccacttttcttccctccccctggatgaccaggtcatactgctccgggcaggttggaatgagctgctgatcgcttccttcagccatcgttctatcgatgtacgagacggtatattgctggctacagggctccacgtccacaggaattctgcacattcagcaggagtaggggctatctttgatcgggtgctgacagagctcgtctctaagatgcgggatatgcgaatggataagactgaacttggatgcctgcgtgccatcattctgttcaatcccgacgcgaagggcctgagtaacccttccgaagtggaggtgctaagggagaaggtctacgcgtctttagagacttattgtaaacaaaaatatcccgagcaacaaggccgattcgccaaactgctgttacggctgcccgcgctgcgttcaattggactcaaatgtctggagcatctgttcttctttaagctgattggagatacccccattgacacctttttaatggagatgctggaagctccacatcagctcgcctag

SEQ ID NO: 132333 - DNA, 1614 bp, Artificial Sequence
  Description of Artificial Sequence: Synthetic coding sequence
atgtcgtgggcagcaagacctccttttttaccacaaaggcacgccgcagggcaatgcgggcccgtaggagtgcgtaaggagatgcactgcggcgtggcgtcaagatggcgaaggagacggccgtggctggatcccgccgccgcagctgcagctgctgtggccgggggggaacagcagactcccgaaccggagccaggtgaagcaggacgggatgggatgggggactcagggagagattcaagaagtcctgattctagctctccgaaccccctcccccaaggagtgccccctccgagtcccccggggccccctcttccaccaagtaccgctccatctctgggaggcagcggagcaccaccaccccccccaatgcctccccctccccttggaagtccatttcccgtcatttctagctctatgggcagtccgggtctgcctccaccggcacctccggggtttagcgggcccgtgtcctccccgcaaatcaactccaccgtgagcctccccggcggcggcagtgggccgcccgaggacgtaaaaccccctgtgcttggcgtcaggggtctccattgtccacctccgcccgggggccccggggcaggtaaaagattatgcgcaatctgtggtgataggagcagcggaaagcactatggtgtatactcatgtgaaggttgtaaaggattttttaaacgcacaattcggaaggatctcacctacagctgcagagacaacaaagattgcactgtagataagcgacaaaggaacagatgtcagtattgtagataccaaaagtgtctcgcaacaggaatgaagcgcgaagctgttcaagaggagcggcagcgcgggaaggacaaagacggcgatggcgagggcgcaggcggggcacctgaggagatgccagtggatcggatccttgaagctgagctggccgtagagcagaagtcagaccagggcgtggaaggcccaggtgggacaggcgggtccggctccagtcccaatgaccccgtcactaatatctgtcaggcagccgacaaacagttatttactctcgtcgaatgggctaagagaattcctcatttttctagcctgcctttggacgaccaggtaattctgttaagggccggatggaacgagctgctgatagcctcgttctcccatcgtagcattgacgttcgcgatggtatactgcttgctaccggcctccatgtgcacagaaattccgctcattctgccggagtcggcgccatcttcgaccgtagcctgagcagggttctgacagagcttgtgtctaagatgcgggacatgcggatggataagaccgagcttggatgcctgcgggcgatcatcctgttcaaccccgacgctaaaggattgagcaatccctccgaggtcgaagtgttacgggaaaaagtatacgcctccctggaaacctactgcaaacagaagtaccctgagcaacaggggaggttcgccaagctgctgcttaggctccctgccctccgctcaattggtcttaaatgcctggagcacctcttctttttcaagctcattggtgatacacccatcgataccttcctgatggagatgttagaagcaccacaccagctcgcttag

SEQ ID NO: 132334 - DNA, 1614 bp, Artificial Sequence
  Description of Artificial Sequence: Synthetic coding sequence
atgtcgtgggccgccagacccccttttcttccccagcgacatgctgcaggacagtgcggacccgtgggtgtccgaaaggagatgcattgtggggtggcctctaggtggaggcgtagaaggccctggctggaccctgctgcggccgcagcagccgcagtggccggtggcgagcagcagacccccgaacctgagcccggagaggcaggaagggacgggatgggagacagcggtcgggacagtcgctcccctgacagctccagcccaaaccctctccctcagggtgtccctccaccaagtccaccaggccctcctctgcctccaagcaccgctccatctctgggcggtagcggggctccaccacctcctcctatgcccccgccaccactcggtagtcccttccctgttataagctcctcgatgggctccccggggctgcctccaccagctccccctggattttcgggccctgtctcctctcctcagattaattcaacagtgagcctcccagggggcggcagtgggcctcccgaggatgtgaaaccaccggtgctgggagttcgcgggctgcactgcccccctcctcccgggggccccggagctggtaagagactgtgcgcgatatgcggcgaccggtccagtggtaaacactatggtgtttactcttgtgagggctgcaaaggcttctttaaaagaactatccgtaaggacctgacctactcttgtagagacaataaggattgtactgttgacaagagacaacgcaaccggtgccagtactgccgttaccagaagtgccttgcgactggcatgaaacgtgaggcggtccaagaagagcgccagcgtggcaaggataaagacggggacggggagggggcaggcggcgctcctgaagaaatgcctgtagacagaatcctggaagccgaactggcggttgaacagaagtccgatcagggcgtggagggtcctggaggcactggcggctctggctcctcccctaacgatccagtgacgaacatttgccaagccgcagacaagcagctttttacactggttgaatgggccaagcgtatccctcactttagcagccttcccctcgacgaccaggtcattctgctgcgtgctggctggaatgagctgctgattgccagtttcagccacagaagcatcgacgtcagagacggaattctgcttgccactggattacatgtgcataggaatagcgcccactcggcaggtgtcggggctatcttcgataggtccctgtctagagtcctgaccgagctcgtttccaaaatgcgcgatatgcgtatggataaaacagagctcggctgcctgcgggccataattctgtttaaccccgatgctaagggcctctcaaacccctccgaagttgaagtcctccgggagaaagtttatgctagcctagagacctattgcaaacagaagtatcccgagcagcaaggtagattcgccaaactgctgttgagattgccagccttgaggagcatcgggctgaagtgcctggagcacctcttttttttcaaactcattggggatactccgatagatacattcttgatggagatgctggaagcccctcaccagctggcatag

SEQ ID NO: 132335 - DNA, 1602 bp, Artificial Sequence
  Description of Artificial Sequence: Synthetic coding sequence
atgtcttgggccgcacgccccccttttctaccccaacgccacgctgctggacagtgcgggccagtcggggttaggaaagagatgcattgcggggtcgccagcaggtggaggagacgccgaccttggctcgacccagccgcagccgcagcagcagcagtggcgggtggagagcaacagactcctgagcctgagcccggcgaagccggcagagatggaatgggcgattcaggacgggattctcgctctcccgattcctcaagcccaaaccctctcccccagggggtccccccaccaagtcccccgggaccacctttgcccccgagcaccgcccctagcctcggagggtctggggccccgcctccaccccctatgcccccccctcccttaggctctccatttcccgtgattagctcatctatgggtagccctgggctgccaccacctgcaccacctggcttttcaggcccagttagctcccctcagattaattctacggtttctctccctggcggcggatcaggtcctcccgaggacgtgaaaccccctgtactgggagtgcgggggctgcattgtcctcccccgcccggaggccctggcgctggcaaacgtctgtgcgctatatgtggggacagatcatcaggtaaacattacggagtgtactcctgcgaagggtgtaaaggcttcttcaaacgtaccatccggaaagatttaacatatagctgtcgagataacaaagactgcaccgtcgacaaaaggcaaagaaaccgctgccagtactgcaggtaccaaaaatgcctagccactgggatgaaaagggaggcagtgcaagaggagcgacaacgcggcaaagacaaggatggagacggagaaggagccggcggcgctccggaagagatgcctgtggatagaatcttggaagctgaacttgctgtggaacagaaaagtgatcagggggtcgagggacctggaggcacagggggctccggctcaagcccaaacgacccagtgacaaacatttgtcaggctgcggacaagcagttatttactctggttgaatgggccaaaaggatcccacacttttcttctctgcctctggacgatcaggtaatcctattacgagctgggtggaatgagctgctgattgcttccttctcacaccgtagcatcgacgtgagggacggaatactcttggctacaggactgcatgtccaccgcaatagtgcacattccgccggtgtcggggccatcttcgatcgtgtactgaccgagctcgtgagtaagatgagggacatgcggatggacaaaactgagcttgggtgtttgcgtgccatcatattgttcaacccagacgcaaaagggctgtccaacccctccgaggtcgaagtcttgcgcgaaaaagtgtatgcaagcttggagacctactgcaagcaaaaatacccagaacaacagggtcgctttgcaaagcttctcctccggctcccagccctgagaagtattgggcttaaatgtttggaacacttgttcttcttcaaactaataggggacacccccatagacactttcctgatggaaatgcttgaggcgccccatcagttagcctag

SEQ ID NO: 132336 - DNA, 861 bp, Artificial Sequence
  Description of Artificial Sequence: Synthetic coding sequence
atgccacaaggaagcgtgggccggtgggggtgcgaaaaaaagtgtatcgttggcagtcgaccaggaggaggcggcgatgggccaggctggatccctcagagaaggagacggcggcgctggcaggccgaaaataacaaaccgaggtctaggagccaaggtcgtctggatggaacaggctgggccactgccggcggcattaactcaactgttagcttaccagggggagggtctggcccacccgaagatgtgaagccccccgtactcggggtcagagggctgcattgccccccaccccctggaggccccggcgctggcaagcggctgtgtgcaatctgtggcgacagaagtagcggcaaacactatggagtatatagctgtgaaggctgcaagggattctttaaacgcacaatacgaaaggatttgacctacagctgtagggacaacaaagattgcaccgtggacaagcgtcagcgaaatcggtgccagtattgccggtaccagaagtgccttgcaacaggtatgaaaagagaggcagtacaggaagaacgacagagggggaaggataaagatggagacggggaaggcgcaggcggagcacctgaggaaatgccagtagacagaatcctcgaagcagagctcgctgtggagcaaaagtcagaccagggcgtggaggggccagggggcaccggcgggagcggctcaagcgtctccgttggagtgaaccccctgagttttgtgatgggagtaggtggaggcagcctaggattgttctatatccccagcccttcatttccactcatcaccttccttaccctactgggcacaggtggagccgctaagcaaggactgtccaatatctag

SEQ ID NO: 132337 - DNA, 1602 bp, Artificial Sequence
  Description of Artificial Sequence: Synthetic coding sequence
atgtcgtgggccgcgaggcctccattcctcccacagcgccacgcagcgggacaatgtggtccagtcggagtgaggaaggagatgcattgcggcgtcgcatcccggtggaggaggcgacggccttggcttgacccggctgccgcggccgccgcggctgtggccgggggcgagcagcagacccccgaaccagagccgggtgaggcaggccgggatggaatgggtgattccggccgggattcccggtccccagactcctcttctccgaacccattgccccaaggcgtaccaccaccctctccgcccggacctccattgcccccttccacagcacctagccttggtgggtctggcgctccgccgcctccacccatgccgcctcctccactgggaagtccatttcctgtgatctcaagttcaatgggctctcctggcctgccaccccctgctccaccaggcttttctggccctgtgagctccccccagatcaatagcactgtgtcgctgccaggtggtggatcagggcccccagaggatgttaagccaccagtactgggcgtaagaggccttcactgtccccccccaccaggggggcccggggccgggaagcgcctctgtgccatttgtggtgatcgctcctccggcaaacattacggcgtctattcttgcgaagggtgtaaagggtttttcaagaggacaatacgaaaggatctcacgtatagttgtcgggacaacaaagattgcaccgtcgataagcgacagcgtaaccgctgccagtactgccgctatcaaaaatgcctggctacggggatgaaaagggaggctgtgcaggaagagcggcagcggggaaaagataaggatggcgacggggagggcgccggtggcgcacctgaggaaatgccggtggatagaatcttggaggctgaattagcggttgaacagaaatccgaccaaggagtggagggaccaggcggtaccggagggtccggatcctccccaaacgatcctgtaacaaacatttgtcaagctgcagacaagcagctgtttacattggtggagtgggccaagcgcattccccatttctcctctctcccgctggatgatcaagtgatcttactgagggccggttggaacgagttactgattgcatcgttttcccatcgtagcatcgacgtaagagacgggatactgctcgccacaggcctacatgtccaccggaatagcgcccatagtgcaggtgtcggagcaatctttgacagagtgctgactgagctggtttctaagatgcgagatatgcggatggacaaaacagagctcggatgcctgcgcgcaattatcctgttcaatcctgatgcgaagggcctctccaacccaagcgaggttgaggtactacgagaaaaagtatacgcttcccttgagacttattgtaagcagaagtatccagaacagcagggcaggtttgccaaattgctcttgcgcctacctgccctgcggtcaataggccttaagtgccttgagcatcttttcttctttaaactgatcggcgacaccccaatcgatactttcctcatggagatgctggaagcgccacatcagctagcctag

SEQ ID NO: 132338 - DNA, 291 bp, Artificial Sequence
  Description of Artificial Sequence: Synthetic coding sequence
taatcccctaatgatccagtaacaaatatctgccaagcagccgataagcagctgttcactttggttgaatgggctaaacgcattccccacttcagttccttgcccctggacgaccaggtgattctactgagagccgggctccacgtgcaccggaatagcgcccattcagcgggcgtgggcgcaatcttcgacagggtactaacagaactagtcagcaagatgagggatatgcggatggataagacagaactcggctgcctacgggctattattttgttcaatcctgactag

SEQ ID NO: 132339 - DNA, 1602 bp, Artificial Sequence
  Description of Artificial Sequence: Synthetic coding sequence
atgagctgggcagccagacctcccttcctgccacagagacacgccgctgggcagtgcgggccagttggcgtgcgaaaagagatgcactgtggagtggccagcagatggaggcgaaggcgtccctggctagaccccgctgcagcagccgctgccgcagtggcaggcggagagcagcagacccccgaacctgagcccggggaagccggccgagatggtatgggagatagtggacgggacagtcggtctccggacagctcctctcctaatccgctgccacagggggtgccccctccgagcccccctgggccacctctgcctcccagcacggctccttcattggggggaagcggcgcgcctccaccaccgccaatgccgccacctccgctggggagcccattccccgtgatctcctcttctatgggaagtccgggtctccccccccctgccccacccgggttctcgggaccagttagttccccccaaatcaattcgacggtgtctcttccaggtggcggaagcgggccacccgaggacgtaaagccccccgtccttggtgtgagaggactccactgtccacccccaccgggaggaccgggcgcaggaaaaaggctgtgtgccatatgcggggataggtcttcagggaagcattatggggtgtactcctgtgaaggctgcaagggtttctttaaacgcacaattaggaaagacctcacttattcttgccgcgacaataaggattgcaccgttgacaaacgccaaagaaacaggtgtcaatactgtaggtatcagaaatgcttagctaccgggatgaagcgtgaggccgtgcaggaggaacggcagcgggggaaagacaaagatggagacggggaaggggccggaggagcgcctgaagagatgcccgtggaccgcatcctggaagctgagttggctgttgaacagaagtccgatcaaggcgttgagggccctggtggcactggtggtagtggaagttcccccaatgatcccgtgactaacatctgccaggccgcagacaaacagctattcactctcgtggaatgggctaagcggataccccactttagctctctgcccctcgacgatcaggttattctcctgagggccggttggaatgagcttcttatagctagcttctctcaccgaagcattgatgttcgcgatggtatcctgctagccacgggcctgcacgtgcacagaaattcggcgcattcagctggagtcggtgcaatctttgaccgcgtgcttacagagctggtgtccaagatgagagatatgagaatggacaaaactgagttaggttgcctaagggcaattattctgttcaaccccgacgccaagggtctgagtaacccttctgaggtagaggtgcttcgggaaaaggtgtatgcatccctggaaacttactgcaagcaaaagtatcctgagcaacagggtcgattcgccaagctattattacggttgcctgctctgagaagcatcggcctcaaatgtctggaacacctctttttcttcaagctgatcggagacacaccaatcgacacattcctaatggagatgcttgaagccccccaccagttagcatag

SEQ ID NO: 132340 - DNA, 291 bp, Artificial Sequence
  Description of Artificial Sequence: Synthetic coding sequence
tgaagtccaaatgacccagtgacaaacatctgccaggctgctgataagcagctcttcacacttgtagagtgggcgaaaagaatcccccacttcagcagtctgccgctcgacgaccaagtcattctactcagggcaggtctgcacgtgcaccggaattctgcacactctgctggggtaggcgctattttcgatcgtgtgctcactgagctagtatcgaagatgcgcgacatgcgaatggacaagactgagctggggtgcctgcgtgcgatcatacttttcaaccctgactag

SEQ ID NO: 132341 - DNA, 1614 bp, Artificial Sequence
  Description of Artificial Sequence: Synthetic coding sequence
atgtcctgggccgcgcggccaccattcctcccacaaagacacgcagctggtcagtgcggtcccgtgggggtccgcaaagagatgcattgtggcgtggcctcacggtggaggaggagacggccatggctggatccagccgcagcagccgctgccgccgtcgccggaggagagcagcagacgccggaacccgaaccaggcgaagccggcagagatgggatgggagattccggcagggactcacgctcaccagatagttcatccccaaatcccctgcctcagggtgtacctccgccctcaccccccggccctccattaccgcccagtaccgctccctctctgggaggctcaggcgccccaccccctcctccaatgccccctcctccgttaggctctccttttcctgttatttcttcaagtatgggctcaccggggttacccccccctgctccgccaggattctcagggccagtttcttctccacagattaactccacagtgagcctgcctggcgggggttcaggtccgcccgaagacgttaagcctcctgttctaggcgtacgcgggttgcactgcccgcctccacctggtggccctggtgcaggtaagaggctgtgtgctatttgcggcgataggagctcgggtaagcattacggagtttatagctgcgaaggatgcaaaggattttttaaacgcaccattaggaaagatctgacatactcatgtagggacaataaagattgtaccgttgataaaaggcagcgaaataggtgtcagtattgtagatatcagaagtgtctggccaccgggatgaagagagaagctgtccaggaggaaagacagcggggcaaggataaagatggagatggagagggagcagggggggcccccgaggaaatgccagttgaccgaattttggaggcggaacttgctgtggagcagaagtctgatcaaggtgtcgaagggcccggaggcaccggaggatcggggtcatcgcctaatgaccctgtgacaaatatttgtcaagctgccgacaaacagctgttcactctagtcgagtgggccaaaaggattcctcatttcagtagtctccctctggatgatcaggtgatccttctgagagctggctggaatgagctcctgatcgcgtctttctcgcaccgctccatagacgttcgggacgggatcctgctcgccaccggcctgcacgtgcacaggaattcagcccatagtgctggggtgggggccatttttgaccggtccctcagtagggtgctgacagaacttgtctccaagatgcgggatatgaggatggacaagacagagctgggctgtctgcgcgcgatcattttattcaatcctgatgccaaaggtctttctaacccttctgaggtagaggtattacgagagaaggtttacgcttccctagaaacctactgcaagcagaagtaccccgaacaacaagggaggtttgctaagctgctgctgagacttcctgctctgcgcagcatcggcctcaagtgcctagaacatctattctttttcaagctgattggggacacgcccattgacaccttcctgatggagatgcttgaggctcctcatcagctcgcttag

SEQ ID NO: 132342 - DNA, 1602 bp, Artificial Sequence
  Description of Artificial Sequence: Synthetic coding sequence
atgtcatgggcggcacgtccacctttcttgcctcagcgccatgccgcgggacaatgcggacctgtgggcgtcagaaaagagatgcactgcggagtagcttcccgttggcgcaggcgtaggccatggctcgacccagctgccgccgccgccgcagcggttgccgggggagagcagcaaacgcctgaaccagaaccaggagaggccgggcgcgatggaatgggggactccggaagggactcccgctcacccgatagtagtagccccaatcccctcccacagggggtcccgcccccatcgcctccaggacctcccctgcctcccagcactgcgccttccttaggtggatctggggccccccctcctcctcctatgcctccgccacccttaggttcccctttcccagtaatctccagcagcatgggcagtccaggacttcccccccctgcccctcccggctttagcgggcctgtgtcttctcctcagatcaacagcactgtgtctctgcccggggggggttcaggacctcccgaagatgtgaagcccccggtcctcggtgtacgcggactacactgcccacccccacctggcggaccaggggccggcaagcggctgtgtgccatttgtggtgaccgctcctccggtaagcactatggcgtgtactcttgtgaggggtgtaaaggcttttttaaaagaacaatccggaaagacctgacttacagctgccgggacaataaagactgtactgttgacaaaaggcagcgcaataggtgccagtattgtcggtatcagaagtgtctggccacaggaatgaagagagaggcagtgcaagaagagcggcagagagggaaggacaaggatggcgacggtgagggggccggcggggcccctgaagagatgccagtggaccggatactcgaagccgagctggctgtcgagcagaaaagcgatcaaggagttgagggaccaggaggtacaggcggctcaggatccagccccaacgatccggtcaccaatatttgccaggctgcagacaaacagctctttaccttggtcgaatgggccaagcggattccacacttctccagtttaccccttgacgatcaggtgatcctgctgagggcaggttggaacgaattgctaatcgcgtcttttagccataggtcaatcgacgtgcgcgacggtatccttctcgctacaggtctgcacgtccaccgcaacagcgcccacagcgcaggagttggggctatcttcgatagggtgttgacagagctcgtatccaagatgagggacatgcgcatggataaaacagaactgggctgcctgcgcgcaattattctgttcaaccccgacgccaaagggttaagcaacccttccgaggtcgaggtcctaagggagaaagtgtatgctagtcttgagacatactgtaagcagaagtacccggagcagcaggggaggttcgctaaattgcttctacggctaccagcccttagaagcatcggattaaagtgcctcgagcacttgttttttttcaagttaattggagacacacctatcgacacgttcctcatggaaatgttggaggccccccatcagctggcctag

SEQ ID NO: 132343 - DNA, 1602 bp, Artificial Sequence
  Description of Artificial Sequence: Synthetic coding sequence
atgtcttgggcagcccgacctccatttctccctcaacgtcacgccgctggtcagtgcggcccagtaggggttaggaaagagatgcactgcggagtcgccagccgctggagacgcagacgcccctggctggaccccgcagctgcagctgctgctgctgtggcagggggagaacaacagaccccggagcccgagcccggggaggctgggagagacggcatgggggacagcggacgggactctcgctcccccgactccagcagtcccaatccccttccccagggcgtgcctcccccatccccccctggacctcccctgccaccttcaacagccccttcccttggaggttctggagccccccccccccctcccatgccacctccccctctcggctctcctttccccgtcatatcatcttcgatgggcagcccaggccttcctccgccagcaccgcccgggttctcaggccctgtttcttctccgcaaatcaattctaccgtgtccctgcctgggggcggatctggccccccagaggatgttaagcccccagttcttggggtgcgcggtctccactgcccccctcctcctggcggacccggcgccggcaagaggctctgcgcaatttgtggagacagaagctcggggaagcactacggtgtgtacagctgtgagggttgtaagggcttttttaagcgaacgatcagaaaggatttgacctattcatgcagagacaataaagactgcaccgtcgataaacgtcagcgcaatagatgccagtactgccggtaccagaagtgccttgcgactgggatgaagcgcgaggctgtgcaggaagaacgccaacgagggaaggacaaagacggagatggcgagggcgcaggaggcgcgcccgaggaaatgcctgtggacaggattttagaggcagagttggcggtggagcagaaaagtgaccagggagtcgaggggcccggaggcacgggcgggtcaggaagctcacccaacgaccctgtaacgaacatctgccaggctgccgacaaacagttgttcactctagtagaatgggccaaacgcattccccacttttccagcctcccactggacgatcaggttatccttcttagagccggatggaatgagctactgattgcaagcttctcgcaccgaagcatagatgtaagggacgggattctgttggctacaggcctgcatgtgcatcgaaactcagctcactctgccggggtcggggcaattttcgaccgcgttctaacggagttagtgtctaagatgcgagatatgcggatggacaaaactgaactcggatgtttacgcgccatcatcctttttaaccctgacgctaaaggattgtctaatccatccgaggtcgaggtgctgcgtgaaaaagtctatgcatctttagaaacttactgtaagcagaaatatcctgagcagcaaggtcgattcgccaagcttttactgcggctgcccgctctgagatccataggcttgaagtgtcttgagcacctgttcttctttaagcttataggcgataccccaattgatacattcctgatggagatgttggaggcaccgcaccaactcgcctag

SEQ ID NO: 132344 - DNA, 291 bp, Artificial Sequence
  Description of Artificial Sequence: Synthetic coding sequence
taaagccccaatgatcccgtaaccaatatttgccaggctgcagataaacagttattcacactggtggagtgggcaaaacggatcccacacttcagctcactcccactcgatgaccaggtgatcctcttaagagcaggcctacacgtccatagaaacagtgcccactcagccggagtgggagcgatttttgacagagttctgactgaactggtctccaaaatgagagatatgcgcatggacaagacggaactgggctgcttacgggctatcatcctgttcaatccagattag

SEQ ID NO: 132345 - DNA, 291 bp, Artificial Sequence
  Description of Artificial Sequence: Synthetic coding sequence
tagtccccgaatgatccggtcaccaacatctgccaggccgccgataaacagctttttactctagttgaatgggctaaaaggataccccacttttctagtttaccgctggatgaccaggtgatcctgttgcgggctgggctgcatgtccaccgtaattccgcccatagtgctggcgtgggtgctatcttcgacagggttctgaccgagctggtcagcaagatgagagacatgcgcatggataagactgaacttggctgtcttcgagcaatcattttatttaacccggattag

SEQ ID NO: 132346 - DNA, 1614 bp, Artificial Sequence
  Description of Artificial Sequence: Synthetic coding sequence
atgtcttgggccgcccggcctccattcctcccccagcggcacgctgcaggtcagtgtgggcctgtcggggtccgaaaggagatgcattgtggagtcgcctccagatggcggcgacggagaccttggctcgaccccgccgctgccgccgccgctgcggtcgccggcggggagcagcagactcccgaacctgagcctggagaagctggacgggatggcatgggtgacagtggtcgagacagcagaagtcctgattcctcttctccgaatccactgcctcagggagtcccgccaccttcccctcctggtcctccactgcccccaagcaccgctccttcactggggggctcgggagcgcccccaccaccccccatgcccccccccccgttaggctcgccgttccccgtgattagctcatctatgggctcacccggacttccccccccggcccctccaggctttagcggccctgtcagtagccctcagatcaactcaaccgtgtccctgcccgggggcgggagcggccctccagaagatgttaaacccccagtccttggcgtgcgtggcctccactgtccacccccgccgggtggaccaggcgccggcaagcgactttgtgccatctgcggcgatcgcagttcaggtaaacattacggtgtgtactcctgcgagggttgcaagggcttcttcaagcgcactatacgcaaggatttgacctattcatgtagagacaataaagattgcacggtcgataaaaggcagagaaaccggtgtcaatactgcagataccagaagtgcctggccactggcatgaagcgggaggctgtccaggaggagagacagagaggtaaagacaaggacggagacggcgaaggagcgggcggcgctccagaggaaatgcccgtcgatagaatcctagaggcagaactggcggttgagcagaagagtgatcagggcgtcgagggtccagggggtaccggaggtagcggctcctcccccaacgatccggtaacaaacatttgtcaggccgcagataagcagttgttcaccctggttgaatgggctaaaagaatcccccatttcagtagtttacctctggatgaccaagtgatcttattgcgcgcaggatggaatgaactgttgattgcaagctttagccatcgatccatcgacgtacgcgatggtatactgctggcgacaggcttacatgttcaccgcaatagcgctcactccgctggcgtcggcgcaatctttgatcgatcactttccagggtgctgacagagctagtgtccaagatgcgggatatgcgaatggacaagaccgaactcggctgcctgagggccatcatcctgttcaacccagacgccaagggattgtctaacccctctgaggtggaggttcttcgtgaaaaggtttatgcttcccttgaaacctactgcaaacagaaatatcctgagcagcagggtaggtttgcaaagctgctgcttcgtctgccggcactacggagcattggcctgaaatgcctcgaacacctgttcttcttcaagctcattggagatactcctatagatacgtttctgatggagatgctggaggctccgcaccaactcgcatag

SEQ ID NO: 132347 - DNA, 291 bp, Artificial Sequence
  Description of Artificial Sequence: Synthetic coding sequence
tagagccccaatgatcccgtgacaaatatttgccaggctgccgataaacagttgttcactctagtggagtgggccaaacgtatcccccacttctcatcgctgcctctggacgatcaggtcatactgcttagggctggcctgcatgtccatcggaacagcgcccatagcgccggagttggtgccatcttcgaccgtgtgctgaccgagttggtctcaaagatgagggatatgaggatggataaaactgagctaggctgtctgagggccatcatcctgttcaaccctgattag

SEQ ID NO: 132348 - DNA, 1614 bp, Artificial Sequence
  Description of Artificial Sequence: Synthetic coding sequence
atgtcatgggccgcgcgccccccttttctccctcaaagacatgccgctggccagtgcgggcccgtgggagttcgcaaggagatgcattgtggggtggcaagcaggtggcgaagacggaggccatggttggatcccgccgcagcggctgccgccgccgtcgccgggggtgaacagcagacaccagaaccggagccaggagaggccggccgggacgggatgggcgatagcggcagagactctagaagcccagactcctccagccctaacccacttccgcagggagtgccccctcccagtccaccaggaccacccctcccacccagtactgctccatccctggggggctcaggagcccccccaccaccccccatgcctccaccccccttggggtccccctttccagttatatccagctccatgggaagccctggcctcccccctcccgcccccccaggctttagcggtccagtgagcagtcctcagataaatagcacggtgagtctacctgggggcggttccggaccaccagaagatgtgaagcccccagttctgggggtgagaggcctacattgcccaccccccccaggcgggcccggtgctggcaaaagactgtgtgccatttgtggggaccgctcctcaggtaagcattatggagtgtattcttgcgaaggatgcaaaggattttttaagagaacaattagaaaggatttgacatactcctgccgagacaacaaggactgcacagtcgacaagcggcagcgaaaccgctgtcagtactgtagatatcagaagtgtctggctacagggatgaagcgggaggcggtccaagaggaacgccaacgcggaaaagataaagatggcgatggggaaggagctggcggggcccccgaggaaatgccggtggatcgcattttagaggccgagctggccgtggaacagaaaagcgaccagggtgtagaaggccctggcggaacaggaggatccggatcctctcccaatgacccagttaccaatatttgccaggctgcagataagcagcttttcacattagtggagtgggctaagcggatcccacacttttccagcctccccctggacgaccaggtgatactgctcagagcagggtggaacgaacttctgatagcaagtttctctcaccggtctattgatgtgagagatgggattctcttggccaccggtctccacgtccatcgtaactcagcccactcagctggcgtcggggcaattttcgaccgttctctaagtcgggtgctgacagagctcgtgtccaagatgagagacatgagaatggataagacagaactgggctgtctgcgtgccattatcctatttaatcccgatgccaaggggctcagtaatccttctgaggtagaggttctccgggagaaggtttacgccagcctggagacttactgtaagcaaaaatatcctgaacagcaggggcggtttgccaagctgctactgaggctgccagcgctccgatcaatcggattgaaatgtctcgaacatttattcttttttaagcttatcggggacactccaatcgacaccttcctcatggagatgctggaggcccctcaccaacttgcttag

SEQ ID NO: 132349 - DNA, 1614 bp, Artificial Sequence
  Description of Artificial Sequence: Synthetic coding sequence
atgagctgggctgcgcggcccccgtttctgcctcagaggcatgcagctggtcagtgtggacccgtgggggtccggaaggagatgcattgtggggttgcttctcggtggcggcggaggaggccatggcttgatcctgccgccgccgcagccgccgccgtggctgggggcgagcagcagacccctgagccggagcctggggaagcgggcagggatgggatgggcgattcagggcgagacagcaggtcaccagactcgagttcaccaaacccactacctcagggggtgccccctcctagccccccggggcctcctctaccacccagtaccgccccgagcctcggaggttcaggagcccccccaccacctcctatgcctcctccccccttgggttcgccattccccgtgatttcaagcagtatggggagccctgggctacctcctcccgctccccccggtttctcgggtcccgtctccagcccccagattaacagtaccgtttctctgccagggggtggatcgggaccccccgaggacgtcaaaccccctgtgctcggggtgcgcgggctgcattgcccacctccacctggagggcccggagccggcaagcggttgtgcgctatctgtggcgatcgctccagcggcaagcactatggtgtgtactcttgcgagggctgtaagggctttttcaagcggacaattaggaaggaccttacttattcttgccgcgacaataaggattgcacagtagataagcggcagagaaaccggtgccagtactgcagataccagaagtgtctggccaccggcatgaagagagaagcagtgcaggaagagaggcaacgcgggaaagacaaagatggtgatggcgaaggtgctggaggagccccggaagagatgcccgtggataggatcttggaggccgagctagcagtggaacagaagagcgatcagggcgttgagggacccggagggacaggcggatctggttcttcccctaatgaccctgtgacgaatatctgccaagccgctgacaagcaactcttcacactagtggagtgggcaaaaagaatccctcatttctcctccctgccactggacgatcaagtcattctccttagagccggctggaacgagctgcttatcgcttcattctctcaccgctcaattgacgtgagggacggaatactgctagccacaggactgcatgtgcacaggaactctgcccatagcgccggagtaggtgcaatctttgaccgtagtctgtcacgagttctgaccgaacttgtgtcaaaaatgcgggacatgagaatggacaagacagaattgggctgcttgagggccattattctttttaatcctgatgccaagggcctgtccaacccgagtgaggtcgaggtattgagagagaaggtatatgcgtctttggagacttactgcaagcagaagtatccggaacaacagggtcgcttcgctaaactattgcttcgcctgcccgccttgcgatcaattggactgaaatgccttgagcatctgttcttttttaaactgatcggagacacccctatagacactttcctcatggagatgctcgaggcaccccatcagctggcttag

SEQ ID NO: 132350 - DNA, 1044 bp, Artificial Sequence
  Description of Artificial Sequence: Synthetic coding sequence
atgcgcgaatgcggcggaggaccgggagcaggcaaacgcttgtgcgcaatttgcggagacagatctagcggaaagcattacggggtgtacagttgcgaaggttgcaagggatttttcaaaagaacaattcggaaggacctgacttacagttgcagggacaataaggactgcacagttgataagcgccaacggaacaggtgtcagtactgtaggtatcaaaagtgcttggccaccggaatgaagagagaggccgtacaggaggaacgccagagaggcaaggataaggacggcgatggggagggggccggcggtgcccccgaggaaatgcccgtcgatcgaatcctggaagccgagcttgccgttgagcaaaagagcgaccagggcgtagaggggcccggcggtaccggtggcagtggttcgagccccaatgaccccgtgactaatatctgccaagcagccgataagcagctttttacattggtcgagtgggccaagagaatcccccacttctcaagcttgcctttagacgatcaggttatcctcctgagggctggctggaatgagttgctcattgcctctttctcacatagatccatcgatgtgagagacggaatcctgctagcgacagggctccatgtccacaggaattctgcccactccgccggcgtcggcgctatctttgacagatccctttcgcgggtactgactgaactggtctctaagatgagggatatgagaatggacaagaccgagttgggttgccttcgcgctataatcctattcaatccggatgctaagggcctgtccaatcccagcgaagtagaggtcctccgcgagaaggtatatgcttccctggagacatactgtaaacagaagtatcccgagcagcaaggacggttcgcgaagctcctcctaaggcttcccgctctgaggagtattgggctgaagtgtcttgaacacttattttttttcaagctgattggcgacacccccattgacaccttcctcatggaaatgctagaggctccccaccagctggcctag

SEQ ID NO: 132351 - DNA, 1179 bp, Artificial Sequence
  Description of Artificial Sequence: Synthetic coding sequence
atgggttctcctggcctcccacctcctgcccctcctggcttctctgggccagtatccagccctcagattaacagcactgtttcactcccaggcggaggaagtggccccccagaggacgtcaaaccccctgtccttggcgtccgcggccttcattgcccgcctccacccggtggccccggcgccggcaagcgcttgtgtgccatatgcggagatcggtctagtggtaagcactacggggtatattcttgtgaagggtgcaagggattctttaaaagaacgattcgcaaggatctgacctacagctgcagggataataaagattgtactgtggacaagaggcagagaaacaggtgccagtactgcaggtatcagaagtgcctagctacaggcatgaaacgcgaagctgtgcaggaggaaaggcagagaggcaaggacaaggatggagacggagagggagccggtggtgcccccgaggagatgccggttgacaggattttagaggcagaattagccgtggagcagaagtctgaccagggcgtggagggtcccggcgggaccggagccccatcgcccaacgacccagtgactaacatctgccaggctgcggataagcagctgtttaccctcgtggagtgggccaaacgtattccacacttcagtagtctgcccttagatgatcaggtcatattactgcgagctggctggaatgaactgctgatagcatccttctctcataggtcaatcgacgtgcgcgatggaatcctactggccactggactccacgttcataggaatagtgctcactcagctggcgttggggcaatttttgatcgtgtcctaacagaactggtctctaagatgagagacatgagaatggacaaaactgagttgggttgcctcagggcaattatccttttcaaccccgacgctaagggcctttctaacccatctgaagtggaagtgcttcgcgagaaggtttatgcttccctcgaaacctactgtaagcagaagtatcctgaacagcaaggaaggtttgcaaaattactactgcggttgcctgcgttacggagtatcggactgaagtgtctcgagcacttgtttttcttcaagctgatcggagacactccaatcgacacattcctaatggaaatgctcgaggcgcctcaccagttagcgtag

SEQ ID NO: 132352 - DNA, 1170 bp, Artificial Sequence
  Description of Artificial Sequence: Synthetic coding sequence
atgggctctccagggcttccgccccccgccccgccagggttctcgggaccagtttctagcccgcagatcaactcaaccgtatcgctacctgggggcgggtccggacctcccgaggacgtgaagcctcctgttcttggcgttcgggggctccattgcccaccccccccaggagggcctggcgcgggtaagaggttgtgcgcaatttgtggcgaccggagcagcggaaagcattatggcgtctattcttgtgaggggtgcaaaggatttttcaaaagaactattcgtaaagatctcacctactcctgtcgggataacaaggattgcacggtggataagagacagaggaatcgctgccaatactgccgctatcagaaatgcctggcgactggcatgaagagggaggccgtgcaggaggaaagacagcgagggaaagataaggacggtgatggcgaaggggcaggaggcgcacctgaggaaatgccagtggatcgaatccttgaggctgaattggccgtcgagcagaagagtgaccaagggggctctcagcatatttcgaaatctcctaatgatcctgtcactaatatctgtcaagctgcggataaacagttgttcaccttggttgagtgggctaaacgtattccacatttttcctccctccctcttgacgaccaggtgatcttgcttcgggcaggttggaacgagctgctgatagcttcttttagtcaccgctcgattgacgtgcgcgacggaattctgttagctactggtctccacgtccaccgtaactcagcacactccgcaggcgtgggggctatcttcgaccgagtcctgaccgagcttgtttccaagatgagagatatgcgaatggacaaaacagaactcggctgtttacgggctatcattctatttaaccccgatgccaaaggcttaagcaacccatccgaggtcgaagtgttacgcgaaaaggtgtacgcctcattggaaacatattgtaaacaaaagtatccggagcaacaaggcagatttgctaagctgctgctaaggctgcctgctttgaggtccattggtctcaagtgtctggagcacctgttcttcttcaagctcatcggcgatacccccattgatacctttctgatggagatgctggaagcgcctcatcagctggcctag

SEQ ID NO: 132353 - DNA, 1044 bp, Artificial Sequence
  Description of Artificial Sequence: Synthetic coding sequence
atgagagagtgcggcggcgggcctggcgctggtaagaggctgtgcgcaatatgcggtgaccggagctcaggaaaacactatggagtctatagttgtgaggggtgtaaaggctttttcaagaggaccattcgaaaggatctgacatattcctgccgcgacaacaaggactgcacggtggataagcgtcaaagaaacaggtgccagtattgtcgctatcaaaagtgtctcgcaaccggaatgaagagagaggctgtccaggaggaaagacagcgtggcaaagacaaggatggggacggtgaaggggctgggggtgctcccgaagaaatgccagtggatcggattctggaagccgaacttgcagtcgaacaaaagagtgaccagggggtagaggggccaggagggaccggagggtccggatcttcacctaatgatccagtcactaacatctgccaagccgctgataaacagctttttaccctggtcgaatgggctaagagaatcccacacttctcatctcttcctcttgacgatcaggtgatcctgcttagagcaggatggaatgaacttctaatagccagcttctctcaccgaagcatcgatgtgcgtgacggaatccttctggcgactgggctgcatgttcacaggaactcggcgcactccgccggtgttggcgccatcttcgatcggagcctgtcacgtgtcctaacagagctcgtctcgaaaatgagagatatgaggatggacaagaccgagctcgggtgtctgcgggctattatcctttttaacccagatgctaagggtttgagcaaccctagcgaagtggaagtgctccgtgaaaaggtctacgctagcctcgagacctattgtaaacagaagtatcccgaacagcagggtcggtttgcaaagttgctgcttcgacttcccgcgcttagatcaatcggcctgaagtgcctcgagcacttgttcttttttaagctgataggagacacacccatcgacacctttcttatggagatgttagaggctccccatcagctggcgtag

SEQ ID NO: 132354 - DNA, 1179 bp, Artificial Sequence
  Description of Artificial Sequence: Synthetic coding sequence
atgggcagcccaggtctgccaccccccgctccccccgggttttccgggcccgtcagctcaccccagataaattcaacagtgtcgctgccaggcgggggcagtggcccccctgaagacgtaaaacctccagtcttgggggtacgtgggctgcactgccctcctcccccaggagggcctggagccggcaagaggttgtgcgcgatttgtggagaccggtcttctggaaagcactacggtgtatacagctgtgaagggtgtaagggcttcttcaaaaggaccatccggaaagacttgacctattcttgccgggataataaagattgtacagttgataaacgccagcgaaatagatgtcagtactgcaggtatcaaaaatgccttgcaaccggcatgaagcgggaagctgtgcaggaggaacgacagagaggaaaagataaagatggggacggagaaggcgccggcggagcgcccgaagaaatgccagtcgaccggatccttgaggctgagctggcggtggaacagaagtccgaccagggtgtggagggcccaggaggaacaggtgccccgtcgcccaacgatccagttactaatatttgccaggctgcagacaagcagttattcacgttggtggagtgggcaaaacgtatcccccacttctcaagcttacctcttgacgaccaggtgattctgctccgggcaggctggaatgaattgctgatcgcttcattctcccacagaagtatagacgtgagggacgggatcctactcgcaacaggactgcacgtccataggaacagcgcacattctgccggggtcggcgcaatcttcgacagagtcttgaccgagctcgtgtcaaaaatgcgggatatgcggatggataagacagaattggggtgtttacgggccattatcctgttcaaccccgatgcgaaaggactcagcaatcctagcgaggtggaggtgctgagggagaaagtgtatgcatccctggagacctactgcaaacagaagtaccctgagcagcagggccgctttgccaagcttctgcttaggcttcctgcactgcgctctattggtcttaagtgtctcgaacacttgttcttttttaaactgataggagacacccccatcgataccttcctcatggagatgctggaagctccccaccaactggcatag

SEQ ID NO: 132355 - DNA, 1170 bp, Artificial Sequence
  Description of Artificial Sequence: Synthetic coding sequence
atgggaagccccgggctgccacctcccgctccgcccggattcagcggacctgtgagctctccacagatcaactcaactgtgtctctgccagggggcggatccgggcccccggaggatgtgaagccacccgtgttaggcgtgaggggcctgcattgtcccccgccccccggaggccctggcgctggaaaacggttatgtgcgatttgcggggacaggtcaagcggcaaacattacggggtttactcttgcgagggctgcaagggcttcttcaagaggacgatccgcaaggaccttacatattcctgtcgcgacaataaggactgtactgtggacaagcgccagagaaacaggtgccagtattgccggtatcagaaatgcctcgcaaccggcatgaagagagaagcagtgcaggaagaaaggcagagggggaaggacaaagacggtgacggtgagggcgcggggggcgcaccagaggaaatgcccgttgaccgcatcctagaggctgagctggcggtcgaacaaaagtccgatcagggcggaagtcagcacatttccaagagcccgaatgatcccgtgacaaacatttgtcaggccgccgataagcagctgttcaccctggttgagtgggcgaagcggatacctcatttttcctctctaccgttagacgaccaggtgattttgctgcgggcaggatggaacgagctcctgattgcttctttttcacaccgtagcatcgatgttagggacggtatcttgctcgctacaggcctgcacgttcacagaaacagcgctcactctgccggcgtgggggccatcttcgaccgtgtgctgacagaactagtgagtaagatgcgcgatatgcggatggacaaaactgagcttgggtgtctgcgtgccataatccttttcaaccccgatgctaagggactcagtaatccttcagaagttgaagtactgcgcgagaaagtgtacgcatcgctagagacctactgcaagcagaagtatcctgagcagcagggacgcttcgccaagctcttgctgcggctgccggccttgcgcagcattgggctgaaatgtctagagcacctcttttttttcaaactgattggggacactcctattgacacatttttgatggagatgttggaagcccctcaccaattagcctag

SEQ ID NO: 132356 - DNA, 861 bp, Artificial Sequence
  Description of Artificial Sequence: Synthetic coding sequence
atgccccagggatctgtgggtcgatggggatgcgaaaaaaagtgtatcgttggatccagaccagggggagggggagacgggccggggtggattcctcagcggaggcggagacgccgctggcaagccgagaacaataaaccacggtctaggagtcaaggacgtctggacggcacaggatgggcaacggctggcggcataaatagcacagttagtctgcccgggggcgggtcaggccctcccgaggacgttaagcctcccgtgctcggggtacgaggactgcactgtcctcctccccccggtgggcctggcgctggaaaaagactgtgcgcaatttgcggcgacagaagctctgggaagcattacggcgtttacagctgcgaagggtgcaaggggttttttaagcgaacaatcaggaaggacttaacttacagttgcagagacaacaaggactgtaccgtggataagaggcaacgcaaccggtgccagtactgtcgttatcagaagtgtctagcaaccgggatgaagcgagaagctgttcaggaggagagacaacgaggcaaagataaggatggtgacggggagggagccgggggtgcacccgaggagatgcccgttgacaggattctggaagccgaattggccgtggagcaaaagagcgaccaaggggtagagggccctgggggcacggggggatcaggctcgagtgtgagcgtcggggtcaaccctctgagtttcgtcatgggggtgggcggtggcagcctcggactgttctatatacctagcccgtcatttcccctgataacattcctgaccttgctggggaccgggggtgccgcgaaacaggggcttagcaacatttag

SEQ ID NO: 132357 - DNA, 1170 bp, Artificial Sequence
  Description of Artificial Sequence: Synthetic coding sequence
atgggcagccctgggcttccccccccagcccccccgggattttctggcccagtctcctccccccagataaactccacagtatctttgcccggaggcggttcaggcccgccagaagacgtgaaaccaccagttctgggggtgaggggattgcactgccccccacccccaggcggccccggggcaggtaagcgtctgtgcgccatttgcggagaccgctcatctggcaaacattacggagtgtacagttgcgaggggtgcaaggggtttttcaagcgaacgatccgtaaagacctgacttactcttgccgggacaataaagactgcacagtcgataagagacagcgcaatcgatgtcaatattgccggtaccagaaatgtctggccactggcatgaaaagggaagcagtacaagaggagcggcagcgtggcaaggacaaggacggggacggcgagggcgccggcggagcacccgaagaaatgcctgtcgatcgtattctggaagctgagctggcagtggagcagaaatctgatcaggggggaagccaacacatttctaagtccccgaacgaccccgtaactaacatttgtcaggcggccgacaaacagttattcactctggtagagtgggctaaacgaattccccacttttctagcctgccccttgatgatcaggtgattctcctgagagccggctggaatgaacttttaatagcctcattctcccatagatcaatcgatgtgagggacgggattctactggccacaggcctacatgtccacaggaactccgcgcactctgcgggagtgggggctatctttgacagggtgcttactgagttagtgagtaagatgcgcgacatgagaatggataagacagaactgggatgccttcgcgccatcattctcttcaaccctgatgccaaagggctctccaacccatctgaggtggaagtcctgcgggagaaagtgtatgcctcactggaaacctactgtaaacagaaataccccgaacagcagggacggttcgccaagttgctgctgcggctgcccgccttgcggtccataggcttaaagtgtttggagcacctttttttttttaagctcataggagacacgccgattgatacattcctgatggagatgctggaggccccacatcagctcgcctag

SEQ ID NO: 132358 - DNA, 861 bp, Artificial Sequence
  Description of Artificial Sequence: Synthetic coding sequence
atgccccaaggtagcgtggggagatggggatgtgagaaaaaatgtattgttggttcacgacctggtggaggcggagatggcccaggctggatccctcagcgccgtcggcgtaggcggtggcaggccgagaataacaaaccgcggagccgaagtcagggcaggctggacgggaccggttgggccacggccggcggcattaactcaacagtgtccctgccaggcgggggttcagggcccccagaagacgtgaagccgcctgttctcggagtgagagggttgcattgccctcctcccccaggtggcccgggcgcgggcaaaaggctttgcgccatctgcggggatcgctctagcggaaaacattacggggtgtactcctgtgagggttgtaaaggtttttttaagagaaccatacggaaagacctgacctactcctgccgcgacaataaagactgcactgtggacaagcgacagcggaatcgatgccaatactgcaggtatcagaaatgcttggcaacgggcatgaaaagagaggcagttcaagaggagaggcagcgcggaaaagacaaggacggtgacggggaaggagccggaggtgcgccggaggagatgcccgtagatcgcattttagaggccgagttggctgttgaacagaagtcggatcagggggtcgagggaccaggcgggaccggtgggtccggatcctcagtgtccgttggagtgaaccccctcagcttcgtcatgggcgtgggtgggggctcccttggacttttttacattccaagcccttctttccccctgattacatttctgacattgctcggaaccggcggggcagctaagcaaggcctgtccaatatttag

SEQ ID NO: 132359 - DNA, 1179 bp, Artificial Sequence
  Description of Artificial Sequence: Synthetic coding sequence
atgggcagtcccggcttaccccctcccgcacccccgggctttagcggcccagtgtctagtcctcagataaacagcactgtgtcattgcctgggggcggctctggtcctccagaggatgtgaagcctcccgtgctgggcgttcgaggtctgcattgtcctcctcctccagggggtccaggcgccggtaaacgattgtgcgcaatctgcggggacagaagttcgggcaaacattacggggtatacagctgtgaaggatgtaaaggctttttcaaaagaacgatccgcaaggatctgacctatagttgtagagacaataaggactgcaccgtggacaaaaggcaacgcaatcggtgtcaatactgtagataccagaagtgtcttgctacagggatgaaaagggaggccgttcaggaagagcgacagagaggcaaggacaaagacggagacggagaaggcgcagggggagccccagaagaaatgccagtggatcgcatcctggaggccgaattagccgtcgaacagaagtcggatcagggcgtcgagggaccaggggggaccggggcgccctctccaaacgacccagtgaccaatatctgtcaggctgcagacaaacagctcttcacgctggtggagtgggcaaaacggatccctcatttcagttccctcccactagatgatcaggtgatactgctgcgggccggttggaacgaacttctcatagcttctttttctcaccggtcaatcgatgtgagggacgggatcctactggctacaggccttcacgtgcatcgcaattctgcccactctgccggcgtcggcgcaatcttcgaccgggtgcttaccgagctggtctcgaaaatgcgcgacatgcggatggataaaaccgagctcggctgtctgagggctattatcctgttcaacccagatgccaaggggctttcgaacccaagcgaagtggaggttctgagagaaaaggtctatgcttcgctagaaacttattgcaagcaaaaataccccgagcagcaggggagattcgcgaagctactgctgcgactacctgcccttcggagcatcgggctcaagtgtctggagcatctgttcttttttaagctcatcggggacactcccatagatacttttttaatggagatgctcgaggccccccatcagctcgcctag

SEQ ID NO: 132360 - DNA, 1044 bp, Artificial Sequence
  Description of Artificial Sequence: Synthetic coding sequence
atgagagagtgcggagggggtcccggagccgggaaacggctgtgcgcaatttgcggtgatcggtcctcagggaaacactacggggtgtactcctgtgaagggtgtaaggggttctttaagcgcaccatcaggaaagatctgacctacagctgtcgcgataacaaggactgtaccgtggataaaaggcagcgaaatcggtgtcagtactgccgataccagaagtgtctggcaacgggcatgaagagggaggctgtgcaagaagaaagacagcggggcaaggacaaggacggggacggggagggcgccggcggggctcctgaggaaatgccggtggaccggatactggaagctgagctcgcagtcgagcagaaatctgatcagggggtagagggccccggcggaacaggtggatccggctcgtcacctaacgatccagtgactaacatctgtcaggctgcagacaaacaactgtttactctggtcgagtgggctaaacggatccctcactttagctccctcccacttgacgaccaggtcatccttttgcgcgccgggtggaacgagctcctcatcgcaagcttttcccaccgaagtattgacgtgagggacggcattctcctggccaccggcctccacgtgcacagaaattccgcccactcggctggggtcggagccattttcgatcgaagtctctcgagagtgttaactgaactggtgagcaagatgagggatatgcggatggataagactgagcttgggtgtttaagggccattatcctgttcaacccagacgctaagggcttgtctaatccgtcggaagtggaggtccttcgcgagaaggtgtatgcctcactggagacctactgtaaacagaagtacccggagcagcaggggcgatttgcgaaacttctcttacgccttcctgccctgaggtctataggcttaaagtgcctggaacacctgttctttttcaaactgatcggcgacactccaattgataccttcttaatggaaatgctggaggctccccaccagctggcatag

SEQ ID NO: 132361 - DNA, 1179 bp, Artificial Sequence
  Description of Artificial Sequence: Synthetic coding sequence
atgggcagccccgggttaccacccccagcacctccaggtttcagcgggcctgttagttcaccccagatcaatagcacagtcagcctgcctggagggggaagcggaccaccagaagacgtgaaacctccagtccttggcgttcggggcttacactgccctccacccccgggaggaccaggagccggaaaacgcctgtgcgcaatctgcggcgataggagtagtgggaaacattatggcgtttactcttgtgagggatgtaaggggttctttaaacgcacgattcgcaaggacctcacatattcctgcagagacaacaaagattgcaccgttgacaaaagacaaagaaacagatgtcaatattgcagataccagaagtgcctagctaccggcatgaagagggaggcagtgcaagaagagaggcagaggggcaaggataaggacggggatggcgagggggccgggggggccccagaggagatgccagtggaccgcatcctggaggcggaattggctgtggagcagaaaagtgaccagggcgtggagggaccaggtggcactggggccccgtcacctaatgaccccgtcacaaacatatgccaagctgccgataagcagctttttaccctggtagagtgggccaagaggataccccatttttccagtctgcctctggacgatcaggtcattcttctcagagccggatggaacgagctgctgatagccagcttctctcaccggtctatcgatgtccgggacggaatcctgctcgcaacaggcctgcacgtgcatagaaactccgcgcacagcgcgggtgtcggcgccatctttgatagggtccttaccgagctggtctccaagatgcgcgacatgcgaatggacaagactgagctggggtgccttcgtgcaataatactgttcaaccccgacgccaaagggttgtcgaatccaagcgaggtggaggtgctgagggaaaaggtgtatgcttctctcgagacttattgcaaacagaagtaccctgaacagcaggggcggtttgctaaactactgttgcggctcccggccctccggagtatcggactcaaatgcctcgaacatctcttttttttcaagttaattggggacacgcctatcgatacctttctcatggaaatgctcgaagccccccaccagttggcttag

SEQ ID NO: 132362 - DNA, 1179 bp, Artificial Sequence
  Description of Artificial Sequence: Synthetic coding sequence
atgggaagtccaggcctaccccctccagccccccccgggttctcaggccctgtgtcctcaccccaaattaactctaccgtaagcctgcccggagggggttcagggccgccagaggacgtgaagccccctgtgctcggcgtaagaggcctgcactgtcctcccccacccggcggacccggcgctggaaagcgcttgtgtgccatttgcggtgaccgcagctcagggaaacactacggtgtgtacagctgtgagggctgcaagggattcttcaagaggacgatcagaaaggatctaacatattcctgccgtgataacaaggactgtacagttgataagcgccaacgcaataggtgtcagtattgccgctatcagaagtgcctggctactggtatgaagcgcgaggcagtgcaggaagaaaggcagcgcggcaaggacaaggacggcgacggggagggggcaggcggcgccccagaagagatgccagtggatcggatcctcgaggctgaactcgccgttgaacagaagtcagaccagggtgtggaaggacccggagggaccggcgcgcccagccccaatgatcctgtgacgaacatttgtcaggccgccgacaagcaattattcacgctggttgaatgggccaagcggatacctcacttttcctctctccctctggacgaccaggtcatcctgttgcgcgcaggctggaatgagctgctgattgcctctttctcacacagatcaatcgatgtccgcgatggaatcctgctggccacgggtcttcacgtgcacaggaattccgcacattcagccggcgtgggagccatctttgaccgggtgctgacagagctagtttccaagatgcgagacatgaggatggataagacagaactgggctgtttgcgagctatcattctgttcaacccagacgcaaagggcctgagcaacccttctgaagtggaagtgctgcgtgaaaaagtctacgctagcttagaaacttactgtaagcagaagtatccagaacagcaggggagattcgctaagctactccttcggttgcctgccctgcggagtattggccttaaatgtctcgagcacctttttttcttcaagctgatcggtgatacacctatcgacaccttcttgatggaaatgctcgaggccccccaccagctagcctag

SEQ ID NO: 132363 - DNA, 861 bp, Artificial Sequence
  Description of Artificial Sequence: Synthetic coding sequence
atgccacagggctcagtgggtagatggggctgcgagaagaagtgcatagtggggagcagacccgggggtgggggagacggacccgggtggatcccccagcgccgtagacggcgaagatggcaggccgagaacaacaaacctagatctagaagtcaggggcgactggatggtaccggctgggcaactgcaggaggcattaacagtacagtgtcacttcctggcggggggtccggaccacccgaggacgttaagcctcccgtcctgggagtgcgcggactccactgtccaccgcctcccggaggacccggggctggcaagcgtctctgcgccatttgcggggacaggtctagcggcaagcattacggagtatactcatgcgagggctgtaaaggattttttaaaaggacaatccggaaggacctcacctattcctgtcgggacaataaggattgcacagtagacaaaagacagcgcaatcgatgtcagtattgcaggtatcaaaagtgcctcgccaccggaatgaagagagaagccgtgcaggaagagcgacagaggggcaaagacaaagatggtgacggtgagggcgctggaggcgcccccgaagaaatgccggtggatagaattctggaagccgaactggcggtcgagcagaagtcggatcagggagttgaaggcccaggcggcaccggcggcagcgggtcttccgtctcggtcggcgttaatcccctctcattcgtcatgggggttggcggtggctcattgggcctcttctacatcccttcaccatcctttcctctcattacctttctaacccttcttgggacaggcggagctgctaagcaaggattgtctaatatctag

SEQ ID NO: 132364 - DNA, 1170 bp, Artificial Sequence
  Description of Artificial Sequence: Synthetic coding sequence
atggggtctcctggactgccccctccagccccacctggtttctccggtccggtgtccagtccccagatcaactctacagtgagcctgcctggcggcgggtcggggcctccggaagatgttaaaccccccgtgctcggcgtgagaggcttgcactgtccccccccacccggaggcccgggagccggcaagcggctatgcgccatctgtggggataggagtagtgggaagcactatggtgtttactcctgcgaagggtgtaaaggattctttaagagaacaatccgcaaagatctgacctacagctgtcgggacaataaagactgtacagtagataaacgtcagagaaaccgatgccagtactgtaggtaccagaaatgtctggctaccggaatgaaacgcgaggccgttcaggaagagagacagaggggcaaagataaggacggggatggcgaaggcgccggaggggcccctgaggagatgccagttgacaggattttggaagccgagctggctgtggagcagaagtcagaccagggagggtcacagcatattagcaagagtcccaatgatcccgtcaccaatatctgccaggcagccgacaaacagctcttcacattggtggagtgggccaagcgcatcccccactttagctctctgccgctggacgaccaggtgatcttgctgagagcgggctggaatgaattactgatcgcaagtttcagccaccgctccattgatgtgagggatggcattctgttggccacagggctccacgtgcaccgaaactcagctcattccgcgggcgtgggggccatttttgacagggtcctgacagaactggtgagtaaaatgcgcgatatgagaatggacaaaacagagttaggctgtttgagggccataattctgttcaatcctgacgccaaaggccttagcaacccttctgaggtcgaggtgctcagggaaaaggtgtatgcttccctggaaacatactgcaagcaaaagtacccggaacagcagggaaggtttgcaaagctgctgctccgacttcccgcactgcgcagcatcggcctcaagtgtctggaacatctgttctttttcaagcttatcggggacacccccatcgacacattcctgatggagatgctcgaggccccacatcagctcgcttag

SEQ ID NO: 132365 - DNA, 1044 bp, Artificial Sequence
  Description of Artificial Sequence: Synthetic coding sequence
atgcgggagtgcggtggcggccctggcgccggcaagagattgtgcgcaatttgcggagataggtcatctggcaagcactacggtgtgtattcttgtgagggatgcaagggcttcttcaaaaggaccatccgcaaagacctgacgtactcatgtagggacaacaaggactgtactgtggacaaacggcaaaggaataggtgtcaatattgcagatatcaaaagtgtctggccactgggatgaagcgggaggccgtgcaggaggagcggcagaggggaaaggataaggacggcgacggcgagggtgccggcggcgcccccgaggagatgccagttgatcgcattttggaggccgagttggctgtggaacagaaatcagaccagggagtggagggtccgggcggcaccgggggaagcgggtccagccctaatgatcccgttactaacatttgccaagccgccgacaagcagctgtttaccctcgtagaatgggcaaagcggatccctcacttcagttccctcccattggacgatcaggtgatcctgctcagagctgggtggaacgaacttttaatcgcatccttttcccacaggtcaattgacgtccgcgatggtatcctcctggccacggggcttcacgtgcataggaacagcgcccactccgcaggggttggggcaattttcgatcggtcccttagcagagttttaaccgagctggtttcgaagatgagagacatgagaatggacaaaacagagctcgggtgcttaagggccatcatcctgttcaatccagacgcaaaggggctatcaaatccctccgaagtcgaagtgcttagggagaaggtgtatgcatctctcgaaacatactgcaagcaaaagtatcctgaacagcagggtcggtttgcaaaactcctgctgcgcctgcctgccctgaggtccataggcctcaagtgcctagagcatctattcttcttcaagcttatcggcgacacgcccatcgatacttttctgatggaaatgttggaggccccccaccagctggcttag

SEQ ID NO: 132366 - DNA, 1170 bp, Artificial Sequence
  Description of Artificial Sequence: Synthetic coding sequence
atgggttcacctggcctgcctcctcccgccccacctggatttagcggcccggtgtcctcaccccagatcaatagcacagttagtctgccaggagggggtagcggcccccctgaagacgttaagccacctgtactcggcgtccgcggattacactgccctcctccacccggaggaccgggcgccgggaaacgcctttgcgcgatctgtggtgacagatctagcgggaaacactacggggtttattcttgcgagggatgcaagggctttttcaaacgcacaatccgtaaagacttgacctactcatgcagagacaataaggactgtactgttgataagcgacaacgcaaccgttgtcagtactgtagataccagaaatgtcttgcaactggtatgaagcgagaggccgtgcaggaggagcgccaaagaggtaaggacaaagacggcgacggcgagggcgccggcggagcaccagaggaaatgcccgtcgaccgcatactcgaggcggagctcgccgtggagcagaaatccgaccaaggaggttctcagcacatatctaaatcgccgaacgaccccgtgacgaatatatgccaggccgccgataaacagttgtttacactcgtcgaatgggcgaagcggattccccatttcagctctctccccctggatgaccaggtcatcttgctaagggcaggctggaacgaactactgatcgcaagtttttcccatcgctctatcgacgttcgagacgggatcctgctggctaccggactgcacgttcacagaaattctgcacattcagctggagtgggtgccatattcgatagggttttgaccgagcttgtgagcaaaatgcgggatatgcgtatggataagactgagctgggctgtctacgagctattattcttttcaaccccgatgcgaaaggtctgtcgaatcccagtgaggtcgaagttctgcgggagaaagtgtatgcgtcgttagagacctactgcaagcagaagtacccggaacagcagggcagatttgctaagttgctcctcagactaccagctctacggtccattgggttaaaatgcttggaacacctgtttttcttcaaactcattggagacactcccattgacacattcttgatggagatgctcgaagcacctcaccagctggcgtag

SEQ ID NO: 132367 - DNA, 1044 bp, Artificial Sequence
  Description of Artificial Sequence: Synthetic coding sequence
atgcgcgaatgcgggggggggcccggagccgggaagagactgtgcgctatctgtggtgatcggtcctccggcaagcactatggagtgtactcatgcgaggggtgcaagggcttctttaagcgaaccatcaggaaagacctgacttactcctgtagagataataaggattgcacagtagacaaacgacagagaaatcggtgtcaatattgcagatatcagaagtgtttagcaaccggcatgaaaagagaggctgtccaggaggaacgccaaagaggaaaggacaaggatggggacggggagggcgctgggggcgccccggaagagatgcccgtcgacagaattctcgaggcagagcttgcggtagagcagaaatcagaccaaggcgtagagggacctggcggcaccggtggctctgggtcctccccaaatgatccagtcaccaacatctgtcaggccgccgataagcaactgttcaccctggtggagtgggccaagcgcataccccacttcagctcactccccttggatgaccaagtgatcctgctgagagccggttggaacgaacttctgatcgctagtttctctcacaggtcaattgacgtgagagatggcattctccttgctaccggcttacatgttcaccgaaacagcgcccactccgccggggtcggagccatatttgatagatccctgagccgggtgctgacagagttagtgtcgaagatgcgggatatgcgcatggataagacagagcttgggtgcctgcgtgccataatactgttcaatccagatgctaaggggctttcgaatcccagtgaggttgaagtgctgcgcgaaaaagtgtatgcgtcactcgaaacctactgcaaacagaaatacccggagcagcaaggtcgatttgctaagctccttctgaggctcccagctctccgttctataggcctgaaatgtctggaacatctgttctttttcaagcttattggtgacactccaattgatacatttctcatggaaatgctcgaggcgccccaccagcttgcatag

SEQ ID NO: 132368 - DNA, 861 bp, Artificial Sequence
  Description of Artificial Sequence: Synthetic coding sequence
atgccacagggaagcgtgggccgttggggctgcgagaaaaagtgcattgtgggctctcggccaggcggtggaggcgacgggccaggatggattccacaacggcggaggaggaggagatggcaggccgaaaacaacaagcctcgctccaggtctcaaggacgcctggatggaaccggatgggccacagccgggggcattaacagcaccgtaagcctgccaggaggcggaagcggtccccccgaagatgtcaagccccccgtgctgggcgtgagaggcttgcactgcccccctcctcccggcggccccggcgccggaaaacgtttatgcgctatttgcggcgatcgatcgagcggtaaacattacggcgtgtattcttgcgagggatgcaagggcttcttcaagaggacaatccgcaaggatctgacatattcctgtagagataataaagattgcacagttgacaaacgccagcggaatcgctgtcagtactgcagatatcagaagtgcctggcaacgggcatgaagcgagaggctgtgcaagaggaacggcagcggggtaaagacaaagatggagacggcgagggggcaggaggagcccccgaggagatgccggtggacagaatcctcgaggcggagctggctgtggaacagaaaagcgatcagggagtggagggcccggggggaacaggcggcagtggatccagcgtctcggtcggcgtcaaccctctgagctttgtcatgggcgtcggcggcggatccttaggcctgttctatatcccttccccttcatttcctcttatcactttcttaacactgttgggcacaggcggcgcggcaaagcaaggcctaagcaacatctag

SEQ ID NO: 132369 - DNA, 1392 bp, Artificial Sequence
  Description of Artificial Sequence: Synthetic coding sequence
atgtatggcaattactcccacttcatgaagttcccggccggttatggaggatccccggggcacaccggcagcactagtatgtcacctagcgccgcactgtctacagggaagccaatggattctcacccctcatataccgacactccggtgagtgcccccagaacactgagcgccgtcggcaccccactgaatgctctcggtagtccgtacagggtcatcacctccgccatggggcccccttccggcgccttggcagctccaccaggcatcaatttagttgctccgccttcatcgcagttaaatgtggtcaactctgtctcctcttcagaggacataaagccattgcctgggcttcccgggattggcaatatgaactatccatctacttcgcctggcagtcttgtgaaacatatttgcgcgatctgtggtgacagatcctcgggcaagcattacggagtgtacagctgtgagggatgcaaaggtttttttaagagaacaatcaggaaagacttgatatatacctgcagagacaataaagattgcctcatcgataagagacagaggaaccggtgccagtactgtaggtaccagaagtgtctcgttatgggcatgaagagggaggctgtacaggaggaacgtcagcgcagccgggaacgtgccgaatctgaggctgagtgcgccacgtccggtcacgaggatatgcctgtcgagagaatcctggaggccgagctggccgtggagcctaagaccgagtcctatggagacatgaatatggagaactcaactaatgacccagttactaatatctgccatgctgcagacaaacagctcttcactctggtggagtgggcgaagagaataccccatttttccgacctgaccttggaagatcaggtgattcttcttagggccggctggaatgaactgctgatcgcctctttctcccatagatccgtgagtgtgcaggacggcatcctactagctactggtttgcacgtgcaccgaagttccgctcacagcgccggcgtgggctctattttcgaccgcgtcctgaccgagttggtgtcaaagatgaaggatatgcaaatggataagagcgagttaggctgtttaagggctatcgtgctgtttaatccagacgctaaaggcctgagcaatccatcggaagtggagacactgcgcgaaaaagtatacgcgactttggaggcttatactaaacaaaaatatccagagcagcctgggaggtttgccaagcttctgctccggttgccggctctgcggagtatcggacttaaatgcctcgagcacttattttttttcaaacttatcggcgatacccccattgacacttttcttatggaaatgctggagacccccctccagattacttag

SEQ ID NO: 132370 - DNA, 2619 bp, Artificial Sequence
  Description of Artificial Sequence: Synthetic coding sequence
atggccacagcctgtaaacgatccggtgagcctcagtccgatgacattgaagctagccggatgaaaagagcagcggcaaagcatctaatcgagagatattatcaccaactcaccgaaggatgcggcaacgaggcgtgtacaaatgagttttgtgctagctgccccaccttcctgcggatggataataacgctgctgcgattaaagcgctcgagctctataaaatcaacgcaaagctgtgtgatccgcacccatccaaaaaaggggctagtagtgcctatttggaaaatagtaagggcgcgcctaataatagttgtagcgagatcaaaatgaataaaaaaggcgcacggatcgacttcaaagacgtgacttatctgactgaagaaaaagtttatgaaattctcgaattgtgtcgcgagagggaagactattcccctctgatcagagttatagggcgagtcttctctagtgctgaggcccttgtgcagtcttttcgtaaggtgaagcagcacactaaggaggaattgaagtctctgcaggccaaagatgaggacaaggacgaagacgaaaaggagaaggccgcatgtagtgctgctgccatggaggaggattccgaggcttctagcagcaggataggagatagttcccaaggcgacaacaacctgcaaaaactgggcccagatgatgtgtccgtcgacattgacgcgattcgccgggtgtacaccagactcctgtctaatgaaaaaatagaaacggcattccttaacgccttggtttatctttctccaaatgtcgagtgcgacctgacttaccataacgtgtatagtagggacccgaactacctgaatctgttcatcattgtgatggagaaccggaatctgcacagccctgaatacctggagatggccttgccactgttctgcaaggccatgtccaaactgccactggcggcacagggcaagctcatcaggctttggtcaaaatacaacgccgatcaaattagacgtatgatggaaacatttcaacagctgataacttataaagtaataagtaatgagttcaattcacgtaacctcgttaacgatgacgatgcgatagtggccgctagtaagtgtctgaagatggtgtattatgcaaacgttgtcggaggggaagtggatactaatcataatgaagaagacgacgaagagccgatccctgaaagttcggagcttactctacaggagctcttaggcgaagagagacgcaacaagaagggaccgcgggtggatcccctggagacagagctaggtgtaaaaactctggattgcaggaaaccactcataccctttgaagaatttattaatgaacctttaaacgaagttctagagatggataaggactatactttctttaaagtggagactgaaaataagtttagcttcatgacttgtcccttcatactcaatgccgtaacgaaaaacctgggcctctattatgacaatcggatacgaatgtactccgaacgcaggatcacggtcctgtactctctggtccagggccagcagctgaatccatatttaaggctgaaagtgagaagagatcacatcattgacgatgccctggtcagacttgagatgatcgccatggagaacccagcagatctgaaaaaacagctctatgttgagtttgaaggcgagcaaggagtggacgagggcggcgtcagcaaagaatttttccagctggtcgtcgaagagatcttcaatcccgacatcggcatgtttacctacgatgaatcaacgaagttattctggttcaatccaagttccttcgagaccgagggccagttcaccttaatcggaatagtgttggggttagctatttacaataattgtatcctagacgtccactttcccatggtggtatatcgcaagcttatgggtaaaaagggcacgttcagagatctaggggacagccacccagtgctgtatcagtctctgaaagatctcttagagtacgagggcaacgtggaagacgacatgatgataacgttccaaatatcccagactgacctgttcgggaacccgatgatgtacgaccttaaagaaaatggagataagatccccattaccaatgaaaaccggaaggaattcgtgaatttatatagcgattacattttgaataaatcggtggaaaaacaatttaaagcctttcggagaggatttcacatggtcactaacgaatctccactgaaatatctgtttcggcctgaagagatagaactcctgatttgcggatctcgcaacttggatttccaggcactggaggaaactaccgagtatgacggaggttacacccgtgactccgttttaatcagggagttctgggaaatagtgcatagcttcaccgatgagcagaagcgcctgttcctgcagttcaccacaggaaccgatcgcgcccctgtcgggggcttgggcaagctcaagatgatcatagcgaagaatgggccagacactgaacggctgccaaccagtcatacctgctttaatgttctactcttgccagaatactccagtaaagaaaaactcaaagagcggctgttgaaggcaatcacttatgcaaaaggatttggaatgctgtag

SEQ ID NO: 132371 - DNA, 75 bp, Artificial Sequence
  Description of Artificial Sequence: Synthetic coding sequence
atgactagggaccagaatggaacctgggaaatggagtccaacgaaaattttgaaggctatatgaaggcactctag

SEQ ID NO: 132372 - DNA, 312 bp, Artificial Sequence
  Description of Artificial Sequence: Synthetic coding sequence
atgacgcgtgatcaaaacgggacgtgggaaatggaaagcaatgagaacttcgaaggttacatgaaggccctggatattgattttgcaacacgcaagatcgctgtgagacttacgcagactaaggtaattgaccaggacggagacaactttaaaaccaaaacgacttctacgttcagaaactacgatgtggactttactgttggcgttgaatttgatgagtacactaaatctttggacaatcggcacgtaaaggcactcgttacatgggagggagacgtgctggtgtgcgttcaaaaaggcgaaaaggaatag

SEQ ID NO: 132373 - DNA, 1494 bp, Artificial Sequence
  Description of Artificial Sequence: Synthetic coding sequence
atgggtctgcctgcattgttggcttcagctctgtgcacattcgtgctccctttactattgttcctcgctgccattaagctatgggatctctactgtgtgtctggtcgggataggagttgtgcactgcccctgccgccaggcaccatgggctttccttttttcggggagaccttgcagatggtgctgcagcggcggaagtttctccagatgaaacggcgtaagtatggtttcatttataagacccatctgttcggccgccctaccgtgcgggtcatgggtgcagataacgttcgcaggatcttgcttggcgagcatcgcctggtaagcgtccattggcctgcctcagtaaggacgatcctgggatcaggatgcttgagtaatctgcacgatagctcacacaagcagcgcaaaaaagtgattatgcgcgcgttcagtcgggaagccctggaatgttatgtgcctgtgattacagaggaagtcggaagctcgctcgagcaatggctctcctgtggagaacgcggactgctggtgtaccctgaggttaaacgtctgatgtttcgcatcgccatgagaatcctgctcggttgcgagccacagctggcaggagacggagattcagagcagcagctggtggaagcctttgaggaaatgacgcgcaatctgttttccctgcccatcgatgtgcccttcagcgggctctatcgaggaatgaaggcaagaaatctgatccatgccaggattgagcagaacattagggctaagatctgcggcctgcgggccagcgaggccggacagggctgcaaggatgcattgcagctcctcatagagcactcctgggagcgtggtgaacgtctggacatgcaagcgctgaagcaatctagcaccgagctgctgttcgggggccacgagacgacagcatccgcagcgacgtccctgattacctacctagggctgtaccctcacgtgcttcagaaggtgagggaagagctcaaatcaaaaggtttgctgtgtaagtctaatcaggataacaaattggatatggagattctcgagcagctgaagtacattggatgtgtaattaaagagactctacgcctcaatccacctgtgcctgggggcttccgggttgctttaaaaaccttcgagcttaatggttatcaaattcccaaaggctggaacgtcatctactcaatctgtgacactcatgacgtcgccgaaatcttcacgaacaaagaggaatttaatcccgatcgattcatgttgcctcatccggaagacgcgagcaggttttcttttataccattcgggggagggcttcggtcctgcgttggaaaggagttcgcaaaaatccttctcaagatttttaccgtcgaactggcccggcactgcgactggcagcttctcaatggtcctcctaccatgaaaacttctcccaccgtttatcccgtggacaacctcccagcccgcttcactcacttccacggcgagatttag

SEQ ID NO: 132374 - DNA, 600 bp, Artificial Sequence
  Description of Artificial Sequence: Synthetic coding sequence
atgaactattccaaaatcccagcccaggttgatctgaggcgacagactgaacgtgattgtcgggtgtccagcttcagagtcaaagagaattttgataaggctagattcagtggtacatggtacgccatggccaagaaggacccggaaggcctgttccttcaggacaacatagtggccgaattctccgttgacgagaccggacagatgtctgccaccgctaaaggccgggttcggctgctgaataattgggatgtttgcgcagatatggtcggaacatttactgataccgaagacccggctaaattcaagatgaagtattggggcgtggccagtttcctacagaaaggaaacgatgaccattggattgtggacaccgactacgatacctacgccgtgcagtactcctgtcgcctcctgaatttagacgggacatgcgccgattcctatagtttcgtgttctccagagaccctaatggtctgcccccagaagcacaaaagatcgttaggcagcgacaggaggagctgtgcctggctcggcagtatcgattgatagtgcacaacggatactgcgatggcaggtccgaaagaaacctgctatag

SEQ ID NO: 132375 - DNA, 606 bp, Artificial Sequence
  Description of Artificial Sequence: Synthetic coding sequence
atgaaatgggtgtgggcccttctgttactcgcagctctgggctccggtcgtgccgagagagattgtagagtttccagcttccgcgtaaaagagaactttgataaggcaagatttagcggtacgtggtacgccatggctaaaaaggaccctgagggtctgtttcttcaggataacatcgtagcagaattttctgtggatgagactggacagatgagcgcaactgccaagggtagggttcgtcttttgaacaactgggatgtgtgcgctgacatggtgggaaccttcactgataccgaagatccggcaaaattcaagatgaaatattggggggtggccagttttttgcaaaaaggtaatgatgatcactggattgtggacaccgattacgacacgtacgccgtccagtattcatgtaggcttttaaatctggacggaacgtgtgctgattcctattcttttgtgttttcacgcgatcctaacgggctgcctccagaagcacaaaaaatcgtacggcaacgccaggaggagctgtgtcttgccaggcagtatcgcttgatagtgcataatggatactgtgatggaaggtccgagcggaacctcctctag

SEQ ID NO: 132376 - DNA, 606 bp, Artificial Sequence
  Description of Artificial Sequence: Synthetic coding sequence
atgaaatgggtatgggccctcctgctgctcgcggcactcggcagcggtcgcgctgaaagagattgccgggtctcctccttccgagtcaaggagaactttgacaaggctcgtttctctgggacctggtatgccatggcaaagaaagatcccgagggtttatttcttcaagacaacattgtggccgagttctccgttgatgagacgggccagatgagcgccaccgcgaaaggccgagtgcggcttttgaataactgggatgtgtgcgctgatatggtcggcacattcacagacaccgaggaccctgccaagtttaaaatgaagtactggggcgtggcatcctttctgcagaagggaaatgacgaccattggatcgtggacacagactacgatacctacgctgtgcaatactcctgccgactgctcaacttggatggaacctgcgccgatagctacagcttcgttttctcaagagatccaaatggactgcctcctgaagcccagaagatcgtcaggcagcgacaggaagagctgtgtctcgcgagacaatatcgactgatcgtgcacaacggatactgtgacggcaggtcagaaaggaatctgctgtag

SEQ ID NO: 132377 - DNA, 600 bp, Artificial Sequence
  Description of Artificial Sequence: Synthetic coding sequence
atgaactactctaagatcccagctcaggtcgacctccgcagacaggctgagcgagattgccgcgtgagctcgttccgggtgaaggaaaatttcgacaaagcacgtttctccggaacgtggtacgctatggctaaaaaggacccagagggactgtttttacaagataacatagttgccgagttttctgtagatgaaaccggacagatgagcgccactgctaaggggagagttcggctgctgaataattgggacgtttgtgccgacatggttggcactttcactgatacggaagatcccgcgaagtttaagatgaaatactggggcgtggcaagcttcctgcagaaaggtaacgacgatcattggatcgtcgatacggattacgacacatatgcagttcaatattcatgtagactcctcaacctggatggtacctgtgctgacagttattctttcgtcttttctcgagatccaaacggccttcctcccgaggctcagaaaattgtgaggcagaggcaggaggagctctgtttggctcgtcagtataggctcattgtgcataatgggtactgcgatggccggtctgaacggaatctgctgtag

SEQ ID NO: 132378 - DNA, 408 bp, Artificial Sequence
  Description of Artificial Sequence: Synthetic coding sequence
atgcccccgaatctgactgggtattaccgcttcgttagtcagaagaacatggaggactacctccaggccctgaacatcagtcttgctgttcggaagattgcattacttctcaagcccgacaaggagattgagcatcagggcaaccacatgacggtacggaccctctccaccttccggaattatactgtccagttcgacgtgggcgtggagttcgaagaggatctaagatcagtggacggaaggaagtgccagacgatcgtcacctgggaagaagagcatctggtctgtgtgcagaaaggagaggtccctaaccgcggctggaggcattggctcgaaggtgaaatgctttatctcgaattgactgctagggatgctgtgtgtgagcaggtttttagaaaggtacgctag

SEQ ID NO: 132379 - DNA, 1026 bp, Artificial Sequence
  Description of Artificial Sequence: Synthetic coding sequence
atgaacatcgtcgtagaatttttcgtggttaccttcaaagtgttatgggccttcgtcctggccgccgctcgctggctcgtgaggccaaaagaaaaatccgtggctggacaggtttgcctgatcactggcgcgggaagcgggctggggagactgtttgcactcgagtttgcccgccggcgtgcgttactagtgctgtgggacatcaatacacagtccaacgaagagaccgccggcatggtacggcatatatacagagacttggaagccgctgacgcggccgccttgcaggcgggcaacggtgaggaagaaatactgcctcattgcaatttgcaggtgttcacgtacacgtgcgacgttggcaaaagggaaaacgtctacctgaccgccgagagggtccggaaggaggtcggagaagtttccgtgctggtcaataacgcgggcgttgtgtcaggccaccatttgcttgagtgcccggacgagctcattgaaagaaccatgatggttaattgtcacgcccacttctggaccacaaaggcatttctcccaaccatgttagagattaatcacgggcacattgttactgtcgctagctctctcggcctcttttccacagccggtgtggaagactattgtgccagcaaattcggtgtcgtgggctttcatgaaagcctctcacatgagttgaaggcggctgaaaaggacggcattaagacaaccctggtgtgtccatatctggtggacaccgggatgttccgagggtgtcgaattcggaaggaaattgaaccttttctacccccactgaagcctgactattgtgttaaacaggctatgaaggccatcctcaccgaccaacccatgatatgcacaccccgacttatgtacatagtgactttcatgaaatctatcctcccattcgaagcggttgtctgtatgtacagattcctaggcgctgacaagtgtatgtatccgttcattgcccagaggaagcaggctactaacaacaatgaggctaagaatgggatatag

SEQ ID NO: 132380 - DNA, 957 bp, Artificial Sequence
  Description of Artificial Sequence: Synthetic coding sequence
atggtggaattgatgttccccctcctgctgctgcttctgccttttctcctgtatatggcagcccctcagattcggaagatgttgtcttcaggcgtctgcacaagcactgtgcagttgccagggaaagtggtagtcgtgactggcgccaacacgggcatcgggaaggaaacagccaaagagctggcccagcggggtgcaagagtgtacctcgcttgtcgggacgtggagaaaggggaattggtcgccaaggagatccagactactaccggcaatcagcaagttcttgtacgtaaattggacctgagcgacactaaatcaattagggcctttgccaaagggtttctagctgaagaaaaacacctgcacgtgttgatcaacaacgccggagtgatgatgtgcccttacagcaagactgctgacggattcgaaatgcatatcggagtaaaccatctgggccacttcttactcacccacctgctcctcgagaaattgaaggaatctgcgcccagcagaatcgttaacgtcagttctctggcccatcacctggggagaattcacttccacaatctgcagggagaaaagttctacaacgctgggcttgcctattgtcactcaaagctggcaaatattcttttcacccaagaactggcccggaggctcaaaggaagcggcgtaacaacttattccgtgcaccccggaaccgtccagagcgagctggtgcggcacagcagcttcatgaggtggatgtggtggctcttcagttttttcatcaagacccctcaacagggcgcacagaccagtctgcactgtgcactaaccgagggcctggagatactcagcgggaatcatttttcagattgtcacgtagcctgggtgtctgcccaggcccgtaacgaaacaattgctcggaggctatgggatgtttcctgtgatctcttggggttgccaatcgattag

SEQ ID NO: 132381 - DNA, 918 bp, Artificial Sequence
  Description of Artificial Sequence: Synthetic coding sequence
atggtggagcttatgttccctctgctgttgctccttcttcctttcctactgtacatggctgctccccaaatacggaaaatgctttcaagcggggtttgtacgtccacagttcagctcccaggtaaggtcgtggtagtaacaggcgctaacacaggcgctagggtgtaccttgcctgccgtgacgtggaaaaaggcgagctggtggcaaaggagatccagacgactacgggcaatcagcaggtgcttgtaaggaagctggatctgtcagacacaaagtcaatccgcgcattcgccaagggttttctggcagaggagaaacacttgcacgtattgattaacaacgctggggtcatgatgtgtccatattcaaaaacagctgatgggtttgagatgcacatcggggtaaaccatctaggacactttctactgactcatctgttgctggagaagctgaaggagtccgctccaagccgcatcgtgaatgtctcatctctggcccaccatttaggccgcatccattttcacaacctgcagggggagaagttttataacgcagggctggcctattgccactccaagctggccaacattctgttcacgcaggagctcgcacgaaggctgaaaggctctggtgtgacgacttattcagtacatcctggcaccgtccagagcgaacttgtgagacattcttcattcatgagatggatgtggtggctgttctccttttttatcaagaccccccagcagggcgcccagacaagcctgcactgtgccctgacagaaggattagagattcttagcggaaaccattttagtgactgtcatgtggcttgggtgtccgcccaggctaggaatgaaacgatcgcccgcaggctgtgggatgtgtcctgcgatttgttgggcctgcctatcgattag

SEQ ID NO: 132382 - DNA, 951 bp, Artificial Sequence
  Description of Artificial Sequence: Synthetic coding sequence
atgcttgtgaccctaggcctcctcacttccttcttcagctttctttacatggtagcgccctccattcgcaagttctttgctgggggcgtgtgtagaaccaacgtgcagctgcccggcaaggtggttgtgatcactggggccaacacgggaattggcaaagaaacggctagagagctcgcctctcgaggcgctcgagtctatatcgcatgccgagacgtcctcaagggagagtctgctgcatcagaaatcagggtagataccaagaatagccaggtgctggtgcgcaagctggatctgtcagacaccaaatctatccgtgcatttgcagagggtttcttggctgaggaaaagcagcttcacattttgattaacaacgcgggagtgatgatgtgcccttactctaagacagctgatggatttgagacgcacttaggagttaatcatctcggccattttctgctcacctatctgctcctcgagagacttaaagtctcagctcctgcgcgtgtcgttaatgttagctccgtggcccatcacattggcaagattccatttcacgacctacagtctgagaaacgctacagtaggggcttcgcgtactgtcacagcaaactggcaaacgtgctgtttactcgcgaactggccaagcgcctgcaggggaccggcgttacaacttacgcggtccaccctggtgtggtgcggtccgagcttgttcgccactcatccctgttgtgcctactgtggcggctgttctcaccgtttgtgaaaacagcaagagaaggggcgcaaacatcactgcactgtgcattggcagagggtttagaaccgctcagcggcaagtacttcagcgactgcaagaggacatgggttagtccacgcgctcggaataataagacagctgaacggctttggaatgtgtcctgtgagcttctgggaattcgctgggagtag

SEQ ID NO: 132383 - DNA, 951 bp, Artificial Sequence
  Description of Artificial Sequence: Synthetic coding sequence
atgttagtgacattgggcctgctgacgtcttttttttcctttctgtacatggtcgctccttccatcaggaagttctttgcaggcggcgtgtgccgcactaacgttcaactgcctggcaaggtggtggtgatcactggcgctaatacaggaatcgggaaggaaacggcccgagagctggcctctaggggagcgagggtctatatcgcctgccgagatgtactgaaaggtgagtccgccgcttctgagatccgggtggatacaaagaactctcaggtactggtcaggaagctggacttgtccgatactaagtccatacgggcatttgctgagggctttctagcggaagaaaagcagctccacatcctcatcaacaatgctggcgtgatgatgtgtccctacagcaaaacagctgatgggttcgaaacccacctgggtgtcaaccatcttggacacttcctcttgacctacctccttttggagagactcaaggtatcggctcctgctcgagtcgtgaacgtatcaagcgtcgcacatcacataggaaagatcccattccacgacctccagagcgagaaaagatactcccgagggttcgcatactgtcacagtaagctcgccaatgtcctttttacaagggagctcgcgaagagattacaggggactggagtgaccacatacgctgtacacccaggtgtcgtaagaagcgagctcgtgaggcacagctctctgctgtgcctgctgtggcgtctcttttcccccttcgtcaaaaccgctagggaaggggcccagaccagccttcactgcgccctcgccgagggactggagccactctcgggcaaatactttagcgattgtaagcgaacttgggtgagcccccgagcaaggaataataaaacagctgagcgtctgtggaatgtcagttgcgaattgctggggattcgctgggaatag

SEQ ID NO: 132384 - DNA, 951 bp, Artificial Sequence
  Description of Artificial Sequence: Synthetic coding sequence
atgctggtgactctcggtttactaactagctttttttcgtttttgtacatggttgccccctccattcggaaattttttgcgggaggtgtatgccggaccaacgtgcagctgcctggtaaagttgtcgttattactggcgccaacaccggcataggaaaggagacggcccgcgaactcgcgagccggggagccagagtatacattgcttgtcgcgatgttctgaagggagagtctgcggcctccgaaatccgcgtggacactaaaaactcacaagttctcgtccgtaagctcgacctgtcagatacaaagtcaatccgggctttcgccgagggcttcctagcagaggagaagcaactccatattttgattaacaatgccggagtgatgatgtgtccatacagtaaaactgccgacggttttgaaactcatctcggcgtgaatcacctggggcactttttgttgacttatctcctgctcgagaggctgaaggtgtctgcgccggcgcgggtggtgaacgtgagctctgtcgcccaccacattggaaaaatcccatttcacgacctgcagtccgagaagcgctacagccgtgggtttgcctattgtcacagtaaactggccaacgtgctattcactcgtgagttagcgaagcgcttgcagggaaccggagtgactacctatgctgtccaccccggggttgtccgcagcgaattagtgcggcattcttccttgctctgccttctttggcggctcttttcaccgttcgtcaaaacagccagagagggagcacagacctccctgcactgtgcgctggccgaaggattggagccattaagtggaaaatacttttctgactgcaagcgtacatgggtgtctcctagggcaagaaataataagactgcggagagactgtggaacgtaagctgtgagttgttaggtatacgttgggagtag

SEQ ID NO: 132385 - DNA, 957 bp, Artificial Sequence
  Description of Artificial Sequence: Synthetic coding sequence
atgtggctcccactcctcctgggagccctgctgtgggcggtgctatggctattaagggatagacagtcactccccgcaagcaacgcctttgtgtttatcacaggttgtgacagcggattcgggagactgctggctctgcagcttgaccagcgcgggttccgcgtgctcgcctcttgcttgaccccttccggcgcggaggacttgcagcgagtcgcctcttcccgactgcacaccaccctgctcgatatcacagaccctcagagtgtacagcaggcagccaagtgggtcgagatgcacgtcaaggaggcaggtctgttcggactcgtgaataatgctggagtagccggaatcatcggtcccacaccctggctgacacgagacgactttcagcgcgtgctgaatgttaacacgatgggccccatcggggtgaccttggctctattaccccttcttcaacaggctcgagggcgggtcataaacatcacatcggtgctgggcagattggccgccaatggcggaggctactgcgtgtcgaagttcgggctggaagcctttagcgacagtctacggagagacgtggctcacttcggcatcagggtttcgatcgttgagccagggttcttcagaactcccgtcacaaacctggaatccctggaaaaaaccttgcaagcttgttgggcccgcttgccgcctgctacccaggcgcactacggaggcgctttcctcaccaagtacctgaaaatgcagcagcgcatcatgaatctgatctgcgatcccgaccttacaaaggtgtcccgatgccttgagcacgccctgactgcgagacatccccgtacacgttactcccctggctgggacgctaagctgctgtggctgcccgcaagctacctgcctgcctccctcgtggatgctgtgctgacctgggtcctcccgaagccggctcaggccgtctactag

SEQ ID NO: 132386 - DNA, 957 bp, Artificial Sequence
  Description of Artificial Sequence: Synthetic coding sequence
atgtggttgcctctgctgttgggggcgctactgtgggccgtcctctggctcttacgcgacagacagtctctccctgcatcaaatgcattcgtgttcattaccggttgcgattcaggatttggcagactgctggcactgcagctggaccagcgggggttcagagtgctcgcaagctgtctgacaccttccggcgcagaggaccttcagagggtggcctcaagcagactgcatactacccttcttgatattaccgatccacagagcgtgcagcaggccgcaaaatgggtggagatgcacgtgaaggaagcagggcttttcggtctcgtgaataatgccggagtagctggaatcatcggccctactccttggctcacaagggatgacttccaaagagtgctcaatgttaacactatggggcctattggggtgacactggccctcctacctctgttgcagcaggcgcggggccgggtgataaacatcacaagcgtcctgggaagactcgcagcgaacggtggcggatactgcgtgagtaagttcgggctggaggccttctccgatagtcttcgcagagatgtggcacacttcggaatacgcgtgagtatcgttgagccaggttttttccggacaccagtaacaaatctggaaagccttgaaaagaccctgcaagcttgctgggcacgtctgcctccagcgacacaggctcattatgggggcgccttcctgactaaataccttaaaatgcaacagaggatcatgaacctcatttgtgatccagatctgacgaaagtaagcaggtgtctggagcacgcattgacagctcgacacccacgaacccgttattcaccaggatgggacgccaagcttctgtggctccccgcctcgtacctgcccgcctctttagtcgatgcagttctgacgtgggtgttgccaaaacccgcccaggccgtatattag

SEQ ID NO: 132387 - DNA, 936 bp, Artificial Sequence
  Description of Artificial Sequence: Synthetic coding sequence
atggccgctgccccccgcaccgtgctaatttccggatgcagctccgggattggtctggagcttgcagtccagttggcacacgacccaaagaagaggtatcaggttgttgccactatgcgggatctgggaaagaaagagaccctggaggccgccgccggcgaagcacttggtcagacactgacagtggcccagctggacgtgtgctcagatgaatcagtggcccagtgtttgtcatgcattcagggcgaggttgacgtgctcgttaacaacgcagggatgggcctggtcgggcctctcgagggtttgtctttagccgccatgcagaacgttttcgatacgaattttttcggcgccgtccgcctggtgaaggccgtgctccctggaatgaagagacgcaggcagggtcacattgtggtaatctcaagcgttatgggattacagggcgttattttcaatgatgtctacgcggccagtaaatttgcacttgaggggttctttgagtcactggccattcagctgttacagtttaatatatttatcagcttggttgagcctggtcctgtggtaacagaattcgaggggaagcttctcgcccaggtgtccatggctgagtttcccggcactgatcccgagaccttgcattacttccgcgatctgtatctgccggcatccagaaagctgttttgctccgtggggcagaatccacaggatgttgtacaggccatagttaacgtgataagctccacgcgacccccactgaggagacagaccaacatcaggtattcccccctgacaaccctcaaaactgtggactcgtccggatctctgtacgttcgaactacacatcgactgctcttcaggtgtccccgacttttaaatctcggacttcagtgccttagctgcggatgtctgcctacccgggtccgacccaggtag

SEQ ID NO: 132388 - DNA, 675 bp, Artificial Sequence
  Description of Artificial Sequence: Synthetic coding sequence
atgagccgcaagatcgaaggattcttgctgcttttactgtttggctatgaggccaccctcgggctgtcctccaccgaagatgaaggggaagatccctggtaccagaaggcttgtaagtgtgactgtcagggaggccctaacgctctctggagcgccggagccacgagcctggattgcatccctgaatgcccatatcataaaccactcgggttcgagtccggggaggtgacaccggaccagatcacatgcagtaatcccgagcagtacgtgggttggtactcaagctggacagcgaacaaggcacgcctgaattcccaaggcttcgggtgcgcttggttgtccaagttccaggattcatcacagtggctccagattgacctcaaagaaatcaaggtgattagcggaattctgacccagggaagatgtgacatcgacgagtggatgacaaaatacagcgttcaatacaggacagatgagaggctgaattggatttattacaaagatcagacaggcaataatcgggtattctatggaaatagtgatcgtacctcaacagtgcagaacctgctgcgacccccgatcatttccaggttcatccggttaatccccctgggctggcatgtgagaattgcaattagaatggagttactggaatgcgtgtcaaaatgcgcgtag

SEQ ID NO: 132389 - DNA, 4077 bp, Artificial Sequence
  Description of Artificial Sequence: Synthetic coding sequence
atgatcgaaccaagcgaggatagcttcgaaaccatgatggagcacaaaaatccgagttccaagcaaatggagagttctgagggctccagcaatacgacagaggctacctctggttccggggttcggggcgaggcaggccccgcttccggccccgctcaagagaagaaagagcctcccagtggacccctgcaggagatggaggagctgcctactgacctgctccaggacatggaggagccctcttccgggcccagaaaagagattgaagacccacccaacgaccttctgcaggacctggaggagtcatgcaatggctctcaccaggctcggggagatccgctctccggagcaagcgaccgcatgaaggaggccagtgtaaatccatccggcgcgcgcgaagaacaggaagctcataccgacctgaaggagagcgggagagaggagacaccacaggaacagaatcaaaccgaacattccacagcagaattgatggcaatggtgcgaagcatcatttcattgtattttcggatgcaagatctaaaggagcaacagagggttgccgaagagatcttgataaagggcataaacgccgggcaattgcctgccccaaagcatttctcgggagatcggagagagttccacgaattcatcgtgctgtgccagctcacactgcagagctatccaagaatgttctacaatgatcgcctgcgcgtgggatacgtaatcaatcatttgtctggtttggcccttgagtgggctaaagctttgcttcaggagaacagccctctgattggggacttccccgcattcttagaagcaatgtccgaggtttttgaataccggcaggccctcagggtggccgaagaagctatgttcaccatccgtcagggcggcaggtctgctactgaatatatcgatgaatttcagagcctagtgccgatcttagggtggcctgatgaagtcctccaggcacatctctgtcagggacttaacgaggagatccgacactacctattccgagtcccccagcctgatagcttggactctctgatagtgttgatcctccaaatagaagaaaaattggccgagcgcagggccatgctgcggttacctcccgaagcaagaccacggaatctcacttggatagactcaccagctccggaacggtggatggtctctagctggctgccaagcgaggtgcatcctgacatcaacagagcccacctcttcctactcctcatggttagggtgaatccctaccacagcgtggcagttcaggcactggtcgattcaggagccgacggcaactttatggacgagaagttcgcccaggagcactacgtggaactttacgaaaagccataccctcagcccgtgcagtccgtggatggatctttaattggaaatgaacctgtctggttgtatacagaaccgctagtttgcattcatcagaatcatcaggagagtatcgagttcgatatagtgcccagtccaaattttagtgtggtgctgggtatccggtggctcagagtgcacgcccccgaagtggactggatcaaagggagatgtacctttcactcgccttattgcctcaagaactgtttcaggccccctccgccctgcattgccttggagaggcacggaatgtccctcctgccaggcctgccccacccctactccgacttggccgacgtttttaaccccaaagaagcggatgacgagactagcgatcaaccgtcatccgacgggtccgacgacctctcagagtccgagcctagtgagcttcaacaggctggggactctgatcattccgaaaccttttatgaatgccccagtacagcaccttgggaacccgttggtgcacgcatgcaagagcgcgccagactgcaagaagaatattgggatctccaggatatgctcacgaatcgacaggattacatccagatgatacctgaactctttgaccaattgcacggggccgagtggttcacaaagttagagttgcgcggcacaatcgtggaagagagcgtgaatggccatcggaccgaggatgtgtggaaagctgctttcggcttggagctagaggagatgaaatcctatcaaccgtttgcgttatctcccgatcccatcatacctcaaaacgtgatccactttatcttgaaggacatgcttgggttcttcgtgctgagctatggccaggaagtcctcatctatagtatgtctcaagaagaacacctccatcatgtccgccaggtcctggtgagatttagacatcacaatgtctactgcagtctggacaaatcgcagtttcacagacagaccgtggagttccttgggttcgttgtaactccgaagggggtcaagctcaacaagaatgtgatgacaatcatcacgggatatcctacccctggctcaaagttgtcactgagaaactttatcgagtttgtttttccctacaggcatttcgtcgagcgtttcagcatcatcgccgaacccctggtgcgtcagctcctatcttcataccaattttactggggcgtcgaagaacaagaagcatttgagtgcctaaagcgggcgtttcggaaggctccgctgttacaccatccaaagcctcagaatcccttttacttggagaccggagtgaccggtacagctctgcatgcttccctgatccagattgatgaccagacggggaaacgcgcatgctgtgcattctactcccgaaacatcagtcctattgaagtggaatattcccaagcggagatgaagatattgcctattagggctgctttcatggtctggtgtcgctacctggaaaatactgaagagcctatcatgattctgctgaacaccgaagaccttgcctccctgaataatgacaggttaacagtcttactacccgggcactgggttttctttttttctcacttcaatttcgacgtgatggaactgcccgaacaggacggcggtcgcgctttaccgccagtgaggaatttgagatggaggcgtgctttccaaaggaacactgccgcacggcagacacttttgttggcctctagaggatttcccagagacccatctactgaatccggggaggaagagaatgaagaacaggacgaattgaatgagcagatattaagacaggaactgttggctatgattcccattgaccagatcctcaatagtttcctggcacacttctccatggcccagattcgcgctgtgatactgcatttttttcgcggcctcctatattggaaaaatacattggcactggccgccatccttgtcctgctgagggtgagacagtgcctgagcttgaggccggcgcctgccatgcgagttgctcggccccagccacaaaggtctctccgcctgatccttgattcatctttaatcgccggctcctctatcactactgctatcactcagctacttacccagatgcccgccttggtgggggcaaacaccatccccgcgcaggaactagcggaactgttccttggcccaggaagatggcagaggaatgcgcttcacagccaagcccatcgtgggcttcagttcacccccgggttttggctgacactgtgcgaattttttggagtgcgcgtgaccccacaagaaggccacctgcctgctttgaggcaaaacagatatctcgagctgcatgtcgtcggggatgaagacgtggtgcttagggaggccctgcaggacgatctgcagcggtataggcagtgcgggctgcatgatggcttacaagacacctcacaggataagcaggataacgatgtccaggaggccccccccagtcacaccgccgcgacccacccaccgcgccctcgccatttaatggacccacaggtgctggagttcctggggagcagattgctgcacattcattctgccgatggacagttgcatctgctgagccgggaacaagcagccagagcattgtctcagttcttaacacttatctataggagggcgctgcctattccggcctgggagagccagccacgcgaacaagcgaggctcgaggagctgcccgatgaggatgaggatgctaaccttgattag

SEQ ID NO: 132390 - DNA, 9393 bp, Artificial Sequence
  Description of Artificial Sequence: Synthetic coding sequence
atgttttcagttagaatcgtcaccgccgactattacatggctagtccattacagggcctggacacatgccaatccccattgacgcaagcgccagtgaagaaggtacccgtcgtacgtgtctttggagcgactcccgccggacaaaagacgtgcttgcatctgcatgggattttcccatacctgtacgtgccctacgatggttatggacaacaacccgagagctacctgtcgcaaatggcattctctatcgatcgtgcactcaacgtggctttgggaaaccctagcagtacagcacagcatgtgtttaaggtctccctcgtcagcggaatgccattctacggctatcatgagaaggagcggcacttcatgaagatctacctgtataatcccactatggttaagcggatttgcgagcttctccagtctggagcgataatgaacaaattctatcagccacacgaagcccatataccctacctgctgcaactgttcattgactacaacttatatgggatgaatttgattaatctggccgcagtgaagttcaggaaggcgaggaggaagagcaataccctgcacgccacaggatcatgcaagaatcatctcagcggcaatagtcttgccgacacactgttcaggtgggagcaggacgagattccatcctccttgattctggaaggcgtggaaccccaatccacttgcgagctggaggtggatgcggtggcagcagatattctaaatcgactggacatcgaggctcagattggtgggaaccctgggctgcaggctatttgggaggatgaaaagcagcgccgcagaaaccggaatgagacaagccagatgtcgcagcccgagtcccaggaccacaggttcgtacctgctaccgaatctgaaaagaaattccagaaacgattacaagagatcctcaaacaaaacgacttttctgttacgctgagcggttctgtggattattctgatggaagtcaggagttttctgccgagttgacactgcattccgaggtgctgagtcctgaaatgctccagtgtacacctgccaacatggtcgaagtacacaaagacaaagagtcgtctaaaggccacacccgtcacaaagtcgaagaggcgctcattaacgaagaggccatcctgaatttgatggaaaattcacagacattccagccacttacccaaaggttatctgagtcacccgtgttcatggactcttctcccgacgaagcactggttcacttgttggccggcctcgaatccgacggatacagaggtgagcgtaacaggatgcctagcccctgcagaagcttcggcaacaacaaatatcctcagaacagtgatgacgaggaaaatgaaccccaaatcgagaaggaggagatggagctctctctagttatgagccagcgctgggatagtaatattgaagagcactgtgctaagaagagaagcctgtgtcgcaatacacatagatcatccaccgaggatgacgacagtagttccggagaggaaatggaatggagcgacaactcacttttgttggccagcctaagtataccccagctggatgggactgccgatgagaacagcgacaatccactgaacaacgagaattcaaggacacactctagtgttattgcaacatccaagttgtcggttaaacctagtatttttcacaaggatgcggcaactctggaaccttcttcttccgcaaaaatcacctttcagtgcaaacacacaagtgcactctcttctcacgtgctcaataaagaagatttgatagaggacctcagtcagactaataaaaataccgagaaagggttagacaacagtgttacatctttcaccaacgaaagtacatactccatgaagtaccctggatcgctgtctagcacggtgcactctgaaaactctcacaaagagaattctaaaaaggaaatcctgcctgtcagtagctgcgagtctagcatcttcgactatgaagaggatattcccagcgtgacccgacaggtgccttccagaaagtacaccaatatccgaaagatcgagaaagattcacccttcattcacatgcacaggcatccgaacgaaaataccctgggaaagaactccttcaacttttccgacttaaaccactcaaagaacaaggtgtcctccgaagggaatgaaaagggaaattccacagccctttcctctctcttcccatcctccttcaccgagaattgtgagctattgtcctgctcaggcgagaatagaactatggtccatagccttaatagcaccgcggatgagtctgggctgaataagctgaaaatcaggtatgaggagttccaggagcacaaaaccgaaaagcctagcctgagtcaacaggctgcacattacatgttcttcccatccgtggtgctgtccaactgtctgaccaggccacagaaactgtcccccgtcacatataaattgcagccaggtaataaaccgagtcgcctgaaactcaacaaacgcaagctagcaggacatcaggagaccagcaccaagtcctccgaaactgggagcacaaaggataattttatccaaaataatccctgtaatagtaatcccgaaaaggataatgccttagccagtgatttaacgaagaccacacggggggccttcgaaaataaaacccctaccgatgggtttattgattgtcacttcggagatggtactctggaaaccgagcagtccttcggactgtacggcaataagtacactctcagagccaagcgtaaagttaactacgagactgaagactcagaatccagcttcgtgacccacaactccaagatcagcctaccacacccaatggagattggtgagtctttagatggcacattgaagtcacgaaaaagacggaagatgtccaaaaaactaccccctgtaataatcaaatacattataattaataggttccgcggtagaaagaacatgcttgtgaaactggggaagatagacagcaaggagaagcaagtgattctcactgaggagaagatggagctgtacaagaagctggctcctctgaaggatttctggccaaaagttcccgacagcccagctaccaaatatcctatttatcctctgacccctaagaaaagccaccggcgcaaatcaaagcacaagagtgccaaaaagaagacaggaaagcaacagagaactaataacgagaatataaagcgaacgttgagctttagaaaaaagagatctcacgctattctgtccccacctagtccgagctacaatgcagagaccgaggattgcgatctaaactacagtgatgtgatgtctaagctgggtttcttaagtgaacgttccacctcccccattaattcctccccacccaggtgctggagtcctacagatcctagggccgaagagatcatggctgctgccgagaaggaggccatgttattcaaggggcccaacgtctataaaaagacggtgaacagccggattgggaaaacctctcgcgcccgtgcacaaatcaagaagagcaaggcgaaactggcgaacccatcaattgtcacaaagaaacgaaataaacggaaccaaaccaataagctggttgacgacggcaagaagaagcctcgcgccaaacaaaagaccaatgaaaagggcacatctcgaaagcataccacactgaaagatgaaaaaattaaatcccagtctggtgcggaggtcaaattcgtgctcaaacaccagaacgtcagtgagttcgccagcagtagtggggggtctcagctcttgttcaaacagaaagacatgcctctcatggggagcgcagtggaccaccccctctctgcttcactgccgaccggcatcaacgcacaacagaagctgtcaggctgctttagttcattcttggaatccaagaagagcgttgacctccagactttccccagtagtagagacgacttacatccatcagtcgtgtgcaacagcattggccccggggtgtctaagatcaatgtgcagcgccctcacaaccagtccgccatgtttacactcaaggagagcacccttatccaaaaaaacatttttgatctttcaaaccacctctctcaggtggcgcagaatactcagatcagctccggcatgtcctccaagattgaggacaatgccaataacatacagaggaactatctcagttcgatcggcaaactgagcgaatatcgcaacagcctcgaaagcaagttggatcaggcttacacccccaacttcctgcattgcaaagactcacagcaacagattgtgtgtatcgccgagcagagtaagcacagcgaaacgtgttcacccggtaacaccgcttcagaagagtcgcagatgccgaacaactgctttgtcacgagcctgcgaagtcccattaagcagatagcatgggagcagaagcagcggggtttcatattagacatgagcaatttcaaacccgaacgggtgaagccgaggtcactatccgaagccatcagtcagactaaagcgctctcccagtgcaaaaatcgcaacgtaagtacgccgtctgcattcggggagggacagtccggtctggccgtgctgaaagaactgctgcagaaacgacaacagaaggcacagaacgctaatactacgcaggaccctctgtctaataaacaccaaccaaacaagaacatttcaggcagcctcgaacacaacaaggccaataagaggaccaggagtgtgacgagtccccggaagccacgaaccccacggtccacgaagcagaaagagaagatccccaaactgttgaaggtggattccttgaatcttcaaaattcttctcagctagacaattctgtctccgacgattcgcccatcttttttagtgatccaggattcgagtcttgctacagccttgaggacagcctctctccagagcacaactacaatttcgatataaacaccattggacagactggattctgctcattttacagtgggtcccagtttgtcccagcggatcagaacctccctcaaaaattcctcagcgacgccgtgcaagatctgtttcccgggcaggccatcgagaaaaatgaattcctgagtcacgacaatcaaaagtgtgacgaggacaaacaccataccactgattcagcctcctggattcgctccggtacactttcccctgagatttttgaaaaaagtactattgactccaacgaaaaccggcgccacaaccaatggaaaaattcgttccaccctctgactacgagatctaattccatcatggattccttttgcgtgcaacaggcggaagattgtctgtctgaaaaatcccggctgaatcgcagctccgtctcaaaggaggttttcctctcacttcctcagcccaacaatagtgactggattcagggtcacacacgaaaggaaatgggccaaagcttagattccgccaatactagtttcacggcaattctcagctcacccgatggcgagctggtcgatgtcgcttgtgaagatctggaactatacgtgtcccgaaacaatgatatgttaactcccacacccgacagttcaccacggtccaccagcagtccaagccagtctaaaaatggcagcttcacaccacggacagcgaacattctcaagccactgatgtcccccccttctcgtgaggaaatcatggctaccctgctggaccatgatttaagcgaaaccatttatcaggagccattctgcagcaacccctccgatgtgcctgaaaagcccagagagataggaggcaggctgttgatggtagagactcgcttggccaacgatctggcagaatttgagggggacttctccctggagggattgcgtttatggaagactgcattttctgccatgacgcagaaccctagaccaggatccccactgcgctctgggcagggcgtggtaaacaagggctctagcaacagtcccaaaatggtcgaagacaaaaagatcgtgatcatgccctgcaaatgtgctccaagccggcagttggtgcaagtttggctgcaggcaaaggaggagtacgagcggagcaagaagttgcccaagacaaaacctacaggcgtcgttaaaagcgcagaaaatttttccagtagtgtgaaccctgatgacaagcctgtggtcccaccaaagatggacgtgtcaccgtgcatccttcccactactgctcacaccaaagaagacgtggataacagtcaaatcgcgctccaggctcccacgactggctgtagccagaccgcgagtgagagccagatgttgccccccgtcgctagtgcctctgacccagagaaggatgaagacgacgacgacaactactatatcagctatagcagtccggattcccctgtgattcccccgtggcaacaacccattagccccgactctaaggctctgaacggtgacgacaggcccagttcccccgtggaggaactgccatccctggccttcgagaatttcttgaagccgattaaggacggcatccagaagtccccctgttcagagccgcaggagcccctcgtgatctccccgattaatacacgcgcacggaccgggaagtgcgagagtctttgcttccacagcacacccattatccagcggaaactgcttgaacgattgccagaagctcccggactgagtccgctgtccaccgaacctaagactcaaaaactctcaaataaaaaaggaagtaacaccgacaccctgagaagagtactgctgacacaagcaaagaatcaattcgccgcagtaaacacccctcagaaggaaacctcccagatagatggtccttcgttgaacaatacgtatggatttaaagtgagtatccagaacctgcaggaggcaaaggccctccacgaaatccagaatctcacgctgatctcagtcgaattgcacgcacggactcgcagggacttggaaccggaccctgaattcgatccaatctgtgctcttttctactgcatttcttccgataccccgctcccagacacggagaagactgagctcacaggcgttatcgtgatcgataaggataagacagtattctcgcaggatattaggtatcagactccgctcctgatcaggagcgggatcacgggcttggaagtgacctacgcggccgatgagaaagcactctttcacgagatcgctaatatcattaagcggtatgacccggacatcctgctgggctacgagattcaaatgcattcttggggatatctcttgcagagagctgccgctctgtccatcgacttgtgtcgcatgattagtcgggttcccgatgacaagattgaaaatcgctttgccgcagagcgggacgagtacggctcatacaccatgtcagaaattaacatcgttggtagaatcactcttaacctttggcggatcatgcgcaacgaggtcgcccttaccaactacacattcgaaaatgtcagcttccatgtgctgcaccagaggtttccacttttcaccttcagggtcctctccgactggttcgacaataaaacagacctataccgatggaaaatggtagaccactatgtatctagagtgagaggcaatctgcagatgctggaacagctggatctcataggcaagaccagtgagatggcccggctatttggcatccaattccttcatgtgcttacgagaggatcacagtacagggtggaaagtatgatgctccgaatagctaagcccatgaactacattcctgtgacgccgtccgtgcagcaacgatcccagatgcgtgctccacaatgtgtcccattgattatggaaccggagtcaaggttttactcaaacagcgtgctggtcctggattttcaatctttatatccgagtatagttattgcatacaattactgcttcagtacctgcctcggccatgtggaaaatctggggaagtacgatgaattcaagtttggctgtacgagcctccgggtgcctcctgacttgctgtatcaggttcgccacgatataaccgttagccccaatggggtcgcctttgtgaaaccaagcgtaagaaaaggggtgctcccccgcatgctggaagaaatcttgaaaaccagatttatggtcaagcagagcatgaaggcgtacaagcaggaccgggcccttagtcgtatgctggatgcaagacaattggggctaaaacttattgctaatgtcacctttggctacacctctgccaacttctcaggccgtatgccatgtatcgaggtgggggacagcatcgttcacaaggctcgtgaaacccttgagcgggctataaagttggtgaacgatactaaaaagtggggtgctcgggtggtgtacggtgacacagattctatgtttgtgctgctgaaaggtgccactaaggaacaatccttcaaaatcggccaagagattgctgaagccgtgacggcaacaaatcctaaacctgttaaacttaagttcgagaaggtgtatttgccatgcgtgctgcagacaaaaaagcgctatgttggctatatgtatgagacactcgaccagaaggaccctgtgtttgatgcgaaggggattgagactgttagacgcgatagctgtcctgccgtgagcaaaatcctggaaagatctctaaagttgctcttcgaaaccagggatatctcactgattaagcagtacgtgcagcgtcaatgcatgaaattacttgagggtaaagcttctattcaggacttcatcttcgcaaaggaatatcgcggaagcttttcttacaagccaggagcctgcgtgccagcactggaattgactagaaagatgctaacttacgataggagatcggagcctcaggtaggcgaacgcgtgccgtacgtgatcatctacggcactccaggggtcccactgatacaattggtgagaagacctgtggaagtactgcaagatcccactttaaggttaaacgccacctactacataaccaagcagatcctgcctcccttggctcgtattttctcactgattggtatagatgtgttttcatggtaccacgagctgccaagaatccacaaggcaacctcctcctctaggtcggaaccagagggtcggaagggtactatctctcaatactttaccactctgcactgccccgtttgcgatgacctcactcagcatggcatctgctcaaaatgcaggagccagccccagcacgttgcagtaattctcaaccaagaaatccgcgaactggagcgtcagcaagagcaattggtaaagatctgcaaaaactgcactgggtgtttcgaccggcacataccatgcgtctccttgaactgccctgtgctctttaagctgtcgcgtgtcaaccgggagctctcaaaggctccatatctgcggcagcttctagatcaattctag

SEQ ID NO: 132391 - DNA, 9393 bp, Artificial Sequence
  Description of Artificial Sequence: Synthetic coding sequence
atgttttctgtaagaattgtgactgccgactactatatggcttcaccactccaggggctggacacatgccaaagcccgctgacccaagctcctgtcaagaaggtgccggtggtgagagtgttcggcgctactcccgcagggcagaaaacctgtctgcacctgcacggtatcttcccttacctctatgtgccttacgatggctacgggcaacagccagagagctatctgtcacagatggcattctctattgacagagcactgaacgtggcactagggaacccgagcagtactgctcagcacgtttttaaagtgagcctagtgtcgggcatgcctttctacggctaccacgagaaagaacgccactttatgaaaatctatctgtataaccctacaatggtcaagagaatttgcgagctgcttcagtctggagccattatgaacaagttttatcaaccacacgaggctcatataccatacctgctgcaactattcatagattataatttgtacggcatgaacctgatcaacctcgctgctgttaaattcagaaaagcacgtaggaaatccaatacgcttcacgccacaggcagttgcaaaaaccatctatctggcaattccctggccgatacactcttccgctgggagcaggatgaaataccctcatcccttatcctagagggggtggagccccagagtacctgcgagctggaggtagacgctgtggcagctgacatcctgaacagactggacatcgaggcgcagatcggcggaaaccccggactgcaggctatctgggaagacgagaaacaaagacgaagaaacaggaacgagaccagccagatgtcccagcctgaatctcaagaccatcgattcgttcctgcgactgagagcgaaaagaaattccagaagcggcttcaggagatcctgaagcagaacgactttagcgttacgctatccggtagcgtggattattcagatgggtctcaggaatttagcgccgagctcacccttcactccgaggttctctcccccgaaatgctgcaatgcactcctgccaatatggttgaagtgcataaagacaaagagagttccaaaggccataccaggcataaggtggaggaagccctgattaatgaggaagccattctcaacctcatggaaaattcgcagacgttccagcccttgacccagcgcctctcggagtcacctgtcttcatggattcgagccccgatgaagccctggtgcacctgctggccggtttggaaagtgacgggtaccgtggcgagagaaatcgcatgccatctccatgtcggagttttggcaacaataaatatccgcaaaattctgatgatgaggaaaacgagccccagatcgagaaggaagaaatggagctctccctggtgatgtcccagcgctgggacagcaatatcgaagaacactgcgccaaaaaaaggtcactctgccgcaatacccaccgaagcagcaccgaggatgacgattcctcttctggggaggagatggagtggagcgacaactctctgctgctggcctcgctatctatcccacaactggacggcacggccgatgagaacagtgacaaccctctgaacaatgagaattctcgcactcactcctctgtcattgcgacgtctaagctcagtgtcaaacctagtatttttcacaaggacgccgccacactcgaacctagcagttcagctaaaattaccttccagtgtaagcacacttcagcattatcctcccacgtgctgaataaagaagacctcatcgaggacctgagtcagacaaacaagaacacagagaagggactggacaatagtgtgacatctttcacaaacgaaagcacatacagcatgaaataccctggcagtctgtcttccaccgttcactccgaaaacagccataaagagaatagcaagaaggagatcctcccagtaagcagctgtgaaagcagtatttttgattacgaagaggacatcccaagcgtgaccaggcaagttccatctcggaaatacactaatatcagaaaaatcgagaaggacagcccttttatccacatgcataggcaccccaacgagaatacactcggtaaaaattcgtttaacttctcagatctcaatcatagcaaaaataaggtgagctcagaaggtaacgaaaaagggaacagcaccgccctgtctagcttattccccagctcattcaccgagaattgtgagcttttgtcctgctcgggggaaaaccgcactatggtgcattccctgaatagcactgctgatgagtctggattgaataaattgaagatccgctatgaggagttccaggagcacaaaaccgagaagccgtcactcagccagcaggccgctcattacatgttctttccaagcgtggttctctctaactgcctgactagacctcagaaactctcaccagtcacttacaaactacagccgggcaacaaaccttccaggctgaagctgaataagcgcaagcttgcgggacatcaggaaaccagtactaagtcaagcgagacaggttctaccaaagataatttcatccagaataatccgtgtaacagcaatcctgagaaagacaacgcactggcaagcgacctgacaaaaacaacgcgtggtgcatttgaaaataagactcccacggatggattcatagattgtcactttggagacgggaccctggaaaccgagcagtccttcgggctttatggaaacaaatacaccctgagggcgaaacgcaaggttaattacgagacagaggatagcgagtccagcttcgtgacacataacagcaaaatctcattacctcatccaatggaaatcggtgaatccctggatggcaccctgaaatcccgaaaaagacgcaagatgagcaaaaaattgccccccgtgattataaagtatatcatcattaaccggtttaggggaaggaagaacatgctggtgaagttgggcaagattgactcgaaagagaagcaagtgatcctcactgaagagaagatggagttgtataaaaaactggctcctctgaaggacttctggccaaaggtgcctgacagtcccgctactaagtatccaatatatccactcacacctaagaaaagccacagaaggaaatcgaagcacaagtcagcaaagaagaaaaccggaaaacaacaacgcacaaataacgaaaacataaaacgaacactgtccttcagaaaaaagaggtcgcacgctatcctgtcccctccatctccctcttacaacgccgaaaccgaggactgcgatcttaactactcggatgtgatgtccaaactgggtttcctgagcgagcgtagtactagccctattaactcatccccccctagatgctggagccctacagatcccagggctgaggagataatggccgccgccgagaaggaagccatgttgtttaaagggccgaatgtgtacaagaagaccgtgaattcgagaattggcaaaacctcaagagcccgggcacagatcaaaaagtccaaggcaaagttggctaatccttccatcgttactaaaaagcgcaataaacgaaaccaaacaaacaaattagtggacgatggcaaaaagaaaccaagagccaaacagaagacaaatgagaaaggaacaagtagaaagcatactacacttaaagatgaaaagatcaaatcccagtcgggcgctgaggtgaagtttgtgctgaaacatcagaatgtttcagagttcgcatccagtagcggagggagccagctgttatttaagcagaaagatatgccactaatgggctctgccgtggaccaccctctgtcggcctccctgcctacgggaataaacgcacagcaaaagttgagtgggtgcttttctagtttcctcgaaagcaaaaagtcagtggacctgcaaacttttcccagttccagagacgacctccacccctctgtcgtgtgcaactcaatcggtcccggcgtgtccaaaatcaacgtccagagacctcataatcagagcgcgatgttcacactaaaagagtcaaccctcatccagaagaatatatttgacctgtccaatcatctgtcccaggtggcccagaacacacaaatatcatccggcatgtcgtccaaaatagaagacaacgccaacaacatccagagaaactatctgtcttccatcggtaagctgtctgaatatcgtaattcgctcgaaagtaaactagatcaggcatacaccccaaattttcttcactgtaaggattctcaacagcaaatagtgtgtattgcagaacaatctaaacactcagagacttgctcccccggcaacaccgcaagcgaggaatcccagatgccaaacaactgcttcgtgacgtccctccgatcaccaatcaaacagattgcatgggagcagaaacaacgcggtttcattctggacatgtcgaacttcaagccggagagagtgaaacctcgctccctatctgaggccatatcccagacaaaggcactgtcccaatgcaagaatcgcaacgtgagtacccccagcgcctttggcgagggtcaatccggtctggctgtgttaaaggagctcctgcaaaagagacagcagaaggcccaaaacgcaaacactacccaggatcctttgtcaaacaaacaccagcctaacaaaaatatttcaggatccctagagcacaacaaggctaataagcgaaccagaagcgtgaccagtccccgaaagcctcgaactcctcgatcaactaagcagaaggagaaaatccccaagctgctaaaagtagacagcctaaatctgcagaatagcagtcagctggataattcagtgtccgacgatagccccatctttttctctgatccagggtttgaatcctgttacagcctcgaggactccctctccccagagcacaattataacttcgatatcaatacaattggtcagacaggtttctgtagcttctactctgggtctcaatttgtcccagcagatcagaatctgccccagaaatttctgtccgatgcagttcaggacttatttcccgggcaggccatagaaaaaaatgaattcctcagtcacgataaccagaagtgtgacgaggacaagcaccacaccactgattccgcatcctggattcgcagcggaacactgagcccagagatcttcgaaaaatcaaccatagattcgaatgagaacagaagacataaccagtggaaaaacagcttccatccactgacaaccagaagcaacagcatcatggatagcttctgcgtccagcaggccgaggactgcttaagtgaaaaatctcggttaaaccgcagctccgtaagcaaagaggtgttcctcagtcttcctcagcccaataatagcgattggatccaaggacacaccaggaaggaaatgggccagtctttagattcagctaacacctcatttacagccatcctatcctcacccgacggagaactggttgacgtggcatgtgaagaccttgaactgtacgtgtcacgaaataatgacatgctgacaccaacgcccgacagctccccccgtagtacatcttccccatcccagtccaaaaacgggtcctttactccccggaccgcgaacatcctgaagccgttgatgtccccccccagtagggaggagatcatggccaccctgctagatcatgacttgagcgagaccatctaccaggaaccattttgcagtaaccccagtgacgttcctgagaagcctcgtgaaatcggaggacgcctactcatggtggaaacgcggcttgccaatgacctggccgagttcgagggtgacttttccctcgagggactgcggctctggaagactgccttctccgcaatgactcagaatcctaggccaggcagccctttgcgtagcggccaaggtgtagtgaacaaaggatcctcaaattcgcctaagatggttgaggacaaaaagatcgtcataatgccctgtaagtgtgcccccagcagacagctcgtccaggtatggctccaggccaaggaggaatatgagcgctccaagaagctgcccaagacaaagcctaccggtgtcgttaagtcagcagaaaactttagctcatccgtaaaccccgatgacaaacccgtggtcccccctaagatggatgttagtccctgtatcctcccaactaccgcacataccaaagaagacgtggacaattcgcagatagctttgcaggctccaacaactggatgctcccagaccgccagcgagtctcagatgttacctccagtggcgtccgcttctgaccccgagaaagacgaggacgacgatgataattactatatttcatattcaagtcccgactccccggttatacccccctggcagcagccaatttctcccgatagcaaggccctgaacggggacgacaggccatcaagcccagtggaggaactgccatctctcgcattcgaaaacttcttgaagcccatcaaggacggaatccagaagtctccgtgctccgaaccacaggagccacttgtgatctccccaattaatactagagcccgcactggcaagtgcgaatccctgtgttttcacagtacaccaatcatacagagaaagttgcttgagagactgcctgaggctcctggcctttccccactatcaactgagccaaagactcagaagttgagcaataaaaaggggtccaacactgatactctgaggcgggtcctgctaacccaagcgaagaaccagttcgctgccgtaaatacaccccaaaaggaaacgtcgcagattgacgggccatcattgaacaacacatacggctttaaggtatctatacagaacttgcaggaggcaaaggcactgcacgaaatccagaaccttacccttatcagcgtcgagctacatgcccggacacggcgtgatctggaaccagatccagagttcgatccaatttgcgcattattttactgtatctcttccgatacgcctctgcccgacaccgaaaagacagaactcacgggcgtcatcgtgattgataaggataaaactgtgttttcacaggatatccgatatcagacacctttactgatcagaagcggcattacaggacttgaagtgacctatgctgcagacgaaaaagccttatttcatgaaattgcaaacattatcaaacggtatgaccctgatatcttactcggttacgaaattcagatgcattcatgggggtacttgctgcagagggcggccgccctgtctatcgacctgtgccgaatgatcagtcgggttcccgatgataaaatagagaacagattcgccgccgagcgcgatgaatatggatcctatactatgagcgaaattaatatcgtaggccgcatcactttgaatctgtggcgtatcatgcgtaacgaggttgctctgaccaactatacttttgagaatgtgagctttcacgtcctgcaccagaggtttcctctgttcaccttccgggttttgtccgattggttcgataacaaaacggacctgtaccgttggaagatggtggatcactacgtaagccgagtaagaggtaacttacagatgttggaacagctggacttgatcgggaagacctctgagatggccagactctttggtatccaattcttgcacgtgctgaccaggggctctcaatacagggtagagtctatgatgctgcgcattgcaaaaccgatgaactatattcccgtgactccgagcgtgcagcagcgctcccaaatgagagcccctcagtgcgtaccactcattatggagcctgaatcacgtttttacagcaacagcgtccttgtcctcgatttccagagcttgtatccgagtatagtaatcgcttacaactactgtttttcgacttgtcttggtcacgtcgaaaatttgggaaaatacgacgagttcaagtttggatgcactagtctgcgggtcccccctgacctgctgtaccaggtccggcatgatatcacagtctcacccaacggggtggccttcgtcaagccgagtgtgcgtaagggggtgttaccccggatgttggaggaaatactgaaaactcgtttcatggtaaaacagtctatgaaagcttataagcaggaccgagccctatctaggatgctggatgcccggcagctaggacttaagttaattgccaacgtgactttcggatacacatccgccaacttcagcgggcgaatgccatgcattgaagtgggggattctattgtacataaagcgcgcgagacacttgagcgcgctatcaagctggtcaatgacacgaagaagtggggagctcgagttgtatacggagacactgacagcatgttcgtcctgttgaagggtgccacaaaggagcagtccttcaaaatcgggcaggagatcgccgaagcagtgactgccactaatccaaagccagtcaagctgaagttcgaaaaggtatacttaccatgtgtcctgcaaaccaagaagcgatacgtcgggtacatgtacgaaacacttgaccagaaggatcccgtgttcgatgccaaaggaattgaaacggtgagaagagacagctgtcctgcagtgagtaaaattctggagcggtctctgaaactgctctttgagacgagagacataagcctgatcaagcagtacgtccagagacagtgcatgaaactgctggaggggaaggcctctattcaggattttatctttgcaaaggagtacaggggatcgtttagctacaaacccggggcttgcgtgcccgcactggaactgaccagaaagatgctgacctacgaccggcggtcggagccgcaggttggtgagcgcgtgccctatgtgatcatctatggcacgccaggagtgccgctcattcagttggtacgccgcccagtggaggttttacaagatcctaccttgcgtctgaacgccacatattacatcacaaagcagattctcccccctttagccaggattttttccctgatcggaatcgatgtgtttagctggtaccacgaactcccgagaatccacaaggccactagtagctccagaagtgaacctgaagggagaaagggaacgatctctcagtactttacaacccttcactgcccagtgtgtgacgatttgacacagcacggaatttgttccaagtgtcgttcacaaccgcaacatgttgcagtgatacttaatcaggaaatacgggaactagaaaggcaacaggaacagctcgttaaaatctgcaagaattgcaccggatgctttgatagacatattccatgcgtaagcctgaactgccctgtgttgttcaaactctctagggtgaaccgcgaactgtccaaggccccctatttgcgtcaactgctagaccagttttag

SEQ ID NO: 132392 - DNA, 9393 bp, Artificial Sequence
  Description of Artificial Sequence: Synthetic coding sequence
atgttttcggttcggatagtcacagccgattactacatggcctccccactgcagggtctcgatacgtgtcagagtccactgacacaggcaccagtcaaaaaggttcccgtagtcagagtgttcggagccacccctgccggccagaaaacatgtctgcatctacacggcatctttccgtatctctatgtgccttacgatggctatggccaacagcctgaatcgtatctgtcccagatggcgttctctatcgaccgcgctttaaacgtggctctcgggaacccatcaagtaccgcccaacacgtctttaaggttagcctggtcagcggaatgcccttttacggataccatgagaaagagcgacactttatgaaaatatatctgtacaacccgaccatggtgaagcgcatatgcgaactcctccagagtggggcgataatgaataagttttaccagcctcacgaggcccacatcccttacctgctgcagctgtttatcgactacaacctgtacggcatgaacttaatcaaccttgctgccgttaagttccggaaagctcgacggaagtcaaacactctccacgccacaggatcttgtaaaaatcacttgtccggaaactccttggctgacaccttgtttcggtgggagcaggatgaaattccaagctcactcattctcgaaggcgtcgagccacagagtacctgcgaactggaggtcgacgccgttgctgctgacatcctgaacaggctggacattgaggcacaaatcggtggaaatcccgggctgcaggcgatatgggaggatgagaaacagagaagacgtaatcgcaacgagacctctcaaatgtcccagccagagtcgcaggaccatcggttcgtgccagcaactgaatcagaaaagaagttccagaagaggcttcaggaaatcttaaaacaaaatgacttctcagtgacactctccggcagtgtagattacagtgacggatcccaggagttcagcgcagaacttactctccattccgaagtcctgtctcccgagatgcttcagtgcaccccagcaaacatggttgaggtgcataaagacaaggaatcgagcaagggacatactcgccacaaagtcgaggaagccttgattaacgaagaggccattttgaatctgatggagaactcccagacttttcagccactgacccagcggctatctgagtccccagtgttcatggactctagcccggatgaggcgcttgtccacttgctggccggcctggaaagtgatggctataggggagaacggaacaggatgccttccccatgccggtcgttcggcaataataaatatccacagaattccgacgatgaagaaaatgagccgcagatcgagaaggaagaaatggagctctcactggtgatgtctcaacgatgggatagtaatattgaggaacattgcgccaaaaaaagatcactctgcagaaacacccatcgttcaagtaccgaggatgacgactcttcaagcggtgaggagatggagtggtccgacaattccctcctattggcttcgctctctatcccccagctcgatggaaccgccgacgagaatagtgacaatcccctgaataacgagaactccaggacacattcctccgtaatcgccacatcaaaactttcggtgaagccgagtatttttcacaaggatgccgcgactctggagccctccagcagcgcaaaaatcactttccaatgcaagcacaccagcgctctatctagtcatgtgctcaacaaagaagaccttatcgaagatttatcgcagaccaacaagaacactgagaagggtctggataacagcgttacatcattcactaacgagagtacctattcgatgaagtacccaggatccctatcatcaacagtccacagcgaaaactctcataaggagaacagtaaaaaggagatcctcccggtatccagctgcgaaagctctattttcgactacgaggaagatatccccagcgtcaccagacaggtgccctctagaaagtacactaatatacgcaaaattgagaaggactccccctttattcatatgcacagacaccccaatgagaacactctggggaagaactctttcaacttttccgatctgaaccacagtaagaataaggtgagcagcgagggtaacgagaaggggaattctacggctctgagttcacttttcccctcttcattcaccgaaaattgcgaactgctgagctgttcaggtgaaaatcgcacaatggtgcatagcctaaattccaccgctgacgagtcagggctgaacaagctgaagatccggtatgaggagttccaggagcacaagaccgagaagcccagcctatctcagcaggctgcccattatatgtttttcccctctgtggtgctttccaactgcctgacccggcctcagaaattgtccccagtgacatataagctccagcccggtaacaaacccagtcgccttaaattgaacaagcggaaactagccgggcaccaggagacatctacaaaaagctcagagacagggtccaccaaagacaacttcatacagaataacccttgcaattctaaccccgaaaaagacaacgccctcgccagtgacctgaccaagacaacacggggtgcgttcgagaacaagacccccacagacgggtttatcgactgccattttggggatggtactctggagaccgaacagtcttttggcttgtacggaaataagtacactctgagagccaaacgaaaagtgaattatgagaccgaggatagtgaaagctcctttgtaacgcacaattctaaaatctctctcccacatcctatggaaattggagaaagcctggacggtaccctgaaatcaagaaagaggagaaaaatgagcaagaagttaccacccgtgataatcaaatacatcatcattaacaggtttcgcgggagaaaaaacatgcttgttaagcttggaaagatcgactcaaaggagaagcaggtgatccttaccgaggaaaaaatggagctctacaagaagctcgccccgctcaaggacttctggcccaaggttcccgattcaccagccactaagtatccaatataccctctcacaccgaagaaaagccacaggcgtaaatctaaacataagagcgctaaaaaaaaaacaggtaaacagcaaaggacgaacaacgaaaacattaaaaggactctgagctttaggaaaaagcgctcccacgctatcctcagtccccctagtccgtcttacaatgctgagaccgaagattgcgatcttaactacagtgatgttatgtcgaagttgggatttctcagcgagcggtctaccagcccaatcaacagcagtccaccgcgttgttggtctcctactgatccgcgcgcggaagagataatggccgccgccgagaaagaggctatgctgtttaaaggccctaacgtctacaaaaaaactgtcaatagcagaattggcaagacgtcccgcgcgcgtgcgcaaataaaaaaatctaaagctaagctggcaaatccctctattgtcactaagaaacgcaacaagcggaaccagaccaataagctggtggatgacggcaaaaaaaagcctcgcgctaagcaaaagactaatgaaaagggaacgagtaggaagcataccacacttaaggacgaaaagataaaaagccagtccggagcagaggtcaagtttgtgctgaagcaccagaatgtgtcggaatttgcttcctcctcaggaggctcccagttgctgtttaagcaaaaggacatgccactgatggggtctgccgttgatcatcccttaagcgcctctctcccaacaggaattaatgcacagcagaagctatctgggtgtttttcatccttcttggagagtaaaaagtcagtggatcttcagacctttccatcttctcgcgacgatctgcacccatcagttgtgtgcaattcgattgggcccggtgtgtctaagatcaatgtccaacgtccccataaccagtcagccatgtttactctgaaggagtctaccctgatccaaaagaatatcttcgatctgtccaaccatctgagccaggtggcccagaacacacagatcagcagtgggatgtcatccaaaatcgaggacaatgccaataacatccaacggaactatctgagcagtatcggcaagctgtccgagtacagaaatagcttagagagcaaactggaccaggcctataccccaaattttttacattgcaaagacagccagcagcagatagtctgcatagctgagcagagtaaacacagcgaaacctgtagcccaggcaataccgcatcggaggagagtcagatgcccaataactgctttgtcacctctcttcgttccccaattaaacagattgcttgggaacagaaacagcgcgggtttatcctcgacatgtcaaatttcaagcctgagagggtaaaaccaaggagcctctctgaggctatctcccagacgaaagcattgagtcagtgtaaaaatagaaatgtgtccaccccctctgccttcggcgaaggacagagcggcctggccgtgctgaaggagcttttacagaaacgacagcagaaagcccagaatgctaacacgactcaggaccctttgtccaataagcatcagcctaacaagaatatcagtgggagtctcgaacacaataaagccaataaaagaactcgatcggtgacctctccccgcaagccgaggactcccaggtctacaaaacagaaagaaaagatcccaaagctcctcaaggtggactctctgaatctgcagaattcctctcaattggacaatagcgtgtcagacgatagcccaattttcttctctgaccccggctttgaatcctgctacagtctggaggattctttgtcacccgagcataactataactttgacatcaacacaattgggcagaccgggttctgtagtttctattccggctctcaattcgtccccgctgaccagaatcttcctcaaaaattcctgtcggacgcagtgcaggatctgttcccaggccaggcgatagagaagaatgagttcctgtctcacgacaaccaaaagtgtgacgaggacaaacaccacaccaccgacagtgccagctggataagaagtggaactttgagccccgaaattttcgaaaagtcgactatcgacagtaatgagaatcgaaggcacaatcagtggaagaatagcttccacccgctaactaccagatcaaactccattatggacagcttctgcgtgcagcaggctgaggattgtctcagtgagaagtcccggctaaataggtccagcgtaagcaaagaagtcttcttgagcctgcctcagccgaataactctgactggatccagggacacacgaggaaggaaatgggccaaagcctggactcggccaatactagtttcacggctattctgtcctcaccagacggcgaattagtcgatgtggcctgtgaggatttggaactatacgtcagtaggaataacgacatgttgacgcccacacccgatagcagcccccgtagtacatcatcgcctagtcaaagtaaaaacggaagcttcactccacgcacagccaatatcctcaagccgcttatgtccccaccctctagagaggagataatggcaacattattggaccacgacttatctgagaccatctatcaggagcctttttgttctaacccatcagacgtgcccgaaaaaccgcgggaaattggaggccgcctgctcatggtggagacccggctcgcaaacgatctggccgagttcgagggagatttttcactggagggattaaggctgtggaagactgcattcagcgcaatgacacagaacccacggcctggtagccccctgaggtcaggccagggcgtggtgaataaaggctcgagtaattcacccaagatggtggaggacaaaaagattgttattatgccctgcaagtgtgcccccagcagacagctcgtccaggtttggctgcaggccaaggaagaatacgagaggtctaagaaattgcctaaaactaaacctaccggagttgtcaaatccgctgagaacttttcatctagtgtgaatcctgatgacaaacccgtcgttcctcctaaaatggacgtgagtccttgcattctccccactacagctcacactaaggaagatgtagataacagccaaatagctttgcaggcacctacaaccggctgtagccagaccgcctctgagagccagatgctgccgcccgtcgctagcgcctccgacccagaaaaggacgaagatgacgacgataactattatatctcctatagcagccctgacagcccagtgattcctccttggcagcagcccatttcccctgacagcaaggcactgaatggagatgaccgcccaagcagtcccgtagaagaactaccttctcttgctttcgaaaacttccttaaacctattaaagacggtatccagaagagcccatgctccgagcctcaagaaccgttggtcatctcaccaataaatacaagagccagaacggggaagtgtgaaagtctgtgttttcatagcactcctataatacagcgaaaacttttagaacggctgcccgaagccccaggactgtcccccctgtctaccgaacctaaaacccaaaaactgagcaacaagaagggtagcaacacggataccctaaggcgggtgctcttgacccaagctaaaaatcagtttgccgcggttaacacccctcagaaggagaccagtcagatcgacggacctagtctgaataacacctatggattcaaagtctctatccaaaacttgcaagaagccaaagcattgcacgagatacaaaatttaaccctgatctccgtggaactacatgccagaacaaggcgagatctcgagcccgatcccgaattcgaccctatttgtgccctcttctactgcataagctcggacactccactcccagatacggagaaaacagaactgaccggagtgattgtaatagataaggacaaaactgtcttctcgcaggacatccggtaccagactcccctgctgattcggagtggcatcaccgggcttgaggtaacctatgctgccgatgagaaagcacttttccatgagatcgccaacatcataaaaaggtatgatcccgacatcctgttgggctacgaaatacagatgcacagttgggggtacctgctgcagcgtgccgcagcgctcagcatagacctgtgtcgcatgatctcgagagtgcccgatgacaagatcgaaaaccgattcgccgctgaaagggacgagtacgggtcctacaccatgtctgagataaatatcgtagggaggatcactctgaacttgtggagaataatgaggaatgaagtcgccctgactaattatacatttgaaaacgtgagtttccacgtgctgcaccaacgctttcctctcttcaccttccgagtgctgagcgactggttcgacaataagaccgatttgtaccggtggaaaatggtcgaccattacgtcagtcgcgtaagaggtaatttgcagatgttggaacagctggatttgatcggaaagaccagtgaaatggcccgactgttcggaatccaattcctgcatgtacttacccgcgggtctcaataccgtgtcgagagcatgatgctgagaatcgcaaagccaatgaattacatccccgtgactcccagtgtacagcagcgttctcagatgagggcaccacaatgcgtaccgttgatcatggagccggagtcccgcttttatagcaatagcgtgctcgttctggacttccagagcctgtatccttccatcgtcattgcctataactactgcttttccacctgtttaggtcatgttgagaacctcggcaagtatgacgagtttaagttcggatgtacctcgctgagggtacctccagatttgctttaccaggtgcgccacgacatcacagtcagcccaaacggcgtggcctttgtcaaacctagcgttagaaagggggtgctgccaagaatgctggaagaaattcttaaaacacgcttcatggtaaaacaatctatgaaggcctacaaacaagaccgcgccctgtcccggatgcttgatgctcgccaattgggcttaaagttgattgccaatgtgacattcgggtatacttccgcgaatttcagcggccggatgccctgtatcgaggtgggggactcaatcgtgcataaggcccgagagactctggagagagccattaaactggtaaacgacactaaaaaatggggcgctcgggtcgtgtacggtgacactgacagcatgtttgtgctgctgaaaggcgctaccaaagagcagagttttaaaatcggtcaggagattgcggaggccgtgacagccaccaacccaaaacctgtgaaactgaagtttgagaaagtctaccttccgtgcgttctgcagaccaaaaagcggtacgtgggttacatgtatgagactctggaccagaaggaccctgtttttgacgctaaggggatcgaaaccgttaggcgtgattcctgccctgccgtttccaagatcctagaacggagcttgaagctgttgttcgagacacgcgatatcagtctcattaagcagtacgtgcagagacaatgcatgaagctgctggaaggcaaggccagcatccaggatttcattttcgccaaggagtaccggggctcttttagttacaaacctggcgcttgcgtcccagcccttgaactgacacggaagatgttaacatacgaccgaagatcggaacctcaagtcggcgagcgggtaccttacgtcattatctacggaacacctggagtcccccttatacagttggtgcgcaggccagtggaggttcttcaagaccccaccctaaggttgaatgccacatactatatcacgaagcaaatactcccacctttggctcgcatatttagtctaatcggtatcgatgtcttcagctggtatcacgaactgcctcggatccacaaggccacatcctccagtcgctccgagcccgaaggtcgcaagggcactatcagccagtatttcactactctgcattgccctgtgtgcgatgatttgacgcagcacggaatttgttccaagtgccgcagccagcctcaacacgtggccgttattttaaatcaagagattcgggagctagagaggcagcaggagcagttggtgaaaatatgtaagaattgcaccggttgcttcgatagacacatcccgtgcgttagtcttaactgccctgtgctgtttaaactgtcaagggtcaaccgggagctcagtaaagccccttaccttcgtcaactgcttgaccagttttag

SEQ ID NO: 132393 - DNA, 9159 bp, Artificial Sequence
  Description of Artificial Sequence: Synthetic coding sequence
atggcattctccatcgatcgagcactgaacgttgcattaggaaatcccagtagtacagctcagcacgtcttcaaggtgtcactggtttccggaatgcctttctacggttaccatgaaaaagaaagacactttatgaagatatatctgtacaatccaaccatggtgaagagaatatgtgaattactgcaaagcggggctatcatgaacaagttttaccagccccatgaagcccacatcccatacctcttgcagctgtttattgactacaacctttacggcatgaacctcatcaatctcgcggcagtgaagtttcggaaagcaagacgcaagtccaacaccctgcatgccacaggaagctgtaaaaatcacttatccggaaattctcttgctgacacactcttccggtgggagcaggacgagatcccatcttctcttatactcgagggagtagagccgcagtctacctgtgagctcgaggtagacgccgttgccgcagacatcttaaataggctggacattgaggctcagataggcggaaaccccggcctgcaggccatatgggaggacgaaaaacaaagacgccgtaaccgcaacgagacttcgcagatgtctcagccggagtcccaggaccaccgcttcgtccccgccaccgagagtgagaagaaattccaaaaaagacttcaagaaatcctcaagcagaatgacttcagcgtgaccctaagtgggtccgtggactatagtgatgggagccaagaattttcagctgagctaaccctacattccgaggtgctttccccagagatgctgcagtgtactcctgccaatatggtggaagtgcacaaggacaaggagtcaagtaagggccataccagacacaaagtagaagaggcccttatcaatgaggaggccatcctcaacctgatggaaaattcacagacattccagcctctaacacagaggctctccgagagtccggtatttatggatagcagtccagatgaagccctcgtccacctgctggcgggtttagagtccgacgggtacagaggtgagaggaataggatgccttccccttgtagaagctttggtaataataaatacccccagaattctgacgatgaggaaaatgagccacagattgaaaaggaagaaatggagctttcactggttatgtctcagcgctgggactctaacatagaggagcactgtgctaaaaagaggtccctgtgccgaaacacccaccgaagctcgaccgaagacgatgacagctcatctggtgaggagatggaatggagcgacaactctcttctgctggcatccctaagcataccacagttagacggcaccgcggatgaaaattccgacaatcccctgaacaacgaaaactcgagaacacactctagcgtcatagccacctcgaaactctctgtgaaaccttccatcttccacaaagacgccgctacactggagccctcttcctccgcgaaaatcaccttccagtgtaagcatacttcagcattgagctctcacgtcctaaataaggaagatctgatcgaggatcttagtcagactaacaaaaacaccgagaagggcttagacaacagcgtcactagtttcaccaatgagtctacctactcaatgaaataccccggatctctgtcctccacagtgcatagcgagaatagccataaggaaaattctaaaaaagaaatcctgcccgtgagtagctgtgagagctctatcttcgattatgaagaggacattccttcagttacacggcaagtcccatcacgtaaatataccaatataagaaaaatcgagaaagacagcccctttatccacatgcataggcatccaaatgaaaacacactaggcaaaaactcatttaacttttctgaccttaatcactccaaaaataaggtgtcttcagagggaaacgagaaggggaactccactgcattatcatcactgttcccttctagcttcaccgaaaattgcgagcttctaagttgttcaggcgagaatcggaccatggtgcattcactgaattcaaccgcagatgaaagtggactaaacaagcttaaaatccgctatgaggagttccaggagcataaaactgaaaagccctctttgtcgcagcaggccgcacattacatgttcttcccttccgtcgttctgtcgaactgtctgacaaggcctcagaaattgtcaccagtgacttacaagctgcagcctggaaataagccaagtagactaaagctcaacaaacgaaaactggccggacaccaagaaacttctaccaagtcctccgaaacgggcagcaccaaggataacttcattcaaaacaacccctgtaactctaatccagagaaagataacgctcttgcatctgacctgaccaagaccacgcgcggggccttcgagaacaagacacctactgacggtttcatagactgccactttggagacgggactctggagactgaacagagcttcggcctttatgggaataaatacaccctgcgggctaaacggaaagttaactacgagaccgaggacagcgagtcctcattcgttacacataatagcaagatttctttaccccaccccatggaaattggtgaatcccttgacgggaccctcaagagcaggaaacgacggaaaatgtccaaaaagttaccacccgtgatcatcaaatacatcattattaataggtttagggggcgtaagaacatgctggtgaagctcggtaagattgacagcaaagagaagcaggtgattctgaccgaagagaaaatggaactgtataagaagttagcacccctcaaagatttctggcccaaagttccagactcacccgctacaaaataccccatatatcctcttaccccaaaaaagagccacaggcgtaagtccaagcacaagagcgcaaagaaaaaaacggggaagcagcagaggaccaataacgaaaacatcaaaaggacactcagttttagaaaaaagcgcagtcatgccatactcagtcccccaagccccagctacaacgcggaaacagaggattgcgatttaaactattcagacgtgatgagcaagctgggattcctttccgaaagatccacatcacctattaattcaagtccaccgagatgctggagcccgacggatccccgagctgaggaaattatggcagctgcagaaaaggaggctatgctatttaagggccccaatgtgtacaaaaagactgtgaactcccgaatcggcaagactagtcgagctcgagcccaaatcaaaaagagcaaagcaaagctcgccaacccttcgatcgtgaccaagaagagaaacaagagaaaccagactaacaagcttgtggacgatggtaaaaaaaagccacgcgccaagcaaaagacaaacgagaaggggacctctaggaaacacaccactctcaaagacgagaaaataaagagccagtcaggagccgaggtgaaattcgtcctgaagcatcagaatgtgagtgaatttgctagcagtagcgggggctcccaactcttattcaagcagaaagacatgcctctaatggggagcgcggtggatcatcccctgagcgcctcgctaccgacaggtattaacgctcagcagaagctgagtggctgctttagctcgtttctagagtccaagaagtctgtggatctgcagacctttccttcatcacgtgacgatctacatcctagtgtagtttgcaactcaattggtcccggcgtctctaaaataaacgtacaacgtccccataaccagtccgctatgtttactttgaaggagtccaccctcatccagaaaaacattttcgatctgtcgaatcacctctcacaggtcgctcaaaatacccagatctcttcaggaatgtcatcaaagattgaagacaacgctaataatatccagcgcaactacctgagtagcataggtaaactgagcgagtataggaattctctggaatcaaaattggatcaagcatatacgcccaattttcttcattgcaaggattcccaacagcaaattgtatgcattgccgagcaaagtaagcactccgagacatgctcacctggtaatacagcatcagaagagtcccagatgccaaataactgcttcgtgaccagcctaaggtcacctataaaacagatcgcttgggagcagaagcaacggggcttcattctggacatgagcaactttaagcccgagagggtgaaaccgcgaagcctgtcggaagcaataagtcagaccaaggcactgagtcagtgtaagaaccggaacgtgtctactcccagtgccttcggagaagggcaatcgggtctagcagtccttaaagaacttttgcagaaaagacaacagaaagcccaaaacgccaataccacacaggacccactatcaaataaacaccagcccaataagaatatcagcggctcgctggagcacaacaaagccaacaaaaggactcggagcgtgacatcaccccgcaagccgcggacaccaagaagtactaagcaaaaagagaagataccaaagttgttaaaagtcgatagcctcaacttgcagaactctagccaacttgacaacagtgtgagcgacgattctccaattttcttctctgaccctggcttcgaatcctgttacagtctggaggactctttatcccccgagcacaattacaatttcgacataaatacaatcggccagaccggtttctgctcattctactctggcagtcagttcgtccccgccgaccagaacctgccgcagaagtttctgtcggacgcagtccaggatctgttccctgggcaggctatagagaaaaatgaattcctgtcccacgacaatcaaaagtgcgacgaggacaaacaccacaccaccgacagcgctagctggatccgaagcggcacactgtcacctgaaatcttcgaaaagtcaaccattgattctaatgaaaatcgcaggcacaaccagtggaagaactccttccatcctttaacaacccggagtaatagcatcatggattctttctgcgtgcagcaggctgaggactgtttatccgaaaagtctcgcttgaatagaagctcagtgagtaaggaggtgtttcttagcctgcctcagcccaacaactctgattggatccagggccacacccgaaaagagatggggcagagtctggactccgccaacactagctttacagccatactgtcttctcccgacggagaactagtggacgttgcttgtgaggatctggaactttacgtgagtagaaacaatgatatgttgacgccaactcccgattcaagccccaggagcactagtagtccgagccaaagtaagaatggctcctttaccccgcggaccgccaacatcttgaagccactgatgagcccccctagccgagaggagattatggccacactcttagatcacgatctgtctgagactatttaccaggaacctttctgttccaacccatctgatgtgcctgaaaagccacgggagatcggcggcagactgttgatggttgaaactcgactggccaatgatttggctgagttcgagggcgactttagtttagaagggttaagactgtggaaaactgccttcagtgctatgacccagaacccccgccccggatcacccctgagatccgggcaaggagtggtgaacaagggttcatcaaattcacccaaaatggttgaagacaaaaaaatcgtgatcatgccttgcaaatgtgctccttcaagacagctcgttcaggtgtggttgcaggcaaaggaggagtacgaacgaagcaagaaactgcctaaaactaaacctaccggggtcgtgaagtctgcagagaacttcagcagctcagtgaaccctgatgacaagccagtggttcctcctaagatggacgtcagtccttgtatcttgcctaccaccgctcacactaaagaggatgtggataactcacagattgcacttcaggcccctaccacaggttgctcccagaccgctagcgagtcccagatgcttcctcctgtggcttccgccagtgacccagaaaaagacgaagatgatgatgataattactatatatcatactcctcgcctgatagccctgttatccccccatggcagcagcccatttcccctgatagcaaagccctgaacggggacgaccggccaagttcacctgttgaggaactgccttccttagctttcgaaaactttctcaagcccatcaaggacggaatccagaaaagtccctgctccgaaccgcaggagccactggtcatcagccccatcaacacaagggcgcgtacgggtaaatgtgaaagtctgtgtttccattcaacccctattatccagcgcaaactgctggaaaggctcccagaggcaccaggtttatcaccattaagtaccgagcccaagacacagaagctgtccaacaaaaagggttccaacacggatacactgagaagagtcttattgactcaggctaaaaaccagttcgctgccgtaaacacaccccagaaggagacctctcagatcgacggcccatccctgaataatacctacggatttaaggtgtcgattcaaaacctgcaggaggctaaggctcttcacgagatacagaacctcacactgatctccgttgagctccacgcacggacacgtagggatctggaacccgacccagaatttgatcccatttgtgcactgttttattgtatcagcagcgatacaccactccctgacaccgagaagaccgaactaactggcgtgatagtgatcgacaaagacaagaccgtgttctcacaggacatcagatatcagacccccctgctgataaggtctggaataacagggctcgaggtcacttacgctgctgatgaaaaggctttgttccacgagatcgccaatataatcaagaggtatgatcctgacatcttattaggttatgaaatacagatgcatagctggggctatctgctccaacgcgccgccgcgttgtctattgatctctgcaggatgatctctcgggtgccagacgacaagattgagaatcgtttcgctgcggaacgagatgaatatggttcttacacaatgtctgagattaatatcgtgggtcgaataactctgaacttgtggcgcattatgagaaatgaagtggcgcttaccaattacacattcgagaacgtgagctttcacgtactgcaccagcgctttccacttttcactttcagagtgttaagcgattggttcgataacaaaactgacctgtatcggtggaagatggtcgatcactacgtcagtagagtccgagggaatctccagatgctcgagcaattagacctgatcggcaaaacgtccgagatggctagactgtttggaattcaattcctgcatgtcctcaccaggggaagtcaatatagagtcgaaagcatgatgttgagaatcgctaaaccaatgaattacatcccggtcacaccctctgtccagcagcgctctcagatgagagccccacagtgtgtgccgctcataatggaaccagaaagccgattctactctaattccgtgctcgtgcttgactttcagtcattatacccatccattgtcatcgcttacaactactgtttcagcacgtgccttggccacgtggaaaatctgggtaaatacgacgagttcaagtttggatgcacgtccctccgcgtccctccggatctcctttaccaggttagacatgacattaccgtgtcccctaatggggtggcctttgtgaagccgagtgtgaggaaaggtgttctgcctaggatgctggaagagatactcaagacacgtttcatggtcaagcagagcatgaaggcctacaagcaggaccgcgcattatcccggatgctcgatgcacggcagctaggcttgaaactgattgccaatgtaacttttgggtacacaagcgcaaacttcagcggtcgtatgccatgcatagaagtaggagactccatagtgcacaaagcaagggagacattagagcgggctattaagctggtgaacgacactaaaaaatggggcgccagagtcgtctacggagataccgactctatgtttgttctgttgaaaggggccactaaggaacagagtttcaagattggccaggaaattgccgaggcggtgacagcaactaatccaaaaccggttaaactgaagttcgagaaagtctatttgccttgcgtgctccagacaaagaaacgctatgtgggctatatgtacgaaacactggatcaaaaagacccagtcttcgatgccaaaggtatcgagactgtccgcagagattcttgccctgctgtttctaagatcctggagcggagcttaaagctcctgttcgaaaccagggatattagcttgatcaaacagtatgtgcagcggcagtgcatgaaactgctcgaggggaaggcctctatccaagattttatattcgcgaaggaataccggggtagtttcagctacaagcccggagcctgcgtgccggccctcgagttaacaagaaagatgctgacctacgataggagaagcgagccccaggtcggagaacgcgtgccttacgtcatcatatacggaacccctggagtgccgctcattcaactggtgaggagaccagttgaggtactccaagacccaactttgcggctgaacgctacctactacattaccaagcagattctaccccctctcgcccggatcttctcgctaatcggcatcgatgttttcagttggtatcacgaactgcctcgcattcataaggcaaccagctctagccgcagtgagcctgagggcaggaaagggacaatctctcagtatttcactaccttacactgccctgtctgtgatgaccttacacagcacgggatctgttccaagtgtcggtctcagccgcagcacgtggccgttattctgaaccaagagatacgcgaactcgagaggcaacaggagcagttggtgaaaatctgcaagaattgcacaggctgttttgaccggcatatcccatgcgtcagccttaactgccccgtgctgtttaagctgtcccgcgtgaatcgggagctgtctaaggcaccttatttgaggcagctcctcgatcagttttag

SEQ ID NO: 132394 - DNA, 2289 bp, Artificial Sequence
  Description of Artificial Sequence: Synthetic coding sequence
atggttgaaaccagactggcgaatgacctggccgaattcgagggcgacttttcactagagggacttcggctgtggaagaccgccttcagtgccatgacgcaaaatccaagacctggaagccccctcaggagtgggcagggcgtggtgaataaaggttcaagcaattccccgaaaatggtggaggataagaaaattgtgatcatgccctgtaaatgtgcccccagcaggcagttggtgcaggtgtggctgcaggctaaagaagaatacgagcgatctaaaaaattgcctaagacgaagcctacaggagtcgtgaagagcgcggaaaacttctcctcctctgtaaatcctgacgacaagcctgtagtgcctccaaaaatggacgtttccccatgtatcttgcctaccaccgctcacaccaaggaggatgttgacaactcgcagatagctctccaagcccccactacaggttgcagccaaactgctagtgagtcccagatgttgcctcctgtggccagtgcctcagatccagagaaggacgaagatgacgacgacaattactacatctcttatagttctcccgacagtcctgtgattccgccatggcagcagccgattagcccagacagtaaggcgctgaacggcgacgacaggccaagttctcctgttgaagagctcccatcccttgcattcgagaattttctcaagccgattaaagatggaatccagaagagtccttgcagtgaacctcaggaacccctggtgataagtcccattaacactcgcgcacggacaggtaaatgtgaaagtctatgcttccactccaccccgatcatccaacggaaactgctcgagcgcctgcctgaagccccgggacttagcccactgtccactgaacctaagactcagaagttgagtaacaagaagggcagcaatactgacactctgcgcagagtactcttgacccaagctaagaatcagttcgccgctgtaaacacgccccagaaagaaaccagccagatagacggccctagtctgaataacacatacggatttaaggtgagcatccagaacctccaagaagcaaaagccctacacgaaattcaaaacctgactctgatctctgtggaacttcatgcccggactcgaagagatctagaacccgatcctgaatttgacccaatttgcgctttgttctactgcatctcatccgatacacccttgccagacacagagaaaaccgagctcactggcgtgattgtaattgataaagacaagacggtttttagtcaagacattcgctatcagacccccctgttaatccgatcaggcattacagggctagaggtcacctacgcggccgacgaaaaggctttgttccacgagatagctaacattataaagaggtacgaccctgatattctgctgggctatgagatccagatgcatagctgggggtacctcctgcagcgggcagctgccttgtctatcgacctgtgtcgtatgatcagtcgggtccctgacgacaagattgagaacagattcgccgccgagagagacgagtacggtagctacactatgtccgagatcaacatagttgggaggatcactctgaatctttggcgaatcatgagaaatgaggtcgcgttgacaaactacacgtttgagaatgtaagctttcacgtgctgcaccaaaggtttccactctttaccttcagagtgctgtccgactggtttgacaacaagactgatctgtacaggtggaaaatggtagaccattatgtaagtagagtgagggggaatctccagatgctcgaacagctggacctgattggtaaaaccagtgagatggctaggttatttggcatccagtttctgcacgtcctgacgcgtgggagccagtacagagtggagagtatgatgctgcggattgccaaaccgatgaactatattccggtgacgccctctgtgcagcagcgcagccagatgcgggcccctcagtgcgtcccccttattatggagccggagtctcggttttatagcaatagtgtcctcgtcctggacttccagagcttgtaccccagcatagtgatagcctataactactgcttctccacttgtctggggcatgtagagaatcttggtaaatacgacgaattcaaatttgggtgtacatccttgcgagtgccccctgatctgctctaccaagtcaggcacgacatcacagtgtcccccaacggcgtggctttcgttaagatcgccaacaagtgtagaccggaagggatggcttag

SEQ ID NO: 132395 - DNA, 3666 bp, Artificial Sequence
  Description of Artificial Sequence: Synthetic coding sequence
atgctgaggtctactggcttctttcgggcgatcgactgcccttattggtccggcgcacccggaggtccctgtagaaggccgtactgccattttcgacatcggggcgcgcggggtagcggtgcacccggcgacggcggagaggccccaccagcagccggactcggttatgatccctacaatccagagctgcctaaacctccggctcagcgcgagaatggcacactgggcctcggcgaagagcccaggcccgatgtgctggagctggagctggtcaatcaggccattgaagcggttaggtccgaggtagaattggagcagcggcgataccgggagctgttagaaacaacgagagaacacaggagcgccgaggcgcctgccttggctccccggggaccaaacgcttctcctactgtgggccctgacgaggacgcctttcccctcgcctttgactactctcccggctctcacggactgttgagtcccgacgccggttatcaacccactccgctggcagcacccgcggagcctggcagcaaatactccttggcatccctggatagaggccagggaagggggggaggaggtgggggcgcgttagagtacgtgcctaaggccgtgtcccaaccgcgacgacatagccgccctgtcccaagcggtaagtacgtggtcgataattcaaggccccctacggatttggaatacgaccccctgtcaaattactccgctaggcacttgagccgagcctcatccagggacgagcgggccgcgaagcgaccgagaggctccaggggttcggaaccttacacaccagcacccaagaaattgtgcgatcccttcggctcctgcgacgctagattctccgactctgaggatgaagccgcaacggtgcccggaaatgaacctaccactgcaagcaccccaaaggcccgagcggaccctgagatcaaggctaccggccaaccaccatcaaaagaaggcctcgaggcagaagggggcggtcttagggagaccaaagaaactgccgttcagtgcgacgtgggagacctgcagcccccacccgctaagccagcttcccccgcacaggtgcagtccagtcaggatggcggctgtcccaaagaaggcaaacccaagaagaaaaaaactggcgctcctcccgcgccttcatgtaaggatggcgctcaggggaaggataagaccaaagacaagggcagaggcaggcccgtagaaaaacccagggccgacaagaaagggcctcaggcgtcctctccacggagaaaggctgaacgacccgaggggactaaaaagaagcccagttctgcgacacccgtcgccacttctggaaaaggccgtccagatagaccggctcggcggccatcacctacatcaggtgattctcggcctgctgctgggcgggggccgccccgcccgctgcagctgccggatcgaaagagcacgaaagcaccgagcggcaagctggtggaaagaaaggccaggtctttggacgaaggcgcctctcaggacgctccgaagctcaagaaacgggcgcttagtcacgcggatttgtttggtgacgagagcgaagatgaagcggccggacctggcgtgccttccgtgtggccctccgctctgccgtccctcagcagcgactctgatagtgattccgactccagccttggatttccagaggcacagggaccaccgaaaagactgaaagctagtcctcccccaagccccgcccccagcagcagctcttccagcagttcctcaacatcatccgctggagctgacgtagactacagtgcactggaaaaagaagtggatttcgatagtgatccaatggaagagtgccttagaatcttcaatgaaagcacctcagtcaaaacggaggaccggggtagactggccagacaacctccgaaagaggagaagagtgaagaaaaggggctttctggtctgacaacattattccctggacagaaaagacggatcagccacctgagcaaacaaggacaggaggtcgagccacccaggcgcgggcccgcagtccccccagctcgacctccgacagcccaagaggtgtgctacctgcgcgctcagcaggctcaacgagcctcagccagcctgcttcaggctccggctcgcttggcagagaaatctcctagcgtccacatcagcgctcccggggaaaagcgccggattgcacacatcccaaatcccagacttgccgccgcccccaccggggccaagcgcaccttggctgcatccggtagccagagtagtaacgggcctgaacctggcggacagcaactgaagacacgaaccctgtcaggtatggcaagcaagaccactaccaccatcatccctaaacgcattgcccatagtcccagcctgcagagtctgaagaaacccattattcctaaggagttcgggggcaaggtgccaactgttatacgacagcgctaccttaacctgttcatcgaggaatgcctgaagttctgtacaagcaaccaagaggcgatcgaaaaagctctgaatgaggagaaggttgcgtatgataggtccccctctaaaaatatatatctcaatgtggcggttaacacactcaagaagttgagaggcctcgccccctcagccgtaccaggattatcaaagaccagcggccgccgcgtcgtgagccacgaagtggtcctgggaggcaggctagctgccaagacctctttttccctttcccggccttcctctccaagggtggaggatctaaaaggtgccgccctctattcgcgcctgcgggagtacctgctcacacaagaccagcttaaagagaacggatacccattcccacatcctgaacggccaggtggcgccattatctttaccgcagaagagaagcggccgaaagatagttcttgtcgcacatgctgtcggtgtggcacggagtacctggtctcttcctccggcaggtgtatcagagacgaagagtgttactatcattggggtaggctaagacgaaacagagtcgccgggggttgggaaacccagtatatgtgttgctctgccgccgccggatcggtgggctgtcaagtcgccaagcagcatgtgcaggacggcagaaaggagaggctggaagggttcgttaagactttcgaaaaggagctgagcggagatactcaccctgggatctatgcacttgactgtgagatgtcatacactacatatggactggagctgacccgtgtgaccgttgtcgacacagacgtgcacgtggtctatgacacatttgtcaaacccgacaacgagattgttgattacaacaccaggtttagcggagttaccgaagccgacctcgcggacacatctgtgacccttcgtgatgtgcaggctgtcctcctatccatgttttccgctgataccattctgataggccattctctggagtccgatctgctagctcttaaggtgatacatagcactgtggttgacacctctgtgcttttcccacaccggctcggcctgccctacaaacggagcctgcgtaatctaatggcagattatctgcgccagatcatccaagataacgtggacggacattcctcgtctgaggacgctggagcctgtatgcacctcgtcatctggaaagtgagagaggacgcaaagacaaagagatag

SEQ ID NO: 132396 - DNA, 1014 bp, Artificial Sequence
  Description of Artificial Sequence: Synthetic coding sequence
atgttaccatccagtactcggttgggatatgatccctataaccccgagctgccaaaaccgcctgcccaaagggagaacgggaccctggggttgggggaggagcctcggcccgatgtgctcgagttagaactggtcaatcaagcgattgaagctgtcagatccgaggtggagcttgagcagcgaaggtacagggagctgctcgagacaactcgtgaacaccgctccgccgaggccccagcactcgcccccagaggcccaaacgcaagtcctacggtgggccctgacgaagatgcctttcccctcgctttcgattactccccaggctcccacgggctgctgtcccctgatgctggctaccaaccaacgccactagctgcaccggcggaaccggggagcaaatactctttggcttctctggatagaggacagggccgggggggtggcggggggggtgctctggaatatgtgcctaaagccgtgagtcaaccgcgccgacatagtcgccctgttccaagtgggaaatatgtcgtcgacaacagccgacctccaactgatttggagtacgacccgctctctaactactcagcgaggcatctttctagagcgagcagccgtgatgaacgcgctgccaagcgtccgcgtggttcccgcggatctgagccttacaccccagcccccaagaagctctgtgatccgttcgggagctgcgacgcacgctttagcgactcagaagatgaggctgcaactgtcccaggaaatgagcctacaacggcgtcaacaccaaaggcccgggccgacccggaaattaaggccacggggcagccccctagcaaggagggcctagaggccgaggggggaggcctgcgtgagacaaaagaaacagccgtccaatgtgacgtgggcgacctgcagccaccccctgctaaaccagcttcaccagcacaggtgcagtcgtcccaggacgggggctgtccaaaggagggtaagccaaagaaaaagaagaccggagcatag

SEQ ID NO: 132397 - DNA, 1482 bp, Artificial Sequence
  Description of Artificial Sequence: Synthetic coding sequence
atggggtctcattctccctgcgcacatacaccatgtgccccacccgctcctacaggtgctaaaaggacattggcagcctccggtagtcagagtagcaatggtccggagccaggtggccagcaattgaaaaccagaaccctaagcggcatggctagcaagacaactacaaccattatcccgaagaggattgcacatagcccttccctgcagtccctcaaaaagccaatcattccgaaggagtttggcgggaaggtccctacagtaattcgccagagatatttaaatctctttatcgaggagtgcctgaagttctgtacttctaaccaagaggctatagagaaggctctgaacgaggagaaggtggcttacgacagatcaccaagcaaaaacatctatttgaatgttgccgtgaataccttaaagaagttgaggggcctcgcacctagcgctgtgcctggcttgtcaaaaacttctggtcgtcgcgtcgtctcccatgaggtcgtgctggggggtcgattggctgctaagacgtctttttcccttagcaggccctcttcgccacgcgttgaagacctgaaaggggctgccctatactccaggttgcgcgaatacttgcttacacaggaccagttgaaggagaacggttaccctttcccccacccagaacgacccggtggggccatcatttttaccgcagaggagaagcggccaaaggacagtagttgcagaacttgctgtaggtgtggtaccgagtatctggtttcatcctcggggcgctgtattcgtgacgaggagtgttactaccattggggtcgtctaagaagaaatcgagttgcaggtggatgggagacacaatatatgtgctgtagtgcggcagctgggtccgtgggctgtcaagtagccaagcagcatgtacaagacggtcgcaaggagcggctggaggggttcgttaagacttttgagaaagagctttccggggacacccacccaggcatatacgctctggactgcgagatgtcttatacaacttatggtctggaattaacaagagtgacagtggttgacaccgatgtgcacgtggtgtacgatacatttgttaagccggataacgaaatagtagactataatacccgtttcagtggagtaactgaagcggacctggccgacacttcagtgactctcagggacgttcaggcagtactgctctctatgttttccgccgatactatcctgattgggcactccctcgaaagcgacctactggcgctgaaggtcattcattcaaccgtggtggatacatctgtattgtttccacaccggctggggctgccctataagaggagcctgcgcaatctaatggccgattacctcaggcaaatcattcaggataacgtggacgggcactcgtcctcagaggacgcaggggcgtgtatgcacctggtcatctggaaggtcagagaggacgctaaaacaaagaggtag

SEQ ID NO: 132398 - DNA, 714 bp, Artificial Sequence
  Description of Artificial Sequence: Synthetic coding sequence
atgttaggaggaagtttagggagccggctgctcaggggggttggcggatcccacggccgcttcggagccagaggagttagagaggggggtgccgcgatggccgccggggaatcgatggcccagaggatggtttgggtggatctggaaatgacagggctggacatcgagaaggaccagattatcgagatggcttgcctaatcaccgacagtgaccttaatatcctggctgaaggaccgaatctcattataaagcaaccggacgaattgcttgattccatgtctgattggtgtaaagagcatcatgggaagagcggcctcacaaaggctgtcaaggaaagcaccataactctgcagcaggctgagtatgaatttctgtcttttgtcaggcagcagacaccacctgggctttgtcctctggctggaaatagcgtgcatgaagacaaaaagttccttgacaaatatatgccccagttcatgaaacatcttcactatcgcatcatcgatgtgagtaccgtcaaagaactgtgtagacgctggtaccctgaggaatacgagttcgcccctaagaaggcagcctctcaccgcgccctggacgatatatccgagagcatcaaagagctccagttctaccggaataatatttttaagaaaaagatcgacgagaagaagcgaaagattattgagaacggcgagaacgaaaagaccgtctcctag

SEQ ID NO: 132399 - DNA, 753 bp, Artificial Sequence
  Description of Artificial Sequence: Synthetic coding sequence
atggggaaggcaaaggtgcctgcttctaaaagggcaccttcatccccagtggccaagcctggacccgtcaagaccttgacaagaaaaaaaaacaaaaaaaaaaaaaggttttggaaaagcaaggccagagaggtctccaagaaacctgcatccgggccaggcgccgtggttcggcctcctaaagcgccggaagatttctcccagaattggaaagccttgcaggaggtgcctcgctggaccggggggaggcagtaccttgctccacggcctgtggagcagagtacaattcgcaaagagcctcgtaagggtcagatggtgatcctcttccagaatgaaggtaccagctcaattcgctcaggaaaactgcgccggcaaccccaaccccaccctccacgggaagagctagaagtggtgcaaaaagaggtagctgaaatgttgaaggggcgcatccttgtcgggcacgctcttcacaacgaccttaaagtgctcttcctcgaccaccctaagaagaaaattagggatacccagaaatacaaaccttttaagtctcaagtgaaaagcggcaggccctcattgcggctgttatcggagaagattctaggtctgcaggttcagcaggccgagcactgctctatacaggatgctcaggctgcgatgcggctgtacgttatggtgaaaaaagagtgggagagcatggcacgggatcgcagaccacttctgacagccccagatcactgcagcgatgacgcgtag

SEQ ID NO: 132400 - DNA, 1269 bp, Artificial Sequence
  Description of Artificial Sequence: Synthetic coding sequence
atgggaaaggccaaggtgcctgctagcaagcgagcaccctcgagcccagtggctaagccgggccccgtgaaaaccctgacacggaaaaagaacaagaaaaagaagcggttctggaaatctaaggcaagagaggtaagcaagaagccagcctcaggcccaggagctgtggtgcgccctccaaaggctccagaagattttagtcagaattggaaggccctgcaggaatggctattgaagcaaaagagccaggctcccgagaaaccactggtgatctctcaaatgggctccaaaaaaaaaccaaaaattattcagcaaaataagaaagagacctcgcctcaggtcaaaggagaggagatgcccgcaggtaaggatcaggaggcctcaaggggaagcgttcctagcggcagtaagatggataggcgggcccctgtcccccgtacaaaggctagtggaaccgagcataataagaagggaaccaaggagcggacgaacggggatatcgtccctgaaagaggggacattgaacacaagaaacgaaaggccaaggaggctgcacctgcaccgccaaccgaggaggacatttggtttgacgatgtggatcccgccgatattgaagctgccattggcccagaggcagcaaagatcgcccggaagcagctggggcagtcagaaggctccgtctctctctcgttggtgaaagagcaggctttcggtggactgacgcgagccctcgccctggactgcgagatggttggggtcggtccaaagggcgaggaatcgatggcggcgcgagtcagcatcgtgaaccagtacggcaaatgtgtctatgacaaatacgtcaaaccaactgagccagtgacagactaccgtacagctgtttcgggtatacgtccagaaaacttgaaacagggagaggagctggaggtggtgcagaaggaggtggcggaaatgttaaaagggaggatactggtcgggcatgcacttcataatgacttgaaggtcctcttcttggaccaccctaaaaagaagatccgggacacccagaagtataaaccttttaagtcccaggtgaagagtgggcgcccctccttacgcctgctaagtgagaaaattctgggcctgcaggtgcagcaagccgagcactgctcaatccaggacgcccaagctgctatgagactgtatgtgatggtaaagaaggagtgggaatcaatggctcgcgatcggcggcctttgctgactgcaccagaccactgctccgatgatgcatag

SEQ ID NO: 132401 - DNA, 570 bp, Artificial Sequence
  Description of Artificial Sequence: Synthetic coding sequence
atgggctccaagaagaagcctaagataattcagcagaataaaaaggaaacctctccgcaggtgaaaggcgaggagatgcccgccgggaaggaccaagaagccagccggggctccgtgccctcaggtagcaagatggatcggagggcccccgtccctagaacaaaggccagtgggacagagcacaacaaaaagggcactaaagaaagaactaatggcgatatcgtgccagaaagaggcgatattgagcacaagaagcggaaagcaaaggaggccgcacctgcaccacccacagaggaggacatatggtttgacgacgtcgaccccgccgacatcgaagccgcaattggccctgaagctgctaagatcgccaggaaacagctgggtcagagtgagggttccgtcagtctgagtttggtgaaagaacaggcattcggcggtttgacccgtgcactcgcactggactgcgagatggtcggggtgggaccaaagggcgaagaatcaatggccgctcgcgtgtcaatcgttaatcagtacggcaagtgcgtatacgacaagtacgtcaagccttag

SEQ ID NO: 132402 - DNA, 1125 bp, Artificial Sequence
  Description of Artificial Sequence: Synthetic coding sequence
cccgtggccaagcctgggcccgtaaaaacattaacacggaagaagaacaaaaagaagaaacgattctggaaatccaaagcaagagaagttagcaaaaagcccgcctcagggcctggggcggtcgtcagaccaccgaaggcccctgaggatttctcccagaattggaaggcgctgcaggagtggctgctgaagcagaaatcccaggcccctgagaaacccctggtgatatcccagatggggtcaaaaaaaaagccgaaaatcatccagcagaataagaaagagactagcccccaagtgaaaggggaggaaatgcccgccggtaaagaccaggaggctagccgaggctctgttccatctggttccaagatggatcggagggcaccggtgcctcgtaccaaggcaagtggcacagagcataacaagaagggaactaaggaaagaaccaatggcgatattgtgcctgaacggggggacatagaacacaagaagagaaaggccaaggaggccgcgcctgcaccccctaccgaagaggatatttggtttgatgatgtcgatcctgcggatattgaagctgctatcggtcccgaagcagctaaaattgcaagaaagcagttgggacagtctgaaggaagtgtgagtctatccctcgtaaaagaacaagcatttggtggtctgacccgcgccttggcactagactgcgagatggtaggagtaggaccgaagggagaggagagtatggctgctcgggtcagcattgtaaaccagtacggtaaatgtgtgtacgacaagtatgttaagccaacagaacccgtgacagattacagaacagccgtctctggcattcggccagagaacctcaaacagggcgaggaactggaagtcgtccaaaaagaggtagcagagatgttgaagggaaggatcctcgtgggccacgccctgcacaatgacctgaagtccggaaggccgtcgctgaggctcttgtcagagaagattcttggacttcaggtacagcaggattcaggctgccctggttccaatgaagctgtgcggcacggcgaggaaggggttggagagcacggcccccgtcaagctccgccagctgattgctcaaggcccctccagtag

SEQ ID NO: 132403 - DNA, 702 bp, Artificial Sequence
  Description of Artificial Sequence: Synthetic coding sequence
atggggaaggcaaaggttcctgccagtaaacgggccccctcaagtcccgttgctaagcccggaccagtaaaaaccctgacaaggaagaagaataaaaaaaagaaaaggttttggaagtctaaggcgcgagaagtgtccaagaagccggctagcgggcccggtgccgttgtgagacccccaaaggcccccgaggatttctcccaaaactggaaagctctccaggaggtcccccgatggacaggcggccgacagtacctggccccacgacctgtggaacaatccacaatcaggaaagaaccccggaagggccaaatggtaatcctgtttcagaacgaaggcacttcatctatccgctcgggaaaactcaggagacaaccccagcctcatccaccccgagaggagcttgaggtcgtccagaaggaggtggcagagatgctcaaaggaaggattctggttggacacgccctgcataacgatttgaaggtgttatttctcgaccacccaaaaaagaagatcagagatacacaaaagtataagccctttaaatcccaagtgaagagcgggcggccttctttgcgcctgttaagtgaaaagattctcggtctgcaggtgcaacaagccgagcactgcagcattcaggatgcacaggcggctatgcggctgtacgtcatggtgaaaaaggaatgggagtctatggcctag

SEQ ID NO: 132404 - DNA, 996 bp, Artificial Sequence
  Description of Artificial Sequence: Synthetic coding sequence
atgtcccgcgctagaggggccctttgtagagcgtgtcttgcccttgccgcagcattagcagcactccttctgcttccccttcccctcccccgcgcacctgctcccgcacgcactcccgctccagctcctcgcgcacccccaagcaggccagctgccccctcactgcgcccggatgatgtttttatcgccgtcaaaaccacacgcaagaaccatggtccacggctgcgtttgctgttacgcacttggatctcccgggcacgacagcaaacctttattttcaccgatggagatgacccagagctagagctccaagggggcgatcgcgtgatcaatacgaattgctccgccgttagaacacgccaggctctatgttgtaagatgtctgtggagtatgacaaatttatagaaagtggaagaaaatggttctgccatgttgatgacgataattacgtcaatgcacgctccttgctccacttactctcttcattcagtccgtctcaggacgtttacctgggacgacccagcttggatcatcccattgaagccacggagagagtacaaggaggacgaaccgtgactacagtaaaattttggtttgccaccggcggtgcagggttctgcctttccagaggacttgccctaaagatgtctccttgggctagtctgggttccttcatgagcacagccgagcaggtgcgactccccgacgactgtaccgttggttatattgtggaaggccttttgggggcccgccttctccacagtcctttattccacagtcatctcgaaaatctacagaggctgcctccagatacactgttgcagcaggttacactctcccatggcggtcccgagaacccgcataatgtcgtcaatgttgctggaggattcagtcttcaccaggatccaactagatttaaatccatacactgtctgctgtatccagataccgattggtgcccacgccagaagcaaggagcccccacctctcgctag

SEQ ID NO: 132405 - DNA, 873 bp, Artificial Sequence
  Description of Artificial Sequence: Synthetic coding sequence
atgtcccgggcccctccatcacgtccagccgccccctctcttaggcccgatgacgtctttatcgccgtgaagactacccggaaaaatcatggtcctcggcttagactgttgctgcgtacgtggatctcccgggcccggcaacagacattcatttttaccgacggcgacgacccggagctggagctccaaggaggtgatagggtaattaataccaattgttcagccgtgcggacgagacaggctttatgttgtaagatgagcgtggagtacgataagtttatagaaagcggacggaaatggttctgtcatgtggacgacgacaactatgtgaacgctcgtagtctcctccatcttctctctagcttctcaccctcccaggatgtctacttaggaagaccgtccttggatcacccaatagaggctaccgagagggtgcaggggggtaggactgtgaccaccgtgaaattttggttcgcaaccgggggcgccgggttttgtctttctcgaggccttgcccttaagatgtcgccgtgggcgagtctgggctctttcatgtctaccgcggagcaggtgcgactccccgacgactgcactgtgggttacatagttgagggtttactgggagcccggctgctgcattccccactcttccactctcacctcgagaacctgcaaaggcttccaccagataccttacttcagcaagtgaccctgtctcatggcggccctgaaaacccccataatgttgtgaatgtcgctggcggcttctctctgcatcaggaccccacccggttcaagagcatccattgtctgctctatccagacaccgactggtgcccccgacaaaaacagggggctcctaccagcaggtag

SEQ ID NO: 132406 - DNA, 1626 bp, Artificial Sequence
  Description of Artificial Sequence: Synthetic coding sequence
atggggagccaggaggtgttggggcacgctgccagactcgccagcagcggactcctgttgcaagtgttgttccggctgattacatttgtgctgaatgcctttatcctgcgttttttgtccaaagaaatcgtgggggtggtgaatgtccggctcactctcctgtactcgaccacactgtttttggcaagggaggcattccgccgtgcttgcttgagtgggggaacacagagagactggtcacagactttgaacctgctgtggctgactgtgccacttggcgtgttttggtcactgttccttggctggatctggttacaattgctggaagtcccagatccaaatgtggtcccacactatgcgacgggggtagtactgtttggcttgagtgccgtagtcgagctgttgggcgaacccttttgggtgctcgcacaggcccacatgttcgtgaaactgaaagtcatagcggagtcactaagcgtcatcctgaagagtgtgcttacagcctttctggtgttatggcttccgcattggggtctgtacatcttttcgctggcacagctgttctacacaactgtgctggtactttgctatgtcatttacttcactaagctgcttggatctccagaatccacgaagctgcagacgttaccggtgagccgcatcacagacctgctccctaacattacacgtaacggtgcgtttatcaactggaaagaggctaaactgacatggagtttttttaaacagtcctttttaaagcagattctcaccgagggtgaacggtatgtgatgacatttctgaatgtgctgaacttcggagaccagggtgtttacgacattgtcaataatttaggctccctggtggcccgcctgatctttcaaccgatcgaagaatccttctacattttcttcgctaaagttctggagaggggaaaagacgctactttgcagaagcaggaggatgtcgccgtggcagccgctgtcttggagtcactccttaaacttgccctcctcgccgggctcaccattacagtatttggttttgcttactcacaactcgctctcgacatttacggtgggacaatgcttagttccggctccgggcccgtgctgctgagatcatattgcctttacgtcctcctccttgctatcaacggcgtgaccgaatgctttacatttgcagcaatgtcaaaagaggaggtggaccgttataattttgtgatgctggcattgagctccagcttcctggtgcttagctatttgctgacaaggtggtgtgggtccgtggggttcatactggctaattgtttcaacatggggattaggatcacccagtctctgtgttttatccatcgttactaccgtaggtctccccacaggcccctagccggacttcatctgtcccccgtgctgcttgggaccttcgcactgagtggcggcgtgacagctgtaagcgaagtctttctttgctgtgagcaaggctggcctgcgaggcttgctcacatcgccgtgggagctttttgcctgggagccactctggggaccgcattcctcacggagacaaagctcattcacttcttgcgcacccagctgggcgtgccacgacggactgataagatgacttag

SEQ ID NO: 132407 - DNA, 1509 bp, Artificial Sequence
  Description of Artificial Sequence: Synthetic coding sequence
atggggtcccaggaagtgctgggccacgccgccagactcgccagtagtggattacttctgcaggtgcttttcagattgatcacttttgtcctgaacgcatttatcctccgtttcttgtcaaaggaaatcgtcggcgtggtaaacgttcgggtgccgttgggcgtcttctggtccctgttcttgggatggatatggctacaactgttggaggtgccagatcccaacgtagttccgcactatgcaacaggcgttgtattattcggtttgtctgccgtcgtcgaactcctgggagaacccttctgggtgctcgcgcaggctcatatgttcgtcaagctaaaggtcatcgcagaatcacttagcgtgatactcaagagtgtgttgacagccttcttagtgctgtggctgcctcattggggcctttacattttctccttagcacagctgttctacacaaccgttctggtgctgtgctacgtcatttattttaccaaactgctcggaagtccggaatctactaagctacagactctgcctgttagccggattacagacctcctgcctaatattacccgtaacggcgcgtttataaactggaaggaggcaaagttaacttggtcattctttaagcagagcttcctgaagcagatcctcactgaaggcgagcggtatgtgatgacatttctgaatgtgttaaacttcggcgatcaaggcgtctatgacattgtaaataacctgggaagcctggtcgcacgcctcattttccaacccattgaagagtctttttatattttctttgccaaagtccttgagagagggaaggatgctacattgcaaaagcaggaagacgtggcggtcgccgccgctgttcttgagagcttgctgaaattggcacttttagcaggtctcactatcaccgtgtttgggttcgcctacagccagctggcgctggatatttatggcggaacaatgctgtcctctggtagtggccccgtacttctgaggtcctattgtctctatgtcctgctcctggccataaatggtgtgactgagtgtttcacattcgcagccatgtcaaaagaggaggtcgatcggtacaatttcgtaatgttagctctatccagctcattcctggtcctgtcatacctgctcacaagatggtgcgggtcagtaggatttattctggcaaactgctttaatatgggcatccggataacgcagagcctgtgctttattcatagatattataggaggtcccctcatcgtccactcgctggcctccacctttcccctgtgctgcttgggacctttgctttatctggaggagtgacagcggtttctgaggtttttctgtgctgcgaacaagggtggccagccagactagcgcacattgctgtcggcgcattctgtttgggtgccactctgggcactgctttcctcaccgaaactaagctaatccacttcctgagaacccagctgggcgtccccagacgcaccgataaaatgacctag

SEQ ID NO: 132408 - DNA, 4308 bp, Artificial Sequence
  Description of Artificial Sequence: Synthetic coding sequence
atggctcaaacccccgacgggattagttgcgagctgaggggggaaattaccagattcttgtggcctaaagaagtcgagctcctgctgaaaacctggctacctggagagggcgctgtgcagaatcacgtgctcgcactcctgaggtggagggcttacctcctccatacaacctgcctccccctccgcgttgactgcacattttcctacctggaagtccaggccatggctctgcaggagactcccccacaggtcacttttgaattggaaagtctgagagagttagtgctggagttcccgggcgtagcggccctggagcagctggctcagcacgtggctgcagctattaaaaaagtgttcccacgctctacacttggtaagctgttccgcaggcctacaccagccagcatgcttgctagactggaaagatcatccccgtccgagtccaccgatccatgttcaccatgcggcggatttctggagacgtatgaagcactgtgtgactacaacggctttccatttcgagaggagatacaatgggatgtagataccatttaccatagacaaggctgtcgccattttagtttaggtgacttttcacatctcgggagcagagatcttgccctcagcgttgccgcgctgtcttataacttatggtttcggtgtctcagctgcgtggacatgaaactgagcttggaggtgtccgagcaaatactgcacatgatgtcccagagtagtcatctggaggaactcgtcctagaaacttgttctctgcggggtgatttcgttcgtcgactggcccaggctttggctggtcattcgagttcaggcctccgagaactgtccctagccggaaatttgctggacgatcgcggtatgacggccttgtctcgacacctcgagcgttgtcccggtgctttgcggaggcttagtctggcccagacgggtctcactcctagagggatgagagccctgggtagggctctggctacaaacgccgccttcgacagtaccttgacgcacttagacctgtccggcaatccaggagccttgggggcctcagaggatagcggaggactgtacagctttctgtctagacctaatgtcctgtcattcctcaatctagccggaacggacacagccttggacactgtacgcggatgtagtgttggcggatggatgaccggacgcgctgattggagagctggcaggggggggctggggcctcccgctggcgtcgcaaattcgcttccgccacaactctttgcggctgtctccagaggatgctgcaccagtctcactcacttagacgcgtctcgaaatgtgttctcccggaccaaatcacgagccgcaccagcagctctgcagctgttcttatcccgagctagaactcttagacatttgggcctggcagggtgtaaactccccccagatgcactgagagctttattggatggcctcgctctgaacactcatctacgggacttgcacctggatctgagcgcatgcgagcttcggtctgctggtgcccaggtgattcaggacctcgtttgcgacgccggcgctgtgagcagtcttgatttagctgacaacggctttggcagcgatatggtgactcttgttctggctatcggcagatcacggagtctgaggcacgttgcgctgggccgaaattttaacgtccggtgcaaagaaacactggacgacgtgctgcatcgcattgtgcagctgatgcaggacgacgattgtcctctgcagtctctatccgtggccgaatccaggttaaaactgggtgcaagtgtgctgctgcgtgcactggctacaaaccccaacctgactgccctggacatcagcgggaacgccatgggagacgcaggggccaagctactggctaaggctctcagggttaatagtagactgcgctccgttgtgtgggatcgcaaccatacaagcgccctggggctgctggatgttgctcaggcattagaacagaaccattctctgaaagctatgccactgcctctcaatgacgttgcgcaagcccaacgctccagacctgaactgaccgcaagagccgtgcaccagattcaggcttgtctgctgcgtaacaaccgcgccgaccctgcctcatctgaccatacaacccgtcttcagccactggggctggtatccgatccgagcgagcaggaggtgaacgaactgtgtcagtccgtgcaggagcatgttgagctgctcggttgtggggccgggccccagggggaagccgctgtaaggcaggcggaagacgccatccagaacgctaatttcagcctatctatacttcctatcctgtatgaggctggctcctctcccagccatcattggcaactcggtcagaaattggaaggattgctgcggcaggtgggcgaagtttgccgacaggacatccaggactttacccaggccaccctggatactgcacggtcgctttgcccccagatgttgcaaggcagctcttggcgggagcaactggagggtgtactggcgggatccagaggactgcccgagctgcttcccgagcagctgcttcaggacgcgttcaccaggttgcgcgacatgaggctttcgatcactggcacactcgccgaatcgatcgtggcccaagctttggctggcttatcagcagcgagggaccagctcgtcgagtcattggcgcagcaagccaccgtaacaatgcctcccgccttgccagcccctgacggcggtgaaccttccctgcttgaacccggagaactcgaagggctcttctttcccgaagagaaggaggaggagaaggaaaaagatgattctcctccacagaagtggcccgaactcagccatggcctccatctggttccttttatccacagtgccgcagaggaggctgaaccggagccagagcttgcagcccccggcgaggatgcagaacctcaagccggcccaagcgcccgagggtctccaagtccagccgcacctggccctccagctggtcccctgcctagaatggatctcccactcgctggtcaacccttaaggcacccaaccagggcacgaccccgtcctcgaaggcagcaccaccatcgcccaccacctggcggtccccaggtgccacccgccctgccacaagaggggaatgggcttagcgcaagagtggacgagggtgtggaagaattcttctccaagcggctgatacagcaagacaggctgtgggcccccgaggaggaccctgcgacagaagggggcgctacacctgtgccccggaccctgcgaaaaaagttaggaacgctgtttgccttcaaaaagccacgctctactcgcgggcctagaacggacctagagacatctcccggagccgccccacggacccggaagactactttcggcgatctgcttcgaccccccacaaggccctccaggggggaggagctcgggggggccgagggagataccagttcaccagatcccgcaggacggtcaaggccgaggtataccagagacagcaaagcctattccatgatactcttgccggcggaagaggaagccacgctgggcgcaagacctgataaaaggaggcccttagaacggggggagactgagcttgctccatcgtttgagcagagggtgcaggtcatgcttcaacgtatcggcgttagccggggcagtggcggcgctgaaggcaaaaggaaacagtcaaaagacggtgagatcaaaaaggccggttcagacggcgacattatggatagcagcacggaagcgcctcctatctccatcaaatcccggacccactccgtcagcgccgaccctagttgccgacctggtccgggatcccaagggcctgagtcggcaacatggaagaccctaggccagcagctaaatgctgagttgcgcagcaggggatggggccaacaggacggcccaggcccaccatcccctggacagtccccttctccgtgcaggactagtccgtcccccgacagtctgggactcccggaggatccctgcctgggtccccgtaacgaggatggccagctgcgccccaggcctctctccgccggacgccgagctgtgtcggtgcacgaagaccagcttcaggcccccgccgagaggccattacgccttcagaggagccccgtgttgaaaagaagaccaaagctggaagcccccccttccccatccctcggctcaggactggggaccgagcccctgcctcctcagcctactgagccgagttcccccgagaggtcgcccccctcgcccgctactgaccagaggggggggggcccaaacccatag

SEQ ID NO: 132409 - DNA, 1335 bp, Artificial Sequence
  Description of Artificial Sequence: Synthetic coding sequence
atgcccccagcactccccgcccccgatggcggcgagccaagcctgctcgagcccggtgaactcgagggactattcttcccagaggagaaggaagaagaaaaagagaaagatgacagtcctcctcagaaatggcccgaactcagccacggtctgcacctggtcccgtttatccatagcgctgcggaagaggccgaaccagaacctgaacttgcggccccaggtgaggatgctgagccgcaagccggaccctctgcaaggggctcaccctctcccgcggctcctgggcctccggccggacccctgccacggatggacctgcccctggccgggcagcctctacggcaccctacccgggcacgccctagaccacgaagacagcatcatcacagaccaccacccggcggcccccaggttcctccagccctcccccaagaggggaatggcctgagtgcgcgggtggacgagggcgtagaggaattttttagcaaacggttgatccagcaggaccggctgtgggcacccgaggaggaccctgcaaccgaaggtggggcgactcccgtccccagaaccctccgcaaaaaattgggaaccctgtttgcatttaaaaaaccgagaagcacacggggtccacggactgacctcgagacaagcccaggtgccgcccccagaacccggaaaaccactttcggggacctgttgcgtcctccgactcgcccctcacgaggtgaagagttgggtggagccgaaggagataccagtagcccagaccccgccggacggtcacgtccgaggtacacccgagactcaaaggcctattccatgattttacttccagcggaagaagaggctaccttgggggctcgccccgacaaacggagaccactcgagcggggcgaaacagaactagcccctagcttcgagcaacgggtccaggttatgttgcaacgcattggcgtctcccgcggcagtggcggcgccgaaggaaagaggaagcaatccaaggatggggagattaagaaagctggatctgacggagacatcatggacagctcaaccgaagcccccccaatatccattaagagccgcacacatagcgtgagcgcagacccctcttgtcggcctgggccaggcagtcaaggcccagaaagcgcgacctggaagacactcggccaacagctaaacgccgagctgcggagtaggggatgggggcagcaggacgggcccgggcctccttcccccggccagtctcctagtccttgcagaaccccgccacagaccgcttgggccagtcagagaacgttagcttgggcccccgagatgaagaatgggccgtag

SEQ ID NO: 132410 - DNA, 4119 bp, Artificial Sequence
  Description of Artificial Sequence: Synthetic coding sequence
atggcccagacgccagatgggatatcatgtgagttgaggggggagatcacgagatttctctggcctaaagaagtggaactcttacttaaaacctggctgcctggagaaggggccgtgcaaaatcatgttctcgccctccttcggtggcgagcgtacttacttcacacaacctgtctcccactgcgagtggattgcacctttagttatttggaagtgcaggcaatggcattacaggaaacacccccccaggtgacattcgaactggaatccctaagggagctggtactggaatttcccggtgtcgccgccttagagcagctcgcccagcatgtggcagcagccataaagaaagtgttccctaggtccaccttgggaaagttatttagaaggccaactcctgcgagcatgctggctagattagagagatcttcacctagcgaatcaacggatccctgcagcccctgtggcggattcctcgaaacttatgaggccttgtgtgactacaatggttttccctttagggaggagattcaatgggacgtggataccatctatcaccgccagggatgtagacacttctctctaggagacttttcccatttgggatcgcgggacctcgcattgagcgtcgccgccctttcctataatctgtggtttcgctgtctgtcatgcgtggacatgaagctgagcctggaagtgtcggagcaaatccttcacatgatgtcgcaatcctcgcacctagaggagctggtgctggagacatgcagccttcgcggggactttgtgcgaaggctcgctcaggccctcgccggccattcctccagcggcttgagagagctgagtctggcaggcaatctgcttgatgatcgggggatgacagccctgtctcggcaccttgagaggtgcccaggagcgcttcggagactgtcattggcgcagaccgggctcacccctcgcggcatgagagcccttggtcgggccctggccaccaatgccgccttcgactctactctgacccacttagacttgtctggaaacccaggagcactgggcgcctctgaagattctggcgggctttactccttcttatcaagaccaaacgtgctcagcttcttgaatctcgctggaacagacaccgcactcgatactttgtttgctgcggtgtcacgcggctgctgtacaagcttgactcacttggacgccagtcgaaacgttttctcccgtaccaaaagtcgtgccgctcccgcagcactgcagttgttcttgtcacgggctagaacgctgaggcatctcggcttagccggatgcaagttgcctcctgacgcgttacgggctctgctcgacggtttagccttaaatactcacctccgggatctccacctcgacctgagtgcatgtgagctgaggtctgccggcgctcaagtgatccaggatctggtgtgcgacgcaggcgccgtaagttcactggatcttgctgataatggcttcggctctgatatggtgactctggtgttggccatcggcaggtcaaggtctctgaggcacgtcgcactcgggcgaaactttaatgtgcgatgcaaggaaacactggatgatgtgctacatcggatcgtccagttgatgcaggatgacgattgtcctctgcagtctctgtcagtggccgaatcaagacttaaacttggggccagcgttctgctgcgcgccctagccacaaatcctaacctgaccgccttggacatctctggaaatgccatgggagatgccggagctaagctactggccaaggctctccgggtgaactcccggctgcggtcagtggtttgggaccgcaaccatactagcgcactgggtctattagacgtggctcaggcactcgagcagaatcacagcctcaaggccatgcccttgccactgaatgacgttgcccaagcacagcgaagtcggccagagctgacggcccgcgcagtacaccagattcaggcatgcctcctgagaaacaatagggctgaccctgccagtagcgatcatacaaccaggctccagccattgggcctggtctccgatccttccgaacaggaggttaacgaactgtgccaatccgtccaggaacatgtggaattgctgggctgcggagccggccctcagggggaagcagctgtaagacaggccgaagacgccattcaaaacgccaacttttcgctgtccatcctccccatcctgtacgaagctggcagttctccttctcaccattggcagctgggtcaaaagctcgaggggctcctgcgccaagttggagaggtctgccggcaggatatccaggactttactcaagctacactggacacagcaaggtctttatgtcctcagatgttacaggggtcctcttggcgagagcagctggagggagtactggcaggcagccgtggtctcccggagcttctcccagagcagcttctccaggacgcattcacccggctcagggatatgaggctgtccataacgggaacgctggccgagagcattgttgcgcaggccctggctggcttatctgccgcgagagaccagttggtggaaagtctggctcagcaggccaccgtaaccatgcctccggcacttccggccccggatggaggcgagccgtcactccttgaaccaggagagctcgagggactgttctttcccgaggaaaaagaagaggagaaggagaaagacgattctccccctcaaaaatggccagagctttcacacggcctgcatctggtgccttttatacacagcgctgccgaagaggctgagcctgagcccgagctggccgcacccggggaagacgccgagccccaggccgggccttcggcccgaggaagcccctcccctgcagccccagggcctcccgcaggaccccttccaaggatggaccttcctctggccggccagccccttcgacatccgacacgggctcgtccccggcccagaaggcagcaccatcacagacccccaccaggcgggccccaggtgcctccggctctgccccaggagggcaacgggctctccgctagggtcgacgaaggggtagaagagttcttttccaaacggttaattcagcaggacagattgtgggcccctgaggaagacccagcaacagagggtggggcgacacctgtccctagaacattgcgcaaaaagctagggactctgtttgctttcaaaaagccccgatcaacgcgggggccaaggacagacctggaaacttcccctggtgctgcacccagaaccagaaaaaccacattcggtgatttgctgaggccccctactcgtccctcacgcggcgaggagctgggaggggccgaaggggacacaagttccccagaccccgctggaaggagccgccctcggtacactcgagacagtaaggcatacagcatgattcttctgcctgctgaggaggaggcgacactgggggcaagacctgacaagaggcggccattggaacggggggaaactgaattggcccctagctttgaacagcgcgtccaagttatgctccagaggatcggagtctcaagaggtagcggaggagcagaaggaaagcgtaaacagagcaaagacggagaaatcaagaaggcaggaagcgatggcgacatcatggacagttccaccgaagccccacccatttccattaagagcaggactcactctgtgtctgccgacccaagctgcagacctggtcctgggtcccagggccccgaaagtgccacgtggaagaccctgggccaacagctgaacgcggaattacgctctcgagggtgggggcagcaggacggacccgggccgccttctcccggacagtccccttcgccatgccgaacttcccccagccccgactccctcggactcccggaagacccttgtctgggcccccggaacgaggaacggcctttacgtttgcagagaagccccgtgctcaagcggaggccaaaactcgaggccccacccagtcccagcctgggctcaggcctcggtaccgagcccctccccccccagccaaccgagccgtctagtcccgagcgttcccctcccagtcccgccacagatcagcgagggggaggccccaatccctag

SEQ ID NO: 132411 - DNA, 1305 bp, Artificial Sequence
  Description of Artificial Sequence: Synthetic coding sequence
atggggatgggcagaggcgctggcagatcggctcttggattctggcctacgctcgcgtttctgttgtgtagttttcccgcagcgacatccccgtgcaagattctcaagtgtaatagcgagttttggagcgcgacctccggctcccatgcacctgctagtgatgacacaccagaattctgcgctgctctgagatcctatgcactctgtactcgaagaaccgcgcggacttgtaggggtgacctggcatatcactctgccgttcatggtatagaagacctgatgagccagcacaattgttccaaagacggacctacaagccagcccaggttgaggacactcccccctgcaggcgattctcaggaaaggagcgacagccccgagatctgccactatgagaagtcttttcacaagcatagcgcaactcccaactatacccattgcggtttattcggagatcctcacctgaggaccttcacagatcggtttcagacctgcaaggtccagggcgcttggccactgattgataataactatctgaatgttcaggtgacaaacactccggtgctacccggttcagcagccacggcaacctcaaagttgacaattatctttaagaacttccaagaatgcgtcgaccagaaagtttaccaggcagagatggacgagctaccagctgccttcgttgatggatcgaagaacggaggagataagcatggcgcaaatagtttgaaaatcactgagaaggtgtcaggacagcacgtggagatccaagccaaatacataggtacaaccatcgtcgtgagacaagtcggtaggtaccttactttcgcagtccgcatgccggaggaagtggtcaatgccgtcgaggattgggactcccaggggctgtacttgtgcctgagaggctgtccattgaatcagcaaatcgacttccaagccttccatactaatgccgaggggacaggcgcacgacggctggcggcagcgtccccagccccaactgccccagagactttcccatatgaaaccgcagtggcgaaatgcaaggaaaaactacccgttgaagacctatattaccaggcctgcgttttcgacctcctgacaactggagatgtgaattttactcttgccgcctattacgccctcgaagacgttaagatgctgcacagcaacaaggacaagttgcacctgtacgacaggactagagatctgcccggacgcgccgctgccggcctccctctcgccccacggccgctgctgggcgcactggtgcctctattagcgcttctgcccgtgttttgttag

SEQ ID NO: 132412 - DNA, 1353 bp, Artificial Sequence
  Description of Artificial Sequence: Synthetic coding sequence
atgcagcctccccgagagcgattggtcgtgaccggccgagcaggctggatgggtatggggagaggtgccggcaggagcgctctgggcttctggcccacgttggccttccttctgtgcagcttcccagccgcgacctccccttgcaagattctgaagtgcaacagtgaattctggagcgccacctccggctctcatgcacccgccagtgacgatacccctgagttttgtgctgcacttaggtcttatgcactctgcactagacggactgctagaacctgtcgcggagaccttgcctatcactccgccgtacacggcattgaggacctgatgtcgcagcataattgctccaaagacggccctacctctcagccaaggctcaggactcttccacccgcaggagactcacaggaaagatccgatagtccagagatatgccactacgaaaagtctttccacaagcacagcgcaactcccaattatacccactgtggcttgtttggcgacccacatctacgcactttcactgaccgcttccagacctgcaaggttcagggcgcctggcctctgattgataacaactatttgaacgtgcaagtcactaacactccagtgctgcctggctccgcggcaacagctacttccaagttgacgattatatttaagaattttcaggaatgcgttgatcagaaggtttaccaggctgagatggatgagctaccagctgcttttgttgatggctctaagaatggtggggataagcacggagccaatagcttaaaaatcactgaaaaagttagcggccaacacgtcgagatccaggctaaatatatcggcacaacgatagttgtgcgccaggtcgggcgctatctgacttttgctgtgagaatgcccgaagaagtagtgaacgccgtggaagactgggactcacagggtctgtacttgtgcctgagaggctgtcctctcaaccaacaaattgactttcaagcctttcacaccaacgcagagggcacaggcgctcgtcggctcgccgcggccagtccggccccgacggccccggaaacatttccctatgagacagctgttgcaaagtgcaaggagaagctacccgtggaagatctgtactaccaagcatgtgtgttcgatttgctgacaacaggagacgtcaactttacgcttgcggcttattacgcgttggaggacgttaagatgcttcactctaataaggacaagctccatctgtacgacagaacccgcgatctccctggtagagcagccgccggccttccgttggctccaagaccactgctgggcgccctggtccctctgctggcgttgttgcccgtgttttgctag

SEQ ID NO: 132413 - DNA, 1305 bp, Artificial Sequence
  Description of Artificial Sequence: Synthetic coding sequence
atgggcatggggaggggagctgggagaagtgccctcggattctggccaaccttagcattcctcctatgttccttcccagcagctacaagcccatgcaaaattcttaagtgcaattctgaattctggtctgctaccagcggctcccacgctcctgcttctgatgacacccccgaattctgcgccgccttacgctcctacgctctgtgcaccaggagaaccgccaggacatgcaggggagatctggcctaccactctgcagtgcacggaatcgaggacctcatgtcgcagcataattgctccaaagatggtcccaccagccaaccccggcttcgtacactcccccccgccggcgactcacaagagaggagcgattcccccgaaatttgccactatgaaaagtccttccataaacactccgcgacccctaattatacccactgtggattatttggggaccctcatctgcgcactttcacggaccgcttccagacttgcaaggtccagggggcctggcctctcattgataataactacctaaacgttcaggtgacgaacacacccgttttgcccggaagcgccgcaaccgcaacctccaaactgaccataattttcaagaacttccaggagtgcgttgatcagaaagtatatcaggccgaaatggacgaactccccgcagccttcgtggacgggagcaagaatggcggcgacaagcatggagctaatagcctgaagattactgagaaggttagcggccagcacgtcgagatccaggccaagtacatcggcactaccatcgtcgtgaggcaagtgggccgctacctcacctttgctgtccggatgccagaggaagtcgtgaatgcagtggaagattgggactctcaaggcttgtacttgtgcttgcgcggatgtccgctgaatcagcagatcgattttcaggctttccacacaaacgccgagggaaccggagccaggcggctggcagcggctagcccggcgcccacggcgccagagactttcccatacgagactgcagtggccaagtgtaaggagaagttgcccgttgaagatctgtactaccaggcctgcgtctttgatctgctcacaacaggggatgtgaatttcactcttgctgcttattatgccctggaggatgtgaagatgttgcactctaataaggataagctgcacctgtacgatcgcaccagggaccttccaggaagagctgcggctggtttgcctctagctcccaggccactcctgggcgccctggtgccgctgctggccctgcttcccgtgttctgctag

SEQ ID NO: 132414 - DNA, 1026 bp, Artificial Sequence
  Description of Artificial Sequence: Synthetic coding sequence
atgtcacaacacaactgttccaaggacggacctaccagccagcctcgcttgcggaccctccctccagcaggcgattctcaggagcggtctgactcccctgagatatgccactatgaaaagagcttccataagcacagcgcgacccccaattatacccactgcggcctgttcggggatccccacctcaggacattcactgaccggtttcagacatgtaaagtgcagggcgcatggcccctaatcgataacaactacctgaacgttcaggtcactaacactccagtactgccaggcagcgctgccaccgctacatctaagctgacaataatattcaaaaatttccaggaatgcgtcgatcagaaggtataccaagctgaaatggacgaactgccggcagcatttgtagatggctccaaaaacgggggcgacaagcatggcgcaaactctcttaaaattacagagaaggttagcggtcagcatgtcgagatccaggcgaagtatattggtactactatcgttgttcgtcaggtaggccggtatctgactttcgccgtcaggatgcccgaagaggtggtgaatgccgtggaggattgggactcgcaagggctgtacctctgccttcgtggatgccccctcaatcagcagatcgatttccaggccttccataccaacgcagaaggcaccggtgcccggaggcttgccgccgcaagcccagccccaaccgcgccagaaacattcccctacgaaacagccgtcgccaagtgtaaagaaaagcttcccgtagaggatctctattatcaagcttgcgtgtttgatcttctgactacgggcgatgtcaacttcacactggcggcctactatgcactggaagatgtaaagatgctccactccaacaaggataagttgcacttgtacgataggaccagggatctgcccggtcgggccgctgctgggctgcctttggcccctaggcctctgttaggagctttggtcccactgttggccttgctgccggtgttctgctag

SEQ ID NO: 132415 - DNA, 1305 bp, Artificial Sequence
  Description of Artificial Sequence: Synthetic coding sequence
atgggcatgggaagaggcgccgggcggtcagcccttggattttggccgaccctggcatttctgctgtgcagctttcccgcggctactagtccttgcaagatcttgaagtgcaactctgagttttggagtgcgacaagtggctctcacgcccccgcttcagatgacaccccagagttctgcgccgcactgcgctcctatgcgctatgtacgaggcggactgccagaacttgtaggggggacctggcgtatcatagcgcagtgcacggcatcgaagacctcatgagtcagcataattgtagcaaagatggtcctacgtcccagccgcgactgcgcacgctcccaccggccggggactctcaggaacgatctgattctcccgagatctgtcattatgagaaatcttttcacaaacatagtgccactcccaactatacccactgcggcctgttcggcgacccccatctcaggacgtttaccgaccggtttcagacctgcaaggtacagggtgcgtggcccctgatcgacaacaactacctcaacgtccaggtgactaatacacctgtattgcccgggtccgctgctacagcgactagcaaactgaccattatatttaagaacttccaggagtgtgtcgatcaaaaggtttaccaggccgagatggatgagctgcctgctgccttcgtggatggcagtaagaacggaggggacaagcacggcgcaaactccttgaagatcacggaaaaggttagcgggcagcacgtcgaaatacaggcaaagtatatcggaaccacgatcgtggtgagacaagtgggacggtacttaaccttcgccgtaaggatgcccgaggaagtcgtgaacgccgtagaggattgggactcacagggactgtacctctgcctgagaggctgccccctgaatcagcaaatcgattttcaggcgtttcacacgaatgccgaaggcacaggtgcaagacgattagccgctgcctctccagcacctaccgcccctgagacttttccatatgagactgcagtggcaaagtgtaaggaaaaacttcccgtggaggacctctattatcaagcctgcgtgtttgatctcctcacaacaggcgatgtgaacttcacgctggccgcctattatgccctggaagatgtaaaaatgcttcacagcaacaaggacaagttgcacctgtacgacaggactcgcgatttacccggcagggcagccgcaggcctcccattagcaccacgtcccctgcttggagccctggtacccttactggcactgttgccggtgttttgttag

SEQ ID NO: 132416 - DNA, 1377 bp, Artificial Sequence
  Description of Artificial Sequence: Synthetic coding sequence
atgggtggattggggcctcgccgggcaggcacgagtcgagagcgattagtagtcacagggcgtgcgggatggatgggcatgggcagaggagctggtaggagcgctctgggattttggcccactctggcttttctgctgtgttcttttcctgccgccacaagcccctgtaagatactgaagtgcaacagcgaattctggtcagccacttccggtagccatgcacctgctagcgacgatacccccgagttttgtgccgcattaagaagctacgcgttgtgtaccagacgaactgcccggacatgccgcggagacctggcctaccactcggcagtgcatggcatcgaggatctcatgtcccagcataattgcagcaaggatggtcccacctctcagccacgtctgcgcacacttccacccgccggggacagtcaggagaggagtgacagcccagagatttgccattacgagaaatccttccacaagcactccgccactcctaactacacacactgtggactctttggagacccccatctacgcactttcacagaccgcttccaaacctgcaaggtgcaaggcgcctggccgctgatcgataacaactatctgaatgtccaggtcaccaataccccagtgcttcccggcagcgcagccaccgctacctccaagctcactatcattttcaagaatttccaagaatgcgtggaccaaaaggtctaccaagccgaaatggatgagttaccagctgcttttgtggatggctcaaaaaatggcggcgataaacacggagccaacagtctaaagattactgaaaaagtcagcggccaacacgtggagatacaggccaagtatatcggcactaccattgtggtgaggcaggtgggtcgatacctgaccttcgcagtgagaatgccagaggaagtggtaaacgccgttgaggactgggacagccaaggcctgtacctctgccttcgcggatgccctctgaatcagcagatagattttcaggcgttccatacaaatgcggaagggactggcgcccgacggctggcggctgcctcaccggcacctacagcccccgaaacgtttccttacgaaacagctgtggcgaagtgcaaggaaaaactgcccgtggaggacctgtattaccaggcatgtgtgtttgatctcctgactactggtgatgttaacttcacgcttgcggcatattatgctctggaggacgtgaaaatgttgcacagtaataaggacaagctgcacttgtatgataggacacgggacctgccaggacgggccgccgcaggcctcccacttgcccctagacccctgcttggagcactggtgcccctccttgcactgctgcccgtgttttgttag

SEQ ID NO: 132417 - DNA, 1437 bp, Artificial Sequence
  Description of Artificial Sequence: Synthetic coding sequence
atgataagaaaaaagcgtaagagatcagcccctccaggtccctgccgaagccacggtccaaggcctgctaccgcacctgcccctccaccctcacccgaacccacccgcccagcttggacgggcatgggcctccgagctgccccttcctctgcggcagctgcggccgccgaggtggagcagaggcgtagccctggactatgccctcccccgttggagctgttactgctcctgctattctcccttgggctcctgcatgctggtgattgccagcagccagcgcagtgccgaatccagaagtgcacaacggattttgttagtttgacatctcatttaaatagtgccgtggacggattcgactccgaattctgtaaagccctgcgcgcctacgcaggttgcacgcaacgcacaagtaaagcatgccgtgggaacctggtctaccacagcgctgtgctagggataagcgacctaatgtcacagagaaactgctccaaggatggccctacgagctccactaacccagaggtaactcatgatccatgcaattatcactctcacgctggtgccagagaacaccggcgcggcgatcagaaccctccaagttaccttttttgtgggctgttcggcgatccccacctccgcacatttaaagataatttccagacttgcaaggtggagggtgcttggcccttgattgacaacaactatttgagcgttcaagtcaccaatgtacccgtggttccaggcagttccgcaacggccactaacaagatcactataatcttcaaggcacaccatgaatgcactgatcagaaagtctaccaggcagttactgatgacctgcccgccgcttttgtcgatggaacaactagcggaggcgacagtgatgcaaagagcctgcggatagtggagcgcgagtcagggcactacgtagaaatgcacgccagatacattggcactacagtgttcgttcgacaggtcggtcgctatctgacactcgcaattaggatgccggaggacttggcaatgtcatacgaggagagccaggacttgcagctctgcgtcaatggttgccctctgtctgagaggatcgacgatgggcaggggcaggtttctgccatactaggtcactcactgccaaggacttccttggtgcaggcgtggcccggttacacactcgagacagcgaacacacagtgtcatgagaagatgcctgtgaaggatatctatttccagtcatgcgtgtttgatttgctgaccacaggtgatgctaactttacggccgccgcacacagtgccttggaggacgtagaggccctccatccacgaaaggagcgctggcacatttttccaagttccggaaacggcacacccagaggcggcagtgacctgtcagtctccttgggacttacctgcctgattctgatcgtatttctgtag

SEQ ID NO: 132418 - DNA, 1314 bp, Artificial Sequence
  Description of Artificial Sequence: Synthetic coding sequence
atgggtcttcgagccgctccttccagcgctgctgccgcagccgccgaggttgagcagcgaaggtccccaggcttatgtccacccccccttgagctgctgcttttgctcttgttcagcctgggccttttacacgcaggcgactgccagcaacctgcccagtgtaggattcaaaagtgcacaacagactttgtgtctctgacatctcatttgaatagtgcagtagacggctttgactctgaattttgcaaggcactgagagcctatgcaggttgtacccagcggacaagcaaggcctgcagaggaaacctggtttatcacagcgcagtcctgggcatttcagaccttatgagtcagaggaactgctcaaaagacggtcctaccagctctaccaaccccgaagtcacacatgatccatgtaattaccactcacacgcaggagcaagggagcaccggagaggggaccagaacccgccctcttacctgttctgcggcctgttcggagacccacacctcaggacgttcaaggataattttcagacttgcaaagtggaaggggcttggccgctgattgataacaattatctgtctgtgcaagttacaaatgtgcctgtcgtacccggatcgagtgccactgcaacaaacaagattacaataattttcaaggctcaccacgaatgcactgatcaaaaagtgtatcaggctgtgaccgacgatctgccggctgcttttgtcgatgggaccacctccgggggagacagtgacgccaagtccctccggatcgtcgaacgtgaaagcggacattacgtcgaaatgcacgccaggtacattggcactaccgtctttgtaagacaggtcggcaggtatttaacgctggccatccgaatgccagaagacctggctatgagttacgaggagtcacaggatttacaattatgcgtgaacggatgccctctttcggagaggattgatgacggccaaggacaggtaagcgccattctcggacattcgttgcctaggacatccctcgtccaggcttggcccgggtatactcttgagacagcgaatactcaatgccacgaaaaaatgccagtgaaggacatatactttcagtcttgcgtgtttgatctcttgaccacaggcgatgctaattttacggcagcagcccactccgcactggaggatgtcgaagcattgcaccctcgcaaggagaggtggcacatattcccttcgtctgggaacggcacaccacggggcggctccgaccttagtgtgtccttagggttaacctgtctgattctgatcgttttcttgtag

SEQ ID NO: 132419 - DNA, 1176 bp, Artificial Sequence
  Description of Artificial Sequence: Synthetic coding sequence
atgatcgaggttgtagctgaactgagccgaggcccggtatttctcgcaggtgaagctcttgaatgcgtggttacggtcaccaaccctttaccaccaaccgccacttctgcctccagtgaggccctagcctgggcaagcgcccaaatacactgccagttccacgcctctgagagccgcgtagctctcccacctcccgacagttcacaacccgatgtgcagccagattctcagacagtcttcttaccacatcggggcgagcgagggcagtgtatcctgagcactccccctaagattctgttttgcgacctgcgcctagaccccggggagagcaaaagctactcatactctgaagttctgccaatagaagggccaccttcctttcgagggcagagcgtgaagtacgtgtataagcttaccatagggtgtcagagagtaaacagtcctattaccctcctgcgtgttccactgagagtcctggtgctgaccggcctgcaggacgtgagatttccccaggatgaagcagtggccccttcttctcccttccttgaagaggacgaaggaggcaaaaaagattcctggctggccgaattggccggtgaaagactaatggcagccacctcatgtagaagtttgcatctctataatattagcgacggccgcggcaaagttggtaccttcggaatttttaaatctgtgtaccgcctgggggaagacgtcgtaggcacgctaaatctcggagagggcaccgtggcttgtttgcaattttctgtgtccctacaaacagaagagcgcgtacagcccgagtaccaaaggagaaggggggccggtggcgttccaagcgtctcacacgtgacccatgctcgccatcaggagtcttgcctgcacactacgaggacgagcttttcccttccgatcccactgtcctccacccctggcttctgcacagcaattgtgtccctgaagtggaggttacatttcgaattcgtgacttcgagggaacctgggctagtccttttgccacccgtcgagcagcccgaacctaccacctggaccggtccagaacaggtgccagtggatactttctcatgggatctacccatcaaggtactgcctaccagccctaccttggcgagctacgccgcgccgggtccttcaacctctacaatcacaatttag

SEQ ID NO: 132420 - DNA, 1296 bp, Artificial Sequence
  Description of Artificial Sequence: Synthetic coding sequence
atgactcgtgctttgtcgggcttggcctgcagagcactgcctgctggccgagacagcgccgaagggcttggagtgccaattcccagtgtagactatgccagaagcgattccggggctgccatgatagaggttgtggcagagttatcgcgcggtcctgtattcctggccggcgaagccctggaatgtgtggtgactgtaaccaatccacttccaccgacagcaacctccgcctccagcgaggcacttgcgtgggcctccgcccagatccactgtcagtttcacgccagcgagtctagggtggccctgccgcctccagactccagccagccagacgtgcaacctgattcccaaaccgtgttcttgccgcacaggggggagaggggccaatgtattctctccacgccacccaaaatcctattttgtgacctgcggttggacccaggcgagtcgaagagctatagctactccgaagtcctgcccatagagggaccccctagtttccgcggccaaagcgtgaagtatgtttataaactgacgattgggtgccagcgcgtaaatagtcccataacactcttgagggtgcccttaagggtgctggtgctgaccgggctacaggacgtgcgattcccacaggatgaggccgtcgccccctcctctccttttctagaggaagacgagggaggtaagaaagacagctggctggctgaactcgcgggggagaggctgatggcggccaccagctgccgctctctgcacctctacaatatctccgatggcaggggcaaggtcggaacctttggtatttttaagtccgtataccgtctgggggaagacgttgttgggacgctgaatctgggcgaggggacggtagcctgtctgcagtttagtgtctccttacagactgaggagcgggtgcagcctgaatatcagagacgccgtggagcaggtggggtacccagcgtcagccacgttacacatgcccgacaccaggaatcctgtcttcacacaaccagaacaagcttctcactgcccatccctctgagtagtactcctggcttttgtaccgccattgtgtccctaaagtggagactacacttcgagtttgtgaccagccgtgagccgggcctagtcctgttgccccccgtggaacagccggaacccaccacgtggaccggacctgagcaggtgcctgttgacaccttcagttgggatctccctatcaaagtgttacccacttctcccacactcgccagttatgccgcccccggcccgagcacctcgaccatcactatttag

SEQ ID NO: 132421 - DNA, 1119 bp, Artificial Sequence
  Description of Artificial Sequence: Synthetic coding sequence
atgagcagtaaatatcccagaagcgtccggaggtgcctgccactctgcgctcttacattggaggcagcattgattctgcttttctattttttcacccactacgatgcatccctggaggatcagaaaggactcgtggcttcataccaggttgggcaggacctcaccgtgatggctgcattgggcttaggattccttacttccaacttcaggaggcattcttggtcttctgtggccttcaatttgtttatgttggctttgggcgtgcagtgggccatcctgttagatggcttcctatcccaattcccccctggaaaggtcgtgataaccctattctccatccgcctggccaccatgtccgccatgtctgtgttgatttcagcgggcgcagtactcggcaaggttaacctggcacagctggtggtgatggtgctcgtcgaagtgacagctctgggtaccctacgtatggtgatttcaaacatttttaataccgactatcacatgaatctgaggcatttttatgtgtttgcagcctacttcgggttaacagtggcttggtgtctgccaaagccacttccaaaaggaacggaggacaacgatcagagagctaccattccctcactttccgccatgctgggagctctcttcctttggatgttctggcccagcgtaaattccgcccttcttcggtcacctattcagcgtaaaaacgccatgttcaacacgtactatgcgcttgccgtttccgtggtgacagcgatatccgggagctcgttagcccatccccaaagaaagatttccatgacctacgtgcacagcgctgtgcttgcaggaggcgtagctgtggggactagttgtcacttgatcccaagcccctggttggctatggtgctcggcctggtggcaggactcatctcaataggcggcgctaagtgccttcctgtctgttgtaatagagttcttggcatacaccacatatcagtgatgcattctatattttcactattaggcctgctgggcgaaataacctatatagtcctgctggtgcttcatacagtttggaatggcaatgggatgtttgcccccaagtcccaaaacatggagagtacctcctgcggttag

SEQ ID NO: 132422 - DNA, 1254 bp, Artificial Sequence
  Description of Artificial Sequence: Synthetic coding sequence
atgtctagcaagtacccccgcagcgtgcgtagatgcctgccactgtgcgcactcacgttagaagccgcgctcatcctactcttttacttttttactcattatgacgcctctttggaggatcaaaagggcttggttgccagttaccaggtgggccaggatttaacggtgatggcagcactgggactgggcttccttacatccaacttcaggcgccactcctggtcaagcgtggcctttaatctcttcatgttggcactgggcgtgcagtgggcaatcttgctcgacgggtttttgtctcagtttccccccggaaaagtcgtaattactctctttagcattcgactggccacgatgtctgccatgtctgtactcattagcgctggcgcagtactgggcaaagttaatctggctcagcttgtggtgatggtcctcgtagaggttaccgccttaggaacgctacggatggtgatctccaacatttttaataccgactatcatatgaacctccgacacttctatgttttcgctgcttatttcggactaaccgtggcatggtgtctgcccaagccgctgccaaaggggaccgaagacaatgatcaaagagctacaattcccagcttgagtgccatgttgggtgctctgttcctgtggatgttttggccatccgtaaacagcgctctgctccgctcccctatccagcgcaagaacgcaatgttcaatacctactatgcccttgccgtttccgtcgtgacagctatctctggatcttccctggcgcatccccagcgaaagatctccatgacctatgtgcacagcgcagtactcgcaggaggcgtggctgtgggcacttcgtgccatctgattcctagcccatggctcgccatggtcttggggcttgtagcaggccttataagcattggcggggccaagtgcctgccagtctgctgtaatagagtgcttggcattcaccatatctccgtaatgcactccattttcagtcttctgggtctgctcggagaaatcacatatattgtgctcctggtcttgcacactgtttggaacggcaatggaatgattggcttccaggtgctgctcagtatcggagagctgtctctggccattgttattgccctgacctcagggctcttgaccggcctgctgcttaacctcaagatatggaaggccccgcacgtggccaagtacttcgacgaccaggtattttggaagttcccacatctggcggtaggtttttag

SEQ ID NO: 132423 - DNA, 804 bp, Artificial Sequence
  Description of Artificial Sequence: Synthetic coding sequence
atgagtagcaagtatccgcgtagcgtgcgccgatgccttccgttatgcgcactgaccctcgaagcagctctcattcttctgttctatttcttcacgcactatgatgcttctctcgaggaccaaaagggcttggttgccagctatcaggttggtcaggacctaacggtgatggcagctttgggcctggggtttctcacgagcaacttccggcgtcacagctggagtagcgtcgcattcaacctcttcatgttagctctcggtgtgcagtgggcaattctacttgacgggtttttgtcccagtttccgcctggtaaagtggtaataacgcttttttccataagactcgccaccatgtcagccatgtccgtgctaatctccgctggcgcagtgctggggaaggtgaatctggcgcagcttgttgtaatggttctagttgaggttactgccctgggcactcttcgtatggtcatctctaacattttcaacacatatgtgcactctgccgtgctcgccggcggggtcgctgtgggaacatcgtgccatctgataccttcaccatggctggcgatggttctggggcttgtcgctggattgatcagcattggaggagctaagtgtctccccgtgtgctgtaatcgcgttctgggcatccatcatatcagcgtcatgcatagcatcttctctcttttagggcttctgggagagattacatacattgtgctattagtgctgcacacggtgtggaatggcaacggaatgttcgccccaaaatcacagaatatggagtcaaccagctgtggttag

SEQ ID NO: 132424 - DNA, 801 bp, Artificial Sequence
  Description of Artificial Sequence: Synthetic coding sequence
atgtctagtaagtaccctcgcagcgtcaggcggtgcctgccgctctgtgccctcaccctagaggccgctcttatcttgctgttttactttttcactcactatgacgcatccttggaagatcagaaagggctggtggcctcatatcaggtcggacaggacctgaccgttatggctgccctagggcttggattcctgacaagcaacttccgccggcacagctggagctccgttgcgtttaacctttttatgcttgctctgggtgtgcagtgggccattctcttagatggattcctgtcacaatttcctcccggaaaggtggtgatcacactgtttagcattcggctggctacaatgagtgccatgagcgtgcttatcagcgccggggccgtcctcggtaaagtcaatctcgcgcagctggtggttatggtcctagttgaggttacggctctcggaacgctgcgcatggttatttcaaacatttttaacgtttgctgcaacagagtactcggtatccatcacatatccgtcatgcattccattttctcactcttagggctgctcggggaaatcacctatatcgttctgctagtgctccataccgtgtggaacggaaatggaatgattggcttccaggtcctgctttccattggcgagctgtcattagcaattgttatcgccctgacttccggattactgacgggattgctgctgaatttgaaaatttggaaggccccccacgtcgctaagtactttgatgatcaggtgttttggaaatttcctcacctggccgtggggttctag

SEQ ID NO: 132425 - DNA, 1206 bp, Artificial Sequence
  Description of Artificial Sequence: Synthetic coding sequence
atgtacttcattaaccagagactcttcctgcgtctatggcgagtgccggtgatgcgggcatcacactgttatcagtcacagggctggagaccagtcgcagtcggacaggacctgacagttatggctgctctcggccttggttttttgacatccaatttccgacgacatagctggagcagcgtcgcctttaatctgtttatgctagcactgggcgtacagtgggccatcttgttggatggatttctctcccagtttccccccgggaaggttgttataaccctctttagtattagactcgctacaatgtctgcgatgtccgttctcatctccgcaggggctgtgctgggcaaggtgaacttagcccaactcgtggtcatggtgcttgtagaagttactgccctgggcaccctccggatggtcatttccaacatatttaatactgactaccatatgaatcttaggcacttttatgtgtttgctgcttactttggactcacagtggcttggtgccttcctaaaccattacctaagggaaccgaagacaacgaccagagagctacaattcccagcctttccgccatgttaggggcgttattcctgtggatgttttggcctagcgtaaactccgctctgctgcgctcccctatccagcggaagaacgctatgttcaatacctactacgcgctagctgtgtcagttgtgacagccatttccggctccagcctggcccacccccagcggaagatcagcatgacctatgtccacagcgcagtcctcgccggcggtgtggccgtgggtacatcatgtcacctgattccttccccttggcttgccatggtgctggggctcgtcgctggactgatctcaattgggggagctaaatgcctgcctgtgtgctgcaaccgcgtcttagggatacatcacatatcagtgatgcattctattttctcactcctgggactactgggggagatcacatacatcgtccttctggtgctgcacactgtctggaacgggaatggaatgattggatttcaggtgcttctgtcaatcggcgaattgtcactggctattgtaattgccttgacatcaggattgctcaccggtctcttgctgaatctgaagatctggaaggctccccacgtagctaaatatttcgacgatcaagtgttctggaagttcccccacctggcagtgggcttctag

SEQ ID NO: 132426 - DNA, 1065 bp, Artificial Sequence
  Description of Artificial Sequence: Synthetic coding sequence
atgagttctaagtatccccggtcagtgaggaggtgcttgcctctgtgcgctctcaccttggaggccgccctgattctgctcttttatttcttcacccactatgacgcgtcgctggaagaccagaaaggcctcgtggcatcgtaccaagtggggcaggatctgaccgtcatggccgcgctgggcctgggctttttgacctcaaatttccggagacacagctggtcatccgttgcgtttaacctgtttatgctggctctcggcgtgcaatgggccatcctgctagatggcttcctgagccagtttcctccaggtaaagtggtgatcaccctcttttctattcgcctggctacgatgtcagccatgagcgtactcatttccgctggcgctgtcctcggaaaggtaaatctggctcaactggtggttatggttctggttgaagtaactgctctcgggactctccgaatggtcatttccaacatctttaataccgactatcacatgaatctgagacatttttacgtgtttgcagcatacttcgggttgaccgtggcctggtgtctccccaagcccctgcctaagggaaccgaggataacgaccagcgtgccactataccctccttgagcgcaatgcttggcgccctgtttctgtggatgttctggccatctgtgaacagtgcactcctgcgctctccaattcagcgcaagaatgcaatgttcaacacgtattacgccctggccgtcagtgtggtgaccgcgatcagtggcagcagccttgcccacccccaaaggaagattagcatgacctacgtgcactccgccgtcctcgccgggggcgtggccgtgggaacatcttgccatctaatcccctccccatggctggccatggtgctgggtctggttgccggcctcataagcataggtggagctaaatgtctccctgactggcttcccgggcctcctcaacattggggtacccagctggggcaccgcgacagctctcacgtgtggagcccagatcgattcgctccaaagtctcagaacatggaatccaccagttgcggttag

SEQ ID NO: 132427 - DNA, 1206 bp, Artificial Sequence
  Description of Artificial Sequence: Synthetic coding sequence
atgtacttcattaaccaacgcttgtttttgagactgtggcgagtgcctgttatgcgagccagtcactgttaccagtcacaaggctggcggcccgtggctgtcggacaggatctgactgtcatggctgctctgggcctgggattcctgacaagcaatttccgcaggcactcatggagttcggtggcctttaatctgttcatgctggccctgggggtacagtgggccatacttctcgatggattcctgtcacaatttccgcccgggaaggttgtgatcaccctgttttctatcagattagccacgatgtctgcgatgtccgttctgatcagcgctggcgccgtcctgggaaaggtcaacctcgcacaacttgttgtgatggtgctggtcgaagttactgctttggggactctgcgtatggtaatctctaatatctttaacactgactaccatatgaacctcagacacttctatgttttcgcagcttacttcggcctcactgtggcctggtgcttgcccaagccccttcctaaggggaccgaggataacgaccaaagggcaaccattcctagtctgagtgccatgcttggagcgctgtttttgtggatgttttggcccagcgtgaatagcgccttactcagaagtcccattcaacggaaaaatgcaatgttcaacacgtattatgctctcgctgttagcgtggtaacagctatctctgggtctagtctggcacatccacagcgcaaaatcagcatgacttacgttcatagcgctgtgctggccgggggtgtggctgtagggaccagttgccatctcatcccatcaccctggcttgctatggtgctggggctggtagctggactgatttctatcggcggcgctaagtgcttacctgtgtgttgtaacagggtgttgggaattcatcatatctcggtgatgcatagcattttctccttgctcggcctcctgggggagatcacttacatcgtattgttggttctccacaccgtgtggaatggcaacggtatgattgggttccaagtgcttctttctatcggcgagttatcgctggctatcgtcattgcactgacttctggcttgctcaccggactgttactgaacctgaagatctggaaggccccccacgttgccaagtactttgacgaccaggtgttttggaagttcccgcacctggctgtggggttctag

SEQ ID NO: 132428 - DNA, 1191 bp, Artificial Sequence
  Description of Artificial Sequence: Synthetic coding sequence
atgtcctccaaataccctaggagcgttaggcgctgcctgcctctttgcgctctgaccttggaagcggccctgatccttctgttttactttttcacccactacgatgctagcctagaggaccagaaggggctagttgcctcataccaggtcggtcaggatctcacagtgatggccgcgttggggctggggttccttacctccaacttccggaggcactcctggtcctctgtggcgttcaatctgttcatgctcgccttgggggtgcagtgggctattctgttggacggtttcctgagccagttccctcctggcaaagtggtgatcacactttttagtattcgcctggccacaatgagtgccatgtccgtgctaatctcagccggagccgtcttaggcaaggtaaacttagctcagctggtggtgatggtgctcgtggaagttaccgccttgggaacattaagaatggtcatttctaatattttcaacacagactatcacatgaatctgcggcatttctacgtcttcgcagcctacttcggacttacagtggcgtggtgtctgcctaaaccactgccaaagggcaccgaagacaatgaccagcgggccacaattccctccctgagcgctatgttgggtgctctgtttctgtggatgttctggccctctgtgaatagcgcactcctgcggagtcccatccagcgaaaaaacgctatgttcaacacttattacgcactggcggtgtctgtcgtcaccgctatcagcgggtcttctcttgcccatccccagcggaagatttctatgacatacgtacactctgctgtgttagctgggggggttgctgtaggcacatcatgtcacttaatcccaagtccatggctggctatggttctggggctcgttgcaggacttatttctattgggggcgcaaaatgcctgcctgtttgttgcaaccgggtgttgggtattcatcatattagcgtgatgcattccattttctctctcctggggctgttgggcgaaattacttacattgttctgttggtgctgcatactgtgtggaacggtaacggaatcttcctgatctggctgctggactttaaacagaaacacccacggaagactaggccagtgcagaagcaggacaacttcttgtccctactcccagctttcgtgagagagaaacggtcctag

SEQ ID NO: 132429 - DNA, 927 bp, Artificial Sequence
  Description of Artificial Sequence: Synthetic coding sequence
atgtcctccaaatatccccgctctgtgaggcgctgtcttccattatgcgctctcacattggaagcagccctcattctacttttctactttttcacccactacgatgcctcgctcgaagatcagaagggccttgtggcctcctaccaggtggggcaggacctgaccgtgatggccgccctaggcttaggattcctaacttctaattttagacggcattcctggtcctccgtcgctttcaaccttttcatgctggcgctcggggttcaatgggcaattcttctggacggcttcctgtcacaattcccacccgggaaggtcgtgattaccttgttctccatccggttggccacaatgagcgcaatgtctgtcctgatcagtgctggtgccgtactcggaaaggtcaaccttgctcagttggtcgtgatggtgcttgttgaagtgacagcgttaggtactctgcgcatggtgatatccaacatcttcaatacggattatcatatgaatctgcgccacttttatgtctttgcagcctacttcggcctgacggtggcttggtgcctgcccaagcctctcccaaagggcacagaggataatgatcagagagccacaatcccgtccctaagtgccatgctgggcgccctgttcctgtggatgttctggccttctgtgaattcagccctgctgcgctctcccatccaacgaaaaaatgcaatgttcaacacttattatgccttggcggtaagcgtcgttacagctatctccgggagtagcttagcgcacccgcagcgtaagatcagcatggactggctcccaggtccgccccaacattgggggacacagctggggcatagggattcatcacatgtatggtcacctgatcggtttgctcccaagtcccagaacatggaatccacttcatgcggttag

SEQ ID NO: 132430 - DNA, 1197 bp, Artificial Sequence
  Description of Artificial Sequence: Synthetic coding sequence
atgagctcaaagtacccacgtagcgtgagaaggtgcctgccattatgtgccttgactcttgaggcggcactgattctgctcttttacttcttcacacactacgatgcctcgctcgaggaccagaaagggcttgtagcatcatatcaggtggggcaggatctgactgttatggccgctcttggactgggattcctgacctcgaacttcagacgccattcttggtccagcgtggcattcaacctgttcatgcttgccctgggtgtgcagtgggccattctgctcgacggatttttgtcccagttccccccgggcaaggtggttatcacactgttttctattcggttagccacaatgagtgccatgagcgtcctaatctccgcgggagccgtgttaggaaaggtgaacttggcccagttggtcgtgatggtgttggtcgaggtaaccgcactgggcacactgcgaatggtaatatcaaacatattcaataccgactatcacatgaatctgcggcacttctacgtgtttgcagcttactttggcctcacagtggcttggtgcctcccaaagccattgcccaaaggcaccgaggacaatgatcagagagctacaattccctccttgtctgccatgttgggcgctctgttcctgtggatgttttggccatctgtcaactctgctttgttgcgctctcctatccagcggaagaacgccatgtttaatacgtattacgctcttgcggtttcagtggttaccgccatcagtggatcatcactggcccatccacagcggaaaatcagtatgacttacgtgcactccgctgtcctggcgggcggcgtcgcagtgggcacttcctgtcacctgatcccatcaccttggctggccatggtattaggtctcgttgccggtctgatcagtatcggtggggccaaatgtctgcctgtatgttgcaatcgagtccttggaatcccccacctgcggcatgctctgcatttgcagttggccgggtcggcatggcgcgaccatcttcactgcgcggctggtgcttcctattgtctggagcggcagtggcacgattggttgcccgggccccctcagcattggggaacacagttaggccatagagactccagtcacgtctggagtcccgatcggttcgcacccaaaagtcaaaacatggagagcaccagttgtggctag

SEQ ID NO: 132431 - DNA, 939 bp, Artificial Sequence
  Description of Artificial Sequence: Synthetic coding sequence
atgagtagcaaatatccaaggtcggtgcgcaggtgtttaccactgtgcgccctaacgttggaggctgctttgattctgttgttttacttctttacacattatgatgctagtctggaggaccagaaaggactcgtggcctcttatcaggtaggccaggacctgacagttatggccgccctgggtttagggtttctcacctcaaactttaggcgtcatagctggtcctctgttgcctttaaccttttcatgctggctctcggcgtgcagtgggctatactcttggatggatttctgtctcagttccccccgggcaaagtcgtgattaccttgtttagtatcagattagccacaatgtctgcaatgtccgtgctgatctccgccggcgccgtgctgggtaaagtcaatttagcgcagctggtggtgatggtgttagtggaggtcacagccttgggcaccttaagaatggtgatctctaatatttttaacacttatgtgcatagtgcagtgctggcaggtggggtggccgttggaacaagctgccacctgatccccagcccttggctcgctatggtgctagggctggtggccggcttgattagtatcgggggagccaaatgcctacccgtatgttgcaaccgggtcttgggaatccaccacataagcgtgatgcattctattttctcgttgttgggcctgctcggggaaatcacgtacattgttcttttggtactgcacaccgtttggaacggcaacggaatgataggatttcaggtcctgctgagcattggggaactgtccctggccatcgtcattgcccttacatccggcctgcttaccggcttactgctgaatttgaagatatggaaagcccctcacgtggctaagtatttcgatgatcaggtgttttggaaattccctcatcttgctgtgggtttttag

SEQ ID NO: 132432 - DNA, 1041 bp, Artificial Sequence
  Description of Artificial Sequence: Synthetic coding sequence
atgagcagcaagtacccacgcagcgtgcggcgttgtctccctttgtgtgccctgacccttgaggccgcactgattctgctgttttacttttttactcactatgacgcttccctggaggatcagaaaggactggtcgcaagctaccaagtcgggcaggaccttaccgtaatggcggcactgggactgggtttcctgacaagcaattttcgacgccacagttggagtagtgttgcgtttaacctgttcatgctggcacttggcgtgcagtgggccattctgctggacggctttctgtcacagttcccacctgggaaagtggtgattactctcttttccatccgcctagcaacgatgtctgccatgagcgtgctgatctcggcgggcgcagtgctgggaaaagtaaatctcgctcagttggtggttatggttttggtcgaggtgactgcactcggtacccttaggatggtaatttctaacatattcaaccccagcgtcaattccgccctattgagatcacccatccagcgcaaaaatgctatgttcaatacatactatgcccttgccgtttcagtcgtcaccgctatatccggatcatccctagcacatcctcagagaaagatctccatgacatatgttcatagcgctgtgctggctgggggagtcgccgttgggacatcatgtcacctgatcccttctccctggctcgccatggttctcggactcgttgtatgttgtaatcgggtgctcgggattcatcacatctccgtcatgcactccatcttctcattgctaggtcttctcggtgaaatcacatatattgtgctcttagttttgcataccgtatggaatggcaacggcatgatcggattccaggtcctgctgagcatcggcgagctgtcgctcgcaattgtgatagccctgactagcggacttcttactgggttgctgttaaacctgaagatctggaaagcgccgcatgttgccaaatacttcgacgaccaggtattttggaagtttccccacctagcggtcggattttag

SEQ ID NO: 132433 - DNA, 1254 bp, Artificial Sequence
  Description of Artificial Sequence: Synthetic coding sequence
atgtcttctaaatatccccgtagcgttcggcggtgcctgcccttatgggcactgactctcgaggctgctctaatattgttattttacttcttcactcattatgatgcttcattagaggaccagaagggactggtcgccagctatcaggtcggccaggacctcaccgtgatggctgccatcggactgggttttctcacttcttccttccggcggcactcttggtcatctgtggccttcaacctgtttatgttagcgttgggtgtccagtgggctatcttgctcgacgggtttctgagtcagttccccagcggaaaggtcgttatcacactgttcagcattcgccttgcaactatgagcgctctgagcgtcctgatctcagtggatgccgttttgggcaaggtgaacctcgcccagctggtggtcatggtgttagttgaagttactgcgctgggaaacttgaggatggtgatttcaaatatattcaataccgattatcacatgaacatgatgcacatatatgtgttcgctgcgtattttggactttcggttgcttggtgcttgccaaaaccactccctgaaggaaccgaagataaagatcagacagcgactatcccaagtctgtccgctatgctgggcgcattattcctttggatgttttggccctcattcaatagcgccctgttacggtccccaatcgaacggaagaacgcagtgttcaatacgtattatgcagtcgcagtcagtgtggtaactgccatcagtggctcttctctcgcacacccccaaggtaagatctctaagacttatgtgcactcggcggtactcgcaggtggagtggcagttggaacaagttgtcatcttattccatctccttggttggctatggtgctagggttggttgctggcctgatttctgtaggcggagccaagtatctgccaggatgttgcaaccgtgtactaggaattccacacagcagcattatgggatacaactttagccttttggggcttctgggcgaaattatctatatcgtgctgctggtgttggacactgttggggcaggtaacgggatgatcgggttccaggtgttgctcagtattggtgaactgtctctggcaatcgttattgctctcatgtccggactcctaaccggcctgctgcttaacctcaagatctggaaggccccccacgaggccaagtatttcgatgaccaggtgttctggaagtttccccacctggcagtcgggttctag

SEQ ID NO: 132434 - DNA, 1482 bp, Artificial Sequence
  Description of Artificial Sequence: Synthetic coding sequence
atgagctcaaagtatccccggtccgtaagaagatgtctgcctttgtgggccctgacactcgaagcagcactgattttactattctacttcttcacccactatgatgctagcttggaggatcaaaaaggtctggtagcaagttatcaggtcggtcaagatctcactgtcatggcagctatcggtttgggcttcttgacctcctcctttagacgccattcttggtcgtctgttgcattcaaccttttcatgctcgctcttggggtccagtgggccattctgctggatggcttcctttcccagtttccctcaggcaaggtggtgatcactttattctccatccgactggcgactatgagtgcactaagcgttcttatctcagtggacgctgtgctcggcaaggtcaatctggctcagttagttgtcatggtactcgtagaggttacggcacttgggaacctgcgaatggtgattagcaatatatttaatactgattatcacatgaatatgatgcacatctatgtctttgctgcctacttcggtttaagcgtagcctggtgcttgcccaagcctctcccagaaggtaccgaggataaggatcagactgctacaatcccctcactatccgcgatgctcggcgccctgttcttgtggatgttctggcccagcttcaattcagcccttctgcgcagcccaattgagaggaaaaacgccgtatttaacacgtattacgcagtagcggtatccgtggttaccgccatctccggatcctcactggcacacccccagggcaaaattagtaaaacatacgtccatagcgcagtgctggctggcggtgtggccgtgggaacctcatgccaccttatccctagcccctggcttgccatggtcttggggctggttgcaggtctgatctcggtgggtggagcaaagtacctccctggctgctgcaacagggtgctggggattcctcactcgtctatcatgggatataatttttctcttcttggcctcctgggggaaattatttatatagttctgcttgtgctggatactgtaggggccggtaacggcatgtcattaggctggaatctggccgtcaagatggccgaggccggagacgaggaactgatgcgcttggacgtgtcacagcggaaccatggcggcgctgcggtaccaaccgggtcctggatgcccagtaccgaaacaacaattgctcccaactatagagatcacattagcgtcgtttctagcttcggttgttggattttgtccaaaagcatccaggagaagcaaggcttgttcaagaacaagaccacatccagccattgctgtcttcacctgtacgtcaggaacgctcacgactcgaaggtaagtaatgtgcgggccgggacaggcgtgcgcgaaaatggggttgagtcatttctctgccattccctgagacgaatcagcccatttatcatgcattgcaggatccagcagtag

SEQ ID NO: 132435 - DNA, 1191 bp, Artificial Sequence
  Description of Artificial Sequence: Synthetic coding sequence
atgtctagcaaatatcccagatccgtccgacgctgcctgcccctgtgggctctgacactcgaggccgccctgatattgcttttctatttctttactcactatgatgccagcttggaggaccaaaaaggactcgtcgcctcctaccaagtagggcaggacttgactgtcatggccgcaatcggcctgggcttcctcactagcagctttagaagacattcatggagctcagtggcgtttaacctattcatgctggccctgggggttcaatgggcaattctgctcgatggcttcctgtcacaatttccaagcgggaaagtcgttattacactcttttccatccgcctagcaacaatgagcgctctgtccgtcctcatctcagtggacgcagtgctgggtaaggtgaacctggcccagcttgtggtcatggtcctggtggaggtcactgccttgggaaatctgaggatggttatctctaatatctttaataccgactatcatatgaacatgatgcatatctacgtctttgcagcctatttcgggctcagtgtggcctggtgtttgcctaagcctctgccagaaggtaccgaagacaaggaccagactgctacgatcccttccctttcagccatgctgggtgctctgtttctttggatgttttggccctccttcaattctgccctactcagatcgccgatcgagagaaaaaatgcggtgttcaatacctattatgcggtggctgtgagcgtggtcacagcgatttccgggtcctccctggcacatccccagggaaaaatcagcaaaacatacgtccacagcgcagtcctcgccggaggcgtcgcagtcgggacttcttgccacctgattccctccccgtggctggccatggtgctcggcctcgttgccggcctgatttctgtagggggcgctaaataccttcccggatgctgcaatagggtgttagggatcccccattcatccatcatgggatataacttctccctcctaggcctgctgggtgaaattatatacatcgttctgctggttctagacacagttggcgccggcaacgggatttttctcatctggctcctcgactttaaacaaaagcacccccgcaagacacggcctgtgcagaaacaggataacttcctgtccctactgccggcatttgtgcgggaaaaacgctcctag

SEQ ID NO: 132436 - DNA, 1137 bp, Artificial Sequence
  Description of Artificial Sequence: Synthetic coding sequence
atgtcgagtaagtacccccgtagcgtccgtcgctgtctgcccctgtgggcccttacgctggaggccgctctcatcttactgttctacttcttcacccactacgacgcgtcactcgaagaccaaaagggcctggtggcctcatatcaggtggggcaggatctgacagtcatggctgcgatcggcctgggatttctgacgagttccttccggcgccacagctggagttccgtggcattcaatctgtttatgctggcactcggggttcaatgggctattctgctggacggattcttgagccagtttccttcaggcaaagtggtgattacactcttctcaatacggctggccaccatgtcggccttgtctgttctgatctctgtcgacgccgttttgggtaaggtcaatctcgcccagctggtcgtaatggtgttagtagaggtcaccgcacttggtaatctgcgtatggtaatcagcaacattttcaatacggattatcacatgaacatgatgcatatctatgtgtttgctgcctattttgggttgagtgttgcctggtgtctacctaagccgctgcccgaggggacagaagataaagaccagactgcaacaatcccaagtctgtcagctatgctgggggccctgttcctgtggatgttttggccttcatttaattcagcccttcttcgctcacccatcgagcggaaaaatgccgtgttcaacacctactatgctgttgcagtgagcgtcgtgaccgccatttccggatccagcctcgcacatcctcagggcaagatctccaagacttatgtacattcagcggtgctcgcgggcggcgtggcagtggggacttcatgccaccttatccccagcccctggctcgccatggtattgggactggtagcgggattaattagcgtaggcggcgccaaatatttgcccgactggctgccaggacctcctcaacactggggaacccagcttggacaccgagattccagccatgtgtggagccccgatagcttcctgatctggcttttggactttaagcaaaaacatccacggaagactagacctgtgcaaaagcaggacaacttcctgtctctgctacccgcgtttgtccgtgagaaaagaagctag

SEQ ID NO: 132437 - DNA, 1464 bp, Artificial Sequence
  Description of Artificial Sequence: Synthetic coding sequence
atgagtagcaagtacccgaggtccgtgcgtcgttgtttacctctgtgggccctcacacttgaggcggccctaatccttctgttctacttctttacgcactacgacgcaagcctggaagaccagaagggtctggtggccagttaccaagtgggtcaggatcttacagtcatggccgcaattggcttgggttttcttactagctcttttaggcggcactcttggtcgtcagtggccttcaatctttttatgctcgccctgggggtgcagtgggccatcctgcttgatgggttcctgagccagttcccctctggcaaagtagtgatcactctgtttagtattcggctcgcgaccatgagcgccctctccgttttaataagcgtagacgccgtgctaggaaaagtgaaccttgcacagctggtagtgatggtcctggtcgaggtgactgcgctcggcaacctgaggatggtgattagcaatatctttaacactgattaccacatgaatatgatgcatatttacgtattcgccgcatactttggcttaagcgtagcttggtgcttgcccaagccactgccggagggcacggaggacaaggaccagactgcaacgatcccctctttgagcgcaatgctgggcgcgcttttcctgtggatgttctggccctccttcaatagcgctctgctgcggtcaccaatagagcgaaagaacgctgtgtttaacacttattatgccgtggccgtgtccgttgtcactgccatctctggcagctctctcgcacatcctcagggaaaaatttccaagacatatgtgcatagcgctgtgttagccggtggcgtcgccgtgggaaccagctgtcatctgatcccctccccatggctggctatggttctgggtctggtggcaggcctcatctctgttggtggagctaagtacctgccagggtgctgtaatagggtcctgggcattccacattcttctatcatggggtacaacttttctttactgggactgctgggggagatcatctacattgtattgttagtcttagacacagttggtgccggcaacggtatgatcggattccaggtcctcctgagcatcggcgagctcagtctcgcaattgtcatcgccctgatgtcggggctgctgaccgggctcttactaaatctgaaaatctggaaagcacctcatgaagctaaatattttgacgaccaagttttttggaagttcccccacctggccgtaggattctctaaatctatccaggagaagcaaggactgttcaaaaacaaaacaacctctagccactgttgcctccatctgtacgtgaggaacgctcacgattcaaaggtaagcaatgtacgtgccggaacaggcgtgagagagaacggcgttgaatccttcctgtgccatagcctgcgaaggattagcccctttattatgcattgtaggatacaacaatag

SEQ ID NO: 132438 - DNA, 1296 bp, Artificial Sequence
  Description of Artificial Sequence: Synthetic coding sequence
atgtcgtccaagtatccacgctcagtgaggcggtgtctgcccttatgggctctgacgctggaggcggccctaatccttcttttttacttcttcacccattacgatgcaagcttagaggaccagaaaggcctggtggcctcttaccaagttggacaggacctcactgttatggctgctatcgggctgggctttcttacttcttcatttcgaagacatagctggagcagtgtggccttcaatttatttatgctcgcactaggtgtgcagtgggcaattctgctggacggattcctcagccagttcccatctggcaaagtcgtcatcacccttttctcaatccggctggccaccatgagtgctttgagcgtcctgatctcagtggacgcagtgctgggaaaagtcaacctcgcccaactcgtcgttatggtactcgtggaggtgaccgccctggggaaccttcgcatggtgatttcaaatatctttaataccgactaccacatgaatatgatgcatatttatgtatttgctgcttactttggactttccgtcgcctggtgcctgcccaaaccactacccgaaggcactgaagacaaggatcagacagcaactatcccatccttgtccgcaatgctcggcgcgctctttttgtggatgttctggccgagttttaactctgcattgctgaggtcaccgatagagcgcaagaatgccgtgtttaatacttactacgccgtcgccgtgtctgtggtgacagcgatctctggttcatccctcgcacatccccaggggaagatcagcaaaacctatgtccacagcgctgttttggccgggggcgtcgcggtgggcacttcctgccacctgataccgagtccatggctggccatggtgttaggtcttgtagccgggttaataagcgtaggcggagccaagtatcttccagggtgttgcaatagagtgttgggcatcccacattcaagcatcatgggctataatttcagcctcctcggtctgctcggtgagattatctacattgttctgctggtactcgacaccgtaggggccgggaatggcatgtcattgggctggaatcttgcagtgaaaatggccgaggctggtgatgaagaactcatgcgcctggatgtgagccaaagaaaccacgggggcgcagcagtgcccaccgggagctggatgccatctaccgaaacaacaatcgcacctaactatagagatcatatctccgtggggttagcctcccggtcctcttcagcgctgggcaattcagcttggcctagctag

SEQ ID NO: 132439 - DNA, 966 bp, Artificial Sequence
  Description of Artificial Sequence: Synthetic coding sequence
atgagtagcaagtaccccagatcggtgcgacgctgtttaccactctgggccctgaccctggaagccgccctcatccttttgttttacttctttacccactacgatgcttcactggaggaccagaaaggcttggtagcctcgtaccaggtgggccaagacctcacagttatggctgctatcggcctgggttttctgacctccagtttccgaagacactcctggagctctgttgccttcaatttatttatgctggcgttaggagtgcaatgggcaatcctgctggacggttttctcagccagtttccctcaggcaaggtcgttattaccctgttttctattaggcttgctaccatgagcgccctaagtgtcctgatatccgtggacgcagtgctcggtaaggttaatctggctcagttagtggtgatggtgcttgtggaagtgacagccctaggcaacctgcggatggtcatctccaacattttcaacacagattatcatatgaatatgatgcacatttatgtcttcgccgcgtatttcgggctgagtgtcgcctggtgcttaccaaagcccctaccagagggtacggaggataaggaccagaccgcaaccataccctccctgtccgccatgttaggagctttgtttctctggatgttttggccatcatttaatagcgctctactccgaagccctattgagcgcaaaaacgctgtgttcaatacttactatgccgtggctgtcagcgttgtgacagcgatctctggctcttccttggcacacccacaggggaagatcagcaagacttacgtccacagtgccgtgttggccgggggagtggccgtaggcactagctgccacctcataccatcaccatggctggctatggtactggggttggtggctggcctcatcagcgtcggcggtgcgaaatacctcccttttccccatcttgcagtcggtttctag

SEQ ID NO: 132440 - DNA, 294 bp, Artificial Sequence
  Description of Artificial Sequence: Synthetic coding sequence
atggccgggtccccgagtcgcgctgcaggtcgccgtttgcagctcccccttctgtgtttatttctccaaggagccactgcagttcttttcgccgtgttcgttcgctataatcataagacagacgctgctttatggcatagatccaatcactctaacgctgacaatgagttctatttccgttacccaaatggagtttctctgctgctgccccggttagaatgtaacgggactatcagcgcacatcataacttgtgcctccccggctcttcggattcccctgcgtcggtatcctag

SEQ ID NO: 132441 - DNA, 462 bp, Artificial Sequence
  Description of Artificial Sequence: Synthetic coding sequence
atggctgggagcccatcgagggcggccggcagaagattgcagctgccactactctgccttttcctccagggggccacagccgtcctatttgccgtttttgtgagatataaccataagacagacgctgctctgtggcatcgctccaaccattccaacgctgacaatgagttctactttcgctaccctaaagaaagccattccgtagctcaggccggagtccagagacgaaacctggggtctctgcaaccctcccccccacgactccctgggagggcatgccacgggcttaggggtctctggttgccccacggcctgcccgccgcccttaggctacagcagaggggcctgcatttaccacccggaagactatgccctgccgtggtgcatactggacccgggctttctcctctgctgcccagatggccgcacccttgctggaggggtgaacacgatcagtgttag

SEQ ID NO: 132442 - DNA, 1119 bp, Artificial Sequence
  Description of Artificial Sequence: Synthetic coding sequence
atggtgtttgtgggctttgggttcctgatggttttcttgcaacggtacggcttctcgtccgtgggctttaccttcctgctggctgcattcgcattgcaatggagtactctggttcagggctttctccacagctttcacggtggccacatccatgttggcgtggaatctatgatcaacgccgatttttgtgcaggagctgttctgatttctttcggcgctgtgctggggaaaacaggaccaacacagctccttttgatggcccttctcgaagtggtcctattcggaattaacgagttcgtgttgctccacctgctgggagtccgcgatgccggaggctcaatgacaatccatacattcggagcttacttcgggttagtactgtctcgcgtcctgtatcgcccacagcttgagaagagtaaacaccgccaaggcagcgtgtatcacagcgatttatttgctatgatcgggactatttttttatggatattttggccgagtttcaacgccgctttgaccgctctgggcgctggccagcaccgcacagccttgaatacctactactctctggcagctagcactcttggcactttcgctctgtctgcccttgtgggcgaggacggccgtctcgacatggtccatatccagaacgccgcccttgccggtggcgtcgttgtgggcacatcaagcgagatgatgttgactcccttcggcgctcttgctgcagggttcctggcagggacagtcagcacgttgggatataaattcttcacgccaatcctagaaagtaagtttaaggttcaagatacctgtggggttcacaatctccatggtatgccaggcgttctcggcgcattgttgggcgttcttgtcgcgggactagcgacccacgaagcctacggagatgggctggaatccgtctttccccttatcgccgagggccagcgctccgctacatcccaggctatgcaccagctgttcggcctgtttgtgacacttatgtttgcttcagtaggtgggggcctgggagggttactgctcaaattgccgttcctggactcacctcctcggctgccggcgctccggggccccagttctcttgcgggcgcgtggcgcgcctag

SEQ ID NO: 132443 - DNA, 1374 bp, Artificial Sequence
  Description of Artificial Sequence: Synthetic coding sequence
atggccggttcaccttcccgggcggccggaagacggcttcagctccctctattgtgccttttccttcagggagccacagccgtgctattcgccgtgtttgttcgatacaatcacaaaactgatgctgcgctgtggcatagaagtaatcactctaacgccgacaacgagttttattttaggtacccttcttttcaagacgtgcatgctatggtcttcgttggctttggttttctgatggtcttcctgcagcgctacggcttcagctcagtgggtttcacatttctgctggccgccttcgcactgcagtggagcactctggtgcagggctttttgcattcctttcacgggggacacattcacgtgggggtggagagcatgattaatgctgatttctgcgccggtgccgtcttgatctcttttggggctgtcctgggcaagaccgggcctacccagctgctcctcatggcactcttggaagttgtgctgtttggcatcaatgagtttgttctgctccacctgcttggtgtgagagatgcaggaggaagcatgactatacacaccttcggcgcctacttcggcctggtgctgtcaagagtactgtatcggccccagctggagaagtccaagcaccgtcaggggtcggtttatcacagcgatctatttgcaatgatcggtacaatttttttatggatcttttggccttcctttaatgctgcactcactgcactgggcgctgggcagcacaggacagcacttaacacttattactctctcgcagcctcgaccctcgggacctttgctctgagtgccctcgtgggcgaggacggaagactcgatatggtgcacatccaaaacgcagctctggcaggcggagttgtggtcggcacttctagcgagatgatgctaaccccattcggtgcactggctgctggcttcctggccggcaccgtgtccaccctcgggtacaaatttttcactcccatcctggaaagcaagttcaaagtgcaggacacttgtggcgtccataacttgcatggaatgccaggagtacttggggcattactgggcgtactcgtagctggtttggccacccacgaggcctatggagacggtctcgagagcgtcttccctctcatagcagagggacagcgttccgccacctcccaggccatgcaccagcttttcgggttgtttgtgactttgatgttcgcatcagtgggaggtggtctgggaggcttgcttctcaaactcccctttctggatccacctgatagccaacactacgaagaccaggtgcactggcaggttcctggggagcacgaagataaagcgcagaggcccttgagggtggaagaagctgacacgcaggcgtag

SEQ ID NO: 132444 - DNA, 1326 bp, Artificial Sequence
  Description of Artificial Sequence: Synthetic coding sequence
atggctggcagtcccagccgggctgctggtcggcggctgcagttacctttgctctgcctgtttctccagggcgcaaccgctgttctattcgcagtgtttgttaggtataaccataagactgatgctgcgctctggcatcgatccaaccacagcaacgccgataacgagttttatttcagatatccatcatttcaagatgtgcacgcaatggtgttcgtaggattcggtttcttaatggtctttctgcagaggtacggcttcagctccgtgggttttacattcctcctcgctgcttttgcactgcagtggagcacccttgtgcaaggctttttgcattccttccatgggggccatattcacgtgggcgtagagtcaatgattaatgcagatttctgcgctggcgctgtgctgattagcttcggggcagttctggggaagaccggcccaacccagctgctgctgatggctctcctagaagttgtgctgtttggaataaatgagttcgtgctgctgcacctcctcggagtgcgggacgcaggcgggagtatgaccattcacaccttcggcgcttactttggcttggtgctgtcgcgagtgctgtaccggcctcagctggagaagagtaaacacagacagggaagcgtctaccactctgacttgttcgccatgatcggaactatttttctgtggatattctggcctagctttaatgctgcgctgaccgcacttggagccggccagcataggactgccctaaatacctattattccctggctgcgtctaccttggggaccttcgctttgagcgcacttgtgggggaagacgggcggctggatatggtgcacatccagaacgccgctctcgcgggcggggttgtggttgggacatccagcgaaatgatgctgacgcctttcggggccctagccgcgggcttcctggctggaactgtttctactctgggctataaattcttcacccccatacttgaaagcaagttcaaggtgcaggacacatgtggggttcacaacctgcacggcatgcccggagtactaggcgctcttttgggggtgctggtggccggactggctacacacgaggcttacggcgatggtctggagagcgtctttcctctgattgccgaaggtcagcgcagtgctacatctcaggccatgcaccagctgtttggcctgttcgtgacactcatgttcgcatctgttggagggggtctcggcggtttgctacttaagctgccttttttagattcacctcctcggctccctgcccttcgaggccccagcagcctggctggggcatggcgggcctag

SEQ ID NO: 132445 - DNA, 1230 bp, Artificial Sequence
  Description of Artificial Sequence: Synthetic coding sequence
atggtctttgttggcttcgggtttctcatggtattcctgcagcgatatggatttagctccgtcggatttacttttcttctggctgctttcgccctgcagtggtctactctggtgcagggattcctgcattcttttcacggtggacacatacacgtcggagtggaatctatgattaacgcggatttctgcgcaggcgcggtgttaatctctttcggggccgtgctcggtaaaaccgggcctactcaactgctcttaatggcattgctggaggttgtgctgtttggcattaatgagtttgtgctacttcacctacttggcgttagagtgtggggcggcatggagtctggggtgggtggcggccagggccaacccctgtcacaggagaggggaggcggtggtggggtgttgcctctgactccgccccctcaggtgcgagatgcagggggcagtatgaccatccacacctttggagcatattttggtcttgtactcagccgcgtgttgtataggccccaactggagaagagcaaacataggcagggctccgtgtaccattccgatctgttcgctatgatcgggacaatcttcctttggatattttggcctagcttcaatgctgcgctgacagccctgggtgccggacaacacaggacagcattaaatacctattactcgctggccgcatccacattggggaccttcgcactgtctgccctggtcggagaagacggccgcttggatatggttcacattcagaatgccgcccttgccgggggggtggtggtaggtacctcctcagagatgatgctgaccccgtttggagctcttgctgcgggattccttgctgggaccgtctctacgctgggatacaagttttttacccccatcctggaatctaagttcaaagtgcaagatacctgtggcgtgcacaaccttcatgggatgcccggggtactgggtgcacttctaggagttctggttgctggcttagctacccatgaggcttacggggatggactggaaagtgtattccctcttatcgccgagggacagaggtcagctacttcgcaagctatgcaccagctgttcggtctgttcgttacgctgatgtttgcatctgttggcggaggattaggggggcttctcctaaaactgccatttctagacagtcccccacgcctgccagccctccggggaccatcatcattggcaggggcctggcgtgcctag

SEQ ID NO: 132446 - DNA, 1125 bp, Artificial Sequence
  Description of Artificial Sequence: Synthetic coding sequence
atggtgttcgtcggctttggcttcttaatggtcttcttacagagatacggattttctagtgtcgggtttacatttctgctggccgcatttgccctgcagtggtcaacccttgtgcagggcttcctgcacagcttccatggcggacacatccatgtgggggtggagtctatgatcaatgcagacttttgcgctggcgccgtgctaatctccttcggggcggtgctggggaagactggtccgactcagttactgcttatggcattgctcgaggtcgtcctctttggtatcaatgaatttgtcctgcttcacctcctgggggttcgagtctggggaggcatggagtccggggtggggggcgggcagggacagcctctctcacaggaacgagggggcggcggtggcgtgctgcctctgacacccccgccccaggtaagagacgccggcggttctatgaccattcacacgttcggagcatacttcggactggtacttagtcgggtactgtacagaccgcagttagaaaagagcaaacaccgtcagggatccgtgtatcacagcgacctgttcgccatgatcggaactatctttctgtggattttttggccttccttcaatgccgccctgactgcgttgggagcagggcagcacagaaccgcacttaatacctactattctttagctgcttctacattaggcaccttcgctttgtccgctctggtgggtgaggatgggcgcctggacatgcctatattggagtcgaaattcaaggtgcaggacacgtgtggtgtccacaatctgcacggaatgccaggtgttttaggggccctgctcggggtccttgtggcgggtttggctactcatgaagcttacggagatgggctcgaaagcgtctttcctctcatcgccgaaggtcagagatcagccaccagtcaggctatgcatcaactgttcggactcttcgtaacactaatgttcgcctccgtcgggggcggcctgggtggcattatactggtactctgcctcctggacccttgcgctctctggcactgggtcgctccatcctcgatggtcggcggacgagaggcttcccagatactgccgtatcaccaccaggggtcctgctag

SEQ ID NO: 132447 - DNA, 687 bp, Artificial Sequence
  Description of Artificial Sequence: Synthetic coding sequence
atggcaggttctccaagcagggcagccggacgccgccttcagttgcctctgctatgtctgtttctgcagggagctaccgcagtgctgttcgccgtttttgttagatataatcataagacggacgccgccttgtggcataggagcaaccattccaacgccgacaatgaattctattttcgatatcctcgaactatctttctatggatcttttggcctagtttcaatgctgcattgacggcgctaggcgctggacaacatcgaaccgcactcaacacatactacagtctcgcagccagcacgctcggcacctttgctctgtcagccttggtcggggaggatggtagattggacatggtgcatatccagaatgcagccctagccgggggcgttgtggttgggacttcttcagagatgatgctcacaccgttcggcgcgctcgccgcaggcttcttggctggtaccgtctccaccttgggacctagcctgaatcaaaactccaaaagcaagacccacgtggagagtaccaccagtatgggttgtaggggttcctggggtccctcttggggcagtctatggctggacctgccgcctatgaagctgacagagatgggggaatttccgccaaatccgtattgctcacgacatcccagcggtatgacctctgtaatcctgttccattgtgtgtag

SEQ ID NO: 132448 - DNA, 1440 bp, Artificial Sequence
  Description of Artificial Sequence: Synthetic coding sequence
atggcctggaacaccaacctgcggtggagactgccactgacctgtctcctgctacaggtaataatggtcatcttatttggcgtcttcgtccgttacgacttcgaagcagatgcacactggtggtctgagcggacacataagaatcttagcgacatggagaacgaattttactaccggtatccaagctttcaagatgtgcacgtcatggtttttgtcggattcggcttccttatgacatttttgcaacgttacggcttcagtgcagtggggttcaattttctgctcgccgcctttggtatccagtgggccctgctcatgcagggctggtttcatttcctccaggatcgctacatcgttgtgggagtcgaaaacttgataaacgccgacttctgtgttgccagcgtttgtgttgcattcggcgccgtcttagggaaggtgagccctattcaactcctcatcatgacgttcttccaagtcaccctctttgccgtgaatgagtttattctgctaaacctcttgaaagtgaaggacgcaggaggctcgatgacgatccacaccttcggggcttactttgggcttactgtcacccggattctgtataggcgcaacctggagcagagcaaagaacggcagaacagcgtttaccagagtgacctgttcgctatgataggcacactgttcctttggatgtactggccctcatttaacagtgcaatcagttaccacggggacagtcagcaccgtgcggctataaatacatattgcagcctcgcggcatgtgtgcttacttccgtggccatatcctccgcactacacaaaaaaggcaaattagatatggtgcacattcaaaacgctactctggccgggggtgtagccgtgggtacagccgcggaaatgatgttaatgccatacggcgccctgattataggattcgtttgcggtatcatcagcaccctcggttttgtttacctgaccccttttttggagagcagactccatatccaggatacctgtgggatcaacaatctgcacggtatccccgggatcattggaggcatcgtaggcgctgtcacagctgcctctgcatcccttgaagtctatggcaaagaagggctcgtgcactcgttcgatttccaaggcttcaacggagattggacagcgcgcacgcagggcaagtttcaaatttacggactgttggttacattggccatggctttgatgggaggcattattgttggcctcatcttgcggttgccgttttggggacagcccagcgacgagaactgcttcgaagatgcggtctactgggaaatgcccgagggcaactccaccgtgtacatcccagaagatccaactttcaagccctcaggtccgtccgtaccatctgtgcctatggtgagtcctttgcccatggcctcgagtgtcccgctggttccatag

SEQ ID NO: 132449 - DNA, 1413 bp, Artificial Sequence
  Description of Artificial Sequence: Synthetic coding sequence
atggcttggaacacgtgcctgctgctgcaggttatcatggtgatcctgtttggcgtattcgttcgttatgattttgaagcagacgcccactggtggtctgagcgaacccacaaaaacctgagtgacatggagaatgaattttattataggtacccttcttttcaagacgtccatgtgatggtctttgtgggatttggatttttaatgactttcttacaaaggtacggcttctctgctgtgggatttaatttcctgctcgcggcgttcgggattcagtgggcacttctgatgcaaggctggttccacttcctccaggaccgttatatagtggtcggcgtagagaacttaatcaacgctgatttttgtgtagcctccgtgtgcgtggcgttcggcgccgtcttaggcaaagtcagtcctatccagctactcatcatgaccttcttccaggtcacactcttcgctgtcaacgaatttatccttctcaatctattgaaagtcaaggacgcaggcggaagcatgactattcacaccttcggggcctactttggcctgaccgtgacacgcatactgtatagacgaaatctggagcagagtaaagagagacagaatagtgtctaccagtcagatctctttgcgatgatcggcaccctgtttttgtggatgtactggccatcttttaatagcgccatcagctaccacggagactcacagcatcgggctgcaataaatacctattgctccttagctgcgtgtgtgctgacatccgtcgccatttcttcagctctacacaagaagggcaaactcgatatggtccacatccaaaatgctaccctagcaggtggggtggctgtgggaacagccgcagagatgatgttgatgccatacggcgctctaataattgggtttgtgtgcggcataatctcaaccctgggtttcgtgtacctaactccctttctggagagtcgtctgcatatccaagatacgtgtggaataaacaatctgcacggcattccaggaatcatcgggggcattgtgggcgctgtgacggctgcctctgccagcctggaagtgtacgggaaagaaggtctggttcactcgtttgacttccagggattcaatggcgattggaccgcacgcacgcagggcaaattccagatttacggtcttttggtcaccctggcaatggctcttatgggtggaattatcgttgggctgattcttcggctgccgttctggggacagccatcggacgaaaactgtttcgaggacgctgtgtactgggagatgcccgagggcaattccacagtgtacataccagaggacccaacctttaagccatccggccctagcgttccctctgttcctatggtttcccctcttccaatggcctcatccgttccactcgtgccctag

SEQ ID NO: 132450 - DNA, 1338 bp, Artificial Sequence
  Description of Artificial Sequence: Synthetic coding sequence
atggcctggaataccaacttaagatggagactgcccctgacatgcctgctccttcaggttattatggtcatcctgtttggcgtttttgtgaggtacgatttcgaggcggatgcacactggtggtccgagagaactcacaaaaacttgagcgacatggaaaacgagttctattatcggtacccgtctttccaggacgtacatgtgatggttttcgtgggtttcggatttcttatgacgttcctacagagatatggattttctgccgtaggctttaactttctgctggccgcctttgggatccagtgggcccttttaatgcagggttggtttcactttcttcaggaccgttacattgtggtgggtgtagagaacttaatcaacgcagacttctgcgtggcaagcgtctgtgtggcgtttggtgcagtgctcggtaaggtgagtccaattcaactgctgatcatgactttcttccaagtcacgctttttgctgtgaatgaatttatcctgctgaatttgcttaaagttaaggatgcaggtgggagcatgactatacacaccttcggcgcctactttggactcaccgtgacccgaatcctctacagacggaacctcgaacagtcaaaggagaggcagaatagcgtgtaccaaagtgacctctttgccatgatcggaacactgttcctatggatgtactggcccagctttaacagtgcaatctcgtaccacggcgactctcagcacagagccgcgataaacacatactgttcactcgcagcctgtgtgctgacctctgtcgcaatctcttccgctctccataagaaggggaaactcgacatggttcacatacagaacgcgacgcttgctgggggggtcgccgttgggacagctgctgagatgatgcttatgccctacggggcattgatcatcggttttgtgtgcggaataatctctaccctggggttcgtctacctcacaccctttctcgaaagtaggctccacatccaagacacttgtgggatcaataacttgcacggtattccagggataatcggcggcatcgtgggtgcagtcaccgcggccagtgctagccttgaagtctatgggaaggagggcttggtccacagtttcgacttccagggctttaatggcgattggacggcccgcactcaggggaagttccagatctacggactgctggtgacgctagcgatggctttgatgggaggcatcattgtgggattgatcctgagattgcctttctggggacagccctccgatgagaattgtttcgaggatgcggtatattgggaagacctggagctggcaccaaatcagtag

SEQ ID NO: 132451 - DNA, 714 bp, Artificial Sequence
  Description of Artificial Sequence: Synthetic coding sequence
tgagacagtcaacaccgcgcagccattaacacatactgctcgctggccgcgtgcgtcctcacatcagtcgcgatcagctcagctctgcacaaaaagggcaaacttgatatggtccacatccagaacgccacccttgccgggggggtcgctgtcggcaccgccgccgagatgatgctgatgccatatggagcactgataatcggctttgtttgcggaattatctccactcttggatttgtctatctgactccatttctcgaatccagactacacatccaggacacatgtgggattaacaacttgcacgggatccccggcattatcggaggaatcgtgggtgccgtcacagcggcaagcgcaagcctggaagtttacgggaaagagggactggtgcattccttcgattttcaggggtttaacggggactggactgcccggacgcagggcaaatttcaaatctatggcctgcttgttacactggccatggccctgatgggcgggattattgtgggcctgatacttcgcctaccattctggggccaaccctccgatgaaaactgttttgaagacgccgtatactgggagatgccggaggggaactcaaccgtctacatccccgaggatccaacttttaagccctctgggccaagcgtgccctcagtcccaatggtcagtcccttacccatggccagctcagtgcctttggttccttag

SEQ ID NO: 132452 - DNA, 429 bp, Artificial Sequence
  Description of Artificial Sequence: Synthetic coding sequence
atggcagctgcagtagcagccgccggcgccggcgagccgcagtccccagatgagctactgcctaagggagatgccgaaaagcctgaagaagagttggaggaggatgacgatgaggaattagacgaaaccctcagcgagcggctgtggggtctgaccgaaatgttcccagagagggtccggtctgcagcaggggctacatttgatttatcactcttcgtcgcgcagaagatgtaccgcttctcgcgcgccgcactgtggattgggacaacgagcttcatgattttagtgctgcctgttgtgtttgaaaccgaaaagctgcagatggagcaacagcagcagcttcagcagcgccagatccttcttgggcccaataccggccttagcggaggaatgcctggcgctctacctagcctccctggcaaaatctag

SEQ ID NO: 132453 - DNA, 1083 bp, Artificial Sequence
  Description of Artificial Sequence: Synthetic coding sequence
atgtcacaggagagacctaccttctatcggcaggagttgaataagacaatttgggaggtgcccgagagatatcaaaatctgtcaccagtgggctcaggggcttatggttcagtgtgcgcggccttcgacaccaagaccggactacgcgtcgctgtgaaaaagctgtccaggccctttcagtccatcatacacgctaagaggacctaccgggaacttcgcctcctcaagcatatgaagcatgagaacgtcatcggcttgctggacgtatttacccctgcccggagcctcgaagaattcaatgacgtttatctggtaacccatctcatgggtgcggacttgaacaatatcgtgaagtgccagaaattgactgatgaccatgtgcagttcttaatctaccaaatcctgcgtggcttgaagtatatccattctgccgatattatacatagggatctgaaaccttcaaacttggccgttaatgaggattgtgagttgaagattctcgacttcggccttgcccgacacaccgatgatgagatgactggctacgtggcaacaaggtggtaccgagctcctgaaatcatgctcaattggatgcactacaaccaaacagttgacatttggtccgtgggttgcataatggcggagttattgaccggcaggactctgttcccaggaacagatcacattaatcaactgcaacagataatgaggctaacaggtaccccccccgcttatctgatcaatagaatgccttcccatgaagcgagaaattatatccagagcctgactcagatgccaaagatgaactttgcaaacgttttcattggggcaaacccacttgctgtcgatctactggagaaaatgctggttctggactctgacaagaggatcaccgcagctcaggccctggcccatgcatactttgcccaatatcacgaccctgatgatgaacctgtcgcagatccttacgaccaaagctttgaaagcagagatcttctgatcgacgaatggaagtctttgacttacgacgaggtgatttcatttgtgccaccccctctcgatcaggaagaaatggagagctag

SEQ ID NO: 132454 - DNA, 1230 bp, Artificial Sequence
  Description of Artificial Sequence: Synthetic coding sequence
atgagattcacctttccgttgatggctatagtgctggagatcgcgatgattgtgctgttcggactgtttgtggagtacgagaccgatcagaccgtgctggagcagctcaacattaccaagccgaccgacatgggcatattttttgaactgtatcccctgtttcaagacgtccacgttatgatttttgttgggttcgggtttttgatgaccttcctgaagaaatacgggtttagcagcgtggggatcaatctgctggtcgcagccctcgggttgcagtggggtaccatcgtccaggggatactgcagagccaaggacagaagttcaatataggaatcaaaaatatgatcaatgccgatttcagcgcagcaacagtactgattagctttggagcagtattgggcaagaccagtccaactcaaatgttgattatgaccatccttgagatcgttttcttcgcccacaacgagtacctggtgtccgaaatcttcaaagcgagtgacatcggtgcaagcatgaccatacacgctttcggggcatatttcggtttagccgttgccggaatcctgtatcgatctggcctcagaaagggtcatgagaatgaggaatccgcctattacagcgatctttttgccatgattggcacactgttcctttggatgttttggccaagctttaatagcgccatcgctgagcccggcgataagcagtgtcgggccattgtcaacacctacttctctcttgcagcctgcgtgctgaccgcatttgcgttcagtagtttagttgagcaccggggcaaattgaatatggttcatatccagaatgcaacactggccgggggcgttgcagtaggcacatgtgcggacatggctattcacccttttggctcgatgatcattggaagcatcgccgggatggtatctgtgctgggatacaaattcctcactcctctgttcacaacaaaactgaggattcatgacacatgtggggtccataacctccatgggctgcctggcgtcgtgggcggattagcgggaattgtagccgtggcaatgggggcaagtaatacctcgatggcaatgcaggcagccgcactggggtcttcaattggcactgctgtggtgggagggctgatgactggactgattttgaaactgcctttgtggggacaacccagtgatcagaactgttatgatgatagcgtatattggaaagtacccaagacacggtag

SEQ ID NO: 132455 - DNA, 1233 bp, Artificial Sequence
  Description of Artificial Sequence: Synthetic coding sequence
atgcggtttaccttccccctaatggcaatagtactggagatcgctatgattgtgctgttcggcctcttcgtggaatatgaaacagaccagactgtgctcgagcaactgaatattaccaagcctacggacatgggtattttctttgaactgtaccctctcttccaggatgtccatgtgatgatctttgtcggcttcggcttcctcatgacatttctcaagaagtacggctttagcagtgtggggataaaccttttggtggccgcgctgggcctccagtggggcacaatagtgcaggggatccttcagagccagggccagaagttcaatattggaatcaaaaatatgattaacgctgatttttcagcagcaacggtcctgatttccttcggcgccgtgttagggaagacttctcctacccaaatgttgattatgacaattctggagatcgtgtttttcgcgcacaatgagtatttggttagtgagatctttaaagcctcagacattggggcctctatgaccatacacgcgtttggcgcatacttcggcctggccgtggccggcatactctataggtcaggactgcgtaagggccacgaaaatgaggaatccgcctactactccgatctgttcgctatgataggaactctgttcctttggatgttctggccctccttcaattccgccatcgcagagccgggggacaaacagtgccgtgcaatcgtgaacacctatttctcattggctgcctgcgttttgaccgcctttgccttcagtagtttggttgagcacaggggtaaactgaacatggtgcatattcaaaatgccaccctggccggcggcgtggcagtgggcacctgtgcagacatggccatccatcccttcggctctatgataatagggtcaattgccgggatggttagtgtactgggatataagtttttgactcccctgtttactacaaagttgaggatccacgacacctgcggcgttcacaacttacatggactgcctggggtagttgggggactggccggcattgttgccgttgccatgggagcaagcaacacttctatggcaatgcaggctgcagctctgggcagcagtataggtacagcggtggttggtggtctgatgacaggtttaatcctcaagctgccactctggggccagccctctgaccagaactgctacgacgacagtgtatactggaaggtgccaaaaacccgcgtatag

SEQ ID NO: 132456 - DNA, 1146 bp, Artificial Sequence
  Description of Artificial Sequence: Synthetic coding sequence
atgcggttcacttttcctttgatggccattgttctggagatcgccatgatagttctattcggtttattcgttgagtatgaaaccgatcaaaccgtgcttgaacagctgaacatcactaagccaactgatatggggatcttcttcgaactgtacccgctgttccaggacgtgcacgtgatgatattcgtaggcttcgggttcttaatgacctttctcaaaaaatatggcttctcttccgtgggtatcaaccttctggtcgccgccctcggtttgcagtggggcaccatcgtccaggggatcttgcagtctcagggacagaagttcaacatcggcataaagaacatgattaatgcagatttctccgctgcaacagtgcttatctcctttggcgctgtattgggcaagacctccccgacacagatgctcatcatgaccattctggagatcgtgttctttgcacataacgaatatctggtgtcggagatctttaaggcctcagatattggagcgtcaatgactatccacgcattcggcgcgtacttcgggcttgccgtggcggggatcctataccgtagcggactccgtaaaggccacgaaaacgaagaatccgcctattattccgaccttttcgctatgataggcacactctttctgtggatgttttggcctagtttcaacagcgcaatcgcggagcctggagacaagcagtgcagagcaattgtgaacacttatttctctttggccgcctgtgttctgactgcgtttgccttttcctcgttggtggagcacagagggaagctcaatatggtgcacatccaaaatgctacactggcaggaggagtggccgtgggtacttgcgccgacatggccattcacccatttgggtctatgataatagggtctatcgctgggatggtctctgtcctcgggtataagtttctgacaccactgttcaccacaaaattgaggattcatgacacctgcggggtccataacctgcatggcctgccgggggttgtgggcggcctggccggaattgtggccgttgcgatgggggccagcaatacttctatggctatgcaggccgccgcactaggttcttcaatcggcactgcggtggtaggaggactgatgacagggacatag

SEQ ID NO: 132457 - DNA, 387 bp, Artificial Sequence
  Description of Artificial Sequence: Synthetic coding sequence
atgaagtctctgatcctgctggccattctcgcggccctggccgtggtgaccctgtgttacggcgaatggcagaaagaggaaaattttgggttcgatattgtcagcgtactgagtctgaactggcacagagcacaggagtcacacgaaagcatggaatcctacgaactaaatccttttattaataggcgaaatgctaacacgtttatttccccccaacagcgatggcgggcaaaagtccaggagaggataagagaaaggtcgaaaccagtgcacgagctgaatcgggaagcgtgtgacgattatcggctttgtgaaaggtatgccatggtatatggctacaatgccgcttacaatcgatattttcggaagcggaggggcacaaagtag

SEQ ID NO: 132458 - DNA, 339 bp, Artificial Sequence
  Description of Artificial Sequence: Synthetic coding sequence
atgacagagaaggcgcccgagcctcacgttgaagaagatgatgatgatgagctggacagcaagcttaattacaagccaccaccccaaaaaagcctgaaagaactgcaagagatggacaaggacgacgagagccttatcaagtacaaaaaaacccttctaggggacgggccagtcgtaactgacccaaaagcccccaacgtagtggtgaccagactcactctcgtttgtgaaagtgcccccggacccattacaatggatctcaccggcgatctcgaggccctgaagaaagagaccatcgtcctcaaagaaggaagcgagtaccgagtaaaaattcattag

SEQ ID NO: 132459 - DNA, 606 bp, Artificial Sequence
  Description of Artificial Sequence: Synthetic coding sequence
atgactgagaaagcacccgagccccacgtggaagaggatgacgatgacgagctggattccaaactgaactacaagccaccaccacaaaaatcgcttaaagagttacaggaaatggacaaggatgatgagtctctgattaagtacaagaagaccctcctaggcgacggccctgttgtcaccgaccctaaggccccaaacgtggtggtaacccggttgacactggtctgcgagtccgccccgggccctatcactatggaccttacaggtgacctggaggcgctcaaaaaagagacaattgtcctgaaagagggctctgaatacagagtgaagatacatttcaaagttaatagagatatcgtaagtgggctcaaatatgtccagcatacttataggacgggggtcaaggttgacaaggctacatttatggtagggtcgtacggccctaggcctgaagaatatgagtttcttacaccagtggaggaggcacctaagggaatgctcgctcggggcacgtatcataataagtcttttttcacggacgatgataagcaggaccatctctcatgggagtggaatcttagcatcaagaaagaatggacagaatag

SEQ ID NO: 132460 - DNA, 606 bp, Artificial Sequence
  Description of Artificial Sequence: Synthetic coding sequence
atgaccgaaaaggctccggagccccacgtggaggaagatgacgacgacgagctggactccaaactgaattataagccacctcctcagaaaagtctaaaagagctgcaggaaatggataaagatgacgaatctctcatcaagtacaaaaaaacactgctcggtgatgggcctgttgtcaccgatccaaaggctcccaacgtggtagtcactcgcttgacgctcgtgtgcgaatcggcccccggcccaatcactatggacctgaccggtgacctggaggctctgaaaaaggagaccattgtactgaaggagggctcagaatatagagtgaaaatccatttcaaggtcaaccgggatatcgtgagtggactcaagtatgtccaacacacttacaggacgggagtcaaagtcgacaaggctacctttatggtgggaagctacggaccacgccctgaggagtatgagttcttgaccccagtagaggaggccccgaaggggatgctagcgaggggaacttatcacaacaaaagtttcttcaccgatgatgacaagcaggatcacctctcctgggagtggaatcttagtattaaaaaagagtggaccgagtag

SEQ ID NO: 132461 - DNA, 267 bp, Artificial Sequence
  Description of Artificial Sequence: Synthetic coding sequence
atgaccgaaaaagctcctgaacctcacgtcgaggaagacgacgacgacgaactggattcgaagctaaattataaaccacctccccaaaagtccctcaaagaactgcaagaaatggataaggatgacgaaagtcttattaaatataagaaaacccttctgggggacggccccgtcgtgaccgatcctaaggctccaaacgtcgttgtaacccgactaaccctagtatgcgaatcagccccaggtccaatcacaatggacctgacatag

SEQ ID NO: 132462 - DNA, 480 bp, Artificial Sequence
  Description of Artificial Sequence: Synthetic coding sequence
atgactgaaaaggctccagagcctcatgtggaggaggatgacgacgacgaacttgatagtaaattaaattacaaaccgccccctcaaaaaagtctcaaagagctgcaggagatggacaaagacgacgagagcttgattaaatataagaaaactctactgggcgacggccccgttgtcaccgaccctaaggccccaaatgtagtggtgacacgacttactctggtgtgcgaatccgctcctggcccaattaccatggatctgaccggcgacctcgaggccctgaagaaggagacaattgttttgaaggaaggcagtgagtacagagtgaaaattcacttcaaggtgaatagggacattgtaagcgggttaaaatacgttcagcatacgtacagaaccggagttaaggtagataaggcaacttttatggtgggatcctacggacctaggccagaagagtacgagttcctcacccctgtctag

SEQ ID NO: 132463 - DNA, 1320 bp, Artificial Sequence
  Description of Artificial Sequence: Synthetic coding sequence
atggaccctctctcagagttgcaggacgatttaacactggatgacacgagcgaggctctgaaccaactaaagttagcctccatcgatgagaaaaactggccttctgacgaaatgcccgactttccgaaatctgacgatagtaagtcatcaagccccgagctggtcactcacctgaagtgggacgacccatactacgatatcgcgcgacaccagatagtcgaagtagcaggcgatgataagtacggaagaaaaatcatcgtgttttcggcctgtcgaatgcccccaagccaccagcttgaccactccaaactcctgggatacctcaaacacaccctggaccagtacgtcgagagcgactataccctgctgtatctccaccacggactgactagcgacaacaagcccagtttgtcttggttgcgggatgcatacagagaatttgaccgcaagtataagaagaatataaaggcactgtatattgtgcatcctaccatgttcatcaaaacgctcctcatcctttttaagcctcttatctcattcaagttcggccagaaaatcttttatgtgaattacctatctgaattgtcagaacacgtgaagctcgagcagctggggatccctagacaggtgctcaaatacgacgacttcctcaagagtacccagaagagtcctgctactgcccccaagccaatgcccccccggccaccactccctaatcagcagtttggcgtgtctctgcagcacctgcaggagaagaatcccgagcaggagcccatccctatcgtgttaagagagacggtggcctacctgcaggcccacgccttgacgaccgagggtatctttagacgctcagccaatacccaggtggtgcgcgaggtgcagcaaaagtacaacatgggcctccctgtcgatttcgaccagtataatgagctacatctccctgcagtcattttgaaaactttcctccgcgagctgccagaacccctgttgaccttcgacttgtatccacacgttgtcgggttcttgaacatcgacgagagccagagagtgcccgccaccctacaggtcctgcagacactgccggaggagaactatcaggtcttgcgctttctcacagctttcctggtacaaatctctgctcactctgaccagaacaagatgaccaacaccaatctggccgtagtgtttgggcccaatttgctgtgggccaaagacgccgctatcactctgaaagccattaatcctatcaacacctttaccaaatttcttctggaccatcaaggagagttgttcccttcacccgatcctagcggactttag

SEQ ID NO: 132464 - DNA, 1377 bp, Artificial Sequence
  Description of Artificial Sequence: Synthetic coding sequence
atggatcccctttctgagctgcaggatgacttgacgctggatgacacaagtgaggcactcaatcagctgaagctcgcctcaatcgacgaaaaaaattggccctcagacgaaatgcctgatttccctaaatctgatgacagcaagagcagctcacccgagctcgtaacccacctcaagtgggatgacccctattacgacatagccagacatcagatcgtggaggtggcaggcgacgataagtacgggagaaaaattattgtctttagcgcctgtaggatgccaccaagtcatcagcttgatcattccaagttactggggtaccttaaacacacgttggaccaatacgtggaaagcgattataccctactttatttacaccatggtctaacaagtgataataagccctctctcagctggctgcgggacgcttaccgagaatttgacaggaaatacaagaaaaatatcaaggcattatatattgtgcatcctacaatgtttatcaagacgctcttgatattatttaaacctctgatcagctttaaattcgggcagaagatcttctacgtcaattatctctccgagctgtctgagcatgtaaaattggagcaactaggtatacctagacaggttctcaaatacgatgacttcctgaagtccacccagaaaagtccagctactgcccctaaacccatgccccctcgtcctccactcccaaaccagcaattcggcgtaagtctccaacatcttcaggagaagaacccagagcaggagcccattcccatcgtgctgcgagagaccgtggcctatttgcaggctcacgccttgactacagaggggatttttcggcgctcagcgaacacacaagtggtgagggaggttcagcagaaatataacatgggactgcctgtggatttcgatcagtacaatgagctgcacctgccagctgtcatccttaagacgtttctgcgcgaattgcctgaaccactgttaacttttgacctctaccctcatgttgtgggctttctgaacatagacgagtcacaacgtgtgcccgctactctccaagtgctccagacgctgcctgaggagaattatcaggtcctcagatttctgacggccttcctcgtccaaatcagtgcccactccgatcagaataaaatgactaatactaatctggccgtggtgtttgggcccaatttgctttgggccaaggatgcggccatcacgctgaaagccataaaccctatggcaacattcttttttttctttctccgctggagcctcgccttatcccctggctggagcgctgtagcacgaagccgccatactagcgcattctgggtacaggctatcttgctgcctcaaccaccagagtag

SEQ ID NO: 132465 - DNA, 579 bp, Artificial Sequence
  Description of Artificial Sequence: Synthetic coding sequence
atggaccctctctctgagctgcaggatgatctaaccctggacgatacatcagaagctctaaaccagctcaagttggcatctatcgacgaaaagaattggcctagcgacgagatgcccgatttcccaaagtctgacgatagcaagagttccagtcccgagctggttacccatctgaagtgggacgatccatactatgatattgctagacaccagattgtggaagttgcaggagatgacaaatacggaagaaagataatcgtgtttagcgcctgccgcatgcctccgtctcatcagctcgaccattcaaaattgctggggtatctgaaacatacactggatcagtatgtggagagtgactacacattattgtatctccaccacggactcacctcagataataagccaagtctctcgtggctgagggacgcataccgcgaattcgatcgcaaatataaaaaaaatatcaaggctttatacatagtacacccgactatgttcattaaaacactcttgattctgttcaaaccactcatcagtttcaagttcggacagaaaatcttctacgtgaactacttgtag

SEQ ID NO: 132466 - DNA, 2361 bp, Artificial Sequence
  Description of Artificial Sequence: Synthetic coding sequence
atggggttacaaccactggaattttccgattgctacttagactctccctggttccgagagaggatcagggcacatgaggcagagttggagcgcaccaacaagtttattaaagaactgataaaagatggaaagaatttaatcgccgcaaccaagagccttagcgttgcccagaggaagtttgcccacagcctgagggactttaaatttgagtttattggcgacgctgtgactgacgacgagcgttgcatcgacgccagtctcagggaattttccaatttcctcaagaatttggaagaacagagggagattatggccctctccgtgactgaaacactcataaagcccctggaaaagttccgtaaggaacagctcggggccgtaaaagaagagaaaaaaaaattcgacaaggagactgaaaagaattactctctcattgacaagcatttaaatctaagcgctaagaaaaaagactcccacctgcaggaggccgatatccaagttgagcagaacagacagcacttctatgaactgagcttggaatatgtatgtaagctccaagagatccaagagcgcaaaaagttcgaatttgttgagcccatgctgagcttctttcagggaatgttcacattttaccaccaaggtcacgaactagcaaaagactttaaccactacaaaatggagctccagatcaatattcagaacacaaggaacaggttcgagggaacccgaagtgaagttgaggagctgatgaacaaaataaggcagaaccctaaggatcacaaaagagcgtctcagtttacagcagagggttacctgtacgtgcaggagaagaggcccgccccgtttggcagctcctgggtaaagcactactgtatgtatcgcaaggccgctaaaaaatttaatatgatccccttcgaacaccggtctggcggaaagctgggcgacggcgaggtattctttttaaaagagtgcactaaacgacatacagatagcatcgacagaaggttttgtttcgacatagaggccgcagacaggcccggagtgtccctcaccatgcaggcgtttagcgaagaggagaggaaacaatggcttgaagcgttaggagggaaggaagctttgtcgcactccttcaatacagccataataccgcgccctgagggaaacgcccagctcgataaaatggggttcaccatcatacgaaaatgcatttctgccgtagagaccagaggaatcaacgatcagggcctgtatcgtgtagtaggggtgagcagtaaagtgcaacgcttactctccatgctgatggacgtcaagacctgcaatgaagtggatttagagaactctgctgactgggaggtcaagaccatcacctccgcacttaagcagtatttgcgatccttgcccgaacctcttatgacttatgagctccatggggatttcatcgttcccgcgaaatccggcagcccagaatctcgcgtgaacgcgattcacttccttgtgcacaagctgccagagaagaataaggagatgctagatatcttagttaaacacttaacgaatgtgagtaatcactctaaacagaacctgatgacggtggctaacctgggggtagtgtttggacccacactcatgaggcctcaggaagagaccgtagcagctttgatggatctcaagttccaaaacattgtggtagagatccttatcgagaaccatgagaagattttccgaactcctcctgacacaacctttccagagcctacttgcctgtccgccagccctccaaatgcgccacccagacagtccaagcgccaaggtcagagaacaaaacggcctgtcgctgtttataacctctgcctggaactcgaagatggggacaacccctatccctccaaagaggatacacccacctcttccttggattccttgtcatctccttctcctgtcaccacagcagtaccagggcccccaggacccgacaagaatcatttgttggcagatggcgggtcttttggagattgggcttctaccatcccagggcagaccaggtcaagtatggtccagtggctaaaccctcagagcccaactacaactagctccaatagcgctgtcacacctctgtctcctggcagcagtccatttccattttctcctcctgcaactgtggcggacaagccacctgagtcaatacgatctaggaaggctcgggctgtctatccttgcgaggctgagcattccagtgagcttagctttgagatcggcgctatcttcgaagatgttcagacatcaagagagcccggttggctcgagggaacattgaatggaaaacggggactgattccacagaactatgtgaagttgttatag

SEQ ID NO: 132467 - DNA, 1155 bp, Artificial Sequence
  Description of Artificial Sequence: Synthetic coding sequence
atgcaggctttctctgaagaagaacgtaagcagtggctggaggcactgggcggaaaggaggctctctcccactcattcaatacagccatcatcccaagacccgaaggaaacgcacagctggacaagatgggattcactattatcaggaagtgcatctccgctgtcgaaactcgcgggataaatgaccaaggtctctaccgcgtggtgggagtgagttcgaaagtccagcgattgctgagcatgctaatggatgtcaagacatgtaacgaggtggacctcgagaactccgccgattgggaagtcaagacaattactagcgctctcaaacagtacttgaggagtttgcccgagcctctcatgacctacgagttacatggcgatttcatcgtgccggctaaaagcggtagtccggagagtagggtcaacgcaatacactttctggttcataaactccctgaaaaaaataaagagatgttggatattctggtgaaacatttgaccaacgtgtccaaccattccaaacaaaacctaatgacagtggcaaatcttggcgttgtattcgggcctacgctcatgaggccacaggaggaaactgttgctgctttaatggatctgaagtttcagaacatcgtggttgagatcctgattgagaatcatgagaagatctttcgcacccctcccgatactacgttcccagaacctacttgtctcagcgcatcacccccaaatgccccgccccgacagtccaagcgccagggacagcggacaaagagaccagtggctgtctacaatctctgtctggaactcgaggatggagacaacccatatccctctaaggaagacactcccacttcgtcattggattcactgagctctccgagccctgtgacaaccgccgtgccagggcctcccggaccagacaagaaccatcttctggccgatgggggttctttcggtgattgggcttcaaccatcattagaagtcggaaggctcgcgctgtctacccttgcgaagcagaacactcatcagaactgagcttcgagatcggagcaatcttcgaggacgtacaaacatctcgcgagcccggatggctcgaaggaacccttaatggcaagaggggactgatcccccaaaactacgtgaagttgctatag

SEQ ID NO: 132468 - DNA, 3072 bp, Artificial Sequence
  Description of Artificial Sequence: Synthetic coding sequence
atgtgggatcagcgccttgtgcggctggctttactgcagcacctgagggctttttacggaattaaagtgaagggagtacgaggtcagtgtgacagacgccgccacgagacagccgccaccgaaatcggtgggaagatattcggcgtcccctttaacgctctcccccatagcgccgtccctgagtatggccacatcccttcattcctcgtcgacgcctgcacaagtctggaggaccatattcacacagaggggctgtttagaaagagtggctctgtaatccgcttaaaagccctcaaaaacaaagtggaccatggcgaaggatgcctgagcagcgccccaccatgtgacatcgctggactcctgaaacagttttttcgagagcttcctgagccgatcttaccagcagacctgcatgaggcgctcctgaaggcacagcagctaggaactgaagaaaagaataaggcaacactgctgttgtcatgcctgctggctgaccacaccgttcacgtcctgcgctacttctttaactttctgcggaatgtcagtctgcggagcagtgaaaacaagatggattcttccaaccttgctgttatttttgctcctaatctgctgcagacctccgaagggcatgagaagatgagctccaacaccgaaaaaaagctgcgtctccaggccgccgttgtgcagacactcattgattatgcctcagacatcggtcgggttcccgatttcatcctggaaaaaataccggctatgcttggtattgatggactctgtgccacaccgtccctggagggcttcgaggagggtgaatatgagacaccgggtgaatataagcgcaagcgtaggcagtctgttggggatttcgtttctggcgccctcaacaaatttaagccaaaccgcacccctagtatcacccctcaagaggagcggatcgcccaactttccgaatcccctgtaattttgacaccaaacgctaaacgcacccttcctgtcgattcttcacatggattttctagcaagaaacgcaaaagtatcaagcacaattttaactttgagctgttgccgtccaatctttttaactcgtcctccactcctgtgagtgtgcatatagatacctccagcgagggttcctctcagagctcactgagtccagtcctgatcggcggcaaccaccttatcactgcaggagtcccacgtcggtctaaaaggattgctggcaagaaagtttgccgagtggaatctggtaaagccggctgctttagcccaaagatcagtcataaagaaaaggtcaggagaagcctgcgcctcaaattcaatcttggtaagaatgggcgggaggtgaacggctgcagcggcgtgaaccggtacgagagcgtgggctggagactcgccaaccagcagtccctcaagaataggattgaatctgtaaaaaccggcctgctcttcagcccagacgtggatgagaaactacccaagaaaggcagcgagaagatttcgaaaagtgaggagacactcctaaccccagagaggctcgttggtactaattatcgaatgagttggaccggccccaacaatagttcattccaggaggtagacgctaatgaagcctctagtatggtcgaaaatctggaggtcgaaaatagccttgaacctgatatcatggtcgagaagagccctgcaacctcttgtgagctgacccctagcaatctcaacaacaagcacaacagcaacatcacaagcagtccactgtccggcgacgagaataacatgacaaaagaaactctcgtgaaggttcagaaggccttttcagaatccgggagcaatctgcacgctctcatgaaccaacggcagtctagtgttaccaatgtgggcaaggtaaaattaacggagccaagttatctggaggatagtcctgaggagaacctcttcgagaccaatgatttaaccatcgtggagtccaaggagaaatacgaacatcacaccggcaaaggtgagaagtgcttctcagagcgggattttagcccgctgcagacccagacattcaaccgagaaactacaattaagtgttattctacacaaatgaaaatggaacatgagaaggacattcactctaacatgcccaaagactatttgtccaagcaggagttcagcagcgacgaagaaatcaagaagcagcagtctcccaaagataagttgaacaataaattgaaagagaacgagaatatgatggaaggaaacctgccaaagtgcgctgctcacagtaaagacgaagctcgaagctcattttcacaacagagtacctgtgtcgtgacaaacctttccaagccgcggcccatgcgaattgccaagcaacagagtctggagacttgtgagaaaaccgtgtcggagtcttctcagatgactgagcacaggaaagtgtccgatcatatccagtggttcaataagctgagcctgaatgaaccgaaccggatcaaggtgaagtcccccttgaaatttcagcgaaccccggtccgtcaaagcgtccgccgcatcaattccctcctcgagtactcccgtcagccaaccgggcacaagctcgcttctcttggagatactgcctctccactggtgaaatccgtgtcttgcgacggggcactgagttcgtgcatagaatccgcatccaaggatagcagcgtgtcctgtatcaagtcaggcccgaaggagcagaaaagtatgtcgtgcgaagagagcaacataggcgccatctccaaatcttcaatggaattgccctcgaagagctttcttaagatgcggaagcatccagatagcgtgaatgcatccctgcggtccaccactgtttataagcagaaaatcctttctgatggacaggtaaaggttccgttggatgacttaaccaatcatgatatcgtgaagcctgttgtgaataataatatgggtatttcgagcggaattaacaaccgcgtgcttcgccgccccagcgagaggggaagggcatggtataaaggatctcccaagcatcctatcggtaagacacagctactgccgaccagcaagccggtcgatctgtag

SEQ ID NO: 132469 - DNA, 2505 bp, Artificial Sequence
  Description of Artificial Sequence: Synthetic coding sequence
atggacagctctaacctggccgtaatatttgccccgaacctgttacaaacatctgaaggccacgagaagatgtccagtaataccgaaaagaagctgagactgcaggccgcggtggtgcagacactgatcgattacgcctccgacatcggccgtgtgcccgacttcatcttggagaaaattcctgccatgctcggaatagatggactgtgtgccacacccagccttgaaggttttgaggaaggtgagtacgagacccccggggagtacaagagaaagcggcgtcagagtgtcggagattttgtttcaggagctttgaacaaattcaagccaaatcggactccctctattactccccaagaggaaagaattgcccagctctcagagtccccagtaatcctgaccccgaacgcaaagaggacacttcccgttgatagcagccacggcttttcgagcaagaagaggaagtcaataaagcacaattttaacttcgaattgctcccatctaacttattcaattctagctctacccccgtctccgtgcacattgacacctcctctgaggggtcctcccagagctctctgtcccctgttttgataggcggcaaccacctcattaccgccggtgtgcctagaaggtccaagcgtatcgccggaaagaaagtgtgtagagttgagtccggaaaggcggggtgtttctcacctaaaatcagccataaggagaaggtccgacggagtttacgactcaaattcaatctcggcaaaaacggtagagaggtgaacggctgtagcggcgtgaatagatatgaaagtgttggttggagacttgccaaccagcagagtttgaagaatcgcatcgaatcagtgaagaccggtttactgtttagcccagatgttgatgagaagctaccaaagaaagggtctgagaagatttcaaagagtgaggaaaccctgctgacaccagagaggcttgttgggacgaattacagaatgtcatggacaggaccaaacaactcatcttttcaggaagtggatgctaatgaggcgtcatccatggtggagaatcttgaggtagaaaacagtttggagccggacatcatggtggagaagtcacccgcaacctcttgtgaattgacacccagcaacctgaacaataagcacaactctaatattacatcttcgccgctgtccggcgatgaaaacaatatgaccaaagaaactttggtaaaagtgcagaaggccttttcggagtccggctcaaatcttcacgctctcatgaatcagaggcagagctccgtcactaacgtcggcaaggtgaagctcactgaaccttcctatctggaagatagcccagaggagaatctcttcgagacaaacgacctaacgattgtggagagtaaggagaagtatgagcaccacacgggaaaaggtgaaaagtgctttagcgaacgtgacttctctcctcttcagacacagaccttcaaccgggaaacaacaataaaatgttattctactcaaatgaagatggagcatgagaaagacatccactctaacatgcccaaagactatttatccaagcaggaattttcttctgacgaagaaatcaaaaagcagcaatcacctaaagacaaactcaataataaattaaaggagaatgagaacatgatggaaggaaacctgccaaaatgtgctgcccatagcaaggatgaggcaagatcctccttctctcagcaaagtacctgcgttgtgaccaaccttagcaaacccagaccaatgagaattgccaaacagcaatccttagagacctgcgaaaagaccgtgagcgaatcgtctcagatgacagagcatcgcaaggtaagcgatcacattcagtggttcaacaaactgtccctgaatgagcctaatagaattaaggtgaaaagtccactgaagttccagaggactcccgtcagacaatctgtgagacgtatcaactctcttcttgaatatagtcgacagccaacagggcacaaactggcaagcctgggcgacaccgcctctcctcttgtgaagtcggtatcctgcgatggagccctatctagttgtattgaatctgcatctaaggattcttcggtatcgtgcattaaaagcgggccaaaggagcagaagagcatgtcctgtgaggagagtaacatcggggccatcagtaaaagcagcatggagttaccctctaagtcttttcttaagatgcggaagcatcccgattcagttaatgcctcattgagatcgaccacggtgtataaacagaagattttgagcgacgggcaggttaaggttccactggacgacctgaccaaccatgacatcgtcaagccagtagtaaataacaatatggggatcagcagtgggattaacaatagagtcctgcgacggccttcagaacgtggaagagcgtggtataagggttcaccgaagcaccctatcggaaagacacagctcctaccaaccagcaaaccagtggacctttag

SEQ ID NO: 132470 - DNA, 1506 bp, Artificial Sequence
  Description of Artificial Sequence: Synthetic coding sequence
atgtgggatcagcggctcgtccggcttgctcttctgcagcacctaagagctttctatggaataaaagtgaagggcgtgcgaggacagtgcgatcgaagaaggcacgagacagctgccaccgaaatcggaggtaagatattcggcgtgccattcaacgccctccctcactccgccgtaccagaatatgggcatattccatcatttttagtggacgcgtgtacatccttagaagatcacatccataccgaagggttgttccgaaagtctgggagcgtcattcgattgaaagcactgaagaataaggtcgatcatggagaaggctgcctcagttccgcccccccctgcgacatcgcaggactcctcaaacaattctttcgcgagttgccggaacctattttacctgctgatctgcatgaggctctattaaaagcccagcagctgggtacggaggaaaagaataaagccacacttttgctctcctgtttgctggccgatcatactgtgcacgtactcagatatttttttaatttcctgagaaacgtgtcactgcggtccagtgagaacaaaatggactccagtaacctggctgttatcttcgctcctaacctgttgcagacttctgaagggcacgagaagatgagttccaataccgagaagaagctaaggttgcaggccgcagtcgttcaaactctaatcgattacgcatcggacattggtagggttccagacttcattttggagaagattcccgccatgttgggcatcgacggcctgtgcgcaaccccaagcctggaagggtttgaagaaggggagtacgagacccccggagaatacaagcggaaacgccgccagagcgtaggagatttcgtctcgggtgccctgaacaaatttaaacccaacaggactccttcaatcacacctcaagaagaaaggattgcacagttgtctgagtcaccggtgattctcaccccgaatgcaaaacggacattgcctgtagatagctcccacgggttctcatccaagaaacgcaaaagcattaagcataactttaacttcgagcttctgccatcgaatctctttaactcttcttcaaccccagtgtccgtccacattgatacctctagcgaaggtagtagccaaagttcactctccccagttctgattggcggaaatcacctcatcaccgcaggcgtccctcggaggtccaagagaatcgcaggtaagaaagtctgccgggtggagagtggtaaggccgggtgttttagtccgaagatctcgcataaagagaaggtccggcggtcccttcggctgaaattcaaccttggcaaaaacggcagggaagtgaatggctgcagcggagtaaacaggtacgagagtgtgggttggcggcttgccaaccaacagagcctgaagaacagaatcgagtcggttaagacaggactgttgttttcccccgacgtggacgagaaactgccgaaaaaagggacctttacatattactgctag

SEQ ID NO: 132471 - DNA, 2385 bp, Artificial Sequence
  Description of Artificial Sequence: Synthetic coding sequence
atgaagatggccgataggtcaggcaagatcattcctggacaggtgtatatagaagtagagtacgactatgaatatgaggctaaggatagaaagattgtcatcaagcagggtgaaagatatatcttggtgaaaaaaactaatgacgactggtggcaggtgaaacctgatgagaacagcaaggcattctatgttccagctcagtacgttaaagaggtcactagaaaggccctgatgccgccagtcaaacaggtagcgggactgccaaacaattctaccaagattatgcaaagtcttcacctgcagaggagcaccgagaatgtaaacaaactccctgagctgtccagctttggtaagccttcatctagcgtgcaggggaccgggttgataagagatgccaatcagaatttcggaccatcatacaatcaaggccagaccgtcaacctgagccttgatctcactcacaataatggaaagttcaacaatgactctcacagtccgaaggtgtcgtcccagaacagaacgcgaagcttcggacatttccctggcccagagttcctggacgtagaaaaaacctccttctcacaggagcagagctgtgacagtgcgggagaaggatctgaacgaatacaccaggattccgagtctggggatgaactttccagtagctctacagagcagatcagagctactactccccccaatcaggggcggcctgatagtcctgtgtatgctaacctccaggagctgaaaatcagtcagtcggccctgccaccactgcctgggagtcccgcaattcagataaacggagaatgggagacgcacaaagattcgagcgggagatgctactactacaacaggggcacacaggagaggacatggaagcctccacggtggacaagggatgcttccatctcaaagggtgatttccagaaccccggcgaccaggagtggttaaagcacgtcgacgaccaggggcgtcaatactactatagcgcggatggaagcaggagtgagtgggaactccctaaatacaacgccagttctcagcagcagcgtgagattattaagtctcggtcacttgacagaagactccaggaacccatcgtattaaccaagtggcggcactctacgatcgttctggataccaatgacaaggaaagccctaccgcctccaaaccctgtttccccgagaacgaaagcagcccaagcagccccaagcaccaagacaccgaccaagagaaatacgggctcctgaatgttaccaagatagctgagaacggcaaaaaagtgcggaagaattggcttagctcatgggccgttctccaaggaagctccctgctttttacgaaaacccaaggatcctctactagctggtttgggtccaaccagtctaagccagagttcaccgtggatctcaaaggcgccaccattgagatggcatcaaaagataagtcttccaaaaaaaacgtcttcgagttgaagactaggcagggaaccgaactcctgatacagtccgataatgacacagtaattaacgattggtttaaggtgctctcttcaaccattaacaaccaagctgtcgagacagacgaaggaatcgaagaggagattcctgactcacccggtattgaaaagcatgacaaggagaaggaacagaaggaccctaagaaactccgctcattcaaggtcagcagcatagactcatctgaacagaaaaagaccaagaaaaatctcaagaagttcttgacacgaaggcccactctacaagctgtccgggaaaaagggtacatcaaagatcaggtgtttggaagcaatctggctaacctgtgtcagagggaaaatggaacagtccctaaattcgttaagctctgtatcgagcacgtggaggaacacggcctcgacatcgatgggatataccgcgtgagcggcaatctggccgtgatccagaagctgagattcgctgttaatcatgatgagaagctagatctgaatgactccaagtgggaggacatccatgtgatcaccggagctttaaaaatgttctttagagaactgcctgaaccattatttacttttaatcactttaacgatttcgtgaatgcaattaaacaggagcctcgccaacgggtagcggcagttaaggatctaattcgccagctgcccaagccaaatcaagacaccatgcagatcctgttcaggcacctgcgtcgggtaatcgagaatggcgagaaaaaccgcatgacttaccagagcattgccattgtgttcggccccactttgctgaaacctgagaaagagaccgggaacattgctgtgcacaccgtgtatcaaaatcagattgtagagctcatcctgttagagctttctagcatatttgggcggtag

SEQ ID NO: 132472 - DNA, 2541 bp, Artificial Sequence
  Description of Artificial Sequence: Synthetic coding sequence
atgaagatggctgaccgaagtggtaaaattatccctgggcaagtctacatcgaggtggaatatgactatgagtatgaggccaaagacagaaaaatcgtaataaagcaaggcgaacggtacatactggtaaaaaagaccaatgatgattggtggcaagtcaagcccgacgaaaactccaaagctttttatgtccctgcccagtatgtgaaggaagtaactcgcaaagctctgatgccacccgtgaaacaggtcgccggcctacccaataactctacaaagatcatgcagagtctgcatctccagcggtctacggagaatgtcaacaaactccctgagctgagcagttttggtaaacccagctcatctgtccagggcacgggattaatccgcgatgcaaatcagaacttcggcccatcttacaaccaaggccagacagtcaacctttctctggacctgacccataacaacggcaaattcaataatgatagccacagcccaaaggtctcaagccaaaaccggaccagatcattcggccactttcccgggccagaatttctcgacgtagaaaagacgtctttctcacaagagcagtcttgcgattccgctggggaggggagcgagagaatccatcaggactcggagtcaggtgacgagctcagttctagtagtaccgaacagatccgtgccactactccacccaatcagggccggcccgactcccccgtctatgccaatctgcaggaactcaagattagccagagcgcactgccacccttgcctggcagtcccgccatacaaattaacggtgaatgggagacccataaggattccagcggccgctgctattattacaacagagggactcaagagcgaacgtggaagcctcccagatggacacgggacgcctctatctctaaaggcgacttccagaacccaggagatcaggagctgctttcatccgaggaaaattactactcaacgtcttacagccagtccgactcccagtgtggatctcctcccaggggttggtctgaggaactcgatgagaggggacatacactatacacatccgattataccaacgaaaagtggttgaaacatgtggatgaccagggaaggcaatattactattctgcagacgggagtcgctccgagtgggagctccccaagtataacgcaagctcacaacagcagagagaaatcatcaagtctagaagtttagaccgaaggttgcaggagcccattgtgttgactaaatggaggcattcgaccatagtgcttgatacaaacgacaaggagagtcctaccgccagcaagccttgcttccccgagaacgagagtagcccatcttccccaaagcaccaggacactgccagtagtcctaaggatcaggaaaagtacggcttgctaaatgtgacaaagattgctgagaacggaaagaaggtgagaaaaaattggttgagcagctgggccgtcttgcagggctccagccttctcttcacaaagacacaggggtcctcaacatcctggttcggatctaaccagagcaagcctgagttcaccgttgatcttaaaggcgccacaattgagatggccagtaaggacaaatcaagtaagaagaacgtgtttgagctgaaaaccaggcagggcacggagttgctgatacagagcgacaacgatacagtcatcaatgattggttcaaggtactgagtagcactatcaataatcaggctgtggagaccgatgagggaatcgaggaggaaattccagattcacccgggatagagaagcacgacaaggagaaggagcagaaagacccgaagaaactccgatcttttaaagtgtcaagcattgatagttcggagcaaaagaagacgaaaaagaacctcaagaaattcctaacacgaaggccgactctgcaagctgtgagagagaaggggtatatcaaggatcaagtgtttggaagcaatctggccaatctatgccaacgagagaacgggactgtcccaaaatttgttaaactgtgtatcgaacatgtggaggagcacgggttggatattgacggaatctacagggtctcaggcaacctggccgtgatccagaaactgcgcttcgcagtgaatcatgacgagaaactggatctgaatgatagcaaatgggaagacattcatgtcattaccggtgctctcaaaatgttttttagggaactgccagagcctctctttacatttaatcatttcaacgatttcgtgaatgcaatcaagcaggaacctcgtcagcgcgttgccgccgtcaaagatttaatccgacaactcccgaagcctaatcaggacaccatgcaaatcttattccgacatttaagaagagtaatagaaaacggtgagaaaaaccgaatgacataccagagcattgcgatcgtctttgggcccacactgctgaagcccgagaaagaaacgggaaatatcgccgtacacacagtataccagaaccagattgtggagctcatcctgttagagctcagttccatttttgggcgctag

SEQ ID NO: 132473 - DNA, 2385 bp, Artificial Sequence
  Description of Artificial Sequence: Synthetic coding sequence
atgaagatggcagataggtccggtaagattatcccagggcaggtatatattgaagttgagtacgattacgagtatgaagctaaagatagaaaaatagtgatcaagcaaggagagagatacatcctggtcaagaagactaatgatgactggtggcaggtgaaacccgatgagaattctaaagcattctatgttccagctcagtacgtgaaagaggtgactagaaaagccttgatgcctcccgtgaagcaggtagcggggcttcctaacaattccactaaaatcatgcagagtctccaccttcaacgaagtaccgaaaacgtgaataaactccctgaactgagttctttcggcaaacccagctccagtgtgcagggcaccgggctgatccgagacgctaatcagaacttcggtccctcctacaatcaagggcaaactgtcaacctgtctctggatttgacccataacaatgggaaatttaataacgacagccacagccccaaggtcagctctcagaacagaacccgatctttcggccactttcctgggcccgagtttctggatgtggaaaaaacttctttttcccaggaacagtcctgcgatagtgcaggagagggaagtgaacggatccaccaggatagcgagtccggtgacgaattaagctctagctctactgaacagattcgagctacaaccccccccaatcaagggaggcctgattcccccgtgtacgctaacctgcaggaactcaaaatcagccagtccgcgctacccccccttcctggttcccctgccatacagatcaatggggagtgggagacccataaagacagctcaggacggtgttactattataatcgaggcactcaggagagaacttggaagccccccagatggacccgggacgcaagcatctcaaaaggagattttcagaacccaggcgatcaggaatggctgaagcatgtggatgaccagggcaggcagtactactatagtgcagacgggtctcgcagcgaatgggagttacctaagtacaacgcttcttcacagcagcaaagagagatcattaagtcacgctctctcgacagaagacttcaagaaccaattgtactcacaaaatggcgccactccactatcgttctggatacgaatgataaggagtcaccaaccgcttcgaagccatgttttccagagaacgagagctccccctccagcccaaaacaccaggacaccgatcaggaaaagtacggactgctgaacgtgaccaaaatagcagaaaatggaaagaaagtgcggaaaaactggctttcctcatgggctgtcttacaaggcagcagtttgttatttacaaaaacccagggctcttccacatcctggtttggcagcaatcagtccaagccagagttcacagtggacctcaagggagccaccatagagatggcttctaaagataagtcaagcaagaagaatgttttcgagctcaaaactagacaggggaccgaactcctgatacagtccgacaacgatacggtcatcaacgattggttcaaagttctgtcaagcaccattaataatcaggctgttgaaacagacgaaggaatcgaagaggagatcccggatagcccgggcatcgaaaaacacgacaaggagaaggaacaaaaagaccccaagaagctccggagcttcaaagtatcgagtattgactctagcgaacagaagaaaactaaaaaaaacctcaagaaatttttgactcgtagacccactttgcaggccgtgcgcgagaagggatatattaaggaccaggtcttcgggagtaacctcgcaaacctgtgtcagcgtgagaacggaacagtcccaaaattcgtaaaactttgcattgaacatgtcgaggaacatggtcttgacattgatggcatttacagagtgtctggaaatctggccgtgattcagaaactgcgtttcgccgtcaatcacgacgagaaacttgacctaaacgattcaaagtgggaggatatccatgtgatcaccggtgctttgaaaatgttcttcagagagctgcccgagcccctgtttacatttaaccacttcaatgatttcgtcaacgctattaagcaagaaccaaggcagagggttgccgctgtgaaagacctcatacggcagctgcccaagcccaatcaggataccatgcagatccttttcaggcaccttagacgtgtcatcgagaacggcgaaaagaacagaatgacttaccagtctatagctatcgtgtttggcccaactctgctgaagcccgaaaaagagacgggtaacatcgccgtccacaccgtgtatcagaaccagatagtcgagctcatcttgctggagctaagcagtatttttggacgttag

SEQ ID NO: 132474 - DNA, 2451 bp, Artificial Sequence
  Description of Artificial Sequence: Synthetic coding sequence
atgaaaatggccgataggtcaggtaagataatccccgggcaagtatatatcgaagttgagtacgactacgagtatgaagctaaagaccgcaaaatagtaatcaaacagggcgaaaggtacatacttgtaaaaaaaactaacgatgactggtggcaggtcaagcccgatgaaaacagtaaagccttctatgtgccagcccagtacgtgaaagaggtgacacgaaaagcactgatgccacccgtcaagcaggttgcgggcttgcccaacaacagcactaaaataatgcagtctctgcatctgcagcggtcaaccgaaaacgtaaacaagctccccgagctgtcgtcttttggcaaacctagttctagtgtgcagggcacaggcctgattagggatgccaaccagaacttcggcccgagttataaccagggacaaacggtaaacttaagcttagacctaacacacaacaacggcaaatttaataatgacagtcactcaccgaaggtcagctctcagaatcgaaccaggtcgtttggccatttccccggtccggagtttctcgacgtggagaagacaagctttagccaggagcaatcctgtgactcagccggggaaggctccgagagaatacatcaggactcagagtccggcgacgaactcagctcttcctccactgagcagattcgagctaccacaccgcccaaccaggggcgacctgattcaccggtctatgcaaacctgcaggagctgaaaataagtcagagtgcccttcctcccctccccggcagccccgcaatccaaataaatggtgagtgggagactcacaaagacagttcagggcgctgctattactataacagaggaacccaggagaggacctggaagccacctcggtggacgagagatgccagtatttccaaaggggacttccagaacccaggagaccaagagttgttatccagcgaggaaaattactatagcacttcatacagtcaatctgattcccagtgcggatctcctcccaggggatggagtgaggagctagatgagcggggccacaccctttacacatccgactacacaaacgagaaatggctgaagcacgtcgatgatcaggggcgacagtactactacagtgccgacggcagcaggtctgaatgggagcttcctaaatataatgcctccagtcagcagcagcgagaaattatcaaatctaggtccctggaccggcgtctccaagaaccgatcgtgctgactaagtggaggcactcaaccatcgtcttagataccaatgacaaggaccaggagaagtatggccttctgaatgtgaccaagatcgcagagaacggaaagaaggtgcggaaaaactggctcagctcttgggccgtgctgcagggatcaagtctgttgttcaccaaaacacagggcagctcgacctcttggtttggaagtaatcagtccaaaccggaatttactgtggatctgaagggggctactatcgaaatggcctcaaaagataaatcctccaagaaaaatgtattcgagttgaagaccaggcagggaacagagctactcatacagtccgacaacgacacagttataaacgattggtttaaagttctgtcttctaccattaacaatcaagccgtcgagacggatgagggcatcgaggaggagatccccgacagtcccggcattgagaaacacgacaaggagaaagagcagaaggatccaaagaaactccggtccttcaaggtgtcgtctattgattcatctgagcaaaaaaagaccaaaaagaatttgaagaagtttttaacccgacgacccacattgcaggccgtgcgtgaaaagggctacataaaagatcaggtctttgggtctaacctggcgaatttgtgtcagcgcgagaacggcacggtaccaaagtttgtgaagttatgcattgaacacgttgaggagcatgggcttgatatcgatggcatatatagggtaagcgggaatttagccgtgattcagaagcttaggtttgcagtgaatcacgacgagaaacttgacctgaacgattccaagtgggaagacatccatgtgattaccggcgcactgaagatgttctttcgcgaactacccgaacctctctttactttcaatcattttaacgactttgtgaacgccataaaacaggagccgcgtcaacgggtggcagccgtaaaggacttaataaggcagctgcctaagcccaatcaggacaccatgcaaatcctgttcaggcatcttcgccgggtgattgagaacggggagaagaaccgaatgacataccagtcaatcgccatcgtattcggacctacgctgctgaagcccgaaaaggagaccggaaacatagccgttcatactgtgtaccagaatcagatcgtcgagcttatcttactcgagctgtcttctatattcggccgctag

SEQ ID NO: 132475 - DNA, 2526 bp, Artificial Sequence
  Description of Artificial Sequence: Synthetic coding sequence
atgaagatggccgaccgctccggtaagatcattcccggtcaggtatatatcgaggtggagtatgactatgagtatgaggcgaaggacaggaaaattgtgattaagcagggggaacggtatatcttagtgaagaagacgaatgacgattggtggcaagtgaaacccgacgagaatagcaaggccttctacgtgcctgctcagtacgtgaaggaggttacccgaaaggccctcatgccccctgtcaagcaggtcgctggccttcctaataattctactaagattatgcagagcttgcatttacagagatcaaccgaaaatgtaaacaaacttccagaactgagttccttcgggaagccatcttcttctgtgcagggcaccgggcttattagagacgctaatcagaacttcggcccctcgtacaatcaggggcagaccgtaaatctcagtctggacctcacgcacaacaatgggaagttcaataacgattctcacagccctaaggtctcgtcacagaataggactagatctttcggacactttcctggccccgagttcctggatgtcgaaaagacaagcttctctcaggagcaatcatgtgattctgcaggtgaagggtccgaacgaattcaccaggactctgaaagcggagatgaactaagcagcagttctaccgaacaaatccgcgccacgacacctcctaaccagggccgacccgatagccccgtgtacgccaatctccaggaactgaagatttctcagagcgctcttcctcctcttcctggctctccagctattcaaatcaacggtgagtgggagacgcacaaggactcaagcgggcgatgctattactataaccgcggtacgcaggaacggacctggaagccccctagatggacgcgcgatgctagtattagtaagggggactttcagaaccctggcgaccaagaattgctttcctcagaggagaactattacagcacaagctattctcagtcagatagccagtgcggcagccctcctaggggctggtccgaggagttggatgaaagaggccataccctctatacctccgactataccaatgagaaatggctgaagcacgttgacgaccagggaagacagtattactactccgctgatggatccagaagcgagtgggaattgcccaaatacaacgccagtagccaacagcagagggagattatcaaatctcgctctctcgatcgccgcttgcaggagcccattgtcctgaccaaatggagacactctacaatcgtgctggataccaatgacaaggagtcacctacagcctctaagccttgttttcctgagaatgaatcttcaccttcctcgccaaaacatcaggataccgatcaagagaagtacggcctgttaaatgtcaccaagatcgcagaaaatggaaagaaggtccgtaagaactggctttcttcatgggccgtgttacaaggctcaagtctgcttttcaccaagactcagggcagcagcacaagctggtttgggtcaaatcagagcaaacccgagttcaccgtggacctgaagggggcaaccatagagatggctagtaaggacaaatctagcaagaagaacgtttttgagctcaagacccgccagggcaccgagctcctcattcagtcagacaacgacactgtcatcaacgattggttcaaagtgctcagttcaacaattaacaaccaggcagtcgaaactgacgaagggatagaggaagagatacctgattctcctggcatcgaaaaacatgacaaagagaaggagcagaaagaccctaagaagctccgcagcttcaaggtgtcatcgatcgattcctcagagcagaagaagacaaagaagaatctgaagaagtttttaactcggaggcccaccctgcaggctgtgagggaaaagggatatattaaggatcaagtgtttggatctaatctagctaatttgtgtcagagagagaatggaacggtccctaaatttgtgaaactttgcattgagcacgttgaggagcatgggttagatatcgacgggatttatcgcgtctccggtaatcttgcggtgatccagaagctgagatttgcggtgaaccacgacgagaagttagacctgaacgacagcaagtgggaggacattcacgtgatcactggtgccctgaagatgttcttccgtgaacttcccgaacctttgtttacatttaaccactttaacgactttgttaatgctattaaacaagaaccgcgccagagagtcgcagcagtgaaagacctgatacggcagctgccgaagcccaatcaggacacaatgcagatccttttcaggcatctgagaagagtcatcgaaaacggggagaaaaacagaatgacctaccagagcatcgcaatagtgttcggccctacgctattgaaacccgagaaggaaactgggaacattgctgtccataccgtctatcagaaccagatagtggaactcatcctgcttgagttgtcttctatttttggcagatag

SEQ ID NO: 132476 - DNA, 591 bp, Artificial Sequence
  Description of Artificial Sequence: Synthetic coding sequence
tgaagcactagctattctcagtccgatagtcaatgtggaagtccaccgagagggtggagtgaggagttggatgaacgtggccatactctgtacacaagtgattatactaacgagaaatggctcaagcacgttgatgatcagggtcgccaatattactatagcgctgatgggtctcgcagcgaatgggaactgcctaaatacaacgcctcttcacagcaacagagggagatcatcaaatcccgctcgcttgaccgaaggctccaagagccgatagttctgacaaagtggaggcacagcaccatcgtactggacaccaacgacaaggagagccctacagcatccaaaccgtgctttccagagaacgagtcgagcccttccagtcctaaacatcaggatacagatcaggagaaatacggccttctcaatgtgaccaaaattgccgagaatggaaaaaaagtgaggaaaaactggctctcatcctgggcagtgctccagggaagctctctgctttttaccaaaacccaggggtcttccacgtcttggttcggcagtaatcagagcaagcctgaatttactgttgacctaaagtag

SEQ ID NO: 132477 - DNA, 2646 bp, Artificial Sequence
  Description of Artificial Sequence: Synthetic coding sequence
atgaagaagcagttcaatcggatgaaacagctggccaaccaaactgttgggcgagcggaaaagactgaagtcctgtccgaggaccttctgcagatagagaggagattggatactgtgagaagtatctgccaccatagccataagcggttagtcgcttgcttccagggacagcatggaaccgatgctgagagaaggcataagaaactgcctttaacggcactggcacagaatatgcaggaggcctcgactcagcttgaagactctctgttaggtaagatgcttgaaacctgtggcgacgccgagaaccaattggcccttgagttgagtcaacatgaagtcttcgttgagaaagagatcgtcgatcccctgtacggtatcgcggaagtagaaattccaaacatccagaaacaacgcaaacagcttgctcgtctggtgctcgattgggatagtgttcgcgcaaggtggaaccaggcacacaagtcatccggcacgaacttccaaggactgccctccaaaatcgacaccctcaaggaagagatggacgaggccggtaataaagtggagcagtgcaaggatcaattggctgctgatatgtacaatttcatggccaaggagggcgagtatggcaaatttttcgttacactgctggaggctcaggcagattaccacagaaaggccctggcagtgttagagaaaaccctgcctgaaatgagagcccatcaggataagtgggcggaaaagcccgcctttgggacgcctctagaagaacatctgaagcggtcagggcgggaaatagcccttcctatcgaagcttgcgtcatgctgctgctggagacagggatgaaggaagaggggctttttcgtatcggtgccggcgcctccaagttaaaaaagttgaaagccgccctggactgcagcacaagccatctggacgaattttatagcgacccccacgcagtggctggcgccctaaagtcatacctgcgcgagttgccggagcccctcatgaccttcaacctctacgaggagtggacacaggtagcctccgtgcaggatcaggataagaagctgcaagacctctggcgcacatgtcagaaactccccccacaaaatttcgttaacttccggtacctcatcaagtttctggccaaactcgctcaaaccagcgatgttaataaaatgacacccagtaacatcgcaatagttcttggacccaatctgctgtgggcccgaaatgagggcacgctcgcagagatggcggccgcaactagcgtgcacgtggtagctgtcattgagcccatcatccagcacgctgattggttttttccggaggaagtagagtttaatgtttccgaagcatttgttcctttaaccaccccttcatctaaccactccttccacactggcaatgattcagactcaggaacactcgaacggaagcgtcctgcttccatggctgttatggagggggatctggtgaaaaaggagagtttcggggtgaagttgatggactttcaggctcaccgccggggggggaccttgaacagaaaacatatcagtccggcgttccaacctcctctccctcccacagacgggtctaccgtagtgcctgccggaccagaacccccaccccagtcctctcgggcagaaagctcctctggcggaggaacggtgccgtcgtcggctggaatcctggagcagggacctagtcccggcgacggctcaccccctaaacccaaggatcccgtgtccgcggctgtccccgccccaggaagaaataactcccagattgcatccggccagaaccagccccaagccgcagccggcagtcatcagctgtctatgggacagccccacaatgccgctggcccgtctcctcatacccttagaagagctgtcaaaaagcctgcacccgctccacccaaacccggcaatccgcctcccggccacccaggcggacagagctctagtggcacctcacagcatccacccagtctctcgcccaaaccaccaacgcgctcgccttctccaccaactcagcacacgggacaacctcccggccagccttctgctccctcgcagctgtcagcccctcgccgttacagttcctctctgagtcctattcaggcaccaaaccatccgccaccacaacccccaacccaggccactcctttgatgcacacgaaacctaattcacaaggcccacctaaccctatggccctgccatctgagcatgggcttgagcagccttcacacacacctccacaaacccctactccaccatctactccgccactcggcaagcaaaatccatctctgccagccccccagaccctggctggcggaaaccccgagactgctcagccgcacgcaggtactctgcccagacctcggcccgtgccaaagcctaggaatcgcccctctgtgcctcccccaccgcagccgcctggggttcactctgcaggcgattcctctctgactaacacagctcctaccgcctcgaaaatcgtgaccgactcgaacagccgggtttctgaaccacaccgctctatatttcccgaaatgcactccgactccgcatctaaagatgtgcccggtcggatacttctggacattgacaacgataccgaaagtactgctctgtag

SEQ ID NO: 132478 - DNA, 2412 bp, Artificial Sequence
  Description of Artificial Sequence: Synthetic coding sequence
atgaagaagcagtttaatagaatgaagcaactggcaaaccagaccgtgggccgagcagagaagactgaggtactgtcggaagacctgctccagatagagcggaggctggacacagtgcgatccatttgccatcatagccacaagagacttgttgcctgttttcagggtcagcatggcactgatgccgaacgcaggcataagaagttgccacttacagcattggctcagaacatgcaggaagcgtctacccagttagaggactctctgctggggaagatgctggagacatgtggagatgctgagaatcagcttgccttagaactgtcccagcatgaggtattcgttgaaaaggagattgtggatccactgtacgggatagctgaggtcgagatcccgaacatccaaaagcaacgcaagcagctagcgagactggtcttagattgggatagcgtgcgcgcccgttggaatcaggctcacaaaagctctggaactaatttccagggtcttcctagtaagatcgataccctgaaagaggagatggatgaagccggcaataaagtagaacagtgcaaggatcaattggccgccgatatgtacaattttatggctaaggaaggcgagtatgggaagttctttgtcactttgttggaggcacaagcagattaccacaggaaagctctggccgtcttggagaagacattgcctgagatgagagctcaccaggacaagtgggccgagaaaccagccttcggcactcccctggaggagcacttaaaacgcagtgggcgagagattgctctgcccattgaagcctgcgtgatgctgctcctggagacggggatgaaggaggaaggcctctttcgtatcggcgctggggcgagcaaactgaagaagctaaaggcagcactagactgcagtaccagccacctggacgagttttattctgatccccatgcggtggcaggagctttaaagtcatatctccgagaacttcccgaacctcttatgactttcaacctttatgaagaatggacacaggtggcttcagtccaggatcaggacaaaaagctgcaggatctctggagaacatgccaaaaattgcccccgcagaatttcgtgaactttagatacctcattaaattcctggccaagctagctcagaccagtgacgtgaataagatgactcccagcaacattgcaattgtactgggccccaacctgctctgggcgcggaacgagggcactctggcagagatggcagctgcgacatcagtacacgtggtggcagtgattgagcccatcattcaacatgcagactggttcttccctgaggaagtggaatttaacgtcagcgaggcgttcgttccgcttactactccttctagtaaccactcatttcataccgggaatgacagcgatagcggcactttggagcgtaaaaggccggcaagtatggcagtcatggagggggaccttgtcaagaaagaaagccctccaaagcctaaggaccccgtctcagccgccgtgccagcgccgggcagaaacaatagccagatcgcatctggacaaaaccagccccaggccgcagctggcagccaccagcttagtatgggccagccacataatgccgcgggtccgagtccgcacacccttcgtagagctgtgaagaagcctgcacccgccccgccgaagccaggcaacccacccccagggcatccaggcgggcagagctcgagcggaacttctcaacatccaccaagcctgtccccaaaacctcctacacggagcccatctccgcccacccaacatacgggtcagccacctggtcagccctcggctcctagccagctcagcgcccctaggcgctactccagtagcctgtcacccattcaggcgccaaaccaccctccacctcagccaccaacccaagctacacccttgatgcatactaagcccaattctcagggaccacccaatccgatggccctcccatctgagcacggcctggaacaaccctctcatacgccaccccaaactccaacgcctccctcaaccccacccctgggaaaacaaaatccctctctgccagcgccacagaccttggcaggtggaaatccggaaactgcccagcctcacgccggaacccttccgaggcccaggcctgtccccaaaccaaggaatcgtcctagtgtgcccccgccaccccagcccccaggagttcatagtgccggggactctagcctaactaacaccgctccaacagcctcaaagatcgtgactgattccaattcgcgagtttcagaaccccaccggagcatttttcccgagatgcacagtgatagcgcaagcaaggatgttccaggtcgtatcctcttagatattgacaacgatactgagtccaccgcactgtag

SEQ ID NO: 132479 - DNA, 681 bp, Artificial Sequence
  Description of Artificial Sequence: Synthetic coding sequence
atgaagaaacagttcaacaggatgaaacagctggcgaatcagacagttggacgcgccgagaaaacagaagtgctgagcgaggatcttctgcagatcgaaagaaggcttgatacagtgcgatccatatgccaccactcacacaagaggttggtcgcatgctttcagggacagcatgggaccgatgcagagcgaaggcacaaaaagcttcccctaacagcccttgcacagaacatgcaggaggcaagtacgcagctcgaggatagcctcctaggcaaaatgctggaaacttgtggcgatgccgaaaatcagctggcactggaactgtcccaacacgaggtgttcgtggagaaggagatcgtcgaccctctgtacggaatcgcagaagtcgagatccccaacattcagaaacagagaaagcaacttgcacgacttgtgctggactgggacagtgttcgcgctagatggaatcaggcacacaaatcctccggtaccaacttccagggactgccttcgaaaattgatacactcaaagaggagatggatgaggccggcaataaggtggaacagtgcaaagaccaacttgcggccgacatgtacaatttcatggcaaaggagggcgaatacggtaaattctttgtgactatttcagggcgcaaaaatcagcccctgggcctcccctag

SEQ ID NO: 132480 - DNA, 2523 bp, Artificial Sequence
  Description of Artificial Sequence: Synthetic coding sequence
atgaagaagcagttcaataggatgaagcagctggctaaccagacagtgggaagagccgagaaaactgaggtgttgagtgaggaccttcttcagattgagaggagactggacacggttagaagcatttgccaccacagtcacaagcgattagtcgcctgcttccagggtcaacatgggactgatgcagagcgcagacacaaaaagctgcccctgaccgccttagcacagaacatgcaggaggcgagcacacagttggaggattctttgctcggaaaaatgctggagacatgtggggacgctgaaaatcagctggccttggaactgagccagcatgaggtgttcgtggaaaaagagattgttgacccattgtatggtatcgctgaagtggagatcccaaacatccagaaacaacgaaagcagctcgcccgcctcgtcctcgactgggattctgtgcgagcccgctggaaccaagctcataaatcgtcagggactaattttcagggtttgccgagcaagattgatacactgaaagaagagatggatgaggcaggtaacaaagtcgagcagtgcaaagatcagttggccgcggacatgtataatttcatggcgaaagaaggggagtacggaaaattctttgtgaccctgctggaagcacaggcagattaccacaggaaagctctcgccgtcctggagaaaaccctgcctgaaatgagagcacaccaggacaagtgggcagaaaaaccagccttcggcaccccgttggaggagcacctgaaaaggtccggacgtgagattgctttacccatcgaggcttgcgtgatgttgctgcttgaaaccggcatgaaggaggagggcctctttcgtataggagcaggggcctctaagctcaagaagctgaaagccgccctcgattgttcaaccagtcacctggacgagttttattccgacccacacgcagtagcaggggccctaaagagctatctgcgcgaactacctgagcccctaatgacgttcaatctgtacgaggaatggacgcaggttgcgagtgtgcaagatcaggataaaaaactgcaggacctgtggcgcacttgccaaaaactcccaccccagaactttgttaatttccgatacttgataaagttcttggctaaactcgctcaaaccagtgatgttaataagatgaccccgtcgaacatcgccattgttctcggaccaaatttactatgggctcgcaacgagggcaccctggcagaaatggcagctgcgacctccgtgcacgttgtggctgtgatagaacccataattcagcatgctgactggtttttccccgaagaagtggagttcaacgtctccgaagcgttcgtgcccctaaccaccccatcctcaaatcactccttccacactggtaatgattcggactctgggactttggagcggaaaaggccagccagcatggctgtgatggagggggatttggttaaaaaggaatctttcggtgtaaagctcatggattttcaggctcaccggcgtggtggcaccctgaacagaaaacatatttcccctgccttccagccccccctgccaccaaccgacgggagcaccgtggtgcctgcgggccctgaacccccaccccaatcctctcgagctgagagtagctcgggtggcgggaccgttccaagctcagctggaattcttgagcagggccccagccctggggacggcagtccccctaagcctaaagatccagtatcagccgcagtccccgctccaggacgcaacaactcccagatcgcctccggccagaaccagccacaagcagccgccggatcacatcagttgtctatgggccagccccataacgccgccggcccttccccacatacactgcgaagggcagtcaaaaaaccagcacccgctccaccgaagcctggcaatcctccccctgggcaccccggtgggcagtcatcgtctggaacttcacaacatccgccctccctttcccctaagccaccgactagatcccccagtccccctacccaacacaccggccagccaccaggacagccctcagcccctagccaactgtctgctccaaggaggtactcctcaagtctgagtcctattcaggctccaaaccacccccccccccagcctcctactcaggccacacctcttatgcacactaagccaaactcacagggacccccgaaccctatggctcttccatccgagcacgggcttgaacagccctcccacactcccccacagacccctacgcccccctctacaccaccccttggaaaacagaatccgtccctccccgccccacagacgttggcaggaggcaatccagaaactgcccagcctcatgccggcactttgcccaggcccaggcccgtgcctaaaccgcggaataggccatcggtgccaccgcctcctcagccacctggcgtgcacagtgccggagattcatctcttaccaacaccgcacctaccgcaagcaaaatcgtgaccggggtctag

SEQ ID NO: 132481 - DNA, 1992 bp, Artificial Sequence
  Description of Artificial Sequence: Synthetic coding sequence
atgtcttggctgagctctagtcagggcgtagtcttgacggcctaccaccctagtgggaaggatcagaccgtcggcaactctcatgcgaaggcaggggaagaagccacatcttctcggaggtacggccagtacacgatgaaccaggagtcaaccacaataaaggtgatggagaagccaccattcgatcgctcaatcagccaggacagtcttgatgaactcagtatggaagattactggatcgaactggaaaatattaaaaagtcctccgagaactcccaagaagaccaggaggtggtggtcgtgaaagaaccagatgaaggagaactggaagaagagtggctcaaggaggccggcttgtctaatctgttcggggaatctgccggagatcctcaggagtcaatcgtgttcctgagtacattaactcgcacgcaggccgctgctgttcaaaagcgcgtggaaacggtgtcccagaccctacgcaagaaaaacaaacaataccagatccctgacgtgagggatatatttgcccagcagcgggagtcaaaggagactgcaccaggtggcactgaatcccaatcattaaggaccaatgaaaacaaatatcaagggcgcgatgacgaggcgtccaatttggtgggtgaggaaaaactcatccctcccgaggaaacgcctgccccggagaccgacatcaacttggaagtgagtttcgcagagcaggccctgaaccagaaggagtcctcaaaggagaaaattcagaaaagtaaaggtgacgatgctacactccccagcttccgccttccaaaggacaagactggcacgactcgcattggcgacctggctcctcaggacatgaagaaggtttgtcacctggctttgatagaattgacggcgctatacgatgtgcttggaattgaactgaagcaacagaaggcagtgaagattaaaacaaaagacagtgggttattttgcgtcccgctgaccgccctcctggaacaagaccagaggaaggtgcctgggatgcgcattccgctcatcttccagaagctgattagtcgaattgaggaaaggggactggagaccgaaggactcttacgcatcccgggagcagccatccggattaagaacttatgccaggagctggaagccaaattttacgagggcacatttaattgggagtctgtgaagcagcacgacgcggcctcactacttaagctgttcatcagggagcttcctcagcccctattaagcgttgaatacttgaaggccttccaggccgtccagaatctgcccacgaaaaaacagcagctgcaggcgctgaacctgctcgtcatcctcctgcccgacgctaatcgggatacgctcaaggccctgctggagtttttgcagcgcgtcatcgataataaggagaaaaacaaaatgaccgtgatgaatgtcgccatggttatggctcctaacctgttcatgtgccacgcactggggctgaagtcttcggaacaacgcgaatttgttatggccgccgggaccgctaacactatgcaccttctcatcaagtatcaaaagttactctggaccattccaaaattcattgtcaatcaggtgaggaagcagaacacagaaaaccataagaaggacaaaagggctatgaagaagcttctgaagaagatggcttatgatcgggaaaaatatgaaaagcaagataaaagcactaatgatgccgacgtgcctcagggggtgatccgcgttcaggcccctcacctgagcaaggtgtcaatggcgatccagttaacagaagagctgaaagcctccgacgttctcgcgcggttcctttctcaggagagcggtgtggcccaaacactcaaaaagggcgaagtgtttttatacgaaatcggcgggaacattggcgagagatgtctggacgacgatacatacatgaaagacctttaccagctgaatcctaacgccgagtgggtcattaaaagtaaaccactatag

SEQ ID NO: 132482 - DNA, 1857 bp, Artificial Sequence
  Description of Artificial Sequence: Synthetic coding sequence
atgaaccaagagagtaccacaatcaaggtcatggagaagcctccttttgacaggtcgatatcacaagatagtctcgatgagttgtctatggaggactactggatagagttggagaacatcaaaaagagctccgagaacagccaggaagaccaggaagtggtggtcgtcaaggaacccgatgagggcgaattggaagaggaatggctgaaagaggcaggtttgtcaaatctcttcggggaatccgccggggacccccaggaaagtatcgtgttcctgagcactctgacaaggacacaggctgctgcagtccaaaaaagagtcgagacggtgtctcagaccctgcgcaaaaagaacaaacagtaccagatccctgacgtacgcgacatatttgctcagcaaagagagagcaaggagactgcccctgggggcaccgagagccagtccttaaggaccaacgagaacaagtaccagggtcgcgacgacgaggcgagtaatctggttggcgaggaaaagctcattccccccgaagagaccccagcgccagaaacggatatcaacctggaagtgagctttgccgagcaagcccttaatcaaaaagagtccagcaaagagaagatccagaagagcaagggcgatgacgctaccctccccagttttcgtcttcccaaggacaaaacaggcaccacgagaatcggagatctggcacctcaggatatgaaaaaagtgtgtcaccttgcactaatcgaactcactgcgctctacgacgtcctgggtatcgagctaaaacagcagaaggctgtgaagattaaaactaaggattccggtctgttttgtgtgcctctgactgccctcctggagcaggatcagagaaaggttccaggcatgcggatacccttgatttttcaaaaactgatttcacgtattgaagagcggggcttagagacagaaggtcttctgcgtatcccgggggctgcaatcagaatcaaaaacctgtgtcaggaactggaggctaagttctatgaaggcaccttcaattgggagagtgtgaagcaacatgatgcggcgtcgctgcttaagctgttcattagagagttgccccaaccactgctgtctgtggaatacctgaaagctttccaggcagtgcagaatttgccaactaagaaacagcaactacaggctctcaatcttttggtgattttgctgcctgacgcgaaccgagataccttgaaggcactgcttgaattcctgcagcgggtgattgataacaaggagaaaaataagatgaccgttatgaatgttgctatggtcatggcccccaacttgttcatgtgccatgctctgggtctgaaatcatctgagcaaagggagttcgtgatggcagccggaacagcaaacacaatgcatcttctgattaagtaccagaagttgctctggactatccctaaatttattgtgaaccaggtgagaaaacagaatacagagaatcacaagaaagataagcgcgccatgaaaaagctgctcaagaagatggcttacgatagagaaaagtacgagaaacaggataaatccactaatgacgctgacgtacctcaaggcgtgatcagggtacaggcgcctcatctgtccaaggtgtccatggccatccagcttactgaggaattgaaggcatctgatgtactcgcacggttcctgagccaagaaagcggcgtggctcagacgctgaaaaagggcgaggtgttcctctatgaaatcggcggcaatatcggagaaagatgcctcgatgacgacacatacatgaaggacctttaccagctgaacccaaatgccgagtgggtgattaaaagcaaacctctctag

SEQ ID NO: 132483 - DNA, 1485 bp, Artificial Sequence
  Description of Artificial Sequence: Synthetic coding sequence
atggcaacagaagctcagagcgaaggcgaagtgcccgcgcgcgagtccggcagatccgatgcaatatgctctttcgtgatatgtaatgattccagtttacggggacagcctatcatttttaatcccgacttctttgtggagaaactgcgacatgagaagccggagatctttacggaattggtcgtgagcaatatcactagactcatcgacctgcctggcactgagctcgctcagcttatgggggaagttgacctaaaacttccagggggggccggccctgcaagtgggttcttccggtctcttatgtcactaaaaagaaaggagaagggagtgatttttggctcgccattgaccgaggagggtatcgcacaaatctatcaactaatcgagtatctgcacaagaacttgagagttgaggggctgtttcgtgtgcccggcaatagcgtccggcagcagattctccgggacgctttgaataatggaactgatattgatttggagtctggagagttccattcaaatgacgttgctaccctgcttaagatgttcctcggcgagctgccagagcctctgctaacacataagcactttaatgctcatttgaagatcgccgacctgatgcagttcgacgacaagggtaacaagactaatatccccgacaaagacaggcaaattgaggcattgcaattgctctttcttatcctgcccccccccaatcgcaacctcctgaaactgctgctggacctgctctaccagacagcgaaaaaacaggacaagaacaagatgtcagcctacaaccttgctctcatgtttgcgcctcacgtcttatggcccaagaacgtaacagccaatgacttacaggaaaacattacaaaactcaattccggcatggcttttatgataaagcatagtcaaaaactgtttaaggctcccgcctacatccgtgaatgcgcccgcttgcactacttaggcagccgcacccaggctagtaaggatgatcttgatttaattgcgagttgccacacaaaatcctttcaactggctaagagtcagaaaagaaatagggtcgattcctgccctcatcaagaggagacacaacatcacactgaagaagctttgcgcgagctgtttcaacacgtgcacgatatgcccgagtctgccaaaaaaaagcagttgatcagacagtttaataaacagtcactgactcagacaccaggccgcgaaccctcaacctctcaggtccagaagagagctcgatcaagaagtttcagtggacttattaaaaggaaagtgctgggaaatcagatgatgagcgagaaaaaaaaaaagaaccccacccccgagtcagtggcaattggggagctgaaaggaacgtcaaaagagaatagaaatctgttattctctggcagcccagcagtcacaatgaccccgacacgattgaaatggagcgagggtaaaaaggagggcaagaaagtgttcctgtag

SEQ ID NO: 132484 - DNA, 1458 bp, Artificial Sequence
  Description of Artificial Sequence: Synthetic coding sequence
atgccacaccagaagctgtcggccttgatcgatgccatctgcagcttcgtcatctgcaacgatagcagcttaagaggccaaccgattattttcaatcccgacttctttgtggaaaagctgcggcacgagaagcccgaaatcttcacggagctcgtggtctcaaacattacacgcctgatagatttaccaggcacagaactcgcacagctcatgggtgaggtagaccttaagctgccgggaggtgccgggcctgcatcaggattcttccggagtctgatgtctttgaagagaaaggagaaaggagttattttcgggtcacctttgacagaagagggcatcgctcagatatatcagctcatcgagtatctgcacaaaaacctaagggttgaagggttgttccgtgtgcccggtaattccgttcggcagcaaatcctgcgagatgctcttaacaacggaacggatatcgacctagaaagcggggagtttcactcgaatgatgtggcaacattactcaaaatgttcttgggtgagctcccagaacccttactgacccacaagcattttaacgcccatcttaagatcgccgatctgatgcagttcgatgataaaggcaataagacaaatatcccagacaaagacaggcagatcgaagcactgcaactgttgtttctgattctgccgcctcctaatcgcaatctcctgaagctactgctagaccttctttatcagaccgccaaaaaacaggataaaaataagatgtcagcctataacctggccttgatgtttgctccccatgtactgtggcccaagaatgtaacagcaaatgacctgcaggaaaatattacgaagctgaactccggcatggctttcatgatcaaacacagccaaaaacttttcaaggctccagcgtacattcgcgagtgtgcacggctccattatcttggctcacggactcaggcctctaaggacgatttggatctaatcgcctcctgccacactaagtcctttcagctggcgaagagtcagaaaaggaatcgtgtggatagctgtccacaccaggaggagactcagcaccatacggaagaagcactgcgggaactctttcagcatgttcacgacatgccagagtctgctaaaaagaaacagctaattaggcaatttaataaacagagcctgacccagacacccgggcgtgagccgagcacaagtcaggtacagaaacgagccaggtctcgttcgttctctggtttgattaaaagaaaggtgcttgggaaccaaatgatgtctgaaaaaaaaaaaaaaaaccccacgcctgagtcggtcgcaattggcgagttaaaaggtacctcaaaggagaatcggaatttactattctccggatcccctgcggtgacaatgactcctacacggctgaaatggtcagaaggaaagaaagagggaaagaaggtttttctctag

SEQ ID NO: 132485 - DNA, 1398 bp, Artificial Sequence
  Description of Artificial Sequence: Synthetic coding sequence
atggccacagaagctcaatctgagggcgaagtcccagcccgggagagcgggaggtccgacgctatctgcagctttgtgatctgcaatgacagttcattgagaggacagcctattatcttcaaccccgatttttttgtcgaaaagcttcggcacgagaaacctgagatcttcacagagctggtggtatcaaatatcaccaggttaatcgatttgcccggaacggaactagcgcagctcatgggcgaagttgacctaaaattgccaggtggcgccggacccgcaagtggttttttcaggtcactgatgtccttaaagcggaaggaaaaaggagttatcttcggaagcccgctaactgaagaggggattgcccagatctatcagctgatagaatatctacataagaatctgcgcgtggaaggcctgtttcgcgttccggggaattccgtcaggcagcagatcctgagagatgcattgaacaacggcaccgatatcgacctcgaaagtggcgaatttcactccaacgatgttgctacactcctgaagatgttcctcggcgaactgcctgaacccctgttgacccacaagcacttcaacgctcacctgaaaattgctgacctcatgcaattcgatgacaaagggaataaaaccaatatccccgataaagatagacagatcgaggccctgcagctcttgtttcttatactcccccctccaaatcgcaatttactgaaactcttactcgatttactttatcagaccgccaagaaacaggataaaaataaaatgagtgcgtacaatctggccctcatgttcgctccgcacgttctgtggccaaaaaatgcccccgcgtatatccgagagtgcgcacgtctgcattacctgggcagccgcacccaggcctccaaggacgatctggacctgattgcctcctgtcacactaagtctttccaactggctaagtctcagaagcgaaaccgagtagacagttgcccccatcaggaagaaactcagcatcacacagaagaagccttgagggagttatttcagcacgtgcacgacatgcctgaaagtgccaagaagaagcagctcattagacagtttaacaaacagtccctgactcagactcccggacgcgaacccagcacaagtcaggtacagaagcgtgcaaggagccgatccttcagcggtcttatcaagcggaaagtactcggcaaccaaatgatgtcggagaagaagaaaaagaacccaaccccggagagcgtcgccatcggagaattaaaggggacatcaaaggaaaataggaatctgctgttttctgggtcgcccgctgtgaccatgacaccaactaggctaaaatggtcggagggcaagaaggagggtaagaaggcttttgtatag

SEQ ID NO: 132486 - DNA, 1485 bp, Artificial Sequence
  Description of Artificial Sequence: Synthetic coding sequence
atggctacagaagcacagtccgaaggagaagtgcccgccagggagtccggtcggtcagatgccatttgcagcttcgtgatatgtaacgattcctctttgaggggacagccaatcatttttaatcctgacttctttgtagagaagctaaggcacgaaaagccggagatctttaccgagctggttgtcagcaacatcacccgcttaattgatctgccaggcacggagctggctcagcttatgggggaggtggacctcaagctcccaggcggtgccggacctgctagcggcttttttcggtctctgatgagtctaaagcggaaggaaaaaggggttatcttcggtagccccctgactgaagaaggaatcgctcagatttaccagttgatcgagtaccttcataagaacctgcgcgtggaaggactcttccgcgtcccaggcaatagcgtgcggcaacagatcctgagagacgcactgaataatggcacggacattgacctagaatcaggggagttccattccaatgatgtcgccacactcctgaagatgttccttggagagcttcctgagccattattgactcacaagcacttcaacgcccatctgaaaattgccgatctcatgcagttcgatgacaagggcaataaaacaaacattcctgataaggatagacagatcgaagctctacagctgctgttcctgattctgccaccaccaaacaggaatctgctcaaactgcttctggacttgctgtatcagaccgctaagaagcaggataagaataaaatgagcgcttacaacttggctctcatgtttgccccacatgtcctgtggccaaaaaacgtcactgctaatgatctacaagagaatattaccaagttaaatagtgggatggcctttatgataaagcatagtcagaaattattcaaagctcccgcctacattcgggaatgtgctcggcttcactacttgggctctagaacgcaggcttcaaaagatgacctggatttgatagcttcgtgccacactaagagctttcagttggccaagtcccagaaaaggaatagagtcgactcttgccctcaccaagaagagacccagcaccataccgaagaagctctgcgagagctgtttcagcacgttcacgacatgcctgagtctgcaaagaagaagcagctcatcagacagttcaataagcagagtttgacccaaacccccggcagagagccaagcacttcacaggtgcagaagcgggctagatcccgcagcttttccggcttgatcaaaaggaaggtgctgggtaatcagatgatgtccgagaagaaaaagaaaaatccaaccccagagtccgtcgctatcggcgaactgaagggaacgagtaaagagaacagaaacttgcttttttctggttccccagccgtgacaatgacccctacacgcctcaaatggagcgagggcaagaaggagggaaagaagggattcctgtag

SEQ ID NO: 132487 - DNA, 1458 bp, Artificial Sequence
  Description of Artificial Sequence: Synthetic coding sequence
atgccacaccagaagcttagtgctctcatcgatgcgatctgctccttcgtgatctgcaatgacagctccctcaggggtcaacccattatatttaaccccgatttttttgtggaaaaactgaggcacgagaagccggagatcttcaccgagttggtggtgagcaacattacaaggctcatcgacttgccggggaccgagttggcacagctgatgggtgaggtcgatctgaaactcccgggaggagctggtccagcatccgggtttttcaggtccctgatgtcactcaaaagaaaggaaaaaggggtaatcttcggatcgccattaaccgaggaaggtatagcccagatctatcagttgatcgaatatctgcacaagaatcttagagtggaagggctctttcgtgtgcccggcaattccgtccgacagcaaatcctccgggatgccctcaacaacggaacagacatcgatctcgagtcgggagagttccacagcaatgatgtagccacgctgctcaaaatgtttctgggtgagctacctgaacccttgctgactcataaacacttcaatgcccatctcaagatagccgacctgatgcaattcgacgacaaaggcaacaaaaccaatatcccagacaaagataggcagattgaggcgttgcagctgctctttctcattctcccacctcccaataggaatctgttgaagctcctcctcgacctgctgtatcagaccgcaaaaaaacaggacaaaaataagatgagcgcatacaacctggcccttatgttcgctcctcatgtgctgtggcccaaaaatgtgacagccaatgacctccaggagaacattacgaaattgaattccggaatggccttcatgattaagcattcccagaagctgtttaaggctccagcctacatccgggagtgtgcgcggcttcactaccttggttcccgaacacaggcctccaaggacgacctcgacctcattgcctcctgccacactaaatccttccaactcgctaagtcccaaaagcgcaacagggtcgacagctgtccacaccaggaggagacccaacaccacaccgaggaagcgcttcgagaattattccaacacgtgcatgacatgccggaaagtgcaaaaaagaaacagctgatcaggcaattcaataaacagtccctgacacagacacctggccgagagcctagcacctcgcaagtccagaaaagggctcgcagccgctctttctccgggctcatcaaaagaaaggtcctgggcaaccagatgatgagcgaaaaaaagaaaaaaaatccaacacccgagagcgtcgccataggtgagctcaagggaactagtaaagaaaatagaaatctccttttcagtggatccccagccgtaaccatgacccccactcggctcaagtggagtgaaggtaagaaggaaggaaaaaagggattcctatag

SEQ ID NO: 132488 - DNA, 942 bp, Artificial Sequence
  Description of Artificial Sequence: Synthetic coding sequence
atgtttctgggggaattaccagaacctctgctgacccacaagcatttcaacgcacaccttaaaattgctgacttgatgcagtttgacgacaaaggaaataaaacaaacataccggacaaagaccgtcaaattgaggcccttcagctgctgttcctaatcctgccaccccctaacaggaatctgctgaagttattgctggatttgttgtaccagacggccaagaagcaagataaaaataaaatgtctgcctataatctcgccctgatgtttgccccccatgttctgtggccaaaaaacgtgaccgcgaatgatctacaggagaacattaccaagctgaacagtgggatggcctttatgataaaacatagccagaagctgttcaaggcccctgcctatatcagggaatgtgcccgactccattatctcgggagtagaacacaagctagcaaagacgatctggatttgatcgctagttgccatacgaagtcttttcaattagcaaagtctcaaaagaggaatcgcgtggacagttgccctcaccaggaggagacacagcatcatacggaggaggcactaagagaactgtttcagcatgttcacgacatgccagaatcagccaagaaaaaacagctgatcagacagttcaataaacaaagcctgactcaaacacctggacgcgagcccagcacatcccaggttcagaagcgcgcaaggagccggtccttcagcgggctgatcaagcgtaaggtgttgggcaaccagatgatgtcagaaaagaagaaaaaaaatccaaccccagaatccgtggctattggagagctcaaaggtacatcgaaggaaaaccgcaacctgctgttttccgggagtcccgcggtcactatgactcctacaagactgaagtggtcagaagggaagaaggagggtaaaaaaggcttcctctag

SEQ ID NO: 132489 - DNA, 1554 bp, Artificial Sequence
  Description of Artificial Sequence: Synthetic coding sequence
atggcgaccgaggcacaatctgagggcgaagtacctgcgagagaatctggacggtccgatgccatttgctcttttgtgatctgcaatgattcctcactgcgcggacaacccatcattttcaacccggacttcttcgtggagaagctgagacatgagaagccagaaatttttacggaactggttgttagtaacatcacccgactgatcgatctgcctggtaccgagctggctcagctgatgggcgaagtggatttgaagctgccgggtggagccgggccggcatccggatttttccgctctctgatgtctctaaagaggaaagagaaaggtgtgattttcggaagtccactcacagaggagggaattgcccaaatctaccagctgatcgagtacttgcataagaatctccgtgtcgaaggtctctttagggtgcctggtaacagcgtccgccaacagatcctcagagatgctttaaacaacgggaccgacatcgacttagagtccggagagttccactctaatgatgtagcaaccctgttgaaaatgtttctgggcgaacttccagagccacttttgacacataaacacttcaacgcccacctaaagatcgcggacttaatgcaattcgatgataaaggtaacaaaacgaatatccccgataaagataggcagattgaggccctgcagcttctgttcctgatactgccacctccaaatagaaatcttcttaaacttctgctggacctgttgtaccagacagccaaaaaacaagataagaacaaaatgtcagcctataatctggcactgatgttcgctccccatgttttgtggccaaagaacgttacagcaaatgatctccaggaaaacattacaaaactgaacagtggtatggcattcatgattaagcattcccagaaactgttcaaagcccctgcttacatacgagagtgcgctcggctacactacctggggtccaggacacaggcaagtaaagacgacttagatctcattgcttcctgtcacacaaaatccttccaactggctaaatctcagaagcggaatcgtgtagattcatgtcctcatcaagaggaaacccagcaccatacagaggaggctctgagggaattgttccagcatgtgcatgatatgcctgaaagcgccaaaaaaaagcaactgatccggcagttcaacaagcagagcctgacgcagacgcccggccgggagccctcaacctcccaagtgcagaaaagagctcgaagtaggtcgttcagtggtctgatcaaaaggaaggttcttggtaaccagatgatgagtgagaagaagaaaaagaatccaacaccagagagtgtggctatcggtgaactcaaaggaacgtccaaggaaaatcgcaacctcttattcagcggatcacctgctgtcaccatgactcccactcgacttaaatggtcagaggggaagaaggaagggaaaaaggggaatagtatggccaccactagcctcggttctatccgcatgacgttgcggggctcgagctcatgcgggtgctgttcatag

SEQ ID NO: 132490 - DNA, 3654 bp, Artificial Sequence
  Description of Artificial Sequence: Synthetic coding sequence
atggctcagccagttgaaatctctccacctgactcatccctgagcaagcagcagacctcgaccccagttctaacccagcccggacgtgcctaccgtatggagatccaggttcctccgtccccgacagacgtggcgaaatccaacactgccgtgtgcgtatgtaatgaatccgtgaggaccgtaatcgtcccttccgagaaggttgtggacctgctgtctaacagaaataatcatactgggccatctcaccggactgaggaggtgcgctacggtgtgtcagaacagacctctctgaagactgtgtccagaacaacatctcccccgctttccattcctacaacccacctgattcaccagcccgccggatccagatctctggagccttccggaatccttctcaagtccggtaattatagcggacattccgacggaatttccagtagtcggtctcaggctgtagaggccccaagtgtttccgtgaaccattacagccccaattcgcatcagcatatcgactggaagaattacaaaacttacaaggagtacatcgataatcgcaggttgcatattgggtgtagaacaattcaggaaagacttgactctctaagggcagcttctcaaagcacgactgactacaatcaggtggtaccaaaccgaacaaccttacagggcaggcgacggtctacctcccatgacagagttccacagtcagttcagattagacagaggtctgtgtcacaggagagactggaggacagtgtgctcatgaaatactgtccccggtccgcatctcaaggcgccctgactagtccgagtgtatctttttcaaatcaccgcacccgtagttgggattatattgagggacaggacgagacactagaaaatgttaactccgggacaccgatcccagacagtaatggcgaaaagaaacagacctacaagtggtccggattcacagaacaagatgaccggaggggtatatgcgagaggccaaggcagcaggagattcataagtccttccgcggctcaaattttacagtggcaccctcggtcgtgaactctgacaacaggagaatgtccggtcggggagtgggttccgtttcccagttcaaaaaaatccctcctgacctgaagactttgcagtctaatcgtaactttcaaactacgtgtgggatgagcttgcctaggggaatctcccaagaccgctcacccctggtgaaagtgcgatctaattctctgaaggcgccatcaacccacgtcacaaagccaagctttagccagaagtccttcgtgtccataaaagatcagaggcctgtcaatcacctccaccaaaactctctcctaaaccaacagacctgggtgagaaccgacagcgccccagatcaacaagtggagacaggaaagtcaccttctctttccggtgccagcgcaaagcccgcaccccaatcttctgaaaatgccggcacaagcgacctggagttgcccgtctctcaacggaaccaggacctctccttacaggaagctgagaccgagcagtcagatactctagacaacaaagaggctgttattctgagagagaagcccccttctggccgccagactccccagcccttgcggcaccagtcttacatccttgcagtgaacgatcaagaaaccggatcagacactacttgctggttgcctaacgatgcacggcgtgaagtacatatcaagcgcatggaggaacggaaagcctcttctacatcaccacccggggatagcctggcaagtatccccttcatcgatgagccaactagcccctcaatagatcatgacattgcccacatccccgctagcgcagtgatcagcgccagcacatcacaggtgccgtctatcgccacagtgccaccttgtctgactacaagcgcccctctcataagaaggcagctgagccacgaccacgaatccgtgggcccaccttcactggatgctcagcccaattccaagacagaacgttcaaaatcttacgatgaggggttggacgactatcgcgaagacgctaaattaagcttcaaacacgtctctagccttaaaggcatcaagatcgccgactcgcagaagtcctctgaagattccggctcacgaaaggactcaagtagcgaagtgttttctgacgcggctaaggaaggatggttgcacttcaggccactcgtgaccgataagggaaagcgcgtgggtggatcgatacgcccctggaaacaaatgtatgtagtcctccggggacacagcctgtacttgtacaaagacaagcgggaacagaccaccccctccgaggaagagcaaccaatttctgttaacgcctgcctcatcgacatatcgtactcagaaaccaaaaggaagaacgtgtttcgtctcactacttctgattgcgagtgtctgttccaggccgaggaccgagatgacatgcttgcctggatcaaaaccatccaggagagctctaatctgaatgaggaggacaccggagtaaccaatcgcgaccttatatctagaaggattaaggaatataataaccttatgagcaaggcggagcagctgccaaagacacctcggcagagcctgagcattcgtcaaactttactcggagccaaatccgaaccgaagacccagagcccacactccccaaaggaggagtctgaacgaaagctgctcagcaaggacgacacctccccaccaaaggataagggaacctggcggaaaggcattccctctataatgaggaaaaccttcgagaaaaagcccaccgccacaggtaccttcggagtgaggttagatgactgccctcctgcacatacaaaccgctacatacccttaatagttgatatttgttgtaagctggtcgaagagcgcgggctagaatacacagggatctaccgcgtgcccggaaataacgccgctatttcttcgatgcaagaggaactgaataagggaatggctgatattgatatccaggatgataagtggcgggacttgaatgtgatcagctccttgttgaaatctttctttagaaagctgcccgaaccgctgttcacaaacgataagtatgcggatttcatcgaagctaaccgaaaagaagaccctcttgaccgactaaagacactgaagcgtctcattcatgacctcccggaacaccattacgaaacgctgaaattcctgtccgcccacctcaagactgtggccgaaaacagcgaaaagaacaagatggagccgcgcaatctcgctatagtgtttggccccacactggtgcgaacatcggaggataacatgacacacatggtcacacacatgcccgatcagtataagattgtggagaccctgattcagcaccacgactggttttttacagaagagggcgctgaggagccgttaactacagtccaggaagaaagtactgtcgatagtcaacctgtaccgaatatagatcatctgcttaccaatataggaagaaccggggtgtctcccggagatgtgagcggggaagtggggggcgtctatcacactgtaatgagtctggtagacagcgttatgtccctgatggattcatggaactgtcgaaaaaaagaggattgctgccctcactgctcatgtctggtctgccgaaatccgaggttcctgtag

SEQ ID NO: 132491 - DNA, 3498 bp, Artificial Sequence
  Description of Artificial Sequence: Synthetic coding sequence
atgatggccacaaggaggacaggactgtctgagggcgatggcgacaaactcaaagcatgcgaggtctccaaaaataaagacggaaaggaacagtccgagacagtctctctcagcgaagatgagactttctcttggcctggccccaaaacggttacccttaagcggacgtcccagggcttcgggttcacgctgcgtcacttcattgtctatcccccagaatctgctatccagttctcctacaaggatgaggaaaatggaaaccggggtggaaaacagcgtaatagactagaacctatggacacaatcttcgtcaagcaggtgaaggagggtgggcctgcgtttgaggccgggttgtgcacgggtgataggatcatcaaggtgaatggagagagtgtaattgggaaaacatattctcaggttatagctctgatacaaaatagtgacacaactctggaattatctgtgatgcctaaggacgaagacattttacaggtcgcatactcccaggacgcctatcttaaggggaatgaagcttacagtggcaacgcaagaaacattccggaacccccccccatctgttacccctggctgccaagcgccccttcggccatggctcagccggtagagatttcccctccggattcgtctctgtcaaagcagcagacgagcactcctgtgttgactcagcctggaagagcctatagaatggagattcaggttccaccaagcccaacagatgtggcaaagagcaataccgccgtgtgcgtgtgcaatgagtcggtgcggacagtgatagtaccctctgagaaagtggtggatctcttgtccaaccgcaacaatcataccggtcccagtcacagaacagaggaggtacgatacggtgtttctgagcagacttctctgaagaccgtgtctcgtactacaagtccacccctgtccattcccacgacccacctgatccatcagcccgccgggagtcggtcactggaaccctctgggatccttctgaagagcgggaactactccggacactctgacggaatctcttcctctagatcccaggccgtcgaagctccttctgtatccgttaaccattatagccccaattctcaccagcacatcgactggaaaaattataagacgtacaaagagtacatcgacaaccgtaggttacacatagggtgcaggacaatccaggaaagactggactccctacgggcggcctctcagtccactacggattataaccaagttgtccctaacagaactacactgcagggtcgcagacgcagtacctcacatgatcgcgtgccacagagtgtacagattaggcagaggagcgtctcacaagagcgcctcgaagacagtgtgctgatgaaatattgccctcgatccgcctcccagggggccctcacatcaccttctgttagtttctcaaatcatcgaacccgctcttgggattacatagagggtcaggacgaaactctcgagaacgttaatagcggcacacccattcccgatagcaacggtgaaaaaaaacagacttacaagtggtcaggattcacggaacaagatgataggaggggcatctgcgagcggccaaggcaacaggaaatccacaagtcctttcggggctctaactttactgtcgctccttcagtggtcaactcagataaccgtcgcatgtctggacggggagtgggctccgtgagtcagtttaagaaaatacccccggatctcaagacgctgcaatcgaatcgcaatttccagacgacttgcggaatgtccctgccgcgtgggatctcccaggacagaagcccccttgtgaaagttagatctaacagcctgaaggctccttccacacacgtcactaagcccagcttcagccagaagagtttcgtgtcaatcaaggatcagaggcctgtcaatcatctgcaccaaaactcgttgctcaaccagcaaacctgggtgcggacagactcagcgccagaccagcaggtcgagacaggtaagtcaccaagcttatcaggagcttcagctaaaccagcccctcagagctctgaaaatgctgggacaagcgatcttgagctccctgtgagccaaagaaatcaggatctctccctccaggaggccgaaacagagcagtcagatactttggacaataaggaggcggtgatcctcagggaaaagcccccatccggccgccagacgccacagccactcagacatcagagttacattctcgcggtgaatgatcaggaaaccgggtctgacactacatgctggctgcctaatgacgcccgaagggaggtccacatcaaaaggatggaagagcgcaaggcgagctctacttctcccccaggcgacagccttgcatcaattcctttcatcgacgagccgaccagtcctagcatcgatcacgacattgcccacatccctgcttccgccgtgatctccgcctcaacgagtcaggttccatctatcgccaccgtgcccccctgtctcacaacatctgcaccactgattcggcgtcagctgtcccacgatcacgagagtgttggccccccatctctggacgctcagcccaactcaaagacagagcgtagcaaatcatacgatgaaggtctggatgactatcgcgaagacgcaaagttgtccttcaagcacgttagttccctgaaaggcataaaaattgccgattcacagaagagctcggaggactctggctcgaggaaggatagcagcagcgaagtctttagcgatgccgctaaggaagggtggctgcattttcggcctctggtgacagataagggaaaaagggtggggggatcgattcgcccctggaaacagatgtatgtcgtattgagaggtcattccctttacctctataaagataagcgtgaacagacaacgccttcagaagaagaacagcccattagtgtgaacgcttgtcttatagacataagttactccgaaaccaaacggaaaaatgtgtttcggctcaccacgagtgactgtgaatgtctgttccaggctgaagatcgcgacgacatgttggcctggatcaagacgatccaggaatcatccaatcttaacgaagaggacacaggagtgaccaatagagacctcatctcacggaggatcaaggaatataataacctgatgtcaaaagctgagcaactacccaaaacaccccggcagagcctgagtatcaggcagaccctgttaggcgcaaaatcggagcctaagacccagagcccacacagccccaaagaggaaagcgagaggaagctcctgagtaaagatgacacctccccccctaaagacaaagggacctggcgcaaaggaatcccatctattatgaggaaaacatttgaaaagaagccaacagcgactgggacatttggtgtgagactggacgattgtcccccagcccacaccaatagggttggggacacctccccacccgactttctaaaatccctgattcagttctag

SEQ ID NO: 132492 - DNA, 5877 bp, Artificial Sequence
  Description of Artificial Sequence: Synthetic coding sequence
atgatggcaacacgcaggaccggcctgtccgaaggtgacggagataaactcaaagcctgcgaagtctctaagaataaagacggaaaagagcaatccgagacagtgtcactgtccgaagacgagacattctcctggcctggccccaagactgtaaccctgaagcggacttcgcaagggtttggttttaccctcagacacttcattgtctaccccccagaaagtgccattcagttttcttacaaagacgaggagaatggcaaccgcggggggaaacagcgcaaccgcctggaacccatggatacaatctttgtaaagcaggttaaagaggggggaccggctttcgaggcaggcctgtgcacaggcgaccggattatcaaggtgaatggggagtctgttatcggtaagacgtattcacaggttattgccttgatccaaaattctgatacaaccttggagcttagtgtcatgcccaaggacgaagacatcctacaggtactccagttcaccaaggacgtcacggcgctagcttattctcaagacgcttatctcaaaggaaatgaggcctattccggcaacgccaggaacatccctgaaccccctcccatctgctacccctggttgccttccgctcccagcgctatggctcagcctgtggaaatcagccctcccgatagttcgctctcaaaacaacagaccagcactcctgtcctgacacaacccggacgggcctaccggatggagatccaggtgccacccagtcccacagatgtagctaagagtaatacagccgtgtgtgtgtgtaatgagagcgtgcgcacagttattgtgccatccgaaaaagtcgttgacctccttagtaaccgaaacaaccacaccggcccttcccatagaacagaggaggtccggtacggcgtgagcgaacagacatctctcaaaactgtttctagaacaaccagtccacctctgtcaattccaacaacgcacctgattcatcagccagctggaagtcgctctctggaaccatcaggtattctgctaaaatcaggtaattattctgggcactctgacggcatctcctcaagtcgcagtcaggcggtcgaggccccgtccgtgtcagtgaaccactactccccgaacagccaccagcacatagactggaagaattacaaaacctataaggagtatatagataaccggcggctgcacatcggatgccggacaatacaggaacggctcgattcgctgagagctgcaagccaatccacgacagactacaatcaggtcgtcccaaatcgcacaacactgcagggccgcagacgttccacctcacatgaccgggttccacaaagcgtccagatcagacaaagatctgtcagccaggagagactcgaagactcagtgcttatgaaatattgtcctagatctgctagtcagggggcccttacaagcccctccgtttctttttctaaccataggacccgaagttgggactatatagagggtcaggacgagactctagagaatgtgaattcagggacgccaatacccgattccaacggggaaaagaagcagacatataagtggtctggttttacagagcaagatgataggagggggatttgtgagcggccgaggcagcaggaaatccacaagtcctttaggggcagcaattttacggtcgcaccatcagtcgttaattctgataaccgcaggatgtcaggcagaggcgtaggaagtgtcagtcaatttaaaaaaattcctcctgatctgaaaactctgcagagcaaccgaaacttccagactacctgcgggatgtctttgcctaggggaatttcccaggaccgcagtcccctggtcaaggtacggtccaattccttgaaagccccaagcacccatgtcacgaagccatcttttagccagaaatcgttcgtgagcatcaaagatcagcgacctgtcaaccatttgcatcagaatagcctgttgaatcagcagacctgggtgcggacggacagcgctcctgaccagcaggttgaaaccgggaagtcaccatctttgtctggcgcctcagccaagcctgccccccagagcagcgagaacgcagggacttctgatttggagcttccagtcagtcagcgcaatcaggatctgtccctccaggaggccgagacggaacagagtgacaccctggacaacaaggaggctgtgatattacgcgagaagccccccagtggtcgccagacgccccaaccgctgagacaccagtcatacatcctcgcagttaatgaccaggagaccgggtctgacactacatgttggctgccaaacgatgcgaggcgcgaggtgcatatcaaaagaatggaggaaaggaaggcttcctctaccagcccaccaggagattcactcgcgtccattccatttatcgatgagcctaccagtccgtctatcgaccacgatatcgcgcacatccctgcctccgctgtcatcagcgcaagcaccagccaagttccatccatcgcaacagtgcccccttgcctgactacatcagcccctctcataagaaggcagctcagccacgaccatgaatccgtaggaccccccagcttggacgctcagccaaactccaagactgaaaggtcaaagtcctacgacgaaggcttggacgattacagagaagacgctaaactgtctttcaagcatgttagcagtttgaaagggattaaaattgccgactcccagaagtcatctgaggactcagggagccgcaaagactcgagttcagaagttttctctgacgctgcgaaagagggctggttgcactttcggccattagtgacggacaaggggaagagagtgggagggtccataaggccctggaaacagatgtacgtcgtgcttcgcgggcacagcctgtacctgtataaagacaagcgagagcagacgaccccatctgaggaagaacagcctataagtgtgaacgcgtgcctgatcgatatcagttattccgagactaagagaaaaaacgtctttcggctaaccacatccgattgcgaatgcctgttccaagctgaagacagagacgatatgctggcatggatcaagactatccaggagtcaagtaacctcaatgaagaggacaccggtgttacgaatagagatctaatctcacgccggattaaggagtataacaacctaatgagtaaagccgagcagctcccaaaaacaccaaggcagtccctctctatcagacagacattactgggagctaaaagcgagcccaaaactcagtcaccacattcacctaaagaggaatccgaacggaaactgctcagcaaggacgatactagcccccctaaggataagggtacgtggcggaaaggcataccgtctataatgagaaaaacctttgagaaaaaaccaacagccacaggaacttttggagttaggcttgatgattgccccccagcccacaccaatagatacatacctctgatcgtggacatatgttgtaagctcgtagaggagcgcggtttagagtacaccggtatataccgggtacctggcaataatgccgcaatttctagcatgcaagaagagttgaacaaaggcatggccgacatcgacattcaagatgataaatggagggacctgaacgtaataagctcacttttgaaatccttcttcagaaagctgcccgagcctttgtttactaacgataagtacgccgacttcatcgaggctaacagaaaggaagatccactggaccgactgaaaacactgaagcgcctgatacatgatctcccggagcatcattatgaaactctgaaattcttgtcagcgcacctaaagactgtcgctgagaatagcgaaaagaacaaaatggaaccacggaacctagcgattgtcttcggacctacactggtgcggaccagcgaggacaacatgacccacatggtgactcacatgccagaccaatacaagattgtcgaaactctgattcagcatcatgattggttttttacagaggagggagcagaggagccccttacaaccgtgcaggaagaaagcaccgtggattcacagcccgtgccgaacatcgatcacctcctgactaatattgggaggactggagtctccccgggggacgttagtgactccgcaacctctgattcgactaaaagcaaggggtcctgggggtcaggtaaggaccaatacagccgggagctcctcgtctcaagtatctttgcggctgcctccaggaaacggaaaaaacccaaggaaaaggctcagccatctagctctgaggacgaactagataatgtgtttttcaagaaagagaacgtggagcagtgtcacaatgacacaaaagaagaatctaagaaagaatctgaaacgctcgggcgaaaacagaagatcataattgcaaaggagaattctactagaaaagatccctcaactacgaaagatgagaagatatccctgggcaaggagtcaacacccagtgaggaaccatccccaccacacaactctaagcacaataaatccccaacactgtcttgtcggttcgccattctcaaggaatccccccggagtcttctcgcacagaagagcagccatctagaagagactgggagcgattcaggcactttactgtctacctcatcccaagccagcctggccaggttttccatgaagaagtcaactagccccgaaactaagcacagtgaatttctcgccaatgtctcgaccatcacctccgactactctaccactagtagtgctacttatttaacgtcactcgattcctctaggctgtcaccggaggttcagagtgtggccgaatcaaagggcgacgaggcagatgacgagcgctccgaactgatatctgaaggaagacctgtcgagacagacagcgagtccgaatttccggttttccctacagcattaactagtgagaggttgttccggggcaagctgcaggaggtgacgaaaagttcaaggagaaatagcgagggcagtgagctcagctgcaccgaagggagtcttacttcatctttggattctcggcgtcaactgttctcctcacacaaattaatcgagtgtgacactctgtcccgaaaaaaatctgcaagatttaagtccgactcaggcagcctgggagacgcaaaaaacgaaaaggaagctccatcccttactaaagtctttgacgtcatgaagaaggggaaatcgaccggatccctgctgacccccacgcggggcgagtctgaaaaacaggagcctacgtggaaaacaaaaattgcagatcggttgaagctgcgtcccagagcccctgcagatgacatgttcggcgttggtaatcacaaggtgaacgcggagaccgccaagcgaaagagcattcgccgccggcacaccctggggggccatcgtgacgcaacggagattagcgttctgaatttctggaaggtccatgaacagtctggtgagcgcgagtcagagcttagcgctgttaacaggctcaagccaaagtgttccgctcaggatcttagcattagcgactggctagcgcgagagaggcttagaacgagcacctcggacctttcacgaggcgagattggtgatccccagaccgaaaatccaagcacccgggaaatcgccacaaccgatacccccctatctctgcactgtaatactgggtccagtagttcaacgcttgcttccacgaaccggccacttctgagcattcctccccagagcccagatcagatcaatggagagagtttccaaaacgtctcgaaaaatgcgagcagtgctgcaaatgcccagccccacaagttatccgaaaccccagggagcaaggctgagtttcacccctgcctgtag

SEQ ID NO: 132493 - DNA, 594 bp, Artificial Sequence
  Description of Artificial Sequence: Synthetic coding sequence
tagaacaatgcagcaatcagctctatgcaagaggagctcaataaagggatggcggatattgacatccaagacgacaagtggcgagatctgaatgtgatctcctcccttcttaagtccttctttcggaagcttcccgagccgctattcaccaacgacaaatatgctgatttcatcgaagctaacagaaaagaggatccactcgacagactcaagactctgaaacggctcatccatgatctgcctgaacaccactacgaaacactgaagttcctctccgcccatctgaaaaccgtagccgagaactctgaaaagaacaagatggagccccgcaacttggcgatcgtgtttggccctacattggtgcgtacgtccgaggacaatatgacccacatggtgacccacatgccagaccagtacaaaatcgtcgagaccttaattcagcatcacgactggttctttacagaggagggcgctgaagaacctcttattcagctcttagttacccagcagaacctgcgcgttttaggcgacctggagcgaataagcatcgccgggaattgtctgtgccccccatctctgcagttactggtgtag

SEQ ID NO: 132494 - DNA, 342 bp, Artificial Sequence
  Description of Artificial Sequence: Synthetic coding sequence
tacatcccacttatcgtcgacatctgttgcaaactagtggaagagaggggactggaatacaccggcatctatcgtgtccctggaaacaacgctgccatctctagcatgcaggaggagttgaataaaggaatggccgacatcgacatccaagatgacaaatggagggatttgaatgttatcagttccctcctaaaatccttcttccgcaagctccccgagcccttattcacaaatgacaaatacgcagactttattgaggcgaataggaaggaggatccattagaccgcttgaaaacccttaagcgtctcttcctgagcgcccacctcaaaactgtcgcttag

SEQ ID NO: 132495 - DNA, 2724 bp, Artificial Sequence
  Description of Artificial Sequence: Synthetic coding sequence
atgcccaaagatgaagacattctgcaggtggcatattctcaggatgcgtacttgaaaggtaacgaggcttattccggcaatgctcgcaatatcccagaacccccacccatatgctatccctggctgccctcagcaccttccgccatggcccagcctgtagaaataagcccgcctgacagctctctgtctaagcagcagacctctacgccagtgctaacacaacccggtcgggcttacagaatggaaatacaagtgccgccctcgcctaccgatgtggcgaaatccaacacagccgtatgcgtgtgtaacgaaagcgtgcgtaccgtcatagtgcccagcgaaaaggtggtggatctgttaagcaacagaaacaaccataccggcccaagccatcgcacagaggaggtcagatacggtgtgtcggagcagacttccttgaaaacagtctcaagaacaacatctccaccactgtcaattcctaccacacaccttattcatcagccagcaggttcacggtcccttgaaccttcgggcattctcctgaagtcagggaactacagcggtcattcagacggtatttcctccagccgtagtcaggccgtggaggccccctccgtgtcagtaaaccattattctccaaactcccatcagcacatcgattggaagaactataaaacttataaagaatatattgataacagacgtctccacatcggctgtcgcaccatccaggaaagactggactcactccgagctgcatcacagagcactaccgattacaaccaggtcgtccctaaccggactactcttcaggggcgtagacggtctacatctcacgatagggtgccccaatctgtacagatccgacagcggagcgtgagccaggagcggctggaagattccgtgctaatgaaatattgcccgcggagcgcatcccagggcgctctgacaagcccttctgtatcattttctaaccacagaacacgatcttgggactacattgagggacaagacgaaaccttggagaacgtgaactctggaacacctatccctgactcaaacggcgagaaaaaacaaacctacaagtggtctggattcacagagcaggacgaccggcgaggtatatgcgaaagaccccgccaacaggagatccataaatccttccgcggaagtaactttacagttgcaccctccgttgtgaattctgacaacaggcggatgtccggacgtggagtgggaagtgtgagtcagttcaagaagatacctccagacctcaagactctccagagcaatcggaactttcagacaacgtgcgggatgtccttgcctaggggcattagccaggatcgcagccccttagtcaaagttcggtccaactctctgaaagcgccttccacccacgtcaccaagccctcattctcccagaagagttttgtttctattaaagaccagcgcccagttaatcatctgcatcaaaacagccttcttaatcaacagacctgggtccgcactgactcagcccctgaccagcaggttgagacaggaaagagtccctcattgtccggcgcctccgctaaacctgccccacagagtagcgaaaatgccgggaccagtgatctggaattgcctgtcagtcagagaaaccaggacctgtccctccaggaggccgaaaccgaacagtccgatactttggataacaaggaagccgtcatcctccgggaaaaaccacccagcggccggcagactccacagcccttacgccaccagtcgtatatcctcgcagtcaatgatcaagaaacaggctccgatactacgtgttggctgccaaatgatgcccggcgggaagtgcacattaaacgcatggaggagcgtaaagcaagctcaacatctcctcctggagatagtctcgcgagtattccttttatcgatgagcccacatcaccgagtatcgaccacgatattgctcacatccccgcaagcgcggtgatcagtgctagcaccagccaggtgcccagtatagcaacggtaccgccctgtcttaccacgagcgcacctttgatcaggcggcagctgagccatgaccatgaatccgtcggtccacctagcctggacgcacagcctaactctaagaccgaacggtctaagagctatgatgaggggctggacgattaccgagaggacgccaaactgtcttttaagcatgtctctagccttaagggcatcaaaatagcggactcgcaaaagagctctgaagatagtggctcacgcaaagactccagttctgaggtgtttagcgacgccgctaaggagggctggctgcatttccgccctctcgtaactgacaaaggcaagcgcgtcggcgggtcgatccggccttggaaacagatgtacgtggttttacgaggccatagtctgtatctctataaagataagagagaacagaccacaccctccgaagaggagcagcccatatccgtcaacgcctgtcttatcgacatatcctactctgagactaagaggaaaaatgtcttcaggctgaccacaagtgactgcgaatgcctttttcaggccgaggacagggacgatatgctagcctggattaaaaccattcaggagtcttctaacttaaacgaggaggacaccggcgtgacaaacagagacctgataagccgcaggatcaaggagtataacaacctaatgtccaaggctgagcagctgccgtag

SEQ ID NO: 132496 - DNA, 3396 bp, Artificial Sequence
  Description of Artificial Sequence: Synthetic coding sequence
atgatggccacccggagaactgggctttctgagggagacggggataaattaaaagcatgcgaagtcagcaagaacaaagacggaaaggaacagagtgaaacagttagcctttctgaggatgaaaccttcagctggccaggacctaagaccgtaaccctgaagcggaccagccagggatttggattcaccctccgccactttatcgtttatccaccggaatctgctatccagtttagctacaaggatgaggaaaacggtaaccgcggcggcaagcagcgcaataggctagagcccatggacaccatcttcgtcaaacaagtgaaggagggtgggcctgctttcgaagctgggctctgtaccggcgaccggattatcaaggtgaacggcgagagcgttatcggcaagacctatagccaggtaattgccctgatccagaatagcgacactaccttggagctctcggtcatgcctaaagatgaagacattctgcaggtgctccaattcacaaaagacgtgaccgccctagcatactctcaggacgcctacttaaagggcaatgaagcctactccggaaacgcacggaacatccccgagccaccgccaatctgttacccctggttaccctctgccccttctgcgatggcgcaaccagtcgaaatctcacctccagatagtagcctttccaagcagcaaacatcaacgcctgtgttaactcagccaggtcgggcgtatagaatggagattcaggtgcccccctcacccactgatgtcgccaagagcaacaccgccgtctgcgtgtgtaatgagtctgtcaggacggtaattgtgcctagtgagaaagttgttgacctgttgagcaatcggaataaccacacaggaccctcgcatagaacggaggaagtgaggtatggggtgtctgagcagacaagccttaagaccgtgagccgaaccacatcaccacctctttccatacccactacccacctgatacaccaacctgccggctccaggtcactggaaccttctggaatcctgttgaaatctggcaactatagcggccactcggatgggatcagctcatcacggtcccaggccgtggaggccccatccgtttcagtgaatcactattcccctaactcccaccagcatatcgattggaaaaactacaagacttacaaagaatacatcgacaatcggagattacacataggctgtaggactatacaggagagacttgactctcttagagcggcatcacagagtacaacagattacaatcaagttgtgcccaacaggactactctgcagggtagacggagatccacctctcacgaccgggttccacaatctgtgcagatcaggcaacgctccgttagccaggagagactcgaagattcagtgcttatgaaatactgccctagatcagcctcgcagggagccctgacctccccatccgtgagcttcagcaatcaccgcaccaggtcgtgggattacatcgagggccaggacgaaaccctggaaaacgtgaacagtggcactcccattccagatagtaatggggaaaagaagcaaacctacaaatggtctggcttcacagagcaagatgatagacgcggaatatgtgaacgtcctcggcaacaggagatccacaagtcattccgaggttctaacttcacagtggcgccttccgttgtcaattccgataaccgccgcatgtctggcagaggcgtcgggagcgtgagccaatttaagaagattccccctgatctcaaaacattgcagtccaaccgtaacttccaaacaacgtgcgggatgtccctcccaagagggataagtcaggacaggtcaccgctcgtgaaggtgagaagcaacagtctcaaagccccatccacgcacgtgacaaagcccagtttctctcagaaatcttttgtgtcaataaaggaccagcgccctgtgaaccacctacaccagaacagcctgttgaatcagcagacttgggtccggaccgactctgcaccagatcaacaggtggagacggggaaatctccatcccttagcggggcttctgctaagcccgcccctcagtcgagcgaaaacgctggtacttcggatctggaactccccgttagtcagcgcaatcaggatctgagcttacaggaagcggaaacagagcagtcagacactctcgataacaaggaagctgttatcctccgcgaaaagcccccaagtggcagacaaaccccacagcccctcaggcaccagagttatatcttagcagtgaatgatcaagagaccggctctgacacgacatgttggttgcccaacgacgctaggcgcgaggttcacatcaagcggatggaagaacggaaagcctcctcaaccagcccccctggggattcgctcgcgtccatcccgttcatagatgaacccacttctccaagcatcgatcatgacatcgctcatatcccagcttctgcagtaatctctgcctcaacatcccaggtcccatctatcgccaccgtccctccctgtttgacaacatctgccccattgatcaggcgacaacttagccacgatcacgaaagcgttggtccccccagcctcgatgcgcaacccaacagtaagactgagagaagcaagagttatgatgaaggacttgacgactacagggaagacgcaaaattatcattcaagcatgtgtcctctctaaaggggatcaagatagcagattcacagaaaagctcggaggatagcggctcaagaaaagatagctccagtgaagtgttttctgatgcagcgaaagagggttggctacactttagacccttggtgaccgataaaggaaagcgggttgggggaagcatccgcccctggaagcagatgtatgttgtcttgagggggcacagcctctacctgtacaaagacaagcgggaacagaccactccatctgaagaggagcagcccatttccgttaacgcatgcctcatcgatatcagctactctgagaccaaaagaaagaacgtttttaggctgacgactagcgattgcgaatgcctgttccaagcggaggacagagacgacatgctggcttggatcaaaacaatccaggaatccagcaatctgaacgaggaggacacaggcgtgactaatagggaccttatctcaagacggatcaaggaatataataatctgatgagcaaagcagagcagttacctaaaacaccacggcagagtttgagcatcagacaaacactgctcggggcaaaaagtgaacccaaaacgcagagcccacacagccctaaagaggaaagcgaaaggaagctgcttagcaaggacgacacgtctccccccaaagacaagggtacctggcgaaagggcatcccatctatcatgtag

SEQ ID NO: 132497 - DNA, 4224 bp, Artificial Sequence
  Description of Artificial Sequence: Synthetic coding sequence
atggccaccagacgcacaggactatcagagggggacggcgacaaactgaaggcttgtgaggtttccaaaaataaggacggcaaagagcagtccgagaccgtcagcctgtctgaagacgagaccttcagctggcccggcccaaaaacagtgaccctcaagcgaacttcgcagggcttcggctttacgttgcgacatttcattgtgtatccaccggaatccgctatacagttctcatacaaggatgaggagaacggcaatcgcggcggaaagcagcgaaaccggttggagcctatggatacgattttcgtgaaacaggtcaaagaaggcggccccgccttcgaagctggattatgcacaggggatcggatcatcaaagttaacggagaaagcgtgattggtaagacttactcccaggtgattgcgctcatccagaactcagacacaaccttggaactgtcggttatgccaaaggatgaggatattctccaggtggcctattctcaagatgcctatttaaaaggtaatgaggcatattctggcaatgcccggaatataccagagcccccgcctatttgttacccatggcttcctagtgctccttccgccatggcgcaaccggtggagatatccccaccggatagcagcttgagcaaacagcaaacttcgacaccagtgctgacccagccaggtagggcgtacagaatggagatccaggtacctcctagccctacagacgtggcgaaatctaatacggccgtctgcgtgtgtaatgagagcgtgagaaccgtcatcgtgccctctgagaaggtcgtagatctgctttccaaccgcaacaaccatacaggtccaagtcacaggaccgaggaggtccggtacggagtgagcgaacagacctccctgaagaccgtgagcaggaccacatctcctccactgtcaattccaaccacccatcttatacatcagcctgcaggcagccgctccctggaaccttctggcattctgcttaagagcggtaattattctggccacagtgacggcattagcagttcacggtcacaggccgtggaggcgccaagtgtgagcgtgaaccactactccccaaacagccaccagcacatagactggaaaaactataaaacctataaagagtacatcgataaccgcaggctccacatcggttgccgcaccattcaagaacgcctggacagccttagagcagcatcccagagcactacggactataaccaggtcgtgccgaaccgcactaccctgcaaggcagacggagatctacatcccacgacagggtaccccaaagcgtgcagatccgccagcgctctgtgtcacaggagcgcctcgaagacagcgtgctcatgaaatactgcccccgatctgcgtctcaaggtgccctgacttcccctagcgtctccttctctaaccatcggacccggtcgtgggattacattgaagggcaggatgaaaccctggaaaatgtcaattctgggaccccaatccctgattcgaacggagagaagaagcagacatacaagtggagcggattcaccgagcaggacgacagaagagggatctgcgagcggccgagacaacaggagatccataagtcctttcgtggctctaactttacggtcgccccctccgtggtgaactcagacaatcggcgcatgtccggcaggggcgtggggagcgtgtctcattggcgaaagggcatcccgtctattatgcgaaagaccttcgagaaaaagccaaccgctaccgggacattcggagttaggcttgacgactgccccccagcccatacaaaccgctatatcccactgatcgtcgatatctgttgtaagttggtagaggagagaggcctagagtacaccggaatctatcgtgtgcccggcaataacgcagcaatatctagtatgcaagaggagcttaacaagggcatggccgatattgacatccaggacgacaagtggcgcgacctgaatgttattagtagcctcctgaaatctttctttagaaaactgcccgaaccactctttactaatgataagtatgccgatttcatcgaagctaatagaaaagaggacccacttgacaggctgaaaaccctgaaaaggctgatccacgacctccctgagcatcattacgaaacattgaaattccttagcgcgcacttaaagaccgtcgctgaaaattccgagaaaaataaaatggagcctagaaatctggctatcgtgtttggcccaaccctagtgcgcaccagcgaagacaatatgacacatatggtaacccacatgcctgatcaatataagattgtcgagaccttaatacagcatcatgattggtttttcacagaggagggggccgaggagccccttactaccgtgcaggaggagagcactgtcgactcccagccagtacctaacatcgaccacctcttaactaatatcggaagaaccggggtatcacctggcgatgtgtccgacagcgctacctcagacagcaccaagagcaaaggttcctggggttcagggaaggatcaatattcaagagaactgttggtctccagcattttcgccgcagcctctcgcaaacgaaagaagcccaaagagaaggcacaaccttcgtcctcagaggatgagctcgataacgtatttttcaaaaaggagaacgtcgaacagtgtcacaacgacaccaaagaagaatcaaagaaagaatccgagacattgggaaggaaacagaagatcattattgccaaggagaacagtacacgtaaggacccaagcactacaaaagacgagaaaatctccctgggaaaagagtccaccccatcagaagagccttcccccccccacaattctaagcacaacaaatctcctactttatcttgccgctttgccatacttaaagaatccccccgcagtctgctggcgcagaaatcttctcacctggaggagacaggtagtgacagcgggaccctcctcagtacaagcagccaggccagccttgccaggttctcaatgaaaaaatctacgtcccccgagaccaagcatagcgaattcctggccaacgttagtacaatcacgtcagattattctactacctccagcgcaacctatctaacatcactggactcctctaggctgtcacccgaagtgcaaagcgtggccgaaagcaagggagatgaagcagacgacgagcggtccgaattgatctcggagggcagacctgtggagaccgacagtgaaagcgagttccccgtgttccccactgccctcacaagcgaacggttgttccgcggaaagctacaggaagttacaaagtcctctaggcggaatagtgagggctccgaactgagctgtactgagggcagtctaacatcctccctggacagcaggagacagctcttctcctcccataagctgatagagtgcgacactctaagtaggaagaaaagcgcacggttcaagtctgactccggatcactaggagacgctaagaatgagaaagaggccccaagtctgacaaaagtgtttgacgtaatgaaaaagggcaagtcaacgggctccctcctgacacctacacggggtgagagtgagaagcaggagccaacctggaagacaaagattgctgataggctgaaactgcgccccagggctcccgcggatgacatgttcggtgtcgggaaccataaggtgaatgcagaaaccgccaagcggaagtccatacggagaaggcataccttgggtgggcacagagatgccacagaaatctccgtactgaacttctggaaagtccatgaacaaagcggcgagagggaatccgagctgtcagctgtgaacaggctgaagccaaagtgttccgcccaggacctttcaatcagcgactggcttgccagggagcgcttaagaacctcaacaagtgacttgagcaggggagaaatcggggatccccaaactgagaatcctagcacgagagaaatcgcaactacagatacaccactttccttgcattgtaatacaggctccagcagttcgaccctcgcgtcaacaaatcggcctctactgagcattcccccccaatctcccgatcagatcaacggcgagagctttcagaacgtgtctaagaatgcatcttctgctgccaatgctcagccccacaaactctccgagacaccaggaagcaaagccgaattccacccttgtttgtag

SEQ ID NO: 132498 - DNA, 279 bp, Artificial Sequence
  Description of Artificial Sequence: Synthetic coding sequence
atggacactatctttgtgaagcaggtgaaagagggaggacctgctttcgaggccggactttgcactggagataggattattaaagtcaatggcgagagcgtcataggaaagacctatagccaggtgatcgccctcatccagaattctgacactacattagagctctccgtcatgcctaaggatgaagacatccttcaagtgaacttagaattttccaccttctacaagaatacaatcgccaaattcctgcaactctctgacatggaaatgctttgctag

SEQ ID NO: 132499 - DNA, 4476 bp, Artificial Sequence
  Description of Artificial Sequence: Synthetic coding sequence
atgaatggcgttgccttctgtttagtaggtattccaccccggcccgagccccgccctccccagttgccactcgggcctagagatggatgttccccccgccgcccgtttccctggcagggaccccgcaccctgctgctttataagagccctcaagatggctttggcttcacactgagacattttattgtgtaccctccggagagcgcagtccactgttctctcaaggaagaagaaaacggtggaaggggaggcgggccctctccacgataccgccttgagccaatggacacaattttcgtaaaaaatgttaaggaggatggcccagctcaccgcgctgggcttaggactggtgaccggctcgtgaaagttaacggggaaagcgtcattggtaagacatactcgcaagtgatcgccctgatacagaattccgatgacaccctcgagttaagcataatgcctaaagatgaagacattctgcagcttgcttattcgcaggatgcttatctcaaaggtaatgaaccttacagtggagaggccagatcaattcccgagccccctcctatttgctacccacgcaagacatacgctcctcctgcccgagcgtctactagagcgaccatggtaccagaacccaccagtgcgctgccatccgatccacgctcgcctgccgcctggtccgacccggggttgcgcgttcctcccgcggcacgagcacatctggataacagcagtctgggcatgagccagcctaggccctcccccggcgcctttccacatctgtcatcggagccaaggacccctagggcttttccagaaccaggttccagggttcccccctctcggttggagtgccagcaggccctgagtcactggctgagcaaccaggttccacgaagagctggggaaagacgatgtccagctatggctcctagagcacggtcagcttcgcaggaccgccttgaggaggtggccgcaccaagaccctggccctgtagtacatcccaagacgcactttcgcagctcggccaggagggttggcatagagctcgctccgatgattacttgtcacgagccaccagatctgccgaagccctggggccgggcgcccttgtatctccccggttcgagcgctgtggatgggctagtcagcgcagctctgcccggactcctgcatgccctaccagggaccttcctgggccccaagcaccacctccttccggcctccagggccttgacgacttaggatacataggatatcgcagctactccccttctttccagaggcgtacaggattattacacgccctgtcctttagggatagcccgttcggagggttgcccaccttcaatctcgctcagtctcccgcttcatttcctcctgaagccagtgaaccaccgagagtggtcaggccggagccctccacacgggccttagaacctccagccgaggatcggggcgacgaagtcgtcctgcgccagaagcctccaacaggcaggaaggtgcaactgaccccggcacgtcaaatgaacctcggattcggcgatgagtctcccgaaccagaagccagtgggcgcggcgagaggctgggccgcaaggtcgcccctctagcaacaactgaagattctttggcttccatccccttcatagacgagccaaccagcccatctattgacctacaagctaagcacgtgcccgcgtctgccgtggtatcttccgccatgaatagtgcacccgtgttgggcactagccctagctcacctacttttaccttcaccctgggccgccactactcccaggactgtagctccataaaagccgggcggaggagctcatatctgttggcaatcaccactgaacgaagcaaatcttgcgatgacggattgaatacatttcgggatgaaggacgtgtgctgagacgtctccccaaccgaattccgagtctgagaatgcttcggagtttcttcacagacgggtctctcgactcttggggcacctcagaagatgcagacgcgcctagtaagagacacagcacttcagatctgagcgatgcaaccttctctgacattaggagggagggatggctttactataaacaaattttgaccaagaaagggaagaaagctggctccggactgcgacagtggaaacgtgtctatgccgccttacgagcaagatccttgagtttgtctaaggaacgcagggagcctgggcctgccgctgctggggccgcagccgccggggccggggaagacgaggccgccccagtatgtatcggctcatgccttgtggacatcagctattcggaaacaaaaagacgtcacgtgttcaggctcacaactgccgatttctgcgaatatctattccaagcagaagatcgagatgatatgctggggtggataagagctattagagagaatagccgcgcagagggcgaagaccccgggtgtgctaatcaggccctgatttcaaagaaactgaatgattatcggaaagtgagtcactcatcggggccgaaggcagactccagtccaaaaggatccagagggctcgggggactgaagtcagagttcctgaagcagtctgccgctcgcggcctgcggacccaggatcttccagctggctctaaggacgattctgcggccgcgcccaagactccctgggggatcaacattattaaaaagaataagaaggctgccccccgagccttcggcgtgcggctggaggagtgccagccagccactgagaaccagcgggtgcctctgattgtggctgcttgttgccggattgtcgaggcacggggactcgagagcaccggaatctatcgagtccccggtaacaatgctgtggttagctcactccaagagcagctgaaccggggtccgggggacattaatctccaagatgagcgatggcaggacttgaacgtaatttcatccttgctgaaatctttctttagaaagctccccgaacctctgtttaccgatgacaaatacaatgatttcatcgaggcaaacagaatcgaggatgctcgggaacgtatgcgaacgttgcggaagctaatccgggaccttccgggacattattacgaaacgttgaagtttctagttggccatctgaaaaccatagcagatcatagcgagaagaacaaaatggagcctagaaacctggccctagtgtttggccctacacttgtccgcacctctgaagacaacatgactgacatggtgactcacatgcctgatagatacaagatagtggagacgctgattcagcacagcgactggttcttctccgacgaagaagataagggggaaaggacgccggtgggggataaggagccacaggccgtacctaatatcgagtacttgcttcccaatataggcagaaccgtcccgcccggagaccccggcagcgatagtacaacttgttcttctgcaaaaagtaaaggcagctgggccccaaaaaaggagccctacgctcgcgaaatgttggcgatcagttttatcagcgcagtgaatcggaaaaggaaaaagagacgggaggctaggggcttgggttcttccaccgatgacgactctgagcaagaggcacataaaccaggtgcaggagcaactgcacccggtacccaagagcggcctcagggacctttgcctggagctgtggcccctgaagctcccggccgactgtcacctcccgctgcgccagaagaaagacccgccgcagacacccgctctatcgtgtctggttactcgacgctgtcaaccatggatcgttccgtctgtagcggggcgagtggacgcagggccggagccggagacgaggctgatgacgagcggagcgagctaagccacgtggagaccgacacggagggagctgcaggcgccggacctgggggcagactgactcggagaccatcgttttccagccatcatctcatgccgtgcgatacactggcccggcggcggctggcccggggccgccccgatggcgagggcgccggacggggagggccccgggctccagaacctcctggcagcgcttccagtagctcccaggagagcctgagaccccccgcggctgctcttgcatctcggccttctcggatggaggcactcagactcagactgcgcggcactgctgatgatatgcttgcggtgcggctccgccgaccactgtcccccgagaccaggcggagacggagctcatggcggcgacacacagttgtggtccagtcgccccttaccgatctgaatttcaacgagtggaaggagttagggggtgggggcccacccgagcctgccggcgctagagctcactccgataacaaggactcgggcctgagttcactagaatcaaccaaagccagagcaccgtcctccgcagccagtcagccccctgctccaggggacaccggtagtctccagtcccaaccacctcgccgttctgcggccagcagactgcatcagtgcctgtag

SEQ ID NO: 132500 - DNA, 3435 bp, Artificial Sequence
  Description of Artificial Sequence: Synthetic coding sequence
atgaacggtgtcgcattttgcctggtgggcatcccaccacgaccagaacccagaccacctcagttacccttgggcccccgcgacggttgctccccaaggagacccttcccatggcagggccctcgcactctgctgctatataaatccccacaggacggattcggctttactttgagacactttattgtctacccacccgaaagcgctgtgcattgttctctgaaggaagaggagaatggagggcgcggaggaggacccagccccaggtaccgtttagagcctatggatactatattcgttaaaaacgtgaaggaagatggccctgcacatcgcgcaggccttaggactggggacaggctcgtgaaagtgaacggggaatcggtgatcggcaagacatattcccaggtcatcgctctgattcaaaacagtgatgacacattggagttgtctataatgcccaaggatgaagacattctgcagctggcttatagccaggatgcttacctgaaggggaatgaaccctactcaggggaggcccgttcaatccccgaaccacctccaatctgctaccccaggaaaacatacgcaccacctgcccgcgcgtctacccgggccactatggttcctgagccaaccagcgcactgccctcggacccaaggtctcccgctgcatggtctgatcctggtttacgtgttccacctgcggcgagggcccatttagataactctagccttggtatgtcccagccccggcctagtcccggggccttcccacacttaagctccgagccacgtacaccccgtgcgtttcccgagcccgggtcgagggtgcctcctagtcgattggaatgtcagcaggccctgtcgcattggctgagtaaccaggtcccgcgacgcgctggcgagaggaggtgtccagctatggcgcctcgcgctcgttcggcctcacaagatcggttggaggaggtggcagctcctagaccatggccatgttcaactagccaggacgccctctctcagctgggacaagaaggctggcatagagcccggagcgatgactacctgtcccgagcaacacgatcagccgaggctctcggtcctggcgctctcgtgtcaccgaggttcgagaggtgtggctgggcgtcccagcgcagcagtgctcgaacgcccgcatgtccaacccgcgatctgcccggcccccaagcacccccaccttcggggttgcaggggcttgacgacctgggctacattggttaccgatcctactccccatcttttcagcgtagaaccgggcttctgcacgcgctgtctttcagggacagtccctttggggggttacccaccttcaatttagcgcaatcccctgcatcttttccccctgaggcttctgaaccacctagggtcgtcaggccggagccgtccacacgagctttggaacctcctgcagaggacaggggtgacgaagtggtacttagacaaaaaccccccactgggaggaaagtccagctgactcctgcgcgacaaatgaacttaggcttcggagatgaaagcccggaacctgaggcctccggccggggagagagactcggcaggaaagtcgcgcccttggccactaccgaagatagtctggcaagtatcccattcatagacgaaccgacctctccctcaattgatctgcaggccaaacatgttccggcgtcagcagtcgtttcatcagccatgaattctgctcctgtgctgggtacatcaccctcctctcccacattcacttttaccttggggcggcactatagtcaggactgctcctccatcaaggctggtaggaggagcagttacttgctagccataacgaccgagcggagcaagtcatgtgacgacggattgaatactttccgggacgagggcagggtgctccgaagactcccaaatcgtattccttcattgaggatgctaagatctttcttcactgacggctcactcgacagttggggaacgtcggaagacgctgatgctcccagcaagcggcacagtacctcagacctctccgacgcaaccttttcggatattaggagagagggctggctctactataagcagatactcactaagaaaggaaagaaagcggggtcaggcctgagacagtggaagagagtgtacgccgcactgcgcgctagatccctcagcttgagcaaagagcgcagagagcccggtcctgccgccgcaggcgccgcagctgcgggagcgggagaagatgaagccgctccagtgtgcattgggtcatgcttagtggacatcagctacagcgagactaagagacggcacgttttccggctaactactgccgatttttgcgaatacctgttccaggccgaggatagagatgacatgttgggatggattcgggccattagagagaattcccgggcagaaggcgaagatccggggtgtgccaatcaagctctcatcagtaagaagttgaacgattacaggaaggtcagccattcgtccggcccaaaggctgacagttcacccaagggctcccgaggtctgggcggactcaaatcagaattccttaagcagtccgcggccagggggttacggacacaagatctccccgccggatccaaggacgactctgcagcagcaccaaagacgccgtggggaatcaatataatcaagaaaaataagaaagccgcccctagggcttttggagtccgcctggaagaatgccaacccgccacagaaaaccagcgtgttcctcttattgtcgccgcctgttgtcgaattgtggaagcaagggggctggaatcaaccgggatatatcgagtgccaggcaataacgctgtcgtcagcagtttacaggagcagcttaacagaggacccggggacatcaacttacaggacgagcggtggcaggacttaaacgttatcagcagtcttctaaaatcgttttttcggaagttgccagagccactgtttacagatgacaagtataatgacttcatcgaggccaacagaatcgaagatgctagggagcggatgagaactcttcgcaaattaattagagacctgccggggcactattacgagacgctgaaatttctggtgggccacctgaaaactattgccgaccactctgagaaaaataagatggaacctcgaaatctggctttggtttttggacctacactggtccgcaccagtgaggataacatgaccgacatggtaactcacatgcctgacaggtataaaatagtcgagacactcatccaacattccgattggtttttcagcgacgaggaggataagggcgaaaggacccccgttggggacaaagagccacaggctgtccccaatatagaatatctgctgccaaatataggaaggaccgttcctccaggggaccctggaagcgctgacttgcttgagatatag

SEQ ID NO: 132501 - DNA, 4194 bp, Artificial Sequence
  Description of Artificial Sequence: Synthetic coding sequence
atggacaccattttcgttaagaacgtgaaagaggacggaccagcgcatagagccggtttgcgcactggtgatcggctggtgaaggtcaacggggagtccgttatcggcaagacctacagccaggttatcgctctgatacagaacagcgatgacacactcgaattgtcaatcatgcctaaggacgaggacatcctacagctggcttattctcaggatgcttaccttaaaggaaacgaaccatattccggcgaggcaaggagtatcccggaaccgcctcccatttgctatcctcggaagacgtacgctccaccagctagagccagtactcgcgcgactatggtccccgagccaacttcagccctcccaagtgatccacggtcccctgccgcctggtccgatcccggtctgcgagttcctcctgcagctcgcgctcatttggacaattcctcccttggaatgtctcaacctcgtccaagtccaggcgctttcccccacctgtcttctgaaccacgaacaccccgcgccttcccagaacctggctccagggtccctccctctcgcttggagtgccagcaggctcttagccattggcttagcaatcaggtgcccagacgtgctggggagagaagatgcccggccatggctcctcgcgcccgtagtgcatcacaggacaggctagaagaagtggccgcccccagaccatggccctgctcaacttcccaagacgccttgagccagctggggcaggaaggttggcaccgggcccggtccgatgactacctctccagggccactagaagcgctgaggcattaggcccaggcgcgcttgtctcaccgcgctttgagaggtgtggttgggcatcgcagaggtctagcgcaagaacgcctgcctgtcctacacgggacctgcccggcccccaggctccgcctccctctgggctccaggggctcgatgacctcggttatattggctaccggtcatactcaccctctttccagaggagaacgggtctgcttcacgccttgtcctttagagattctccctttggcggattgcccacattcaaccttgcacagagtcccgcctccttcccgcccgaagccagcgaaccaccacgggtggtgagacctgaaccttctacaagggctttagagccccccgcggaggataggggagacgaggtggtcctgcgacaaaagccccccactggccgcaaggtacaactgacccccgccaggcagatgaacctagggttcggcgatgagagccccgaacccgaagcatctggtcgtggcgagcgactaggcaggaaagtcgctccattggccactacagaggacagtctggcctccatccctttcatcgatgagcccacaagtccatcaattgatctgcaggccaaacatgtccccgccagcgccgtggtctctagcgcaatgaacagcgcgccggtgttgggtactagcccgtcctcccctacgttcacattcactctggggcgtcattactcacaggactgctcctctataaaggccggcagaaggtccagttacctgttggctataaccaccgaacgttccaaatcttgcgacgatggactgaatacctttcgggacgagggaagagtactgagaaggctgcccaaccgcattccgagcctcagaatgctgcggtcttttttcactgacggcagtcttgatagttggggcacatccgaggacgccgatgcccccagtaaaaggcactcaacaagcgatctatccgacgctacattttccgacatacggcgcgaaggatggctatattataagcagatcctgactaagaagggaaaaaaagctggcagcggcctgcggcaatggaaacgagtctatgctgcattgcgcgctcggagcctgagcctgtctaaggagaggagggagccagggccggccgcagctggcgccgcagcggctggggctggcgaggacgaagctgcccccgtgtgcattggaagctgtctggtggacatctcgtactctgagaccaaaaggcgacacgtgttcagactgaccacagcagacttctgtgaatacctgttccaggcagaagatcgggatgatatgctggggtggattcgggctattcgcgagaattctcgggccgaaggcgaggatccgggctgtgcgaaccaggcactgatcagcaagaagctgaatgattacagaaaagtttcccactccagcggcccaaaggccgacagttctccaaaaggcagcagaggtctggggggattaaagagtgagttcctaaaacagagcgccgccagaggtctgcgtacgcaggatctgcctgcaggatccaaagacgatagcgctgcagccccaaagaccccatggggcatcaatatcataaagaagaataagaaagctgccccccgggcatttggagtaaggctggaagagtgccagcccgcaacagagaaccagcgcgtgccactgatcgttgccgcttgctgtagaatcgttgaggccagaggtctggagtctacgggcatctaccgtgtgcctgggaacaacgctgttgtgtcctctttgcaagagcaactcaaccgggggccaggagacatcaacctgcaggacgaacgctggcaggacctcaatgtgatcagttccttgctgaagtcttttttccgcaagctccctgaaccactattcactgacgataaatacaatgacttcatcgaagccaatagaatcgaagatgcaagggaacgcatgaggacactacggaagctgattagggacctcccaggccactactatgaaaccctgaagttcttagtcggacacctcaaaaccattgcagatcacagcgagaagaacaaaatggaaccaagaaatcttgcccttgtttttggccctactttggttcgaacatccgaagataatatgaccgacatggtaacacatatgcctgacaggtataaaattgtcgagaccctgattcagcacagcgactggttctttagtgacgaggaagataaaggggaacggacccccgtcggggacaaagaaccccaagctgtgccaaacattgaatatctacttcccaatatcggcagaaccgtaccccctggcgatcctgggtccgacagcacaacctgcagcagtgccaagtcgaaaggatcttgggcacctaaaaaggaaccatacgctcgtgagatgctggcaatctcctttatcagtgccgtgaacaggaagaggaaaaagcggcgcgaagctagaggtctggggagttctactgacgacgactccgaacaggaggcacataaaccaggagccggggctacagctcccggcacacaggagcggccacagggcccgctccccggcgctgttgcaccagaggcacccggcagactttctcctcctgccgcccccgaggaacgcccagcagccgacacacggtctattgtgtctggatacagtacactgtctacgatggacaggtctgtgtgtagtggggcaagtggtcgccgcgctggagctggagatgaggcagatgacgaacgctccgagctctctcacgtggaaactgataccgagggcgctgctggtgctggtcccggcgggaggctgacaaggcgccccagctttagctcacaccatttgatgccctgcgacacacttgcacggcgcagactggccaggggccgccctgacggggaaggcgcagggaggggcggcccaagggcaccagaacctccgggctccgcctcgagtagttcccaggaatccctacgccccccagcagcagcgttagcctcccgccctagtcgcatggaagccctgcggctacggctccgggggactgccgacgatatgctggcggtgaggctgcgtcgcccattgtcccccgagactcgaaggaggagaagctcctggaggaggcatacagtggtggtacagtctccattgactgacctgaattttaacgagtggaaggaactgggcgggggcggaccaccggagcctgcaggtgccagggcgcatagcgataataaagactcgggactttcatctcttgagtccaccaaggcccgcgctcctagttctgctgctagccagcccccggccccaggggacaccggctctctccagagccagcccccccgccggagcgccgcgtcccgactgcaccagtgtttgtag

SEQ ID NO: 132502 - DNA, 1968 bp, Artificial Sequence
  Description of Artificial Sequence: Synthetic coding sequence
atgccagaagataggaattcgggcggttgtcctgcgggggcgctagctagcacccctttcattcccaaaactacttatcgccgtattaaacgttgctttagcttccggaaaggaatcttcggacagaaactggaagacaccgtgagatacgaaaaacgttacggaaatcggctcgcgcccatgttggttgaacagtgcgtggactttattaggcagcgcgggctcaaggaagaaggtctttttcggctgcctggccaggccaacctggtgaaagaacttcaggatgcctttgactgtggagagaaaccaagtttcgatagcaatactgatgttcacaccgtggcctcactcctcaagctctatctgagggaactgccagaaccagtgattccctacgctaaatacgaggatttcctcagctgtgcgaagctgctgagcaaggaggaagaagccggggtgaaggagcttgccaagcaagtgaagtctcttccggtggtaaattataatctcctgaagtacatttgtaggtttttggatgaggtgcagtcgtattcaggggtcaataagatgagcgtacagaatctggcaacggttttcggacctaacatactgaggcctaaagttgaagatcccctgaccatcatggaggggactgtggttgtacagcagcttatgagtgttatgatttcgaagcacgattgcctcttccccaaagacgcggaactccaatctaaaccacaagacggcgtctcaaacaataatgaaattcagaaaaaggcaacaatgggccaactgcagaataaggagaataataacactaaggactcccctagcagacaatgttcttgggacaagagcgagtctcctcagcgctcttccatgaacaatggatcacccactgccttaagtggcagcaagactaatagcccaaaaaattccgtgcacaaattagacgtatcaagatcaccaccattgatggtgaagaagaatccagcattcaacaaggggtctggcattgtgactaatggctcttttagcagcagcaatgctgagggactcgagaaaacccagacaactccaaatggcagcctgcaggcacggcgctcctcatcactgaaggtgtcaggaaccaagatgggcactcatagcgtgcaaaatggcaccgtgaggatgggcattctgaacagcgataccctcgggaatcctacgaatgtgcgaaatatgagctggctacccaacgggtatgtgacacttagggacaacaagcagaaggagcaggccggcgagctggggcaacataacagactgtctacgtacgacaacgttcaccagcagttctctatgatgaatctggatgacaagcagtctatagattcggcaacttggagcacatcttcttgcgagatcagcttgccagaaaacagtaattcctgccgaagttccacgaccacttgccctgagcaggacttttttggcggaaacttcgaggacccagttctggatgggccacctcaagatgatctgagccatccccgggactacgaatctaaaagtgaccataggtctgtcggcggaagaagctcccgcgcgacctccagctccgataatagcgagacatttgtcggaaacagctcatctaaccacagcgctctgcattccctggtgagttcgctgaagcaggagatgacgaagcaaaagatagagtacgagagtcgcatcaagtccctcgaacagcgtaaccttacactggaaactgaaatgatgtctttgcacgatgagctggatcaggaacgaaagaagttcactatgattgaaatcaagatgaggaacgccgagcgagcaaaggaggacgccgaaaaacgcaatgatatgctgcaaaaggagatggagcagttcttctcgacatttggcgaacttaccgtggaaccccggcgcactgagcgtgggaatacaatctggatccagtag

SEQ ID NO: 132503 - DNA, 1962 bp, Artificial Sequence
  Description of Artificial Sequence: Synthetic coding sequence
atgacggccaaccacgaatcatacttgttgatggcgagtacacagaatgatatggaggactgggtcaagagtattcgccgcgttatttggggtccattcgggggcggcatcttcggccaaaagctggaggatactgttaggtatgagaaaagatatgggaatcgacttgccccgatgcttgttgagcagtgtgtggattttattagacaacgggggttgaaggaagaaggtcttttcaggctccctgggcaggctaatctggtgaaggagctgcaggacgcatttgactgtggcgagaaaccttcatttgactcaaacactgacgttcatacggtcgccagcttactcaagctctacttgcgcgaactgcccgagccggttattccatacgctaagtacgaggactttttaagctgcgccaagcttctttcgaaggaggaggaggcgggcgtgaaagagctcgctaagcaggtcaaaagcctaccggtggtcaattacaatctgctgaagtacatctgtcgcttcctggatgaagtgcagtcgtattctggggtcaataagatgagcgtacagaatctcgcgacggtgtttggtcccaatatcctgaggcccaaagttgaagaccccctaacaatcatggaaggtactgtcgtcgtacagcaattgatgtctgtgatgatatcaaagcacgactgcctcttcccgaaggatgctgagctgcagtccaagccccaggacggggtttcgaacaataacgagatccaaaagaaggccacaatgggccagctgcaaaacaaagagaacaacaatacgaaggacagcccatctagacagtgtagttgggacaaatctgaaagcccacagcgcagcagtatgaacaacgggtcgccgactgcactgtccgggtccaagacaaattcccctaagaacagcgtccataaactggatgtgtcccggagccctcctttgatggtaaaaaagaacccggcattcaacaaaggctcgggcattgtgactaatggctcattctctagctccaacgctgagggactggaaaagacacagacgacgccaaacgggtccctccaggcccggcggtcctcaagcctgaaagtaagtggcacaaaaatgggaacccactctgtgcagaatggcacagttcggatgggtatccttaactcagacaccttaggcaatcccaccaacgtacggaacatgtcttggctccccaatggctacgtgaccctgcgggataataaacagaaggagcaagcaggcgaactaggtcagcacaatcgcctgagtacctatgacaatgttcaccagcagttctcaatgatgaacttggacgacaagcagtctatagactctgctacttggagtacttcgtcttgcgagatttcgctacctgagaacagcaactcgtgtagatcctccaccactacttgtccagagcaggacttcttcggagggaactttgaagatcctgtgctggacggaccccctcaagacgatttgtcccaccccagagactacgaatcaaaatccgatcaccggagcgtggggggtaggtcatccagggccacctcatcttctgataatagcgagaccttcgtggggaatagtagtagtaatcactccgccctgcactccctcgtctcgagcctgaagcaggagatgacaaaacagaaaatcgaatacgagagccggattaagagtctggaacagaggaatctgacactcgagactgagatgatgagtttgcatgatgagctggatcaggaacgcaagaagtttacaatgattgagatcaagatgcgcaatgcagaacgtgcgaaagaggatgctgaaaaacggaatgatatgctccaaaaggagatggagcagtttttctccacgttcggcgaacttaccgttgaacctagacgcactgaaaggggcaatacgatctggatccagtag

SEQ ID NO: 132504 - DNA, 2247 bp, Artificial Sequence
  Description of Artificial Sequence: Synthetic coding sequence
atggaagagaacaatgacagcaccgaaaacccccagcaagggcaggggcggcagaacgctattaaatgcggctggctgcgtaagcagggcgggtttgtgaaaacctggcacactcggtggtttgttctgaaaggtgatcagctgtattactttaaggacgaggatgagacaaagcctcttggaacaatattcctcccagggaacaaagtaagcgaacacccatgcaacgaggagaaccccggtaagttcttatttgaggtggtccctggaggggatcgcgaccgaatgaccgctaatcatgaatcctatctcttgatggcaagtacccagaacgacatggaggactgggtcaagtccatacgaagagtcatttggggcccattcggcggcggcatctttggccaaaagctggaggatacggtgcgctacgagaagaggtatggcaatcgccttgcccccatgctcgtggaacagtgcgtcgactttatccggcagcggggactcaaggaggaaggactgttccgtctgcccggtcaggctaacttggtcaaggagttgcaggacgcctttgactgtggcgaaaaacctagcttcgactctaacacagacgtgcatactgtggcctctttgctgaaactgtacctccgggaattgccagaacctgtaattccctatgcaaaatacgaggacttcctatcctgtgccaagctgctgagtaaagaggaggaagccggcgtcaaagaattggcaaaacaggtgaaatctttgcctgtagtgaactataatttgctgaagtatatttgccgctttctggacgaagtacagtcctactccggggtgaataagatgtccgtgcagaacctggctaccgtgttcgggccaaacattctgaggccaaaggttgaagatccactgacgatcatggagggcacagtcgtcgtgcagcagctgatgagcgtcatgatttcaaagcacgactgtcttttcccaaaggatgcagagctccaatcaaaaccccaggacggcgttagcaataacaacgagatccagaagaaggcaaccatgggccagttgcagaataaagagaacaacaataccaaagattccccgtcacggcagtgctcttgggataaatccgagagtccacagagatcctcaatgaataatggttctcccacagctttatctggcagcaagacaaatagccccaaaaattcagtccacaaactggacgtgtcccgttctccaccactgatggtcaaaaagaaccccgcctttaacaagggaagcgggattgtgaccaacggctccttttcttcgtccaacgctgaaggattagagaagactcagacaacacctaacgggtccctgcaggctaggcgctcatctagtcttaaggtgagtggcactaaaatgggcactcactctgtgcagaatggaacggtgaggatgggaattctcaactcggacaccctcgggaatcctaccaacgttcgcaacatgagctggctcccgaacggttacgtgacactcagggacaataagcagaaagaacaagccggagagctcggccaacataataggcttagtacatatgataacgtccatcagcagttttccatgatgaatctcgacgacaaacagtcaatcgactccgcaacatggagtaccagtagttgcgaaatatccctccctgagaattcgaactcctgtcggtcatccacaacgacctgccccgagcaagatttttttggaggcaactttgaagaccccgtgctggatggtccccctcaggatgacctgtctcacccccgcgattacgaatctaagtccgaccacaggagcgttgggggcaggtcttcaagagccactagttcgtcagacaactctgaaactttcgttggtaacagcagttccaaccacagcgctcttcacagcctcgtgtcaagcctcaagcaagagatgacaaagcagaaaatcgagtatgagtcacgaattaaatcgctcgagcaacggaaccttaccctcgaaacagaaatgatgtctctgcacgatgagctagaccaagagagaaaaaagtttaccatgatagagatcaaaatgcgcaatgccgagagagcaaaagaggacgccgagaaacggaacgatatgctccagaaagaaatggagcagttttttagcacattcggcgagctcaccgtggagcccaggcgaacagagcgagggaataccatttggatacagtag

SEQ ID NO: 132505 - DNA, 741 bp, Artificial Sequence
  Description of Artificial Sequence: Synthetic coding sequence
atggaagagaacaatgactccacggagaatccacagcaaggccaggggcgccagaatgccattaagtgtggatggttgaggaagcagggtggctttgtcaaaacctggcatacccgctggtttgtattgaagggagaccagttgtattatttcaaggatgaagacgagactaaaccacttgggacaattttcttaccaggcaataaggtgtctgagcacccatgtaacgaagagaatcctggtaaattcctctttgaagtggtacccgggggggaccgagatcggatgacagctaaccacgaatcatatctcttgatggcctctacgcagaacgatatggaggactgggtgaagtcaatacgccgggtgatttgggggcctttcggcggaggcatattcgggcaaaaactggaagacacggtccgatacgagaaaaggtacgggaatcgtctcgcgccgatgttggtagaacaatgcgtggactttatccgtcagagaggcctgaaagaagagggactcttcaggttgcctggtcaggccaacttggtgaaagagctgcaggatgcattcgattgcggcgaaaagccaagcttcgacagcaatactgacgtgcacacggttgcgagtctgctgaagctatatctgcgagagctaccggagcctgtgattccctacgctaaatatgaggactttctgagctgcgcaaagctgctcagcaaagaggaggaggctgtgagttag

SEQ ID NO: 132506 - DNA, 249 bp, Artificial Sequence
  Description of Artificial Sequence: Synthetic coding sequence
atgacagccaatcatgagtcctacttactcatggcctcaacacaaaacgacatggaggactgggtgaaatccatcagacgtgtcatttggggcccgtttggaggcggcatcttcggccagaagctggaggataccgtgcggtatgaaaagcggtatggtaacagactggcccctatgcttgtggaacagtgtgttgacttcatccggcagcgcgggctcaaagaggagggcttgtttcgcctcccatag

SEQ ID NO: 132507 - DNA, 1938 bp, Artificial Sequence
  Description of Artificial Sequence: Synthetic coding sequence
atgagtctgaaattgccccgtaattgggactttaacctgaaggtggaggccgccaaaattgcgcgaagtaggtctgtcatgacgggagaacaaatggctgcttttcacccctcatcgacaccaaatcccctcgagagaccaattaagatggggtggctgaagaagcaacgatctattgtcaagaattggcagcagaggtactttgtgctgcgagctcagcaactatactactataaagatgaagaggatacaaagccacagggatgcatgtacttacccggatgtactattaaggaaatcgcaacgaatcctgaggaagccggcaagttcgtgttcgagattatacccgcaagctgggaccagaatcggatggggcaggattcctatgtactgatggcctcttctcaagccgagatggaagagtgggttaagtttctcagaagagtcgcaggcacgccatgcggagtatttggacagcgacttgacgagaccgtcgcttacgagcaaaaatttggcccccacctggtgccaatcctggtggaaaaatgcgcggagttcattctggagcatggccggaatgaggagggcatctttagattgcctggccaggacaatctggtgaagcaattacgcgacgcattcgatgcgggtgagcgcccgtctttcgatcgggatactgatgtgcacacagtggcctcacttttgaaactatatctgagggatctccctgaacctgtcgtgccttggtcccagtacgagggttttctcctgtgtggtcagcttacgaacgccgacgaggcaaaggcccagcaggagctgatgaaacaactgtcgatcctcccaagggacaattacagtctgctctcatatatttgtcgcttcctgcacgaaatccagctcaactgcgccgtcaataagatgtcagtggataacctggctacggtgataggggtcaaccttatcagatctaaggtcgaggatcccgctgtgatcatgcgggggacccctcagattcaaagagtgatgaccatgatgatccgcgaccacgaagtattatttcctaaatccaaagacattccactgtcaccacccgctcagaaaaatgacccgaaaaaagccccagtagctagatccagcgtaggatgggatgccaccgaggacctgcggatatcaaggaccgattctttttctagcatgacctccgacagcgacacaacctctcccaccggccaacagccatccgacgccttccctgaagactccagtaaagtgccacgggagaagccaggtgactggaagatgcagtcaagaaagcgaacgcaaacattaccgaacaggaagtgtttcttgactagtgcctttcaaggcgccaacagtagtaagatggagatatttaaaaatgaattctggtcgccttcttctgaagcgaaggctggggaaggccacagacgtaccatgagccaagacctccggcagctgtccgattcacagaggaccagcacttatgacaacgttccgagcctgccaggatctcccggcgaagaagcttctgctctgagcagtcaagcctgtgacagcaagggggatacattggcatcccctaactccgaaaccgggcctggtaaaaagaacagtggcgaggaggagatcgactccttgcaacgcatggtgcaagaactacgaaaggaaattgaaacgcagaagcagatgtatgaggaacagattaagaatcttgagaaagagaattatgacgtctgggcaaaggtagtgcgtctaaacgaagagctcgagaaggagaaaaagaaatcagctgccctggaaataagcttgcgcaatatggagcgtagccgcgaggacgtcgagaagcggaacaaggccctggaagaggaagtgaaggagtttgtgaaatcaatgaaggaacctaagacagaagcatag

SEQ ID NO: 132508 - DNA, 1917 bp, Artificial Sequence
  Description of Artificial Sequence: Synthetic coding sequence
atgtcgcttggtcagtcagcctgcctctttctgagcatagcacgaagccgcagtgtcatgacaggagagcagatggctgccttccatccttctagcacccctaaccccctggagagacctataaaaatgggttggcttaagaagcagcggagcatagtcaaaaattggcagcagcgatatttcgtgctgcgcgcccagcagctgtactattacaaagatgaagaggacactaagccacaaggatgcatgtacctgcctggttgcaccattaaagaaattgccactaaccccgaagaggctggaaagttcgtttttgaaatcattccggcctcctgggaccagaataggatggggcaggactcttacgttctgatggcctcaagtcaggctgaaatggaagagtgggtgaagttcttgcgaagggtggctggaaccccctgtggtgtgttcgggcagaggctggatgaaaccgtggcttacgagcagaagttcggaccacacctggtacctatccttgtggagaaatgcgccgagttcattctagaacacggcaggaatgaggagggtatcttcaggctgccaggtcaagacaaccttgtgaaacagctccgggatgccttcgatgcaggggagaggccatcctttgatcgcgataccgatgtgcacaccgtggcttcattgctgaaactgtaccttagagatttgcccgaacccgtggtgccctggtcacagtacgaaggctttctattgtgcggtcagctgacaaacgccgatgaagccaaggctcagcaggagctgatgaaacagcttagcattttgcctcgggacaactactctctgctttcctacatctgtcgattcctgcatgaaattcagctgaactgtgctgtgaataaaatgtctgtcgacaaccttgccacagtaatcggcgttaacctgattcgctctaaggttgaggatcccgcggtaatcatgcgtggcactccccagattcagcgcgtgatgactatgatgattagagatcacgaagtactgttccccaaaagcaaggatatcccccttagtccacctgcacagaaaaatgatccgaaaaaagccccggtcgcacggtccagcgtaggctgggatgcaacagaagacctgaggatcagtcgaaccgatagtttctcctcaatgacaagcgacagcgatactaccagcccaaccgggcagcagccttccgatgcattccctgaggacagctccaaagttccgcgagaaaaaccaggcgactggaagatgcagtcaaggaagaggacgcagaccctgcctaacagaaagtgcttcctgacctcagcgttccaaggggcaaatagcagcaaaatggagatttttaaaaatgaattttggtccccaagctctgaggcaaaggctggagagggacatcggaggaccatgtcgcaagacctgaggcagctgagcgactcccagcggacctcaacatacgataacgtaccgagcctgcctgggagccctggagaggaggcctccgccttatccagccaggcttgcgacagtaagggcgataccctggcttcacccaatagcgagacagggcctggaaaaaagaactcaggagaggaggagatagacagcctgcagcgcatggtgcaggaacttcggaaagaaatagaaactcagaagcagatgtacgaagagcaaatcaagaatttagaaaaggaaaattatgacgtttgggcgaaggtggtgcgcctcaacgaggaacttgagaaagaaaaaaagaagagtgccgcgctggaaataagtctgaggaacatggagcgtagccgggaggacgttgaaaaacggaacaaagccttagaagaggaggtcaaggaattcgtgaaaagcatgaaggaacctaaaacagaggcctag

SEQ ID NO: 132509 - DNA, 1941 bp, Artificial Sequence
  Description of Artificial Sequence: Synthetic coding sequence
atgagtctgaaactgcctcggaattgggatttcaacctgaaagtggaagctgctaagatagccagatcaaggtctgtgatgacaggcgagcagatggcagcattccatccttcctccacaccaaaccctttagagcggccaatcaaaatgggatggcttaagaagcaacgatccatcgttaaaaactggcagcaacgctatttcgtgcttcgagctcagcagctctactattacaaggatgaagaggacaccaagccccagggctgtatgtatctgcctgggtgcacaattaaggagattgctactaaccccgaggaggccggtaagtttgtgttcgaaattatcccagcatcctgggatcagaataggatgggacaggattcatacgttctgatggctagttcgcaggctgagatggaggaatgggttaaattcctcagaagggtggccggaactccttgcggggccgtgtttggtcagagacttgacgagacggtcgcatacgagcagaagttcggaccccatctggtgccaattctcgtggaaaagtgtgcagagttcattcttgaacacggacggaatgaagaaggcatcttcaggctgccgggtcaggacaatcttgtgaaacaactccgggatgcctttgatgctggcgagcgcccaagctttgaccgtgatacagacgttcacacagtcgcctccctgcttaagttgtacttgagagatttgcccgaacctgtggtaccctggtcccagtatgagggcttccttctttgtgggcaactgacaaacgccgacgaagcgaaggcacagcaggagcttatgaagcagttaagtattctgcccagagacaactatagtcttttgtcctacatctgtaggttcctgcatgagattcagctgaactgtgcagttaacaagatgagtgtcgataacctggctacggtcattggcgtgaatctgatacggagcaaagtggaggatcccgctgtcatcatgcggggcacacctcaaattcagcgtgtgatgaccatgatgattagggatcacgaggtgctgttccccaaaagtaaagatatcccgttatccccaccggctcaaaagaatgacccaaaaaaggctcccgtggcccggtcttccgtgggctgggatgcaaccgaagatctcaggatttcgaggactgactccttttcaagtatgacatcggattcagatacaacctctcccacaggtcagcagccctctgatgcgttcccagaggactcttctaaggtacctcgggagaaaccaggagattggaagatgcagagtcggaagcgcacccagacccttcctaatcgcaagtgcttcctcacatctgcttttcaaggggcaaactcctccaagatggagatatttaagaatgaattttggagcccttccagtgaggcgaaagccggagaggggcatcgacgaaccatgagccaagacttgcgccagctgtccgattctcagcggactagcacttatgacaatgttcctagtctccccggaagtccaggggaggaggccagcgccctctcaagtcaggcttgcgatagcaaaggtgatacattggcctcacccaattctgaaaccggccctgggaaaaaaaactcaggtgaggaagagatcgattcactgcagagaatggtgcaagaacttcgaaaggaaattgagacgcagaaacagatgtatgaagagcaaatcaaaaacttagagaaagagaactacgacgtttgggccaaagtggtcaggctgaacgaggagctcgagaaggagaaaaagaagagcgccgctcttgagatctctctcaggaatatggaacgatctcgagaggatgttgagaagagaaataaagcccttgaagaagaggtgaaagagttcgtgaagagcatgaaggagccaaaaacagaggcttag

SEQ ID NO: 132510 - DNA, 1920 bp, Artificial Sequence
  Description of Artificial Sequence: Synthetic coding sequence
atgtccttgggtcagtccgcttgcctttttttgtccattgcaaggagcaggtcagttatgacaggagaacagatggccgcatttcatccttcatccactccaaacccactcgaacgtccaatcaagatgggatggctaaagaagcagcggtcaatcgtcaagaattggcagcagagatattttgtactgcgggctcaacagctgtactattataaggacgaagaagacactaagccgcaaggttgtatgtatttgcctggttgtaccatcaaggagatagccaccaacccagaggaggcgggcaagtttgtgtttgagattatcccagcctcatgggaccaaaatcggatggggcaggacagctacgtcctgatggcctcttcccaggcagagatggaggagtgggtgaagttcctgaggagagtggcaggcaccccctgcggagcggtcttcggtcaaaggctggacgaaacagtggcatacgagcaaaaatttggcccccacctggtgccaatcctggttgagaaatgtgcggagtttattctagaacacgggcgcaacgaagagggcatcttcagactgcctggtcaagacaatttagtgaagcaattgcgtgacgcgtttgacgcaggtgaacgccccagtttcgatcgagacacagacgtacacacggtggcatccttgcttaaactctacttgcgagatctgccggagccagtggttccctggtctcagtatgaagggtttttgctttgtggacaactgacaaacgcagacgaggctaaggcacagcaagaacttatgaaacagctctcaattctcccccgagacaactactccctcctgtcttatatatgtaggtttttgcacgaaatccagctgaactgtgcggtgaacaagatgtcagtagacaacctggcgactgtcattggagtcaatctgataaggtccaaggttgaagaccccgccgtgatcatgcggggcacacctcagattcagagggtgatgaccatgatgatcagagaccacgaggtcctgtttcccaagtccaaagacattccattgtccccgcccgctcaaaagaatgaccccaagaaagctcccgtggctaggagctccgtgggatgggatgcgacagaagatcttagaatatctcgcaccgatagcttttcaagcatgacctctgatagcgataccacaagccccaccggccagcaaccctccgacgcattccctgaggacagcagcaaagtccctagagagaagccgggagattggaagatgcaatcaaggaagcggacacagacccttcccaaccggaaatgcttccttacatccgcttttcagggtgccaacagcagcaaaatggaaattttcaagaatgagttctggtctccctctagcgaggccaaggcaggagaaggtcatagaaggaccatgagccaggacttgaggcagctctccgactctcaacggactagcacatacgataacgtgccctccctgccaggtagccccggtgaggaagcttccgctctgagctcgcaggcttgtgactctaaaggcgacactttggcttcccccaactcagagacaggaccgggcaaaaaaaattccggtgaggaggagatcgattccctccagcggatggtgcaggagctgcgcaaagagatcgaaactcagaagcagatgtatgaggagcagatcaaaaacctggagaaagagaactacgatgtttgggcgaaagttgttaggctaaatgaggagctcgaaaaggaaaaaaaaaagtccgccgccctcgaaatcagcctgcggaatatggagcgctcgcgggaggatgtcgaaaaaaggaataaagcattagaagaggaagtcaaggagttcgtgaagtcaatgaaggagccgaaaacagaagcctag

SEQ ID NO: 132511 - DNA, 852 bp, Artificial Sequence
  Description of Artificial Sequence: Synthetic coding sequence
atgaccggggagcagatggcagcctttcacccttcatccaccccaaacccactggagaggccaatcaagatgggatggttgaaaaagcagcggtctatcgttaagaactggcagcagcgatacttcgttctaagagcccagcagctttactattacaaagatgaagaggacacgaagccccagggctgcatgtacctgccagggtgtactataaaggagatcgccaccaatccagaggaggcagggaaattcgtctttgagatcatcccagcgtcttgggaccagaatagaatggggcaggattcctatgtcctgatggcaagttcccaggccgagatggaggaatgggttaagtttctgcgacgcgtggctggaactccttgtggggcagtattcggccagcggctggatgaaacagtggcttacgagcagaaatttggtccacatctcgtgcccattcttgtggaaaagtgcgcggagttcatactggaacacggtagaaatgaggaggggatatttcgactgcccggacaagataatctagtgaagcagttgcgagacgcctttgacgccggggagcgccctagctttgatagggacaccgacgttcataccgtggcttccttgctgaaattatacctccgtgatctgcctgaaccggtcgttccatggagccagtacgagggattcttactgtgtggtcagcttacaaacgctgatgaggccaagaactatcgaaaccggaacgactgtcagtccgttgtttcagcacagatacaccagttttgcccacgggtgtcactgttagcgcatggccaggctcacctgctcgtgaacgacctactagtttag

SEQ ID NO: 132512 - DNA, 1776 bp, Artificial Sequence
  Description of Artificial Sequence: Synthetic coding sequence
atgtcgctaggacagagtgcatgcctgtttctgtcaatcgcccgtagtcggtcggtgatgaccggtgaacagatggccgcttttcatccttctagcacaccaaatcctcttgagcgccccatcaaaatgggctggctcaagaagcagcggtcaatcgtgaagaattggcaacaaagatattttgttttgcgggcccagcagctgtattactacaaggacgaagaggatactaagcctcagggatgtatgtacttacctggttgcacgatcaaagaaatagccacgaaccccgaagaggctgggaaattcgtgtttgaaatcatacctgcgagctgggatcagaataggatggggcaggacagctatgttttgatggctagcagccaggcagaaatggaagagtgggtcaaatttcttcgccgcgtcgcaggcacaccctgcggagctgtcttcggccagcggctcgacgagaccgttgcatatgagcagaagttcgggcctcacctggtgcccatacttgtggagaagtgcgccgaatttatactggagcacgggcgaaacgaggagggtatttttagactgccaggccaggataatctggtgaaacaattgcgcgacgccttcgatgccggggaaaggcccagttttgaccgtgacacagatgttcacactgtggcctcattgctgaaactgtatttgcgggaccttcctgagcccgtcgtcccgtggagccagtacgaaggttttttgttgtgcgggcaactcacgaatgcggatgaggcaaaagcccagcaagaactaatgaagcaattgtccatcctgcctcgtgataattattcccttttgtcttacatctgccgatttctgcatgaaattcagctgaattgtgcggtaaataagatgtcagtggataacttggcaacagttatcggtgtgaatttaatcaggtccaaagtcgaagaccctgctgtgatcatgcggggtacccctcagatccagcgagtgatgactatgatgatccgcgatcacgaggtattattcccaaagtccaaagatatccccttaagcccccctgctcagaagaatgaccccaaaaaggcgccagtagcccgcagtagcgtgggctgggatgcaacagaggatctgcggatctcaagaacggactccttttcatccatgacgagcgactctgacaccacctctcccacgggccaacaaccttcggatgctttccctgaggactcttccaaggtgccgcgcgagaagcctggagattggaagatgcagagcagaaagcgcacacaaacactgcccaatcggaaatgttttctcacaagcgcctttcagggggccaatagcagtaaaatggagattttcaagaacgagttctggtcgcctagttcagaggctaaggcgggggagggacatcgtaggactatgtcccaggacttaagacagctgtcggacagccagaggacctcaacctatgataacgttccaagccttcctggctctccaggtgaagaagcctcagccctgagcagccaggcttgtgatagtaagggggataccctcgcctccccaaactcagagacgggccccggaaaaaaaaactccggcgaggaagagattgacagtctccaaaggatggtacaggagctgcggaaggagattgagactcagaaacagatgtacgaagagcaaattaagaacctggagaaggagaactatgacgtctgggccaaggtagttcgtccttttttatcagccatctag

SEQ ID NO: 132513 - DNA, 1377 bp, Artificial Sequence
  Description of Artificial Sequence: Synthetic coding sequence
atgtccctgggacaaagtgcgtgcctgttcctgagcatagcacgtagtaggagcgtgatgactggcgagcagatggctgcgttccacccatcgagcactcctaatcccctcgagcgccctatcaaaatgggctggcttaagaagcagagaagtatcgttaaaaactggcagcagcgatatttcgtgcttagggctcagcaactgtactactacaaggatgaggaggacactaagccacaaggctgcatgtacctgccaggttgcacgattaaagagatagcaaccaatccggaagaggctggcaagttcgtctttgaaatcatccccgcctcatgggatcaaaacaggatgggccaagactcatatgttttaatggcatcatcccaagctgaaatggaggaatgggtgaaatttctgagaagggtagcggggaccccatgtggggccgtattcggccaaaggcttgatgagaccgtggcttacgagcaaaaattcggcccgcacctcgtgcctattctagtggagaagtgtgccgagtttattctggaacatgggaggaacgaagaaggtatatttaggttgccagggcaggacaatcttgtgaagcagctgagagacgccttcgacgcgggggagcgcccttcttttgaccgcgacacagatgtccacaccgtcgcttctctgctcaaactgtatctccgcgacctgcccgaacccgtggtgccatggagtcaatacgaaggcttccttctgtgcggacagctaacgaacgccgacgaagctaaagctcagcaagaattgatgaagcagttatccatcctgccccgcgacaattactctctcttatcctacatctgccggtttctgcatgaaatccaactgaattgtgccgtcaataagatgtcagtcgataacctcgctacagtgataggggtcaaccttatccgatcgaaggtagaagaccctgcggtcatcatgcggggaaccccacagatccagcgggtaatgacaatgatgatacgagaccatgaagtcttatttccaaaatctaaagacattccactgagcccaccagcccagaaaaatgacccgaaaaaggctcccgtcgctagatcatccgtggggtgggatgctacagaagatctccgcatatcccggacagattccttttcatcgatggtgcggtgcagagagccgagctgtttccactgggtgttacccctggtacaggccatcccatgcaaagcgtgttcccgggttgcgatttggggagtgcttggagacgccgttgctgtgggagccgcagctactgacagctccgagcacacacttaaggcctggccactgagcaaatcatcattctattggcatctttag

SEQ ID NO: 132514 - DNA, 1893 bp, Artificial Sequence
  Description of Artificial Sequence: Synthetic coding sequence
atgtcactcggccaatcagcgtgtctgtttctctcaatagcaagatccagatcagtaatgaccggcgagcagatggctgcctttcacccctctagtacgcccaaccccctggaacgacctattaagatgggctggcttaaaaaacagcgtagcatcgtgaagaattggcagcagtcctattattacaaggatgaggaggacactaagccgcagggatgtatgtatttgccaggctgtacaatcaaagagatcgctaccaatcccgaagaagctggtaaatttgtgttcgagattattcctgcaagttgggaccagaaccgaatgggtcaggacagctatgttttgatggcctcctcccaggccgagatggaggaatgggtaaagtttctgagaagagtggctggcactccgtgtggcgccgtgttcggacagagactggacgagacagtcgcttatgaacagaagttcggacctcacttggtacctatcttagtggaaaaatgcgcggaattcatactggaacacggcagaaatgaggaaggaatttttcgcctgcccgggcaagataaccttgtgaagcaactgagagacgcgttcgacgctggggaacgcccgtccttcgaccgcgatacagatgtccacacggtggcctctctgttgaagctctatctgagagatctccccgagcctgttgtgccatggagccagtacgagggctttctgctgtgtggccaattaacgaatgctgacgaggcgaaggcacagcaggaactgatgaagcagctgagcattttgcctcgcgacaattatagcctgttgtcctatatttgtcggtttctgcacgagattcagctgaattgtgccgtgaacaagatgtcagtggacaatcttgcgactgtgattggagtgaatctcattcgttctaaggtagaggatccagccgtcatcatgcgcgggacccctcagattcagcgcgtgatgactatgatgattagagatcacgaggtactgttccctaagtccaaggatattcccctctccccgccggctcaaaagaacgatccaaagaaagcaccagtagcaagaagctcagttggatgggacgccaccgaagatttgcgcatttcacgcactgactccttcagcagcatgacctctgattccgacacaactagccccacaggccagcagccaagtgacgcctttcccgaggactcctcaaaagtgcccagagaaaagcccggagactggaaaatgcagtcacgcaaaaggacacagaccctgccaaacagaaagtgtttccttactagtgccttccagggggccaatagctccaaaatggaaatcttcaagaacgaattctggagcccatcgtccgaggcgaaagctggcgaagggcatagacgtactatgagtcaggatctgagacagttatccgattcacagcgcacctctacctatgataacgttccaagtctgcccggttctccaggggaggaagctagcgcgctgagcagccaggcctgtgactctaaaggcgacacgctcgcaagccctaattctgagactggacctgggaagaagaacagcggtgaggaagaaatcgactcactccagcggatggtgcaggaactgagaaaagaaattgagacgcagaaacagatgtacgaggagcagattaagaacctagaaaaggaaaactatgacgtgtgggcgaaggtggtgcgcctgaatgaagagcttgaaaaggaaaagaagaaaagcgccgcccttgaaatatcccttcgaaacatggagagatcaagagaggacgtggaaaaacgcaataaggcccttgaagaggaggtgaaagaatttgttaaaagtatgaaagaacctaaaacagaggcttag

SEQ ID NO: 132515 - DNA, 852 bp, Artificial Sequence
  Description of Artificial Sequence: Synthetic coding sequence
atgaccggagagcagatggccgcattccacccctcctcgacacctaatcccctagaaaggcctatcaagatgggctggcttaagaagcaacggtcaattgtgaagaactggcaacaacggtacttcgtcctgagagcgcagcaactgtactactataaagacgaagaagatacgaagccacaagggtgcatgtatctcccaggctgcaccattaaagaaatcgccacaaaccccgaggaagccggtaagtttgtgttcgagatcattcccgccagctgggatcagaaccgcatgggccaagactcgtatgtgctcatggcgtcaagccaggctgaaatggaggagtgggtcaagtttctcagacgcgttgccgggactccttgcggggctgtattcgggcagcgcctggatgaaaccgtcgcctacgaacaaaaatttggcccacaccttgtgcctatcctcgttgagaagtgcgccgaatttattctggaacacggccggaatgaggaaggcatcttccgtctccccggtcaggacaatctagtaaagcaattaagagacgcgtttgacgctggagagcgcccttcttttgatcgagacactgacgtccacaccgtggcatcactcctcaagctctacctacgagacctcccagagcccgtagtcccatggagccaatacgaggggttcctgttatgtggacagctcactaacgcggatgaggccaagaactaccggaacaggaacgattgtcaatccgtcgtcagtgcacagatccatcagttctgcccccgcgtatccctcctagcccatggccaagctcacctcctggtgaacgacttgttggtatag

SEQ ID NO: 132516 - DNA, 1821 bp, Artificial Sequence
  Description of Artificial Sequence: Synthetic coding sequence
atgagtttgaagttacccaggaattgggacttcaatctgaaggtcgaggccgccaagattgcacgatcccgttctgtaatgactggcgaacagatggcggcctttcacccaagcagcacacccaatccgctcgagcggcctattaaaatggggtggttgaagaagcaacggagcattgtgaagaactggcagcagcgctattttgtcctgagggctcagcagctctactattataaggacgaagaagacaccaaacctcagggctgtatgtacctccccggctgtacgataaaggagatcgctaccaaccccgaagaagcaggtaagttcgtgtttgagattatccctgtattcggacagcggttggacgagactgtggcctacgagcagaagtttgggccccatctggttcccattttagttgagaaatgcgcagaatttatcttggaacacggccgaaacgaggagggcattttccggcttcccggacaggacaatttggtgaagcagctgagggacgcatttgatgcaggcgagcgacccagctttgaccgcgacaccgacgtgcatacggtggcgtcgcttctgaagctgtatctgagagacttgcctgaacccgtagtgccttggtcccaatacgagggattcctcctgtgcggacaactgacaaacgctgacgaggccaaggcacaacaggaactgatgaagcagttgagtatactgccccgagacaactattctctgctgtcctacatatgtagattcctgcatgaaatacagctgaactgcgccgtcaataaaatgtcagtggacaacctcgccacagttatcggcgtgaatctcatccggtccaaagtagaggatcccgcagtaattatgcgcgggaccccccagatccagcgcgtgatgacgatgatgatcagggatcatgaggtgttgtttcccaagtccaaagatatcccactcagtcctcctgctcagaaaaatgacccgaagaaagccccggtggctaggtcatccgtcggctgggacgccaccgaggacttgcggatcagtcgtaccgacagcttcagtagcatgacaagcgactctgatacaactagccccaccggccagcaaccgtctgatgccttccccgaggacagcagcaaagttccacgtgaaaagcctggggattggaaaatgcaaagccggaagcgaactcaaaccctgccaaatcgtaagtgctttttaacttccgcctttcaaggagccaatagcagcaagatggagatctttaagaacgagttttggtctccttcttcagaagcaaaagctggcgaagggcataggcggactatgtctcaggatctgaggcaactgagcgactcccagcgcaccagcacctatgataatgttcccagtttacccgggtctcccggtgaagaagcttccgccctctcttcccaggcttgcgactccaagggcgataccctggcatcgcctaattctgaaactggtcctggaaaaaaaaacagtggagaggaggaaatagactctctccagaggatggtgcaggagctccgcaaagaaatagaaacccaaaagcagatgtacgaagaacagatcaagaacctcgaaaaggagaactacgatgtatgggcaaaagtggtcagactcaacgaagagctcgagaaagagaagaagaagtccgctgccttggagatctctttgcggaatatggagcgatctcgcgaggatgtagagaagcggaataaagccctggaggaggaggtgaaggaattcgtgaaatccatgaaggagccaaagactgaagcctag

SEQ ID NO: 132517 - DNA, 2445 bp, Artificial Sequence
  Description of Artificial Sequence: Synthetic coding sequence
atggggttgcctgccttggaattcagtgactgctgtctggatagcccacacttccgggagaccctgaaatcgcacgaagctgagcttgacaaaaccaacaagtttatcaaggaactcataaaagacggaaagtctcttatatctgctcttaagaacctcagctcggccaaacgcaaattcgctgactcgttgaacgaatttaagtttcagtgcattggagatgctgaaactgatgacgagatgtgcatcgctaggtcactgcaagaatttgcgacagtactcaggaacctggaagatgagcgaattagaatgattgaaaatgcctccgaggtcctgattactccactagaaaaattccggaaggagcagataggggccgccaaagaagcaaagaagaaatacgacaaggaaactgaaaaatattgtggtatcttagagaagcacttgaacctaagctctaagaaaaaggagtcacagctgcaggaggcagactcacaggtcgaccttgttcggcagcatttttacgaagttagcctggagtacgtgttcaaagtgcaggaagttcaggaacggaaaatgtttgaattcgttgaaccactactggcttttctccaggggctgttcaccttttatcaccacggctacgaattggcgaaagattttggagactttaagacccaactcaccattagcattcaaaacaccagaaaccgcttcgagggaacccgctcagaagtggagtccctgatgaagaaaatgaaagaaaacccactggagcacaaaaccatttcgccctacaccatggaaggttatctgtatgtccaggagaagcggcacttcgggacatcatgggtcaagcattattgcacttaccaaagagactccaagcagattacgatggtcccgtttgaccagaagtctggtggaaaggggggcgaagacgagtccgtgatcttgaagtcatgtacgcgtcgtaagaccgactcaatcgagaaacggttctgcttcgatgtcgaggccgttgaccgccccggcgtcataacaatgcaagccctgagcgaggaggaccgcagactgtggatggaagctatggatggccgcgaaccggtgtataattcaaataaagactctcagagcgaggggacagctcagctggacagcataggtttctccattataagaaagtgcatacacgctgtggagaccaggggcataaacgaacaagggctatataggattgtgggtgtgaactctcgagtccagaagttgttgagcgtcctgatggacccaaaaactgcctctgagaccgagactgatatctgcgctgagtgggaaattaaaactatcacatctgctttgaaaacctacttaaggatgttgcccggacctctcatgatgtatcagttccagagatcctttattaaagcagctaagctagaaaaccaagagtcaagagtgtctgagattcatagtctggttcaccgattgccagaaaaaaatcggcaaatgctgcagctcctgatgaatcacttagccaatgtcgccaacaatcataagcaaaacttgatgaccgttgccaacctgggcgtcgtattcggtccgactctgttgcggccacaggaggagacagtagcagccattatggacattaaattccaaaatatcgtgattgaaattctgattgagaatcacgagaagatattcaatacggtgccagatatgccactgacgaacgcccagctacacctttctcgtaagaaatccagtgactcgaagcctccttcctgcagcgagcggccgctgaccttgttccatacagtacagtctacggagaagcaggaacagaggaattctatcatcaactccagcctcgaaagtgtcagttccaaccctaactctatactgaattccagttctagcctgcaacctaatatgaactcaagcgaccccgacctcgccgtggtaaagcctacaagaccaaacagcctgcccccaaacccgtctcctacgtcccccctgtccccttcttggcccatgtttagcgccccttccagtccaatgcctaccagctcgacgtcatctgatagctcccccgtgcggagcgtcgcaggtttcgtatggttctccgttgccgcagtggttctaagtttggcacgatcaagcctgcatgctgtattctctctgctcgttaacttcgttccctgtcaccccaaccttcacctgctgttcgatcgacctgaggaggctgtgcatgaagactcaagcacgccctttcgcaaggccaaagcactttacgcttgcaaggcagagcatgactctgaactgtcttttaccgccggaacagtgttcgacaacgtccatccctcacaggagccaggttggctggagggcacgttgaatgggaagaccggcctgattccagaaaactatgttgagttcctgtag

SEQ ID NO: 132518 - DNA, 2280 bp, Artificial Sequence
  Description of Artificial Sequence: Synthetic coding sequence
atgggtctgcccgccctggaattcagcgactgttgcctggacagcccccactttagggaaactttgaagtctcacgaagccgaattagataaaacaaataagtttatcaaggaactcatcaaggacggcaagagcctgatcagtgcactgaagaacctgtcgtctgcaaaacgaaagttcgcagacagcctcaacgaatttaagtttcagtgtattggtgatgcagaaactgacgatgaaatgtgcattgccagatccctccaggaatttgccacggtgctgcgcaatttagaagatgaacgaattaggatgatagaaaacgcttcggaggtattgatcacacctttagagaaatttcgtaaggagcaaattggagcagcaaaagaggcaaagaaaaagtatgacaaagagaccgagaaatattgcggcatcctggaaaaacacctcaatcttagttccaagaagaaggagtcacaactacaggaggcagattcccaggtggacctcgtgcggcaacacttctatgaggtgagccttgagtatgtgttcaaggtccaggaagttcaagagcggaagatgttcgagtttgtggaaccgctccttgcattccttcagggactttttacattctaccaccacgggtacgagctggccaaggattttggggacttcaagactcaattgacaatatcaatccagaatacacgtaacaggtttgaagggacaagaagcgaagtggagagccttatgaaaaagatgaaggaaaatccattagaacataaaacgatctctccctacaccatggaaggatatctctatgttcaagagaagcgccattttgggacttcttgggttaaacactattgcacttaccagcgagactccaagcagatcacgatggtgcccttcgatcagaaaagcggcggaaagggcggagaagacgagagcgtgatcctgaagagctgtactaggcggaagactgactctattgaaaaaaggttttgttttgacgtggaggccgtggataggccaggcgttattacgatgcaggccctgagtgaagaagaccggcggctatggatggaggcaatggacgggcgagagcccgtctataacagtaataaggatagccagtctgagggcaccgcacagctggactccattggattctcaataatccggaaatgcatccatgctgtggaaactcgagggatcaatgagcagggcctgtaccgaatcgtgggggtgaactctcgagtgcagaagctgctgagcgtgctcatggatccaaaaaccgcaagtgaaaccgagactgatatctgtgccgaatgggaaattaaaaccatcacctccgcgctcaaaacgtatctcagaatgttgccaggacctctcatgatgtatcaatttcagaggtcatttatcaaagctgctaaactggaaaaccaggaaagcagagtgtcagagatccattctctggtgcaccggctgccagaaaagaaccgccagatgctgcagctgctgatgaaccacctggccaatgtcgctaataaccacaagcagaatctgatgactgtggcaaacttaggagttgtgttcggccccacacttttgcggcctcaagaggagacggtggccgctatcatggacatcaagtttcagaacatcgtgatcgagatcttgattgaaaaccacgaaaagatctttaataccgttcccgatatgcctctgactaacgctcagcttcatttgagcagaaaaaaatcttcagactctaagcccccaagctgttctgaaaggccattgacactgttccacactgttcaatccaccgaaaagcaggaacagcgcaactcaataattaattctagcctggagagcgtttcatccaatcccaatagtatactaaattcaagttccagcttacagcccaacatgaactccagcgatcctgatttggcagtggtgaagcctacccgacctaatagcctgccacctaacccgagccctaccagccctctgtccccatcatggcccatgttttctgcaccaagctcacctatgccaacctcatctacatctagcgactcatcccctgttagcacgccgtttagaaaggctaaggctctctatgcatgcaaagcggagcacgatagcgagctgagcttcacagcggggacagttttcgataacgtgcatccgtcccaggaacccggatggttagagggcaccctgaatggcaagactggcttgattcctgaaaattatgtggaatttctgtag

SEQ ID NO: 132519 - DNA, 885 bp, Artificial Sequence
  Description of Artificial Sequence: Synthetic coding sequence
tgaccgaagacagcatctgagacagagaccgacatctgcgctgaatgggaaatcaagactatcacaagcgctctcaagacctatctgcgcatgctgcctggacccttgatgatgtatcaatttcaaaggtctttcatcaaagcggctaagttggagaatcaagagtcaagagtcagtgagatccattctctggttcaccgcttgccagagaagaatcggcagatgttacaactgttgatgaatcacctggccaacgttgccaacaatcacaagcagaacctgatgacagtagccaacttgggagtcgtgttcgggccaactctgcttcggccgcaggaggaaacggtggccgctatcatggacatcaaatttcaaaatatcgtcatcgaaatcctgattgagaatcacgagaagatcttcaatacggtgcctgacatgcccctgaccaatgcgcaactacatctgtctcgcaaaaagtcgagcgatagcaagcctccttcctgctcagagcggccattgactctttttcacaccgtccagagcactgagaagcaggaacagcggaacagcataataaatagctcccttgaatccgtgagctcaaacccgaatagtattctgaatagctcttcttctttacagccaaacatgaactcatctgatcccgatctcgccgtggtgaagccaactagaccaaactccctgaccccttttcggaaagccaaggctctctatgcctgtaaggcagaacacgattccgaactgtcatttacggcaggcaccgtgttcgacaacgtgcacccctctcaggagccagggtggctggagggaacactgaacggaaagactgggttgatccccgagaattacgttgaatttctatag

SEQ ID NO: 132520 - DNA, 861 bp, Artificial Sequence
  Description of Artificial Sequence: Synthetic coding sequence
atggatccgaaaacagccagtgaaacagagactgacatttgcgctgagtgggaaatcaaaaccattacatccgcactgaaaacttatcttcggatgctgcccggtcccttgatgatgtatcagtttcagcgatctttcatcaaggccgcgaaactggagaatcaagagtccagggtgagcgaaatccactcacttgtccatcggctgcccgaaaaaaacagacagatgctgcagctgctgatgaaccacctggctaatgtggcaaacaaccacaagcaaaacttgatgacagtggctaatcttggagtggtgttcggccccactttgctccgaccacaggaggagaccgtcgctgctattatggatattaaatttcaaaatattgtaatcgaaatactgatcgagaatcacgaaaaaattttcaatactgtcccagacatgccacttacgaatgcccagctccatcttagtcgcaagaagtctagcgattctaagcccccatcctgctccgagcgaccactcacactattccataccgttcagtccacagaaaagcaggagcagcgcaatagcatcatcaatagcagcttagaaagtgtgagttctaacccgaattctatcctcaattctagctccagtctgcagccaaatatgaattcttctgatcccgatctggcagtcgtcaagcctacccgtcccaatagcttaccgcctaaccccagtcccacctcgcccctctcacctagctggcctatgtttagtgccccgtctagcccaatgcccacatcctccacttcctccgattcaagcccacgcatcacatggtcaagttccaacagaggccctcagcagaactgctag

SEQ ID NO: 132521 - DNA, 1167 bp, Artificial Sequence
  Description of Artificial Sequence: Synthetic coding sequence
tgagctcagctggatagtattggattcagtatcattcgcaaatgcatccatgcagttgagaccagagggattaatgaacagggcttgtatcgcatcgttggcgtgaactcccgggtccaaaaactgctgtccgtcctaatggatcccaaaacagccagcgaaactgagactgatatatgcgcagaatgggagattaaaacaatcacttccgccttgaagacatatctgagaatgttgcctggccccctcatgatgtaccagtttcagcggagcttcattaaagccgccaagctggaaaatcaggaatcacgagtcagcgagattcacagcctcgtgcatcgattgccagaaaaaaacaggcagatgctccagttgctgatgaaccacttggccaacgtggccaataaccataaacagaacctcatgaccgtagctaacttgggagtggtgtttggcccgacactgttgagaccccaagaggagactgtcgcggccatcatggatattaaatttcagaatatcgtaatcgagatcctcattgagaaccacgagaagattttcaataccgtccctgatatgcctctcacgaacgcccagctgcatctttcacgcaagaaatccagcgatagcaaaccccccagctgcagcgagaggcctctgacactctttcacaccgtccaaagcacagagaaacaggagcaaaggaactctatcataaattcatcacttgaaagtgtttcctcaaatccaaacagcatactgaacagttcctcctcactacagcccaacatgaatagttctgatcccgacctcgctgttgttaaaccaacacgtcccaacagcttgccacctaacccatccccaacgtcgcctctgtccccgtcttggcctatgttctctgctcctagttctccaatgccgaccagtagcacgtcatccgatagttccccagtgcggccagaagaagccgtccacgaggattctagcacaccattcagaaaggccaaggcactgtacgcatgcaaagctgagcacgatagcgagctgtcctttaccgccggcacggttttcgacaatgtgcacccctcgcaggagcccggctggctggaaggcactctcaatggaaagacaggcctgatacccgagaattacgtggagtttctctag

SEQ ID NO: 132522 - DNA, 792 bp, Artificial Sequence
  Description of Artificial Sequence: Synthetic coding sequence
atggcagcagatgttgtcggggatgtctacgttctggttgaacatcccttcgaatacacaggcaaggacggtcggagggtggcaatcagaccaaacgaaagatacaggttgttgcgcaggtcgacggagcactggtggcacgtgcgtagagagcctgggggtcgaccattttacctccccgcccagtatgtgcgggagctgcctgccctgggcaatcccgccgcagcggccccccccgggcctcacccatctccagccgctcctgagccccttgcatacgactacaggttcgtgtcggcggcagccactgccggacccgacggcgcgccagaggagagcggggggagggcctcatccttgtgcggccccgcacaaagaggcgcagcaacacagaggtcgtccctggccccaggcctcccggcgtgtctgtacctgaggccggcagccccagtcagaccagctcagtcgttgaatgatctcgcctgtgctgctgtgagcccaccagctggactgctggggagctctggctcttttaaggcttgcagtgtagccggatcatgggtgtgtccgcggccactagcccgcagcgattccgaaaatgtttatgaggtgatccaggacctgcatgtgcccccacccgaggagtctgccgagcaggttccgcccagggctcttggtaggggtggcggatggcgcgcccgagaccgcgctagaacggagccaggccgcaaagagacgcgtagtgcccaaagacgtgcgaggcgaccccctctctcggaggatttcggctag

SEQ ID NO: 132523 - DNA, 1647 bp, Artificial Sequence
  Description of Artificial Sequence: Synthetic coding sequence
atgcagccaggccttagccctgggagtcctggggatccccgcccacccacgcccgagactgactatcccgagtccctcaccagctatcccgaggaggactacagcccggtgggcagcttcggagagccaggccctactagtcctctaactactccccctggctggtcctgtcatgtgagccaagataaacagatgctctacactaaccactttacccaggaacaatgggttaggctggaagacccgcacggaaagccctacttctataatccagaggattcttccgtacggtgggaactgccgcaggtgcccgtgcccgcaccgagatcaatccataagtcttcccaggacggggacacccctgcacaggctagccctcctgaagagaaggtcccagccgagttagatgaggtgggatcttgggaagaggtttcccccgccactgccgccgtgcggactaagactctggacaaagcaggcgtgctgcaccgaaccaagacggccgataaaggcaagcggttgaggaaaaagcactggagcgcttcttggaccgtgctcgagggcggcgtgctgacattttttaaagactctaaaacgagtgccgcgggtggccttcgccagccctcaaaattcagcacgcccgagtatacagtggagctgagaggtgccacactaagttgggcccctaaagataagtctagtagaaaaaacgtgctggagctgagaagtagggacggatctgagtatctgatccaacatgactcagaggccatcatctcaacctggcacaaagctatcgcccaaggtatccaagaacttagcgcagagttaccacccgaagaatccgagtcctcgcgggtagactttggcagcagcgaaagactcgggagctggcaagaaaaggaggaagacgcccgccccaatgcggccgctccggccctcggccctgtggggctggagagcgacctgtctaaggtacgccataaattgcgaaagttcctgcagaggcgcccaacactgcagtcgctcagagagaaaggctacatcaaagatcaggtcttcgggtgtgcattggccgctttatgcgagcgggagcgtagccgagtcccgaggttcgtacagcagtgtattagggctgtggaagcccggggcctggatattgacggactgtatcgcatcagcggcaacctcgccacgatccagaaacttagatacaaagtcgaccacgatgagagactggacctcgacgatggtcgttgggaagatgtgcacgttatcaccggtgccctcaaattattttttcgcgagcttccagaacccctgtttccgttctcccactttaggcagtttattgctgcaataaaactgcaggatcaggccaggcgcagtcgttgtgtcagagatctggttcgttcgctcccggctccaaatcatgatacgctgagaatgctgttccaacacctgtgtcgcgtcattgagcatggcgaacagaacaggatgtctgtgcagtctgtagccattgtgtttggtccaaccctcctgcgacctgaggtggaagagaccagtatgccaatgacaatggtcttccagaatcaggtggtcgagttgatcctgcagcagtgtgccgacatttttcctccacattag

SEQ ID NO: 132524 - DNA, 2670 bp, Artificial Sequence
  Description of Artificial Sequence: Synthetic coding sequence
atggctgccgacgtggttggagatgtgtacgtgttagttgaacatccttttgagtacacgggcaaggatggaaggagggttgccatccgacctaacgagaggtacagactgttgagacggtcaaccgaacattggtggcacgtgcgaagagagcccggaggacgccccttctatttaccagctcaatacgttcgcgaacttccagcgttagggaatcccgccgcagccgcacctcccggcccgcatccttcgccggccgccccagagcctctcgcttatgactacagatttgtgagcgccgctgcaaccgccggccctgacggcgcgcctgaagagagcggtggcagggcatcctccttgtgcggtccagctcagcggggcgccgccactcagcgaagcagcttggcacctggtcttcccgcttgcttatacttgagacctgcagctccggtgcgcccggcccagagcttaaacgatctggcgtgcgcagccgtgtctccgccagctgggctgcttgggagctcgggaagttttaaggcctgtagcgtcgcagggtcctgggtgtgccctaggccactggccaggagtgattcggagaatgtgtatgaggtgattcaagacctccatgtcccccctcccgaagagagcgcggagcaggtggacgacccacccgagcctgtttacgcaaacatagagcgccagcccagggccaccagccctggcgctgcggcggcacctctgccctctcctgtttgggaaactcatacagacgctggcacagggagaccatactactacaacccagacacaggtgtcacgacatgggagtctccctttgaggcagccgaaggagccgcctctccagctacatcccctgcttctgtcgactcgcatgtcagtcttgaaacggaatggggccaatactgggacgaggagagcaggagggtgttcttctacaatcctcttacaggcgaaaccgcgtgggaagacgaagcggaaaacgagcctgaggaagagctggaaatgcagcctgggttatccccaggtagtccaggcgaccctagacctcccacccccgagacggattatccagagagcctgacctcataccctgaagaggactattccccagtgggaagttttggcgagcctgggcccactagccccctcacaaccccgccaggttggtcttgccacgtgagccaggacaaacagatgctttacacaaatcacttcacccaggagcagtgggtccgcctggaagatcctcatggtaagccctatttttacaatcctgaagatagtagcgtgaggtgggagcttcctcaagtgcccgtgcctgcccccagaagtattcacaaatcttcacaggatggcgatacgcccgcacaggcctctcctccggaagagaaagtccctgctgagcttgatgaggtgggctcatgggaagaagtttcccctgccactgcggccgtgagaaccaaaacactggacaaggccggggtcctccatcgcaccaagacggctgataaagggaagagactgcgcaaaaagcactggagcgccagttggacagtgctggagggtggcgtcctgacattttttaaggatagcaaaacgagtgccgcaggcggtcttcggcagccatccaagttcagtacaccggagtacaccgtagagctgagaggggcgacactgagttgggcccccaaggataagagtagtcgaaagaacgtgcttgagctccgcagccgtgacggttccgaatacctcatccagcatgactcagaggccataataagtacatggcacaaagccattgcacaaggcatccaggagctctcggccgagctcccacctgaagaaagcgagagtagccgcgtggactttggctcctcagagagattggggagttggcaggagaaggaggaagacgctagacccaatgctgccgctcctgcgctgggtccagtaggactggagtcggatctgtcaaaggtgaggcacaagctgcgtaagttcttgcaacggcggcccaccctccagagcttgagagaaaagggctacatcaaggatcaggtttttggttgcgcccttgcagctctgtgtgagagagaaagaagcagagtcccccgatttgtgcagcagtgtatcagagcggtcgaggccaggggactcgacattgacggtctgtacagaatttctggtaacctcgccacaatccagaaactgcgctacaaggtggaccatgacgaaagactggatttggatgacggccgctgggaggacgtgcatgtcattacaggagcactaaagctgtttttccgcgaactgccagagcccctctttccctttagccatttcagacagtttatcgctgcgatcaagcttcaggaccaggcacggagatcgcgctgtgttcgcgatctggtcagatccttgcccgcgccaaaccatgatactcttcgtatgctgtttcagcatctgtgtcgcgtgattgagcacggtgagcagaaccgaatgtccgtgcagtctgtcgccatcgtgtttggacctacattactgcgtccggaggtcgaagaaacttctatgcccatgactatggtgtttcaaaaccaggtggtggagttaatcctccagcaatgtgcagacatcttccccccacattag

SEQ ID NO: 132525 - DNA, 2589 bp, Artificial Sequence
  Description of Artificial Sequence: Synthetic coding sequence
atggcagcggatgttgtcggcgatgtttacgttctggtcgagcacccatttgaatatactggcaaggacggacggcgagtggccatccgacctaacgagagatatcgcctgctcagacgcagcaccgaacattggtggcatgtgcgccgggagcctgggggacgccccttttatctccctgcgcaatacgtgagggagctgccagcactgggtaaccctgccgccgccgcccctcctgggccccatccatcacctgctgcaccagaaccactcgcgtacgactatcgattcgtatcagccgcagccactgccggccctgatggcgccccagaggagagcggggggcgagcgtcctccctctgcggcccagcccagagaggagctgcgactcaacgcagtagtttggcgccagggttacctgcctgcttatacctgcggccggcagcacctgtcaggcccgctcagtcgctcaatgacttggcgtgcgcagccgtgtcccccccagccggactcctgggctctagcggatcatttaaggcgtgctcggttgccgggtcctgggtgtgtccgcgacccctagcccgttccgactccgaaaatgtatacgaggtgatccaggacttgcacgtgcctcctccagaggaatctgccgaacaggtggatgacccgcctgagccggtctacgcaaatatcgagaggcagcctagggccacttcgcccggggctgctgccgcccctctcccttctcccgtttgggagacccacactgacgccgggacaggacgcccgtattactacaaccccgatacaggagttaccacctgggagagcccattcgaagcggccgaaggggctgcatcaccagcgaccagccccgcgagcgtggacagccatgtgagcctcgagactgaatgggggcagtattgggatgaggaatcaagacgggttttcttctacaatcctctcacgggcgaaactgcctgggaagacgaggccgaaaacgaacctgaggaggagctcgaaatgcaacctgggctctctcccggatccccaggcgatcctcggcctcctactccagaaacggactaccctgaatctttaacaagctatcccgaggaggactatagccccgtcggctccttcggcgagccgggccccactagccccttgaccactccacccggatggtcatgtcatgtcagccaggataagcagatgctgtacaccaatcactttacgcaggaacaggtgccagtgcctgctccgcggtctatccataagagcagtcaagatggcgacactccagcccaggcatctcccccagaagagaaggtacctgctgaactcgacgaagttggcagttgggaggaagttagtcctgccaccgcagccgtacgaacaaaaaccctcgacaaagcgggggtgctccaccgaactaaaactgcagataagggcaagcgcctgaggaaaaagcactggtctgcctcctggaccgtcttggagggtggggttctgacttttttcaaggattcaaaaacttccgctgccggagggttgaggcagccaagtaaatttagcaccccggagtacacagtcgagttacggggggctactttatcatgggccccaaaggacaaatctagtcgcaagaacgtgctggaattgaggtcacgcgacggcagcgagtacctaatccagcacgattcagaggctattatctccacatggcacaaggccatcgcccaaggcatccaggagctgtccgccgagctgcccccagaggaaagcgagagtagcagggtggactttgggtcctctgaacggctaggctcatggcaagaaaaggaggaagatgcccgacctaatgctgctgcccctgccctcgggccagtgggcttggaatccgatctcagcaaagtccgccacaaactgaggaagttcctgcagcgcagaccgacactgcagtcgctgcgagaaaaggggtatataaaggaccaggtgtttggctgcgctctcgccgccctatgtgagagagagaggtcccgtgtgcctcgtttcgttcaacagtgcatacgggccgtggaagcgcgagggttggacatcgacgggctctatagaataagtggtaatctggctacgatccaaaagcttcgatataaggttgatcatgatgaacggctcgacttagacgacgggcggtgggaagacgtacacgtgattaccggcgcccttaagctgttttttagggagttacctgagcctctgttcccattttcccacttccgtcagttcatagccgccattaagctacaggatcaagccaggagatcccgatgtgtgagggacttagtgcggagcctcccggcacctaaccatgacaccttaaggatgttgttccagcatttgtgtcgggtcatcgaacacggcgaacagaaccgcatgtcagtgcagagcgttgcaattgtatttggcccgactttgctgaggccggaagttgaggaaaccagcatgcccatgacaatggtgttccagaatcaggtagttgaattgatcttgcagcagtgcgccgatatctttcctccacattag

SEQ ID NO: 132526 - DNA, 1647 bp, Artificial Sequence
  Description of Artificial Sequence: Synthetic coding sequence
atgcagcccggcctttcgccaggaagcccgggtgaccccagaccgcccacaccggaaaccgactaccccgagagcctaacctcctaccccgaggaagattatagtcccgttggatcttttggtgagcccggaccgacctcacccctgactacccccccaggctggtcctgccacgtctcccaggacaagcagatgctgtacactaaccactttacacaagagcaatgggtccgattggaagacccccacggtaaaccatacttttataatcctgaggatagtagcgtacgatgggaactgccacaggtgccagtgccagccccgcgatccattcataaatcaagccaagatggggacacacccgcccaggctagcccacctgaagagaaggtgccagcggaactcgacgaagtgggatcctgggaagaggtttcccctgctacagcggcagtgcggactaaaactcttgataaagcaggggtgctgcacaggaccaaaacggccgataaaggtaaaagactaagaaaaaaacattggtcggcctcgtggaccgttctggaaggcggggttctgaccttttttaaagactcaaagacctcagccgccgggggccttagacagccttcgaaattctcgaccccagagtatacagtcgaacttcgaggggcaaccctgtcctgggcgcctaaggataaaagctcacggaaaaacgtgttggaactcagatcgagggacggctcagaataccttatccaacacgattccgaagccattatcagcacttggcacaaagctattgctcagggcatccaggaactcagcgcagagctgccgcccgaggaatccgagtcgtcacgagtagatttcggaagcagtgagcgccttgggagctggcaggagaaggaggaggacgccaggccaaacgcagctgcacctgctctgggaccggtgggactggagtcagatttaagcaaggttcgacataagcttcggaaatttctgcaacggcgccctaccctgcaatcactccgcgagaagggttacattaaggaccaggtttttggctgcgccctagcggctctgtgtgaaagagagcgatctagagttcctcggttcgtccagcaatgcattcgcgccgtggaggccagagggcttgatatcgatggattatataggataagcggaaacctggcgacgattcaaaagctgcgatataaggtcgaccatgatgagcgactggacttagatgatgggcgctgggaggatgtgcacgtcatcaccggcgcactaaagcttttttttcgtgagctgcccgaacctttattcccttttagtcactttcgacagtttatcgccgccatcaaacttcaggatcaggcccggcgtagtcggtgcgtgcgggacctagttcgcagcttacctgcacccaaccatgatacactgcgtatgctctttcagcacctgtgtagagtgattgaacacggtgagcagaatagaatgtccgtgcagtccgtggctatcgtctttggcccaacactccttcgacctgaagtggaagagacaagcatgcccatgaccatggtgtttcaaaatcaagtggtcgagctgatcctgcagcagtgcgcggacatctttccgcctcattag

SEQ ID NO: 132527 - DNA, 792 bp, Artificial Sequence
  Description of Artificial Sequence: Synthetic coding sequence
atggccgcagacgtggtgggggatgtgtacgtgctggtcgagcacccttttgagtataccggcaaggatggcaggcgggtcgcaattagaccaaatgagagatatcggttactgaggaggagcaccgaacactggtggcatgttaggcgggaacctggtggcaggcccttttatctgccggcccagtacgtcagagagctacccgcccttggcaatccggccgctgcagctccgcctgggccccacccctctcccgccgcaccagaacccctggcatatgattaccgcttcgtcagcgcagccgccactgccggccccgatggggcacccgaggaatcaggcggacgcgcaagttcactttgtggacctgcacagaggggcgccgccacccagcgatctagtctggcgccaggcctgcccgcctgtttgtaccttcggcctgctgccccagtacggcctgctcaatccttgaacgatttggcatgtgccgccgtgtccccacccgctgggctgctcggatcttctggcagtttcaaagcctgctcagtggcaggcagttgggtctgtcccaggccactggcccgctctgatagcgaaaatgtctacgaggtgatccaagatctgcacgtcccgcctcctgaggaaagcgctgagcaggtgccgcctagagccctgggcaggggcgggggctggagagccagggatagagcacgcaccgagccaggccgcaaggaaaccagaagtgctcagaggagagcaagaagacctccactatccgaggattttggatag

SEQ ID NO: 132528 - DNA, 1566 bp, Artificial Sequence
  Description of Artificial Sequence: Synthetic coding sequence
atgcagcctggtctgtcaccaggatctccaggagatccacgaccacccacaccagaaacggactatccggagtctctgacttcctacccagaagaagattactccccagtcgggtccttcggcgagccaggtccaactagcccactgacaactcctcctggatggtcctgccacgtcagtcaagacaagcagatgctgtacaccaaccattttacacaggagcaagtgcccgtgccagcccctcgctcaatccacaaatcaagccaagatggtgatacccccgctcaagcgtctcctccagaggagaaggtgcctgctgagcttgacgaggttggaagttgggaggaggtatcccctgccaccgccgcagtgcgaaccaaaacgctggataaggccggcgtgctgcaccgcacaaaaaccgccgacaagggcaaaaggttaaggaaaaaacactggtccgcctcttggaccgtgctagaaggaggagtcctgacattcttcaaagacagcaaaaccagcgctgctggggggttgaggcagccatctaagttcagtacaccagaatacactgttgagttacgtggcgccaccctgagctgggcgcccaaagataagagtagccgcaagaatgttctcgaactccggagccgggatggctcagagtacctcattcagcatgattcagaggctataatttcaacgtggcacaaagctattgcacaggggatacaagagctctcagccgagctgccacctgaagaaagcgaatccagccgggtcgacttcggatcctccgagagactcggctcctggcaagagaaggaggaggacgcgcggcctaacgctgctgcccccgcgcttgggccggttgggcttgagtctgacctcagcaaggtgagacataaactccgaaagtttctgcagcgtcgcccaactttgcaatctctcagagagaaaggatacatcaaagaccaggttttcgggtgtgcattggcggcgttatgtgaaagggagaggtcccgcgtacccagattcgtgcagcagtgcatcagagctgtggaggctcgcggcttggacatagatgggctttatcggatttcaggcaacctagccactatccaaaaactccgatacaaggtggaccatgacgaaaggctggacttggacgacggccgctgggaggacgtgcacgtaatcacgggggctctgaaactgttcttccgagagctgcctgagcctctttttccatttagccatttcagacagtttatcgcagccattaagttacaggaccaggctcgtcgaagccgctgtgttagggacctggtcagaagtctgcctgcacccaatcatgacactcttaggatgctgtttcagcacttgtgtagggtgattgaacatggggaacagaataggatgagtgtccagtcagttgccattgtttttgggcctacgctgctgaggcccgaggtcgaagaaacatccatgcctatgaccatggtctttcagaaccaggttgttgagctgatcctgcagcagtgcgccgatatttttccaccccactag

SEQ ID NO: 132529 - DNA, 2013 bp, Artificial Sequence
  Description of Artificial Sequence: Synthetic coding sequence
atgctgtccaacgagagcctccatccacccgccttctcccgtagtaatagcgaggcctccgtcgactctgcctccatggaggacttttggcgggaaatcgagtcgattaaggattcttcaatgggtggccaagaggagccaccgccagcagaggtgactccagtagacgaaggcgaactggaggcagaatggctgcaggatgtaggcctgtccaccctgataagcggagacgaagaggaggacggcaaagctctcttaagtaccctaacacggacccaagccgctgccgtgcagaagaggtaccatacctacacccagactatgcggaaaaaggataagcagagcatacgcgatgtgagggatatattcggagtgagcgaatctccgccccgagacacctgcggaaatcacactaaccagctggacggcactaaagaggagcgcgaactgccacgggtcatcaagaccagcgggtcgatgcctgacgacgcgtctttgaacagcaccactctgagcgacgcgagccaggataaagagggatcatttgccgtgcccaggtccgactccgtggccattctggagacaatcccagtgctgcccgtgcactctaatggctctcccgagcctggacagcctgtccaaaatgccatctccgatgacgactttttggaaaaaaacataccccctgaggccgaggaactgtcattcgaggtgagttacagtgaaatggtaacagaagccctgaaacgcaacaaattaaaaaagagtgaaatcaagaaggaggactatgtcctcaccaagtttaatgttcagaagacccggttcgggctaaccgaggccggggacttgtctgctgaagacatgaagaaaatccgacacctgtcgctcattgagctgacagctttttttgatgccttcggcatacagctgaagcggaataaaactgagaaggtcaaagggcgcgataacggaatctttggggtacccctgaccgtgctactggatggggatagaaaaaaggatcctggtgtgaaggtgcctctcgttctgcaaaaattcttcgaaaaagtggaagagagcgggttagaatccgaaggaatatttcgcctatctggctgcaccgcaaaagttaagcaataccgggaagagcttgacgctaagttcaacgcagataaattcaagtgggataaaatgtgccaccgcgaggccgccgtaatgctcaaggccttcttcagggagctgccaactagcctgtttccagttgagtacatacccgcttttatctccctgatggagagggggccccacgtgaaagttcaattccaagcactccatctcatggtcatggcattgccagacgccaatcgcgatgcggcccaggcactgatgactttttttaacaaagtcattgccaacgagagcaagaaccgtatgtccctgtggaatataagcactgtcatggcccccaacctcttcttctctagatcaaagcactccgactacgaggagctcctcctggctaacacggccgcgcatataattcgattgatgctaaagtaccaaaagatactgtggaaggtgccgtcctttctaatcacccaggtgcggagaatgaatgaggcaacaatgcttctcaagaagcagctgcctagtgtaaggaagttattgcggcggaagacactggaacgcgaaaccgcctctcctaaaaccagcaaagtgttacagaagagtccgtcagcccgcagaatgagcgacgtgcccgagggcgtcatacgggtacacgcacccctgctgagtaaggtctccatggcaattcagctaaataatcagaccaaggccaaagacatactcgccaaattccagtacgagaacagaatcctgcattggcaaagggctgctttatcttttctaaacggcaagtgggtgaagaaggagagagaagagagcaccgagactaatcgttccccaaaacacgtgtttctgttcacaatcggactcgacataagcacctag

SEQ ID NO: 132530 - DNA, 1713 bp, Artificial Sequence
  Description of Artificial Sequence: Synthetic coding sequence
atgcggaaaaaggataagcagtcaatcagggacgtccgagacatattcggggtttcagagagcccacccagagatacctgcggtaatcatacaaaccagctggatggaaccaaggaagagagggaattgccccgtgtgattaagacatccggtagtatgccggatgacgcgagtctgaattccacaaccctatccgacgctagccaggacaaggaaggctccttcgccgtacctcggtctgattctgttgctatcctggagacaattcccgtactgcctgtgcattcaaatggatcacctgagcctgggcagcccgtccaaaacgcaatctctgacgacgattttctggaaaagaacattccaccggaggccgaggaactctctttcgaggtcagctactccgagatggtcaccgaggcactgaagagaaataagctgaagaaatccgaaataaagaaggaagattacgttctcaccaagttcaatgtgcagaagacacgcttcgggctgacagaggctggggatttaagcgccgaggacatgaagaagatccgccatctttccctaattgaacttaccgctttctttgacgcctttggtattcagcttaaacggaacaaaacggagaaagtaaaagggcgggacaacggcatctttggggtcccacttactgtgctgcttgacggggacagaaaaaaggaccccggcgttaaggtgccattggtgctgcagaaattttttgaaaaagtggaagaaagcggactggagagtgagggaattttccgtctgtccggttgtaccgcgaaggttaagcaatatcgggaagaactggacgccaaatttaatgcagacaaatttaagtgggataagatgtgccaccgggaggcggctgttatgttaaaggctttttttcgtgagttgcccacttctttgtttcccgtagagtatataccagcgttcatttcgctgatggagcggggaccccacgttaaggtgcagttccaggcactgcacctgatggtaatggccctgcctgatgccaatcgcgacgcagcccaggcacttatgactttctttaataaagttattgccaatgagtcaaaaaataggatgagcctctggaatatttcaaccgtcatggcccccaacctcttctttagtcgaagcaaacactcagactacgaagaactgctgcttgccaacactgctgctcacattattaggcttatgctgaagtaccagaaaatcctgtggaaagtgccatccttcctaatcacccaggtccggagaatgaatgaagctacaatgctgctcaaaaaacagctcccatctgtacgcaaactgctcagacgtaaaactctggagagggagactgcaagcccaaaaacgtccaaagttctgcagaagtctccttcagcaagaaggatgagcgacgtgcctgaaggcgtgattcgggtccacgccccattgctatccaaagtgtcgatggcgatacagttgaacaaccagactaaagcaaaagatatcctcgccaagtttcagtatgagaactcgcatgggtcaagtgaatgcatcaaaatccagaaccagagattgtatgagattggtgggaacatcggagaacattgtctagaccctgacgcctacattctggacgtgtatcggatcaatccccaggcagaatgggtgattaagccacagcagtcttcgtag

SEQ ID NO: 132531 - DNA, 1638 bp, Artificial Sequence
  Description of Artificial Sequence: Synthetic coding sequence
atgaacgaactgcctagggatacctgcgggaaccatacaaatcagcttgatggcacaaaagaagaaagagaactgccgagagtgatcaaaacaagcggttcgatgcctgacgacgcctcactgaatagcaccaccctgagtgatgcttcccaggataaggaaggatctttcgccgtgcccagatctgacagcgtggccatccttgaaacaattcctgtcttgccagtgcactcaaacggcagccccgaacccgggcagccagtgcagaacgcaatttcagatgatgacttcctggaaaagaacatacccccagaagccgaggagttgtctttcgaggtgtcttacagtgaaatggtcaccgaagcactcaaacgcaacaagctgaagaaaagcgagataaaaaaggaagactatgtgctgacaaagtttaacgtgcagaagactcgctttggtctcaccgaggcgggcgatctctctgcagaggacatgaagaagattcgacatctctccctcattgagctcaccgccttttttgatgccttcggcatccagcttaagcgcaataaaacggagaaggtcaagggaagggacaatggcatctttggtgtccccctgacagtgttactcgacggggacaggaaaaaagaccctggcgtgaaagtgccactggtactgcagaaatttttcgagaaggttgaggagagcggattggagtctgaggggatcttcagactgtcaggttgtacagcaaaagtaaagcagtatagagaggaactggacgcgaaatttaacgcagataagtttaagtgggataagatgtgccaccgagaagccgctgtcatgctcaaggcattctttcgtgaactgccgaccagtctatttcctgtcgaatatatccctgccttcatctccctcatggagcgaggcccacacgttaaggtccagtttcaggcacttcacctgatggtcatggcgttacccgacgcgaatcgcgatgctgcccaggctctgatgacattttttaacaaggttattgctaatgaaagtaaaaaccgaatgtccctctggaatattagtaccgtgatggccccaaatctcttttttagccggtcgaaacatagcgactatgaggagctgctgctcgctaacaccgctgcccacatcattaggctcatgctcaaatatcagaaaatcctctggaaggtcccatcattcttgatcacacaggtgaggaggatgaacgaagcaaccatgctgctgaagaaacagctaccctcagtacggaaactgttgcgacgcaagacactcgaaagggaaaccgcatcccctaaaacctcaaaggtactgcagaaaagtccaagcgcccgccgcatgtcggacgtcccggagggcgtgattagagttcatgcaccgctgctttctaaggtgagcatggccatccagcttaataatcagaccaaggccaaggacattttggccaagtttcagtatgagaatcgaatactccactggcagcgcgctgcccttagcttcctgaacgggaagtgggttaagaaagagagggaagagtccacagaaacaaatcgctcccccaagcacgtttttctttttactatcggattggacatatcaacctag

SEQ ID NO: 132532 - DNA, 2169 bp, Artificial Sequence
  Description of Artificial Sequence: Synthetic coding sequence
atggaggtcgaggattctggaggagttgtcttaaccgcctaccacagctacgcccgggctcagccaccgaatgccgagagtagatgtgcacctcgcgccgctgccagtcatccgctgagtcgcaaaagcatcccacgatgtcgacgaatcaatcgcatgctctctaatgaatccctgcatccaccagccttctctcgctccaactcagaggcttctgtggactcagccagtatggaggatttttggcgggagattgaaagcattaaggacagcagcatgggaggccaagaggagccccctcccgcagaggttacccctgttgatgagggagagctggaagcggagtggctccaggacgtcggtctttctaccttgattagcggagacgaagaagaggatggcaaagctctcctgagcaccctgacccgcacacaggccgctgctgtgcagaaacggtatcacacatacactcaaaccatgcggaaaaaagataaacagtccatccgcgacgtgcgcgacatcttcggggtgtcagaaagcccgcctcgggatacatgcggtaatcacaccaatcaattggatggtacaaaagaggagcgcgagctgcccagagtaatcaaaacttctggttctatgcctgatgacgcatctctcaattctaccacactgtctgatgctagccaggacaaagaaggctcttttgctgtccctcgcagtgattctgtggctatcctggagacgatcccagtgttacccgtccacagtaatggcagccctgaacccggacagcccgtccagaacgcgatctccgatgacgatttcctagagaagaacatacctcccgaagctgaggaacttagcttcgaagttagttactccgaaatggtgacagaagcgcttaaacgaaataaactaaaaaagtctgaaataaaaaaggaagattacgttctaaccaagtttaacgtgcagaaaacccgctttggtctcaccgaagctggcgacctttcggctgaagacatgaaaaaaatacggcacctgtccctgatcgagcttacggccttttttgacgcgttcgggatccagctcaagcgcaacaaaactgaaaaggttaaagggcgggataacggaattttcggtgtcccacttacagtgctcctggacggcgatcggaagaaggatcccggagttaaggtcccccttgtgttgcaaaagttttttgagaaagtggaagagagtggactcgaaagcgaggggatcttcagattatccggatgcacagctaaggtcaagcagtatcgggaagaattggacgccaagttcaacgctgacaagtttaaatgggacaagatgtgccacagagaggccgcagtgatgctaaaggcattcttcagggagctgcccacaagcctttttccagtggagtacatacctgcgtttatttccctgatggaacgcggtcctcatgtgaaagtacaatttcaggccctgcacctcatggttatggcgttgcccgatgcgaacagggacgccgctcaggccctgatgacatttttcaacaaagtcatcgctaatgagagcaaaaaccggatgtcactgtggaacatcagtactgttatggcgccaaatctattcttttcccggtctaaacatagtgattatgaagaactcctgctcgcgaatacggccgcccatatcattcgactgatgcttaagtatcagaaaatcctttggaaggtcccctcctttcttattacccaggtgcggcgtatgaacgaggccaccatgctgctgaaaaaacagcttccttctgttcgtaagctccttcgtcgcaagacccttgagagagaaactgcatctcccaagacctctaaggtgctgcaaaaatccccatccgcccggcgaatgtctgacgtccctgaaggtgttatcagagtccacgccccgttgcttagcaaggtgagtatggccattcagttaaacaatcagacgaaagcaaaggacatcctggcaaagttccagtacgaaaaccgaatactgcactggcaaagggctgcgctgagtttcctcaacggcaaatgggttaagaaggagcgcgaggaatcaactgaaacaaataggtctccaaagcacgtctttctgttcactataggactggacatctcaacttag

SEQ ID NO: 132533 - DNA, 1692 bp, Artificial Sequence
  Description of Artificial Sequence: Synthetic coding sequence
atgcggaagaaagacaagcagtccattcgcgatgtacgcgatatcttcggggtttctgaaagtcccccgagagatacgtgtggtaaccacacaaaccagctggacggaaccaaggaggaacgtgagctcccccgagtcatcaagaccagtggatccatgcctgatgacgcttctctgaactcaactacccttagcgacgcatctcaagataaggagggaagcttcgcggtgcctcgatcagattctgtagccattctagaaacgattcctgtcttgcctgtgcattccaatggatctccagaacccggacaaccagttcagaacgctattagcgacgatgacttcctcgaaaagaacatccctccagaagctgaggaactgtcctttgaagtgtcctacagcgaaatggtaacggaagctctcaaacgcaacaagttgaaaaaaagtgaaatcaaaaaagaagattacgttctgacaaagttcaatgtgcagaagacccgctttggtctgactgaagccggagacctgagtgccgaggatatgaaaaagatccggcacctatccctcatcgagctcactgcattttttgatgcattcggcattcagctaaagcgtaataaaacagagaaggttaagggccgggataatgggatctttggagtccccctcaccgtactcctcgatggggaccggaagaaggatcccggggttaaggttccgctggttctgcagaagtttttcgaaaaggtcgaggagtccggacttgaatccgaaggaatattcaggctaagcgggtgtacagccaaagtgaagcagtatcgggaagagctcgatgcaaaattcaatgcagataagttcaagtgggacaagatgtgccatcgggaggctgccgtaatgctgaaagcctttttcagagaacttcccaccagcctcttcccagtagagtacattcccgccttcattagcttgatggaacgaggaccacacgtcaaggttcagtttcaggcattgcatctgatggttatggcactgcccgacgcaaacagggacgccgcacaggcactgatgacctttttcaataaggtcattgccaacgagagcaagaacagaatgagcctgtggaatatttccacagtaatggctcccaatctgtttttttctaggtctaagcattcggactatgaggagctgcttcttgccaatacggccgcccatataattaggttgatgttgaaataccaaaagatcttgtggaaggtgcctagtttcctcatcacacaggtgaggcggatgaacgaagccaccatgttgttaaagaaacagctgccctctgtaagaaagctcttgaggcgcaaaactttggaaagggagactgcctctcccaagacatctaaggtgctgcaaaagagcccaagcgcgcgacggatgagcgacgtgcctgaaggcgtaattagagttcacgcccctttgctttccaaagtttccatggccatacagctgaacaaccaaactaaagccaaagatatcctggctaagtttcaatatgagaatcgaattctgcattggcaaagagctgctctgtcttttctgaatggaaaatgggtgaagaaagagagggaagagagcaccgagacaaataggagccccaagcatgtcttcctgttcacaataggactggatatcagcacgtag

SEQ ID NO: 132534 - DNA, 1713 bp, Artificial Sequence
  Description of Artificial Sequence: Synthetic coding sequence
atgcgcaaaaaggacaagcaatcaatccgggatgtcagggacatctttggagtttcggagagccctcccagggatacttgcggaaaccacacaaaccaactggacggaaccaaggaggaacgggagctccctcgggtaattaaaacatctggaagcatgcctgacgacgcctccctcaactccaccacactctctgatgcctctcaagacaaggaagggagctttgccgtaccccgaagtgattcagtggcaatcctggaaacaattccagtccttccagtgcattcgaacggttccccagagcccggacagcctgtacaaaatgctatctcagacgatgattttctagaaaaaaacatccccccggaagccgaagaactgagcttcgaggtctcttactctgagatggtgaccgaggcactgaagaggaataagctgaaaaaatccgaaatcaagaaagaggactacgtcctgacaaagtttaatgtgcagaagaccagattcgggctgacggaagccggggacctaagtgccgaagatatgaagaaaatccgccatttgagcctcatcgagttaacagctttcttcgatgctttcggcattcagctgaagagaaacaaaaccgagaaggttaaaggtagagataacgggatttttggagtgcctctcaccgttttgttagatggcgacaggaagaaagacccgggcgtgaaagtgccacttgttctacaaaagttcttcgagaaagtcgaggagtcaggcctagagtctgaaggcatctttaggctgtccggttgcacggccaaggtcaagcagtaccgggaagagctggatgccaagttcaatgccgacaagttcaagtgggataagatgtgccatagagaggcagctgtaatgctaaaggcgtttttcagagagctgcccacctctctgtttcccgtggagtacattccagcctttatttcactgatggaacgtgggccccacgttaaagtacaatttcaggcccttcacctcatggtcatggcattgccagatgccaatcgggacgctgctcaggctctgatgactttcttcaataaggtgatcgctaacgagagcaagaacagaatgtcactctggaacatttctaccgttatggctcccaatctgttcttctctcgaagtaagcacagtgattatgaggagctgctccttgccaacaccgctgcccacattattcgtctgatgcttaagtatcaaaaaatcctttggaaggtgccttcctttcttatcacccaagtgaggcgtatgaacgaggcaaccatgctgctgaaaaagcagttgccgtccgttaggaagctgctgcgtcgaaagacactggaaagagaaaccgcttcccccaagacgtctaaggtacttcagaagagcccttctgcgaggaggatgtctgatgtgccagagggagtcatccgcgtccatgcccctcttttgtcaaaggtgagcatggccattcaactaaataatcaaaccaaagccaaagacatcctcgccaagtttcagtacgaaaacagccacggcagctctgagtgtattaagattcaaaaccagagactgtacgagatcgggggcaacattggcgaacattgtctcgaccctgacgcttatatcctggatgtgtaccgcataaatcctcaggcggaatgggtgataaagccgcaacagtcatcgtag

SEQ ID NO: 132535 - DNA, 354 bp, Artificial Sequence
  Description of Artificial Sequence: Synthetic coding sequence
atgctttcgaacgaaagtctccatccacctgcatttagccgttctaatagcgaggcctctgtcgattcggcctctatggaggacttctggcgggagatagagagcataaaggattcatctatgggaggacaagaagagcccccccccgctgaggtgacccctgtcgacgaaggagagctcgaggctgagtggctgcaggatgtgggcctgtctactctgatatctggagacgaggaggaagatggcaaagctctcctttctacacttaccaggacacaggcggcagcagtgcaaaagcggtatcacacctacacacagaccatgaggaagaaggacaagcaaagcattaggtag

SEQ ID NO: 132536 - DNA, 1665 bp, Artificial Sequence
  Description of Artificial Sequence: Synthetic coding sequence
atggctttcatgcgaattaacgttataatgaacgagctgcctagagatacctgcggtaatcatactaatcaactcgacggtacgaaggaagagagggaactgccccgtgtcatcaaaacatccggtagtatgcccgacgatgccagtcttaattccaccacactgtccgatgcttcccaggataaggagggatccttcgcagtgccgcgatctgatagcgtggctatcctggaaaccattcccgtgctaccagtccactctaacggttctcctgaaccaggccagcctgtccagaacgctatctccgacgatgatttcctggagaaaaatataccgcctgaagcagaagagctgtctttcgaggtttcttacagcgaaatggtgacagaggctcttaagcggaacaagctgaaaaaaagcgagattaaaaaggaggattacgtgctgaccaaatttaatgtccagaagacccgattcggtttgaccgaagcaggagacctgagcgctgaggacatgaagaagattcgtcacttaagcctgattgaattgaccgcattctttgatgctttcggaattcagctgaaacggaataagaccgagaaggtcaagggccgtgataatggaattttcggggtccccctgaccgttctcttggatggggatcgcaagaaggatccaggggtaaaagtacctttggttctccagaaattttttgagaaagtggaggaatctggtctggaaagcgaaggaattttcaggctctccgggtgcacagccaaggtaaaacagtaccgggaggagctggacgctaagtttaacgccgacaagtttaaatgggacaagatgtgccaccgcgaggcagccgtaatgttgaaagcctttttccgcgagttacctaccagtctgttcccagtggagtatattcccgcattcattagcctgatggagcgaggcccccacgtgaaggttcagtttcaggcccttcacctgatggtgatggctctaccagatgccaaccgtgacgccgcccaagcgctgatgacattcttcaacaaagtgattgctaatgagagtaaaaaccggatgtctttatggaacatcagcaccgtgatggcccctaatctgttcttttccaggagtaagcactcggactatgaggaattgctattggccaacactgctgctcacatcattagactgatgctgaaataccagaagattctatggaaagttccgagtttcctgattacacaggtcagacgaatgaacgaggctaccatgcttttgaagaagcagctcccatctgtgaggaagctccttcggagaaagacactggaacgggagacagcatcccccaagacctccaaagtgctacagaaaagcccgagtgccagaaggatgagcgatgtgccagaaggagtcatcagagtgcatgccccactcctcagcaaggttagtatggctatccagctcaataatcaaaccaaggccaaggatattctcgccaagttccaatatgaaaatcgcatcctgcactggcaacgcgctgccctgtcattcttgaacggaaagtgggtgaagaaagaacgtgaagagtctaccgagactaataggtcccctaagcacgtgtttctctttactattggtctcgatatatcgacttag

SEQ ID NO: 132537 - DNA, 3786 bp, Artificial Sequence
  Description of Artificial Sequence: Synthetic coding sequence
atgattgcccataagcaaaaaaagacaaaaaaaaagcgcgcatgggctagcggtcagctctcaactgacatcaccaccagcgagatgggactgaagtccctaagttccaactctatctttgacccagattacataaaggagcttgtgaatgacataagaaagttttcccatatgctactgtatctgaaagaggcgatttttagcgattgttttaaagaggtcatccatataaggcttgaggaacttttacgagtgctgaagtcaatcatgaacaagcaccagaacttaaattccgtggacctacagaacgcagctgaaatgctgactgctaaggtcaaggcagtcaacttcactgaagtgaacgaggagaataaaaatgatctgtttcaggaggtgttctcctctatcgaaacattagcgtttacttttggtaatatccttacaaactttctgatgggtgatgttgggaacgacagcctgctgcggctacccgtgtcgagagagaccaaatccttcgaaaatgttagtgtcgagtccgttgattcctcctccgagaaaggcaacttcagtccacttgaactggacaatgtgctgctcaagaacaccgatagcatagagctggctctttcatatgcaaagacatggtctaaatacactaaaaatatcgtcagttgggtagaaaaaaagctgaacctcgagctcgagtcaactagaaatatggtgaaactggcagaggctactagaacaaatatcgggatccaggaattcatgcctctacagagtttattcacaaatgctctcctcaatgacatcgaaagctcacacctgcttcagcagacgatcgcggcactgcaggcaaataaattcgtgcagcctctcctgggacggaagaacgagatggaaaaacagcggaaagaaatcaaggagctttggaagcaggaacaaaacaaaatgctggaagccgagaatgcactgaaaaaagccaagttactgtgtatgcagaggcaagatgaatacgagaaagcaaagtcttccatgttcagggccgaggaagaacacttgtcttcaagcggcgggctggcaaaaaatctcaacaagcagttggaaaagaaacgccgattggaagaggaagctttacagaaggtggaggaggccaatgagctctacaaagtatgtgttactaacgttgaggagcggcgaaatgatcttgaaaacacgaagcgcgagatccttgctcagttgcgaacactcgtgttccagtgcgacctaactctgaaggctgtcaccgtcaacctgttccacatgcagcacttacaggcggctagcttggcagactccctgcagagcctctgtgacagtgcaaagttgtatgacccgggccaggagtactccgaattcgtgaaggctactaatagcacagaggaggagaaggtcgatggcaacgtcaacaaacatctgaacagctctcaaccatcaggcttcggccccgctaactcattggaggacgtggtcagactgcccgattcgtcaaataagattgaggaagatcgctgcagcaactccgctgacatcactgggccaagtttcattaggtcatggactttcgggatgttcagcgatagtgagagcaccggaggctcctccgagtctcgctctctggattctgagtccatcagccccggggactttcacagaaagctgcctcggaccccctcttcaggaactatgtcctcggcggatgaccttgatgaacgcgagcctcctagtccgagcgagaccggccccaattccctcggaacatttaaaaagactttgatgtcaaaggccgcgctaactcacaaattcagaaagctgcgttcgcctaccaaatgtagggattgtgagggtatcgttgtgtttcagggcgttgagtgcgaggagtgtttgctggtctgccataggaagtgtcttgagaacctggttatcatatgtggacatcagaagctgcctggaaaaatccatttgtttggagctgaattcacacaggtggctaaaaaagagccagatggaataccctttattctgaaaatctgtgcctcggaaatagagaatcgggcactgtgcctacagggcatttacagggtatgtgggaataagataaagaccgaaaagctttgtcaagccctggaaaacggtatgcatctcgtggacattagcgagttttcaagtcacgatatctgtgacgttttgaagttatacctccggcagctcccagaaccttttatcctctttagactctataaagaatttattgatttggctaaagaaattcagcacgtcaacgaagaacaggagacgaaaaagaacagtctggaggacaagaaatggccaaatatgtgcattgagatcaaccgaatcctgcttaagagtaaagacctgctgagacagctgccggcctcgaattttaattccttgcactttcttattgtgcacctcaaacgggtggtcgatcacgcagaggaaaacaagatgaactctaaaaatttgggcgtgatatttggtccgtctttgattaggccacgaccaactactgcccctattacaatctccagtctggccgagtatagtaatcaggctcgcctggttgagttcctgattacttacagtcaaaaaatatttgacggcagcctgcagcctcaggacgtgatgtgttctattggagtggtagatcagggatgctttcccaagccgctcctaagccctgaggaaagagatattgagcgctcaatgaagtcattgttcttctcgagcaaggaagacatccatacctcagaatccgagtccaaaatcttcgagcgagccactagttttgaggaaagcgaacgtaaacagaatgccctcggtaagtgtgacgcctgcctgtccgataaggctcagctattgttggaccaggaggccgaatccgctagccagaaaattgaggacggcaaaacccctaagccattatctcttaaatcggaccgaagcaccaataatgttgaaagacacacaccgcgtacgaagatccgcccagtgtcactgccggttgaccgcttacttctggcctctcctcctaatgagcggaacggaagaaacatgggcaacgtcaatcttgacaagttttgtaagaacccagcgttcgagggagtaaacaggaaagacgcagcaacaacagtttgtagcaagttcaacgggtttgaccaacagaccttacaaaagatacaggataagcaatatgaacagaactccttgaccgccaaaactacaatgatcatgcctagtgctctgcaggagaagggggtgactacctcgctgcagatttccggagatcattcgataaatgccacacagccttccaagccatacgccgaaccggttcgatccgtgagggaggctagtgaacgccggagctcagatagctaccctttagctccagtcagggctccacgcacccttcagcctcagcattggaccacgttctataagccacacgccccaatcatctccattagggggaatgaagagaagcccgcatctccatccgctgcggttccccctgggactgaccacgatccacacggtctggtcgtgaaatcaatgccagaccccgacaaagcttcagcctgcccggggcaggcaaccggacaacccaaggaggactccgaagagttgggactgcctgacgtgaaccccatgtgtcagcgtccgcgcctcaaacggatgcaacaatttgaggatctggagggggaaatccctcaatttgtgtag

SEQ ID NO: 132538 - DNA, 1182 bp, Artificial Sequence
  Description of Artificial Sequence: Synthetic coding sequence
atgatcgcacataagcagaagaagactaaaaagaaaagagcatgggctagtggccagctatctactgacatcacaacaagcgaaatggggctgaaatccctttcaagcaacagcatttttgatccagattacatcaaggaattggtcaacgatattcgtaaattctcccatatgctgctgtatttgaaggaggccatattctctgattgcttcaaagaggtgatccatatacggctagaagaattactccgggtcttgaagtccattatgaataaacatcagaacctgaattccgtcgatttacagaatgctgctgaaatgttgaccgccaaggtgaaggccgtgaactttacggaggtcaacgaagaaaacaagaatgacctgttccaggaggtgtttagctctatcgagaccctggcattcactttcggtaacattttgaccaatttcctgatgggcgatgttggcaacgactccttgcttaggctacccgtgtcaagagaaaccaagagttttgaaaacgtgagcgtggagtcagttgattcaagttctgaaaagggcaattttagtccactagagctggataatgttctactcaagaatacagattctatcgaactcgctctgagctatgctaagacatggtccaagtatacaaagaacattgtcagttgggtggagaaaaaactgaatttggagctggaatccacaagaaatatggtgaagctggcggaggcaaccagaaccaatatcggaattcaggagttcatgccactgcagagcctcttcaccaatgcactgctgaacgacattgaaagctctcatcttttacagcaaaccattgccgcccttcaggccaataaattcgttcagcctctcttaggcagaaagaatgagatggaaaaacagcgtaaggaaatcaaagagctctggaagcaggaacaaaataaaatgctcgaggccgaaaacgctctgaagaaagctaagctcctgtgtatgcaacggcaggacgagtacgagaaggctaaatcctcaatgtttcgtgccgaggaggagcatctttcgagctctgggggtctagccaaaaatctgaataaacagctcgaaaaaaaaagaaggttggaggaggaggccctgcaaaaagtcaccatattctttttctttatctgtaaacttaactag

SEQ ID NO: 132539 - DNA, 3306 bp, Artificial Sequence
  Description of Artificial Sequence: Synthetic coding sequence
atgaaatcccgacaaaagggaaagaagaaagggtctgctaaggaacgagtgtttggatgcgacctgcaggaacatttgcagcactcgggccaggaggtgccgcaggttcttaaaagttgcgccgaattcgttgaggagtatggcgtggtagatgggatctacagactgtcaggggtatccagcaacattcagaagctgcgacaggagttcgagtcagagagaaagcctgaccttcgcagagacgtctatctgcaggacatacattgcgttagcagtctctgcaaagcatacttcagagagctccccgatcccctactcacttatagactgtacgacaagtttgctgaggctgttggcgtccagctagagccagaacgtttagtcaaaatcctagaggtgctccgcgagctgccagtcccgaattatcgcaccctggaattcctcatgcgccatctggtacacatggctagtttctcagcccaaacaaatatgcatgcgcgcaatttagctatagtctgggcccccaacctactcaggagcaaagatatcgaagccagcgggtttaatggcaccgcagctttcatggaggtgcgcgtgcaatcaattgtggtagaatttatcctgacgcatgtcgaccagttgttcggtggcgcagccctgagtgggggcgaagtagagtccgggtggcgctcattaccaggaactagagcatccggctctccagaagatttgatgccgcggccgctgccttatcatctgccctccatcttgcaggctggagacggcccccctcagatgagaccctatcataccatcatcgagatcgccgagcacaaaaggaaagggtccctaaaggtcagaaaatggaggtctatctttaacctcgggagaagcggccacgagacaaaaaggaaactgccccggggcgcggaagatcgggaagataagtccaacaagggcactctccgaccagctaaatcgatggacagcctatctgcggcagctggcgccagtgatgaaccagaagggctggtgggaccctcatcgccaagaccctcgccgctgctgccagagagtctcgaaaatgatagtattgaggcagccgaaggcgagcaggagccggaggccgaagctcttggggggaccaattccgagccggggacgcctcgggccgggcgctccgccattagggctggcggtagttctagggcagaaaggtgtgcaggggtgcacatttcagacccttataatgtcaacctccctctgcatatcacctcaatcctctcggtgcctccaaacataatctccaatgtgtccttggcccggctgaccagaggcctggaatgtcccgccctgcaacatcgcccgagcccagcctctgggcctggacccgggccaggcctgggcccagggcctcctgacgagaaactggaagcatcgcccgccagttctcctttggccgacagtggccccgacgatctggcacccgctttggaggactccctgagtcaggaggtgcaggatagcttttcattcctggaggacagtagctccagcgaacctgagtgggtcggagccgaggacggtgaagtagcacaggccgaagctgccggtgctgcgttcagccccggggaggatgatcccggcatggggtacctggaagaactcctgggtgtcgggccccaggtggaagagttttcagtggagccacccctcgacgacctgagcctggacgaggctcagtttgtccttgccccttcctgctgtagtttggacagcgcaggccccagacccgaggtagaagaggaaaacggcgaggaggtgttcctctctgcgtacgatgacctgtccccccttctggggcccaagccacctatctggaaagggtctgggtcattggagggagaggctgccggctgcggcagacaggcgctgggtcagggtggtgaggagcaggcctgctgggaggtgggcgaagataagcaggccgaacccggggggagactggatattagggaagaggcagagggctcacctgaaacaaaagtagaagcgggcaaggcttccgaggaccggggggaggccggcggatcccaagagactaaggtcagactgcgcgaaggctcgagggaagaaacagaagctaaagaagaaaagagcaaaggtcagaaaaaggccgacagcatggaggccaagggagtcgaggaaccaggaggagacgaatacaccgacgagaaagagaaggagatcgagagggaggaggatgaacaacgggaggaagcccaggtggaggctggtcgcgatttggaacagggtgcccaggaggatcaggtggccgaggaaaagtgggaagtcgtgcagaagcaggaggccgaaggcgtgcgcgaagacgaggataaaggacagcgggagaaaggctatcacgaggcgcgcaaggatcaaggcgatggtgaagacagcagaagccccgaggcagctaccgaaggaggcgcaggggaggtgtcaaaggagcgggagagcggcgacggagaggcagagggcgatcagagagcaggtggatactacctggaagaagacacactgagcgaggggagcggcgtcgcttccctcgaggtcgattgcgccaaggaagggaatccacactcatcagagatggaagaggttgcaccacaacctccccagcccgaagaaatggaacctgagggacagccttccccggatggatgcctttgcccatgtagtctcggactgggtggcgttggcatgagactggcctctaccctggttcaagtgcagcaggtccgctccgtgcctgtggtgcctcctaaaccgcagttcgctaagatgccgtcagctatgtgttctaagatccacgttgcccccgccaatccatgcccccggccgggccgcttagatggaactccaggcgagagagcttgggggagccgggcctctagatcctcttggcgcaacgggggatcactctcatttgacgctgcggtggcgctggccagagatagacaacgaacagaggcgcagggcgttcggagaacacagacctgtaccgaggggggtgattactgtctcatcccccggacttcgccgtgtagtatgatttcagcccactcaccacgacctctgagctgtctcgagctaccttcagagggcgctgaggggtctggatcacggagtaggctttcgctgcccccaagggaaccacaagtacccgaccccttgctgagctcccaacgtagaagttacgccttcgagacccaagcaaatccgggaaagggtgagggcctgtag

SEQ ID NO: 132540 - DNA, 2673 bp, Artificial Sequence
  Description of Artificial Sequence: Synthetic coding sequence
atgaaaagtcgacagaagggtaaaaaaaaaggcagtgccaaggagagggtgtttgggtgcgacctccaggagcatttgcaacattccggtcaggaggttccacaggtactgaaatcatgtgcagagttcgttgaggagtacggcgtggtcgacggaatctatcggctgtctggcgtgtccagtaatatccagaaactcagacaggagtttgaatctgagaggaagcctgacctccgaagggacgtgtacctgcaggatattcactgcgtgagctcactctgcaaggcgtacttccgcgaactgcccgaccctcttttaacctaccgtctgtatgacaagttcgcagaggccgttggggtacagttggagcctgaaaggctggtcaaaatactggaggtacttagggagctgccagttccaaattaccggacccttgaatttcttatgcggcacctcgtccacatggcatcctttagcgctcagaccaatatgcacgctcggaacttagcaatcgtctgggctccaaacctgctacgttcgaaagacattgaagcctctgggttcaatgggaccgccgcctttatggaagtcagagtccagtccatcgtcgttgagtttattctgactcacgtggatcaactatttggcggagcagccctttcaggcggtgaagtcgagagcggctggcgtagtctgcccggtacacgggcatctgggagccctgaggatctgatgcccagacctctaccgtatcacctcccatccatcctccaggctggtgatggaccacctcagatgaggccttaccatacaattatagagattgctgagcacaagcgcaaggggagcttgaaagtcagaaagtggcgctctatttttaacctcgggcgcagcggccacgaaactaagcgcaagttgccacgtggagcagaggatcgggaagacaagagcaataagggtaccctgagaccggcaaaatccatggattctctctccgcggctgcaggcgcctctgacgagcccgagggcttggttggcccctccagcccacggccttcgccattgctgcccgagtccctcgagaatgacagtatagaagcggccgagggcgagcaggaaccggaagcagaggctctgggggggaccaatagtgagcccggtactcctagagctgggagatctgctattagagctggtggtagttccagagccgagcgttgcgccggcgtgcatatcagtgatccctacaacgtcaatctgccactacacataaccagtatcttgtctgtccccccaaacatcattagtaacgtgtcactggcccgactcacaaggggcctagaatgcccagccctgcaacaccggccatctccagcgtctgggcctggcccaggcccgggcttagggccaggaccccctgacgagaaactggaagctagccctgcctcgtctcccctggccgattctggccccgacgacctggcaccagctttggaggattctttgagccaagaggtacaggattcctttagcttcctcgaggatagcagtagctctgagcccgagtgggttggcgccgaggatggcgaggttgctcaggcagaggcagcaggagccgcattcagccctggtgaggatgaccccggtatgggatacctcgaggagcttctaggagtaggcccccaagtagaggaattttccgtcgagccccctctcgacgacctgtcactggacgaagcccagtttgtgctggctccaagttgctgtagcttggactccgccggcccacgccccgaggtggaggaggaaaatggtgaggaggtttttctgagtgcctacgatgacttatccccgctgctgggcccaaagcctcctatatggaaaggctccggctcattagagggcgaggcagcaggctgtgggagacaggcgctgggacagggcggagaggaacaggcatgctgggaagtaggcgaggataaacaagccgagcctggcggacggctggatatccgtgaagaagcggaaggcactccccagcccccccagccagaagagatggagcccgaggggcagccatctcccgacggttgcttatgcccttgttctcttggcttaggcggcgtcggaatgagacttgccagtaccctggtacaagtgcagcaggtacggtctgtgcccgtagtgcccccaaaaccccagttcgcaaagatgcccagcgcaatgtgctcaaagatccacgtggctcccgccaatccctgcccacgccccggccgcttagatggcaccccaggggaacgagcgtggggctcacgggcctcaaggtcttcctggcggaatgggggatccctgtccttcgacgccgctgttgccctagctcgtgacagacagcgaacagaggcccagggagttcgtcggacacagacctgtaccgagggtggagattattgcttgatcccccgtacaagcccgtgcagcatgatatccgcccattcacctaggcctttgagctgcctggagttaccatccgaaggagccgagggatcgggtagtcgctcaaggttatctctgccccccagggaacctcaggttccggaccctttactatcctctcaacgacgcagctatgcctttgagacccaggctaacccaggaaagggagagggactctag

SEQ ID NO: 132541 - DNA, 1500 bp, Artificial Sequence
  Description of Artificial Sequence: Synthetic coding sequence
atgagacacctggtccacatggcaagcttttccgcccagaccaacatgcatgcaagaaatctggccatcgtgtgggccccaaatctgctgagatctaaagatatcgaggcctccggcttcaatggcacagctgcttttatggaggtccgagtgcaaagtattgtagttgagtttatactgacccacgttgatcagcttttcgggggagcagcattgtccgggggtgaagtggaatcgggctggcgatcactaccagggactcgggcctccgggagtcccgaggaccttatgccccgcccattgccataccacctaccgtccatcctgcaggcaggcgacggaccacctcaaatgaggccgtaccataccatcatagaaatagctgaacacaagaggaaggggagtcttaaagttagaaagtggcgctcaatttttaatttgggccgctccggccacgaaaccaaaaggaaattgcctaggggggccgaagatagagaagacaagtcaaataagggtactctgagaccggccaaaagtatggactctctgagtgctgccgctggagcttccgatgaacctgaaggtctcgtagggccaagtagcccccgccctagtcctctcctcccagaaagtttggagaatgacagcatcgaggctgcagagggcgagcaggagcctgaggccgaggccctgggaggaacaaacagcgaacccggaacccctagagccggcagatcagcaattagggccggcgggtcaagtagggctgaacggtgtgcaggcgtgcacataagtgatccgtacaatgttaaccttcccttgcacatcacctctatcctgtccgtgccgcccaacataatcagcaatgtctctctggctcggctaacacggggccttgaatgtcctgctctgcagcaccggccctcccctgccagtggaccaggacctggccctggacttggccctggccctcctgatgaaaaactagaagccagtcctgcctccagtccactcgccgacagtggccctgacgacttggcaccagcacttgaggatagtctgtctcaggaagttcaggatagttttagttttctggaggactcttcctcatccgaacccgaatgggtgggtgcggaggatggagaagtcgctcaagccgaggccgccggggccgcatttagtccaggggaggacgaccctggaatgggatacctcgaggaactcctgggggtgggcccacaggtggaggagttttccgtggagccaccactggacgacctctctctcgatgaagctcagtttgtcctcgcgcccagctgctgcagcctcgattctgctggacctagaccggaggttgaggaggaaaacggcgaggaagtgtttctcagtgcttatgatgacctctctcccgccttggggctgctactgcagcccgggtggggacatcggtcgcatagttctgaaggacaatgtttgagaattaaggcagtatttctgtag

SEQ ID NO: 132542 - DNA, 4335 bp, Artificial Sequence
  Description of Artificial Sequence: Synthetic coding sequence
atgaagaataagggggctaagcagaagctgaagagaaagggggcagcttccgcgttcggctgcgatctgaccgagtacttagaaagttcaggtcaggacgttccctatgtcttaaagagctgcgcagagtttattgagacacatggaattgtggacggaatctaccggctgagtggagtgaccagtaatatccaaagacttaggcaggaattcggaagtgaccagtgccccgatctgaccagagaggtatacttacaggacattcactgcgtgggctccctgtgcaagctctatttccgcgaactgcccaaccctctgctgacgtacgaactctacgagaagttcacggaagctgtctctcactgccctgaggagggacagttggcgcgcatacagaatgtgattcaggagttaccacctagtcattaccggacgcttgaatacctgatcaggcaccttgcacatattgcaagtttttcaagcaaaacaaatatgcacgccaggaatttagcactcgtctgggcccccaatctacttaggtctaaagagatagaggctaccgggtgcaatggagatgcagcctttcttgccgttagagtccagcaggtggtaatcgaatttatccttaatcacgtggaccaaatttttaacaatggcgctccggggagtctggagaatgacgaaaataggccaattatgaaatcccttacactgcccgccctgtccttgcccatgaaattagtctctctggaagaagcccaggcccggtccctggccaccaatcatcctgcacgcaaggagaggagagagaactcactgccagaaatcgtcccccctatgggcacgctcttccacaccgtgctcgagctgcccgacaataagagaaagctgagctcgaaaagcaagaagtggaaaagcattttcaatttaggccgctccggaagcgatagcaaatccaaactgagccggaacggctccgtgttcgtgaggggtcagcgcctgagcgtggaaaaagcgacaatacgccctgcaaaatccatggatagtctctgctctgttcccgtggagggcaaggagactaaagggaatttcaatcgtaccgtgaccacaggggggtttttcattccagcgaccaaaatgcactccactgggaccggcagctcttgtgatctgactaaacaggagggtgaatgggggcaggagggcatgccacccggagccgagggaggctttgacgtgtcctccgaccgatcccacctgcagggtgctcaggcgcggccccctcctgagcagctcaaagtattccgacccgttgaggatccagaatccgagcagactgccccaaaaatgttgggaatgttttacacctctaatgatagcccatctaaaagtgtcttcacgagcagcctctttcaaatggaacccagtcctcggaaccagcggaaggcacttaacatatcagaaccttttgctgtgtcggtgcccttgcgggtcagcgcggttatctctacgaacagtacaccttgcagaactcctcccaaagaactgcagtcactgagctccctggaggagtttagctttcacggatcagaatctggcggctggcctgaggaggaaaagccactgggcgccgagacgagcgcagcctccgtgcccaagaaagccgggctggaggatgccaaggcagtgcccgaagctccaggcacggtggagtgcagtaaggggctctcccaggagcctggagcgcatcttgaagagaaaaagacccccgaaagtagtttaagctcgcagcacctgaatgagctggaaaaaagacctaaccccgagaaagtggtggaggaaggcagagaagccggagagatggaaagttccactctccaggagtcccctagagcgcgcgccgaagctgtgctgttgcacgaaatggacgaggacgatctggccaatgctctgatttggccggagatccaacaggagctaaagattattgaatctgaagaagagctcagttcacttccaccgcccgccctgaagacatcccccatccagccaatccttgagtccagtctgggcccatttattcctagcgagccccctggcagcctgccatgcgggtcattccctgccccagtgagtacccccctcgaggtgtggacacgggatcctgccaatcaatccactcagggagcatcaactgccgcctctcgcgagaaacccgaacccgagcagggccttcacccagacctggctagtttggcccctctagaaatcgtgccattcgaaaaggcaagtccccaggccacagtggaggtagggggtcctggtaacttatcaccacctctcccccccgccccaccacctcctaccccacttgaagaatccacccctgtgctgctgagtaaaggaggaccagaaagggaagactcgagccgcaagcttagaaccgacctttacatcgaccaactcaagtcccaggattctccagagatttcctccttgtgtcagggcgaagaagcaaccccgcgacacagtgacaaacaaaacagcaagaatgccgcttccgaggggaagggatgtggtttcccttccccgacccgcgaggtggaaatcgtgtcccaagaggaggaagatgtgacgcattccgtacaggagccatcagactgcgatgaggatgacacagtgacggatatcgcccaacatggactggaaatggtggagccctgggaggaaccacaatgggtaacgagccctctgcacagtcccacattgaaagacgcccataaagcccaggttcagggactccaagggcaccaactagagaaacggctgagccaccggcctagcctccgccagtctcattccctggacagcaagcctacagttaaatcccaatggaccctcgaagtgccttcatctagcagttgcgctaacctcgaaaccgaaagaaattccgaccccctgcaacctcaagcaccaagacgggaaatcactgggtgggacgaaaaagctctgaggagttttagagaattcagtgggctgaagggggccgaggcgccaccaaaccagaaaggacctagtggagtccagcctaatccagcagagaccagccccatctccttagccgaggggaaggagctcgggacgcatctcggccacagttctccgcagatcaggcaagggggagtcccagggcccgagagcagtaaggagtccagcccctcagtccaggattccaccagtccgggggagcacccagccaagctgcaattaaaaagtaccgaatgtggaccccctaaagggaagaaccggccctcttctctcaatctggaccctgctattccaatcgcagacttattttggtttgaaaatgtagcctctttcagcagtcccggcatgcaggtgtcagagccaggtgacccaaaagtgacctggatgacctccagctattgtaaggcagacccgtggagggtctatagccaggacccacaggatcttgatatcgtggcgcacgccctgacgggaagaaggaactcggcaccagtgtcagtttccgcagtgagaacgagtttcatggtgaagatgtgccaggcccgcgcagtaccagtcattcccccgaaaattcagtatacccagatcccccagccactgccttctcagagctccggagagaacggcgtgcagcctttggaacgttctcaggaaggtccaagctctacatccggcacgactcagaagcccgccaaagatgattccccgtcatctctcgagagctccaaggaagaaaaacccaaacaggacccaggcgccatcaaatccagcccagtagacgctaccgccccctgcatgtgtgaggggccgaccctctccccggagcctggttcttctaacctgctgagcacccaagacgctgtggtccagtgtcgcaagaggatgtccgagacagagcctagcggagacaatctcttgagctcaaagctggaacgcccatccggaggaagtaagccgttccataggagccgccccggacgacctcagtcactgatcctcttttcacccccatttcctataatggaccatcttccacccagcagcacggtgacagattctaaagtgctgctcagcccaatcagatctccgacacagaccgtgtcccctggtctgttgtgcggcgagctcgctgagaatacttgggtaactccagaaggcgtcaccctgcgtaataaaatgacaattcctaaaaatggccagagactggagacatcaaccagttgtttctaccagcctcagcggcggtcagtgatcctcgatgggcgctccggtaggcaaatcgaatag

SEQ ID NO: 132543 - DNA, 3300 bp, Artificial Sequence
  Description of Artificial Sequence: Synthetic coding sequence
atgaaaaacaaaggagccaaacagaaacttaaacgaaagggggcagcctcggcctttggctgtgatctgaccgagtatcttgaaagttccgggcaggatgtcccctacgttctcaagtcctgtgccgagtttatcgaaacgcacggcattgtcgatggaatttaccgcttgtccggagtcacgagtaacatacagaggctacgacaggagttcggatcggatcagtgcccagatttgacaagggaggtgtacctacaggacattcactgcgtaggcagcctgtgtaagctatacttcagggagctgccaaacccgctcctcacttacgaactgtacgagaagttcaccgaggccgtctcacactgcccagaagagggtcagctggcacggatacaaaatgtgattcaggagttgcctccctcacactaccgaaccctagagtatctaatacgacacttggcacacattgcaagctttagctcgaaaacaaatatgcatgctaggaacctggccctggtgtgggccccaaaccttttaagaagcaaagaaattgaagccacaggatgtaatggcgatgccgcatttctcgccgtgagggtccaacaagtggttattgaattcatcttgaatcacgtggatcagattttcaacaacggtgcccccggctcattagagaatgatgaaaatcgtcctatcatgaaatccctcacactcccggctttatctctgcctatgaagctggttagcctggaggaggcccaggctagaagtctggctaccaaccaccctgccaggaaggaaagacgagaaaactccctgccagaaattgtgccgcccatgggcactttgttccataccgtcctggaactccctgataataaaagaaaactctcatcgaagtcaaaaaagtggaagtcaatttttaatctaggtcgttcaggcagcgatagcaagtcgaagctaagcaggaatgggagtgtattcgtcagggggcagagactgagcgttgagaaagctacaatccggcccgccaagtcgatggactctctctgctctgtgcccgtcgaggggaaggaaacgaaggggaattttaacaggaccgtgaccacagggggtttctttatccctgcaacaaaaatgcattccaccggaaccgggagctcatgcgacctgacgaaacaagagggcgaatggggccaggaaggaatgccgcccggcgctgagggaggattcgatgtgagctcagacaggtcccacttgcagggcgcccaagcccgccccccgccggagcagcttaaggtgtttagacccgtagaagatccagagagtgaacagacggcacccaagatgctgggcatgttttatacttctaatgactccccatcaaaatccgtctttacttcctcactctttcaaatggagcctagtcctaggaaccagcgaaaagcgttgaacattagtgagccatttgctgtgtcagtgccgctgcgggtttcagcagtgatatccactaactccactccgtgccgtacaccccccaaggaattgcaatctctctcctccttagaggaatttagtttccacggaagtgaaagcggcgggtggccggaggaagagaagccactgggggctgagaccagtgccgccagcgttccaaaaaaggccggcctggaggacgcaaaagctgtgcccgaggctccagggaccgtcgaatgctctaaggggctttctcaagagccgggtgcccacctggaagagaaaaagacccctgagtcatcactcagctcacagcaccttaacgagttagaaaaacgccctaatccagaaaaagtggtcgaggaaggaagagaggcaggggaaatggagagtagcacactccaggagagccccagggcaagggccgaggctgtgctgcttcatgaaatggatgaagacgacctggccaacgccctgatctggcctgagattcagcaggaactaaagatcatagagtctgaagaggagctctctagtctaccaccacctgctctgaagacctcacccatccagccaatactggagagcagtcttggcccattcattccatctgagccacccggttccctgccttgcgggtcttttcctgccccggtatcaacgcccctggaggtttggacgagagacccggcgaatcagagcacccagggcgcgagcacagcagccagtagggagaaacccgaaccagagcaggggctccaccccgacttagcctctttggctccgctggagattgtgccattcgagaaggcctcccctcaggccaccgttgaggtcggtggtcctgggaacctctcgcccccgctccccccagctccaccacctcctacccccctggaggagagtacccccgtactgctgagtaagggcggccccgagcgggaagatagtagccggaagctgcgcaccgacctctatattgatcagcttaaaagccaggactccccggaaatttcttctctctgtcagggggaagaagctactcccaggcattccgataaacagaattctaagaatgccgctagcgaggggaagggctgcggattcccgagccctacgcgggaggtcgaaattgtgtcccaagaagaagaagatgtgacacattccgtccaggaacctagcgactgcgatgaagatgacacagttaccgacatcgcacaacatggacttgaaatggtcgagccctgggaagagccccaatgggtcaccagtccactgcacagccctaccctaaaggatgctcataaagcccaggtgcaggggttgcagggacatcagcttgagaaaagactttctcacaggcccagtctgaggcagagtcacagccttgattcaaagccgacagttaagtcccagtggacgttggaggtccccagcagttcctcctgcgccaacttggagacagaacggaacagtgaccctctgcagccccaagctccgagaagagagattactggatgggatgaaaaagcattgagaagtttcagggagttttccgggctcaagggggcagaggcccccccaaaccagaagggacctagcggggtccagcctaatcccgctcagcccgtaggcccattacgaaatctgcccaagatgatcctccccccgccatggaaggcccagagaaaaaaaaaccagtccaagattcctgagcctttgtcaccacaccagtggatgccgctccaccccgcttgtgctagagatctgccgttcttacagaatcaggcaaggctgacatgctcccccccccggatgcagtag

SEQ ID NO: 132544 - DNA, 4509 bp, Artificial Sequence
  Description of Artificial Sequence: Synthetic coding sequence
atgatggcaaaaaataaggaaccgaggccccccagctacaccatctccattgtgggtttgtccggaactgagaaagataaagggaactgtggagtaggcaaatcttgcctctgcaaccgctttgtgcgctctaaagcagatgagtactacccggaacacacgtcagtgctttcaacgatagacttcgggggacgtgtcgttaataacgaccatttcttatattggggcgatatcatccagaactctgaggacggcgtggaatgcaagatccacgtgatcgagcagacagagttcatcgatgatcagacttttctgcctcatagaagcacaaacctccagccttatataaaacgcgccgccgccagtaaacttcaaagtgccgaaaaacttatgtatatctgcacagatcagctgggcctggaacaagacttcgagcagaaacagatgccggagggcaagctcaacgtggacggctttcttttgtgtatagatgtatcacagggttgtaaccgaaagtttgatgaccagctgaagtttgtaaataatctcttcgtccaactgagcaagtccaagaagcctgtgattattgcagctactaagtgtgacgagtgtgttgatcactatctacgggaggtacaggcatttgcgagcaataagaagaacctgctcgtggtggaaactagcgcccgattcaacgtcaatatcgagacgtgctttacggccctggtccaaatgcttgacaagacccgctctaagccaaagattatcccgtacctagatgcttacaaaacccagaggcagctagtggttactgccactgacaagttcgagaagctggttcaaaccgtgagggattatcatgctacttggaagacagtctctaataagttgaaaaaccatccagactatgaggagtacattaacctggagggcacgcgcaaggctaggaatacctttagcaaacatattgagcagctgaagcaagaacatatcaggaaacgcagagaagaatacataaataccctccctagggcttttaacactcttttaccaaaccttgaggaaattgagcatcttaactggagcgaggctctgaagctaatggagaaacgcgcagattttcagctctgtttcgtggtgcttgaaaagactccatgggacgagacagatcacatcgataagattaacgatagacgaatccctttcgacctcctcagtaccttagaggccgagaaagtttatcagaatcacgtgcagcaccttattagcgagaagcgaagggtggaaatgaaagaaaaattcaagaaaacgttagagaagatccagtttataagtcctgggcagccttgggaagaggtgatgtgctttgtgatggaagatgaagcctataagtacatcactgaggccgactccaaagaagtctacggccgccaccagagagagatagttgaaaaggctaaggaggagttccaggaaatgctctttgagcactctgagctgttctatgatctggatctcaatgctaccccatccagcgataagatgtccgagatccacactgttctctccgaggagccgaggtataaagccctgcaaaaactcgctcctgatcgggagagtctgttattgaagcatatcggtttcgtttatcacccaaccaaagagacatgcttgtccggccaaaattgtacagatattaaggtcgagcagcttctggcctcttcactcctgcaactggaccacggcagacttaggctataccacgacagcacgaatatagacaaagtgaatctgttcatcttaggcaaggacggcctggcacaggaattggcaaacgaaattcggactcaaagcaccgatgacgagtatgccctcgacggcaaaatctacgagctcgacctgaggcctgtggatgccaaatcaccctactttctgtcccaactttggaccgcggcatttaaaccacacgggtgcttttgtgtatttaactctatcgaaagcctgagtttcatcggagagttcatcggcaagatcaggactgaagcttcgcaaatccggaaagacaaatacatggctaacctaccctttacgctgatcttagcaaaccaacgggattctatctccaaaaacctgcccatactacgccaccaaggtcagcaactagccaataagcttcaatgtcccttcgtcgatgtgcctgcaggtacatatccacgaaaatttaacgagactcaaataaaacaggctctgcggggagtgctcgagtctgtgaagcataacttggatgtggtgtcgcccattcccgccaataaagaccttagtgaagccgaccttcggattgtcatgtgtgccatgtgtggagaccctttcagtgtggacctgattctgtccccattcctggactcccacagctgctccgcagcccaggccgggcagaacaatagcttaatgctcgacaagatcataggagagaaacggcggagaatacaaatcaccatcttgtcctaccattcttccataggcgttcgaaaggacgagttagtgcatggttatatactggtctacagtgccaagcggaaggcctccatgggcatgctgcgggccttcttgtccgaagtgcaggacactatccccgttcagctcgtggctgttacagattcgcaggctgacttttttgagaatgaagccataaaagaactgatgacagagggtgagcacatcgccacggagatcacagccaagtttactgctctttactccctatcgcagtaccacaggcaaacggaggtattcacattgtttttttctgacgtgctagaaaaaaaaaatatgatcgaaaactcctacctctccgacaacacacgcgaatcaactcatcagtccgaggatgtgttcctgcccagccctcgggattgcttcccatacaacaattaccctgattccgacgatgatactgaggcgcctcccccatatagcccaataggcgacgatgtgcagttgctacctaccccctccgatcgaagtcggtatagattagacctggaaggcaatgaatatcctattcatagtacgcctaactgtcacgatcatgaaaggaaccacaaagttcctccccccatcaaaccaaaaccagttgttcctaagactaatgtgaaaaagcttgatcccaatctgctgaaaaccatcgaggccgggattggaaagaatcccaggaagcagacctcacgggtgcccctggctcaccccgaagacatggaccctagcgataattatgccgagcctattgataccatttttaagcagaagggctacagcgacgaaatatatgtggtgcctgacgactctcagaacaggattaaaattcgaaattcattcgttaataacacacaaggagatgaggagaacgggttctcagaccggacttcaaaatctcacggtgagaggcgtccgtcgaagtataagtataaaagcaaaactttgttttccaaagctaagtcctactatcgaagaacccactcagacgcgtctgacgatgaagccttcaccaccagtaagaccaagcgaaaggggcgccatcgaggtagtgaggaagatcctttgctgtcccccgttgagacatggaagggtggcattgataacccagccatcacctctgaccaagagctggacgacaagaagatgaaaaagaaaacccataaggtgaaagaagacaaaaagcagaaaaagaagaccaagaacttcaacccccctaccagacggaattgggaatctaattactttgggatgccgctccaggatctggtaaccgctgaaaagccaatcccactttttgtggaaaagtgcgtggaattcatcgaagacacggggctgtgcacagaggggctctatcgggtcagtggcaacaaaacagatcaggacaacattcaaaagcagttcgatcaggaccacaatatcaatctggtctcaatggaggtgacggtcaacgctgtggcaggcgccctcaaggcgttctttgccgacctgcccgacccattgattccttacagtctgcatccagaacttctggaggctgcaaagatcccggacaagacagagcggctccatgccctcaaggaaattgttaaaaaatttcaccccgtgaactatgatgttttccgttacgtgatcacacacctcaaccgagtttctcagcagcacaaaataaatctaatgacagctgacaatcttagcatctgcttttggcccactctcatgcgaccggatttcgagaaccgggaatttctcagtaccaccaagatccatcaaagtgtggttgaaacattcattcagcagtgtcagttcttcttctataacggcgagatcgtcgaaacaactaacatcgtcgctccgccccctccgtccaatcccgggcaactggtggaaccaatggtgcctctgcaactgccacccccactgcagccacagctcattcaaccacagttgcagaccgacccactgggcattatctag

SEQ ID NO: 132545 - DNA, 714 bp, Artificial Sequence
  Description of Artificial Sequence: Synthetic coding sequence
atgtccctcccaccaccccctcctggcccactgcctctcagacgtaggaggcgccgcccaacccttctagggctttgtaccgaaggactgtacagggttagtggcaacaagaccgaccaggacaacatccagaaacagttcgaccaagaccataacattaacttggtatctatggaggtcactgtgaacgcagtggccggagcacttaaagcctttttcgcagacctgccagatccgttgattccgtatagtcttcacccagaactgttggaagccgcaaaaatcccggacaagacagagcggttacacgctctgaaggagatcgttaagaaattccaccccgttaactatgatgtgttccgatacgttattacccacctgaaccgagtgtcccaacagcacaagatcaatttgatgaccgcggataatttatcaatatgcttttggcctaccctgatgaggcctgactttgagaacagagaatttctgtcaactacaaagatccaccagtcagttgttgagactttcatccaacagtgtcagttcttcttttataatggcgaaattgtggaaacaaccaacattgtggcaccaccacctccgagtaatcccggccagctcgtcgagcccatggtgcccctgcagctgcctcccccgctccaaccacagttgattcagccgcaactgcagaccgatccactgggcatcatctag

SEQ ID NO: 132546 - DNA, 4506 bp, Artificial Sequence
  Description of Artificial Sequence: Synthetic coding sequence
atgatggctaagaataaagaaccacggccacctagttataccatcagcatcgtaggactatcggggaccgagaaagacaaagggaattgtggggtgggaaaatcctgcctctgtaatcgctttgtgcgttcgaaagcagatgagtactatccagagcacaccagtgtgctctccactatagattttggaggtagagtggtcaataacgaccactttctatattggggggacattatccagaactctgaagatggggttgaatgtaagattcatgtgatcgaacagactgaatttatagatgatcagacattcctccctcacagatcaacaaacctccagccctatatcaaacgcgctgcagcgagtaagctgcaatctgcagagaaactgatgtatatttgtacggatcagctgggactggagcaggatttcgagcagaagcagatgcccgagggcaagctgaatgtggacggattcctgctgtgcattgatgtgtcacagggatgtaacagaaaattcgacgaccagctcaagttcgtcaacaatcttttcgtccagctgagcaaatccaagaagccggttattatagccgcaaccaagtgtgacgaatgcgtcgaccactatctccgcgaagtacaggcattcgctagtaataagaaaaacctgctggtggtggagacctcagccagattcaatgtgaacatcgaaacttgctttacagcgctggtgcagatgctggataagactcgttccaagccaaagataatcccttatctggacgcatacaaaacgcaacggcagctggtcgttacagcgactgataaattcgagaaactcgtccaaaccgtgagagactaccacgcaacttggaaaactgtctccaataagctgaaaaatcaccctgactatgaggagtatattaatctggagggtacacgtaaggccaggaacacattctccaagcacattgagcagctcaaacaggagcacatccgtaagcggagagaggagtacataaatacgctccccagggccttcaatacgctacttccaaacttagaggaaatcgaacatctaaattggtctgaagccttgaagctgatggagaagcgcgccgatttccagctatgttttgtggtactcgaaaaaaccccttgggacgaaaccgatcacatcgataagatcaatgatcgccgtatccccttcgacctgctatccacccttgaagcagagaaggtgtaccagaatcatgtgcagcacctgatctccgagaagcggcgtgtggagatgaaagagaagttcaaaaaaacgttggaaaaaatacaattcataagccctggacagccctgggaggaggttatgtgctttgttatggaggacgaagcctacaagtatatcaccgaggccgattctaaagaggtgtacggaagacaccaacgggagattgtggaaaaggcaaaggaggagttccaggaaatgctttttgaacactcggagctgttctatgacctggacctcaatgctacacccagctctgacaaaatgagcgaaatacacacggtcctatccgaagagcctcgctacaaagccctccaaaagctggcgcccgacagggagtcccttcttttaaagcacattggcttcgtataccaccctactaaggaaacttgcctgtccggacagaactgcaccgatattaaggtcgaacaactgttagctagctctctactgcaactcgaccacggtcggcttcgcctatatcacgattcgacaaacattgataaagtgaacctctttattctagggaaagacggcctggctcaagagctggctaatgaaattcgcacacaaagcaccgacgacgagtacgcccttgacgggaagatctatgaacttgacttgagacccgtcgatgctaagagcccttatttcctgtctcagttatggactgcggcattcaagcctcacggctgcttctgcgtgttcaactccatagagtctctctcattcattggggagtttattggaaaaatcagaacagaggcctctcagatacgcaaggacaagtacatggccaacctcccatttactctgattctggctaaccagagggatagcattagtaagaacctgccaatattaagacaccaaggtcagcagctggccaataaactgcaatgccctttcgtggacgtccccgccggcacctatccccggaaattcaacgagacccaaattaagcaggctttgcgcggagtgcttgaaagcgtgaagcataatctggacgtggtgagccctatcccagccaacaaagatctctctgaggcagatttgcgcattgtgatgtgcgctatgtgtggcgacccattttccgtggacctcattctgtcccctttcttagacagccactcctgctccgcggctcaggccggacagaacaactccctgatgctggataagatcatcggggagaaacgacgccggattcaaatcacgatcctgagttaccacagctccattggtgtgcgcaaagatgaacttgtacatggctacatcctggtctattcggccaagcggaaagcttccatgggaatgctgcgggcctttctgtctgaagtgcaggatacgatcccagtgcagttggttgcggttaccgatagtcaggccgatttctttgagaatgaggccatcaaggagctgatgactgagggcgagcacattgccaccgagattacagccaaattcacagccctctacagcctctcgcagtaccacagacagacagaagtgttcaccctgttcttctcagacgtgctagagaagaaaaacatgatcgagaatagctacttgtctgataacacacgtgagtctacgcaccagagcgaggatgtgtttctgccgtcaccacgtgactgcttcccgtacaataattatccggacagtgacgatgataccgaagctcctccaccatactctccaatcggggacgacgtgcaactgttgccaacacccagcgacaggtcccgatatcggttggacctcgagggcaacgagtaccctatccactccacccctaactgccatgatcacgagcgaaatcataaagtcccccctcccatcaaacccaagcctgtcgtcccaaagaccaatgtgaaaaagctcgacccgaacctcctcaaaaccatagaagccggcatcgggaagaaccctcgaaagcagacaagtcgtgtccccctggcccatcccgaggacatggacccaagcgacaactacgccgagccaatcgatacaattttcaagcagaagggttactccgacgagatctatgtagttcccgacgactctcagaacaggatcaagatccggaacagcttcgtcaataatacacagggggacgaggagaacggcttcagcgaccgcacttccaaatcccacggcgagaggcgcccttcaaagtacaagtacaagagtaaaaccctgttctccaaggccaagtcttattatagacgaacgcatagtgatgcatctgacgacgaagcctttaccacatctaaaaccaagcgcaaagggcggcataggggcagtgaggaggatccactcttgagcccagtagagacctggaagggcggaatcgataaccctgctattacatccgatcaggagctggatgataagaagatgaagaagaagactcacaaggttaaagaagataagaaaaaaaagaaaaccaaaaatttcaaccctcctaccagacggaattgggaatcgaactattttggcatgcctctccaagacttagttaccgctgagaaaccaattcctttattcgtggagaaatgtgtcgaattcatcgaagataccgggctgtgcacggaggggctctaccgagtgagcggcaacaagacagaccaggataacattcagaagcagttcgatcaggatcataatattaaccttgtgtctatggaagtgactgtgaacgccgtggccggggccctgaaggctttttttgctgatcttcccgatcctctgataccatacagcctccatcctgaactgctggaggccgctaagatccctgataagacagagcgccttcatgcacttaaagagattgtcaaaaagtttcatcccgtgaactacgacgtgtttcgttacgtgatcacacacctgaaccgggtctcacagcagcacaagattaatctgatgactgcggataacctcagtatttgcttttggcccactctcatgcgtccggacttcgaaaatcgggagtttcttagtaccactaaaatccaccagtctgtggtggaaacattcattcaacaatgtcaattttttttttataatggcgagatcgtggagacaacgaatattgtggcacctccgccaccatccaatccaggacagcttgtcgagccaatggtgccactgcagctgcccccgcccctgcagccccagctgatccaaccccagttgcaaactgaccccctcggtatcatttag

SEQ ID NO: 132547 - DNA, 726 bp, Artificial Sequence
  Description of Artificial Sequence: Synthetic coding sequence
atgccactgcaagacctggtcacagccgagaagccaatccccctgttcgtggaaaagtgcgtcgagttcatcgaagatacaggcctttgcacggagggcctttaccgggtgtcagggaacaagactgatcaggataatatccagaagcagttcgaccaagatcacaatattaatctagtttctatggaggttaccgttaacgccgtcgccggcgcactgaaagcgttcttcgccgacctccctgatccgctgataccgtacagcctgcacccagagctcttggaggccgccaagatccctgacaagaccgagcgcctccacgcgctgaaagaaatcgtcaaaaagtttcaccctgtcaactatgacgtttttagatacgtgatcactcatttgaacagagtttctcagcagcacaagataaacctaatgaccgccgataacctatccatttgtttctggccaaccctgatgcggcccgactttgaaaaccgggaatttctgtcaaccacaaagatccatcagagcgtggtcgaaacattcattcagcaatgccagttcttcttttacaacggagagattgtggaaaccactaatatcgtcgcacccccccccccatctaaccccggccagctggtagaaccgatggtaccgcttcaattgccacccccccttcagccccagctcatccagccacagcttcaaaccgaccccctcggcatcatctag

SEQ ID NO: 132548 - DNA, 4509 bp, Artificial Sequence
  Description of Artificial Sequence: Synthetic coding sequence
atgatggccaaaaacaaggaacctcggcccccatcctacacaatttccatcgtcggactgtcaggaactgaaaaagacaagggcaattgtggggttggaaagtcttgcctgtgcaaccgatttgtgagatcgaaagccgacgaatactaccctgagcacacatctgttttgtcaactattgacttcggtggcagagtggtgaacaatgaccacttcctttattggggcgacataatacagaatagcgaggatggggtcgaatgtaagatacatgtcatagaacagacggaattcattgatgaccagacttttctccctcatcgttcgacaaacttacaaccatacataaagcgggctgccgccagcaaacttcaaagtgccgagaaattgatgtatatctgcaccgaccagttaggccttgagcaagattttgaacaaaaacagatgcccgaaggcaagctcaatgttgatggattcctgctctgtattgacgtgagccaaggctgcaatcgcaaattcgacgaccagttgaagtttgtgaacaacctgttcgtccagctgtctaagtccaaaaagcctgtcattatagccgctacaaagtgtgacgaatgtgttgatcactatctgagggaagtgcaggcctttgctagtaataaaaaaaacttgctggtggtcgaaaccagtgctcgtttcaatgtgaacatcgaaacctgcttcacagccctggtgcagatgctcgacaagacacgctccaagcctaagatcataccctacctcgacgcgtataaaacccagagacagcttgtagtgacagctacagataagttcgaaaagcttgtacagactgttcgtgactatcacgcgacatggaagacggttagtaataagcttaagaatcatcccgattatgaagaatacatcaacctggaggggacaaggaaggcgaggaatacattttccaaacacatcgaacagctcaagcaggagcatatacggaaacgccgcgaagaatatatcaacacactaccaagggctttcaatacacttctgcctaatctggaagaaatagaacatctcaactggagtgaagcactgaagttaatggagaagcgggccgacttccaactgtgctttgtggtcctggagaaaactccctgggacgagactgatcatatcgacaagatcaacgatcgccgaattccgttcgatcttcttagcacactcgaggccgaaaaagtgtatcagaaccacgtccagcatctaatcagcgagaagaggcgcgtggaaatgaaagaaaagttcaaaaaaaccctggaaaaaattcagttcatctcaccaggtcagccttgggaagaagtcatgtgctttgttatggaggatgaagcttataagtacattacggaggcagattcaaaggaggtctacgggagacatcagcgggagatcgttgagaaagccaaggaggagtttcaggagatgctctttgagcactcagagctgttctacgacctagatcttaatgcgactccaagcagcgataaaatgagcgagatccacactgtgttgtccgaagaaccccgttacaaagccctccagaaacttgcaccggaccgtgagtcgcttctattaaagcacatcggcttcgtttatcacccaacaaaggaaacatgtcttagcgggcagaattgcacagatattaaagtggaacagctgctggcctcctcccttctgcaattggaccatggccggctaagactctaccatgactccaccaacatcgacaaggtgaatctgttcattctgggcaaagatggtctagctcaggaactagccaacgaaatacgaacacagtccactgacgatgagtacgctctggacggaaagatctatgagctggacctgagacctgtggacgcaaagtctccctattttctgtctcaactatggaccgccgcgtttaaaccccacggatgcttttgcgtcttcaattccatcgaaagcctcagtttcatcggcgagttcattggtaagatccggactgaggcatcacagatccgaaaggacaaatatatggccaacctaccgttcactctcatcctcgctaaccagcgggattcaatatcgaagaacctgcccatcctaagacaccagggtcagcagctggccaacaagcttcagtgccccttcgtcgacgtcccggctggaacatacccgcgtaaatttaatgagactcagattaagcaagccctgcggggcgttctagaaagtgtgaaacataatctcgatgtggtgtcccctatccccgcaaacaaagatctgagcgaagccgacctgcggattgtgatgtgtgccatgtgcggcgatccattctccgtcgacctcatccttagccctttcctggattcccactcatgttccgctgcccaggcgggccagaacaactcacttatgctggacaaaattatcggggagaagaggagacggattcaaattacaatcctgagctatcatagctccatcggggtgcgtaaagatgagctcgtgcacgggtatatcctagtatactcagcaaagcgaaaggccagtatgggcatgctacgcgcctttctgtctgaggtacaagacacaattccagtacagctggtggccgtcactgactcccaagctgacttcttcgagaacgaagctattaaggagttgatgaccgaaggcgaacatattgcaaccgagatcaccgccaagtttacagccctctattctcttagccaataccacagacaaacagaggtctttaccctgttcttcagcgacgtcctggagaaaaaaaatatgatcgaaaactcatacctaagcgataatactcgcgagtctacgcaccagagcgaagatgtgtttctcccctcaccacgcgactgcttcccttacaataattaccccgactcagatgatgataccgaggctcctcctccatactctcccattggggacgacgtgcagttgctgccgaccccatcagacaggtcccgctatcggcttgacctggaaggaaatgaatatcctatccattcaactcccaattgccatgatcatgagagaaatcataaggtgcccccccctattaaacccaaaccagtggtaccgaagactaatgtgaagaagctagaccccaacctgctgaagacaattgaagccggtattggaaagaatccccgtaaacagactagtcgcgtgcccttagcccatcccgaggacatggatccatccgataattacgcggagcctatagatacgatttttaaacagaaagggtactccgacgagatttacgtcgtgcctgatgactcccagaatcgcattaagattagaaactcatttgtcaataatacacaaggcgacgaggagaatggctttagtgacagaaccagtaaatcccatggcgagagaaggccttcaaaatataagtacaagagtaaaaccttgttttccaaagccaaatcatactacagaagaacgcatagcgacgcaagcgatgacgaggctttcacaacatctaagactaagcggaaaggtagacatcgcggttccgaggaggatccactgctgtctcccgtggagacttggaaaggcggtatcgataatccagcaattacctcggatcaggagttagatgacaagaagatgaagaaaaaaacgcataaggttaaagaagataagaaacaaaaaaagaagactaagaactttaatccccccacccggagaaactgggaaagtaactattttggtatgcccctgcaggacctggtgaccgctgaaaaacctattccccttttcgtggagaagtgcgtcgagttcattgaagataccgggctatgcacagaaggattgtaccgggtgtcaggcaataagacggatcaggacaatatccagaaacaattcgatcaggatcacaacattaacctggtgagtatggaggtaaccgtaaacgcggtggcaggcgcattgaaggcatttttcgcggacctgcctgaccctttgatcccttacagcctgcacccggagctgctcgaagccgctaagatcccagataaaacagaaaggttgcatgccctgaaggagatcgtgaagaagtttcaccctgtaaattacgatgtctttcggtatgtaattacccatcttaacagagtgtcacagcagcacaagatcaatcttatgacagccgacaatctctcaatttgtttctggcctaccctcatgaggcctgatttcgaaaatcgagagttcctgtcgaccacaaaaatccaccagtccgtggtcgagaccttcatccagcagtgtcaatttttcttctacaacggggaaattgtggaaacaactaacatagttgccccaccccccccaagcaatccaggacaattggtagaaccaatggtgccccttcaactcccgcctcctctgcaaccgcagctaattcagccccagctacagacagacccgcttggcatcatatag

SEQ ID NO: 132549 - DNA, 414 bp, Artificial Sequence
  Description of Artificial Sequence: Synthetic coding sequence
atgccactccaggatctcgtgacagctgaaaagcctatcccactctttgtggaaaaatgtgtggagtttattgaggatactggactgtgcacggaaggattgtaccgtgtttcggggaataagaccgaccaggacaacattcagaaacagttcgaccaggatcacaacattaatttggtttctatggaggtcacagtcaacgctgtggctggggccttgaaggctttttttgcagatctcccggaccccctgattccctactcgctgcatcctgagctcctcgaggccgctaagatccctgataagaccgagcgcttgcacgccctgaaggagatcgtgaaaaagttccacccggtaaattatgacgtgttccgttacgtgatcacccacctgaatcgtgtgtctcagcagtag

SEQ ID NO: 132550 - DNA, 114 bp, Artificial Sequence
  Description of Artificial Sequence: Synthetic coding sequence
atgatggcgaagaacaaggaacccaggccgccatcctatacaattagtattgtggggcttagcggaacagagaaggacaagggaaattgtggcgtggggaagagctgtctatag

SEQ ID NO: 132551 - DNA, 423 bp, Artificial Sequence
  Description of Artificial Sequence: Synthetic coding sequence
atgatggccaaaaataaggagccacggccacccagttacaccatcagcattgtcgggttgtccgggacggagaaagacaagggaaattgtggagtgggaaaaagctgcttgtgcaaccgattcgtgcggtccaaggcagacgagtattaccccgaacacactagtgtgctcagtactatagatttcggtggcagagtggttaacaacgaccatttcctgtactggggggacataattcagaacagtgaggacggtgtggagtgcaaaattcatgtgattgagcagacggagttcattgatgatcagaccttcttaccccatagaagtaccaacttgcagccttacataaagcgagccgctgccagtaagctgcaaagcgccgagaagctgatgtacatctgcaccgaccagctaggtttgtag

SEQ ID NO: 132552 - DNA, 4506 bp, Artificial Sequence
  Description of Artificial Sequence: Synthetic coding sequence
atgatggccaagaataaggaaccacgaccaccctcctatactatcagtattgtcggcctgagcggcaccgagaaggacaaggggaattgcggggtggggaagagctgtctttgcaataggtttgtgagatctaaagctgatgagtattacccagaacatacatcagtcctctctacaattgatttcggtggtagagttgtgaacaatgatcattttctgtactggggcgacatcatacaaaactctgaagatggagttgagtgcaaaatccacgtgatcgagcagacggagtttattgatgaccagacattcttgccacacagatccaccaatctgcaaccatatatcaagcgcgccgccgcatccaaattacagtctgcagaaaaactgatgtatatctgcaccgaccagctgggcctggagcaggatttcgagcaaaaacaaatgcccgaggggaagctgaatgtagacggtttcctgctgtgcatagatgtctcacagggttgtaataggaaatttgacgaccagctgaaatttgttaacaatctctttgtacaactgagcaagagcaaaaaacccgtcataattgcggccactaaatgtgacgagtgtgttgaccactatctaagagaggtccaggcatttgcctctaataagaaaaatttgctggttgtggaaaccagcgcacgttttaatgtcaacatagaaacatgcttcactgctctcgttcaaatgctggacaaaacccggagcaagccaaaaattatcccatatctagatgcatacaagacacagcgtcagctggtcgtcaccgctaccgacaagttcgagaagctcgtgcagacggtgagggactatcatgcgacctggaagactgtaagtaataagctgaaaaatcaccccgactacgaagaatatattaacctggaagggaccagaaaagctcggaacaccttctccaagcacatcgaacaactgaagcaggagcacatcaggaagcgcagagaagaatacattaatacactgcccagggccttcaacactctcctcccgaatttagaggagattgagcacttaaactggtccgaggcactcaaactgatggagaagcgagcggactttcagctctgttttgtggtgctggaaaaaaccccttgggatgaaactgatcacatcgacaagattaacgacaggcgtattcctttcgatttgttgagtaccctggaggcagaaaaagtttatcagaaccacgtgcaacacctgatcagcgaaaaacgacgggtcgagatgaaggagaaattcaagaaaactctcgaaaagatccaattcataagccctggccagccctgggaggaggtgatgtgttttgtgatggaggatgaagcctataagtacatcacagaagccgactccaaggaggtttatggacgtcatcagcgggaaattgtagaaaaggccaaggaggaattccaggagatgctgttcgagcactccgagctcttctacgatctggatttgaacgcaacaccgagctctgacaaaatgagcgagatccacaccgtactgagcgaggagccacgttataaagccctccagaaactcgcaccagaccgcgaatctctgctccttaagcatatcggttttgtataccacccaaccaaagaaacctgcctctccggacagaactgcaccgatattaaagtcgagcaactgctcgcctcctccctcctgcagctggatcacggacgcttgcgtctataccatgatagcacaaatatcgacaaggttaatctttttatactgggaaaggacggtttggcacaggaactggctaatgaaatcaggactcagagcaccgacgacgagtacgctctggatgggaagatttatgaactggacctgagacccgtagacgcgaagtccccatacttcctttcacagctctggaccgctgccttcaaaccccacggatgtttctgcgttttcaactccattgagagtctgagttttataggggaatttattggtaaaatcagaaccgaggcatcacagatccgaaaggacaagtatatggccaatctgccctttacattgattctggctaaccaacgggattcaattagcaagaatctacccatattgcggcatcaggggcagcagctcgctaataaattgcagtgcccgttcgtcgacgttccagctgggacataccctcgaaaattcaacgaaacgcagattaaacaggcgctgagaggggttctcgaatcagtgaaacacaatttggacgtcgtctcacctatccctgccaacaaagatctcagtgaagcggatttgaggattgtcatgtgtgccatgtgtggcgatcctttcagcgtcgatttaatcctgagcccgtttttggattctcactcctgttcagcggcacaggcgggacaaaacaacagcctgatgctagataagataatcggagagaagaggcgccgcattcagatcacaatcctgtcgtatcatagtagtatcggcgtccggaaggacgagttagtgcacgggtatatcctggtgtattctgctaagaggaaagcctctatgggcatgctgagagcctttctgtctgaggtccaagacaccatccccgtgcagctggtagctgtgactgattcgcaggccgatttctttgaaaacgaggccattaaagagctgatgactgagggcgaacatatcgccaccgaaattactgctaagtttacagcactgtactcgctttctcagtaccatcggcagactgaagtctttacgttgtttttcagcgatgtgctcgaaaaaaaaaacatgatagaaaacagctacttgagcgataataccagggagtccacccaccagtcggaagacgtctttctgcctagcccccgggactgcttcccatacaataattaccctgacagtgatgatgatacggaggcacctcctccatactcccccatcggtgatgatgttcagttactgcccacaccgagcgatcgaagtcgttatcggctcgatttagagggtaacgaatacccaattcattcgacgcccaactgtcacgaccacgagcggaaccataaagttccccctcccatcaaacccaaacccgtggtgccaaagactaacgtgaagaaacttgatcctaatctgttgaaaactattgaagcaggaattggtaaaaacccccgtaaacagacaagcagggtaccgctggcccaccctgaggacatggaccccagcgataattacgctgagccgattgataccatttttaagcagaagggctacagcgacgaaatctatgtggtgccagatgacagtcagaataggatcaaaatcagaaatagtttcgtaaacaatactcagggcgacgaggaaaacggcttttcagaccgtacgagcaagtcccatggcgaaagacgcccttccaaatataagtacaaatctaaaactttatttagcaaagctaaaagttactaccgaagaacgcactctgacgcttccgacgacgaagctttcaccacctccaagaccaaacgaaaaggacgacaccgagggagcgaggaggatcctctgttatcacccgtggaaacttggaaagggggaatcgataaccccgccatcacttcggatcaggagttagacgataaaaaaatgaagaagaaaacgcacaaggtgaaagaggacaagaagaagaaaaaaacgaaaaatttcaaccctcccacacgccggaattgggagagcaattactttgggatgccgctccaagatctggttacggccgaaaaacccatcccactctttgtcgagaagtgcgtagaatttatagaggatacaggcctgtgcactgaaggcctgtatcgagtgtcgggcaacaagactgatcaggacaacatccagaaacagtttgaccaggaccacaacatcaaccttgtctcaatggaggtgacagtaaacgctgtcgccggcgccctcaaggcattctttgccgatttaccagatcccctgatcccctattccctacatcctgagctccttgaggctgccaagattccggacaaaacagagcggctccacgccctgaaggagattgtaaagaagttccaccccgtgaattacgacgtgttccggtatgtcatcactcatctcaatcgcgtgtcacaacaacacaaaattaacttgatgactgccgacaacctatccatttgtttctggccgaccctgatgcgtcccgacttcgagaaccgcgaatttctaagtacaacgaaaatccatcaatctgtcgtagagacatttatacagcagtgccagttcttcttctacaacggtgagatcgtggaaacaaccaatattgtcgcaccaccacctcctagcaacccagggcagttggtagaaccaatggttcccctccagttgccaccacccctgcagccccaactcattcaaccacagttacagactgacccgttggggatcatctag

SEQ ID NO: 132553 - DNA, 2316 bp, Artificial Sequence
  Description of Artificial Sequence: Synthetic coding sequence
atgtctggccggagcgtccgcctgcgtagcgttcccatccagagtctgagcgagctagaacgagcgcgtctgcaagaagtcgcattttaccagctccaacaggattgtgacctcagttgccagattacaattcctaaggatggccagaagagaaagaagagcctgcgcaaaaaactcgactccctgggcaaggaaaagaataaagacaaggagttcatcccacaggccttcgggatgcccctaagtcaggtgatagccaacgaccgggcttacaaactcaaacaggacctgcaacgagacgaacagaaggacgcctcggacttcgtagcttctctgctgccctttggcaacaaaaggcaaaataaagagctgtccagttcaaacagtagcttgtcctcgacatcagagacgcccaatgaatccacatcacccaacactcccgagcctgccccccgggctcggcgacgcggcgctatgtcagtcgacagcattaccgatctggatgacaatcagtcacgcctactggaggctttgcagctgagcctccccgcagaagctcaaagcaagaaggaaaaggcccgggataaaaagttaagtcttaaccccatttatagacaagtccccagactggtcgactcttgttgtcagcatctggaaaagcatgggttacagacagtcgggatctttcgcgtaggctcctccaaaaagcgggttagacagctccgcgaggagttcgacagagggattgacgtatctctcgaggaagagcatagtgtgcacgacgtggcggcactcctgaaagaattcttgagggacatgccagaccccctccttacgagggaactgtacaccgcatttataaacaccttgctgcttgaacccgaagaacagctggggactttacagcttctgatttatctgttacctccctgtaactgtgatacactccataggcttctacagttcctgagcattgtagcaagacatgcagacgacaatatttccaaggacggccaggaggttactggaaataagatgacatcactgaacctggccacaattttcgggccaaatctgttgcacaagcagaagtcaagcgacaaagaattttccgtgcagtccagcgccagggctgaagagtctacagcaatcattgccgtggtccaaaaaatgatagaaaactatgaagccctgtttatggttccacctgacttacagaatgaagtgcttattagcctgctggagactgaccccgacgtggtggactatttacttagacggaaagcttcacagagttccagccctgatatgttacagtccgaggtttcattcagcgttggtgggagacacagcagcaccgacagcaacaaggcgtcatccggtgatatttccccatacgataacaacagccccgttctatccgagcggtcacttctagccatgcaggaggacgctgccccgggcggcagtgagaagctatacagagtgcccggacagtttatgctggtcggtcatctttcaagtagcaagagcagagagtcctcacctggtccaagactgggaaaagacctgtctgaggagccatttgacatttggggaacttggcactccactctgaaatcgggcagcaaagatcccggcatgaccggatcttccggagacatttttgagtcctcctctctgagggccgggccttgctcactttcacagggcaacctgtcccccaactggcctcggtggcaaggcagcccggccgagctggactccgacactcagggcgcgcgaaggactcaggcggccgcccccgccactgaagggcgagcccatcctgcggtgtcaagggcctgcagtacccctcacgtccaagtggcgggaaaggccgaaagacctacagccaggtccgagcagtacctgacgttgtctggcgcgcacgatctgagtgagagtgagctggatgtggccgggctgcagtcccgggcgacccctcagtgtcagaggccacacgggtcgggacgcgacgacaagcgacctccccccccttacccgggtccgggtaaaccggctgcagctgccgcctggatccagggacctcccgaaggtgtcgagaccccgacggaccagggcggacaggcggcagagcgggaacaacaggttacacagaaaaagctgtctagtgcgaactcgttacctgctggcgagcaagacagtccccgactcggagatgctggctggctggattggcaacgcgagaggtggcagatttgggagctcttgagcacagataaccctgatgcactgcccgaaaccttagtctag

SEQ ID NO: 132554 - DNA, 2925 bp, Artificial Sequence
  Description of Artificial Sequence: Synthetic coding sequence
atgtcagctcagagcctccttcatagcgtttttagctgctcttccccagcctcaagctccgccgcatctgccaaaggatttagcaagagaaaacttcgccaaacaagatcacttgatccagccttaatcggaggatgtggttctgatgaagctggcgctgaagggtccgccagaggggcaacggccggtagactgtattcgccttcactgccagccgagtctctcggacccaggctggcttccagctctcgtgggccaccaccgcgtgccaccaggcttccacctccggggccactgtgttctagcttctctaccccatccacgccacaggagaaatctccatctggttctttccactttgactacgaagtaccactcggacgcgggggtctaaagaagtccatggcatgggatctacccagtgtcttagcaggccccgcatctagtcggtccgcgagttccatcctctgcagtagtggagggggtcccaacggaattttcgctagtcctcggaggtggctgcagcagcgcaaatttcaatccccccccgattcacggggacacccttacgtcgtgtggaaatccgagggagatttcacatggaattcaatgtccggaagatcggtgcgtttgaggtctgtgccaatacaatctctgagcgagcttgagagagcgcggttgcaggaggtggctttttaccagctgcaacaggactgcgatttatcttgccagattaccatcccaaaagatgggcagaagaggaaaaagagcttacgcaaaaagttagactcattaggtaaggaaaagaacaaggacaaggagtttattccacaggcgtttggtatgcccctgagccaggtgattgccaatgatcgcgcctacaagttgaaacaggatctccagagagatgagcaaaaggacgcaagtgacttcgttgcttccctcctgccatttggaaataaacgccagaacaaagagctgagctccagtaactcgagcctgtcatccacaagcgagacccctaatgagtctacctcacctaatacacctgagccagcccctcgagcgcgcagacgcggtgcaatgtccgtcgactcaatcactgacctcgatgacaaccagtccagattactggaagctctgcagttatctctgcccgccgaggctcagtcaaagaaggaaaaggctcgcgataagaagctatcactaaaccctatctaccgccaggtcccgaggctagtggacagctgctgccagcatctcgagaaacacgggctgcaaacggtgggcatcttcagagttggatctagtaaaaaaagagtgcggcagctgcgagaggagttcgatagaggcatcgacgtgtccctcgaggaggagcacagtgttcacgacgtagccgccctcttgaaagagttcctccgggacatgcccgacccccttttaacccgcgagctatacacggctttcattaacacgctgttactggaaccggaggagcagctgggcaccctgcagttactgatttatctcttacctccatgtaactgcgacaccctccataggctgctacagtttctgagtatagtagcccgtcatgcagacgataacatatcgaaagatggccaggaggtcacagggaataagatgacaagtctgaatctggccacgatctttggccctaacttactccataagcagaagtcctccgataaagagttctcagtacagagcagtgcgcgcgcagaagagtctacggccatcatagcagtcgtgcaaaaaatgattgagaattacgaggcccttttcatggtaccacctgatttacaaaacgaggtgctcatttccctgctagagacggatccggatgtagtcgactacttattgcgccggaaagcttcccagagctcctcccccgatatgctccagtcagaggtgagtttctccgtgggaggaagacactcgtcgacagattcaaataaggcctctagcggtgacatcagcccatatgataacaactccccggtgttgagtgagagatcactgctggctatgcaggaggatgccgcccctggggggtcggaaaagctgtatagagtgcctggtcaatttatgctggtcggacacttatcgagcagtaagtccagagagagttcacccggaccgagactcggcaaagacttgtctgaggaaccgttcgacatctgggggacatggcacagcacccttaagtcaggttctaaggatcctggcatgacaggtagttccggagatatattcgagtcatcaagtttacgggccggtccatgttcactgtcccagggaaatctcagtcctaactggccccgatggcagggttcacccgccgaactcgattcagacacccagggggcccggcgaactcaggcagcggcccccgccactgagggccgtgcgcatcccgctgtctcacgtgcatgtagtaccccacacgtccaggtggcagggaaagcggagagacccaccgcgagaagcgagcagtatctgacactctctggcgcacacgaccttagcgagtctgagctagacgtggccggtctccagagccgggccaccccccagtgccagaggccacacggatccggtcgagacgacaagagaccaccgcctccctatcccggccctgggaagcctgcggcagcagctgcatggattcaaggaccacctgagggtgtggagactcccacagatcagggcggtcaagccgcagaacgcgaacagcaggtcacccagaaaaagttatcgtccgctaattcgctgcctgccggtgagcaagactctccccgcctcggcgatgcaggctggctcgactggcagagagagcgctggcagatatgggagttactgagtactgataatccagatgcactccccgagacattggtgtag

SEQ ID NO: 132555 - DNA, 1806 bp, Artificial Sequence
  Description of Artificial Sequence: Synthetic coding sequence
ctggagctctacgatcttcaaatccttggtacaaagcctcctatgaattctgacacccaccgcaacttcgatcctactgcgactctcaggaatcaaggtgactttacatggaactcaatgagtggcaggtcagttcgattgcggtccgtccctatacaaagcttatctgagcttgagcgggcgcggttacaggaagtagccttttatcagcttcagcaagactgcgatctctcttgtcagatcactatacccaaagatggacagaaaaggaagaaaagtctacgcaaaaagctggactccctggggaaggagaaaaataaagataaggaattcattccgcaagcgtttggaatgccgctgtcgcaggtgattgccaacgatcgggcgtacaaactcaagcaggatctccaacgggacgaacagaaggatgcctccgacttcgtcgcatctctcctcccatttggcaataagcgacaaaataaagagctgtcgtccagtaactcttcgctgtcatctacatcagaaaccccaaacgaatcgaccagcccgaacacaccggaacccgctcctcgtgccagacgtagaggcgcaatgagcgtggacagcattaccgatcttgatgataatcagagtaggctgcttgaggccttgcagctctccctgcccgcagaagcccagtcgaaaaaagagaaggcacgcgataagaagctgtcactgaatccaatctacagacaggtgccaaggctggtagacagttgttgccaacacctcgagaaacacggtttgcagacggtcggtatctttcgcgtgggcagctctaaaaaaagggtacgccaactccgcgaggagttcgaccggggcatcgatgtgagcttggaagaagagcactcagtccatgatgtggctgccttactaaaggagttcctgagggacatgcccgatcctctgcttacccgggaactatataccgctttcattaacacacttcttctggagccagaagagcagctcggaaccctgcagctactcatttacctgctgcctccctgcaattgtgatactctccataggcttttgcagtttctctccatcgtggcccgacacgcagatgataatattagtaaagatggacaggaggtaaccggaaacaaaatgacttctttgaatttggcgaccatttttggcccaaatttgctgcacaagcaaaagagctccgataaagaattttcagtacagtcctctgctagggctgaggagagtacagctattatcgcagtagtacagaagatgatcgaaaattatgaggcgctgtttatggttcctcccgatctgcagaatgaggtattgataagccttctggaaacagaccctgacgttgtggactacctgctacgtcggaaggcctcccaaagttcttctcccgatatgctccagagtgaggtatctttcagtgtgggagggaggcactcatctacagatagcaataaggctagttccggggacatctccccgtacgacaacaactcacctgtactctcagaaaggtcactgctggctatgcaggaggacgctgcccccggggggtctgagaagctttaccgagtccccgggcagtttatgctagtgggccacctgtcctcctctaagtctagggaaagctctcccggtcccagactgggaaaaggaaattggagtcttgcttcaaggcgatggcccaagcaggctactctactgctgttgcacgtggcatggtgcggagctctcaggactttttctagcagcctcccgtatctcatgtttctgtag

SEQ ID NO: 132556 - DNA, 2298 bp, Artificial Sequence
  Description of Artificial Sequence: Synthetic coding sequence
atgtcagctcaatctctgctgcactctgtcttttcctgtagttccccggcctccagttctgcagcatctgccaaaggttttagcaagagaaagctacggcagactcggagtttagacccagccctgataggaggatgtgggtctgatgaggccggggctgaggggtccgcccgaggggccaccgctggccgactttactcgcctagcctcccagctgagtcccttggcccaaggttagcttcttctagcaggggaccccctccacgtgccacgaggctacccccacctggaccattgtgctcctcttttagtacgccgtccactcctcaggaaaagtccccctccggttcatttcattttgactacgaagtaccattaggcaggggtgggctgaaaaagtccatggcatgggatcttcctagcgtgttagctggccctgcaagctcgcgttcagcgtccagcatcttgtgttccagcggcggagggccaaatggtatttttgcgagcccccgtagatggctgcagcagagaaagtttcagtctccacccgattccagaggccatccatacgtggtctggaagtccgaaggcgattttacttggaatagtatgagcggacgaagtgttcgtttgcggtcagtccctatacagagtctgtccgagttagagagagctcggctacaggaggtcgcattttaccagctgcaacaggattgcgacctcagctgtcagatcacgattccgaaagacgggcagaagcgtaaaaagtctcttaggaagaaactggactccctcggcaaagagaaaaataaggataaggaatttattcctcaggcctttggaatgcctctttctcaagttatagccaacgaccgcgcgtataaattgaagcaggatttacagcgagatgaacaaaaagatgcctccgactttgttgctagtctgttgccctttggtaataaacggcagaacaaagagttgtcttcgtcaaacagttccctttctagcaccagcgagacacccaatgagtccacatcccccaacacacctgagccggcacctagggcccgtcggcggggggctatgagcgttgactcaattactgatcttgacgataaccaaagccggttgcttgaggccctgcagctgtccctgccagccgaggcccagtcaaaaaaggaaaaagcgagagataagaagctctccttaaaccccatttatcgccaagttcccagactggtggattcatgctgtcagcaccttgaaaaacacggccttcagactgtcggtatcttcagggtgggatcttctaaaaagagggtgaggcagcttagagaggaattcgatcggggtatagatgtgtccctggaggaagaacactccgtacacgacgtggccgcattgttaaaggaattcctaagggatatgccagacccactcctaacgcgcgagctctatactgcatttatcaacactctcttgcttgaacctgaagaacagctgggaaccctgcagctgctgatttatctcctgccaccttgcaactgcgacacacttcacaggctcctgcagttcctctccattgttgctcgccacgcagacgacaatattagcaaagacggtcaagaggttaccggtaacaaaatgacctctctcaacctggccacaatattcgggccaaacctgttgcataagcagaagagtagtgacaaagagttctctgtccagtcctccgccagggctgaggaatcgacagcgatcattgcagtcgtgcagaagatgatagagaactacgaagctctgtttatggtgcctccagatctgcagaacgaggttcttatatccctgttagagacagatcccgatgtggtggattacctgcttaggcgcaaggccagccaatcaagctctccagatatgctgcagagcgaggtgagcttctcggtgggtggaagacactcatcaaccgattctaataaggcatccagtggcgatattagtccttacgacaataactcacctgtgctttcagagcggtcccttctggctatgcaggaggacgctgcgcccgggggatctgaaaagctgtatcgggtgcccggacagttcatgctagtgggacacctgtcctcaagcaagtccagggaatccagccctggaccgagactgggaaaggggaactggtccctcgcatctcgccgctggcctaaacaggcaacactgctgctcctccacgtagcgtggtgcggagctctaaggaccttctcctcttcattaccctatctgatgtttctgtag

SEQ ID NO: 132557 - DNA, 2073 bp, Artificial Sequence
  Description of Artificial Sequence: Synthetic coding sequence
atgagtgcccaaagcctgctccactcagtatttagctgcagttcccccgcttccagttctgccgcttctgcaaagggtttttccaaaagaaagcttagacagaccaggtcactggacccagccttgatcggtggctgtggatccgatgaggcaggtgcggaaggctctgccaggggagcgacagcaggtcggctctacagtccatccttgccggcagagtctctcgggcctagactcgcttcttccagtcgaggcccgccacctcgggcaaccagattgcctccacctggacccctctgttcgtcgtttagtactccctctacacctcaggaaaagagcccgagtggctcatttcacttcgactatgaagtccctctgggccgcggcggcctcaagaaatctatggcctgggacctgccgtccgtccttgcgggtcctgcctcctcgagatccgccagctctatcctgtgcagctcaggaggcggacctaacggaatttttgcctccccacggagatggctgcaacagcgtaaattccagagtccccccgattctcggggacatccatacgtcgtttggaagtccgaactggagttgtatgacttgcaaatcctaggaaccaagcctcccatgaatagtgatacgcaccggaatttcgatccaactgccaccctccgaaatcagggggacttcacctggaatagcatgtccggaaggagtgttcgactgcgcagcgtcccaatccaaagtttgagcgaattagaaagagctcgcctccaggaggtggctttctatcaactccagcaagattgcgacctcagctgccagataaccattccaaaggatgggcagaagcgcaagaagtctctccgtaagaaactcgattctttgggcaaagaaaaaaataaggacaaagaatttattccccaggccttcggcatgcccctttcccaggtgatagccaacgatcgggcctacaagttgaagcaggatttacagcgtgacgagcagaaggacgcctcggatttcgttgcatcactccttccattcggtaataagaggcagaacaaagagctctcgtcatcaaatagctccctgtcttctaccagcgagaccccaaacgagtccacctctccgaacacacctgagccggctcccagagcccgccgcagaggtgccatgtccgtcgacagcatcacagatttggacgacaaccaatcgaggctgcttgaggctttgcaactgagccttccagccgaggcacagtccaagaaggaaaaagccagggataagaagctctctctgaacccgatctaccgccaggttccacgtttggtggatagctgctgccagcaccttgagaagcatggtctgcaaacggtggggattttccgggtaggctccagcaaaaagagagtgcgacagctccgggaggaattcgataggggtatcgatgtttccctggaggaggagcacagcgtgcacgatgttgccgcgctactgaaggaatttctacgtgacatgcctgatcccctacttactcgtgaactgtacacagccttcatcaacacactcctgcttgagccagaggagcagttagggactctgcagctccttatctacctgcttcctccgtgtaattgcgacaccctccaccgactcctgcagttcctgagcatagtcgctcggcatgccgatgataatatcagtaaagacggacaggaggttacaggcaacaagatgacctcactcaatctggctactatattcggtccgaatctgctccacaagcagaaatcttcggataaagagttcagtgttcaatctagcgcacgggccgaggaaagtactgccatcattgccgtggttcagaagatgatcgaaaactacgaagctttattcatggtaccccccgatctccagaatgaggtgctcattagtctgctggaaactgatccggatgttgttgattatctcttgaggcggaaggctagccaatcatctaccagtagcgtgttgcccgccgcagtgcaggcctgcccgcagtatccagccagcatgttcaccccgtag

SEQ ID NO: 132558 - DNA, 2316 bp, Artificial Sequence
  Description of Artificial Sequence: Synthetic coding sequence
atgtccggacgctccgttaggctgcggagcgtgccgatccaatccctgagcgagctggaacgagctagactccaggaagtggccttctaccagctgcaacaggattgcgatctatcctgccagatcacaattccaaaggatgggcaaaagcgtaagaagtcactgcggaagaaactggatagcctcggaaaagaaaagaacaaagacaaggaatttattccccaagccttcgggatgcctttaagccaagtcattgctaacgatcgcgcctacaagctgaagcaggacctgcagagagatgagcagaaagacgcttcggactttgttgctagtctcctcccctttgggaacaagcgacagaataaggaactgtcttcaagcaattcctccctgagttccactagtgagacgccaaacgaatcgacatctcctaacactccggagcccgccccgcgggcacgaaggcggggcgccatgtctgtcgattccattacagatcttgacgataatcaatccaggctgctcgaggcgttgcagctctcacttcccgccgaggcacagagcaagaaggagaaggcaagagataaaaaactctccctaaaccccatatacagacaggtcccacgtctcgtagactcctgttgccagcatctggaaaaacacggcctgcagaccgtaggaatattcagagtaggctctagtaagaagcgagttcggcaactgagggaagaattcgataggggaatcgatgtcagtctggaggaggaacacagtgttcacgatgtggccgcccttctcaaggaatttctgcgggacatgccagatccactgctgactagagaactgtatacagcgttcataaatacattgctgctggagccagaggaacagttaggcaccctgcagcttctgatctatttgctgcccccttgtaattgtgacaccctgcacaggttgttacagttcctgagcattgtggctcgccatgccgacgataatatctctaaagacggtcaagaggtcacgggcaacaaaatgacaagcctgaatctggctactatcttcggcccgaacctcctgcataaacagaaatctagcgataaggagttttcagtacagagcagcgctagggcagaagaaagcactgctatcattgccgtggtgcaaaagatgatcgagaattatgaggcattattcatggtcccacccgatcttcagaacgaggtgctcattagccttctggagaccgaccccgacgttgtcgactacctattacggagaaaggctagccagtcttccagccctgacatgctacaatctgaagtgagctttagcgtcggaggcagacattcctcgactgacagcaacaaagcatcctccggagacatatcaccttatgacaataatagtcccgtgttgtcagaaaggtcgctcttagccatgcaggaagatgctgcacccgggggctcagagaagctgtatagagtgccaggacagtttatgctcgtggggcacttgagttcaagcaaatcaagagaatcatcacctggtccgcgattgggtaaggatttgtctgaggaaccattcgacatttggggcacgtggcattctacactgaagtcgggctccaaggatcccgggatgactggttcctctggggatatctttgagtcttcctccctgagagcagggccatgttcgctgagtcagggcaatctttccccaaattggccacgctggcagggatcaccagccgagctcgattccgacacacaaggagctcgtcggactcaagccgcagcccctgcgacagagggaagggcacaccccgcagtgtccagggcttgctctacgccacatgttcaggtggcaggcaaggcagagcgcccaactgctcgaagcgagcagtacctgaccctttctggtgcccacgatctgagcgaatccgaactcgatgttgctgggttacagtcccgcgccacccctcagtgtcagcggccgcatgggagcggtcgcgatgataaacgccccccaccaccatacccaggccccggcaaacccgccgcagcggcggcgtggattcaggggcctcctgagggcgttgagacaccgactgaccagggtggccaggccgccgagcgagagcagcaggtcacccaaaagaaactgtcaagcgccaattccctgcctgctggcgaacaggatagtccccggctgggagacgcaggatggttggactggcaacgcgagcgttggcagatatgggaactactgagtactgataatccggacgccttgccagagacgttggtttag

SEQ ID NO: 132559 - DNA, 1404 bp, Artificial Sequence
  Description of Artificial Sequence: Synthetic coding sequence
atgtaccgaattttcggggacttcacatggaactccatgagcggcagaagtgtgaggcttagaagcgtacccatacagtctcttagcgagctggagcgcgccagactgcaggaggtggctttctatcaactgcagcaggactgtgatttgtcttgtcagatcacaatcccaaaggatggtcaaaagaggaaaaagagtctcaggaaaaaattggacagtttaggcaaggagaagaacaaggataaagagttcataccacaggcgttcgggatgcctcttagccaggtcatagctaacgatagggcctataaactgaaacaggacctgcagagggacgagcaaaaagacgcatctgactttgtggcttccctgctcccctttgggaacaagcgccaaaacaaggaattgagcagttctaatagtagcttatctagcaccagcgagacacccaatgaatctacttctcccaatactcccgaacctgctccacgtgccagaagacggggggcgatgtcagtagattccattacagatcttgacgataaccagagtcgtctgttggaggcactgcaattatctttaccagcagaagctcaatctaaaaaggaaaaggcaagagataaaaagctcagcctcaatccgatctatagacaggtgccgaggctggtggattcatgctgccaacacttggagaaacatggattacagaccgtcggaatttttcgcgtgggttcatcgaaaaagagagtaagacaactgcgggaggagtttgaccgcggaatcgacgtcagtctggaggaggagcacagtgtccatgatgtcgccgctcttctcaaagagtttctccgtgatatgcccgacccactcctcacccgtgaactgtacaccgctttcatcaacacccttcttttggagcctgaggaacagctaggcacactgcagctgcttatctacttactgccgccgtgtaattgtgataccctccatagactgttgcagttccttagcattgtcgccaggcacgctgacgataatatctctaaggacggccaggaagtgaccgggaataagatgaccagcctgaatcttgccaccatctttggccccaatttgttgcacaaacaaaaaagttctgacaaggaattttcagtgcagagctctgctagggctgaggaaagtacggccatcattgcagtcgtgcagaagatgattgaaaactatgaggccctatttatggttcctccggatttacagaacgaggtgttaattagcctgcttgagaccgaccctgatgtcgtagattacctgcttcgcaggaaagcttcacagtcaagtacgtcaagtgtgctgccagcagctgttcaggcctgtccccaatacccagccagcatgttcacaccctag

SEQ ID NO: 132560 - DNA, 1815 bp, Artificial Sequence
  Description of Artificial Sequence: Synthetic coding sequence
atgaaacggctgcacattttcgggcccaagatccacagtagcggcgggctgtggcagcagaaaggggattttacgtggaacagtatgtcgggccggagtgtacgactgaggagcgtacctatccaatcactgagcgagctggagcgggccagattacaggaggtggcgttctatcaactccaacaggattgtgacctgagttgtcagattaccattcctaaagacggccaaaagaggaagaagagtctgagaaagaagctcgactccttgggtaaagaaaaaaataaagataaggagttcatcccccaggcgtttggaatgccactgagtcaggtgatcgcaaatgatcgcgcctacaaactcaagcaggatctccagagagatgagcagaaggacgcctctgactttgtggcttcgttgctgcccttcgggaacaagaggcagaataaggagttatcctcctcaaattcatccctcagtagcactagcgaaactcctaatgagtccactagccctaacacacccgagcctgcacctcgggctaggagaagaggcgcaatgtctgtagattccataacggacctggacgataaccaatctaggctcctggaagcactccagttgtctcttccagctgaagcccagagcaaaaaagaaaaggcaagagacaaaaaacttagcctgaatccaatctatcgccaggtgccaagactggtggactcatgctgccagcaccttgaaaagcatggcctgcaaacggttgggattttccgggtggggagttccaaaaagcgggtgaggcagttacgcgaggaatttgatcgaggcattgacgtgagtctggaagaggagcactcagtgcatgacgtggcagccttgctgaaggagtttctccgcgacatgcccgatcccctgctgacaagagaactgtataccgcttttattaatacactcctattggagccagaggagcaactggggacactgcaattgctgatctaccttcttcccccatgtaattgtgatacgttgcatcgtctgctgcagttccttagcatcgtggcacgccacgccgacgacaacattagtaaggacggacaagaggtgacagggaataaaatgaccagccttaatttggcaactatttttggtccaaacctgttgcataagcaaaagtcctccgacaaggagttcagcgtacaatcctcagccagggctgaagagtcaactgcgatcattgccgtagtgcagaaaatgatagaaaactatgaggcgctgtttatggtaccaccagacctacagaacgaggtgctcatctcgttacttgaaacagatcctgatgtggtggattatctcttaagaaggaaggcctcacaatcatcctcacccgatatgctgcaatccgaagtcagcttttcagtcggcgggagacatagctccacagattctaataaggctagttctggggacatcagtccatacgataataacagccctgttctttctgaacgatcccttctcgcaatgcaggaagacgcagcgcccggtgggagcgagaaactctacagggtgcctgggcagttcatgctggtgggtcacctgagcagctctaaatccagggagtctagccctggccctaggctcgggaaagatttaagtgaagaaccatttgacatctggggcacctggcactctacactcaagagtgggagcaaggatcctggtatgaccgggacaacccctctattgaatatcagctcccaggaagaccataggcagaaggatttgcgccttatttttaaaatttatccttag

SEQ ID NO: 132561 - DNA, 918 bp, Artificial Sequence
  Description of Artificial Sequence: Synthetic coding sequence
atggccggtcaggacccagcactcagcacatcccacccattctacgacgttgcacgccatggcatccttcaggtcgctggggatgatcgctttggaagaagagtggtgactttcagctgttgtcgcatgcctccgtcacacgagctggaccaccaaagactgctagaatatctcaagtacacactggaccaatacgtggaaaatgattacacaatcgtatacttccactatggactgaacagccggaacaagccctccctcggttggttacaaagcgcttataaagaatttgatcgcaaatacaaaaagaacctgaaggcactatacgtggtgcaccctacaagcttcattaaggtgctgtggaacatccttaaaccactcatctcccacaagtttggaaaaaaggtcatttacttcaattacctttctgagctgcacgagcatctcaagtacgatcagctcgtaattccacctgaggtgctgcgctatgacgagaaactccagtctctccatgaagggagaacaccacctcctaccaagactcctcctcctcgtcctcctttaccgacccagcagttcggggtgtcattgcagtaccttaaggataaaaaccaaggagagctcattcctcctgtgctgcggtttaccgtaacttatttacgtgaaaagggtcttcggacagaggggctgttccgtcggtctgcgtccgtgcagaccgtgcgggagatccagcgcctctacaaccagggtaagcctgtcaatttcgatgactacggagatattcatatcccagccgtgatcctcaaaacattcctcagggagctacctcagccactgttgacattccaggcctacgaacagatactgggcatcacgtgtgtccccggcgaacaccttcagcagaacgagcagctatag

SEQ ID NO: 132562 - DNA, 1302 bp, Artificial Sequence
  Description of Artificial Sequence: Synthetic coding sequence
atggctggtcaagaccccgccctgtcgactagtcatccattctacgacgtggcaaggcacgggatactgcaggtcgccggggacgataggttcggccgtagggttgtcacgttctcctgctgccgaatgccaccaagccacgagcttgatcatcagaggttactggaatacctgaaatacactctggatcagtacgtggagaacgattataccattgtctacttccattatggtcttaactctcgcaataagccatcactcggatggctgcagagcgcctataaagagttcgatcggaaatacaagaagaacctcaaagcactctatgtggttcatccgacgtcctttattaaagtcctctggaatatactcaaacctctcatcagtcataagttcgggaaaaaagttatctactttaattatctgtcggagctgcacgagcacctgaagtacgaccagttggtgatacctccggaagtcttgaggtacgatgaaaaactccaatcgcttcacgaaggtagaacacccccaccgactaaaacacctccacctcgaccccccctacctactcagcagtttggcgtgagcttacagtacctcaaagataaaaaccagggagagctgattcctcctgtgctacggtttactgtcacatatctgagagagaagggtctgcgcaccgaaggtctgttccgacggtccgcgtctgttcaaactgtgcgagaaatacagcggctttataatcagggcaaaccagtgaacttcgatgactatggcgacattcatatccctgctgtgatcttaaagacctttcttcgcgagctacctcagccactgctcacattccaggcctacgaacaaatcctggggattacttgtgtggagagctcactccgtgtgactggatgtcggcagattctgaggagtctcccagaacataactatgtcgttctcagatatctgatgggcttcctccacgctgtttcaagagagtctatctttaataagatgaattcatctaacttagcgtgtgtttttgggctcaacctaatttggccatcacagggcgtgtcatctctctctgccctggtgccacttaacatgtttacagaacttttgattgagtattatgaaaagattttctccacccccgaagcacccggcgaacatggtttagccccctgggaacaaggatcaagggccgctccattgcaggaggcagtgccgcggacccaggccaccggcctgacaaagccaaccctgccgccttcccccctgatggcggcacggaggcggctgtag

SEQ ID NO: 132563 - DNA, 1668 bp, Artificial Sequence
  Description of Artificial Sequence: Synthetic coding sequence
atgagctccccaagccttagtgacctgggtaaaagggagccggccgcagcagccgacgaaaggggaacccagcagcgacgtgcctgcgctaatgctacgtggaactcaatccataatggggtgattgccgtgttccaacggaaagggctccctgatcaggaacttttttcattaaacgagggagtcaggcagctgcttaaaacagaacttggctccttctttacagaatatctgcagaatcagttgttgacgaaaggtatggttatccttagagacaagatacggttctacgaggaattgcaacgggacaaggctgccgctgccgctgtccttggcgctgtaaggaagcgtccaagtgtggtccccatggctggccaagatccagcacttagcacctcccatcctttttacgacgtggcccgacacgggattctgcaggtggccggtgatgaccgctttggcagacgcgtcgtcacttttagctgttgtcggatgcccccctcacacgaactagaccaccagaggctgttagagtacctgaaatatacacttgatcaatacgtggaaaatgattacaccattgtatactttcactatggcttgaacagccgcaacaagccctctctggggtggcttcagtcagcgtacaaagaatttgacagaaagtataaaaagaatctgaaagctttgtatgtagtgcatcccacgtcgttcatcaaggttctctggaacatcttgaagcctcttatcagccacaaatttggcaaaaaagtcatatactttaattatttgtccgagctgcacgagcacctaaagtacgaccagttagtgattcccccggaagtcttaaggtacgacgagaagctgcagagccttcacgaggggaggacccctccgccaaccaaaaccccacctccaaggccacctctccccacccagcaatttggtgtgtcccttcaatatctgaaagacaaaaaccaaggagaacttataccgcccgttctcagattcaccgtgacatatcttagagagaaggggctgcgaacagaaggtttatttcgcaggagcgcaagcgtacaaactgttcgcgaaatacagaggctgtacaaccaggggaagcctgtgaacttcgatgattacggcgacatccacataccggcagtcattttaaagaccttcctgcgtgaactaccgcagccattattgacttttcaggcgtacgagcagattctcggcatcacctgcgtggaatccagtctgagagtgacagggtgtcggcagattctgcgatcactcccagagcacaactatgtggtgctgaggtatctgatggggttcctgcacgccgtgagtcgcgagtctattttcaataagatgaacagctccaaccttgcctgcgtgtttggactgaatctgatctggccctcccagggagtgagcagcttatccgccttggtcccattaaacatgttcaccgagctgctcatcgagtattatgagaagattttcagcaccccagaggccccaggagagcacgggctcgctccatgggagcaaggatcgagggcagccccactacaggaagcagtgccgcgcacgcaagccacagggcttacgaaaccgacactcccacccagccccttgatggctgcccggcggcgactgtag

SEQ ID NO: 132564 - DNA, 1395 bp, Artificial Sequence
  Description of Artificial Sequence: Synthetic coding sequence
atggccggccaggatccagcactgtccacttctcatccattttacgatgtagcacgccacggaatccttcaggtggcgggtgacgaccgcttcggtcgcagagtcgtgaccttttcctgctgcagaatgcccccttctcacgaactcgatcaccaaagactgctggagtacttgaaatataccttagaccaatacgtggagaacgactataccattgtttattttcactatggtctgaatagccggaataaaccttcactgggttggctccaaagtgcctacaaggagttcgatagaaaggatggcgatctgacgatgtggccacgacttgtttctaacagcaagcttaaacgaagctctcatttgtcactgcctaaatattgggactaccggtataagaaaaatcttaaggcactctatgtggtgcacccaactagctttatcaaggtgttatggaatattctgaagcccctcattagtcacaaattcggaaagaaggtgatctacttcaattacctttccgaactacacgagcacctgaaatatgatcagctggtgatccctcctgaggtcctacgctacgacgagaaactgcaaagcctacatgaggggaggacccccccgcccaccaagacacccccaccccgcccccctctcccaacacagcagtttggagtatcactgcagtaccttaaagataagaatcagggcgaacttattcccccagtgctgaggttcacagttacctacctgagagaaaaggggcttcgaactgagggcctgttcaggcgctccgcgtctgtgcagaccgtgcgcgagattcaacgcctgtataaccaagggaagccggttaactttgatgactacggggatatccacatccccgccgttattctgaagacctttctacgcgaactgccacagcctctgcttacgtttcaggcctatgaacaaatccttggaatcacctgcgtcgagagctcactgcgagtgactggatgtcggcagatcctgaggtcactgcctgagcataactacgtagtgctgaggtatttgatgggatttctgcacgccgtgtccagagagtcaatttttaataagatgaattcaagcaatcttgcttgtgtgtttggtctcaacctgatttggcctagccagggtgtctcttccctgagtgctttagttccactgaatatgttcacagaactgttaattgagtactatgaaaagatcttcagcacccccgaggctcccggggagcacggcctggcgccctgggagcagggcagccgcgccgctcccttgcaagaggccgtgcctagaacacaggcaaccggcctcaccaaaccaaccctgccgccctctcctttgatggccgctcgccgccgcctgtag

SEQ ID NO: 132565 - DNA, 393 bp, Artificial Sequence
  Description of Artificial Sequence: Synthetic coding sequence
atggccggccaggaccccgcattgagcaccagccatcccttctatgatgtcgcccgccatggaattctccaggtggcaggcgacgatcgatttggaagacgggtggtgacattcagctgctgtcggatgccccctagccatgagttggatcatcaaaggctccttgagtacctgaaatacacccttgatcaatatgtcgagaacgattacaccattgtctacttccattatggactgaactcccgaaataaaccatctctagggtggctccagagcgcatataaggagttcgacagaaaagatggggatttaacgatgtggccccggttggtttccaactccaagcttaaaaggagttctcacctatctctgcctaaatactgggattactag

SEQ ID NO: 132566 - DNA, 348 bp, Artificial Sequence
  Description of Artificial Sequence: Synthetic coding sequence
atggccggtcaggatcccgctctctcaacatcccacccgttctatgatgtagctagacacgggattctccaggtggccggagatgatagattcgggcgcagagtcgttactttctcttgctgtcgtatgcctcccagccacgagctcgaccatcagcgcctgctggaatacctaaagtataccttggatcagtatgtcgaaaacgattatactatagtgtactttcactacggactgaactcccgcaataagcccagcctaggatggctgcagtcagcatataaggagttcgatagaaagtacaagaagaatttgaaggcactgtacgttgtgcacccaactagctag

SEQ ID NO: 132567 - DNA, 1932 bp, Artificial Sequence
  Description of Artificial Sequence: Synthetic coding sequence
atgagaaccctgcgaaggctcaagtttatgagcagcccttctctaagcgacctgggcaagcgcgaacccgcagcggccgcagacgaaaggggaacgcaacagagaagggcctgcgcaaatgccacctggaactcaattcacaatggagtgatcgcggtgttccagaggaaggggctacctgatcaggagctattcagcctcaatgagggcgtcaggcaactgctgaagactgagctcggtagcttcttcactgagtatctgcagaatcaactgctcaccaagggcatggtgattctgagggacaagatccgcttttatgaggggcagaaattgctcgactctctcgcggagacctgggatttttttttctcagatgttctcccaatgctccaggcaatcttttaccctgttcaggggaaggaacctagcgtccgccaactggcccttctccatttcaggaacgcgatcacgctgtctgtaaaactggaggatgctttggccagggcccatgcccgcgtgcctcccgcaattgtgcagatgctactggtgctgcagggcgttcacgagagtcggggggtgaccgaggactacctgaggctggaaacactcgtgcagaaagttgtcagcccctacctggggacttacggcctccatagctctgagggcccctttacgcactcttgtatcttagagctgcagagggacaaagccgctgctgctgccgtgttaggcgcagtgcggaaaagaccctcagtggtgcccatggctggacaggatccagcgctttctacatcgcatccattctatgatgtcgcacgacacggtattctgcaggtggctggcgatgataggtttggacgcagggtggtcaccttcagttgttgtcgaatgcccccatctcatgaattggaccatcagcggttacttgagtataagaaaaatttaaaagctttgtacgtcgtgcaccctacctcatttataaaagtgctctggaacatcctgaaacctctgatttcccataagtttggtaaaaaggttatctactttaattacttaagtgaattacatgaacacctcaaatacgaccagctggttattcctcctgaagtactaagatatgatgaaaagcttcaaagcctgcacgagggtaggaccccaccccccaccaagactcccccacctagaccccctctgccaactcagcaatttggtgtttctctgcagtaccttaaggataagaatcagggtgaacttataccaccagtcctgcggttcaccgtaacgtacctgcgagaaaaagggctgcgcaccgagggcttgttcagaagatccgccagcgtccagaccgtccgggagattcagaggctctacaaccagggaaaacctgtcaatttcgacgactacggtgacatccacattcccgccgtgatcctgaagaccttcctccgggagctcccgcagcccctccttaccttccaggcttacgaacagattctgggcatcacctgcgtcgagtcaagcctgagggtgactggttgcaggcagatattacgtagtctgcccgaacataattacgtggtactgcggtatctaatggggttcctgcacgccgtgagtagagaaagcattttcaacaaaatgaactcttcaaatttggcctgtgtattcggcttaaatttaatttggccgagccagggagtctcgagcctttctgccctcgtgccactcaacatgttcaccgagcttttgatcgagtattacgaaaagatcttctcgactcccgaggctccaggtgagcatggcttggcaccatgggaacagggaagtcgcgccgcccccctccaagaggccgtgccacgaacacaggccaccggcctgacgaaaccaacattgcccccttcccccctcatggccgcccggaggcggttgtag

SEQ ID NO: 132568 - DNA, 2322 bp, Artificial Sequence
  Description of Artificial Sequence: Synthetic coding sequence
cagacacagaccgaatctttaactctgtgtagtggagaagccgaacgaagaggtaaggaggaatggccagattcccaccactaccccggacccacccccgcccccgagtcctccgatggcccccataaggtgaccgttctcgcaacgatgttgtcttctcggtggtggccctcatcctggggcatccttggcctcggtcctagatcaccaccacgaggcagtcaactttgtgctctgtacgctttcacctacactggagctgatggacagcaggtgagcttagctgagggcgaccgttttctgcttctgaggaaaactaacagcgattggtggctggccagaagactcgaagcgcctagtacgagcaggcccatctttgttcctgctgcgtacatgattgaagagtccatcccaagtcagtcaccaactaccgtgatacctggccaactgctctggacgcctgggcccaaattgttccatggaagtctggaagagttgtcccaggcattgccatcaagagctcaggcatccagcgagcagccacccccactccctcggaagatgtgtcgctcagtcagtactgataaccttagtccctccctcctcaagcccttccaagagggccccagtggtcggtccctgtctcaggaagacctgccatctgaggctagcgcctcaacagctggcccccaacctctgatgtctgagcccccagtgtactgtaatctggtggacctgcgccggtgtccgcgcagtccacctcccggccctgcatgtccattgctgcagagactagatgcttgggaacagcacttagacccgaatagcggaaggtgtttctacatcaattctctcaccggctgtaaatcttggaagccccctcggcgttctcgatccgagacaaatcctgggtctatggagggaacccaaacattgaaacgcaataatgacgtactccagccccaagccaagggatttagaagcgacactggtacccccgaaccgctggatccccaaggaagcctgtcgttgtcacagaggacgtcccagctggatcctcccgcattacaggcccctagaccactgcctcagctgctagatgaccctcatgaggtcgaaaaaagcgggcttttgaacatgaccaagatcgctcagggagggaggaaattgcgtaaaaactgggggccaagctgggtcgtcttgactggcaacagtctcgtgttttatagagaacctccgcctaccgcgccaagtagcggctggggccctgctggctccaggcctgagtcatcggtggacctgcgaggggcggctctggcacacggaagacatctgtccagcagaaggaatgtactccacatcaggaccatccctggtcatgagtttctccttcagagcgatcacgagaccgagctgcgggcctggcaccgtgcactgagaacagtaatagaaagattggatcgcgaaaatcctctcgagctgcgcctgtctggatccggacccgccgaactatccgccggcgaggatgaagaggaggaaagcgaactggtgtccaaacccctcctacgcctttcgtcaaggaggtctagcattcggggacccgagggtacagagcaaaacagggtgaggaataagctaaagagactaattgctaagcgccccccgctccagagcctgcaagaaagaggccttcttcgggatcaggtcttcggatgtcaattggaaagcctgtgccagcgggaaggggatacggtccctagctttctcagactctgcatcgcagctgtcgacaaaagagggctggacgtcgatgggatttatcgcgtgagcggaaacctggccgtggtgcagaaactcaggttcctggtggaccgggagagagcagtaacctccgatggccggtacgtgtttcccgagcagcccggtcaggaggggagactagatttagatagcacggaatgggatgatatacacgtggtgactggagctttgaaacttttcctgcgggaactgccacagcctctggttcctcccctgctgctgcctcatttcagagccgctctggccctcagccagatacaggagctgatcgggtccatgcccaaacctaaccacgatactctgcggtacctgttagagcatctttgcagggttatagctcatagcgacaagaacaggatgacgcctcacaaccttggaatcgtcttcggcccaacactattccgcccggaacaggaaacctcagatcccgccgctcacgccttgtatcctgggcaacttgtccagctgatgttgactaatttcacctccctcttcccgtag

SEQ ID NO: 132569 - DNA, 2253 bp, Artificial Sequence
  Description of Artificial Sequence: Synthetic coding sequence
atgctgtctagccgctggtggccttctagttggggcattctgggcctcggcccacggtctccaccgcgcggtagtcagctgtgtgctctttatgcttttacctacaccggcgccgatggtcagcaagtgagcctggctgaaggcgaccggtttttgttgcttagaaaaacaaattctgactggtggctggctcgaaggttagaggctcctagcacgtcgagaccaatatttgtacccgccgcgtatatgatcgaggaatctataccatcccaatccccaaccacagtgatcccaggacagctgttgtggacccccggtcctaaactattccatggttcactggaagagttgtcccaggccctcccctccagggctcaggcctcaagtgaacagcccccacccttaccgagaaagatgtgtaggagcgtgtcgaccgataacctttcaccgagtttgctaaaacctttccaggaagggccatccgggaggtcactctcccaggaggatctgcccagcgaggctagtgcctcaaccgctgggcctcaaccattaatgtctgagcctcctgtgtactgcaatctggtcgatctccgtcggtgtccacgctctccaccacccggccccgcctgccccctcctgcaaagactggatgcgtgggagcagcatctcgacccaaatagcggaaggtgtttttacattaattccctgaccggatgtaagtcctggaagccgcccaggcggagccggagcgaaaccaatcccggatctatggagggcactcaaaccctgaaacggaataacgatgttttacagcctcaggccaagggttttcggagcgacacaggaacaccagaaccacttgaccctcagggaagcctcagcctgagccagagaacatcccagttggatcctccagctctacaagctccgaggcctcttccccagctgctggacgacccacacgaagttgagaaaagcggtcttcttaatatgactaagatcgctcagggagggcgcaagcttcgcaaaaattgggggccaagttgggtggtgctcaccggcaactcccttgtcttttaccgcgaaccccccccaactgccccttcgtccggctggggaccagcaggttctcgcccagagagtagcgtcgatctgcgtggcgcggccttagcccatggaagacacctcagtagtcggcggaatgttctgcatattaggactatcccaggccacgagtttctgttgcagtccgatcacgagacggagcttagagcctggcatagggccctgagaacagtgatcgaacggctcgtgcgctgggtcgaagcccgccgggaggcgccaacagggcgcgaccaaggctcaggtgaccgcgaaaatcctcttgagctgcgcctgtcagggtccggaccagcagagctgagcgccggtgaggacgaggaggaagaatcagaactggtgtctaagcctctgttgcggctttcatcgcgaagatccagcatccggggccctgagggcaccgaacagaaccgagtgcggaataaactgaagaggctcatcgcgaagagaccacctctgcagagtctgcaggagcgtgggctgcttagagaccaggtgtttggctgccaactcgagtctctgtgccagagggagggggacaccgtgccctcatttttacgcttgtgtatcgccgccgtggataagagaggcttggatgtggatggtatctatcgcgtctctgggaatctcgcggttgttcaaaagctgagatttctcgtcgatagggagagggccgtcacctctgatggaaggtacgttttccccgaacaacctggccaagaggggcgcctagacctcgactccactgagtgggacgatatacacgtggttactggcgcactcaagctttttctccgggagctgccccagcctctggttcctcctctcctcctgccgcattttagagccgcccttgccctttccgaatcggagcaatgcctgagtcaaatccaagaactcattgggagcatgcccaaaccaaatcacgatacgctgcggtatctcttggaacatctctgccgggtcatcgcacatagtgataaaaaccgcatgacacctcataacctgggtatcgtcttcggcccgacactgttccggccagagcaagagaccagtgatccagcagctcacgctctgtatccaggccagttggtgcagttgatgctgactaattttacctcgctgtttccatag

SEQ ID NO: 132570 - DNA, 2196 bp, Artificial Sequence
  Description of Artificial Sequence: Synthetic coding sequence
atgctcagttccaggtggtggcccagctcctgggggattctgggtctgggaccccgctctcccccacggggctcacaattgtgcgcgttgtacgctttcacttataccggggccgatggacaacaggtgtctctggccgagggcgacagatttctcttgctgaggaaaacaaactccgactggtggctggcacgacggctggaagcaccctctacctctagacccatctttgtgccagccgcttacatgattgaagaaagcatcccctcccagtcacctacaactgtgattcctggacagctcttgtggacgcccggcccgaagcttttccatggctccttggaagaactatcccaagcactccctagccgagcacaggcttcttctgagcaacctccacccctacccagaaagatgtgtcggagcgtctcgaccgacaatctaagccctagtctactaaaacctttccaggaaggccctagtggacggagcctgtcgcaggaagatctccccagcgaggcctctgcaagcacagccggtccacagcccctgatgtccgaaccccccgtgtactgcaacctggtcgatctgcgcaggtgccctcgttcaccccccccgggaccagcatgtcctctgctgcaacgtctggacgcttgggagcagcacctggaccctaactccggccgttgcttctacattaattcactgacaggttgtaagagttggaagcctcctagaaggtctcgcagcgagaccaacccaggctccatggagggtacacagacactgaagagaaataatgacgtgctgcaacctcaggctaagggtttccggagcgacactggcacccctgagcccctggatccccagggcagtctgagtctctctcagcgcacatctcaactagatcccccagcactccaagcacctcgcccacttccgcagcttctggatgatccacacgaggtggaaaagagtggactgctgaacatgaccaaaatcgcccaggggggcaggaaacttagaaagaactgggggccctcttgggtggtactaactggtaattccttagtattctacagagaaccaccgcctaccgccccgagtagtggttggggccccgccggttcacgccctgagagctctgtggacctccggggtgccgcgttagcacatggaaggcacctctcttcgaggaggaatgtgttacatattcgaactattcctggccatgaattcctattacagtcagatcatgaaactgaactgagagcatggcacagggccttgaggacagtgatcgagagactggaccgggagaacccattagaacttcggctctctgggagcgggcctgcagagctgtccgcgggggaggacgaagaagaggaatctgagctggtgtccaagccacttttaaggctgagtagccggcgctcaagtatccgcgggcctgaggggacagaacagaatagagtgagaaataagcttaagaggctgatcgctaaacgtccgcccctacagtctctccaggagcggggtcttcttcgcgaccaggtgtttgggtgtcagctcgagagcctctgtcagagagaaggtgatacagtgccctcttttctgcgcctatgtatagctgccgttgacaagagagggctggacgtggacggaatttatagagtgtcgggcaatctcgctgtggtccagaaactccggtttctcgtggaccgagagcgcgcagtaacgtctgacggtcggtatgtgttccccgagcaaccgggtcaggaaggtcggctggacctggactccaccgaatgggacgatattcacgtagtgacaggagccttaaagttgtttcttcgggaattgccacagcccttggtaccacccctcctgctgccccatttccgggctgcactcgcgctaagtgagtcggagcaatgcttgagccagattcaggaattgattgggtccatgcccaagcccaaccacgataccctacggtacctgctcgagcacctgtgccgcgtgattgctcactccgacaaaaatcgtatgacgccgcataatcttggtatagtatttggacctacactatttagaccggagcaagagacgagcgaccccgcagcacacgccctgtacccaggccagctggtacaacttatgctcactaactttacgagtctgttcccctag

SEQ ID NO: 132571 - DNA, 2466 bp, Artificial Sequence
  Description of Artificial Sequence: Synthetic coding sequence
atgcgacgggggagcagcgattcatgtgctagcgggtcccaagtggcagggactaccgttgcgggaccagcccaccctgaatctttgacactatgctccggagaagctgagcgtagggggaaggaagagtggccagactctcatcattacccagggccaactccagcaccagagtccagtgatggccctcacaaggtaacagtcctagcaactatgctgtcgtctcggtggtggcccagcagctggggtatcctgggcttgggacctcggtccccaccacgcggctcccagctgtgcgctctgtacgcgtttacttataccggcgctgacggccaacaagtctcactggccgagggggacaggttcctcttgttacgaaagaccaacagcgactggtggctggccagaaggctagaggctccctctacaagccgacctatcttcgtgccagctgcctatatgattgaagaatctataccaagtcagtcccccacgacagtgattcccggacagcttctgtggacccccggccctaagctttttcatggctctctcgaggagttgtcacaggccctgccctccagagcccaggcgtcctccgaacagcctccacccctcccaaggaagatgtgccgatcagtatctacagacaatctgagtcccagcctgctgaagccatttcaggaaggcccctctggacggagtctcagccaggaagatctgccatcagaggcgtccgcctctactgcggggccccagcccttgatgtccgagccccccgtttattgcaatcttgtagatcttcggcgctgccctagatcacctccaccaggacccgcctgcccactactccagcgactcgacgcctgggagcaacacctggacccgaattcgggcaggtgcttctatatcaactccctcactgggtgcaaatcttggaagcccccgaggcgcagcagatctgagactaacccaggatctatggagggtacccaaaccctgaaaagaaacaacgacgtcctgcagccacaggccaagggttttaggtccgacactggcaccccagaaccattggatccccagggtagcttatctcttagccaacgaactagtcagctcgatccccccgcactccaggcacctcggccactacctcagttgttggatgatccccatgaggtcgaaaagtccggtctgctcaacatgaccaagattgctcagggaggcaggaagctcagaaagaattggggcccctcatgggtcgtgttaactggtaattctctggtcttttacagagaaccgccgcctacagcgccttcatctgggtggggccccgctgggtcccgacccgagtcatcggtagacctgaggggcgccgctctggcccacggccggcatctttcctcacgtaggaatgtcctacacattcgtactatccctgggcatgaattcctcctgcagtccgatcatgaaactgagctgcgtgcatggcatcgtgccctcaggaccgtgattgagcgtctggtccggtgggtcgaagcccggagagaggcccctaccggtcgggaccaaggcagtggcgaccgtgagaaccctctcgagctgagactatcagggagtggtcctgctgagctgtctgctggcgaggatgaagaagaagagagcgagttggtgtcgaagcccctgctccggctatcctctaggcggtctagcatcagaggcccagagggaactgagcagaacagagtacgaaacaaacttaaaaggttgatcgctaagcggccccccctgcagagcctgcaggagcgtggcctgttgagggatcaagtgttcggctgtcagctggagagcctctgccagagagagggggatacagtgccctcgtttctcagactgtgtatcgctgcagtggacaagcgcggcctggatgtggacgggatatatagagtgtcaggcaacttggcagtggtccaaaagttgcgatttctggtcgatcgagagcgcgctgtgacgtccgacggccggtacgttttccctgagcagccgggtcaagaaggccggctcgacctggatagcactgaatgggatgatatccatgtagtaaccggcgctttaaagctgtttcttcgcgagctaccacagccattggtgcctcctctactgctgccccactttcgagccgcccttgctctttcggagtctgagcaatgcttgtctcagatacaagagctgatcgggtctatgcccaaaccaaaccacgatacgctacggtacctactggagcacctgtgtagggtgatcgcgcactcggacaaaaatagaatgacccctcacaatttgggcatcgttttcggcccgacactgttccggcctgaacaagaaacttcagacccagcggcccacgcactgtacccagggcagcttgtgcaactgatgctgaccaacttcactagtttgtttccctag

SEQ ID NO: 132572 - DNA, 900 bp, Artificial Sequence
  Description of Artificial Sequence: Synthetic coding sequence
atgacaaaaatagcccagggagggcgcaagctgcgaaagaactggggcccaagttgggtcgttctcacagggaatagtttagtcttttacagggagcctccgcctacagctccctcgagtggttggggacctgccggctctagaccagagtcaagcgttgacctgaggggcgccgccttagctcatgggcggcacttatcatcaagacgaaacgtgctacacatccggaccatcccaggacacgaatttctactgcagagcgatcacgagacagaacttcgggcctggcatcgggccctgagaactgtgatcgagcggcttgacagagagaatccattagagctccggctgagcggaagcggacccgcagaactgtccgccggagaggacgaggaagaagagagtgaactggtgtccaaaccactcctgcgcctgtcatcaagacgctcttcaatcaggggtccagaggggacagagcagaatcgagtgagaaacaagctcaaacgcctgatcgccaaaaggccaccacttcagtcactgcaggaacggggcttgctccgcgatcaggtgtttgggtgccagcttgagtcgttgtgtcagagggaaggtgatacagtcccctccttcctgagattatgcatcgcagctgtggacaaaaggggtttggatgtcgatggaatttacagggtatcagggaacttggctgtggtgcagaagctcaggtttctggtggacagggagcgagctgtgacctcagatggtcgttatgtttttcctgaacaacctggtcaggcattatccgagtccgaacagtgcctcagtcagattcaggaactgattggatccatgcctaagcccaaccacgatacactccgatacctcctggagcacctatgttag

SEQ ID NO: 132573 - DNA, 1923 bp, Artificial Sequence
  Description of Artificial Sequence: Synthetic coding sequence
atgctcagtagcaggtggtggccatccagctggggcattctcggtctcggacccagatcccctcccagaggttcgcaactgtgcgccctctatgccttcacctacaccggagcagatggacagcaagtgagcctggctgagggggatcgttttctcctgctgcgcaagaccaactcagactggtggttggcacggaggctcgaggctcctagtacctcccggcccatttttgtgcctgccgcatacatgatcgaggagtctataccctcacaatcacctaccacagtaattcctgggcagttgctttggactcccggcccaaagcttttccatggcagtttggaagagcttagccaagccctcccctcacgggctcaagcttcatcagagcagccccctcccctccctcggaaaatgtgcaggtccgtatctacagataacctgagtcctagcctgctgaaaccattccaagaggggcctagcggccgttcactttctcaggaggacttgcctagcgaagccagcgccagcacagccgggccccaacctctgatgagcgaacctcctgtctattgtaatctcgtcgatttgcgacggtgcccgaggtcacccccacctgggcccgcgtgcccactgctgcagcggctggacgcttgggaacaacacttggatcccaattccggccggtgtttttacataaactcattgactggatgtaaaagttggaagcccccaagacggagtagaagtgagactaatccggggtccatggaaggcacacagacactgaagagaaataatgacgtactgcagccccaggcgaaaggattccggtccgacacagggactcctgagcctttggacccacaaggttccctctctctgagccagagaacctcccagttggaccctcccgcgctgcaggccccccgccccttgccacagctgctggacgatcctcacgaagtggagaagagtgggctgcttaacatgacaaaaatagcccagggtggccggaagcttagaaagaactgggggccatcatgggtggtccttactggcaattcattagtgttctaccgcgagcctccccccacagctccctcatcagggtggggtccagccgggtctagacccgagtcaagcgtggacttgaggggcgctgccctggcacatggcagacacttaagctctcgtcggaatgtattgcacattcggacgattcccgggcacgagtttctgctgcaaagcgaccatgaaacagagctgcgtgcgtggcaccgggcactcaggaccgtcatcgaacgcttagatagagagaatccacttgaactccggttgtccggctccggccccgccgaactctctgccggcgaggacgaggaggaggaaagcgaactggtgagtaagcctctgctgcgcctctcctccaggagatccagcattcgcggccccgagggcaccgagcagaatcgagttaggaataaactcaagcgccttatcgccaagcgtccacccctgcagtctttacaggagcggggcctgcttcgggatcaggtattcggatgtcagctggaatctctgtgtcaacgggagggtgatactgtcccatctttcctgagactgtgcatcgccgctgtggacaagagagggctcgatgtggatgggatttatcgtgtgagcggcaatctagcagtagtgcagaagctgcgcttcttggtagatcgggagcgcgccgtcacgtcagatgggcgctacgtctttccagaacagccaggccaggaaggacgcctcgatctcgattccaccgaatgggatgatatacatgtcgtaaccggagcgcttaagctgtttctgcgagaactcccacaaccactcgttcctcccctgctgcttccccatttccgggctgctctggggtag

SEQ ID NO: 132574 - DNA, 1644 bp, Artificial Sequence
  Description of Artificial Sequence: Synthetic coding sequence
atgtctgaacctccggtttattgcaacttggttgacctcagacggtgcccacggtccccacctcccggcccagcttgcccacttctgcaacggctggatgcttgggagcagcatctcgacccaaattcggggcgttgtttctatatcaacagtctcaccggctgtaaatcatggaaacctccaaggagatcaagatcagaaaccaatccaggctccatggaggggacccaaactctcaaacgtaacaacgatgtgctacagccgcaggctaagggcttccggagtgacactgggacacccgagcccctcgatcctcagggttctctctcgctgtcccagcgaacctctcaactggatccgccggcccttcaggctccgagaccactccctcagctactggacgaccctcatgaagttgaaaaaagtgggctactgaatatgaccaaaatagcacagggaggccgaaagctgaggaaaaactggggaccttcttgggtggtgctgactggcaattccctagtattctatagagagcctccaccaacagcacccagttccggttgggggcctgcaggcagtcggccagagagttccgtcgatctgcgcggggcggcgttggcccacggtaggcacctttcctctcgtcgtaacgtgctccacataagaaccattccgggccacgagttcctgttgcagtccgatcatgagacagaactcagagcctggcaccgagccttaaggacagtgattgagcgattagacagggagaaccccctggaattgaggctctccggctctgggccagcggagctgagcgccggcgaagacgaggaggaggagagcgaacttgtgtcgaagccactgctgaggcttagtagtcgaaggtcatcgatacggggaccagaaggtactgaacagaatcgagtgaggaacaagctcaaacggctgatagcaaagaggcccccactccagtcccttcaggagcgcgggctgcttcgagatcaggtgtttgggtgtcagctcgagagcctgtgtcagcgggagggcgatacagttcctagtttcctgagactctgtattgctgcggtggataagaggggcctggacgtggacgggatctatcgagtgtctggtaatttagctgttgtgcagaagttgcgtttcctcgtagacagggaacgtgcggttacctctgatggccggtacgtgttccctgaacagcccggccaggagggtaggctggatctggactctacagaatgggatgacattcatgtagtcactggggcactgaaattattcctaagggagctgccccagcccctcgtgccccccttactcctaccacacttccgggctgccctggctctttctgaatccgagcagtgtttgagccagattcaggagctgatcggcagcatgcccaagccgaaccatgacactctgaggtaccttttggaacacctctgtcgcgtgattgctcacagtgataagaaccggatgaccccacacaacctgggtatcgtcttcggcccaacccttttcagaccggaacaagagacgtccgatcccgccgcacacgctctatatcctggccagctggtgcagctaatgctcacaaatttcacaagtctctttccatag

SEQ ID NO: 132575 - DNA, 894 bp, Artificial Sequence
  Description of Artificial Sequence: Synthetic coding sequence
atgtcagagcctccggtctattgcaatctcgtggatttgcgcagatgtccacggtcaccacctcccggccccgcctgcccactcctccagcgtctcgacgcctgggagcagcatctcgacccaaattcaggtaggtgtttttatattaactccttaacgggttgtaagtcctggaagcctcccagaaggtcacgaagcgagaccaaccctggcagcatggaaggcacccagactctcaagcgaaacaatgatgtgctgcaacctcaagcaaagggttttcgtagcgacactgggacccccgagcccctggatcctcaagggtcactgtcactcagtcagagaacttcccagctcgacccgcccgctctgcaggcccctcgcccacttccacagctgctcgatgacccccatgaggtggagaaaagcggtcttctcaatatgacgaagatcgcccagggcggcagaaaactccggaaaaactggggaccttcttgggtcgttctgacggggaacagcctggtattttatcgggagcccccccccaccgctccgagctccgggtggggccctgctggatcccgccccgaatccagtgtagatttgcgtggtgctgccttggcgcatggacggcacctgagctcacgtcggaatgtgctccacattcgtactatccccgggcatgaattcctcctgcagtctgatcatgaaacagaactcagagcctggcatagagctttgagaacagtgatcgaacggcttgaccgtgagaaccctctcgagctgagattgtcaggttctggaccagcagagctgtccgccggagaagatgaggaggaagagagcgagcttgtgtctaaacccttgctacgcctctcttcccgacgctccagttag

SEQ ID NO: 132576 - DNA, 186 bp, Artificial Sequence
  Description of Artificial Sequence: Synthetic coding sequence
atgtcagagcctccggtgtactgtaacctagtagatttaagacgatgtcccaggtcccctccaccgggcccagcctgcccactcctgcagcgcctggatgcctgggagcagcacctggatcccaattcagggcggtgtttttacatcaattccttgaccggctgtaagagctggaagcctccctag

SEQ ID NO: 132577 - DNA, 471 bp, Artificial Sequence
  Description of Artificial Sequence: Synthetic coding sequence
taagaaggggacacagtcccgtctttcctgcggctatgcatcgccgccgtggacaagcgaggcctggacgtggacggcatctatagggtctcgggtaatctcgccgtggtgcaaaaattgagatttctggtagaccgggagcgtgccgtgacaagtgacggcagatacgtgtttcctgaacagccgggccaagctctgtctgagagcgaacagtgtctctctcagatccaggagttaatcggttcaatgccaaaaccaaatcacgacaccctacgatacctactcgagcacttgtgccgggtgattgctcacagcgacaagaacagaatgactccgcacaacctaggaatcgtgtttggacctacattgttccgacctgagcaggagactagcgatcccgcagcccatgctctctacccggggcagctcgtccagctgatgctgaccaactttacctcactcttcccctag

SEQ ID NO: 132578 - DNA, 396 bp, Artificial Sequence
  Description of Artificial Sequence: Synthetic coding sequence
atgtcagagcctccagtctactgcaacttggtggacctgcgccgctgtccccggtcccccccacccggtccggcctgtcctcttttacaaagactggacgcgtgggagcaacatttggatccgaactcgggacggtgtttttacattaattcccttaccgggtgtaaaagttggaagcctccacggcgttcccgaagcgagacgaatcctgggagcatggaaggcacccagactctaaagcggaacaatgatgtgttgcagccccaagcaaagggattcagatctgatactgggacgcccgagcccctcgacccgcaaggatcgctgtccctgagtcagcgcacctcccagctggaccccccagctctgcaggcccctagaccccttccacagtag

SEQ ID NO: 132579 - DNA, 2028 bp, Artificial Sequence
  Description of Artificial Sequence: Synthetic coding sequence
gaacccgggtcagggagtcgggaccccggacctggcatagccgaacccgacctgggtcgccctgctgggcaccttagagctgatacatccccggcagaacctagggagatggaggactttgctcgaggagccgcctcccccgggccttctaggcccggtctggtgcccgttagtatcattggggccgaggatgaggactttgaaaatgagctggagactaatagcgaggagcaaaattcacagtttcagtctcttgaacaagtcaagagaaggcctgctcacctgatggccctcctacagcacgttgccttacagtttgaaccaggtcccctgttgtgctgtctgcacgcagatatgctgggtagtttgggtccaaaggaggccaagaaagccttccttgacttttaccacagctttctggaaaagaccgccgtcctgcgcgtaccagtgccgccaaatgttgccttcgaactagaccgtactcgagctgatctgataagcgaggacgtccagcggcgcttcgtccaggaagtggttcaatcccagcaggttgctgtgggccggcagcttgaagattttcgctccaagcggctgatgggcatgaccccttgggaacaggagcttgctcaacttgaggcctgggttggcagggaccgcgcctcgtatgaggctagagaaagacacgtggccgagcgcctgctgatgcacttggaagagatgcagcacaccataagcactgacgaggaaaagagtgccgccgtagtgaatgctatcgggctatacatgcggcatctgggcgtgagaacaaaaagcggggacaagaagtctggcaggaatttcttccgcaaaaaggttatgggaaatcgccgaagcgacgagcctgctaagactaagaaaggtctcagctccatcttagacgctgcgcggtggaataggggagagccccaggtgcccgactttagacatttgaaggcggaggtcgatgccgagaaaccaggagcaacagaccggaaaggtggggttggaatgccatcacgagacaggaatattggggcccctggccaagacacaccgggtgtatcccttcacccactcagcctagattcacccgaccgtgagccaggcgccgacgccccactggaactgggcgattcatcaccccagggtcccatgtcgctcgaaagcctggccccgcccgaatctactgacgaaggcgcagagacggagaggtgcccaggatggggggctggagccggaggtgtcgcttactgggctttggtaggaggctgtcgagtgactgccgctatttgtgcatgcctgtctcaggctcttgctccccatgcacccctcctgctatcaggctcaggacactcgagtcctttcttctttccatttctgatctcactgctgctgccacactgtcctcctttcctgctgtcgttcctcttccctttactgctccccctgttgcctttcttcaccaacccttctccacctccattcttgtccaccaccccaagtatcagttttatctcatctccactgctgagccacctacccccccccttgttcccgcctcattcctcacttacgtgggtcttttttcctcacctacccagcccttccgatttacctgccacattccactttttctccccaagtccattctcttttaagccaccatgccccctacccccgacaccgcggctggcaccggcctcctggtgtccatcattgaatcctcctcccctgtgtagcgttccgtggggtccttgcccgccttacagctggggtgctggctcagcatcttgcccaagtctgtgccgatgctttggcgatcctctcgtgggcgcaggacgctgggttcgtttccaccttggaccacctctgacactgtgcccatcgcttccgcgaaggtggaaaaggtgggtgcctggaccatgggtgggagagggtttagccccgcccccattcttacccgcccctcccctgtctccgtggcccttaccacccttgcactctctttag

SEQ ID NO: 132580 - DNA, 2784 bp, Artificial Sequence
  Description of Artificial Sequence: Synthetic coding sequence
atggcctccctgtcaacgtggagctccccggccgagcccagagaaatggaagattttgctaggggggctgcctcaccagggccctcccgaccaggactcgtgcccgtgtcaatcatcggggccgaggacgaagattttgagaatgagctggagactaactcggaagagcagaattcgcagtttcagagcttagagcaggtcaagcggcggcccgcacatttgatggctctcctgcaacatgtcgccttgcagtttgaacccggaccgctcctctgttgtctgcacgctgacatgctgggctcccttggccccaaggaagctaagaaggcttttcttgacttctaccactctttcctcgaaaagacagccgtcctaagggtaccagtccctccaaacgtagcctttgagcttgaccgaacacgagccgacctcatctctgaggacgtccagcgccgcttcgtgcaggaagtggttcaatcccaacaggtcgcagtgggacgacagttggaagacttccgcagcaagcgtttgatgggaatgaccccctgggagcaggaactagctcagctggaggcttgggtcgggagggacagggcctcatacgaagcacgcgaacgccacgtggcagagagacttctaatgcacctcgaggagatgcagcacactatatccaccgacgaggaaaagtccgctgctgtggttaatgccatcggactgtatatgcgtcacctgggagtcagaacaaagagtggagataagaaaagcggcaggaattttttccgtaaaaaagtgatgggaaataggcgcagcgatgagcctgccaaaacgaaaaaagggctctcaagcatccttgatgccgcccgatggaacaggggcgagcctcaggttccggacttccgccaccttaaggccgaggtcgatgcggagaagcccggggctacagaccggaaaggcggggttgggatgcccagccgggacagaaacatcggagctcccggacaggacacgccgggggtttctctgcatccgttgtctctggattcacccgaccgagagccaggagccgatgcaccactggagcttggggacagtagccctcagggcccgatgtccctggagagtctggctcccccagagtctactgacgagggagccgagacggagtcccccgaaccgggcgatgagggcgagcctgggcgcagtggtctggaacttgagcccgaggagcctccagggtggcgagaactggtaccccctgacaccctacatagccttcctaagagccaggtgaaaagacaggaggtaatttcagaactgctggttaccgaggccgctcatgtgcgcatgcttcgggttttgcatgacctcttttttcagccaatggctgaatgcctcttctttccactggaagagttacagaacatctttccttcactggatgagctcatcgaagttcattctctgttcctggaccggctcatgaagcgcaggcaggagtcgggatatcttatagaggaaatcggcgatgtcttgctagcacggttcgatggagcagaagggtcctggttccagaagatctcaagtaggttttgttcgcgtcagtcatttgccctggaacaattgaaggctaagcagcgtaaggaccccagattctgcgcctttgtccaggaggccgagtcccgccctcgatgtagacgtcttcagcttaaagacatgatcccaacagagatgcaacggctgacaaaatacccactgctgctccaaagtattggccagaacactgaagagccaaccgagcgcgagaaagtggagctcgctgctgagtgctgcagggaaattctgcatcacgtcaatcaggcggtgagggatatggaggatcttcttaggctaaaagactaccaacgcagactcgatctcagccatctcagacagtcctccgatcccatgctgtctgaattcaaaaatctggacatcacaaagaagaaattggtccatgaagggcctctcacctggcgtgtgacaaaagataaagctgtggaagtacatgttctcctcttggatgatctgctgctcttgcttcagagacaggacgagagacttctgttgaagtcacactctaggactctgacccctacgcccgacgggaagactatgctgcggcccgtcctgaggctcaccagcgccatgacaagagaggtcgctaccgaccataaagccttctatgttctgttcacctgggaccaagaggcccagatatacgagctcgtggctcagacagtcagtgaaaggaagaattggtgcgccctgattacagagacagcaggaagccttaaagtgccagcaccggcgagcagacccaagccccgcccatcaccaagctcaacacgcgagcctctcctaagttcatccgaaaacggcaacggagggagagagacatcacctgctgatgctagaactgaaagaatcctatccgacctcctacctttttgccgacccggccccgagggacagcttgctgcaactgctctgagaaaagtgttgagcttgaagcagctgctctttcctgctgaggaggacaacggtgcaggccccccgagggacggggacggagtgccggggggaggtccactttctcctgcgcgaacacaggagatccaagagaacctgttgtctctagaagagaccatgaaacagctggaagaactggaggaggagttttgcaggttacgcccattgctttcccaacttggcggcaatagtgtgccgcagcctggctgtacctag

SEQ ID NO: 132581 - DNA, 2640 bp, Artificial Sequence
  Description of Artificial Sequence: Synthetic coding sequence
atggaggatttcgccaggggcgccgcttcacccggacccagcagacctggtctcgtgccagtctcaatcattggcgccgaagatgaggactttgagaacgaactcgagactaactcagaagagcaaaattcacagtttcagtccttggagcaggtgaagcgacggccagcacacctcatggccctgctacagcatgttgcattacagttcgaacccgggcccctcgtcctgagggttccagtgccacccaatgtcgcattcgaactcgatagaacgagagccgaccttatcagcgaagacgtgcagaggcgctttgtgcaggaggtggttcagtcacagcaggtggccgtaggcagacagttggaggacttccggtctaagaggttaatgggaatgactccctgggaacaggaactagcacaactggaggcctgggtggggagagatcgggccagctacgaagcgagagaacggcacgtcgcggaacgtctgctcatgcatcttgaagaaatgcagcacactatctctaccgacgaagaaaagtcagctgccgttgtaaacgccattggcttatatatgagacacctcggtgtgcgcactaagtctggagacaaaaagtcaggcaggaattttttccgcaaaaaggtgatgggcaataggcgatcggatgagcctgccaagaccaaaaaaggcttgtcctccatactcgacgccgcaagatggaatcgcggggaaccgcaggtgcccgattttaggcacttgaaagcggaagtggatgctgagaagcccggagccaccgatcgcaagggaggagtagggatgccaagtcgggaccggaatataggcgcccctggccaggatactccaggggtatctctgcatcccctcagtctggacagccccgacagagagccgggcgccgatgcaccattggagctgggagatagctctccccaaggtcccatgtccctggagtcgcttgctccccctgaaagtaccgacgaaggcgccgaaacggaaagcccagaacccggcgacgagggcgaacctggtcgctcgggcttggaattggagcccgaggaaccccccggatggcgcgagctcgtaccgcccgataccctccattcactgccaaagagccaggtgaagcgccaggaggtaatttccgagttgctcgtcactgaggctgcacacgtgcgtatgctcagggtgctgcacgacctcttttttcagcctatggcagagtgcctgttctttccactcgaagagctgcagaacatcttcccaagcctggatgaactcatagaggtgcattccctgtttctagatcgcctgatgaagcgccgtcaggagagcgggtatctgatagaggagattggcgatgtgcttctcgcccgattcgatggggccgaagggagttggttccagaagattagttctaggttttgcagtcgtcagtctttcgcccttgagcagcttaaggccaaacaacgaaaagacccccgcttctgtgcgtttgtacaggaggccgaatcccgtccgcggtgccggcgtctccagctcaaagacatgattccaactgagatgcaacgcctgaccaaataccctctcctgctccagtctatcggacagaacacagaagaaccaacggagagagaaaaggtggagctggcggcagaatgctgtcgcgagattctgcatcatgtgaatcaagccgttcgggacatggaggacctgttgcgcctgaaagattaccagcgcaggttagatctgtcccatctaagacagtcgtcagatccaatgctatcagagttcaagaacttggatatcacaaagaaaaaactggtccatgaggggcccttgacctggagggttactaaagataaggctgttgaagtgcacgttttacttctggatgatctcctgttgctattgcagcgccaggatgagcgcttgcttctaaagagccatagcagaacgcttacccctacaccggacggcaagacaatgttgaggcccgtgctacggctgaccagcgcaatgactcgggaggtggcgactgaccataaagccttctatgttctttttacttgggatcaggaggcacaaatttacgagctggtcgcacagaccgtgtccgagcgcaaaaactggtgtgcgctgatcacagagaccgccggaagcctcaaggtccccgccccagcctcgagacccaagcctcgaccctcaccatctagtaccagagagcctctcctgagctcttccgagaacggaaatggtggaagggaaacttcccctgccgacgcacgaacagaaagaattctgtcagacctgttacctttttgtcgacccgggccggagggacaattagctgccacagccctacggaaggtcttgtcactgaaacagcttctcttcccagctgaagaagataatggtgctggccctcccagagatggcgacggggtgcctggcggcgggcccctgagccccgctaggactcaggaaatccaggagaatctcctgtccctcgaggaaaccatgaaacagctcgaagagctcgaggaggaattttgtaggcttcggcctttgctgtcgcaattggggggtaattcagtcccgcaacctggctgtacatag

SEQ ID NO: 132582 - DNA, 2739 bp, Artificial Sequence
  Description of Artificial Sequence: Synthetic coding sequence
atggaggacttcgctcgcggggctgcctcacccggaccaagccggccaggattagtgcccgtgtcaatcatcggggccgaagacgaggattttgagaacgaactcgagaccaattctgaggaacagaactcgcagttccagtcgctggagcaggtcaaaaggcgaccagcacaccttatggctctactgcaacatgtagccctacagtttgaacctggccccctgctttgctgtctacacgcagatatgcttggtagtctaggtccaaaggaagcaaagaaagcattcctcgacttttatcactcatttttagagaagactgcagtcctgcgggtaccagtgccccctaacgtggcattcgagctcgatcggacccgggccgacctgatcagcgaggatgtgcagaggcgctttgtccaggaggtggttcagagccagcaggttgcggtagggcgtcagctggaagatttccggtctaaacggctcatgggtatgactccatgggagcaggagctagcacagctcgaggcatgggtagggagggatagagcctcctatgaagctagggagcgccacgttgcagaacggctgttgatgcacctagaggagatgcaacacacaatatctacggatgaggaaaagtccgctgccgtggttaacgccataggcttatacatgagacaccttggtgtccggacaaaatcaggtgataagaaatccggccgcaattttttccgtaagaaggtgatgggaaatcggcgttcagatgagcccgccaagaccaagaagggtttgtcaagcattttggatgccgctcggtggaaccggggagagccccaagtgcctgattttcgccatctcaaagcggaggtcgacgctgaaaaacccggagcaaccgatcgaaagggtggcgtggggatgcccagtcgggatcgcaatatcggtgccccaggtcaggatactccaggggtttccttgcatcctctgtctttggactctccagatagagaaccaggggcagacgcccccttagagttgggagattcatcgccgcaaggacctatgagccttgagtctctggctcctccggagagtactgacgaaggagctgagacagaaagcccggagccgggagatgagggcgaaccgggaagaagtggcctggagctggagccggaggagccacccggctggcgtgaattggtgcccccagataccttgcacagcctgcctaaatctcaggtgaagcgacaagaagtgatttccgagcttctggtaaccgaggcagctcacgtgcgcatgttgcgcgtcctccacgatttgttcttccaacccatggcagagtgtttattcttcccactggaagaactccaaaacatattccctagtctggatgaattaattgaggtgcatagcttattcctcgaccggttgatgaaaagacggcaggagtccggatacctcatcgaggagataggggacgtgttgctggcacgattcgacggggccgaggggtcctggtttcagaaaatcagtagcagattttgtagccggcagtcctttgcactcgagcagctgaaggccaaacagcgcaaagacccaaggttctgcgccttcgtccaggaagcagagagtcgaccgcggtgcagacgcctgcagctgaaagatatgatacccaccgagatgcagcgattaactaagtatccattgctgctgcagtcaatcggacagaatacagaagagccaacagagcgcgagaaagttgagctggctgcagaatgctgccgggagattctccatcacgtcaaccaggccgttcgcgatatggaagatctgttgcgcttaaaagattatcaacggcgcctggatctttctcatttgagacaatccagcgacccaatgctcagcgagttcaagaaccttgacattaccaagaaaaaacttgtgcacgagggacccttgacttggcgggtcaccaaagacaaagcagtcgaggttcatgtattgctcttagatgatctcctgctcctacttcaaaggcaagacgagcggcttctgttgaagtcccactctaggactctgacccctacacctgatggcaaaacgatgctgaggccagtactacgcctcacctctgcaatgactcgcgaggtagcaaccgaccataaagctttttatgtgctgttcacctgggaccaggaagcccagatttatgaactggtggcacagaccgtcagcgagcgtaaaaattggtgtgccctgattacagagacagccggctctctgaaggttccagctcccgcctcaagacctaagcctcggcctagtcccagttctacgcgggaacccctactgtcatcttccgagaacggaaacgggggacgcgagacgtccccagccgacgctaggaccgaacgaatcttgagcgatttgctccctttttgtcgacctggtcccgaggggcagttagcggccaccgccctccgtaaggtgctgtctttaaaacagctgcttttccctgccgaagaggataacggggccggacctcctcgagatggagatggagtgccaggcggaggtcctttgagtcccgcacggactcaggagatccaggagaacctgctgagtctggaggagacaatgaagcagcttgaggagctcgaggaggaattctgccggctgcgccccctcttgtcacagctgggcggcaactccgtgccacaaccagggtgtacatag

SEQ ID NO: 132583 - DNA, 2847 bp, Artificial Sequence
  Description of Artificial Sequence: Synthetic coding sequence
atggcgagcctttcaacgtggagctcaccagctgagccccgggagatggaggactttgcccggggcgccgcgtctccgggacccagtcgccccggtttggtccctgtgtctatcattggcgctgaagacgaggatttcgagaacgagctggagacaaatagtgaagaacagaattcccagtttcagtctctggagcaggtcaagagaagacctgctcatctcatggcgctgctgcagcatgtggccctgcagtttgagcccggcccattggttttgcgtgtccctgtgccccccaatgtcgctttcgaattagacagaacccgtgctgacctgatttctgaggatgtacagcggcgatttgttcaggaggtggtacaaagccagcaggtggccgttggtcgacagcttgaagattttcgatccaaaaggctcatgggcatgactccttgggaacaggaactcgctcaactggaggcgtgggtcggcagagatagggctagctacgaggcaagggaacgacatgttgcagagcggttactgatgcatctggaggaaatgcaacacaccatctcaacagatgaggagaagtccgccgctgtagtcaacgcgattggactatacatgaggcatctgggggtgcgtaccaaatcgggggataaaaagtctggaaggaatttttttagaaagaaagtgatgggcaataggcgctctgacgaacccgccaagacaaagaagggtctgagcagcattcttgacgctgcgaggtggaaccggggcgaaccacaggtgcccgatttccgtcatctcaaggctgaagtggacgcagagaaaccaggcgccaccgatcgcaaagggggggtgggaatgccatcccgggacagaaacattggggcccccggacaggatactcctggggtgtcactgcaccctctgtccttagatagccccgatagagaacccggtgccgatgcccctctcgaacttggagattcttcccctcagggcccaatgtccctggagtccctggccccgccagagagcaccgatgagggagctgagacggagagcccagaacccggggacgagggagaaccagggcgatctgggctggagctggagccagaggagcccccagggtggcgagagttagtgcctcctgacactcttcacagtctccctaaaagtcaggttaagcgccaggaggtcatctctgagctgcttgtgaccgaggccgctcacgtgagaatgctccgggtgctgcacgacctcttcttccagcccatggcggaatgcctgttttttcccctggaggagctgcagaacatattcccttccctggacgagctcatcgaggtccattctctttttctggataggctgatgaagcggagacaagagtcaggataccttatcgaagagattggtgacgtgctgttggccagatttgatggcgccgaaggaagttggtttcagaagattagctcccggttctgttcacgacaatcattcgcgctggagcagctgaaagccaagcagaggaaagatccaaggttctgcgcctttgtgcaggaggccgaatcaaggccccgctgcaggcgattgcaacttaaagatatgatcccaaccgaaatgcaacgattgactaagtatccactgttgttgcagtctataggccagaataccgaagagcccacggagcgggaaaaggtggagctggcggcagaatgttgccgagaaattctgcaccacgtcaatcaagccgttagagatatggaagatctgctgaggctcaaggattaccaaaggcgtctcgatctctcccacctccgccagtcctcagacccaatgttatccgagttcaagaacctggacattaccaagaaaaagttggtgcatgaggggcctcttacgtggcgggtgacaaaggacaaagctgttgaggtgcacgtgctgctcctcgacgacctcctgctgctcctccagcgtcaggatgagcgcctgctcctaaagtcacacagccggacactcacacctactccggacggcaagactatgcttagaccagtcttgcgccttacttcagccatgactcgtgaggttgcaaccgatcacaaagccttttatgtcttgttcacatgggaccaggaagcccagatttatgagctcgtcgcacaaacggtcagcgaacgcaagaactggtgcgccctgattactgaaaccgctggctccctgaaagtgccagctcccgcctcaagacccaaaccacggccctcaccctcctcaacgcgggaaccactcctgagttctagcgagaacggcaacggaggccgtgagacgtcccctgccgacgcaagaactgaacgaatcctcagcgatttgctgccattctgtaggcccgggccggaaggccagttggcagccacggcactgcggaagggcgtcggaggcgggattctgccgccagagactcctcctgtgtccgcatggggagaactgtgcccacccgcctggttacacttgcggtttcctcccaggaaagcattctgtaaaaaggagcggaatggcggcgaggatgttcgggatcacccgcacccacactcctgtcgaagcatttctcatccggagggactcaggagggggtcatgtgggcctcgcctcggtggtgcccagttaggactgctagcgccacatgagccacggccgagcctccctcccgcattatgcctcggcgattctggactgcactctggcgggcatcacggggatcccgggcacctgtccatcgcctgcggaggccatcccagcactccaactcccaaatgcctgcgctctgtctttatcccatag

SEQ ID NO: 132584 - DNA, 4023 bp, Artificial Sequence
  Description of Artificial Sequence: Synthetic coding sequence
atgcgccctccagggtttctttcacgggcccctagcctgaatcgagccgagagaggcatttggtcatgcagcatggaccaacgagaacctctccctccggcccctgccgaaaacgaaatgaaatatgacaccaataacaatgaggaggaggagggcgagcagttcgacttcgacagtggggacgaaattcccgaggctgatcggcaggccccaagcgcacctgagaccggcggggcaggagcctccgaagcccctgccccgaccggtggggaagacggcgcaggagccgagacaacaccagtggccgagcccacgaagctggtgctccctatgaaagtcaacccctactcagtgatagacattaccccttttcaggaggaccaaccccccactcccgtccccagcgctgaggaagaaaacgttggcttgcacgtgccgtgcggatatttggtgcccgtcccgtgcgggtacgctgtaccaagtaacctgccactgctcctgccagcttacagctctccagtgataatttgcgcaacatcccttgacgaagaagccgaaactcctgaagtgaccgaagataggcagcccaactctctgtcctccgaagagccacctacttcagaggaccaggttgggagggaggatagtgccctcgccaggtgggcagcggacccggctaacaccgcatggatggagaatccggaagaggccatctatgacgacgtgccaagagaaaacagtgattccgagcctgacgaaatgatatacgatgatgtagagaatggagacgaaggcgggaactcttctttagagtatgggtggtccagcagtgagtttgagtcctatgaagagcaatctgacagcgaatgtaagaatggcatcccgagatcattcctgagaagcaatcacaaaaagcagttgtcccatgacctgacacggcttaaagagcattacgagaagaaaatgagggacctgatggcctctactgtaggcgtcgtagagatacagcagttacgccagaagcatgaactgaagatgcaaaagttggtgaaggctgccaaagacgggacaaaagacgggctggagaggaccagagcagctgtgaaaaggggaagaagttttataagaacaaagagtctcatagcacaggaccaccgaagctctcttgaagaagagcagaatctctttatcgacgtagactgcaaacacccagaagcaattctgacccccatgccagaggggctctcccaacaacaggtggtgcggaggtatatcctggggtctgtcgtggattccgagaagaactacgtcgatgctctgaaaagaatactcgagcagtacgagaagcctctttcagagatggagcccaaggtcctgtcggaacgtaaattgaagactgtgttctaccgtgtaaaggagatactgcagtgtcattctttatttcagatagccctggcctcccgtgtttccgagtgggacagtgtggaaatgataggagatgtatttgtcgcaagcttcagtaagagcatggtcctggatgcctatagcgagtatgtcaacaactttagtacagccgttgccgtgcttaagaagacctgtgctactaaaccagccttccttgagtttctgaagcaagagcaagaggctagcccagacagaacaacgctttattctctaatgatgaaacctattcaaaggttcccacagttcatccttctgcttcaagatatgctcaaaaacacatccaaaggccaccccgaccgccttccgctgcagatggccctcacagagctcgagacactggccgagaaacttaatgagcgcaaaagggatgccgaccaacgttgcgaagtgaagcaaattgccaaggctattaatgagaggtacctcaataaattgctctcttcggggtcccgctatcttatccgcagcgacgatatgatcgaaaccgtttacaacgaccggggcgagattgtgaagacgaaagagagaagagtcttcatgctcaatgacgttctgatgtgtgctactgtttcttcccgtcccagtcacgattcaagagtgatgagcagccagcgctacctcctcaaatggtccgtcccgctgggacacgtcgatgctatagaatatggaagctcggccggaacaggcgagcatagtcggcatctggctgtccatccaccagaatcactggctgtggtggccaacgctaaaccaaacaaagtgtatatgggacccggtcagctgtaccaggatctgcagaatctgctccacgatctgaatgtgattggacagatcacccagctgattgggaatctcaagggaaattatcagaatttaaaccagtctgtggcgcatgattggacttccggtctgcagaggctcattctgaaaaaagaggacgagattagggccgccgattgctgccgaatccagctccagctgcccggcaagcaggataagagtggaaggcccaccttcttcacggctgtgtttaatacgtttaccccagcgatcaaagagtcctgggtcaactctcttcagatggcaaagcttgccctggaagaagagaatcacatggggtggttttgcgttgaggatgatggaaatcatattaagaaagagaagcatccactcctcgtagggcacatgcccgttatggtggccaagcagcaggaatttaaaattggtagttgcacccaccaaatgggccaaatcgctatcgtcagcttccaaaacagtacgcccaaggtcatagagtgtttcaacgtcgagtctcgcatcctctgcatgctctacgtgcctgtggaagaaaaaagacgagagcccggggcccctccagacccagaaactccagcagtgcgagccagtgacgtgccgaccatctgtgtcggtaccgaagaaggatctatttccatttacaaaagctcccagggttcaaagaaggtacgcctccagcatttcttcacacctgagaaatctaccgtgatgagccttgcatgtacttcgcagagcctctatgccggcctcgtaaatggcgctgtggctagttatgccagagccccagacggctcctgggattccgagccccagaaggtgatcaagctgggcgttctccccgtcaggtcacttctaatgatggaagacactctctgggctgcatccggcgggcaggtgttcattatttcagttgaaacccatgccgtggaagggcagcttgaggctcaccaggaggaaggaatggtgatctctcacatggcagtgtccggggtggggatttggatcgccttcacttcaggaagcaccctgagactgtttcataccgaaaccctcaagcatttgcaagacattaatatagcgacccccgttcataacatgctccctggccatcaacgattgtctgtgactagcctgctggtgtgtcacggcttgctgatggtgggaacttccctgggggtgttggtcgctttacccgtgccccggctgcaggggatccccaaagtgaccggacgtggaatggtgtcatatcacgcgcacaattctcccgtcaaatttatcgtactcgctacagctctgcacgaaaaggataaggataaatcacgggactctctagccccagggccagaaccccaggacgaggaccagaaagacgcacttccatccggcggcgcggggtcgagcttatcccaaggcgaccccgacgcagccatctggctcggcgattccctgggaagcatgacccagaagtccgacctgtcttcctcctcaggctctctttcgctgagccacggaagctcttccctggagcataggagcgaggacagtaccatatatgacctcttgaaggacccggtttcactgcgctccaaggcgagacgcgcgaaaaaggcaaaagccagtagcgccctggttgtgtgcggggggcagggacacagacgggtccacaggaaagcgcggcagccacaccaagaggagcttgcccctactgtgatggtctggcagattccactgctcaacatttag

SEQ ID NO: 132585 - DNA, 4035 bp, Artificial Sequence
  Description of Artificial Sequence: Synthetic coding sequence
atggaccaaagagaaccattgcctcccgccccggccgaaaatgaaatgaaatatgataccaacaacaatgaagaggaagaaggagagcagttcgatttcgactccggggacgaaatcccagaggctgatcgacaggcccccagcgcaccagagacaggcggcgcgggagctagcgaagctcctgcccccacaggaggagaggacggagccggagcagaaacaacgcctgttgccgagcccacaaaactggtgctcccgatgaaagtcaatccctactctgtcatcgatatcaccccattccaagaagatcaaccccctacaccagttccttctgccgaagaagaaaatgtgggcctacatgtcccttgtggatatctggtaccagtcccatgtggctatgcggtgccatcaaatctgccacttctgttgccagcttacagcagcccagtgattatctgtgccacctctttggacgaggaggaaactccagaagtgactgaggacagacaaccgaactctttatcctcggaggagccacccacttctgaagaccaagtgggtcgcgaggactcggcattagctagatgggcagcggaccctgctaatactgcctggatggagaacccagaggaagctatctatgatgatgtcccacgcgagaatagtgatagcgagccagatgagatgatttatgatgacgtggaaaatggtgacgaaggaggtaactcatcgttggagtatgggtggagctcttccgagttcgagagctacgaagaacagtccgacagcgagtgcaagaacggaatccccagaagctttctccgctcgaaccataagaagcagctcagccacgacctcaccaggcttaaagaacattacgagaaaaagatgcgggacctgatggcttcaaccgttggcgtagtcgagattcagcagctgaggcagaagcatgaactgaaaatgcagaagctggttaaagctgcaaaggacgggactaaggacgggctggagcgaacaagggccgccgttaaacgaggaaggagtttcattcgtactaagagtctgatcgcccaggatcacagatcatcattggaggaagagcagaatctttttatcgacgtcgactgcaagcaccctgaggccatcctcacacctatgccagaggggctgtcacagcaacaggttgtgcgccgctacatactgggaagcgtggtggactctgagaaaaactacgtggacgctttaaagagaatacttgaacaatacgagaagcccttgtctgagatggaacctaaagttctcagtgagagaaagctgaagactgttttttatcgggtgaaggagattctccaatgccattccttgttccagatcgctttggccagcagggtgagcgaatgggacagtgtcgaaatgataggcgacgttttcgtagcatctttcagcaagagcatggtgctggatgcctatagcgaatatgtcaacaatttcagcactgcagtagctgtgctgaagaaaacttgcgctactaagcccgcatttctagaatttttaaagcaagaacaggaggcttccccggacaggacgaccctgtatagccttatgatgaaaccaatccagcgcttcccccagttcatcctcctgctgcaagatatgctgaagaatacatcaaaaggacatccagatcgcttgcccctgcagatggcgttgaccgagctggaaacccttgccgagaagctgaacgagcgcaagcgggatgccgaccagaggtgtgaggtcaagcaaattgccaaggcaattaatgagaggtatttaaacaagctgctctccagcggctctcggtacttaatcaggtcagacgacatgatcgagacagtgtacaacgaccgcggcgagatcgtgaaaaccaaggaacgacgcgtgtttatgctgaacgacgtactcatgtgcgcaacagtgtcatctagaccctctcatgattccagagtcatgagctcacagcggtacctcttgaagtggtcggttcctttgggccacgtggacgctattgagtacgggtcaagcgctggaacaggtgagcacagccgccatctggccgtccatcctccggagtctctcgccgtggtcgcgaacgctaaaccaaacaaagtatatatgggccctggacaactttatcaggacctccagaacttgctgcatgatttaaatgtcattgggcagattacgcaattaatcgggaatctgaaaggcaactatcaaaatctcaatcagagtgtggctcacgattggacatccggactacagcggctcattctgaaaaaggaggatgagatcagggctgcagattgctgccgaatccagttgcagctgccagggaaacaggataagtccggtcgacccacttttttcacagcagtgttcaatacctttacgccagcaatcaaagaaagttgggttaattcgctgcagatggctaaactggcactcgaggaggagaaccacatggggtggttctgtgtggaagacgatggaaaccatataaagaaagaaaagcacccactgctagtgggtcacatgcccgtgatggtggctaaacagcaggaattcaagattgaatgcgcagcttacaaccctgagccatacctgaataacgaatctcagcccgactctttcagcaccgcccatggctttctgtggataggatcgtgtacccaccagatgggtcagattgccattgtatcgtttcagaattccacccctaaggtcattgagtgcttcaacgtggagtccagaatcctatgtatgctgtacgttccagttgaagagaaacggagagagcctggggccccacctgatcctgagaccccagccgtcagggcttcagacgtgccaactatctgtgttgggacagaagagggatccattagtatctacaagagctctcagggtagtaaaaaggtgcgtctgcagcacttttttaccccagaaaaatccactgtgatgtctctggcttgcacgtcccaatctctttacgcaggattagtaaatggtgctgtggcttcatatgccagagcccctgacggctcctgggactctgaacctcagaaagtcattaaacttggcgttcttccagttcgctccctgttgatgatggaggataccctgtgggcagcttcgggcggacaggtgtttattatatcggtcgagacgcatgccgttgagggccagcttgaggcccaccaagaggaaggaatggtcatttcccacatggccgtaagcggcgtgggaatctggatcgcatttaccagtggatctactctgagactgttccacaccgagacgctaaaacacttgcaagatattaacatcgctaccccagtacacaacatgcttccaggccaccaaagactgtcagtgacgtcactgcttgtgtgccacggactattgatggtgggaacctccttgggtgtcttagtggcgcttcctgtaccaaggctgcaggggatacctaaagtgacaggcaggggcatggtctcatatcatgcacataactctcccgtgaaattcattgtactagctacagccttgcacgaaaaggacaaagataaatcaagggattccttggccccgggtcccgagccacaggatgaggatcagaaggatgccttgcccagcggaggcgccgggtcatccctaagccaaggcgatccagatgcggccatctggctgggagatagcctcggctcaatgacacagaagagcgatctgtcttcatcctccggctcactatctctatcccacgggtcttccagcctggagcaccgatccgaggacagcaccatttatgatctgctcaaagatcctgtatctctgcggagcaaagccagacgagcaaagaaagctaaggcttcctccgctctggtcgtctgcgggggtcaggggcatcggcgggttcacagaaaagccaggcaacctcaccaggaggaactcgctcccacagtgatggtgtggcagattccactgctgaacatatag

SEQ ID NO: 132586 - DNA, 1833 bp, Artificial Sequence
  Description of Artificial Sequence: Synthetic coding sequence
atgcgacctcccgggttcctctcccgggctcctagtcttaatcgggcggaacgggggatctggtcctgttccatggatcagagagagcccctgccacctgcccccgccgaaaatgagatgaaatatgatacaaataataatgaggaggaggagggcgagcagtttgatttcgatagcggggacgaaatccccgaggccgacaggcaggcccccagcgcaccagagactggcggcgctggagccagcgaggcacctgctcccactggcggagaagatggcgctggagccgagacaaccccggttgccgagcctactaagctcgttctgcccatgaaggtgaacccatatagtgttatagacatcaccccatttcaggaagaccagccgccaaccccagtacctagcgcggaggaagagaacgttggcctacacgtcccttgtggttatctcgtaccagtaccctgcggttacgccgtgccaagtaacctgcccctgttactgcctgcatactctagcccggtcattatttgcgcgacatcactggatgaggaggccgagacgcctgaggtgacagaagaccgacaacctaatagcctttccagtgaagagcccccgactagcgaggaccaagtggggagagaggatagcgccctggcccgctgggcagcagatcccgcaaatactgcatggatggaaaatcctgaggaggcaatctacgacgacgttcctagagaaaacagcgattccgagcctgacgagatgatctacgatgacgtcgaaaatggcgacgaaggcggaaattcttctctagaatatgggtggtcgtctagtgaatttgagtcctacgaggagcagtccgattcagagtgtaagaacgggatcccccgatcatttctgcgcagtaaccataaaaaacagatgcaaaagctggtgaaagccgctaaggacggcactaaggacgggctggagcgaaccagggccgctgttaagagggggaggagcttcattaggacgaaaagcttgatcgcccaggaccacagaagctcactggaggaagagcagaacctgtttatcgatgtcgattgtaaacacccagaggctatcctgacccccatgcctgaaggactttctcagcagcaggtagtgagaaggtacattctggggtccgtggtggacagcgagaagaactacgtcgacgcactgaaacggattcttgaacagtacgaaaagcctctcagcgagatggagcccaaggtgttgagcgagaggaagttgaaaacagttttttacagagtgaaggagatacttcaatgccacagcttatttcaaatcgctcttgcctcccgggtgtcagaatgggattctgttgaaatgattggcgacgtatttgttgcctccttcagcaagtccatggtacttgatgcttacagtgagtatgtgaacaatttttccaccgccgttgctgtgttgaagaagacttgtgcgactaagccagcattcctcgaatttctgaaacaggaacaggaagcctctcccgaccgtactactctgtatagcctgatgatgaaaccaatacaacgatttccacagtttattctgttgctgcaggatatgctgaaaaatacaagtaaaggccatcccgacagactacctttgcagatggcactcactgagctcgaaacactggcagagaagttaaacgagcggaagcgggatgctgaccaacggtgcgaggtaaaacagattgccaaggctattaatgagcgctacctgaacaaggtggaacgcgggttcctgcagttatatagtaagatcatttttgccctgtgctag

SEQ ID NO: 132587 - DNA, 4110 bp, Artificial Sequence
  Description of Artificial Sequence: Synthetic coding sequence
atgcgtccccctggtttcctgtcccgcgctccatccttaaacagggctgaacgtggcatttggagttgttccatggatcagcgcgagcctttacccccagcacccgccgagaacgagatgaaatatgacacaaacaacaacgaggaagaggagggagagcagtttgacttcgactctggagacgagatcccagaagcggatagacaggccccttccgcccctgagaccggcggggcaggcgcctctgaggccccagctccgacgggcggagaagatggagccggggcagaaaccacaccagtcgccgaaccaactaagctggtccttcctatgaaggtgaatccctatagcgtcattgatataaccccctttcaagaggatcagccaccaacccctgtgccttccgccgaagaggaaaatgttggactgcatgtaccgtgcggctatttagtcccggtgccctgtggttacgccgtcccatccaacctgccgctcctgttgcccgcttattccagtcctgtgattatatgcgccactagcctcgacgaagaggctgagacgcccgaggtgacagaggataggcaacctaatagcctctctagcgaggagccccctacttcagaagaccaagtgggaagagaggactctgcgctagcgcggtgggccgccgacccagcaaacacagcttggatggagaatcccgaggaagccatctacgacgacgttccccgggaaaatagtgacagtgaacccgacgaaatgatttacgatgatgtagaaaacggagatgaaggcgggaactcaagcttagagtatgggtggtcaagttcggagttcgagagctatgaggaacagagcgatagcgagtgcaaaaacggaattcccagatccttcctccgctccaatcataaaaaacaactgtcacatgacttaacaaggctgaaggaacactatgagaagaagatgcgggacttgatggctagtacagtaggggtcgttgagattcagcagcttcggcagaaacacgaactgaaaatgcagaagctcgtgaaggctgctaaggatgggaccaaagacgggctggagcgcacccgggcggctgtgaaacgggggcgttctttcatcaggacgaagtcgctgatcgcccaggatcataggtcctctctggaagaggagcagaatcttttcatcgatgtggattgcaagcaccctgaggcaatcctgacccccatgcccgagggtctctcccaacagcaggttgtgcgtcgttatattcttggcagtgtcgtcgactcggagaagaattacgtcgacgcgttaaaaagaattttagagcaatatgaaaaacctctcagcgagatggaacccaaggtgctgagcgagcgaaaactgaaaactgtgttttaccgagttaaagaaatcttgcagtgtcattcacttttccagatagcattggcgtcacgggtgagtgaatgggacagcgtggagatgatcggcgatgtgtttgtggcctccttctccaagtctatggtgttggatgcctattccgagtacgtgaacaacttttcaactgcggtagccgtgctgaaaaagacgtgcgcaactaagccagccttcctggaatttttaaagcaggagcaggaagccagtcccgacagaaccaccctgtactccctcatgatgaaaccaatccagagatttcctcagttcatcctcctcttgcaggacatgctgaaaaatacatctaaagggcacccagaccggctcccccttcagatggcactgactgagcttgaaacccttgccgagaaactgaacgagaggaaacgagatgcggaccaacgctgcgaggtgaaacagattgcaaaagccattaacgaacgatatctcaacaagttactgtctagcggtagtaggtatctcattcgctcagatgatatgatcgagaccgtctacaatgaccgcggggagattgtgaaaaccaaggaaagaagggtgtttatgcttaacgatgtgctcatgtgcgcgacagtgagttcccgacccagccacgatagtagagtgatgagtagtcaacgatatcttcttaagtggtcagttcccctcggacatgtggatgctatagagtatggatcttctgccggtaccggcgagcactctcggcatttagctgtgcacccaccagagtccctggctgttgttgctaacgctaaaccgaacaaggtgtacatgggaccagggcaactgtatcaggacctgcagaatctgttgcacgatcttaatgtgatcggacagattacacagcttatcgggaatctgaagggaaactatcagaacctgaatcagagcgtggctcacgattggacttctgggctccaacggttgatcctgaagaaggaggacgagatcagggccgcagattgctgtagaatccagctccaactacctggaaaacaagataaatcaggtaggcctaccttctttaccgctgtattcaacacatttactcccgccataaaggaatcctgggtgaattccctccaaatggcgaagctggcactcgaggaagagaaccacatgggatggttctgtgtggaggatgacggaaatcacatcaaaaaggagaaacacccattgctggtgggccacatgccagtcatggtagcaaagcagcaggagttcaagattgagtgtgctgcctataatccagaaccttacctgaacaacgagtcccagccagattcatttagcacagcccatgggtttctctggattggcagttgtactcaccagatgggtcaaattgccatcgtgtcctttcagaatagcacaccaaaagtgatcgagtgctttaatgttgaaagtagaattctttgcatgctatacgtgcctgtggaggaaaagaggcgggagccaggggctccccccgaccctgaaactcctgctgtgcgcgcctccgatgtgcctacaatatgtgtgggaaccgaagagggatcaatttctatttataaaagtagtcagggatcaaaaaaagtccgattgcagcatttttttactccggaaaagtcaacggtaatgtcactggcatgtacatcccagagcctctacgccggactggttaacggcgctgttgcatcatacgcccgcgcaccagatggctcgtgggacagcgagccacagaaagtcataaagctgggggtccttcctgtccgctcgctactgatgatggaggatactttatgggccgcctcaggcgggcaggtgtttattatatccgtcgagacccatgccgtagagggccaactagaagcacaccaggaggagggcatggtaatcagtcacatggccgtgagtggtgtcggcatatggatagccttcacctctggctcgaccctgcgcctgttccataccgagactcttaaacatctacaagatattaatatagcaacccccgtccacaacatgctgccgggccatcagcggctgtcagttaccagtttgcttgtatgtcacggcctcctgatggtgggaacaagtctgggtgtactagtcgcactccctgtcccccgacttcagggcatcccaaaggttaccggccggggcatggtgtcctatcacgcccacaacagtcctgttaaatttatagtactggctacagcgttgcacgaaaaggataaggataagtctcgagactcgctggcgcctggaccagagcctcaggacgaggatcagaaagacgctctgcccagtggtggcgccggctcatcactatcccagggagaccccgacgcagctatctggttgggcgactctctaggatccatgacccagaaatcagatctgagcagctccagtggcagcctgtccttgtctcacggcagctcaagcctggaacatcgaagtgaggactctaccatctacgatctgctcaaagaccccgtgtctttgcggtctaaagccaggcgggccaagaaggccaaagcttccagcgccctagtggtgtgtggcggtcagggacatcggcgcgtgcatcgtaaagctagacaacctcaccaggaggaactcgcgcccaccgtgatggtgtggcagataccactccttaatatttag

SEQ ID NO: 132588 - DNA, 4107 bp, Artificial Sequence
  Description of Artificial Sequence: Synthetic coding sequence
atgcggccacccggcttccttagcagggccccgtcactgaatagagccgagcgtggaatctggagctgcagcatggaccagagggagcctctgcccccagcccctgccgaaaatgagatgaaatacgacaccaataataatgaggaagaagaaggtgagcagttcgatttcgattccggcgacgagatcccagaagctgacagacaggccccaagtgctcccgaaaccggtggtgctggcgctagcgaggcgccagccccaacaggcggagaggacggtgctggagccgagaccactccggtggctgaaccgaccaaactcgtcctgcctatgaaagtgaatccatactccgtgatcgatatcacgccctttcaggaggatcagcctcccacccccgtgcctagcgccgaagaagagaatgtgggactccatgtcccttgtgggtatctggtgccagtcccttgcggatacgctgtgccgagcaatttgcccctgcttttgcctgcgtattcatcccccgttataatttgtgctacgagcctggatgaggaggccgagacacccgaagtgacggaagatcgtcagcccaactccctgtcctctgaggagccccctacttccgaggatcaggtagggcgagaggactcagcgctggccaggtgggctgccgatccggccaatacagcctggatggagaatccagaagaagcgatatatgatgacgttccaagagagaattctgattccgagcctgatgagatgatttacgacgacgtggaaaatggggatgagggcggtaattcatcccttgagtatgggtggtctagtagcgagttcgaaagctatgaggagcaaagcgattccgaatgcaagaacggaattccccgcagcttcctaagatccaaccataaaaaacagctgagccatgacttgactcggcttaaagagcactacgagaagaagatgagagatctgatggcctctactgtcggggtggtagagatccagcaactgcggcagaagcacgagttgaagatgcaaaaactggtcaaagccgcaaaggacgggactaaagacggcctggagagaactcgggcagcggttaagcgcgggcgatccttcattcgaacaaaaagcttgattgcccaggatcaccgcagtagtctggaagaagaacagaacctgtttattgatgttgactgcaaacatcccgaggcgattttgacccccatgccggaaggcctttcacaacagcaggttgttagacgctacatcttgggcagcgtggtcgattctgaaaagaactacgtggatgctcttaaacggattctcgaacagtacgagaagccactttcggagatggagcctaaagtgctgtccgaaagaaagctgaaaaccgttttttatagagttaaggaaatccttcagtgccatagtctctttcagattgctcttgcttctagagtgagtgaatgggattcagtggagatgattggcgacgtattcgtcgccagtttttcgaagagtatggtcctggacgcttattccgaatacgtgaataattttagtactgctgtggccgtgctcaagaaaacctgtgcaactaagccagcattcttggaattcctaaaagaacaggaagcgtctcccgacagaacaaccttgtactcgctcatgatgaagcctatacaacgctttccacaatttatccttcttctccaggatatgctgaaaaatacctctaaggggcaccccgataggttgcccctgcaaatggcattgactgagttggaaacgctggccgaaaaactcaacgaacgaaaaagggatgctgaccaacgctgtgaggtgaagcagattgcaaaggctatcaatgaacggtacttaaacaaacttctttcatctggctctaggtacctgatccggtccgacgacatgattgaaacagtgtacaatgaccggggagagattgtcaagactaaggaacggcgtgtgttcatgttaaatgatgtgctgatgtgcgccaccgtgagctctcggccatctcatgacagccgggtgatgtcttcacagagatacttgttgaagtggtccgtgccccttggccatgtcgatgcaattgagtacggcagttccgctggtacaggcgagcacagtcggcatcttgccgtgcatcccccagagtctctggctgtggtcgccaacgccaaacccaacaaggtgtatatgggccctggacaactttaccaggatctgcagaacctgctacacgacctgaacgtcattggccagattacccagctgattggaaacctgaaaggtaattatcagaacctgaaccaatctgtagcccatgactggacgtctggactccagaggctgatcctgaagaaagaagacgagatcagggccgcagactgctgtaggatacaactgcagctgccgggaaaacaggataagagtggtaggcccacgttttttactgccgtgtttaacacattcacaccagccataaaggaatcatgggtcaacagcttgcagatggcaaaattagcacttgaagaggaaaaccatatgggctggttctgcgtggaagacgacgggaatcatattaaaaaagaaaaacaccccctcctcgtggggcatatgccggtgatggtcgccaagcaacaggaattcaaaattgaatgcgcagcctacaatcccgaaccatacctgaacaatgagtctcagcctgatagttttagcactgcccatgggttcctgtggatcggtagctgtacacaccagatgggtcagattgcaattgtttcctttcagaacagcacccctaaggtgatagagtgctttaacgttgagtcacggatactgtgcatgctctatgttccggtggaggaaaagcggagggaaccaggggctcccccagatccagagaccccagctgtgagagccagcgacgttcccaccatctgtgtgggtacagaagaggggagcatatcaatttacaagtccagtcagggatccaagaaggtgaggcttcaacacttctttacacccgagaagagtactgtgatgtcccttgcatgtaccagccagtctctgtatgccggtctggtgaatggcgccgtagcttcgtatgcacgcgctcccgacgggagctgggacagtgagcctcagaaagtgattaaattgggcgttctccccgtgaggtcactgctgatgatggaggatactttgtgggcagcctcagggggacaggtcttcattattagtgtagaaacccatgccgttgaaggccagctggaggctcaccaggaggaaggtatggtgatctcacatatggctgtcagtggcgttggaatttggattgcgtttacaagtgggagtactctgcggttgtttcacacagagaccttaaaacatcttcaggacattaacatcgcgacgccagtacataacatgttaccgggacaccaaagactgtcagtgacgagcttactggtgtgtcacggcctgctgatggtgggaaccagtctcggagtgctcgtggccctgcccgtcccccgactccagggcatcccgaaggtgaccgggcgtgggatggtgagctaccacgctcacaattctccagtaaagttcattgtcctggctaccgctctccatgagaaggataaggacaagtcacgggattctctggctccaggcccagagccacaggacgaggatcaaaaggatgcactcccttccggaggcgcaggctcctcactctctcaaggcgatccagacgccgcaatctggctgggtgactcactaggaagtatgacccaaaaaagcgacctgtcttctagttccgggtccctgtcactgagtcacggaagtagctctctggaacaccggagtgaggatagcacaatttatgatctgctaaaagatccggtaagcctccggtcaaaggccagaagggccaaaaaggcaaaggcctcctcagccttagtggtctgcgggggccaaggacaccgcagggtccaccggaaggctaggcagcctcaccaggaagaacttgccccaactgtgatggtttggcagatccccttgcttaatatttag

SEQ ID NO: 132589 - DNA, 2949 bp, Artificial Sequence
  Description of Artificial Sequence: Synthetic coding sequence
atgttaccttcatcgtcttggggaaaacggaagttaaggggccgcttagggtgggtgcgcagtgatgctcgcggagtgatgtgggctcgtcaggaagggctccatcaccctcacccccatgcagtaatacgctgtccatcctctagcagctctagcgtgagctgcagcggcgactcagaggaggaggatatgggactactggaagtatcagtttcagacatcaaaccgcccgcgcccgagcttggacctatgccagagggcctcagtccccagcaggtggttagaagacatatccttggctccatagtacaaagcgaggggtcttatgtggaatcccttaaacgtattctccaggactacagaaatcccctcatggagatggaacccaaggccctgtcagctcgcaaatgccaggtggtgtttttccgggtgaaggagattctgcactgccacagcatgtttcagatcgcactctccagcagggtggcagaatgggactctactgagaagataggggacctgttcgtggcatccgatatgctcaagaacaccccaagaggtcaccctgaccgactgtcgctgcagctggccctgacggaactcgagacccttgcggaaaagcttaacgaacagaagcgtctcgccgaccaggtggctgagatacaacagttaactaaaagcgtgagtgacaggtcatccttaaacaagctcctgactagcggacagcgccaactgctgctctgcgagacactgacagaaactgtgtacggagaccgcgggcagctaattaaatcaaaggagaggcgcgtgtttctccttaatgatatgttggtatgtgccaatattaacttcaaagggcaactggagatttcttcactggttcccctgggcccaaaatacgtggtgaagtggaatacagccctaccccaggtccaggttgtggaagtcggacaggatgggggcacatatgataaagacaatgtcctaattcagcacagcggggccaaaaaggccagcgccagcggacaggctcaaaataaggtgtaccttggacccccccgcctgtttcaggaactgcaggatttgcagaaggacctggccgtcgtggaacagataaccctgctgattagtaccctccacggtacctaccaaaacctcaatatgacggtggcacaggattggtgtttagctttgcaaaggcttatgcgggtgaaagaggaagaaatccacagtgccaacaagtgccgtctgagattattactgcctggtaaacctgacaaaagcggcaggcccattagttttatggtggtcttcatcactcctaacccactgagcaaaatcagttgggtaaaccggctgcacttagccaaaatcggcctgcgagaagaaaaccaacctggctggctctgccccgacgaagacaagaaatcaaaggccccattctggtgtccaatactggcgtgttgtattccagccttcagttctcgagccctaagtctgcagttgggagccctcgtccacagtcctgtcaattgccccctgcttggcttctcggctgtgtcaacatctctgccccagggctatctgtgggtgggtggaggccaagaaggggccgggggacaagtggagatcttctccctgaatcggccctcaccgcgcaccgtcaagtcttttccacttgccgcacccgttctgtgcatggaatacattccggagctggaggaagaggctgagagtcgcgatgagtccccaacagtggccgatccgtccgcgactgttcatcccacaatttgtctaggactgcaggacggaagtatcctgctctattcatcagtggataccggtacgcagtgcctggtgtcttgccgatcacccggcttacaacctgtgctgtgcttgaggcattcaccgtttcatctgctggccggcctccaggacggaactctcgcagcttacccgcgcacctccgggggggtcctgtgggatcttgaatcaccgccggtgtgccttactgtcggtcctgggccagttcggaccttactcagcctggaagacgccgtgtgggctagttgtgggccctgggtgacagtgctcgaagccacaacccttcagccgcagcagtccttcgaagctcaccaggacgaggcagtcagcgttactcacatggttaaggccggaagtggggtctggatggccttcagcagcggcacttcaatccggttgtttcacacagagacactggagcatctgcaggaaataaatatcgctacccgcaccacttttctgttgccaggccagaaacacctgtgcgtgactagcctgctgatatgccaagggctactgtgggtgggcactgatcagggggtgattgtactgctacctgtgccacggctggaggggattccaaaaatcaccggcaaggggatggtgagcttgaacggtcactgcggtcccgtggctttcctggcagtcgccactagcatattagctccggacatcttacggtcagatcaggaagaggccgagggcccaagggctgaagaggataagcccgacggacaagcccacgagccaatgccagactcacatgttggtagagagttaactaggaagaaggggatcctgttacagtatcgcctgcgctctaccgcacatctacccggccctctgctttctatgcgcgagccagcacctgccgacggcgccgccttggagcacagtgaagaggacgggagcatctacgaaatggcggatgatccagatatttgggtgagatcgagaccttgtgcaagggacgcccatcgcaaggagatttgctccgttgcaatcatcagtgggggccaaggctatcgcaattttggatcggctctcggttcctcaggcaggcaggctccttgcggcgaaactgactcaaccctcttgatctggcaagttcctcttatgctgtag

SEQ ID NO: 132590 - DNA, 3840 bp, Artificial Sequence
  Description of Artificial Sequence: Synthetic coding sequence
atggcatcatctaatccccctccacagcctgccataggtgatcagttggtgccaggggtaccggggccaagcagcgaggcggaagacgatccaggtgaggctttcgaatttgacgactcagacgacgaagaggatactagcgccgctttgggcgtgccgagtctggccccagagcgggatacagatccacctttgatacacctagattcaattcctgtaactgatccagatcctgcagccgcacctcctggcacgggcgtgcctgcttgggtgagcaacggggatgccgcagatgccgccttttctggagcgaggcattcatcatggaagaggaaatcctccaggaggatagatcggttcactttccccgcgctggaagaagacgtaatttacgatgatgtcccatgtgaaagccctgacgcacatcagcccggtgctgaacgcaacctgctgtacgaggatgcccatcgagctggcgccccgcggcaagccgaagacctgggctggtccagttctgagtttgaaagctattctgaagactctggcgaggaagcaaaaccagaggtcgaagtggaaccggccaaacatcgtgtatcttttcaacctaagttgtcacctgatctaactcgcctaaaggaaagatacgctcgaacaaagcgggacattcttgccctaagagtgggaggacgagatatgcaggagctgaaacacaaatatgactgcaagatgactcagctgatgaaagcagccaagagcggcaccaaagacggactcgagaaaacaaggatggctgtgatgcggaaggtgtcctttctccacaggaaagatgttctcggggacagtgaagaggaggatatgggtctccttgaggtcagcgtcagcgacataaaacctcctgctcctgagctgggccccatgccagagggtctgagcccacagcaggtggttagacggcacatactgggttccatcgtgcagtcagagggttcatacgtggagagtctgaaacggatcctgcaagactataggaatccattaatggagatggagcccaaggctctcagcgcaaggaaatgtcaagtcgtattcttcagggtaaaggaaattcttcactgccacagcatgttccagatagccttgtcaagccgcgtcgcagagtgggactctactgaaaaaattggtgacttatttgtcgcgtctttctctaagtccatggtgctggacgtctattctgattacgtcaacaattttaccagtgccatgagcataatcaaaaaagcatgtttgactaaaccagccttcctggagttcctcaaacgacggcaggtgtgtagtccggacagggtgacactttacggtctaatggtgaaaccaatccagaggttcccccagtttatcctgctgttgcaagatatgctcaagaatacaccccggggacaccccgatcggctgtctctccagctggccttgacggaacttgagactctggccgagaaacttaatgagcagaagagacttgccgaccaggtggctgagatacaacagttgactaaatctgtcagcgatcggagtagcttgaacaagctccttacttccgggcagcggcagctcctcctgtgtgaaacacttaccgagactgtttatggggatagaggccagctgatcaaaagcaaggagagacgcgtgtttctgcttaacgacatgctggtctgtgccaatattaacttcaagcctgcaaatcaccgcggacagcttgaaattagctctctggtgccgctgggaccaaaatatgtggtgaagtggaatacggccctgccccaggtccaggtagtagaggtggggcaggatggtggcacctacgataaggataacgtccttatacaacactcaggtgctaaaaaagcctccgctagcggccaggctcagaataaagtctatttgggaccgccacggctctttcaagagctgcaggacttacagaaagatctggctgtggtcgagcagatcacgctgctcatctccacactgcatggcacatatcagaacctgaatatgacagtcgcccaggactggtgcctggccttgcagcgactgatgcgggttaaggaagaggagatccattccgctaataagtgtagactcaggttacttctgcctgggaagcctgataagtctgggaggccgatatcgtttatggtcgtgttcatcacaccaaatccgctgtctaagatcagctgggttaatcgactgcacctggcaaaaatcggactgcgggaggagaaccagccagggtggctttgccccgatgaagacaagaagagtaaggcccctttctggtgccccatccttgcttgctgcatccctgccttttccagtagagcactcagcctgcaactaggggccctggtacacagcccagtgaattgcccgctgctgggtttttccgccgtctccaccagcctgccgcaagggtacctctgggttggaggcggccaggaaggggctggaggtcaggtggagattttttcgcttaaccgtccatctccacgcacagtgaagagctttcccctggcagccccggttctctgtatggagtacatcccagagttggaagaggaggcggagagtcgggatgagtcccccacagtggcagatccgtctgcaactgtccaccccaccatctgtttgggcttgcaggacggcagcatcctgctgtactcctccgtggacaccgggactcagtgcctcgtcagttgcaggagccccggcctgcaacccgtactttgcctgagacactccccctttcatctgcttgccggactgcaggacggcacgctggcagcatatccccggactagcggcggagtcctatgggatttagagagtccaccagtttgtttgacggtaggacccggaccagtaaggacactcctaagcctagaagatgccgtctgggcctcttgtggaccctgggtaaccgtgctggaggccacgacactacaacctcagcagtcatttgaagctcatcaggacgaagctgtgtcagttacacatatggtgaaagccggttctggtgtgtggatggccttttcttcaggcacatccatcagactcttccacaccgagacccttgaacacctacaggaaataaacatcgctacacgcacaacatttctcctgcctggccagaagcatctatgcgtgacttccctcctgatctgccaggggctgctgtgggttgggactgatcagggagtcattgtgcttctcccggtgccccgtctagaaggaataccaaagataactggtaagggcatggttagcctgaatgggcattgcggacccgtggcatttctggccgtggcaacgagtattctcgctccagatatcttacgtagcgaccaagaggaagccgaaggaccgcgggcagaggaggataaacctgatgggcaggcccatgagccaatgcctgactcgcacgtgggaagggaactcaccagaaagaagggaatcttgttgcagtaccggctccggagtacagcacacctgccgggccctctcctctctatgcgggaacctgccccagctgacggcgccgccctggagcactctgaagaggacgggtccatctatgaaatggccgatgacccagatatttgggttcggtctcggccatgtgcaagagatgctcacaggaaggagatttgctcggtggccatcatctcgggtggtcaggggtaccggaacttcggaagcgctctggggagctcaggcaggcaagcgccgtgtggcgagactgattcaaccctcctcatttggcaggtgccccttatgttatag

SEQ ID NO: 132591 - DNA, 3159 bp, Artificial Sequence
  Description of Artificial Sequence: Synthetic coding sequence
atgctgccctctagcagctggggaaagaggaagctgcgcggcaggctgggatgggtcaggtctgacgctcgaggcgtgatgtgggctcggcaggagggattgcatcatccacaccctcatgccgtaattagatgtccatcttcttcaagttcaagtgtcagttgctcaggtgactccgaagaggaagatatgggcttgctcgaggtgagcgtgtccgatattaaaccgcctgcccccgaactaggtccaatgcctgaaggcctcagcccacagcaggtcgttcgtaggcacattttaggctcgattgtccaaagcgaaggctcctacgttgagagcttaaaacgcatcctgcaagattacaggaatccgctcatggagatggagccgaaggcgctctctgcacgcaagtgtcaggtcgtgttcttccgcgtcaaagaaattctgcactgtcacagcatgtttcagatagccttgagctcacgggtcgccgaatgggattcaaccgaaaagataggagacctcttcgttgctagcttctccaaatcgatggtcttagacgtgtacagtgattatgtaaacaacttcacatcagcaatgtctattatcaagaaggcatgtcttactaaacccgcttttctggagttcctaaagaggcgacaggtgtgctcgcccgaccgcgtgaccctctacgggctgatggttaagccaatccagcggtttccacagtttatcctcctgctacaggacatgttgaagaacaccccaaggggccatcccgacagactgagtctccagctcgctctgactgagctcgagactttggccgagaaactcaacgagcagaaacggttggctgatcaggtagcagagatccagcagctgaccaaaagcgtctccgaccggagtagcttaaataagttgctgacatcgggtcaacgccagttgctgctgtgtgagacattgactgagaccgtgtacggtgacaggggacagttaataaagtcaaaagagaggcgggtgttcttgctcaacgacatgctggtgtgtgcaaatataaactttaagggccagttagaaatttccagcttagtgcccctgggacccaagtatgtggtgaagtggaacaccgctctgccccaagtacaggtggtggaagttggccaggatggtggcacgtacgacaaggacaacgtgctgattcagcactcgggagctaagaaagctagcgcttcggggcaagcacagaataaggtgtacctgggccccccacgactcttccaggaattacaggacctgcaaaaggacttagctgtagtagaacagataacactgttgatttccaccctgcacggaacataccaaaatctgaatatgacagtggcccaggactggtgcttagcccttcagcgcctaatgcgggtgaaggaggaggagatacactcagcaaacaagtgtcggctacgacttctgttgccggggaaacccgataaaagtggccgccctattagctttatggtggtgtttataactcccaacccattaagcaaaatcagctgggtgaacaggctacaccttgcaaaaattgggctccgagaggagaatcagccgggctggctgtgtcccgatgaggacaagaagtccaaggcacctttttggtgtcctatactggcatgttgcatccctgcattctcaagtagggctttgagcctgcaactgggcgccctagttcatagtcccgtgaattgtccccttctgggattcagcgccgtgagcacctctctcccccagggttacctttgggtaggcggcgggcaagagggggcgggaggacaggtcgaaatttttagcctgaatcgaccttctcctcggactgttaaaagtttccccctggcggctccagtgttgtgtatggaatatatccctgaactggaagaggaggcggaatcacgcgacgagtccccgaccgtggccgaccctagcgccacagtccaccctacaatatgccttgggctgcaggatgggtctatcctgttatactcctctgtggacaccgggacgcaatgtttggtcagttgcagatcaccaggacttcaacccgtattgtgcctgcgacactctccctttcacctcctcgctggcctccaggatgggactttagctgcttatcccagaacctcaggaggcgtactgtgggatctggagagtcctccagtatgtttaaccgtcggtcctggccccgtccggacactgctttcgcttgaggatgccgtctgggcctcgtgtggaccttgggtaaccgtgcttgaggcaaccactctgcaaccacaacagtcatttgaagcccatcaggatgaagctgtgtccgttactcacatggtgaaagccggctccggcgtttggatggcattcagcagcggaaccagtatcagactgttccatacagaaaccttggagcatctccaggaaatcaacatcgccacaaggaccaccttcctgctaccagggcagaaacacctttgtgtgacgtcactgctgatctgtcagggtctgctttgggtcggcactgaccagggcgttatcgtcctcttgcctgtcccccggctggagggtatccctaaaattacggggaagggcatggtcagcctcaacggccattgtggcccggttgccttcctagcggtcgccacctcaatcctggcaccagacatactcaggagtgatcaggaggaggccgaaggcccacgggccgaagaagacaagcccgacggtcaggctcacgagcctatgcctgactcccatgttggtcgcgaactgacgagaaagaaaggcatcttgctgcaataccgtttgagatctactgcgcacctgcccggaccgttattgagtatgcgtgaacccgcacctgccgacggcgcagctctggagcactctgaagaggatggttcaatatacgaaatggcagatgatcccgatatttgggtccggtctagaccgtgtgcccgcgacgcccatcggaaggagatttgctcagtggcaattatctcgggaggccaaggctatcggaacttcggatccgctctgggcagctccggccgccaggccccctgcggtgaaacggactctactctgctgatttggcaagttcctctgatgctgtag

SEQ ID NO: 132592 - DNA, 3723 bp, Artificial Sequence
  Description of Artificial Sequence: Synthetic coding sequence
atggcctcaagcaacccaccacctcagcctgccattggagaccagctcgtgccaggagttccggggcccagtagtgaggccgaagatgatcctggggaagcatttgagttcgacgattccgatgatgaggaggatacgagcgccgccctgggtgttccaagccttgccccggaacgcgacacagatcctcccctgattcacctggattccatcccagtaacagatcccgatccagcggcagctcctcctggcacaggggtgccagcttgggtctctaatggtgacgccgcagacgccgcgtttagcggcgcccgccattcctcctggaagaggaaaagctcacgaagaatcgatcggttcacatttccagctctggaagaagatgttatctatgatgatgtgccgtgtgagtcgccagatgcgcaccagcccggagctgagcggaaccttctctatgaagacgcacacagagcaggcgccccacgccaggccgaggacctgggctggagctccagcgaattcgagtcctatagcgaagactccggcgaggaggccaagcctgaggttgaagtagagcctgcaaagcatagagtttcctttcagcccaagatgacacagctcatgaaagccgcgaagtccggaacaaaggacggattagagaaaactagaatggcagtgatgcggaaggttagctttttgcacaggaaggacgtgctgggcgattcagaggaagaggacatggggctgctcgaagtgagcgtgtctgatataaagccccctgcccccgaactgggccccatgccagaggggctgtctcctcagcaggtggtacggcgtcatatattgggttctattgtgcagtctgagggatcctacgtggagtctctcaaacgtatacttcaagactataggaatccgttgatggagatggagcccaaggccctttcggctaggaaatgtcaggtggtgttcttccgcgttaaagagatccttcactgtcattctatgttccagattgccttgtcttcccgggtggccgaatgggatagcactgagaagattggagatctgttcgtggcgtccttttccaagtcaatggtgttggacgtctacagcgattatgtcaataattttacttcggccatgtccatcataaagaaagcatgcttgacaaagcctgccttcctggaatttctcaagcgcaggcaggtgtgtagtcctgaccgagtcactctgtacggcctcatggtcaaacccatccaacgattccctcagttcatccttctgttacaggacatgttgaaaaatacccccagaggccatcccgaccgtctctcccttcagctggcgttgaccgagctggaaaccctggccgaaaaattgaatgaacagaagcgccttgcagaccaagtagccgagatacagcagctgacgaaaagtgtgtctgatcggtcttccttaaataagttgctgactagcgggcagagacagctgcttctctgcgagacactgaccgaaacagtctatggggatcgggggcaacttattaaatccaaggagcggcgagttttcctacttaacgatatgctcgtctgcgccaatataaactttaaaccagcaaatcacagggggcagctggaaatctcctccttagtgccgctgggccctaaatacgttgttaaatggaacaccgctttaccccaggtgcaagttgtggaagtgggacaggatggaggcacttacgacaaggacaatgtgctcatccagcatagtggggccaagaaagcttcagccagcgggcaggcccaaaataaggtatatctaggtcctcccaggttgttccaagaacttcaagatctgcagaaggatctcgccgttgtggagcagatcactctcctcatatcaaccctgcacgggacttaccagaacttgaacatgaccgtggctcaggactggtgcctggctctgcagaggctgatgagggtaaaggaggaagagattcactcagcaaataagtgccggctgcgtctcctgctcccggggaaacctgataagtctggaagaccaattagtttcatggtagtgttcatcaccccaaacccacttagtaagataagctgggtgaaccgcttgcacctggccaagatcggactgcgggaggagaatcagcccggatggctgtgccctgacgaggacaaaaaaagcaaggcacctttctggtgccctatcttggcctgttgtatcccggcgttctcttcacgcgctctgagccttcagctcggtgccctggtgcacagtcctgtgaattgccctcttctcggtttttcagctgtgtcaacctccctgccccaggggtatctctgggtggggggcgggcaagagggggccgggggccaggtggagatcttctctcttaatcgaccgtcgccccggacagttaaaagctttcctttagccgctccagtgctgtgcatggaatacattccggagttggaagaagaagccgaatcccgggacgaatctcccacagttgccgatccatctgcgaccgttcaccccactatctgcctgggactgcaagatgggtctattctattgtactcctccgtcgataccggtacacagtgcctggtgtcctgtcggtcccccggcctccagcccgtgctatgcctgagacatagcccctttcacctcctggcggggctgcaagatggcactcttgcggcttaccccagaactagcgggggggtcctctgggacctagaatcaccacctgtatgcctcacggtgggtccagggcccgtgcgaacgcttttaagcttggaggacgctgtgtgggctagctgcggtccatgggtgacggtcttggaggccactacgctgcagccacagcaatcgtttgaggcccaccaggatgaagctgtgtcagtgacccacatggttaaggcagggtcaggagtgtggatggcttttagcagtggaacctctatacgactgttccacaccgaaacactggagcatctgcaggaaataaatatcgccactaggaccacatttttactcccaggacaaaagcacctgtgcgtgacctccctactgatatgccaaggattactgtgggtgggcactgatcaaggtgtgattgtgctgctgcctgtacctcgattggaggggataccaaaaattaccgggaagggtatggtgagccttaatggtcactgtggcccagttgcattccttgccgtggccacaagtatcttagccccagatatcctgcggagcgaccaggaagaggccgagggtcctagagccgaggaggacaagcccgacggccaggcccatgagccaatgccagactcccacgtagggcgggagctgaccaggaaaaaaggcatcctactgcagtacagactccgctctaccgctcatcttcctggcccattactgtccatgcgagagccagctcccgccgacggcgcagcactcgagcactccgaagaagatggctcaatatacgagatggccgacgatcccgatatttgggtacgaagtcgcccttgcgcccgggatgcccatcgcaaggaaatatgctcagtggccattatctccggaggtcagggttaccggaactttgggtcagcacttggtagctccggaaggcaggcaccttgtggtgagacggactctaccctgctgatctggcaagttcctctcatgttgtag

SEQ ID NO: 132593 - DNA, 1467 bp, Artificial Sequence
  Description of Artificial Sequence: Synthetic coding sequence
atgacccaactgatgaaggctgcgaaatcaggcactaaggatggcctggagaagacccgaatggctgtaatgaggaaagtgtctttcctgcaccgcaaagatgtgcttggcgacagtgaggaggaggatatgggcctgttggaagtaagcgtgagtgacatcaagccacctgcacctgaactcggtccaatgcccgaaggcctcagcccgcagcaagtggtaaggcggcacattttgggaagcattgttcaatctgaagggagctatgtggagtcacttaagcggattctgcaagactaccgcaaccccctgatggaaatggaacctaaggccctgtctgcccggaagtgccaggtggtattttttagggtcaaagaaattctgcattgtcactctatgtttcagatcgccctctcctcgcgcgttgcagaatgggacagcaccgagaagattggcgatctcttcgtggcctctttctctaagagcatggtccttgatgtatattcggactacgttaataatttcacctccgcgatgagcatcatcaagaaagcatgtctaactaaaccggcctttctcgaattcctcaaacgcagacaagtatgtagccccgacagagtgacactgtacgggctgatggtcaagcctatccagaggtttccgcaattcatcctgctgctgcaagatatgctgaaaaatacaccaaggggccatcctgaccggctcagccttcagctcgcactgacagaattagaaaccctcgcggagaaactcaacgaacagaagaggctagcagatcaagttgcggagatccaacaattgacaaagtcggtgtctgaccggtcctctcttaataagttgctgactagcggccaaagacagttgttattatgcgagacccttacggagacggtgtatggcgatagaggacaactaatcaagagtaaggaaagaagggtattcttacttaacgacatgctagtttgcgccaacatcaacttcaagcctgcaaatcatagagggcagttggagatttccagtctcgtccctctgggacctaaatacgtagtgaagtggaatacggctctaccccaggtgcaggtggtcgaggttggccaggacgggggtacctacgacaaggacaacgtgctgatccaacactccggggctaaaaaagcgagcgcctccggccaagcgcaaaataaggtatatctcggcccgccgcgactcttccaggagcttcaggaccttcaaaaggatctcgccgttgtggagcagataactttactcatctcgactctccacggtacatatcaaaacctgaacatgacggtggcacaggactggtgcctggctttacagcggcttatgcgagtgaaggaagaagagattcacagcgctaacaaatgccgcttaagactcttactgccaggaaaacctgataaaggcacttggtcagatatgtag

SEQ ID NO: 132594 - DNA, 3204 bp, Artificial Sequence
  Description of Artificial Sequence: Synthetic coding sequence
atggcctcttctaatccccccccccagcctgccatcggagaccaattggtgcctggcgtaccagggccatcctccgaagctgaggacgatccaggggaggcattcgagtttgatgattccgacgatgaagaagatacatccgccgcacttggtgttccatccctggcccctgagagagacaccgatccacccctgattcatctggacagtatccctgtgaccgaccccgaccctgcggccgctcctcctggcaccggagtccctgcatgggtgtcaaacggggatgctgcggatgccgctttcagcggtgcgaggcattcttcctggaagcggaagtcatcccgacggatcgatagattcacttttcccgctctggaggaagacgtcatttatgatgacgtaccctgcgagtctcctgacgcacaccagcctggcgcagaacgtaacctgctgtatgaggacgctcaccgagcaggggcccctcgtcaggcagaggacctggggtggtccagctccgaattcgaatcctactctgaggactccggtgaggaagccaaacctgaggtcgaggtcgagcctgccaaacatcgagtatcctttcaaccgaaactgagtcccgacctgactcggctgaaagagaggtacgcaagaacaaagcgagatattttggcactgcgggtcggtgggcgcgatatgcaagaactgaaacataaatatgactgtaaaatgacgcagctgatgaaagccgcaaagtctgggacaaaggacgggttagaaaaaacccggatggctgtgatgaggaaggtgagtttcctccacagaaaagatgtactgggagacagcgaggaagaagacatgggcttgctggaggtctctgttagcgatatcaagccacctgctccggaactgggtcctatgcctgaggggctgtctccccagcaggtcgtgagaaggcatattcttggtagcatcgtgcagagtgaaggcagctatgtcgagagtctcaagaggatacttcaggattatcgaaatcccctgatggaaatggagcctaaagctctcagtgcaagaaagtgccaagtggttttctttcgtgttaaagaaatcctgcactgccactctatgtttcaaatcgcattaagttctagggttgctgagtgggatagcacagagaagattggggacctctttgtcgcaagttttagcaaaagcatggtcttagatgtgtatagtgactacgtcaacaatttcactagcgccatgagtatcatcaaaaaggcatgtctcactaagcccgccttcttagaattcctaaaaagaagacaagtgtgcagtcccgatcgcgtcacgctatatgggctaatggttaaaccgattcaacgcttccctcagttcattttgctattgcaggatatgctcaaaaatacccctcggggccatcctgataggttaagcttgcagctcgccttaactgagctcgagacattagctgagaagctaaacgagcagaagagactggctgatcaggtggctgagatccagcagcttacaaagtccgtatccgaccggagcagcctgaacaagctactcacaagtgggcaaagacaactgctgctgtgcgagaccttgacagagactgtctacggagaccgcggccaactgatcaaatcaaaggagcgtcgagtgttccttctcaatgacatgctagtttgcgccaacatcaattttaaggggcagctggaaatctctagcctcgtccctttagggccaaaatacgtagtgaaatggaacactgcactacctcaggtccaggtggtggaggtcggtcaagatggaggcacctatgataaagacaacgtgctgatccaacattctggtgctaagaaagccagcgcctccggccaggcccagaacaaggtgtatctcggacctccgcgactttttcaggaactccaagatctgcagaaggatttggcggtggtggagcaaattaccctgctcatatctacactgcatgggacttatcaaaatttaaatatgacagtcgcacaggactggtgtttagctttacagcgtctgatgagggttaaagaagaagagatccattcggccaacaagtgcaggctcaggctcctcctgccaggtaagcccgacaaatcaggaaggcccatctcattcatggtcgtctttattactcccaacccattgtctaagatcagctgggttaaccgccttcacttggctaaaattggcctgcgtgaggagaaccagccagggtggttgtgccctgatgaagataaaaagagcaaagcccctttttggtgccctattcttgcctgctgtatcccagccttttcctctagagccctgtctctgcagctaggcgctcttgtccacagcccggtgaactgcccactcctcggattctctgccgtcagcaccagcttacctcagggatatttatgggtcggcggcggccaagagggtgccggggggcaggtcgagatcttctccctgaacagaccctcacctcggaccgttaaaagttttccactggcagcccctgttctgtgcatggagtacattccagagctcgaggaggaagccgagagcagggatgaatcaccaaccgtggccgatccctcagctaccgtgcacccaacaatctgcctcggccttcaggacggaagtatcttactgtactcctccgtcgacactggcacacaatgtctcgtgtcttgccggtcaccaggactgcaacccgttctttgtcttagacactcaccatttcatttactggcaggattgcaagatgggacccttgctgcatatccccggacctcgggaggtgtgctctgggacctggagagccctccggtctgccttactgtcggcccaggccccgtccgaaccctgttgtctttggaggacgctgtttgggccagctgcggaccttgggtgaccgtactcgaggccaccacactgcagccacagcagagcttcgaagcccatcaggatgaggcggtatccgtcactcatatggtgaaggcagggtcaggagtgtggatggctttttctagcggtaccagcatccgtctctttcacacagagaccctcgaacacttgcaggaaattaacatcgctacaagaacaaccttccttttaccggacagaagcctgatcaagtgctcaccccgggcatag

SEQ ID NO: 132595 - DNA, 3723 bp, Artificial Sequence
  Description of Artificial Sequence: Synthetic coding sequence
atggcctcatccaacccgccaccacagccggccatcggtgatcagttggtgcctggggtccccgggccttcctcagaagcagaggacgatcctggtgaggcttttgaatttgatgatagtgatgacgaggaagacacatcagctgctctgggtgtcccttctctggcaccagagagggacaccgatccacctctgatccacctggactccattccggtgactgatccggatcccgccgccgcccctccaggtaccggggtcccagcctgggttagcaatggagacgcagccgatgcagccttcagcggcgcccgccacagttcctggaagcgaaagagttcacgcagaatcgaccgctttaccttcccagctctagaggaggacgttatctacgacgatgtgccatgtgagtctccagacgcccaccaaccgggcgcagaacggaacctactttacgaggacgctcaccgggcgggcgccccacggcaggccgaagatctgggttggtccagctctgagtttgaatcttatagcgaggactctggagaagaagcaaaacccgaggtggaggtagaacctgcgaaacacagagttagcttccagcctaagatgacacaactaatgaaagctgctaaatcagggaccaaggacggcctggagaagacccgcatggccgtgatgcgcaaggttagcttcctccacagaaaggacgtgctcggagattcggaagaggaggacatgggcctactcgaggtgagcgtgagtgatattaagccacctgccccggaattgggtccgatgcctgagggtctcagcccacagcaggtggtgcggcgacatatactaggcagcattgtccagtccgaaggcagctacgtcgagtccctgaagcggatcctccaggattatcgaaaccctcttatggaaatggaaccgaaggcccttagcgcgaggaagtgtcaggtggtcttttttcgggtcaaggaaatattgcattgccactctatgtttcagattgcattgtcctcacgggtggctgaatgggatagtactgaaaaaattggcgaccttttcgtggcttctttctctaaaagcatggtgttggatgtctactcagattacgtgaataacttcacgagcgcgatgtcaattatcaagaaagcatgcctcacgaagcctgcctttctcgaatttcttaagcgtagacaagtctgctctccagatagggttactctgtacgggctcatggtcaaacccatacagaggtttccgcagtttatactcctgctccaggacatgctgaaaaacactccccgcggacatcccgaccgactgtccctacagcttgccttaacggagctcgaaactcttgcagaaaaactgaatgaacagaagaggctagcagatcaggttgcagagattcagcaactgactaaatcagtctccgacaggtcttcactgaataagctgctgactagcgggcagagacagctgctgctttgcgagaccttaacagaaacagtttacggcgaccgggggcagctgatcaagtccaaagaacgtcgcgtgtttctgctgaatgacatgctggtgtgtgccaatatcaattttaagcctgccaatcatcggggccagttagagattagttctctggttcccctcggaccaaaatatgtggtcaaatggaatactgctctgccacaggtacaagtggtggaggttgggcaggacggtgggacctatgacaaggataatgtgctaattcagcactccggggcaaagaaagcctcggcgagcgggcaggcccaaaacaaggtgtacctagggccccctcgattgtttcaggagctgcaggatctccagaaagatctggcagtggtcgaacaaatcaccttactgataagtacactccatggtacttaccaaaatctcaacatgaccgtcgctcaggactggtgcttagcactgcagcgtctcatgcgggtaaaggaagaggagattcacagtgccaacaagtgtcgtctaaggttgttactccccggcaagcccgacaaatccggaaggcccatctcttttatggtggtgttcatcactccaaaccctctcagtaagatcagctgggtcaaccgcctccaccttgcgaagattggcctgagagaagagaaccagcccggctggttgtgtcccgacgaggacaagaaatctaaggccccattctggtgtcccatcctcgcctgttgcatcccggcatttagctcccgagccctgtctctgcagcttggggcgttagtgcatagccccgttaattgtccgctcttgggcttctctgccgtttcaacatccctgccgcagggctacctgtgggtcggcggaggccaagaaggcgccgggggccaagtcgagatattctccctgaatcgtccatcaccacggaccgtcaagagctttcctctggccgcacctgtcctgtgtatggaatacatacctgagctcgaggaggaggctgaatcaagggacgaaagcccaaccgtggccgatccctcagccactgtccatcccactatatgtctgggccttcaggatgggtctatcctgttgtatagcagtgtcgacaccggaactcaatgtctagtcagctgcagaagcccgggactccagcctgtcctgtgcctgcgccactcacctttccatcttctggccggcctgcaggatggaaccctggccgcctacccaaggactagcggcggggtgctgtgggatctggaatcccctcctgtgtgtctgactgtgggtcccggaccagtgcgaaccctcctgtctctggaagatgcagtgtgggcctcgtgcggtccgtgggtaactgttctcgaggccactacccttcaaccccagcagtcattcgaagcacaccaggatgaagcggtgtcagtcacacacatggtgaaggctggctcaggggtttggatggcattctccagcgggacaagcatacgcctgtttcatacagaaactctggagcatctgcaagagataaatattgctacgcggactaccttcctgctgccgggccagaaacatctgtgtgttacttccctgctgatttgccagggactgctgtgggtcggcactgaccaaggagtgatagtcctcctgccagtgccgcgcttagaggggatcccaaagatcactggaaaaggaatggtgagcctcaacggccactgcggcccagtagcctttctggcggtggccacctctatcctggcccctgatatactgcgatctgatcaggaggaagccgagggcccacgcgccgaagaagataaacctgacggtcaggcccacgagccgatgcccgactcacatgtcggccgggagctcaccaggaaaaaaggtatactcttgcagtacagactgaggtccacagcccacctgcccggcccgctgctgtcaatgcgcgagcccgcacccgccgacggggctgcgctcgaacactccgaggaagacggcagtatttatgaaatggccgatgatccggatatctgggtgcgatcacggccctgcgcccgggatgcccataggaaggaaatctgctctgtcgctatcatctctggggggcaggggtatcggaatttcggcagcgcactcggctctagcggccggcaagcaccttgtggtgagactgatagcaccttactgatatggcaggtccccctgatgctttag

SEQ ID NO: 132596 - DNA, 3129 bp, Artificial Sequence
  Description of Artificial Sequence: Synthetic coding sequence
atgcttccttcttcttcatgggggaagagaaagctgcgcgggcgcctgggttgggtgcgctccgatgctcgtggcgtaatgtgggcccgccaggagggcctgcatcaccctcatcctcatgcagtcatcagatgccccagttcctcttcctcttcggtgtcctgcagcggggattctgaagaggaggacatggggctgctcgaggtgagcgtatctgacatcaagccccctgccccagaactgggtcctatgccggaaggactgtcgcctcagcaggtggtgcgaagacacatactcggttccatcgtgcagagcgagggctcctacgtggagtctctgaaacggatccttcaagattaccgaaatcctctcatggaaatggaaccaaaagcactgtcagccagaaagtgtcaggttgtgttttttcgggtaaaggagatcctgcactgccactcaatgtttcaaattgcgctcagtagtcgtgttgccgaatgggatagtactgaaaagattggagacttgttcgttgcctcgttcagcaagagtatggtgcttgacgtgtactccgactatgttaacaattttacctccgccatgagtattattaagaaggcgtgtctgaccaaaccagcctttttggagtttctgaagcgccggcaggtgtgtagccccgatagagtcacattgtacggccttatggttaaacctattcagcgcttcccacagtttatcctgcttctccaggatatgttaaagaatacccctagagggcaccctgatagactgtccctgcaactggcgctcacggagcttgaaaccctcgccgagaagctgaacgagcaaaagcgattagccgaccaggtcgcagagattcagcagctaaccaagtcagtaagcgataggagctcactcaataagctgctaaccagcggccaacgccaactactgctgtgtgagacactgacggagaccgtgtatggcgatcggggccagttgatcaaatcaaaggaacggcgcgtgttcctgctgaacgatatgctcgtttgtgcaaacataaactttaaaggacagctcgaaatcagctcgctggtccccctgggccctaagtatgtcgtaaaatggaacacagctctccctcaggtccaggtggttgaggtcgggcaagatggtggcacatacgacaaagacaacgttttgatccagcactctggggcaaagaaggcaagtgcatccggtcaggcgcagaacaaggtatacttgggaccgccacgtctgtttcaggaattgcaggatctgcagaaggaccttgccgttgtagaacagatcactttgcttatcagtacgctccacggtacatatcaaaatctcaacatgactgtagcccaggattggtgcctcgccctgcagcggctgatgcgcgtgaaagaagaggaaatccactccgccaataagtgcagactaagactgctgctccccggcaagcctgataaatcggggagacccatcagttttatggtcgttttcattacaccaaacccgctgtccaagatctcttgggtaaatcgactccacctggctaagatcggcctgcgcgaggaaaatcaacccgggtggctttgccccgatgaagataaaaagtccaaggcccctttctggtgccctattcttgcgtgctgtattcccgccttctcaagtcgcgctctgagcctgcagctgggcgcactcgtacactctccagtgaactgtccactgctgggcttttcagccgtgagtacatcattgccgcagggctacctttgggtgggtggaggccaggaaggggctggcggccaagtggagatttttagccttaaccgaccgtcacctcggacagtgaagagctttcctctggcagcgccagtactgtgtatggaatacattccggaactggaggaagaagccgagagtagagacgagtctccgactgtcgcggacccgagtgctacggtacatccaacaatctgcctgggcctgcaagatgggagtatcctgctgtactccagtgttgacactggcacacaatgcttagtgtcttgccgcagtcccgggctacaaccagttctctgcttgcgacattcacccttccacctgctagccggtcttcaggacgggacactagccgcctatccacggacttctgggggagttttgtgggacctggagagtccccctgtctgtctgaccgtgggtcctggtccggttcggacgctcctgtctctggaagacgccgtctgggctagctgcggtccatgggtcactgttctggaagcgacaacgctgcagccccagcaaagttttgaagcacaccaggacgaggcggtgagtgttacccatatggttaaggccggaagcggagtgtggatggccttcagttcgggaaccagtatacggcttttccacacagaaacactggagcatttgcaggaaatcaacatcgcaacgaggactaccttcctcttacccggtcagaagcacctgtgcgttacatccctactaatctgtcagggcctgttatgggtggggactgaccagggcgtcatagtgctgttgccagtgccaaggctcgaggggataccaaaaatcactggtaaggggatggtgagtctcaatggacattgtggtcctgtggcattcctggctgtagccaccagtatcctcgcccccgatattttgcgctctgaccaagaggaggccgagggccctcgcgctgaggaggacaaaccagatggccaggcccatgagcccatgcctgatagtcacgtcggtcgcgagctgacaagaaagaaaggaattctgctccagtaccgtcttaggagcaccgcccatctgcctggaccactgttatccatgcgggaacctgctccggcagacggagcagctctggagcactcagaggaagatggatccatctacgagatggcgttttttttaaaggccaaaaacactaagccacataactgcctcgctagtccggttagccttgtttgggccttagctggactgcagggaagccacactccactcctggaaggttgcgtgcgggtttccgtgtgcgaatgcgtcggctggtgcgtgaacatctacaagtag

SEQ ID NO: 132597 - DNA, 4578 bp, Artificial Sequence
  Description of Artificial Sequence: Synthetic coding sequence
atgtctgggacgcaatctactatcaccgatcggttcccactcaaaaaacccatcagacatggctccattcttaatcgcgagagtcccaccgataagaaacaaaaagtggagcggattgcctctcatgacttcgacccaacagggttagtgcagcggtgtgttataattcagaaggacgataatggatttggcctgacggtctctggcgataaccctgtgttcgtgcagtccgtgaaggaggacggcgctgctatgagggctggcgtgcaaactggggatcgaataatcaaggtaaacgggactttggttacacactctaatcaccttgaagttgtgaaactcatcaagagcggttcctatgtggcactgacagtgcagggtcggccccctgggagtccccagatccccttagccgactccgaggtagagccttctgttatcggtcacatgagccctatcatgacctccccacacagcccaggtgctagcggtaacatggaacgcatcaccagccctgtgctgatgggcgaagaaaataacgtcgttcacaatcaaaaggtcgagatcctcaggaagatgctgcaaaaagagcaggagcggctccagctgttgcaggaagactacaaccgcactcccgcccagagactactcaaagagatacaagaagccaagaaacatataccccagttgcaggagcagctcagcaaggccactggcagtgcccaagacggggcagtggtcacaccgtctaggccgctcggggataccttaacagtgtcagaagcagagaccgaccctggtgatgtgctgggacggacagactgttcgagtggggacgcctcaagaccatcctctgacaacgcagactcgcccaaatcaggcccaaaggagaggatttatttggaggagaatcctgaaaagagcgagacaatacaggacactgatacccagtcactggtaggttccccttccactcggattgctccacatatcattggggccgaggatgacgacttcgggactgagcacgagcagatcaatgggcagtgtagttgctttcagagtattgaactcctcaagagtagaccagcacacttggcagtttttcttcaccatgtagtgtcccagttcgaccctgctactctgctttgttacctttatagcgacctgtacaagcacaccaattctaaggagaccagaagaatttttttggagttccatcaattttttctcgacaggtctgctcacctgaaagtgtctgttcccgatgagatgtccgccgacttggagaaaagaaggcccgaactcataccggaggacctccaccggcactacattcaaactatgcaggagcgagttcaccctgaggtgcagagacatctggaggactttcggcagaaaagatctatgggcttgaccctggccgagtctgagttaaccaagcttgacgccgaacgtgacaaagacaggcttaccctggagaaggaacgtacctgtgccgagcaaatagtagctaagatcgaagaggtactgatgactgcgcaggccgttgaagaagataaatcttccaccatgcagtatgtgatcctgatgtatatgaagcacttaggagttaaagtgaaggagcctaggaacctggagcacaagaggggtcgtatcggtttcctgcccaagatcaagcagtccatgaaaaaagataaggagggcgaggagaagggcaagcgacggggttttccctctatactggggcctccacgccggcccagtagacacgataactctgctattggccgggccatggagttacaaaaggccagacaccctaagcacctgtcaactccatcaagcgtctctccggaaccccaggactctgctaaactgcgacagagcggtctcgctaacgaggggaccgatgccggttacctgccagccaacagcatgtcctccgtagccagtggcgctagttttagccaagagggcggaaaggagaatgacacagggtccaagcaagtaggagaaacgtccgcgcctggagacactcttgacgggacaccgagaactttaaataccgtttttgactttcctcctccgcctctggaccaagtgcaggaggaagaatgtgaggtagagagggtgaccgaacacgggacccccaaaccattccgaaaattcgactccgtggcctttggcgaaagtcagtcagaggacgaacagtttgagaacgaccttgaaaccgatcctccaaactggcagcagcttgtgtcccgtgaagttttgctgggcctgaagccttgtgagattaagcgacaggaggtgattaatgagttattctatactgagagagctcatgtaagaactctgaaagttctagaccaggtgttttatcagagggtgtccagggagggcatcttgagtccctcagagctgaggaagattttctcgaatctggaagatatcctccagctgcatattgggcttaatgaacagatgaaagccgtgcggaaacgcaatgagacgtctgtcatcgatcagatcggcgaagatctattaacttggtttagtggtcccggcgaagaaaagctgaaacatgccgccgctacattttgctctaatcagccattcgcccttgaaatgattaagtccaggcagaaaaaggattcaaggtttcagacctttgttcaggatgctgagagcaatcctctgtgcaggagactgcaactgaaggatatcatacctacacaaatgcagcgccttacaaagtaccctctcctgctggataatattgccaagtacaccgagtggcccacagaacgggaaaaggtgaaaaaggccgcagatcactgccgccagatcctgaattacgtcaatcaggccgtcaaagaggcagagaataaacaacgtctcgaggactatcagagacgccttgacacgtcttcccttaaactctctgaatacccgaatgtcgaggaattgcgtaatctggacctaactaagagaaagatgattcatgaaggcccccttgtgtggaaggtgaacagggacaagaccatcgacctgtacacgctgcttctcgaggatattctggtcctcctacagaaacaggacgacagactggtcctgagatgccatagtaaaattcttgcctctacagcagacagcaagcacacattctctccggtgatcaagctgagcaccgttctagtgcgccaggtggccactgataataaagccctcttcgttatctcaatgagtgacaatggggctcagatatacgagcttgtggcccagacagtttccgagaagacggtttggcaggacctgatctgtcggatggctgcctcggtgaaagagcagtctaccaaaccaattccattgccccagtccacacccggcgaaggtgacaacgacgaagaggacccaagcaagttgaaggaagaacagcatggcatttcagttacaggcctgcagtcccctgaccgggacctcggacttgagtccacactcatctcttcaaagccacaatcccactcccttagcacctccggtaagagtgaagttagagacttgtttgtagctgaacgccagttcgcaaaagaacagcacaccgacgggactctcaaagaagtcggcgaggactatcagattgccatccctgactcacaccttcccgtcagcgaagagagatgggcgctggacgctcttcggaacctcggattgctcaaacaactgctggtacagcagctgggccttaccgaaaagtccgtccaggaagattggcagcatttcccacgctatcgaaccgcctcccaagggcctcagaccgactctgtgatacaaaatagtgaaaacataaaggcttaccactcgggcgaaggtcacatgccattccggacggggacgggcgacattgcaacctgctactccccccggacaagcacagaatctttcgcccctcgggattctgtgggactggccccacaggacagtcaggcttcaaatatcttagtgatggaccatatgatcatgacaccagagatgcccactatggaaccagaagggggactggatgatagcggcgaacatttttttgatgctcgcgaggcccactcagatgagaatccgagcgagggggacggggctgtgaataaagaagaaaaggatgtgaatctgcgcatttccggtaattacctgatccttgacggttacgacccagtgcaagaatctagcactgatgaagaagtcgccagctccttgaccctgcaaccaatgacaggcatcccagccgtggaaagtacacatcagcagcagcattctcctcaaaatacacattcagatggagctatttcccccttcacacctgagttcctcgtccagcagagatggggggcgatggagtactcctgttttgagatccagagtccgtcatcttgtgcagactctcagtctcagatcatggagtatatacacaaaatcgaggccgatctggagcatcttaaaaaagtggaagaaagctatactattctgtgtcaacggctggctggatctgcactcaccgacaaacacagcgataagtcttag

SEQ ID NO: 132598 - DNA, 4635 bp, Artificial Sequence
  Description of Artificial Sequence: Synthetic coding sequence
atgtccggtacacaatccacgatcacggaccggtttccactcaagaagcccatacggcatggctctatcctgaaccgagagtcaccaacagacaaaaagcagaaagttgagagaattgcctctcacgacttcgatcctacggacagctccagtaagaagactaagtcaagtagtgaggagagtcgatctgagatttacggcctcgtccagcgatgtgttattattcagaaagacgacaacggcttcggactgactgtcagcggtgataatccagtgtttgtgcagagcgtgaaggaagatggagcagccatgagagccggggtgcaaacgggggaccggattatcaaggtgaatggcactctggtgacccattccaatcatctcgaagtggtcaaattgatcaaatcgggctcctatgtcgccctgaccgtccaggggaggccaccaggaagtccccagatacctctggcagatagcgaggtagagccctctgtcatcgggcacatgtctcccattatgactagccctcatagccctggggcttcaggcaacatggagaggataacaagtcctgtactgatgggtgaggagaataacgtggttcataaccaaaaggtagagattctgaggaagatgctccagaaggagcaggagcgcctccagctgttacaggaagactataatcggaccccagcgcaacggttactaaaagaaatccaagaggctaaaaagcatataccccaactccaagagcagttgagcaaggccacagggagcgcccaggatggagctgtcgtgacccccagccgcccccttggtgacacgcttacggtctcagaagcagaaacagacccgggtgatgtactgggcaggacagactgctcctccggcgacgcatctcgcccttcaagcgacaacgccgacagcccaaagagtgggcccaaggagagaatctaccttgaagagaacccagagaagtcagagaccatacaggacaccgatacacagtcactggtcggctctcctagtacgaggattgccccgcatatcatcggagctgaggatgacgactttggtactgaacacgagcagattaatggacagtgcagctgcttccaatctattgagctcttaaagagtaggccggctcacctcgccgtctttctccatcatgtagtgtcgcaattcgatcctgcaactcttctttgttacctgtacagcgatctgtataaacatacaaattccaaggagaccagaagaatctttctcgagtttcatcagttctttctggaccgcagcgctcacctgaaggtaagtgtgcctgatgagatgagcgccgatctggaaaaacgaagaccagagctgatccccgaggatcttcatcgccattatatccaaaccatgcaggaacgcgtgcatcctgaggtccagcgacaccttgaggatttccgacagaagagatccatgggactgaccctggcggagtcagaactgactaaactggatgccgaaagagataaagataggcttacgctggagaaagagcggacctgcgccgaacagatcgtcgccaagatcgaagaggtactgatgaccgcgcaggcagtcgaagaggataagtcctccaccatgcagtatgtcatcctgatgtatatgaagcaccttggagtgaaggtaaaggagccaaggaacctagagcataaacgggggaggattggattcctccccaaaatcaagcagagcatgaagaaggacaaagagggcgaggagaaggggaagagacgcggattcccatcgattctaggacctccccggcggccatctaggcacgacaattcagccatcgggcgtgcaatggagttgcaaaaggctagacatcccaaacatctgtccacgccatcttcagtctctcctgagccgcaggactctgccaaactgcgtcagagtggcttggcaaacgaaggcacagacgcaggataccttcctgcaaattctatgtcttccgtggcttctggtgcttcatttagccaggagggaggaaaggagaatgacactgggagcaagcaggtgggggaaaccagcgcccctggggataccctcgatggtacgccgcgtaccctaaacaccgttttcgactttcctcccccccctctcgaccaggtacaggaggaagaatgtgaagtcgagagggtcactgaacacggcaccccaaagcccttcagaaagtttgacagtgtggcattcggagaatcccaatccgaggatgagcagtttgagaacgatcttgagaccgatccccctaactggcagcagctggtctctcgagaggttctcctgggcctcaaaccatgcgagatcaaacgccaggaggttattaatgaattattctatacagagcgggcacacgtgcgcacactgaaggttctggatcaggttttctatcagcgcgtgagtagggagggtatcttgagcccctctgagctgcgaaaaatctttagcaacctcgaagacatcttacagctgcacattggcctgaatgagcagatgaaggccgtgagaaagagaaatgagactagcgtcatcgatcagatcggtgaagatttgttgacttggttcagcggccccggggaggagaagcttaaacacgccgccgctaccttttgctcaaaccagccgttcgcgctggaaatgatcaagtcaagacagaaaaaagatagtcgcttccaaacattcgtgcaggacgccgagtctaatcctctttgtcgccgactccaactgaaagacatcattcctacacaaatgcagcgcctgacaaagtatcctctgctgctcgataacattgccaagtataccgagtggcccacagagcgcgaaaaggttaaaaaagccgctgatcattgccgacaaatactgaattacgtgaaccaagctgttaaagaagcagaaaacaagcaaaggctggaggattatcagagaagactggacacgtcaagcctgaaactctctgaatatcccaatgtggaggagctccggaaccttgatcttacaaaacgaaaaatgattcatgagggccccctcgtgtggaaagttaacagagataaaacgattgacctttatacccttttgctcgaggatatcctggtgctgctccagaagcaggatgaccggctagtgctgcggtgccactcaaaaatcttggcctccacagccgattccaagcacaccttctcaccagtgatcaagctatctacggtcctggttcggcaggttgcaacagacaataaggccttattcgttatatccatgtctgataacggtgctcagatttatgagctcgtggcccagacagtgtcagagaaaactgtatggcaagacttaatctgtcggatggccgctagcgtgaaggagcagagcactaaacccatacccttgccccagagcacgccaggagagggagataacgacgaggaggatcccagcaaactgaaggaagaacaacacggtatctcagtaaccggcctgcagtcaccagatagagatctcggcctggaatccaccctgatatcctctaagcctcaaagtcattcgttgtctaccagcggcaagtccgaagtcagggacctcttcgtggccgaaaggcagttcgcgaaagagcaacacaccgatggcactctgaaagaagtcggtgaagactaccagattgctatccccgactcccatctacccgtctctgaggagcgctgggccctcgacgcactgaggaacctgggcctgttaaaacagctcctggttcagcagctgggattgacagaaaagtctgtccaggaagactggcagcatttcccaagataccggacagcatcgcagggaccacagaccgacagtgtgatccagaattccgagaatatcaaggcttaccacagcggcgagggccacatgccgttccgcaccgggaccggagacattgctacctgctatagccctcgaacctccaccgagtcgttcgcccccagggatagtgtgggacttgccccacaggatagccaagcttctaacatccttgtcatggaccacatgattatgacaccagaaatgccaactatggaacccgagggcggcttggacgactcgggggaacacttcttcgacgcccgggaagcccactctgatgagaaccccagcgaaggcgacggagccgtgaataaagaagaaaaggatgtgaacttgcggatctcaggcaattatttaatactggacggctacgatcctgtccaggagtcctccaccgacgaagaggtggcctcgtccttaacgctgcaacccatgaccgggatacccgccgtcgaaagcacacaccagcagcagcattctccccagaacacccatagcgacggcgccattagtcctttcacaccagagtttctggtgcagcagaggtggggagccatggaatacagctgctttgaaatccagagtccatcaagctgcgccgacagccagagtcaaataatggaatatatccataagattgaggccgatttggagcatctgaagaaagttgaggagtcttacactattctgtgccagcgactcgcaggcagtgcccttaccgataagcattcagataaatcgtag

SEQ ID NO: 132599 - DNA, 2409 bp, Artificial Sequence
  Description of Artificial Sequence: Synthetic coding sequence
atggactgcggccctcctgctaccctccaacctcatctcacaggaccaccagggaccgcccatcaccccgtggccgtctgccagcaggagtctcttagcttcgccgaactgccagcattgaagccaccatctcccgtttgcctggacttatttcctgtggcgccagaagagctcagagcccccggctcccggtggagtctcggcaccccagccccactccagggtctactctggcctctgagtcccgggggtagcgacaccgagatcacctcgggaggtatgcgcccgtccagagccggatcttggcctcattgcccaggcgctcagcctccagccctggagggcccatggtctcctaggcacactcagcctcagcgtcgcgcctcccacggaagtgaaaaaaaatccgcatggagaaagatgagagtctaccaacgtgaggaggtccccgggtgtccggaggcccacgccgtcttccttgagccaggtcaagtcgtgcaggagcaggccctgtctaccgaggagccccgggttgagctgtccggatccacgcgcgtcagtctggaaggacccgagcgccggcgcttcagtgcctctgaattaatgactcggctccactcgagccttcgattggggcgcaactctgccgctagagccctgatatctggctccgggacgggagctgcccgggaaggtaaggccagcggtatggaggcacgctccgtggagatgtccggggacagggtgagcaggccggcaccgggggactcacgggagggagactggagcgaaccacgactagacacccaggaagagcctccactagggtcgagaagcacgaatgaacgtcggcaaagcaggttcttattaaactccgtgttatatcaggagtacagtgacgtggcctccgctcgcgaacttaggcgtcaacagagagaggaggaggggcctggagatgaggccgagggcgccgaggaaggaccaggcccacccagggccaatctgagcccctcctcttcctttagagcgcaacgttccgcccggggcagtactttctctttgtggcaggacatccctgatgtacgggggtccggagtgttagccactctgtccttgcgtgactgtaaactccaggaggccaaatttgaacttatcacttccgaagctagctacatacacagcctgtcagtcgccgtggggcatttccttggctccgcagagttgagtgagtgcctgggagcccaagataaacagtggctgttcagcaaacttccagaggtaaaaagtacttcggaacgtttcctgcaagacctggagcaacgactggaagctgatgtcctcaggttcagtgtgtgcgatgtagtgttggatcactgtccagcctttaggcgggtgtacctcccttatgtgacgaaccaggcctaccaggagcgcacataccaaaggctcttactggagaacccaaggtttcctggtatcctcgcacgactggaggaaagtcctgtgtgtcaaaggctgccgctgactagcttcctaattctccctttccagagaatcactagactaaaaatgctggttgaaaacatcctgaaaagaaccgcacagggatctgaggatgaggacatggcaacgaaggcatttaatgctctaaaggagctcgtgcaggaatgtaatgcttccgtccaaagtatgaagcgaacagaagagctcattcatctgagcaaaaaaattcatttcgagggaaaaatcttcccattgatttcccaggcaaggtggttggtccgccacggcgagctggtggagctggcgcctctgcccgctgctcctccagccaagttaaaactgtccagcaaagccgtgtatctccacctgtttaatgattgcctactactcagtcgaaggaaagagctcggcaaatttgctgtatttgtgcatgctaaaatggcggagctacaggtgcgagatctatccttaaagctacaaggcatccctggacatgtgttccttctacagctgcttcacggacaacacatgaagcaccaattcttgctgagagcccgcacggaaagtgaaaagcagcgatggatctcagcactctgccccagcagtccgcaggaggacaaagaggtgatttccgaaggagaagactgcccccaggttcagtgcgttagaacttacaaggctcttcaccccgatgagttgacgctggaaaagaccgatattctcagtgtcagaacttggacctcggacggctggctggaaggcgtaagactggcagatggcgaaaaaggctgggtgcctcaggcctacgttgaagaaatctcctctttgtcagcacgtctgcgaaatttacgcgagaataagagggtgacatccgctacttcaaaactgggagaggccccggtttag

SEQ ID NO: 132600 - DNA, 1575 bp, Artificial Sequence
  Description of Artificial Sequence: Synthetic coding sequence
atggattgcggacctccagcaacccttcagccccatctcactggtcccccgggcaccgcacatcaccccgtagccgtctgccagcaggagtcgctcagttttgccgagttgccagcactgaagccaccaagtcccgtttgcctcgacctgttccctgtcgcccctgaggagttacgcgctcccggatcacgctggagcctgggcacgcctgctccattgcagggtctcctgtggcccctctcacccgggggtagcgatacggaaatcactagtggaggcatgagaccctcccgcgccgggagctggcctcattgccccggagcccaaccacccgccttggaaggcccttggtcccctcggcacacccaaccgcagcgtagggcatctcacggatctgaaaagaagagtgcttggagaaagatgcgcgtgtatcagcgggaagaggtgccaggttgccccgaagcacacgccgtgtttttggaacccgggcaggtagtgcaggagcaggctcttagcacagaagaaccaagagtggaactgtcaggcagcaccagggtctcactagaggggcccgaacgccgcagattttcagctagtgagctgatgacccgcctccattcaagcttgcggctgggccggaattctgcggcaagggccctgatctcagggtctgggactggcgcagcccgagaagggaaggctagtggtatggaagctcgctcagtcgaaatgtctggggaccgggtctcccgacctgctccaggcgactcacgggaaggagattggtctgaacctcggctcgacacgcaggaggagcctcctctcggatcaaggagtacaaatgagcgccgtcagtccaggtttttgctaaacagtgtgctgtaccaggaatatagcgatgtagccagtgcgcgcgaattaaggcgacagcagagagaagaagaaggtcctggcgatgaggcggagggcgccgaagaaggccccgggccccctcgggcaaatctttccccgtcttcctctttccgagcccaaaggtctgctagaggcagtaccttttccctgtggcaggatatccctgatgtgcgaggttctggcgttttggccacccttagcctgcgcgactgcaagctccaggaggccaagttcgagcttatcacctccgaagcgtcctatatacattccttgtccgtggccgtaggccattttctaggcagtgccgagttgtccgaatgcttgggtgcacaagataaacaatggctcttcagcaagttacccgaagtgaagtccacctccgaacgtttcctgcaggacctggaacaaaggttggaggcagatgtcctgagattctcagtatgtgatgtagtcctcgaccattgccccgcatttcggcgcgtatacctcccttatgtcactaatcaggcataccaggagcggacctaccagaggcttcttctggagaatcccaggttcccggggattctggcaaggctggaggaatcacccgtgtgtcagcggctaccgctgacctcctttctcattctccaaccacccgggggtcagggtgggcaccaatag

SEQ ID NO: 132601 - DNA, 1509 bp, Artificial Sequence
  Description of Artificial Sequence: Synthetic coding sequence
atggattgcggacctccagccacactccagccccatctgacgggtccccccggtaccgctcaccatcccgtagcggtctgccagcaggaaagcctatcattcgcagaattaccagcactgaagcccccttcccctgtctgtttagacctgtttcccgtcgcgccggaggaactgcgagctccaggtagccggtggtcgcttggcaccccagccccactgcaggggctcctatggcccctgtcacccggcggtagcgacaccgaaattaccagcggggggatgcgtccttctcgggccggaagctggccgcattgtccaggagcccagccccctgctctcgaaggtccgtggtccccaagacacacccagccccagagaagggcctcccatggctccgaaaagaaatccgcctggcggaaaatgcgtgtctaccaacgggaggaggtgccaggctgtccggaagcacatgccgtgtttctggagccaggtcaggtggtgcaagagcaagccttatcaacagaggagccaagggtggagttatcaggttcgacccgcgtgtcactggagggtccagaacgccggcggtttagtgcctctgagctgatgaccaggctccactccagccttaggcttggaaggaatagtgcagccagggccctgattagtggttctggcactggagcagcgcgagaaggcaaagcctcggggatggaggctagatcagtcgaaatgtccggcgatagggtgagcaggcccgccccaggcgactcccgagagggcgattggagcgaaccgcgtctggatactcaggaggagccccccctgggcagtaggagtacaaatgagcgacgccagtccagattcctccttaacagcgtgctctatcaggaatattctgatgtggcatccgcccgcgagttaaggcgtcagcagagagaagaggaaggcccaggtgatgaggcagagggggccgaagaagggccaggccctccacgcgccaatctgtccccctcatcgtcttttagagcccagcgcagcgcaagaggcagcacgtttagcctatggcaagacattccagacgtgcgggggtcaggcgtgttggctacgttgtctctgagggactgcaaactgcaagaggctaaatttgaactgatcacttccgaagctagctacatccattcccttagcgtcgccgtggggcacttcctgggatctgcagaactctccgaatgcttgggcgcccaggataagcaatggctgttcagcaagctgcctgaggttaagtctacttccgaacgcttcttgcaagatctcgaacagcggctggaagccgacgtactgaggttttccgtgtgcgacgttgtgctcgatcattgccccgcattccggagggtgtatctcccatacgtgactaaccaggcatatcaggaaaggacctaccagagattactgagggaaaacaaacgagtaaccagcgccacttctaagttgggagaagcccccgtctag

SEQ ID NO: 132602 - DNA, 504 bp, Artificial Sequence
  Description of Artificial Sequence: Synthetic coding sequence
gagcgcttggcccaattccctgccgctggccggggcagccccgggccgcctggggcaaggctgggcgttggtctggaaaaaggaagaggccgggaagtgtggaggccaggagtttggggttgcgaagcccgcgcttcagaagtgaattggagttgccctttcgatccagtctgcgccctgcctcaggcgaagttcgagctaatcacaagtgaagcttcgtatatccacagcctgagcgttgccgtggggcattttctggggtccgcggagctgtctgagtgcctgggcgcgcaagacaagcagtggctcttttccaaattacctgaagtgaaaagcaccagtgaaaggttcttacaggacctcgagcagcgccttgaggcagatgtgcttagattttcagtatgtgacgttgtgctggaccactgtcctgcgttccgccgtgtatatctcccatacgtgacaaatcaggcctatcaagagcgcacttatcagagactgttatag

SEQ ID NO: 132603 - DNA, 924 bp, Artificial Sequence
  Description of Artificial Sequence: Synthetic coding sequence
tgacgtgatcggggacaagagcggttagctcagttcccagccgcagggaggggatctcccggcccgcctggagctcgccttggggttggactcgaaaagggacggggtagggaagtatggagaccaggagtatggggatgtgaagcgcgggctagtgaggtgaactggagctgccccttcgatcctgtttgtgcactgccgcaagccaaattcgaattgatcaccagcgaggcctcctatatccatagtctctctgtagccgtcggccactttctgggcagtgcggagctatcagaatgtttaggtgctcaggataaacagtggctcttcagtaaactgcccgaggtgaagagtacatctgaaagatttctgcaggacctcgagcagcgactggaagccgacgtgctacgcttctcagtgtgtgatgtggtgctggaccactgccccgccttccgccgggtgtacctgccctatgtcacgaatcaagcttatcaggagaggacttatcagcgccttttgctggaaaatccccggtttccaggaatcctcgctagattggaagaatctcctgtctgccaacgattacccctgaccagtttcctaattctacccttccagcggatcacacgtctcaagatgctggtcgagaacatactgaagcgtaccgcccaggggtcggaggacgaggacatggcaactaaagcctttaatgctctcaaggagctggtgcaggagtgcaatgccagcgtgcagtccatgaagcgcacggaagaactgattcatctctccaaaaagattcacttcgagggcaagatctttcctcttatctcccaggcccggtggcttgtacgccacggagagctggtggagctcgcgccactgccagcggcacctccagctaaactcaagctttcatccaagtag

SEQ ID NO: 132604 - DNA, 1581 bp, Artificial Sequence
  Description of Artificial Sequence: Synthetic coding sequence
atggtggcgaaggattatcctttctatctgactgtgaaacgggctaattgctccctcgagctgcctccagcgtcgggacctgcaaaagacgccgaagaacctagtaacaagagagtgaaaccactcagtcgtgtgacatccctcgccaacctgatccctcctgtgaaggccacacctttaaaacggttttcccagaccctgcagaggagcatttcattccgctccgagagcaggcccgacatattggcccctcgcccctggagtaggaacgccgccccttcttcaaccaagcgcagagactccaagctgtggagcgaaacctttgacgtgtgcgtgaaccagatgcttacctcaaaggagattaaaagacaggaggccattttcgagctttctcagggtgaggaggacctaatcgaggacctgaaattggctaaaaaggcatatcacgacccaatgctgaaactgtccatcatgaccgaacaggagctcaaccaaatctttggaacccttgattctctcatccccctccacgaggaactgctatcacagctgcgggacgttaggaagcccgatgggtcgacagagcacgtgggacccatcttggtgggttggttgccttgcctctcttcttacgactcttattgtagcaatcaggtagccgcaaaggctctactggaccacaagaaacaggaccacagagtacaggattttcttcagagatgtttggaaagcccattcagcaggaaactggatctgtggaacttcttagatatccccagatccagactggtgaaatatccgctgctcctccgcgagatcctgagacatactccaaacgataaccctgatcagcaacatctggaagaagcaatcaacataatccagggaatcgtggccgagatcaacactaaaaccggcgagtcagagtgtagatactacaaagaacgactgctgtatctggaggaggggcagaaagacagcctgatcgatagcagcagggtgctatgttgccatggcgaattaaaaaataatcgcggtgttaagctacacgttttcctgttccaggaagttctggtgataactcgcgctgttacccataatgagcagctttgttaccagctgtatcgccagccaattcccgtaaaggacctcctgttagaggacttgcaggacggggaagtgcgactgggtgggtccctgcgcggagcgttctccaataatgaaaggatcaagaatttcttcagagtctcgtttaagaacgggtctcagtcacagacccatagcctgcaagcgaacgacacttttaataagcaacaatggctcaattgtatccgccaggcaaaagagacagtgctgtgtgcggcgggccaagccggcgtgttggactccgaggggtccttcctgaatcctactactggctctcgagagttgcagggtgaaaccaagctggaacagatggatcaaagcgattcagaatccgattgttccatggatactagtgaggtcagccttgactgtgagcgtatggaacaaactgactcttcttgcggtaattctaggcatggggagagtaatgtctag

SEQ ID NO: 132605 - DNA, 1677 bp, Artificial Sequence
  Description of Artificial Sequence: Synthetic coding sequence
atggactcatctaccgcaatgaatcagtgctcctgccgcggcatggaagaaaataaggaacgccccaagcggcaaagacagaacaacttcccgatgtttccctccccaaaagcatggaacttccgcgggagaaagagaaagcaatccacacaggacgaggacgccgtcagcctatgtagcctcgatatttcggaaccttccaacaaacgagttaagccgcttagccgagtgacttcattggcaaacctcattccaccagtgaaggcaacaccacttaagcggttttcacagacgctccaaagatcaatctcatttcggtccgaatctagacccgatatcctggccccacgaccttggtcaagaaacgctgcaccatcatctaccaagcgcagggattccaagctgtggagtgaaacatttgatgtatgcgttaaccagatgctgacttcgaaggaaatcaaacggcaggaggcaatcttcgaactgtcccagggagaggaggacctaatcgaagaccttaagctggccaagaaggcttaccacgatcccatgttaaagctctcaattatgaccgagcaggagttgaaccagatatttggtactctcgacagcttgatccctttgcacgaggaactcctgtcccagttaagagatgtgaggaaaccagacggctcgaccgagcacgtgggtccaatcttggtaggctggctgccgtgtctcagttcctacgacagctattgctctaaccaggtcgctgccaaggcccttttggatcataaaaaacaggaccaccgggtccaggatttcttgcagcgctgtctagaatcccctttttctcggaaattggacctctggaattttctagacattcccagaagccggttggtaaagtaccctctgctgctgcgtgagatactcaggcataccccaaacgataaccctgaccagcagcacctggaggaagcaattaacatcatccagggcattgtcgcggagatcaacactaaaaccggtgaaagtgagtgtagatattataaagagcgcctgttgtatctggaagaagggcagaaagacagtcttatcgactcatcaagagtgctctgttgccatggcgagttgaaaaataataggggtgttaaactgcatgtatttctttttcaggaggtcctggtcataactcgagcagttacccacaacgaacagttgtgctaccagctgtacaggcagcctattcccgtaaaggacctactgctggaggacctgcaggatggagaggtgagactggggggctccctcagaggggccttcagtaataacgagcggatcaagaatttcttccgggtgtcttttaagaatggttctcaatcccagacgcactccctgcaggcgaatgatacattcaacaaacagcagtggttaaactgcataaggcaggcgaaggagacagtcctgtgcgccgcaggccaggccggcgtgctcgacagcgagggcagctttttaaatccgaccaccggcagccgtgagttgcagggtgagaccaagctcgaacaaatggatcagtctgatagcgaatccgattgctcaatggacactagcgaggtttcactggactgtgagcggatggagcagacagacagctcatgcgggaatagccggcacggagaatcaaatgtgtag

SEQ ID NO: 132606 - DNA, 1599 bp, Artificial Sequence
  Description of Artificial Sequence: Synthetic coding sequence
atgatcgaggtgtgccaccacaattggctactgtggctctgtcccagtaagttcggaatcttcatgtgctgtctagccagcaccactgggcagatggaactgcggcgtacgagggaaccatctaacaagcgggtgaagcccttaagcagagttaccagtctggcgaatctgatcccgcccgttaaggccacgcccttaaagcgctttagtcaaacactgcagaggtccatctctttccgcagtgaaagtcgccctgacatccttgcaccacggccatggagcagaaatgcagctccgtcttccacaaaacggcgcgatagtaagctctggtccgagactttcgacgtgtgcgtcaaccagatgttgacatccaaggaaatcaagcgccaggaggctatttttgaactttctcagggcgaggaagatttgattgaagacctcaaactggctaaaaaggcctatcacgacccaatgctcaagttgtctataatgacggagcaagagctgaaccagatttttggaactctagattcactaattcctctgcatgaggagctgctgtcacagcttagggacgtccggaagcccgatgggtctacagagcatgtaggtcctatcctcgtgggttggcttccttgtctcagcagttacgattcttactgcagcaaccaggtggccgcgaaagccctgcttgaccacaagaaacaggaccaccgagtgcaggacttcctccaaagatgcctcgagtccccttttagccggaagcttgatctctggaactttctggacatccccaggtctcggttggtgaaatatcccctgctgctgcgcgaaattctcagacacacgcctaacgacaatcccgatcaacagcacctcgaggaggccatcaacattattcagggtattgtggcagaaatcaataccaaaaccggagagtccgagtgtcgatattacaaggaacgtcttctctatctggaagagggtcaaaaggattccctgattgatagctctcgggttctgtgctgtcacggcgaactaaaaaacaaccgcggcgttaaattacacgtgttcctcttccaagaggtcctggtcattactcgcgcggtgacacacaacgaacagctgtgttatcagctgtaccgtcaaccaatcccggtgaaggatctcttgctggaggatctgcaagacggagaggtgagattggggggcagcttgcgcggagctttctcaaataatgagaggatcaagaacttctttcgtgtatcatttaagaacggaagtcagagccagactcactctctacaggccaacgatacattcaacaaacagcagtggctgaattgtatcagacaggctaaagagacggtgctctgcgctgccggccaagctggcgtcctggattccgagggatcctttctaaacccaacgaccggaagtcgtgagctgcaaggagagaccaaactggaacagatggatcagtcagacagtgagtcggattgctcaatggatacaagcgaggttagccttgactgtgagcgaatggagcagaccgattcatcctgtggcaactcacggcacggcgagagtaatgtgtag

SEQ ID NO: 132607 - DNA, 2073 bp, Artificial Sequence
  Description of Artificial Sequence: Synthetic coding sequence
atgccgtgggaggagccagccggcgagaagccttcatgcagccattcccagaaagcttttcatatggaaccagcccagaagccatgcttcacaaccgacatggtgacatgggcactcctgtgtatctccgccgaaaccgtgaggggggaagcaccgtcccaaccacgtggaattccccatcggagccctgtctccgtcgatgatctttggctcgaaaagacgcagagaaaaaagttacagaaacaggctcacgtggagagacgcctgcatatcggtgccgttcacaaggacggtgttaagtgttggagaaaaactattattacctcccctgagagcctgaatctccccaggagatcacatcccctttcccagagcgcccctactggactgaaccacatgggttggccagaacatacccccggaaccgccatgccagacggcgcattagatactgcggtgtgcgccgatgaggtaggatctgaggaggatctctacgatgatttgcactccagctctcatcactattcccatccagggggcgggggtgaacaactggccattaatgagctcatttcagatggaagcgtggtctgcgccgaggccctgtgggatcacgtcacgatggatgatcaggagttgggattcaaggctggggatgttatcgaagtgatggacgcgaccaatagagaatggtggtgggggcgagttgctgacggagaagggtggttccccgcctcttttgttcggctcagagttaatcaggacgagccagccgacgacgacgccccgctcgctggcaatagcggagccgaagatggcggggcagaagctcaatcttctaaggatcagatgcgtactaatgttattaatgagatcctttccaccgagcgggactacatcaagcaccttcgcgatatctgcgagggatatgttagacagtgccggaaacgggctgacatgttcagcgaagagcagctgcgaacaattttcggcaacatcgaggatatttataggtgtcagaaggcctttgtcaaggcgctggagcagcggttcaacagagagcgaccccatttgtcagaattgggcgcctgtttcctcgagcaccaggcagattttcagatctactccgagtactgtaacaatcaccccaatgcctgtgtggagctatcccggctgacgaaattgtcaaagtatgtttacttcttcgaggcctgccgactccttcagaagatgatcgacatatccctggatggctttctgctcacacccgtacagaaaatttgcaagtatccgttgcaattggccgaactcctgaaatatacacacccgcagcaccgtgatttcaaagatgtggaggctgcccttcacgctatgaaaaatgttgcacagcttatcaatgaacgaaagcggcggctggagaacatcgacaagattgctcaatggcagagctccatcgaagactgggaaggtgaagacctgctggtgagaagcagcgagctgatctactctggtgagctgacccgcgtgacgcagccgcaagccaaatcgcagcagagaatgtttttcctgttcgatcaccagctgatttattgcaaaaaagatctgctcaggagggacgttctctattataaaggccgattggacatggacggtctcgaagtggttgacctcgaggacgggaaggaccgggacctgcacgtttcaatcaagaatgcattccgactgcatcggggagctacgggtgactctcatctcttatgcacaagaaagccagaacagaagcagagatggctgaaagccttcgcgagggagcgggagcaggttcagttagaccaggagaccgggttctctattacagagcttcaacggaagcaggcaatgctgaacgcttctaaacagcaagtcacgggtaaaccaaaagccgtggggcgaccatgctacctcacacgccagaagcatcctgcgcttccttcaaacagaccccaacagcaggtgctggtgttggcagagcctcgccgcaaacccagcaccttttggcacagcatcagtcgtctggccccctttcgtaaatag

SEQ ID NO: 132608 - DNA, 1860 bp, Artificial Sequence
  Description of Artificial Sequence: Synthetic coding sequence
atgcggcctgacggtcagcaggcacttgacgccgtggtgcgctcatttgactgccattctgaggccgctctccgccagcgtaacgacgtcatttactgtagcttacctcgtacggcacagggcattgtccaacgtgaagaccaactggaggttctggtgagcctccgcgaagtatggggcaggagacgtgggcgcgacggaacatgcaccggggcaatgccagacggggcgttagacacggctgtgtgcgccgatgaggtcggctctgaggaagacctgtacgatgacctgcatagctcctcccatcactatagccaccctgggggcgggggcgaacaacttgccataaacgaactgatctcagatggctctgtggtgtgcgccgaagccctctgggaccacgtcacaatggacgatcaggaacttggctttaaagcgggggatgtgatagaggtgatggacgcaacaaaccgggaatggtggtgggggcgcgttgcagacggagagggttggtttcccgcctcatttgtccgtctgcgagtcaatcaggatgagccggctgatgatgatgcccctctagccggaaatagcggtgccgaggatggtggagcagaggctcagtcgtccaaggatcagatgcgaacaaatgttataaacgagattcttagtactgagagggattacataaaacatctgcgcgacatttgtgagggctatgttcggcagtgcagaaagcgcgcggacatgtttagtgaggagcagctgcgcactattttcggtaatattgaggacatatacaggtgccagaaagccttcgtaaaggcactggagcagcggtttaatcgcgagaggccccatcttagtgagctgggcgcctgcttcttggagcaccaggcggactttcagatatattcagaatattgtaacaatcatcccaacgcctgcgttgagctcagccgcctgacgaagcttagtaagtacgtgtacttctttgaggcctgtcggctgttgcagaaaatgatcgatataagcctggacggcttcctgcttactcccgttcagaagatatgtaaatatccattgcagctggccgaacttctgaaatatacacacccccagcatagggacttcaaagacgtggaagcagctctgcatgccatgaaaaatgtggcccagctcattaatgagagaaaacgtaggttggaaaacatcgataaaattgctcagtggcagtcatccatcgaggattgggaaggagaagacttgcttgtccgcagcagtgagttgatttactctggggagctgactagggtaacccagccacaggccaagtcccagcagcgcatgtttttcctttttgatcaccaactgatttactgcaagaaggatctgttaaggcgtgatgtgctttattataaaggacgcctggatatggatggccttgaggtggtcgacttagaggacggtaaggaccgggatctgcacgtcagtatcaaaaatgcgttccggctgcacaggggtgctacgggtgactcccatttgctgtgtacacgcaagccagagcagaaacagcgctggttgaaagcgtttgcaagggaacgggagcaggtccagctggatcaggaaacaggcttttccataacagaactacaacgaaaacaggcgatgctcaatgcaagtaagcaacaggtgacggggaaacctaaagccgtaggcaggccatgctacttgaccaggcaaaagcatccggcactgccatctaaccgacctcaacagcaggtgctagtgctcgccgagccccggaggaaacctagtactttctggcattcaataagtcgcctggccccctttagaaagtag

SEQ ID NO: 132609 - DNA, 2013 bp, Artificial Sequence
  Description of Artificial Sequence: Synthetic coding sequence
atgccttgggaggaacccgcaggagaaaagcccagttgctcacattcacaaaaagcttttcatatggaacccgctcagaagccctgtttcactaccgacatggttacatgggccttgctatgcatttctgcagaaaccgtgcgtggcgaggccccttctcagcccaggggcattccacaccggtctcccgtgtccgtggacgacctttggttagaaaaaacccagcggaaaaaactccagaagcaagcccacgttgagcggcggttgcacatcggcgcagtccataaggacggggtgaaatgttggcgtaagaccattatcaccagccccgaaagcctgaatcttccacgacggagccacccactgtcccagtcagcccctacaggtctaaatcacatgggatggcccgagcacacccctggaacagctatgccagacggtgccttggatacggcggtctgcgcagatgaagtcggctctgaggaggacctctacgacgacctgcactcgtcgagccaccactatagtcatccaggtggcggtggggagcagcttgccatcaacgaactgatcagcgatgggtcggttgtttgcgcagaagcgctttgggatcacgtgaccatggacgaccaggagcttggttttaaagccggagatgttattgaagtaatggatgccactaatcgggagtggtggtggggtcgggtggcagacggcgagggatggtttccagcatccttcgtcagactgagggtcaatcaggacgaacctgctgatgatgacgctccccttgctgggaatagcggcgcagaggatggcggcgcagaagctcagtcgtccaaggatcagatgcgaaccaatgttatcaacgaaatcctctctactgaacgcgactatataaagcatctacgcgatatatgtgaggggtacgtgcgccaatgccgcaaaagggcagatatgttttccgaggagcagttgagaactatctttgggaacattgaagacatctacaggtgccagaaggcatttgtgaaagctcttgagcagcgtttcaatagggagcggcctcacctctccgaactgggcgcttgctttctcgagcaccaggccgactttcagatttatagcgaatactgtaataatcatcccaatgcatgcgttgagctgagccgcctgacaaaactctctaaatatgtgtattttttcgaagcctgtcgtctacttcagaagatgatcgacatatccctggatgggttcctgctgacccccgtgcagaaaatatgtaaataccccttacagctggctgaactcctgaagtatacacatcctcaacacagagactttaaagacgtggaagccgctcttcatgctatgaaaaacgtcgcgcaactgatcaacgagcgaaaaagaagactggaaaatatcgataagatagctcagtggcagagctcaatcgaagattgggaaggtgaggatctcttggttcggagctccgaattgatctacagtggcgaacttaccagggtgacccaaccgcaggcgaagtctcagcagcggatgttcttcctattcgaccatcaattgatctattgcaagaaggacctgctgcggagagatgtgctgtattacaaaggacgtctggatatggacggcctggaagtggttgatctggaggatggtaaagatagagatttacatgtgtccatcaagaatgccttcaggctacatcggggcgccacgggcgacagtcacctgctgtgtacacgcaagccggaacaaaagcagaggtggctgaaagctttcgctagagagcgcgagcaggtccagctggaccaggagacaggtttttctataaccgagctgcagagaaaacaggcaatgttaaacgcttcaaaacagcaagtgactggcaagcctaagggaaggcggacggctgctcctcctccccgattgcccgggccttaccctgctgacatcatccctttcagcgagccacagtcccaggcctcttag

SEQ ID NO: 132610 - DNA, 1893 bp, Artificial Sequence
  Description of Artificial Sequence: Synthetic coding sequence
atgccttgggaagagccagcaggcgaaaagcccagttgcagtcactcacagaaagcctttcacatggaacccgcgcaaaagccatgttttacgacagatatggtgacgtgggctctgctgtgtattagcgctgagacagtacgaggagaagcaccgtctcaaccccgcgggattccccataggagcccggttagtgtcgacgacctgtggcttgaaaaaacccagagaaagaagttgcaaaagcaggcccacgtggaacggcggctccacataggagccgtgcataaagatggagttaaatgctggagaaaaacaatcattactagtcctgagtccctcaatttgccacggaggtcacaccccctgagccagagcgctccaaccggactgaatcacatggggtggcccgaacatacccctggtacagccatgcctgacggagctttggacacagctgtttgtgcggacgaagtaggctccgaagaagacttgtatgacgaccttcactcatcctcacaccactacagccaccctggcggcgggggggaacaactggccattaacgagttgatcagcgacggtagcgtcgtctgtgcggaagccctttgggatcacgtaaccatggatgatcaggagttaggattcaaagctggagacgttattgaggtaatggatgctaccaacagagagtggtggtggggccgagtggcagatggtgaggggtggttccctgcgtcctttgtgaggctccgggttaatcaagatgagccggcagatgatgatgcaccactggcgggcaactctggagcagaagacgggggcgctgaggctcagtctagcaaggatcagatgcggacaaatgtaatcaatgagatcctgagtactgaaagggattacatcaaacacttgagggacatatgtgaacaggctgactttcagatttattctgagtactgtaacaatcatcctaatgcctgtgtggagctttcgagattaaccaagttgtctaaatacgtctattttttcgaagcatgtcgcctcctgcagaagatgatagatatcagcctggacgggtttctgctgactccagtacagaagatctgcaaataccctctgcagttggctgaactcctgaaatacacacacccccaacaccgggattttaaagacgtcgaagctgcactgcacgccatgaagaatgtcgcacagttgatcaacgagcgcaaacggaggttggagaatattgacaagatcgcccaatggcaaagctcaatcgaggactgggagggagaggatctgttggtgagatcttcggaactgatttattcaggggagctcaccagggtaacgcaaccccaggctaagagtcagcagaggatgtttttcctttttgatcaccagctcatctactgtaagaaagaccttctccgcagagatgtgttgtattacaaaggacgacttgacatggatgggctggaggtggtggacctggaagacgggaaggaccgtgacctgcacgtgtcaatcaaaaatgcgttcagattgcatcgcggagccaccggagatagccatttactgtgcacccggaaaccagagcaaaaacagaggtggctaaaggcttttgcgcgggagcgtgagcaagtgcagctcgatcaagagaccggattttctatcacagagctccagcgcaagcaagctatgctgaatgctagcaaacagcaagtgactggtaaaccgaaggccgtgggcagaccctgttacctgacccgacagaaacaccccgcactgccgagcaataggccacagcagcaggtgctggtgctggctgagcctcggaggaaaccaagtacgttctggcacagcatcagtaggctggccccctttagaaaatag

SEQ ID NO: 132611 - DNA, 579 bp, Artificial Sequence
  Description of Artificial Sequence: Synthetic coding sequence
atgccttgggaagagccagctggggaaaaaccttcctgtagccattctcagaaggccttccacatggaacccgcgcagaagccctgcttcaccaccgacatggtcacttgggctttactgtgcattagtgctgaaaccgtgcggggggaagcaccatcccagccacgggggatcccccacagaagccccgtgagtgtggacgacctctggctggagaaaacgcaacggaagaaactccagaaacaggctcacgtggagagacggctgcacatcggtgccgtccacaaggacggagtgaaatgttggcggaagacaataataacaagtcccgaaagtttaaatctcccacgccggagccacccactgtctcagagtgcgcctacaggactgaaccatatgggttggccagagcacacccctggtacagcggtggggcggccttgctacttgacccgtcagaaacaccctgcactaccaagcaatcggccacagcagcaagtgctggttctagccgaaccaagaaggaaaccgtccaccttctggcatagcatctcacgcctagctcctttccggaagtag

SEQ ID NO: 132612 - DNA, 2013 bp, Artificial Sequence
  Description of Artificial Sequence: Synthetic coding sequence
atgccttgggaggagccggcaggagagaaaccatcttgctcccattcccaaaaggcctttcatatggagccagcccaaaaaccttgttttaccacggacatggttacctgggccctcctctgcattagcgccgaaacggtgagaggggaggcgccttctcaacccagggggatccctcacagaagtcctgtgtccgtcgatgacctctggctggagaaaacacaacgtaagaaactacagaagcaggcacatgttgagcggcggctgcacatcggcgctgtgcataaggacggggttaagtgctggagaaagactataatcaccagtcctgagtccctcaatctacctaggagatctcatccactgagccagtccgcccctactggcctcaatcatatgggatggccagaacataccccgggcaccgctatgcccgacggggccctggatacagctgtatgtgcagatgaagtgggttctgaggaggacctgtatgacgacctacattcatcgtcccatcattattcccacccaggaggcggcggcgaacagctcgctattaatgaactaatttctgacggctccgtcgtgtgcgcagaggcgctgtgggatcacgtcactatggacgaccaggagttgggctttaaagctggagatgtgatcgaggtgatggacgcaaccaatagggagtggtggtgggggagagtggcagacggggaggggtggtttcctgcttcattcgtgcgcctccgagtgaatcaggacgagcccgcagatgacgatgcacccttggcggggaactccggtgccgaagacggcggtgcggaagcccagagctcaaaagatcagatgcgcaccaacgtcatcaacgagatactctcgacagaaagagattacattaagcatcttcgggacatttgtgagggatatgtgaggcagtgccgaaagcgtgccgacatgttttctgaggagcagctaaggacgatttttgggaacatcgaggatatatataggtgtcagaaagcctttgtcaaagcattggagcaaagatttaatagggagcgacctcacctatccgagcttggcgcttgcttcctcgagcaccaagccgatttccagatatattctgagtactgcaataaccacccaaatgcctgcgtcgagctgtcccggctcacaaaactttctaagtacgtctatttttttgaggcatgcagactgctgcagaagatgatcgatatatccctcgacggattcctcttaacaccagtccaaaagatatgtaagtacccgctccagctggcagagctgttaaagtacactcatccccagcatcgggattttaaagacgtggaagccgcgctacacgcaatgaaaaacgtggcccagctcatcaacgaaaggaaaaggagacttgagaatatcgacaagatcgcgcagtggcagtcatccatcgaggattgggagggtgaggatctgctggttaggtcttctgagcttatttactcaggggaacttacacgcgtcactcaaccacaggctaaatcacaacagcgtatgttttttctctttgatcatcaactgatttactgcaagaaagacctcctcagaagggacgtgctttattacaagggcaggctcgacatggacggcctggaggtcgtggacctcgaagatggcaaggatagggacctccacgtcagcatcaaaaatgctttccgcttgcaccggggcgcaaccggcgactcccatctgctgtgtacacggaagccggagcagaaacagaggtggctgaaggcgtttgctagggagcgggagcaggtgcagctcgatcaggagaccgggtttagcatcaccgagctccagcgcaagcaagccatgctaaatgcctcaaaacagcaggttaccgggaagcccaaagggcgaagaactgccgccccacctcccaggcttccgggaccataccccgctgacataatccccttttccgagccgcagagccaagcatcctag

SEQ ID NO: 132613 - DNA, 4794 bp, Artificial Sequence
  Description of Artificial Sequence: Synthetic coding sequence
atggaggctgaagaagcgcagcgtggggcttctcctccaatctccgcaatagaagagttttccattatccctgaagcaccgatgaggtctagccaggtgagcgccctaggcttagaggcccaagaggatgaagatcctagctacaaatggcgcgaggagcaccggttatccgctacacagcagagtgaactgcgcgacgtttgcgattatgctatagaaactatgccttcatttcctaaagaagggagtgctgatgtggagcccaatcaagagtcccttgttgccgaagcctgcgatacacccgagcattgggaggcggtgcctcagtcgctcgctggccgacaagctagaaccctggcgcctcctgagttgtgggcatgccccattcagtcagaacacctagatatggcacccttcagcagcgacctcgggagtgaggaagaagaggtggagttttggcccggtcttacctccctcactctgggcagcggccaagcggaggaagaagaagagacaagcagcgataactcaggacaaacccgctattattctccttgcgaagagcaccccgctgaaacaaaccagaacgaaggttccgagtccggcaccatccgccagggcgaggagctccctcccgaagaactgcaggagtcccaggggctgttgcacccccaagaggtgcaggttcttgaggagcaagggcagcaggaagctggattcaggggggaagggacactgagggaggacgtgtgcgcagatggcctgctgggcgaggaacaaatgatcgagcaggtgaatgatgaaaagggggaacagaaacagaaacaggaacaggttcaagacgtaatgctggggagacagggtgagcggatgggactgaccggagagccagaaggattgaacgatggggaatgggaacaggaagatatggagcgaaaagctcaggggcagggcgggccggagcagggggaggagaggaagagagaactacaggtacctgaggaaaatagggccgacagtcaggatgagaaaagccagacttttctaggaaagtccgaagaagtgaccgggaaacaagaagatcatggaatcaaggaaaagggggtgcctgtgtcagggcaagaagcaaaggagccggaatcttgggatgggggaagattgggggccgtcgggcgtgcacgttctcgggaggaggaaaacgagcatcacggcccttccatgcctgccctgattgcccccgaagattcgcctcattgtgatctgttcccaggcgcctcttatttaatgactcagatccccggaacacagacagagtcccgggccgaggagctcagccctgcagctctttcccctagcctggagcccatcaggtgcagtcatcagcccatttccttgttaggaagctttttgactgaggaatcccccgacaaggaaatcgatcaaaacagtcagcaggaggagtctaggctgcgaaaaggaacagtgtcaagccagggcacagaggtggtgttcgcttccgccagcgttaccccgccccggacccctgatagcgctcctccctcccccgctgaagcctatcccatcacaccggcaagcgtttctgcccggcctcccgtggccttccctcggagagaaacgtcatgcgccgcgagggcacctgaaaccgcgtctgctcctttgtccatggatgacccaagcccttgcgggaccagcgagatgtgtccagcggccctgtatgggtttccctcaaccggcacatcacctccccgccctccagccaactcaaccggaactgtccagcatctcaggagcgactccttcccagggtcacaccggacagagcagacgccggaccttgtcggtatgcttctgagctacagtcacagcgagttacctcagaggcctccaaagcctgcaatctattctagcgttacaccaaggagggaccgccggagcggccgcgattattccacagtctccgcctcacctacagctctaagcacgcttaaacaagatagccaggagagcatatcaaacctggagcgcccctcatctcctccctccatccagccctgggttagtcctcataaccccgcttttgcgaccgagtcacctgcatatggctcaagcccctccttcgtgtccatggaagatgtgaggatccacgagccgttaccaccacccccacctcaacgacgggacacacatccaagcgttgtggagacagacggacacgcaagggttgtcgtgccgacactcaagcaacatagccacccaccaccgttggcactcggatctgggctccatgcgcctcacaagggccccttgcctcaggcgtcagaccctgctgttgcccggcagcatagacctctgccttccactcctgatagctcccatcacgctcaggctaccccccggtggcgatataacaaacccttgcctccaactcctgacctaccccagcctcatctcccacctatttccgcgcctggaagtagcaggatataccggccgctgccccccctccctattatcgatccccctacagagcccccacctttaccacccaaatcccggggccgctcacgaagtaccagaggtggtcacatgaactcaggaggtcacgccaagacccggcccgcctgtcaggactggaccgttccactgcccgcatctgccggacgaacttcatggccacctgcgacagccagaagtacagagagtttcacgtctacgagcaggagcaaaagtgaggtttcccctgggatggcatttagcaatatgaccaatttcctgtgtccaagttcaccaacgaccccttggactccagaactacagggccccacctccaaggatgaggccggtgtctctgagcaccctgaggctccggcccgggaaccactgcgaaggacaaccccccagcagggcgcttctggacctggtcgctctcccgtaggtcaggcccgacagccggaaaaaccatctcacttacatctggaaaaggcgtcaagctggcctcaccggcgagatagcggtagacctcctggggatagcagtgggcaagctgtggctcccagcgagggcgccaacaagcataaaggctggtccagacaagggctccggagaccatccatcctgcctgaagggagctcggattccaggggtcccgccgtcgagaagcaccctggcccgagcgacacggtggtttttagagagaagaaaccaaaagaggtcatggggggatttagcagacgatgttccaagttgatcaattccagtcaactcctttatcaagagtactctgacgtcgttctgaacaaggaaatacagagccaacagaggctagagagtttgagtgagacccctgggccctctagcccacggcaaccaaggaaagccctcgtatcttccgagagctacctccagcgcttatccatggcatcatccggatctctgtggcaggaaatcccagtggtaagaaactccacagtcctgctgagtatgacccacgaggaccagaaactgcaggaggtgaagttcgagctgatcgtatctgaggcaagctatctacgctctctgaacatcgccgtggatcatttccagttgagcacatctctgagagccacacttagtaatcaagagcaccagtggctcttctcacgcctgcaagatgtgcgggatgtctccgccacatttcttagtgacctggaagagaacttcgagaataacatattcagcttccaggtgtgtgatgttgtgctgaatcatgctccagattttagacgtgtgtacctaccctacgtcactaatcaaacctaccaggagaggacatttcagagtctaatgaattccaacagtaacttcagggaggtgctggaaaagcttgagagtgaccccgtctgtcagcggctgtcactgaaaagctttttgatactgccatttcaaagaatcaccagattgaagcttctgctccagaatatcctgaagagaacacagccaggttcctctgaagaggcggaagcaaccaaggcccatcatgctctggagcaactgatcagagactgcaataataatgtgcagtcaatgcggaggacggaagagctgatttacttgtctcagaaaatagagttcgaatgtaaaattttcccactgatttcacaatccagatggctcgtgaaatctggcgaactgactgcattggagtttagcgccagccccggccttcgtcgcaagctcaatactcgcccagttcatctccacttgttcaacgattgtttgctgctgagtagaccccgcgagggaagcaggtttctagtgtttgaccatgcccctttttcctccattcgcggagaaaagtgtgagatgaagctccatgggccacacaagaatctttttcggttgttccttagacagaatacgcagggcgctcaagccgagtttctgtttaggacagaaacccagtctgagaaactcaggtggatctcagctctggcgatgcccagggaggagctggacctgctggagtgttacaactctccgcaggtccagtgcctgcgagcgtacaagcccagagagaacgatgagctggccctggagaaagctgatgtcgtgatggtgacacagcaatcttctgacgggtggctggagggcgtacgcctcagcgatggagaacggggatggttccctgtgcaacaggttgagtttatttctaacccggaagtgagggctcagaacttgaaagaggcacatcgggtgaagactgctaagctgcagcttgtggagcagcaagcctag

SEQ ID NO: 132614 - DNA, 1197 bp, Artificial Sequence
  Description of Artificial Sequence: Synthetic coding sequence
atggcctcctccgggagcctgtggcaggaaatccccgtggtgcggaattctaccgtgcttctttccatgacccacgaggatcagaaacttcaggaggtcaaatttgagctaatcgtgagcgaagctagttatctgcggtcccttaacattgccgtagatcactttcagctttccacgtctctgagagctacattgtctaaccaggagcatcagtggctttttagccgactgcaggacgtgagggacgttagcgcaaccttcctcagcgacctcgaggagaatttcgaaaacaatatcttctcatttcaggtttgtgacgtggtgttgaatcatgcccccgactttagacgtgtttacctgccatatgtgacgaatcagacatatcaagagcggactttccagtccttgatgaatagcaattccaatttccgggaggttctggagaagctggagtccgatcccgtatgtcagaggctgtctctgaaatcatttctgatcttaccatttcagcgtataacacgattgaaattgttattacagaatatactgaaaaggactcagcctgggagcagcgaagaagccgaagccacgaaggcccaccacgcgctagagcagcttattagagactgcaacaataatgtgcagtccatgcggaggaccgaagagctgatttatctctcacaaaagatagaattcgaatgcaaaatttttcccctgatctcacagtctaggtggttggttaagagtggagaattgacagccctcgaattttccgcgtctccaggcctacgcagaaagctgaacacccgtcctgtgcatctccacctcttcaacgattgcttgcttctgtctcggcccagggagtcagagaagctaaggtggataagtgcactggccatgccccgtgaggagttagatctccttgagtgttataactcacctcaggtgcagtgcttacgcgcctataagccacgcgagaacgatgagttggcactggagaaagcagatgtggtcatggtgacacagcagagctctgacggctggctcgaaggcgtgcgcctctcggacggtgaacgtggttggtttccagtgcaacaagtggagtttatttcaaaccccgaagtcagagctcagaacctcaaagaagcccacagggttaagacagccaagctgcaactggtggagcagcaggcatag

SEQ ID NO: 132615 - DNA, 1560 bp, Artificial Sequence
  Description of Artificial Sequence: Synthetic coding sequence
atgggtggtttctcccgccgttgctcaaaattaatcaattctagccagctactttatcaggaatatagcgatgtggtgctgaataaggagatccagtctcaacagcgcctcgaatcattgtccgagacaccgggacccagcagcccccggcagccccgaaaggcactggtgtccagcgaatcttatctgcagaggctgtcaatggcctcttctggatccttgtggcaggagatcccagtggtgcgtaactcaaccgtactcttaagcatgactcacgaggatcagaaactacaggaagtcaaatttgaattaatcgtctccgaggcttcctacctgcgatctctgaatatcgcggtcgaccactttcagctgtccacttctctacgcgcaacgctgtccaatcaggagcatcagtggcttttcagccgtctgcaagatgttcgcgacgtatcagcaacctttctaagtgatttagaggagaatttcgagaataacatattcagctttcaggtgtgtgacgttgttctgaatcatgcccccgacttccgtcgagtgtatctgccatacgtgacaaaccagacgtaccaagagaggaccttccagagcttgatgaactcaaacagtaattttcgggaagtgcttgaaaagctggaaagcgatccagtgtgtcagagattatccttgaagtccttcctgatcctacctttccagagaataacaagattgaagctgctgctccagaatattcttaaaaggacacagcccggttcttccgaggaggctgaggctacaaaagcccaccacgcccttgagcagctgatcagggactgcaacaataatgtgcagtcaatgcgcagaaccgaagagctgatttaccttagccaaaaaattgaatttgagtgcaagatttttccactgatttctcagtcccggtggctggtgaagtccggagaactgactgccctcgaattctctgcctccccgggtctcagacgtaaattaaacacaagacccgtccaccttcatctgttcaacgactgtcttcttctgtcgcgccccagggaggggtctcgcttcttggtttttgatcatgcaccattttcctctatccgaggggagaagtgcgagatgaagttgcacggaccacacaagaatctgtttcgcctgtttctacgacaaaacactcaaggagctcaggcagaatttctgttcaggacggagacgcagtctgagaagctaaggtggattagcgccctggcaatgccacgtgaggagctggacctgcttgaatgctataacagcccccaagtccaatgtcttagggcatacaagccccgagagaatgacgagctcgccctcgaaaaggccgacgtggtcatggtgactcagcagagttctgatgggtggctggaaggcgtccggctctcagacggagagcgagggtggttcccagtgcagcaggtcgagttcatctccaaccctgaggtccgcgctcagaatctgaaagaggctcatcgcgtgaagactgcaaagcttcaattggttgaacagcaagcgtag

SEQ ID NO: 132616 - DNA, 2394 bp, Artificial Sequence
  Description of Artificial Sequence: Synthetic coding sequence
tgagttgttgtacctaccttgaagcagcattctcacccccctcccttggctctcgggagcgggcttcacgcccctcacaaggggcctcttccccaggcaagcgacccggccgtggctcgccagcatcgacccctgcctagcacgccagattcttcacatcatgcccaagccactccacggtggcggtataataaaccattgcctcccactccagacctgccccaacctcacctccctccgatctctgcgcccgggagctctcggatctacagacctttgcccccactgccaatcattgatcctcctacagagccaccaccactgccacctaagagcagaggacggtctcgttctacccgtggggggcacatgaattctggaggccacgctaaaacgcggccagcctgccaggactggactgtacctcttcccgcgtccgccgggcggacatcctggccaccagcaactgccagaagcaccgagagcttcacctcaaccagcaggagcaaaagcgaggtttcccccggcatggcattttccaacatgactaacttcctgtgcccctcatcccccacaactccctggacgcctgagttgcagggcccaacctccaaggatgaggcgggtgtgagtgaacatccagaggctcccgccagagagccactgcggcggactactccgcagcagggcgcttccggccccggtcgttcacccgtgggccaggcaaggcagccggagaagccctcacatttacacctcgaaaaggcttcctcctggccacacagaagggattctggacgcccacccggcgatagcagcggtcaagcagtggccccctccgaaggagctaataaacataagggctggtcacggcaggggctccgtcggcccagtatcctacccgagggctcatcggattctcggggtccagcagtggaaaaacatccgggacccagcgacaccgtagtctttagagagaaaaaacccaaagaagtgatgggtggctttagtcggaggtgttccaaactgatcaattcaagtcagctgttgtaccaggaatactcagatgtcgtgcttaataaagagatacagagccaacagagactggagtcattgtccgagactcctggtccctctagccctcggcagcccagaaaggccctcgtgagttctgagtcatatttacagcggctcagtatggcaagttctggtagtctctggcaggaaattcccgtggtgcgtaatagcactgtcctgctgagtatgactcacgaagaccagaagttgcaggaggtgaagttcgagctcattgtgtccgaagcttcgtatctgagaagtcttaacatcgccgttgaccattttcagttatccacatccctgagagccactctttccaatcaggagcaccagtggctattcagcagactccaggacgtgagagacgtctccgcaaccttcctgtctgatctcgaagaaaattttgagaacaacatcttctccttccaagtgtgcgacgtggtgcttaaccacgcccccgactttaggcgcgtctaccttccctatgtaactaatcagacgtaccaagagcgcacattccagtctctgatgaattcaaacagtaacttccgggaggttctggaaaaattagagagtgaccccgtgtgtcaaagactttccctcaagtcattcctaattctcccattccaaagaattacacgtctgaaactccttctgcagaatattcttaagaggacacagcccggcagctccgaagaagcagaggctacaaaggcccatcacgccctggagcaactgataagggattgcaacaacaacgtgcagagtatgcgacggacggaggaactgatctatctgtctcagaaaattgagttcgagtgcaagattttccctctcataagccagagtcgatggctcgtcaagtccggtgaactaactgcccttgaattctcggcatcacccgggttgagacgaaagctgaacaccagacctgtgcacctccatctcttcaatgattgtctcctgctgtcccgcccacgcgagtctgagaagctcagatggatatcagcgctggcaatgccaagggaggaattggatctcttggagtgttataactcaccgcaagtccaatgcctcagggcttataaacctagagagaacgacgaattggctctggagaaagctgacgtcgtgatggtgacccagcagtcatccgacgggtggctcgagggagttcgcctaagtgatggagaaaggggctggtttccggtgcagcaggttgagttcatcagtaaccccgaagtgcgggcacagaacctgaaagaagcacatagagtcaagaccgctaagttgcagctagtcgaacagcaggcctag

SEQ ID NO: 132617 - DNA, 2958 bp, Artificial Sequence
  Description of Artificial Sequence: Synthetic coding sequence
atgagccggatcgagagccttacacgcgcgcgcattgaccgaagccgggagttagcctcaaaaacgagagagaaagaaaagatgaaagaggccaaagacgccaggtacaccaatggccatctcttcacaactatttccgtctcaggcatgacgatgtgctatgcctgcaacaagtccataacagctaaggaagcattgatctgtcccacgtgcaatgtcaccatccataacagatgcaaagacacactggcgaattgtaccaaggtgaagcagaagcaacaaaaagccgccttattgaagaataatacagctctgcagagtgtgagcctccgttcaaagaccacaataagggagagacccagttctgccatctatccctctgattccttcagacagtccttactgggttcccgtcggggaaggagctctctgtctctagccaagtccgtgagtaccacaaacatagcaggtcactttaacgacgagtccccccttggattaaggcgcattctctcgcagagcactgattctttgaacatgcgcaaccggacccttagtgtcgagtccctgatagatgaagaagtcatttacagtgagctgatgtccgattttgagatggatgaaaaggatttcgccgcagactcctggtccttggcagtggactcttccttcctgcagcaacataagaaagaagtgatgaaacaacaggacgttatctatgaactaatccagaccgagctgcaccatgttagaactcttaagatcatgacccgtctctttcggaccggcatgcttgaggaattgcaccttgagccgggggtcgtccaggggttatttccctgtgtggacgaactgagtgacatccacactcggttcctctcccagttgctggagagacgcaggcaagcattgtgccccggatcaaccaggaacttcgtgattcatagactcggtgatctgctcatctctcagttctcgggcccctctgctgagcagatgtgtaaaacctattccgagttttgctcacgtcatagcaaagcactcaagctctacaaggaactgtatgcaagagataagcggttccaacagtttatacggaaggtgactcgacccgcggttctgaagcggcacggagtgcaggagtgtattctccttgtaacccaacggatcactaagtatcccctcctgatcagtagaattcttcagcattctcatggcatcgaggaggagagacaggatttgactactgctctcggactcgtaaaggagcttttgtccaatgtggacgagggaatttatcagttggagaagggcgcaaggctacaggagatctataatagaatggatccccgggcgcaaaccccagtgcctgggaagggtccatttgggagggaggagctgctgcggaggaaacttattcacgatggctgtttactgtggaagactgccactgggagattcaaggacgttctggttcttttgatgacagacgtccttgtattcttgcaggaaaaagatcagaaatacatttttcccacactggataagccttctgtcgtgtccctgcaaaacctgattgtgcgggacatcgccaaccaggagaagggaatgtttcttatcagcgccgccccacccgagatgtacgaggtgcacactgcctctagggatgataggagcacctggatcagagtcatccagcagtccgtcaggacatgcccaagccgggaagacttcccactgatcgaaacagaggacgaggcttatctgagaagaattaagatggagctgcaacagaaagatcgagcactggtagagctgctccgcgagaaggtgggtttgtttgcggagatgacgcacttccaggcagaagaagacggcggttctggtatggccctgccaaccctgccgcgtggcctttttcgttccgagtcccttgagtctccccggggagagagactgttgcaggacgctattagggaagtagagggattaaaggacctgctggttgggccaggggtggagctactcctcacgccgcgagaaccagccctgccccttgagccggattccggaggaaacacaagccccggagttaccgccaatggagaggcacgaactttcaatggtagcattgaactctgccgggccgactcagactcaagccagagggaccgaaacggcaatcagctgcggagtccacaagaagaggccctgcaaaggctcgtgaacctgtacgggctcctccacggcctccaggccgcggtggctcagcaggacaccctgatggaggccaggttccctgaaggcccagaaagacgcgaaaaattgtgtcgcgctaactctagagacggagaagccggccgcgccggagccgcccctgttgcccccgaaaaacaggccacagagctcgcgctcctccagcggcaacacgcccttctccaggaagaactccgaaggtgtaggcgcctgggcgaagagagagccactgaggccggcagtctggaggcccgcctgagagagtccgaacaagccagagctctccttgaacgtgaggctgaggaggccagaaggcagttggctgccctgggacagacagagcctctgccagccgaggctccatgggcccggcggccagtggacccccgccgccgttctttacctgcaggagacgccctgtacctgtcttttaacccaccccagccttctaggggcacagatcgtctggatcttcccgttacaacccgatctgtccatcgaaactttgaagacagggagcgtcaggagttggggagtccagaagaaagactgcaggattccagcgaccctgataccggatccgaagaggagggcagttcaagacttagcccccctcactctcctagggactttactagaatgcaggacatcccagaggagaccgaatccagagatggagaagcagttgccagcgagtcctag

SEQ ID NO: 132618 - DNA, 2877 bp, Artificial Sequence
  Description of Artificial Sequence: Synthetic coding sequence
atgaaagaagctaaggatgcccgttacaccaacggtcacctgttcactactatcagcgtgagcggaatgactatgtgttatgcttgtaacaagtccattacagcgaaggaggctttaatctgtcccacctgtaacgtgactatccataaccgatgtaaggacacacttgccaattgtactaaggttaaacagaaacagcaaaaagcagcactgctgaagaacaacacggcactgcagagtgtgagcctgcggagcaagacgaccattcgggagcgtccctctagcgcaatctacccaagtgactctttccggcagtccctgctcggttcgagacgcggccgctcatcactgtccctggccaagagtgtgagcacaactaatatcgccggacacttcaatgacgaaagcccactcggactaaggagaatcctgtcccagagtaccgattcgttgaacatgcggaatcggacgttgtcagtggaatccctcattgatgaggaagtaatctattcagagctgatgtcagattttgagatggatgaaaaggactttgccgcggactcctggagcctggcagtagactcatcgtttcttcagcagcacaagaaggaagtgatgaagcagcaggacgtgatttacgaattaatccaaacagagttgcatcatgtacgcacacttaaaatcatgacgcggctgtttagaacagggatgctggaggaactgcatttagaacctggggtagtgcagggactcttcccctgtgtggacgaactcagtgacatccacaccaggtttctgtcccagctgctggaacggagaagacaggccctctgccccggctctactagaaactttgtcatccatcgcctgggcgaccttcttatctcccagttttcaggcccgagtgctgagcagatgtgcaagacctatagtgagttctgcagtcggcattccaaggctctcaaactttacaaggaattatatgctcgtgataaacggtttcagcagttcataagaaaagtcacacgtccggccgtgctgaaacgccacggggtccaagagtgtatccttctggttactcagagaatcactaaatatcctctgcttattagcagaattttacagcactcccacgggattgaggaagagaggcaagacctgaccaccgccctcgggctcgtgaaggagttgttgtcgaatgtggacgaagggatctatcaattggagaagggcgcccggctgcaggaaatctacaatcggatggatccacgcgcacagacaccagttcctgggaagggtccgttcggcagagaagaactgctccgaagaaagctgatccacgacggttgtctattgtggaaaactgcaacgggtagattcaaggatgtgctcgtcctgctcatgaccgacgtcctggttttcctgcaagagaaagaccaaaagtacatttttcctacacttgataagccatccgtggtttcactgcaaaacctgatcgtgcgggatattgccaatcaggagaaggggatgttcctgatttccgctgccccccctgagatgtacgaagtgcacaccgcctctagggatgacagatcaacctggataagggtaattcagcagtccgtgaggacttgtccatccagggaggacttcccactcattgagactgaagacgaggcctacttgcgccgaattaaaatggaattacagcagaaagacagagcgctggttgaattgctaagggagaaggtgggcttgttcgctgagatgacccacttccaggctgaggaggatgggggcagcggcatggctctaccaactctcccccgtgggctcttcaggtccgaatcgctggaatctccacgtggagagaggctcctacaggacgccatcagagaagtggaaggcttaaaagatttgctcgtaggccctggtgttgagctgctcctaactccacgggaaccggcacttcccctggagcctgatagcggggggaatacctccccaggcgtcacggcaaacggcgaggcccgaactttcaacggctccatcgaactgtgcagggcagatagtgactcttctcaaagggatcggaacgggaaccagctccgctccccacaggaggaggcccttcagcgcctcgtgaacctgtacggccttctgcatggactacaggccgccgtcgcgcaacaagatacgttaatggaggctcggttcccagagggcccagaaaggagggagaagttgtgcagagcgaacagcagagacggggaggcagggagagccggggcagcgccggtcgccccggagaagcaggctacagaactggcattgctgcagagacagcatgccttgctgcaggaggagctacgtaggtgcaggcgcctcggcgaggagagggctacagaggctgggtctttagaagcgcgtctgcgggaatcagaacaagcaagggccctcctcgaaagggaggccgaggaggcccgacgacagttagcggccctgggtcagaccgagccgctgccagccgaggctccatgggcaaggcgccctgtcgaccctcgcagaagaagtctgccagcaggtgatgctctttacctctcatttaatcctccccaacctagccggggcacagataggttggacctgcccgtaactactagatctgtccatcgcaatttcgaagaccgagaacggcaggagcttggatcgccagaggaacggctacaggacagttctgatcccgacacagggagtgaagaagaaggtagctcccggctctcaccgccacactctcctcgcgacttcaccaggatgcaagatatccccgaggaaacggagtcccgagatggagaggctgttgcaagcgaaagttag

SEQ ID NO: 132619 - DNA, 2961 bp, Artificial Sequence
  Description of Artificial Sequence: Synthetic coding sequence
atgtcgaggatcgagtctctgactagagcccgcatagatcgaagtcgggagttggccagcaaaactcgcgaaaaggagaagatgaaggaagcaaaagacgccaggtacactaacggccacctgttcaccactattagtgtgagtggcatgaccatgtgctatgcgtgcaacaagtctattacagctaaagaggctctgatctgccccacatgtaacgtgactatccacaatcgatgtaaggacaccttggcaaattgcacgaaggtgaaacaaaagcagcaaaaggccgccctcctgaaaaacaatacagccctgcagtctgtctccctgcggtctaaaacaacgattagggagcggccatctagcgctatatacccttccgactccttccgacaatccctgctgggcagcaggagaggtaggtctagtttaagtctggcaaagagcgtgagcaccacaaatatagccggccacttcaacgacgaatctccactgggactccgacgcatcctctcacagagcaccgattcgcttaacatgaggaatcgcacactgagcgtggaatctttaatcgatgaagcagaagtcatctactcagagttaatgtccgactttgagatggacgaaaaggacttcgctgctgactcctggtctctggccgtcgactcctccttcctgcagcagcataagaaggaagtgatgaagcagcaggacgtgatctacgaacttattcagactgagctgcaccatgtacgtactctcaagatcatgaccaggttatttagaactggcatgctcgaggagctccatcttgaaccaggggtagtacagggtctgtttccatgcgttgatgaattgtcagacattcacacgcgttttttatcacaacttcttgagagacggagacaggcgttatgtcctggctccactcgcaactttgtgattcaccggctcggcgacctgctcatcagccagtttagcggaccatccgctgaacagatgtgcaaaacctatagcgaattctgcagcaggcactctaaagcgcttaagctgtataaagaactctacgcccgggacaaaaggtttcagcaatttatccggaaagtaacacgaccagccgtgctgaaacgacacggggtgcaggagtgcattctcctcgtcactcagaggatcacaaagtaccccttattaatctcacggatcctgcagcatagccacggaattgaagaagagcgccaagaccttaccactgccctgggccttgtcaaagaactgctgtccaacgtagatgaggggatctatcagctggagaagggggctaggctgcaggagatatacaataggatggacccaagggctcagaccccagtccccgggaaaggcccttttggtcgggaggaactcttaaggcgtaaactaatccatgatgggtgtctcctgtggaagaccgcaacaggacgtttcaaagacgtgcttgtgttgcttatgacagatgtcttagtgtttctgcaggaaaaagatcaaaagtacatcttcccaacactcgataagccgtccgtggtgagtctccagaatcttattgtgagagacattgccaatcaggagaagggcatgtttttaatttcggcggcccctccagagatgtacgaagttcacacagcttcgcgcgatgaccgcagcacctggatacgcgtcattcagcaatccgttaggacctgccccagcagggaagacttccctttgattgagactgaagatgaagcttatcttcgacgcatcaaaatggagctgcagcagaaggaccgtgcgctagtcgagctgctgcgcgagaaagtgggactattcgccgaaatgacacatttccaagctgaagaagatggaggctcagggatggcattgccgactctgccgcggggactctttcgcagcgagtctctggagagtcctaggggagaacgcctgctgcaggacgccatcagagaggtggaaggattgaaggatctgctcgtgggcccaggagtagagctgctcctgacccccagagagcctgctctgcctctggagccagattcaggcgggaatacttcacctggcgtgactgcaaacggtgaagcgaggacctttaatggatctattgaactttgcagggcagacagtgactctagtcagcgtgacagaaacggtaatcagttacgaagtcctcaggaagaggctctgcagagactggtgaatctatatggcctcctgcacggacttcaagccgcagtggcacagcaagataccctcatggaagcccggtttccagagggccccgagcggcgagagaagttgtgcagggcgaactcacgggacggcgaggccggaagggccggggctgctcctgtggcaccagaaaagcaggccacagagctggctttgctccagaggcagcatgctctcctgcaggaagaacttaggagatgccgccgcctaggcgaggagcgcgctaccgaggcagggtccctcgaggcaagactgcgcgagtccgagcaggcccgggccctgctggagcgtgaggccgaggaggccaggcgccagctggcggcgcttggccaaacggagccactgccggccgaggctccttgggctcggaggcctgtggaccctcgcaggagatcactgcctgccggcgatgctctctatctctcctttaaccctccacaaccttcgaggggcactgatagactggatctgccggtgactaccaggtccgtacacagaaactttgaagatcgcgagcgacaagagttagggtcaccagaggagcgactgcaagatagcagcgacccagacaccggttcagaagaagagggcagctcacggctgagtcccccgcattcccctagagatttcacgcgtatgcaggacattcccgaggagaccgaaagccgggacggcgaggccgtggcaagcgagtcttag

SEQ ID NO: 132620 - DNA, 2964 bp, Artificial Sequence
  Description of Artificial Sequence: Synthetic coding sequence
atgtgttgctgttgcggatgttgccctttactggctcacttagaacagggctccttacgtgagcgtaccagggagaaggaaaaaatgaaagaggctaaggatgccaggtataccaacggccacctatttacaacaattagcgtgtccggcatgactatgtgttacgcctgcaacaaatctataaccgctaaggaggccctcatttgcccaacttgcaatgttaccatccataaccgctgcaaagacaccctggctaattgcactaaagtgaaacagaagcagcagaaggctgctctgctaaaaaataacaccgctctgcaaagcgtctccttaagatctaagaccactatccgggaacgtcccagtagcgctatttaccctagcgactcctttcggcagagcctcctagggtcgagaagaggaaggtcttcgttatcgctggcaaaatctgtgtccacaacaaacatagcaggccactttaacgacgaaagccctctagggctgaggcgtattctatcccagagcacggacagtctgaatatgcggaatcgtacgctgtccgtggagagcctcatcgatgaggccgaggttatttattccgagctaatgtctgatttcgaaatggatgaaaaggatttcgccgccgacagttggtcactcgctgtggattcctcctttctgcagcagcacaaaaaggaggtgatgaagcagcaggacgtgatctatgagctcattcagacagaattgcatcatgtccgcactctcaagattatgacccgcctcttcagaactggcatgcttgaggagcttcacttagagcctggggtcgtgcagggtttgttcccctgcgtagatgagttgtccgatatccacacacgcttcctgagtcagctgctagagagacggcggcaagcgctttgcccgggatctacccgcaactttgtcattcaccgcctgggggacctgttaatatcacagtttagcggccctagtgctgagcagatgtgtaagacatatagcgagttttgttcacgtcactcaaaagccctgaagttgtacaaagaactgtacgcccgtgacaaaagatttcagcagtttatccgcaaggtcactagacctgctgtgctgaagcggcacggtgtgcaagagtgcatcctcttagtgacccagaggatcacaaagtatcctctactcatctcaaggatcctgcagcattcccacggaatagaggaagaacgccaggacctcaccaccgccctgggactcgtcaaagagctgttatctaacgtcgatgaaggtatctaccagttggaaaaaggggcgcgtttgcaggagatatacaatcggatggatcctagagcccagactcccgtgcctgggaaaggtccattcgggagagaagagcttttgcgccgcaagttgatacatgatgggtgcctgttgtggaagaccgctactggacggttcaaggatgttttggttttgcttatgactgatgttctcgtattcttacaagagaaggaccagaaatatattttccccacactggacaaaccctctgttgtgagtctgcagaatctgatcgtcagagatattgcgaatcaggaaaaaggtatgttccttatctcagccgcccccccagagatgtatgaggtccatacagctagcagagatgatcgttcaacctggattcgcgtaatacagcagtccgttcgtacttgcccctccagagaggatttccccctgatcgagactgaagatgaagcatatctgcggagaattaaaatggagcttcaacaaaaggacagagctcttgttgaacttctgcgcgagaaagtgggtctgtttgccgagatgactcactttcaggctgaagaggacggtgggagtggaatggctctgccaacattaccaaggggcctgtttcgttccgagtcgctggagtcaccacggggagagcgcttactccaagacgcaatccgagaggttgaaggactaaaagacttgctggtggggccgggggtcgagctgctgctgacacctcgggaacccgccttgccacttgagcctgattctggtgggaacacatcaccaggcgtgacagccaatggtgaggccaggactttcaacggttcaatcgagctgtgcagggccgattcggacagcagccagagagacaggaatggaaaccagctgcgttccccgcaagaggaagctttacaacgactggtcaatctttacggtctgctgcacggcctacaagcagctgtggcacagcaggacactctgatggaggcacgctttcctgaagggcccgagcggagagagaagctctgtcgcgccaatagtcgggacggcgaagcaggcagagccggcgccgctcccgtggcacctgagaagcaggcaacagaactcgccttgttgcaacgacagcacgctctcttacaggaggagctgcgccgctgcagaaggctcggcgaggagagggcgacggaggcaggatcgctggaggctagactccgcgagagcgagcaagctcgtgcacttctggagagggaggcagaagaagctcgaaggcaacttgccgctctgggacaaaccgagccccttcctgcggaagcaccttgggcccgcagacctgtggatcctcgaaggcgttcactgcccgctggcgacgccctatacctttctttcaatccacctcagccgagtcgaggcacagataggctggacctgcccgttacaacgcgaagtgtgcacagaaactttgaggatcgtgaaagacaggagctaggaagcccagaagaaaggctgcaggactcgtctgatcccgatactggcagcgaggaggaaggctcttcgcgactctcaccacctcattcccctcgcgactttacccgcatgcaggacattcccgaagaaactgagagtcgggacggagaggcggtagcctccgaatcctag

SEQ ID NO: 132621 - DNA, 2877 bp, Artificial Sequence
  Description of Artificial Sequence: Synthetic coding sequence
atgaaagaggcaaaggatgctcggtacacgaacgggcatttgtttacgactatttcagtttccgggatgacaatgtgctatgcctgcaacaaatcaatcaccgccaaggaagctctgatctgtccaacctgtaacgtgactatacataacaggtgcaaggacactctggccaactgtacaaaggtgaaacaaaagcaacagaaagcagcactgttgaaaaataataccgccctgcagagtgtatccctgcggagcaagacgacaattagggaacgacccagctccgctatctacccctcggattccttcaggcagagtttactgggttcgcgaaggggcagatcatctttgtcactggccaaatctgtttcaaccactaatatcgcagggcacttcaacgatgagtctccgctggggctcagacgaatcttgtcgcagtccaccgattctctcaacatgaggaaccggacactgtcagtcgaaagcctgatagacgaggaagttatctactccgaactgatgagcgatttcgagatggacgaaaaagacttcgccgctgacagttggtccttggctgtggattcatccttcctgcaacagcataagaaagaggtaatgaaacaacaggacgtgatttatgagctaatacaaaccgagttgcatcatgtgagaactctgaagatcatgactagactgttccgtaccggcatgctggaggagctgcaccttgagcctggcgtggtccagggtttatttccctgtgtggatgaactgtccgatatccacaccaggtttctgagccagctgcttgagagacgccgccaagcactctgtccggggtctacacggaactttgtaatccataggctcggtgatctcctgatatctcagtttagcggaccatctgctgagcagatgtgtaagacttattcggaattctgtagccggcatagcaaggctctgaaattgtacaaggagttatacgctcgggataaacggttccaacagttcatccggaaagttactcgtccggcggtcctcaagagacatggagtgcaggagtgcattctcctcgtcacccagaggattacgaagtacccactcttaattagcaggatactgcagcattctcacggtatagaggaagaaagacaggacttaacaactgcgctggggttggttaaagagctactgagtaatgttgacgaaggtatttatcagctcgagaaaggtgcaaggctgcaggagatctacaacaggatggaccctcgtgctcagacaccggtgccagggaagggcccatttggtcgcgaagagctcctccgcaggaagctgattcatgatggatgccttctgtggaagactgccacgggccgtttcaaggatgtgctggtgctgctaatgaccgacgttctcgtgttcctgcaagaaaaggatcagaaatacatctttccaacactcgacaagccctccgtggtgagcctgcagaatctgattgtgcgagacatagcaaatcaggaaaagggtatgtttctgatttctgcagccccacctgaaatgtacgaggtgcacacagctagtagagacgatagaagtacctggatacgcgtgattcaacagagcgtccggacatgcccatctagggaggactttcctctgattgagactgaggacgaagcttacctacgtcgaattaagatggagctgcagcaaaaggatagagcactggtggagctcctccgcgagaaggtcgggctgtttgcggaaatgacccactttcaagcggaggaggatggggggagtgggatggcacttcctaccctgcccaggggactcttccgttctgaaagcctggagtctcccaggggagagcgactgctgcaggatgccatcagagaggttgaaggactgaaggaccttttggtgggtcctggagtcgagctccttctcacccctagagagcccgctctccccctggagcctgattctgggggtaatactagtcccggcgtgactgccaatggggaggcgagaacctttaatggttccatagaactttgccgcgcggactccgatagcagccaacgcgacaggaacggaaatcagctgagaagtccccaggaagaagcgcttcagagactggttaatttgtatggtctgctgcatggactacaggccgctgtggcacagcaagacacactgatggaggcgcggtttccagagggccccgagcggagggagaagctgtgcagggccaacagtagagatggagaggctggccgcgccggagcagcccctgttgcccccgagaagcaagccaccgagttggcgttactgcagagacaacacgcgctgctgcaggaggagctgcggcgctgccggcgacttggagaggaacgcgccacagaagccgggagtctggaggcgagattacgagagagtgagcaggccagagctctgttagaacgggaggccgaggaggcccgtcgccagctggccgccctgggacagactgaaccccttccagccgaggccccatgggcccggagaccagtggatccgcggcgtagaagtctacccgccggggatgccctctacctgtccttcaaccctccccaaccttcaagggggaccgataggttggatttacctgtgacaacccgcagcgtgcaccgtaactttgaggaccgggaacgacaggagctgggttctcccgaggagcgtctgcaagattcttccgaccccgatacagggtccgaggaggagggcagctctagacttagtccaccacactcaccccgcgatttcacacggatgcaggatatccccgaggaaaccgaatctcgagatggcgaggccgtagcgtcagagtcctag

SEQ ID NO: 132622 - DNA, 1548 bp, Artificial Sequence
  Description of Artificial Sequence: Synthetic coding sequence
atgctctccaaaagcgttccggtttcaggcatcaactgtctcctggataggagcgacactgatggaaacgtgtcccagtctagcgccatcgatttaaggaagaggtgtagccagcttgagggccacagcggcacccgggtgggaagcagtctgcgccagacgttctcgttcctgagcggaatgacaggcaaggccaaaactagggaaaaggagaagatgaaggaggccaaagatgccaggtataccaatggccacctcttcactaccatttctgtctctgggatgaccatgtgctacgcatgcaacaagagcatcaccgcgaaggaagccctgatatgtcccacatgtaacgttaccatccacaacaggtgtaaggatacactggcgaattgcactaaggttaaacagaaacagcaaaaagcagccctgctcaaaaacaatactgcattacagagtgtgagcctccgaagcaagacaacaattcgcgagcgaccatcatctgcaatatacccttcagattcgtttagacaaagcttattggggtcacgtagagggcggagcagtttgtctctagccaagtctgtctcgacaactaatatagccggccacttcaacgatgagtcgccattaggcctgcggcggatattgtcacaatccaccgatagcctgaatatgcgcaatcgtactctctccgtcgaatccttgattgatgaagccgaagtgatttactccgagttgatgagtgacttcgagatggacgagaaggactttgcggcagatagctggagtctggcagttgactcctcgtttttgcaacagcacaaaaaggaggtgatgaagcagcaggacgttatctatgaactaatccagactgagctgcatcacgtcagaaccttaaaaataatgaccaggctctttagaactggcatgctggaagagctgcacctcgagcctggcgtggtgcagggcctgttcccctgcgtggatgaactgagcgacatccacactagatttctgagccaactgttggagagaagacggcaggccttgtgcccaggaagtactagaaactttgttattcaccggctgggagacttgctcattagccaatttagtggtccaagcgctgagcagatgtgtaagacatatagcgaattctgtagcaggcactctaaagccctgaaactgtataaggaactgtatgcacgggataagcgcttccagcagtttatcaggaaagtcactcggcctgcagtgctgaaacggcacggggttcaagaatgcatactgctagtgacccaaagaattaccaagtatcccctcctgatatccaggattctacaacactcgcacggcattgaggaggaacgccaggatcttacaaccgctcttgggttggtaaaagaacttctgagcaacgttgatgaaggcatctaccaattggaaaaaggcgcaagattgcaggagatttacaacctgctgctccttttttccctttcaccctcgtttatggaggcgctgggagataatctcgcaagttggagctag

SEQ ID NO: 132623 - DNA, 1332 bp, Artificial Sequence
  Description of Artificial Sequence: Synthetic coding sequence
atgaaggaggccaaagatgcacgctacacaaacggacatctgtttactactattagtgtgtcggggatgaccatgtgctatgcttgcaataaaagcattactgctaaggaggcactgatttgccctacctgtaacgtcaccatccacaatcgctgtaaggacaccctcgccaattgtaccaaggtcaagcagaagcagcagaaggctgcccttttgaaaaacaacactgctttacaatctgtgtcactgcggtctaaaacgacgattcgcgaacggccgtctagcgccatttacccgtccgattcgtttcgacaaagcctgctcggcagtcgaaggggcagatcatctttgtccttagccaagtccgttagcacaactaacatagctggacactttaatgacgaatcaccactgggcttgcggcgcattttgtcacagtctactgattccctgaatatgcgtaacagaacactcagtgtagaaagcctcatcgatgaggctgaggtcatatacagcgagctgatgtctgacttcgagatggacgaaaaggatttcgctgccgacagttggagtcttgcagtggactcatcttttctccaacagcataagaaagaggtgatgaagcagcaagatgttatttatgaacttattcagacagaactccaccacgtgcgcacacttaaaattatgactcgtctcttccgtaccgggatgctggaagagcttcatctggagcctggtgtggtgcagggcttgtttccgtgtgtcgatgaacttagtgacatacataccagatttctgtctcagctgctggaaagaaggcgccaggctctgtgccctggttccactcgaaatttcgtcattcatcgtctgggggatttactgattagccaattcagcgggccttcggccgaacagatgtgcaagacctacagtgagttctgcagcaggcacagcaaagccctgaaactgtacaaggagttgtatgcaagagataagcgctttcaacagttcatccggaaggtgactcgacctgctgtcctaaagcgacacggagtccaggaatgtattctcctcgtgacacagagaattacaaaatacccccttttaattagccgcatcctgcagcattctcacgggattgaagaggagaggcaggatcttacaacagccctaggccttgtgaaggaactattgagcaacgtcgacgaaggaatctaccaactagagaaaggggcccgactccaagaaatatacaatctcctcctgctgttctccttgtcaccgagttttatggaggcgctcggcgataatctggctagctggagttag

SEQ ID NO: 132624 - DNA, 4167 bp, Artificial Sequence
  Description of Artificial Sequence: Synthetic coding sequence
atgagtaggccccctcctaccggcaagatgcccggcgcgcccgagaccgcacctggggacggagctggtgccagccgtcaacgcaagctggaggccctcattagggaccccagatccccaatcaacgtcgagtcactccttgacggcctgaattccctcgtgttggatctggattttccggccctcaggaagaacaagaacattgacaactttcttaatagatatgagaaaatagttaaaaagatcaggggcctgcaaatgaaggctgaagactatgatgtggtgaaagttattggcaggggcgcctttggggaagttcagctggtgagacacaaggcctcgcagaaagtatacgccatgaaactcctaagtaagtttgaaatgatcaagagatccgacagcgcatttttttgggaagaacgcgacattatggcgtttgccaatagcccatgggtggtccagctcttctatgccttccaggatgatagatacctatatatggtaatggagtatatgcctggtggggatctggtcaacctaatgtccaattatgacgttccagagaagtgggctaaattttacactgccgaagtggtgttggctttggacgccatccacagcatgggcttgattcatcgcgatgttaagcccgacaacatgctcctggataaacacggacatcttaaactggccgatttcggcacctgcatgaagatggatgaaaccggtatggtacactgcgacaccgcagtgggtactcctgattacatctctcccgaggtccttaaaagccagggaggggacggcttttacgggcgcgagtgtgattggtggagtgttggggtgtttctgtacgagatgttggtgggtgatactccattttatgccgattccctcgtggggacctattctaaaataatggatcacaagaactcactgtgttttcccgaggacgccgagattagtaaacacgcaaaaaatttaatttgtgccttcctgaccgatcgagaggttcgactgggaaggaacggagtggaggagatccgacagcatcctttctttaaaaatgatcagtggcactgggacaacatccgggaaactgccgctcctgttgttcctgagctgtcctccgatatagattcgagcaatttcgacgacatcgaagacgacaagggagatgtagagactttccccattcctaaagcctttgtcgggaaccagctgccttttattggctttacctactatagggagaacctcctccttagcgacagcccaagctgcagggagaccgattccatccaatctaggaaaaatgaagagagccaggagattcagaagaaactttacacactggaagagcatctgtcaaatgagatgcaggcaaaggaggaactcgagcagaagtgtaagagtgtgaacaccagactggaaaaaactgctaaggagctcgaggaagagatcactctaaggaaatcagtcgagagcgccctgagacagttggagcgcgaaaaggcactgttacagcacaagaacgcggagtaccaacgaaaggctgaccacgaggctgacaagaaaagaaacctggagaacgatgtgaacagtctcaaggaccagttggaggacctaaagaaacgcaatcaaaattctcaaatttcaaccgagaaggtgaaccagctgcagagacagctagatgaaacgaatgctttactccgcactgagagcgacaccgcggcacggctgcgcaagacccaagctgaatctagcaaacaaatccaacagctggagagcaataaccgcgacttgcaagataaaaactgtctcctggagaccgccaaactcaaactggagaaagagttcatcaatctgcagagtgccctcgaaagtgagaggcgggatcgaacgcacgggtccgagattattaatgacctgcaagggcgcatttgcggcctagaggaggatctaaaaaatggaaaaatcctgttagccaaggttgaactggagaagcgccagttgcaggagaggtttaccgacctagaaaaggagaaatccaatatggagatagacatgacctatcaactgaaagtcatccagcaatccctggagcaggaagaagccgagcataaggccaccaaggccagactcgccgacaagaataaaatttacgagtctattgaggaggctaaaagcgaagcgatgaaggagatggagaagaagttactagaagagcgcactcttaagcagaaggtcgagaacctcctcttggaggccgaaaagcgctgctctctgctggactgtgatctcaaacaatcccagcagaagataaatgagctgctcaaacagaaggacgtcctgaacgaagacgttaggaatctaacacttaagatagagcaggaaacacagaaaagatgcctgacccagaacgatcttaaaatgcagacccagcaggttaacacgctaaagatgagcgagaagcagctcaagcaagagaacaaccacctgatggagatgaagatgaacctcgagaagcagaatgctgagctacgtaaagaacggcaggacgctgacggtcaaatgaaagagctccaagaccagttagaagcggagcagtatttcagcaccctttacaagacgcaggttcgggaactaaaagaagagtgcgaagaaaaaactaagctgggcaaagagctccagcagaaaaagcaggaattacaagacgagagagactccctggccgcccagctggaaataactctcaccaaagccgatagcgagcagctggctcggtcgattgcggaagagcagtacagtgatctggagaaggaaaagataatgaaagagttagaaataaaggagatgatggcccggcacaaacaagagctgacagagaaggacgcaacaatcgcgtctctggaggagacaaataggacacttacctcggatgtcgcaaaccttgcaaatgaaaaggaggaactgaacaacaagctgaaggatgtgcaggagcagttatctcgcctaaaggatgaggaaatctcagccgctgcgattaaggcccagtttgaaaaacagcttcttacagaaaggacactaaaaacccaagcagtgaacaagctggccgagatcatgaacaggaaggaacctgtgaagcgagggaatgataccgacgttcgaagaaaagagaaggaaaatagaaaactgcacatggagctgaaaagcgagagagagaaactgacccagcagatgattaaatatcagaaggagctcaatgaaatgcaagcacagattgccgaagagtcacagatcaggattgaactccagatgactctggacagcaaggactccgacatagagcagcttagatctcaattgcaggccctgcatataggcttggactcatcgtctatcgggagcggacccggcgatgctgaggcagacgatgggttcccggaaagccgacttgaaggctggctgagcctccccgtgaggaataataccaaaaagttcgggtgggtaaaaaaatatgttatagtgtcttctaagaagattctgttttatgacagtgaacaggataaagagcagtccaacccttacatggtcctagatatcgacaagcttttccatgtgcggccagtgacgcagacagatgtgtaccgagccgacgccaaggaaatacctcgaatcttccagattctttatgccaatgagggcgagtcaaaaaaggagcaggaatttccagtcgaacctgtgggcgaaaagagtaattatatctgccacaaagggcacgagtttatccccacactctaccactttcctacgaactgcgaggcctgtatgaagcctctctggcatatgtttaaaccgcctccagcactggagtgccgcaggtgtcatataaagtgccacaaggaccatatggacaagaaagaagaaatcatagctccttgcaaagtgtactatgacatctcaaccgctaaaaacctccttctcctggcgaatagcacagaggaacaacaaaaatgggtttccaggctggtgaagaagatcccgaagaagccgcccgcgccagatcccttcgctaggagcagcccaaggacctctatgaaaattcagcagaatcaaagtattcgcagaccctccaggcagttggcccccaacaagccatcatag

SEQ ID NO: 132625 - DNA, 2241 bp, Artificial Sequence
  Description of Artificial Sequence: Synthetic coding sequence
atgatatacaaagtggaatgcgggttggaagaggatctgaagaacggaaagattcttctggctaaagtagaactcgagaaacggcagctgcaagaacgctttacagatcttgagaaagagaaatccaatatggagatagatatgacgtatcagttgaaagtgatccaacagtccctggagcaggaggaagcagaacataaggcaacaaaagcccgtctcgcagataaaaataaaatctacgagtcgatcgaggaggccaagtcagaggctatgaaggagatggagaaaaagctcttggaggaacgaacgcttaaacagaaggtcgaaaatctgctgctcgaagctgagaagagatgtagtttactggactgcgatctgaagcaatcacagcagaagatcaatgagctgttaaagcaaaaagacgtgcttaatgaggatgtgagaaatctgactcttaaaattgagcaggagacccagaagcgctgtctgacacagaatgacctgaaaatgcagacgcagcaggtgaatactctaaagatgtctgaaaaacagttaaagcaggaaaataaccacctcatggagatgaagatgaacttagaaaagcaaaatgccgagctccgaaaggaaagacaagatgcagacggacagatgaaggagttgcaagaccagctagaggccgaacaatatttctctaccctctacaagacacaggttcgggaactgaaagaggaatgtgaagaaaagactaaactaggcaaagaattgcagcagaagaagcaggaactccaggacgagcgggacagcttggcggcacagttggaaattactctgaccaaggcagattccgaacagctcgccaggtccatcgccgaggaacagtactctgaccttgagaaagaaaagattatgaaagaactggagatcaaggagatgatggctcgtcacaaacaggaattaactgagaaggatgccacaatcgcctctctcgaggaaaccaacaggacactgacttctgatgttgccaacctcgccaatgaaaaggaggagctcaataacaaactgaaagatgttcaggaacagttaagccggttgaaagacgaggagattagcgcggcggctattaaagctcaattcgaaaagcagcttctgacggagcggaccctgaaaacacaggctgttaataagctggccgaaataatgaataggaaggagcccgtaaaaagggggaatgacaccgatgtacgcagaaaagagaaggagaacagaaaactgcacatggaacttaagtccgaacgcgaaaaacttacacagcagatgatcaaataccagaaggagctcaacgagatgcaggcccaaatcgcagaagaaagtcagatcagaatcgaactgcaaatgaccttggatagtaaggacagtgatatagagcagctcaggtcacagctgcaggccttgcatatcgggctggatagctcatccatcggatctggacccggagacgccgaggctgatgatgggttccccgagagccgcttggagggatggctgtccttacctgtccgcaataacacaaagaagttcggatgggtcaaaaagtatgttattgtctcctccaaaaaaatattgttctatgactctgaacaggacaaagaacaatccaacccttacatggtgctggacatcgataagctgtttcacgtaaggccagtgacacagaccgacgtgtatcgcgccgatgcaaaagaaatacccagaattttccagattctttacgccaatgagggggaatccaaaaaagaacaagaatttccagtggaacccgtgggagaaaaatcaaattacatctgccataagggtcacgaattcataccgaccctgtatcatttccccacgaattgcgaagcgtgtatgaagcctctgtggcacatgttcaagccccccccggcccttgaatgccgccggtgtcacatcaagtgccacaaggatcacatggacaaaaaggaggagattattgccccatgcaaggtgtattacgacatctctacagcaaagaaccttcttctcctcgctaattctacagaagaacagcagaagtgggtgagccggctggtcaaaaagatcccgaaaaaacccccagcgcccgacccttttgcccggtcctcacctcgtacttcaatgaagatccagcagaatcagtccattaggcgtccaagcaggcagctggctcccaataagccaagctag

SEQ ID NO: 132626 - DNA, 3438 bp, Artificial Sequence
  Description of Artificial Sequence: Synthetic coding sequence
atggttcactgtgacaccgcagtgggtacccccgactatatctcaccagaagtgctcaaatcccagggaggggatggcttctatggacgcgagtgcgattggtggagtgtaggagtattcttgtacgagatgctcgtcggcgacacacccttctacgctgattctctggtgggaacgtactccaaaatcatggaccacaaaaattctctgtgcttcccagaagacgcggaaatctccaaacatgccaagaacctcatctgtgcttttcttactgaccgtgaagttcgtttgggtaggaatggcgtcgaggaaattcgacagcatcccttttttaagaacgaccagtggcactgggacaatatccgcgagaccgccgctcctgtagtccccgagcttagttccgacattgactcaagtaatttcgacgacatcgaagatgacaagggggatgtcgaaactttccccatccctaaagcctttgttggaaaccagctcccatttatcggctttacgtattacagggagaatcttctgctgagcgattcgccctcctgccgcgagaccgactctatccagagcagaaagaatgaggaaagccaagagatacaaaaaaagctgtatactctcgaagaacatctgtccaacgaaatgcaggctaaagaagaacttgagcagaagtgcaagagcgtcaatacaaggcttgaaaagacagcaaaagagctggaggaggaaatcactctgcgcaagagcgtggagagcgctctcagacaacttgaaagggagaaggctcttctgcagcataaaaatgcagagtatcagagaaaagctgaccatgaagcagacaaaaaacgaaatttagagaacgatgtgaatagcttaaaggaccagctggaggacctcaaaaagcgaaaccagaactctcagattagcactgagaaggtgaaccagctccagcgccagctcgacgagaccaatgccctgctgcgaaccgagagtgacacagccgccagactgcggaagacccaggctgagtcctcgaagcaaatccaacagctggaatcaaacaatcgggacctgcaggataagaattgcctgcttgagactgccaaactgaagctggaaaaagagttcattaaccttcagtcggcccttgagagtgagagacgggatagaacacatggttcagaaataattaacgatctgcaaggccggatctgcggattggaggaggatctgaagaacggcaagattctgttggccaaggtagagcttgaaaaaagacagctgcaagaaagatttaccgatttggagaaggaaaagtctaatatggaaatcgatatgacctaccagctgaaggtgatccagcagagtcttgagcaggaagaggccgagcacaaagccacaaaggccaggcttgcagataaaaataagatttacgagtctatagaggaggccaagagcgaagcgatgaaagaaatggaaaaaaaattgctggaggaaagaactctgaaacagaaggtggagaatttgctgctggaagccgagaaaagatgctctttgcttgattgtgatctcaagcaatctcagcaaaagattaacgagctccttaagcagaaggacgtcctcaacgaggacgtacggaatctgacccttaaaatcgagcaggaaacgcagaagcgttgtctgactcaaaacgatttgaaaatgcaaacacaacaagtgaatactctgaagatgagcgagaagcaacttaaacaggagaataaccacctgatggagatgaaaatgaatctcgagaaacagaacgccgagctgcggaaagaacgccaggacgcagatgggcaaatgaaggaactgcaggaccagttagaggcggaacagtacttctccacactgtacaaaacacaggttcgcgagcttaaagaagagtgcgaagaaaaaactaaattaggcaaagagctccagcagaaaaagcaagagctgcaagacgaacgggattcactggcagctcagcttgaaattactctgaccaaggcagattcagagcagttggcaaggagcatcgcagaggaacaatactccgacttagagaaagagaagattatgaaagaactggaaataaaggaaatgatggcaagacacaaacaagaacttactgagaaagacgccacaatcgcatccctggaggagaccaaccggaccctgactagcgacgtcgccaaccttgcaaatgaaaaagaagaactgaacaacaagctgaaggacgtgcaggagcagcttagcagactcaaagacgaagaaataagtgcagcagccattaaggcacagttcgagaaacagctgttgactgagcgaacacttaagacacaggccgtgaacaagttggccgagattatgaatcggaaggaacccgtaaaaaggggcaatgacacagacgtgcgccgcaaagagaaggaaaatcggaaactgcatatggagttgaagtctgagcgtgagaagcttactcagcagatgataaagtaccaaaaagagctgaacgaaatgcaagcccagatcgccgaggagagccagatcagaattgagctccaaatgacactagactccaaggactcggacattgagcagttgcggtcacagcttcaagccctgcacataggcctggacagcagttccattggatctggaccaggggacgccgaggctgatgacgggttcccagaaagtcggttggaggggtggctgtctctccccgtgcgtaacaatacgaagaagttcggctgggtcaagaaatatgtgatcgtgagctccaagaaaatacttttttacgattctgagcaggataaagagcagtccaatccctacatggtgctcgacatcgacaagctgttccatgtccgaccagtcacacagacagacgtatacagggccgatgccaaagaaattccccgcattttccaaatcttgtatgcaaatgaaggggagtccaagaaagaacaggagttcccagtggagccagtgggggaaaagagcaattacatttgccacaagggacacgaattcattcctaccctctaccatttccctactaattgcgaggcttgtatgaagccactctggcatatgttcaagccaccgcccgctctggaatgcaggcgctgccacatcaagtgccacaaggaccacatggacaaaaaagaagaaatcatagccccgtgtaaggtgtattacgatatttccaccgcaaaaaacctcttgctcctggctaacagcacggaagaacagcagaagtgggtcagccgcctggtcaagaagatccctaagaaaccacccgcaccggatcctttcgctcgatcgtccccacggacctccatgaaaattcaacagaatcagagtatcaggcgccccagcaggcagctggcccctaataaacctagctag

SEQ ID NO: 132627 - DNA, 2568 bp, Artificial Sequence
  Description of Artificial Sequence: Synthetic coding sequence
atgtcagaggcaagaagggactctacttcgagcctgcaaagaaaaaaaccgccttggctcaaacttgatataccgtctgctgtgcctttaacagctgaagaaccttcgttcctacagccattgcgacgccaggccttcctgagaagcgtgtcaatgccagcagagaccgcccacattagtagtcctcaccacgaactccgcagacccgtcctgcagcggcagacatctatcacccagacgattcggcgagggacggctgactggtttggcgtgtccaaggattccgattcaacgcagaaatggcagcggaagtcgatccggcattgttcccagagatacggcaaattaaaaccacaagtgttgagagaactggacttaccgtctcaagacaatgtctctctaacctccaccgaaacccccccccccctttatgtgggaccatgccagctggggatgcagaaaatcatcgatcctttagcccgggggcgagcctttcgcgtagcagatgataccgccgagggcctctcggcaccccacacacctgtaacccccggagcggcttcactgtgtagcttctcttcttcaaggtccgggtttcacaggctcccccggcgcagaaaacgggaaagtgttgcaaagatgagttttcgcgcagcagccgctctcatgaaagggagaagcgtgcgcgatggcacattccgtagagcccaacgcaggtcgttcacaccagcgtcatttcttgaggaagacacaactgacttccctgatgagctagacacttctttctttgccagggagggaatcctgcacgaagaactcagtacatatccagacgaagtgtttgagagtccttccgaagccgccttgaaggactgggagaaggcacccgagcaggccgatttaaccggcggcgcattggatcgttcagagctggaacgcagtcatctgatgctgccactggagcgtggatggcgcaagcaaaaagaaggagccgccgccccacaacctaaggtgcgactgaggcaggaagtcgtgtcaacagccggacccagacgcggtcaacgcattgccgtgccagttcgcaagcttttcgccagggagaagcggccctacgggctgggcatggtgggcagattgactaacagaacttataggaaacggatcgatagttttgtgaaaaggcagatcgaggacatggatgaccatagaccgttttttacatattggctcacttttgtccattctctggttactatcctggccgtctgtatttacgggattgccccagtggggttcagccagcacgagacagtggattccgtgttaagaaatagaggagtttatgaaaatgtcaagtacgtgcagcaggagaatttttggatcggccccagtagcgaggctcttattcacctcggcgcgaaattctcgccttgcatgagacaggaccctcaggtgcactcatttataaggtcagccagggaacgtgagaaacacagcgcctgctgcgtgcgcaacgacagaagtggatgcgtgcagacatcggaggaagagtgttcttctactctcgccgtctgggtgaagtggcctattcacccatccgcccccgagctggccgggcataaacgacagtttggcagtgtgtgccaccaggatcctagggtgtgcgatgagccttcctcagaggacccgcacgagtggccagaggacataactaagtggcctatctgcaccaagaactcggcgggcaatcacactaaccatccccatatggactgcgtcattacagggcgcccttgctgcatcggtaccaagggcaggtgcgagattacatccagggaatactgcgatttcatgcgaggttacttccacgaggaagctacattgtgctctcaagtgcattgcatggacgacgtctgtggccttctgcccttcctgaatcctgaagtgcccgatcaattctacaggctgtggctgtccctatttttgcacgccggcatattgcactgcctggtctccatctgctttcagatgacggtgttgagggatctggaaaaactcgccgggtggcaccggatcgccataatctatctcctgagcggcgtgacaggcaacctcgcctcagccatattcctcccctatcgcgcagaagtcgggcccgcgggctcccagttcggcatactcgcctgtctgttcgttgagctgtttcagtcctggcagatcctagcacgcccttggagggcgtttttcaagttgcttgcggtggttctcttcctgtttacctttggactgctgccctggattgataacttcgcccatattagcggcttcatcagcgggttatttttgagcttcgcgttcctcccctatatatcctttggtaagttcgacttgtaccgcaagagatgccagataattatattccaggtagtttttttggggctgttggcgggcctggtcgtcctattctatgtgtacccagtgaggtgcgaatggtgcgagtttctgacttgcatccctttcaccgacaaattctgcgagaagtacgagttagatgctcagctgcattag

SEQ ID NO: 132628 - DNA, 573 bp, Artificial Sequence
  Description of Artificial Sequence: Synthetic coding sequence
atgtcagaggcgcgccgggactcaacaagttctctgcagcgcaagaaacctccgtggttaaaactggatataccctcggctgtgccccttacagctgaggagccctcattcctgcagcctctgcgacgccaggcattcctgagatcggtctcaatgcccgccgagaccgcacacatcagctcaccgcatcacgagctgaggcgaccagttcttcaacgccagacttcgatcactcaaacgattcgaagctcaagacaggttcgtttcggccgcgtgcacactttacccctgctgggccctcgtgcagcccgaagagcctttccacagagacaaagtctgtcctggtccctgctgcgaggcaccgcagactggttcggcgtgagcaaggatagtgatagtacccagaaatggcagcgcaagtccatccggcactgttcacaacgctacggcaaactcaagccccaagtcctgagggaattagacctgcccagtcaggacaatgtatcgttgaccagcactgaaaccccccctccactgtatgtcggcccctgccagctgggtatgcaaaaatag

SEQ ID NO: 132629 - DNA, 699 bp, Artificial Sequence
  Description of Artificial Sequence: Synthetic coding sequence
tagaggccatgctgtattgggaccaagggaagatgcgagatcacgtcccgagagtattgcgattttatgcggggatactttcatgaagaggccacactttgtagccaggtacactgtatggatgacgtatgcggtctgctgcccttcttgaatccagagatgaccgtgctcagggatctcgaaaagctggccggttggcaccgaatcgctataatttatctgctctctggtgttaccggcaatttggcctctgctattttccttccatatcgcgccgaggtaggcccagccggctcccaatttggcatccttgcctgcctgtttgtggagttgttccagtcatggcagatcctagctaggccctggagagcctttttcaagctgctcgcggtcgttctattcctattcacattcggactcctcccatggattgataattttgcacatatctcagggtttatatccgggctgttcctgtcattcgcgtttctgccctacattagcttcggaaagtttgacttatacagaaagcgctgtcagatcatcatatttcaggttgtattcctggggctcttggcaggcctggtggtgctgttttacgtgtaccccgtgagatgcgagtggtgtgagttccttacgtgcataccattcactgacaagttttgcgagaagtacgaactggatgcacagttgcattag

SEQ ID NO: 132630 - DNA, 492 bp, Artificial Sequence
  Description of Artificial Sequence: Synthetic coding sequence
atgagcgaggccaggcgggattccacttcctcgctccaacgtaagaaacccccctggctgaagttggatatcccctcagcagtgcccttgaccgcagaggagccctcctttctgcagcccctgcggcggcaggctttcttacgctccgtgtcgatgcccgctgaaactgcgcatatttccagccctcaccacgagctccgcaggcctgtactgcagagacaaacatcgattacccagacaataaggaggggcaccgcagattggtttggcgtgtcaaaagactcggatagtactcagaagtggcagcggaagtccatacggcactgttcccaaaggtacggcaagcttaagcctcaggtcctccgggagcttgacctgcctagtcaggacaatgtttctctgacatcaacagagactcctcctcctctctacgttgggccttgtcagttggggatgcaaaaaataatcgacccgttggccaggggccggtag

SEQ ID NO: 132631 - DNA, 1740 bp, Artificial Sequence
  Description of Artificial Sequence: Synthetic coding sequence
atgtcagaggcccggcgggattctactagcagtttacaacgcaagaagcctccctggctcaagctggacataccttcagccgtgccactgacggcagaagagccgagctttctgcagcccctcagacggcaggcatttttgaggtccgtcagtatgccagcagaaacggcacacatttcaagcccccatcatgagctgagacggccagtgttacagagacagacatcaattacacaaactatccgccgggggaccgctgactggtttggtgtgtccaaggactcagactctacacagaagtggcagcggaagagcataaggcactgcagtcaacgatatgggaaattaaaaccccaggtccttcgcgaactcgatctgccctcacaggacaatgtgagtctaacgagtacggaaacgccaccacccctgtacgttggcccatgccaactcgggatgcagaaaattatcgatcccctagctagaggcagggcatttagagtggccgacgataccgccgaaggccttagtgctccgcacaccccagtgacccccggggctgcaagcctgtgttccttttccagtagtaggtctggatttcaccgactccctcggcggcgcaagcgagagtcagtggcaaagatgtctttccgcgccgccgctgctctgatgaaaggtcgctctgtgcgtgatgggacctttcgaagggcccagcgtcggagctttacaccagcctcctttctggaggaggacacaaccgacttcccggatgagctggacacttcatttttcgcgcgagaaggaattttgcacgaagagctcagtacttacccggacgaagtattcgagagccctagcgaggctgctctgaaggactgggaaaaggcccctgagcaggcagatctcactgggggcgcactcgacagaagtgagttggagagaagtcacctaatgctgccccttgagcgagggtggcgaaaacaaaaggaaggggcagcggccccccaaccaaaggtgagactacgacaggaggtggtgtcaaccgcagggccacgccgcggtcagaggattgctgtgcccgtaagaaaactttttgcgcgggaaaaaagaccctatggtcttgggatggtgggtaggcttacaaaccgaacctatcgtaagcgcattgattcatttgtgaagagacagatcgaggacatggatgatcatcgacccttttttacctattggctgacatttgtccactctctggtcacgattcttgctgtctgcatctacggtatagcgcctgtgggcttctcacagcacgaaacagtggactccgtgttgcgaaatcggggtgtctacgagaacgtgaagtacgttcagcaggaaaatttttggataggtcccagtagcgtgcggactggacttggggctgggccagccggggccggcccaggaggagcaagacgggggcaggaagcaccggattgtgggcgcagttctccaagccccgcaggcggtccccatcctccgggccggcaggtgtttgctctccatgcgccgggacccgcgggcgcccaactccatagtttgggggcaagggcccgtgaggctctcagacttctgcgggcccaaaggcaagttggcctcagagctgacctgggggggggcgtcctgggagctttcccccggccgggtctgccacccagttcagcccggtgctcattgttccgacctcagattgattccgcagaatag

SEQ ID NO: 132632 - DNA, 2571 bp, Artificial Sequence
  Description of Artificial Sequence: Synthetic coding sequence
atggctagcgccgataagaatggcggtagtgtttcctctgtctctagcagccgtctccagtcaaggaagccaccgaatctcagcataaccattccccccccagaaaaagagacccaggcccccggagaacaagatagtatgttgcctgaaggattccagaacagaagacttaaaaaaagtcagccaaggacttgggccgcccacacgacggcctgtccaccatcgttcctgcccaagaggaagaacccagcctacctcaagtcggtgagcttacaagagccacgcagtcggtggcaggagtcaagcgaaaagagacctggttttcgcaggcaggcatcactcagccaatcaattagaaagggcgctgcccagtggtttggggtctcaggggactgggaaggtcagcgccaacaatggcaacgcagatcccttcaccattgcagtatgaggtatggtcgtctgaaggctagctgccagagggatctggagctgccctcccaggaagctccttcatttcagggcaccgaatccccgaaaccttgtaaaatgccaaagatcgtggatcccctggcccggggtcgcgctttccggcatcccgaagagatggacagaccacatgcacctcacccgccactgacccccggcgtgctgtcactcactagtttcacttcggtgaggtcaggatactcgcaccttccacgcagaaagcggatgtcagtcgcacacatgtctcttcaggccgccgcggctctgctgaagggaagatctgtgctggatgcaactgggcagcgctgtcgtgtagtcaagcgaagcttcgcattcccttcattcctggaggaggacgtggtggacggggctgacacctttgattccagtttttttagcaaggaagaaatgtcaagtatgcccgatgatgtgtttgagtcaccacctttatcagcatcatatttccgggggatcccccactctgcttctccagtcagcccggacggagttcagatcccgttgaaggaatacggacgcgcccctgtcccaggaccacgccgcggcaaaagaattgcctcaaaagtgaagcacttcgctttcgatcgcaaaaagagacactatggccttggggtcgtcggcaattggctcaatcgatcctacaggagatcaatatcatccactgtgcaacgccaactggagagcttcgacagccataggccatattttacttattggctgacctttgtgcacgttatcatcacacttctcgtcatttgtacctacgggatcgcgccagtgggctttgcccagcatgtaaccacccagctggtcttaaggaacaagggagtgtacgagagcgtaaaatacatccagcaggaaaacttttgggtgggcccatcttccatcgatcttatacacctgggagctaagttttcgccatgcattagaaaggacggccagattgagcaactcgtcctgagagaaagggacttagagagagacagcggatgttgcgtccagaacgaccacagtggctgtattcagacccagagaaaggattgttctgaaacactcgctacgttcgtgaagtggcaggacgacacaggcccaccaatggacaaaagcgacctcggtcagaagaggaccagtggggctgtctgccaccaggatccccgaacctgcgaagagcctgcatcctcgggagcacacatctggccagatgacatcacaaaatggcctatctgcaccgagcaggctaggtcaaatcacacggggtttctacatatggactgcgaaatcaaggggcgtccgtgttgtattggtaccaaggggtcttgtgagatcacaacccgcgagtactgcgagtttatgcatggctatttccatgaagaagcaacactgtgctcccaagtgcactgtttagacaaggtgtgcggactcctgcctttcttgaaccctgaagttcctgatcaattctacagactttggctgtccctgtttctgcacgccggcgttgtgcactgtctggtgtccgttgttttccagatgaccatcctacgcgatttagaaaagctggccggctggcaccggatcgcgatcattttcattcttagcggtattaccggaaacctggcctctgcgattttcctcccatatcgcgctgaggtgggtcctgctgggtcacagtttggtctcttggcgtgtttgttcgtggagctattccagagttggccactcctggaacgcccctggaaagcgttccttaatttgtccgctattgtgctgttcctcttcatctgtggcctgttgccctggatcgacaacatagcccacatcttcggattcctgagcgggctgctattggccttcgcatttctgccctacataactttcgggacatcagacaagtatcggaaacgcgctcttatactggtgtcgcttctggcattcgctggactgttcgctgctctggtactttggttatacatttatccaattaattggccatggatcgagcatctaacatgtttcccctttacatcaaggttctgcgaaaagtatgagctcgaccaagtcttgcactag

SEQ ID NO: 132633 - DNA, 2484 bp, Artificial Sequence
  Description of Artificial Sequence: Synthetic coding sequence
atggcctccgcggataagaatggtggttcggtgtcatccgtttctagctctcgcctacagagccgaaaacccccgaacctgagcatcactataccccctcccgaaaaagagactcaggcacctggcgagcaagattccatgctccccgaaagaaaaaaccccgcgtatctgaaatcagtctctcttcaggaaccccgctccaggtggcaagagtcatctgagaaacggcccgggttccggaggcaggcttctctcagccagagtatccggaagggggccgcccagtggttcggtgtgagcggcgattgggaggggcagaggcagcagtggcagagacggtccctgcaccattgctcaatgagatatggtcgtctaaaagcatcatgccagcgcgacctggaactgccctctcaagaggctcccagtttccaagggaccgaatcgccaaagccctgcaagatgcccaagatagtggatccccttgccaggggccgcgcatttcgccaccctgaagagatggatagaccgcacgctccccacccccccctaacccccggggtgctgtccctaacctctttcacaagcgtccggtcaggatacagccacctgcccagaaggaaacgaatgtccgtggctcacatgtctttacaggcagcggcagccctgctgaagggcaggagtgtgttagatgcaactggccagcgatgcagggtggtgaaaaggtcctttgcttttcctagttttcttgaagaggacgtcgtggatggagcagacacgtttgatagctctttcttctctaaagaggaaatgtcctcaatgcccgacgacgtctttgagagccctcccctgtctgcctcttattttcgcggcatcccccacagtgctagccctgtctcccctgacggcgttcagatccctctcaaagagtacggccgtgcgcccgtgccagggcctaggcggggcaagcgcattgcttctaaagtgaaacattttgcatttgatagaaagaagcgccattatggactgggggttgttggcaattggcttaatcgttcctatcgcagatccattagtagtaccgttcagcgacagctcgagtccttcgactcacacagaccctatttcacctactggcttacttttgtgcacgtgataattactctcctggtcatttgcacatatggaatcgctcccgtgggcttcgctcagcatgttaccacacagttagtcctgcgcaataagggagtgtacgagtcagtgaaatatatccagcaggaaaatttctgggtcggcccgagcagcatagatttgattcacctcggtgccaagttctcaccgtgcataaggaaggacggtcagattgagcagttggtcttgcgggagagggatttggagcgagactccggctgttgtgtccagaacgaccatagtgggtgtatacagacacaaagaaaagactgctctgagaccttagcaactttcgtgaagtggcaggacgataccggtcctcccatggataagtctgacctgggccagaagcggacttcaggagccgtgtgtcatcaggaccccagaacctgtgaggagcctgcttcttctggcgcacatatatggccagacgatatcactaaatggcctatctgcacagaacaggcccgctcaaatcatacaggtttccttcacatggactgtgagatcaagggacgaccctgttgcatagggaccaaggggtcctgcgagattaccaccagagaatattgtgagtttatgcacggctacttccatgaagaggccactctttgcagccaggtccactgccttgacaaagtctgcggactcctgcctttcctgaacccagaggtaccggatcagttctatcgcctgtggttaagcctgtttctgcatgccggggtggttcattgcctggtatcagtagtgttccagatgacaatcctgcgcgacctcgaaaaactcgccgggtggcataggattgcaattatcttcatcctctcagggatcacgggcaacttagcctccgcgatttttcttccctatcgggccgaggtggggcctgctgggtcccagtttgggctgctggcttgcctctttgtggaactattccagtcctggccgttgctggagcgaccctggaaagcgttcctaaatttatctgcaatagtgctgtttctgttcatttgcggcctgctgccatggatcgataacattgctcatattttcggcttcttgagcggtctactccttgcatttgccttcctgccatatatcacttttggcaccagtgacaaatacaggaagagagctcttatccttgtatcactattagcttttgcagggctcttcgccgccttggtgctgtggctgtatatctatcctataaactggccctggatcgagcatcttacttgttttccctttaccagtcgcttctgtgagaagtacgagcttgaccaggtgctgcactag

SEQ ID NO: 132634 - DNA, 2151 bp, Artificial Sequence
  Description of Artificial Sequence: Synthetic coding sequence
cctggttcctctcgctcccgacaccccctcctgctgctgatttggtccctcggtagttctcagggcccgcatcgccagataagaccacccccaccctgccgtcatgccggcactcatgtgccctccccactgccgcacacccaagtccatcgccgacgccaagcgtatgcccatctcagcctggtgtgctttcggcggggcgccgcccaatggttcggggtaagcggtgattgggagggacaacgacaacagtggcaaagacgatccctccaccattgtagcatgagatacggaagattaaaggcatcttgtcagcgggacctggaactgccctcccaggaggcaccatcattccagggcactgaaagccccaaaccctgcaagatgccaaagattgtggacccattggcccgcggccgcgcctttcgccaccctgaggagatggaccgcccccacgccccccatccaccactgactcctggcgtgttatctctgacctcctttacttccgtgaggagcggatattctcatctcccgaggaggaagagaatgtcagtggctcacatgtccctccaggcggcagccgctctgttgaagggtagatcggtcctggacgctaccgggcaaaggtgcagggtggtgaagaggtctttcgcttttccatcctttcttgaagaggacgttgtcgatggggcagatacctttgatagctcatttttctccaaagaagagatgtcttcgatgcccgatgatgtgtttgaatcacctcctctgtccgcctcgtatttcagagggatcccccatagcgcctcccccgtctcccctgacggggtgcagattcctttaaaggagtatggcagagccccagtgcccgggcctcgccggggcaagagaattgcatccaaagttaaacatttcgccttcgatcgcaagaagcgtcattacggcctaggcgtggtaggtaattggctcaatcggagctacaggcgttcgatctcctctaccgttcagcgacagttggaaagcttcgactcacacaggccatatttcacctattggctcacattcgtccacgtcattataaccctcttggtgatctgcacttacgggattgctccggtgggtttcgctcaacatgtgacgacccaacttgtcctcaggaacaaaggagtgtatgaaagcgtcaaatatattcagcaagagaatttctgggtgggtccgtcctccatcgacctcatacacctaggcgccaaattttctccttgcatcagaaaagacggacagatcgaacagctcgttctccgcgagcgggacctggagcgcgattccggatgttgtgtgcagaatgaccattctggctgtatacagactcagaggaaggactgttcagagaccctagctacctttgtgaagtggcaggacgatactggcccccctatggataagtctgaccttggccagaaacggaccagtggagccgtttgccaccaagatccccgtacatgtgaggagcccgccagtagtggagcccatatttggccagatgacatcactaaatggcccatttgcacggagcaggccagatctaatcatactgggtttcttcacatggactgtgagatcaaaggcaggccgtgctgcatcggcactaaaggatcctgcgaaattactacgcgcgagtactgcgaatttatgcatgggtatttccacgaggaggccactctatgctcccaggtgcactgcttagacaaggtatgcgggctgctcccctttcttaatccggaggtccctgaccagttttacagattgtggctgagtcttttcctgcacgcgggggtggtgcactgcctcgtctccgttgtttttcagatgactattctccgcgatttagaaaaactggctgggtggcaccgcattgctattatattcatcttgtccgggatcaccgggaacctggcctcagctattttcctcccctaccgcgccgaagtgcgcatgtggcgcatgggcccattaccacacattgggggccagccttgttgcagctatagtactcatctgggctcagcccggggaacacgctgcccctcctgcaccggtttacattcagggggtacagcaaatctgggagcatactggctcgtgagctag

SEQ ID NO: 132635 - DNA, 639 bp, Artificial Sequence
  Description of Artificial Sequence: Synthetic coding sequence
atggcccagaccgacaaaccaacttgcattccgcccgaactgcccaagatgctgaaagaattcgctaaggctgcgattagggtccagccccaggacttgattcagtgggccgctgactattttgaggcactgagccggggggagacccccccagtgcgggagaggtccgaacgagtagctctctgtaacagagcggagttgactcccgaactgctcaagatcctgcacagccaggtagcaggcaggttgatcatccgcgctgaggagttagctcaaatgtggaaggtggtgaacctaccgaccgatttgtttaactccgtcatgaatgtgggcaggttcaccgaggaaatcgagtggctgaagtttctggctttggcatgctcagcacttggtgtgacgattacgaaaacgcttaaaattgtttgcgaagtgctaagctgcgaccataatggtggcagtccccgcattccctttagcacatttcagtttctgtacacctatatcgctaaggtcgatggagagattagcgcatcgcatgtgagtcgaatgctcaattatatggaacaggaagtgataggcccggacggcattattaccgttaacgactttactcagaatcctcgcgtgcaacttgagtag

SEQ ID NO: 132636 - DNA, 639 bp, Artificial Sequence
  Description of Artificial Sequence: Synthetic coding sequence
atggcgcagacagacaaaccaacctgcatcccccctgaactccccaagatgcttaaagagtttgccaaagccgccatcagagtgcagccgcaggaccttattcagtgggctgcagattacttcgaggccctgagccgtggcgaaacaccccccgtgcgggagcggagcgagcgcgtggccctgtgcaatcgggctgagcttactcccgagttacttaagatcctgcactcccaggtcgccggacgtttgatcatccgggctgaggaacttgcacagatgtggaaggtggtgaacctgccaacagacctttttaactccgtgatgaatgtcggccgattcacagaagagatcgagtggctcaaattcctggccttagcctgcagtgcccttggcgtaacaatcaccaaaactctcaagatcgtttgcgaagtgctgtcctgtgatcataacggtggctcccctcgcatccctttcagcacgtttcagtttctgtacacttatattgctaaggtggatggagagatctccgcctcacacgtgtctagaatgcttaactatatggagcaggaagtcattggacccgacggcatcatcactgttaacgacttcactcagaatccacgcgtgcagctcgaatag

SEQ ID NO: 132637 - DNA, 351 bp, Artificial Sequence
  Description of Artificial Sequence: Synthetic coding sequence
atggcacagaccgacaagcctacgtgcattcctcctgagcttccaaagatgctcaaagagtttgccaaagcggctattagggttcagccgcaggacctcattcagtgggctgccgactattttgaggcactctctcgtggtgagaccccccccgtccgcgaaagatcggaaagggtcgcattatgtaacagggccgaacttactcctgaactgctgaagattctgcacagccaggtggcggggagactgataattagggcagaagagctggctcagatgtggaaagtcgtcaacctccctaccgacctctttaattcggtgatgaacgttggtagattcaccgaggaatag

SEQ ID NO: 132638 - DNA, 393 bp, Artificial Sequence
  Description of Artificial Sequence: Synthetic coding sequence
atggcacaaactgataagcctacctgcataccacccgagctgcctaaaatgcttaaggagttcgctaaggccgcgatcagggtacagccccaggatctcatccaatgggctgctgactactttgaggctcttagccgcggagagaccccccctgtcagagaaaggtcagagagagtggctctttgcaatagagcggaactaacaccagagctattgaaaatactacacagtcaggtggccggtaggcttataatacgcgccgaagagctcgctcagatgtggaaggttgttaacctgcctacagacctgtttaacagcgttatgaacgtggggaggttcaccgaggagatagagtggcttaaatttctggccttagcgtgtagcgccctttag

SEQ ID NO: 132639 - DNA, 312 bp, Artificial Sequence
  Description of Artificial Sequence: Synthetic coding sequence
atggcccagaccgacaaacctacctgcattccccccgagctgcctaagatgctgaaggagtttgccaaggctgccattcgggtgcagccgcaggacctcatccagtgggcagcagactattttgaggctctctccagaggcgaaacacctccggtgcgagaacggtccgagcgtgtggccctgtgcaaccgggccgagctgacccctgagctgctgaaaattctgcattcccaggtcgcaggcaggctgataatccgcgcggaggaattggcacagatgtggaaggtggtgaacctacctacggatctgtag

SEQ ID NO: 132640 - DNA, 234 bp, Artificial Sequence
  Description of Artificial Sequence: Synthetic coding sequence
atggcacagactgataaacccacttgtatccctcccgaactccccaagatgctgaaggaatttgccaaggctgccatcagagtccagccgcaggatctgattcaatgggccgccgattattttgaggccttgtccagaggcgagactccccctgttagagagcgatccgagagggtggcgttgtgcaatagagccgaactaacaccagagctcctcaaaatcctacattcctag

SEQ ID NO: 132641 - DNA, 693 bp, Artificial Sequence
  Description of Artificial Sequence: Synthetic coding sequence
atgccgctcccagatactatgttctgcgcacagcaaattcatattcctccagagctcccagatatccttaagcagttcaccaaggcagcgatacgtacacagcccgcagatgtccttagatggagcgcaggatacttctctgccctgtcccgcggagatccattacctgtgaaagataggatggagatgccaaccgccacccaaaagacagatactggcctgacacaagggcttctgaaggtactccataagcagtgccatcacaaacgatatgtcgagctgaccgacctggagcagaagtggaagaatctgtgcctccctaaagagaaattcaaggccttgttacagctagatccttgcgagaataaaatcaaatggattaattttctggccttgggctgctctatgctgggaggcagcttgaacaccgccttgaagcacctttgcgaaattttaacggacgaccctgagggcggcccggcccggatcccttttaagacattttcatatgtctacagatatttagcaaggctggattctgatgtgagccctttggaaactgagagctaccttgcatccctgaaagagaatatcgatgcacggaagaatggaatgattggcctttcagatttttttttccctaagagaaagctgctggaatctattgagaatagtgaagatgttggacactag

SEQ ID NO: 132642 - DNA, 693 bp, Artificial Sequence
  Description of Artificial Sequence: Synthetic coding sequence
atgcccctacctgacacaatgttttgtgctcaacagatccatatacctccagaactgcccgatatcctcaaacaattcacgaaggctgctattcgcacgcagcctgcagatgttcttaggtggtctgctggatacttttctgctctatcccggggagatcccttgccagtgaaggacagaatggagatgccaactgcaactcagaaaaccgatactgggctgacacaaggcctccttaaggtgctgcacaagcagtgccaccataaaagatacgtagagctcaccgatctcgaacagaaatggaagaatctgtgcctgcccaaggaaaaattcaaggcccttctgcagctcgatccttgcgagaacaagatcaaatggatcaatttcctcgccttaggttgctccatgttgggaggttctctcaatacagcgctcaaacacctctgtgagatcttgacagatgatcccgagggtggacccgctcggatcccattcaagacctttagttatgtctaccgatatctagcaagactggattccgatgtgtctcctctcgagaccgagtcatacctcgccagcctgaaggaaaatattgatgccagaaagaacggtatgattggcttgagtgattttttctttcctaaaagaaaacttctggaaagcatcgaaaatagcgaggatgtggggcattag

SEQ ID NO: 132643 - DNA, 2091 bp, Artificial Sequence
  Description of Artificial Sequence: Synthetic coding sequence
atggacgccgatatggactatgagcgtcccaacgtagagacaattaagtgcgtggtggtcggagataatgccgtgggtaaaaccagactgatctgtgcccgggcttgtaatacaactctgactcaatatcaactgcttgccactcatgtgccaaccgtctgggccatcgaccaatatagagtgtgccaagaggtcttggagcggtcccgagacgtggtggatgaggtttctgtttctctgcggctctgggatacttttggcgaccatcacaaggatagaagattcgcttatggacgaagtgatgtggtagtcctgtgtttctccatcgccaaccccaacagtcttaaccacgttaaaagtatgtggtatcccgagattaaacacttctgtccacgcacccctgtgatcctcgttggatgtcagttggatctgaggtacgcggacctagaggcagtcaatcgcgctcgccggcccctggcccggccaatcaaaaggggggacattctgccccctgaaaagggccgcgaggtggcgaaagagctcggcctcccctactatgagacaagcgtattcgaccaattcggtatcaaggatgtctttgataatgcaatcagggcagccctcatttcccgtcgacatttgcagttctggaagagtcatttgaagaaagtccaaaaacccctcttacaagctccatttcttccgcccaaagctcctccaccagtcattaagatcccagagtgtcctagcatgggtacaaatgaggccgcttgccttcttgacaatcctctgtgcgcagacgtgctgttcatcctgcaggaccaggagcacatctttgcacaccggatctacttggccactagcagtagtaagttttacgacctgttcctgatggagtgcgaggagtctcccaatggttctgaaggcgcatgtgagaaggaaaagcagtcaagggattttcagggtcgaatcctttccgtggatccagaggaggagcgggaagaggggccaccccgaattccccaggctgatcagtggaaatcaagcaacaagagcctcgtcgaggccctgggcttggaagccgagggagctgtgcctgagacccagactcttacaggatggtccaaaggattcattgggatgcacagggaaatgcaggttaatccaataagcaaaagaatgggtccgatgactgtggtcagaatggacgcttccgtccagccaggtccctttaggacacttctgcagttcttgtacaccgggcagctggacgagaaagaaaaggacctagtgggcctcgcccaaatcgctgaagtgctggaaatgttcgatctccgcatgatggtggaaaacatcatgaacaaggaagcttttatgaatcaggagatcaccaaagcattccatgttcgcaaggccaatcgaatcaaggagtgcctttctaagggaaccttctccgatgttaccttcaaactggacgatggagccatctccgctcacaagcctctgttaatttgcagctgcgaatggatggcagcaatgtttggcggatcttttgtagaaagcgccaactccgaggtttacctgcccaacataaacaaaatatccatgcaggccgtgctcgactatctttacacgaagcagctctcgcccaacctggacctggatcccctggagctgattgccctggccaatcgtttttgcttgccccatttagtggccctagcagaacaacacgccgtacaggagctgaccaaagccgccacatcaggcgtggggatcgacggcgaggtactgagttatctggaactggctcagttccacaatgcccatcagctggcagcatggtgtctgcatcacatttgtacgaattataactctgtctgcagtaagtttaggaaggaaataaagtcaaaatctgccgataaccaggaatacttcgagcggcatcggtggcctccggtctggtacttgaaggaagaggatcattaccagagggttaaacgcgaaagagagaaagaggatattgctctcaacaagcatcgcagtcgccgcaagtggtgtttttggaactcctcccctgccgtagcctag

SEQ ID NO: 132644 - DNA, 2091 bp, Artificial Sequence
  Description of Artificial Sequence: Synthetic coding sequence
atggacgccgatatggattatgagagacctaacgttgaaaccattaagtgcgtggtggtaggagataacgccgtaggaaagacacgcctcatctgcgcccgtgcatgcaataccaccctcacacaataccagctgcttgctacacacgttccaaccgtctgggccatagatcagtaccgagtgtgccaagaagtgttagagaggtcgagagacgtcgttgatgaagtctcagtcagccttaggctctgggatacatttggagatcatcataaggaccgtcggtttgcctacggacggtcagacgtggtggtgctgtgtttcagcattgcaaaccccaactccctgaatcatgtgaaaagtatgtggtacccagagatcaaacatttctgccctcgcacacccgtgattctggttggctgccagttggatctgcgatatgctgacctggaagccgtcaatcgcgcccgcaggccactagctagacctataaaaaggggcgacattctgccgccggagaagggcagagaggtagctaaggaattgggcttgccttattacgagaccagcgtgtttgaccagttcggaatcaaggatgtttttgacaatgccatacgtgctgcccttatctccaggcggcatctgcagttttggaagtctcatctcaagaaggtccagaagccactcttgcaggccccctttctcccccctaaagcgccacctccagtgatcaagattccagagtgtccttcaatggggactaatgaggctgcttgcttactcgataatcccttatgtgctgacgtcctgttcattttacaggaccaggaacacatcttcgcccaccgcatatatctggccacctcctccagcaagttctacgacctgttcctgatggaatgtgaggaatctcctaacggcagtgagggggcttgtgaaaaggagaagcagagcagagactttcagggacggatactgtctgttgatccagaagaggagcgcgaggaggggcccccgagaatccctcaagctgaccagtggaaatcgagcaacaaatctcttgttgaggcactgggcctggaggccgaaggcgcagtccccgagacccaaacactgactgggtggtctaaaggctttatcggtatgcacagagaaatgcaagtgaaccctatttccaaacgtatggggcccatgaccgtggtgagaatggatgcctctgtgcaacccggcccattcaggactcttctgcaattcttatacacaggccagctggatgaaaaagaaaaggatctcgtggggcttgcccagattgcagaagtgctggaaatgtttgatctaagaatgatggttgagaatatcatgaacaaagaggcatttatgaaccaggaaatcaccaaggcttttcatgttaggaaggccaatcgaatcaaggagtgtttgtctaagggaacattctcagacgtgacctttaagctcgatgatggggccatttccgcccataagccgctcttaatatgttcttgtgaatggatggcagctatgttcgggggaagctttgtagaatcagcaaactccgaggtgtacttgcccaacatcaacaagatctccatgcaagctgtgctggactacctctatactaagcagctgagtcctaatctcgaccttgaccctctagaactgatcgctctcgcgaacagattctgcttgcctcacttggttgctctggccgaacagcacgccgtccaggaactgacgaaggcagctacttcgggcgtggggattgacggcgaggttctgtcttatctggagctggcacagttccataatgctcaccagctcgctgcttggtgccttcaccacatctgcaccaactataactctgtgtgttcaaaattccgtaaagagatcaagtctaagagtgctgataatcaggaatactttgaacggcaccgttggccacccgtatggtatctcaaagaagaggaccactatcagagagtgaaacgagaacgcgaaaaggaggatatcgctctgaacaaacacaggtcacgaagaaagtggtgcttctggaacagcagccctgctgtagcatag

SEQ ID NO: 132645 - DNA, 300 bp, Artificial Sequence
  Description of Artificial Sequence: Synthetic coding sequence
atggatgctgacatggattacgagcggcctaacgttgagacgatcaagtgcgtggttgttggcgacaatgcagtgggcaagacgaggctgatctgcgcgcgggcctgcaatacgaccctaacccagtaccagctgctggccacccatgtgccaaccgtctgggcaatagatcagtaccgcgtctgccaagaagttttagagcgcagccgggacgtcgtggacgaggtatctgtaagcctgagactctgggatacattcggagaccaccataaagatcgtcgctttgcttacggccgctag

SEQ ID NO: 132646 - DNA, 2184 bp, Artificial Sequence
  Description of Artificial Sequence: Synthetic coding sequence
atggacagcgatatggactatgaaagaccaaatgtggagactattaaatgcgtcgtggtcggggataacgcagtcgggaaaacacgcttgatatgtgcaagggcttgtaacgctacattgacgcagtatcagctcttagctacccacgtcccaactgtgtgggctattgaccagtatcgcgtctgtcaggaggtgctggagagaagcagggatgtcgtcgatgacgtgtccgtgagccttcggctgtgggataccttcggggaccatcacaaggacaggcgctttgcctacggccggtctgacgtcgtggttttatgtttcagcattgcaaaccctaatagcctgcaccacgttaagaccatgtggtaccctgagattaaacacttctgtccgcgcgcccccgtcatacttgtaggatgccagctggacttgaggtatgccgacctggaggccgtgaacagagcccgaaggcccttggccagacctattaaaccaaatgagatccttccccccgagaaggggagagaggttgcgaaagagttgggcattccatactatgagacaagcgtagtcgcgcaatttggcattaaggacgtcttcgataatgctattagggccgctttaatttcgcggcggcaccttcagttctggaagagtcatctgagaaacgtgcagaggcccctgctgcaagcaccctttctcccccccaaaccccccccaccaataatagtcgtgcccgaccccccatcctcgtccgaagagtgcccagcgcacttgcttgaggaccctctatgtgccgacgtgattctggtcttgcaggagagagtacggatttttgctcataaaatttatctgtccacatcctcaagtaaattctacgatttattcctgatggacctgagcgagggtgagctgggcggccccagtgaacctgggggtacccacccagaggatcaccaggggcactccgaccagcatcatcatcaccaccaccaccaccatgggcgcgactttcttttacgggccgcgtcctttgacgtctgtgagtcagttgatgaagcaggcgggtcaggtcctgccggattgagagccagcacctccgacggaatcttgcgggggaatggcactggataccttccaggaagaggcagggtgctcagcagctggagtcgagcttttgtttcaatccaggaagagatggctgaggatccgttgacttacaaatcacgccttatggtggtcgtcaagatggactcatccatccaacccgggcctttccgcgctgtgctgaaatacttatacactggagaactggacgaaaatgagcgcgatttgatgcacatagcacatatcgctgagctgcttgaagttttcgatctgcggatgatggtcgcgaacatccttaataatgaagcattcatgaatcaagagataacaaaagcattccacgtgcgcagaactaaccgtgtgaaagaatgcttagccaagggcaccttttcagacgtgacttttatcctcgacgatgggacgattagtgctcacaagcccctgctaatttcttcttgtgactggatggcagcaatgtttgggggcccattcgttgaatctagtactcgagaggtcgtctttccctacacctctaagagttgtatgagagcagtgctggagtacctgtataccggaatgttcacttcaagtcccgatctggacgacatgaaattgatcatcctggcaaatcggctttgcttgccgcatttagtcgccctcacagaacagtacaccgtcaccgggctgatggaagctactcagatgatggtcgacatcgatggcgacgtgctggtcttcttggagttggcacaatttcattgcgcttaccaactggctgactggtgtcttcaccatatctgcacaaactataataacgtctgtcgtaagttcccccgcgatatgaaagcaatgagtccggaaaaccaggagtattttgaaaaacaccgctggccccccgtttggtacctgaaggaggaggatcactaccagcgagcacgtaaggagcgcgagaaggaagattacttgcatttaaagcgacaacctaagcgacgttggttgttctggaactcaccctctagccctagcagtagcgccgcctcttctagttccccaagttcctcaagcgcagtcgtatag

SEQ ID NO: 132647 - DNA, 2250 bp, Artificial Sequence
  Description of Artificial Sequence: Synthetic coding sequence
atgcaggcttggcgcaaggggcccgacgggccacagaaaacatcatctgatagcatgagtaggctcatggacagcgatatggattacgaacgcccgaacgtagaaaccatcaaatgtgttgtcgtgggcgataatgcagtggggaagacacgattgatttgtgcacgggcatgtaatgccacactgacacagtaccaactcctcgctactcatgtgcccaccgtgtgggccatcgaccaatatagggtatgccaggaggttttggaaaggtcaagagatgttgtggacgatgtgtctgtcagtcttcgcctttgggacaccttcggggaccatcacaaggaccgccggttcgcctacggacgttccgatgtagtcgtactgtgctttagcattgctaatcccaattccttgcaccacgtcaagacaatgtggtaccctgagatcaaacacttttgtccaagagcaccagtgattctcgtgggctgtcagctggacttgcgatatgcggatctggaggccgttaaccgggcccgccgtcccctcgcacggcctattaagccgaacgaaattctgcctcccgaaaagggtagagaagtggccaaagagctggggataccatattacgaaacaagcgtggttgcacaatttggcatcaaggacgtctttgacaatgccattagagctgctctaatctctaggcgacatctccagttctggaagtcgcatctcaggaatgtccaacgcccactcctgcaggcacccttcctgccaccaaaaccacctcccccgattatcgttgttcctgaccccccaagctccagcgaggagtgccctgcccatttattggaagaccctctgtgcgcggatgtcatacttgtcctgcaggagcgggtacgaatattcgcccataagatctatctctccactagttcctcaaagttctacgatttgttcctgatggatctttcggaaggagagctcggcgggccttcagagccagggggaacacacccagaggatcaccaggggcactctgaccagcatcatcatcatcaccaccaccaccacggaagagacttcctgttacgggccgccagttttgacgtgtgcgagagcgtggatgaggcgggcggatctggaccagccggcttacgcgcctccaccagcgacgggatcctccggggcaacggcacaggatatctccctggcaggggtagagtgttgagcagctggtcgagagctttcgtttctattcaggaagagatggctgaagatccactgacctataaatcgcggctgatggttgttgtcaaaatggactccagtatacagcccggtcccttccgtgccgtgttaaaatacctgtacactggagagctcgacgagaacgagcgagatctgatgcacatagctcacatcgccgagttgcttgaagtctttgacttaagaatgatggtggcaaacatcctgaacaacgaggcctttatgaatcaggaaatcaccaaagcattccacgtgcgccgtaccaatcgagtgaaggaatgtctcgccaaggggacttttagcgatgtcaccttcattctggacgatggaacaatctcagctcataaacccctgctaatttcctcctgtgactggatggccgccatgttcggaggaccgtttgtggaatcgtctacacgagaggttgtgttcccgtatactagtaagagttgcatgcgcgccgtactggagtatttatacaccggtatgttcacttcttccccagatctcgacgatatgaaactgatcattctggccaacaggctgtgcttgccacacttagtagctctgaccgaacagtacactgtgacggggttaatggaagctacacagatgatggtggacatagacggggacgtcctcgtatttctcgagttggcccagttccattgcgcttaccaattggctgactggtgcttacatcacatttgcacgaattacaataatgtctgtaggaaattccctagagacatgaaagcaatgtcccccgaaaaccaagaatactttgaaaaacaccgctggcctcctgtctggtatctgaaagaggaggatcactatcagagggcgaggaaggagcgcgagaaagaggattacctccatctaaagcgtcaacccaaacggcgttggttgttctggaatagcccatcaagtccatctagcagcgccgcttcaagcagcagcccttcttcgtcctctgcggttgtgtag

SEQ ID NO: 132648 - DNA, 2205 bp, Artificial Sequence
  Description of Artificial Sequence: Synthetic coding sequence
atgaaagcccggagcaggttgatggactccgatatggattacgaaagacccaacgtggagactattaagtgcgttgtggtcggagacaatgctgtgggaaaaacgcgcctgatatgcgcacgagcctgcaacgccacattaactcagtaccagttgcttgctacacacgtgcccacagtttgggccattgatcagtaccgggtctgtcaggaagttctggagcgatcgcgggacgtggtggatgatgtcagcgtttcactccgtctatgggacactttcggagaccaccacaaagatcggagattcgcttatggacgctcagacgtcgttgtcttgtgtttcagcattgctaatccaaatagcctgcatcatgtgaagactatgtggtatcctgaaattaagcacttctgccctcgcgcccctgtgatactggtaggatgtcaattagatctgcgttacgccgatttggaggcagtaaacagagcgcgacggccgctcgcccggccaattaagcccaatgagatccttccacctgagaaagggagagaggtcgccaaggagctcggcatcccttactacgagacctcggtggtagcgcagtttggtatcaaggatgttttcgacaacgccatccgggctgcactgatttcgcggcggcaccttcagttttggaagagtcatctgcgcaacgttcagaggcccctcttacaggccccatttctgccacctaagccgccccctcccatcatcgtggtgccagacccccctagttcctcagaagaatgtcccgctcacctactcgaggaccccctctgcgcggacgtcatcctcgttctgcaggaacgcgtgagaatattcgcacacaagatctacctgtctacttcttcatccaagttctacgacctcttcctgatggacctgagcgagggagagctgggcggtccaagcgaacccgggggcactcacccggaagatcaccaaggacactctgaccagcatcaccaccaccatcatcaccaccatggacgtgattttttgctgagggcagcatccttcgacgtgtgtgaatcagtggacgaggcgggggggagtggacccgctggtcttagggcaagcacgtctgatggcatcctgcgagggaatggcacaggctatctgccaggtagagggcgcgtgctcagttcctggagtagggcctttgtctccatccaggaggagatggcggaggaccctctgacgtataaatcccggctgatggtggtcgtcaaaatggactcctcaattcaaccggggcccttccgggccgtcctcaagtacttatatacgggtgaactggacgaaaatgaacgggacctaatgcatatcgctcatattgccgaacttctggaggtgttcgatctgaggatgatggtggccaacattcttaacaacgaggcttttatgaaccaagagatcacaaaggcctttcatgtgcgccggactaatcgcgtgaaggaatgcctggccaaggggaccttctccgacgtcacattcatcctcgacgacggtaccatcagtgcccacaagcctttgttgatcagctcctgtgattggatggccgcaatgtttggcggcccctttgtggaaagtagtacccgcgaagtggtgtttccgtacacgtcaaagtcatgtatgcgcgcagtgcttgagtacctctacacagggatgttcacaagttctcctgatctagacgatatgaaactcattattttagccaaccgcctgtgcctgccccatctcgtggcacttaccgaacaatacacagtcaccgggctcatggaggccacccagatgatggtcgacatcgatggggacgttctggtgttcttagaactggcacaatttcattgtgcctatcagctggctgactggtgtctccaccacatttgtactaactacaacaatgtctgtagaaagtttcctagagacatgaaagcgatgtctcccgagaaccaggagtattttgaaaagcatcggtggccgcctgtctggtatcttaaggaagaagatcattatcagagggcacgcaaggagagggagaaagaggactacttgcacctcaaacgtcagcctaaaagaaggtggttgttttggaatagccctagctccccgtcatcaagcgcggcgtctagttcatctccctcgagcagttctgccgtcgtatag

SEQ ID NO: 132649 - DNA, 1836 bp, Artificial Sequence
  Description of Artificial Sequence: Synthetic coding sequence
atgagcatacacatagtggctcttggtaacgagggggatactttccatcaggataataggccctccggtctcatccgtacatacctcgggaggagccccctggtcagtggagacgaaagtagcctcctcctgaatgcagcgtcaaccgtggcacggccagtcttcaccgagtatcaggcctccgctttcgggaatgtgaaactagttgtgcacgattgcccagtgtgggatatatttgactctgattggtacacgagccgaaaccttatcggcggcgcagacataatcgtaatcaaatataacgtaaatgacaaatttagcttccatgaagtgaaggataactacatccccgttatcaagagggccctcaactctgttcctgtcattattgccgcagtgggaactagacagaacgaggagctgccatgcacgtgtccgctctgtacaagtgaccgagggagctgtgtgtcaacaaccgaggggattcagctcgctaaagaactaggcgccacatatcttgagcttcattccctggacgatttttatattggcaagtacttcggcggcgtccttgagtacttcatgattcaggctttgaaccagaaaacaagcgaaaagatgaaaaaaaggaaaatgtccaattccttccatggcattcgacctccacagctggaacagcccgagaagatgcccgtgctgaaggccgaagcctcacattataacagcgacctgaacaacttgttgttctgctgtcagtgtgtggatgttgtgttttataatccaaacctgaagaaagttgttgaagcccataaaattgtgttgtgcgcagtgtctcacgtctttatgttgctatttaacgtcaagtctcccacagacattcaagattcttccatcattcggactacacaggatctgtttgcaatcaacagggatacagcctttccaggtgctagccatgagagcagcggaaaccctccactcagagtgatagttaaggacgctctattctgctcttgtttgtctgatatcctcaggttcatctactccggtgcttttcagtgggaggagctggaagaagacattagaaagaagcttaaagactctggagacgtgagcaacgttatagagaaggtgaagtgtattttgaagactcccgggaaaattaactgcctgaggaactgcaagacttaccaggctagaaagcctctatggttttataacacgtccctcaaatttttcctgaacaagcctatgctcgccgatgtagtcttcgaaatccagggcacgacagtgccggcccatcgggccattttagtggcgcgttgtgaggtcatggctgccatgttcaacgggaactacatggaggcaaaatccgttctgattcccgtttatggggtatccaaggaaacctttctgagttttttggagtacctatacacggattcgtgttgcccagccggaatatttcaggcaatgtgcctgttaatatgcgcggaaatgtaccaggtgtccagactgcagcacatttgcgagctgttcatcataactcagctacagtctatgccctcacgggaactggcctcaatgaatctggacattgtggacctgctgaagaaggccaagtttcaccactctgattgccttagtacatggctgttgcattttatagcaactaattatttgatattctctcagaagcccgaatttcaagatttatctgtcgaagagcgctctttcgtcgaaaagcatcgctggccaagcaatatgtatttgaagcagctcgccgagtacagaaagtacattcactccagaaaatgtaggtgcctggtgatgtag

SEQ ID NO: 132650 - DNA, 354 bp, Artificial Sequence
  Description of Artificial Sequence: Synthetic coding sequence
taagaaatgtaccaggtgagccgcctgcagcacatctgcgaactctttattatcactcaactgcaaagcatgccatcccgcgagcttgcgtctatgaacctggacatagtcgatttgttgaaaaaggccaaatttcaccacagcgactgcctgtccacctggcttctgcatttcatcgcgaccaattacttgatcttctcacagaaacccgaatttcaggacctgagtgttgaggagcgaagcttcgtcgagaaacatagatggccttccaatatgtatcttaaacagctggcggaatatagaaaatacattcatagcaggaagtgccgctgcctagtgatcaagcgacactag

SEQ ID NO: 132651 - DNA, 1692 bp, Artificial Sequence
  Description of Artificial Sequence: Synthetic coding sequence
atgttttcgcgcaatcaccgctcgagagtaacggtggcaagagggtccgcccttgagatggaattcaagaggggaaggttccgcctgagccttttctcagacttacctgaggacactgaactgcagcgcaaactggaccacgaaatcagaatgcgcgagggcgcctgtaagctgctggccgcatgcagccaaagagagcaggcgctggaagccaccaagtctctgctggtgtgcaatagccggatactgagttatatgggcgaactgcaacggagaaaagaagcgcaggtcctgggaaaaaccagcagaaggcctagtgactcgggaccaccagccgaacgctcgccatgcagagggcgtgtgtgcattagcgatcttcgcatacccctgatgtggaaggatacagagtatttcaagaataaaggtgatcttcatcgatgggcggtgtttctgctacttcagctcggtgaacatatacaggacacggaaatgatactggtggatcgaactctgactgatataagcttccagagcaatgtgttgtttgcagaggcaggacccgactttgaactgcgtctggagttatacggagcgtgcgttgaagaggagggcgcgctcacaggtggccccaagcggctggccactaagttgagttcaagcctcggtaggtcttcaggaaggcgcgtccgcgcctcactggatagcgccgggggctctggatctagccctatcctgcttcccacaccagtggtaggcgggccgcgatatcacctcctggcccacacaaccctgacactcgccgccgtgcaggacggctttcgaactcacgacctgaccttggcatcacatgaggagaatcccgcttggttgccactgtacggctcggtgtgttgtcgactcgccgcgcagcccttgtgtatgacacagccgaccgcaagtggaacgctccgggtccagcaggcaggagaaatgcaaaattgggcccaggtacacggggttctgaagggaacgaatctcttttgctataggcagcctgaggacgcagacacgggcgaggagcctctcttaacgatcgctgtgaacaaggagactagagttcgcgcgggggaactggaccaggcgttgggacggccttttacgcttagcattagtaaccaatacggcgacgacgaagtgactcatacgctgcagaccgagtcccgtgaggccctccagtcatggatggaagccctgtggcagctttttttcgatatgagtcaatggaagcagtgctgtgacgagattatgaaaatcgagacacccgcgcccagaaagccccctcaggctttagcaaagcagggaagtctgtaccatgagatggcaatcgagcccctcgatgacattgcagctgtcactgacatcttaacccagagagaaggcgcgaggctggagactcccccaccatggcttgcaatgttcacagatcagcccgcactgcctaatccttgctcacctgcttccgtcgcccccgctcccgactggacccatccactgccgtggggccgaccacgaactttctcactagatgctgttcctcctgaccacagtcccagagctaggtcggtagcacctttaccaccgcagcgctcccctcgcacccggggactttgctctaaaggccagccaagaacttggctacagtcacccgtatag

SEQ ID NO: 132652 - DNA, 1653 bp, Artificial Sequence
  Description of Artificial Sequence: Synthetic coding sequence
atgcaggaccgtctgcacatcctggaagatctcaacatgctatacatccgccaaatggccctctctttggaagatactgagcttcagaggaagctagatcacgaaatacggatgagggagggagcttgtaagctgctggctgcctgttctcaacgggagcaggccttggaggctacaaaaagtctgctagtctgcaatagtagaatcctctcgtatatgggagagttgcagcgacgaaaggaagcccaggttcttgggaagaccagtcgtagaccttctgattcaggtcccccagcggagaggtccccgtgccgggggagggtgtgcattagcgacctgaggattccccttatgtggaaagacactgagtattttaagaacaaaggtgacctgcaccggtgggccgtattcttgctcctacagttgggcgagcacatacaagacaccgaaatgatcctggtcgatcgcactttgaccgacatttcatttcagagcaacgtcctgtttgcagaggccgggcccgactttgaattacgactggagctttacggggcatgcgtcgaggaggagggcgccttaaccgggggacccaagagactggctacgaaactgtccagcagtctcggcaggagctcaggaagaagggtgcgggcttcacttgatagtgccggggggtcaggcagctctcccatccttctccccacgcccgtggtgggcggcccacgatatcatttgctggcccacaccacactgacgctggccgcagttcaggacggattcagaacacacgacctgactctcgcctcccacgaggagaaccccgcttggctgcctttatatggttctgtgtgctgccggctcgccgcccagccactgtgcatgacccaacccacagcctccggcaccctacgtgttcagcaagctggagagatgcagaactgggcccaggtccatggcgtgctgaagggaacaaatctgttttgctaccgccagcctgaagatgcagatacaggcgaagaacctctgctgacgattgccgtgaataaggaaaccagggtgcgcgctggggagctagaccaggcactaggaaggccattcaccctgagcatcagcaatcagtatggggacgatgaggtgacacacacactacaaacagaatctagagaagctctccagagttggatggaagctctgtggcagttgttcttcgatatgtctcagtggaagcagtgctgcgacgaaatcatgaagatagagacccctgctccaagaaaacccccacaggctctagcaaaacagggttcattataccacgaaatggctattgagccattagacgatatcgccgccgtgaccgacatcctcactcaaagggaaggtgctagacttgaaacccctcctccctggctcgcaatgttcacagatcagcctgccctccccaatccctgttcgcccgcttccgtggccccggcacccgattggacccacccattaccttggggacggccaagaacttttagtctggatgcggtgccacctgaccattctccaagagcgaggagcgtggcacccctacccccccaacgcagcccaaggacgcgcggcctgtgttcaaagggtcagccgcgcacgtggctccagagccccgtttag

SEQ ID NO: 132653 - DNA, 4635 bp, Artificial Sequence
  Description of Artificial Sequence: Synthetic coding sequence
atggatagtggaccagtgtatcacggtgatagcagacagttgagtgcctctggtgtccctgtaaacggagcaagggaacctgcgggcccctcactgctgggaacgggaggaccatggcgagtcgatcagaaacccgattgggaagccgctccaggaccagcccacacagccagactcgaggatgcccatgatctggtagctttctccgcagtggcagaagctgtcagttcgtacggtgccctgagtacccggctatacgaaacatttaatcgagagatgagccgtgaagctgggaacaattccagaggaccccgccctggacccgagggctgctccgcaggcagtgaggatctcgatactctgcaaaccgctctagcgctggccagacatggaatgaagcctccaaattgcaactgcgacgggccagaatgtccagactacctagaatggttggaagggaaaatcaaatctgtcgtgatggagggtggagaagagcgcccccgactgccaggaccattaccaccaggtgaagccgggctccctgctccctcaacacgaccactgttgagcagcgaggttcctcagatctcaccacaggaggggctccccttgtcccagtcagccttgagcattgctaaggaaaagaatatttcactacagactgcgatcgccatcgaagcactgacgcagctgagctcagctttgcctcagcctagccatagcaccccgcaagcatcttgcccccttccagaggccctctctccacccgcaccatttcgttcaccccaatcctacctgcgcgccccgagttggcctgttgttcccccagaagaacacagcagttttgccccggacagtagcgcatttccccccgctacccctcggacagagtttccggaggcctggggaaccgatactcctccggccactcctcgaagctcttggccgatgcctcggccctctccagaccctatggccgagctggaacaactcctaggcagtgcttccgactacatccagtcggtcttcaagagacctgaggccctcccgaccaagcctaaggtaaaggttgaggccccatcaagctcccctgctcccgccccatcccccgttctgcagagagaggctcctactccctctagcgagccagacacccatcagaaggcccagaccgcactgcagcagcacctacaccacaagcggtccctattcctggaacaggtccacgacaccagctttcctgctccctccgagccgtccgcgcctggatggtggccgccacctagtagcccagtcccaagattgccagacagaccccccaaggaaaaaaagaagaaacttcccacccctgcagggggaccagtgggcacggaaaaagctgccccgggcataaagccctcggtccgcaaacctatccaaatcaaaaaaagtcgccctagggaggcacagccactctttcctcctgttcgtcagatcgtcctcgaagggcttagatctcccgcctcccaggaggtacaagctcacccccctgcccctctgcccgctagtcaggggtccgctgttcccttacctcctgagcctagtttggcacttttcgcaccctcgccaagccgtgatagcctgctgccccccactcaggagatgcgtagcccttcccctatgaccgccctacagccagggtcaacggggcccctgccccccgcagacgataagttggaggaattaatccgtcaatttgaggcagagtttggcgatagcttcggcttacctgggcctccttctgtccccatccaagatccggaaaaccagcaaacttgccttcctgcccccgaatctccatttgccacccgcagccccaaacagataaaaattgaatcaagtggtgccgtgacagtactatctacaacttgcttccacagtgaggagggcggccaggaggcaacccctactaaggccgaaaaccctctgacacctaccctgagtggctttttggagtcgcctctgaagtatttggatactcctaccaagtcattgctggacacacctgcgaagagggcccaggctgagtttccgacatgtgattgtgtggagcagattgtagaaaaggacgaaggaccatattatacgcatctgggttcgggacccactgttgccagcatccgggaactcatggaggaacggtatggcgaaaaaggcaaagcaatcagaattgagaaagtgatctatactggcaaagagggcaagtcgagtcgaggttgccccatcgccaaatgggttatcagacgacacaccctggaggagaagcttctctgcttggtccgacacagggctggccaccactgccagaatgccgttattgttatcctgattctggcatgggaaggcatcccaagaagcctcggagataccttgtatcaggaattaaccgacacacttcgaaagtacggaaatcccacttcccgcagatgtgggctgaacgacgatcgtacatgtgcttgtcaaggcaaagatcccaatacttgtggcgcatccttcagcttcggatgctcctggagtatgtacttcaatggctgtaagtatgcccggtccaagacacctaggaaattcaggctcgccggggacaacccaaaagaggaagaggtgctcagaaaatcattccaagacctggcaacagaggtagctcctctctataagagactggccccccaggcctatcagaaccaggtgaccaatgaggagattgctatcgactgcagattgggactcaaggagggtagaccctttgctggcgtcacggcatgcatggatttttgtgcccacgctcacaaagatcagcataatctgtacaatggctgtacagtggtgtgcacccttaccaaggaggataatcgatgtgttggaaagatcccagaggacgagcagttacatgtccttcctctgtacaaaatggcaaacaccgacgaattcgggagcgaagagaaccagaatgccaaggtagggtctggggcaatccaggtacttactgctttcccgcgcgaagtcagacgcctgcccgagccagcgaaatcctgccgccagcgacaactagaggctaggaaggctgccgccgagaagaaaaaaatccagaaggaaaaactgtcaacccccgagaagattaagcaggaggcactggagctggcggggattacgtctgacccaggcctttccttgaagggcggtttatcacaacaggggctgaagccatcccttaaggtcgagccacagaatcacttcagttcattcaaatattccggcaacgctgtcgtcgaaagctacagtgttctgggcaactgtaggccctctgacccttactccatgaatagtgtttactcctaccattcttactatgctcaaccctcccttacatccgtcaacggattccatagtaagtatgcccttccgtcattttcttactatgggtttcccagtagcaatcctgttttcccgtcacagttcctgggacctggcgcctgggggcatagtggctcgtccggcagctttgagaaaaaaccagatctgcacgcgctccataactccctgtcacctgcttatggtggggctgagttcgccgaattaccttcacaggccgttccaacggacgcacatcaccccactccccatcaccagcagcccgcttatccaggccccaaggaatacctgttaccgaaggcccctctactgcattccgtgtcgagagatccctctccctttgctcagtcgagtaattgttacaacagaagtatcaagcaggagcccgtagatcccctgacacaagccgaacctgtcccacgtgacgcgggaaagatgggaaagaccccactctccgaagtgtcccagaatggaggaccgtcccatctttggggacagtattcgggcggcccgagcatgtctccaaaacgcacaaatggtgtgggcggaagctggggcgtcttctcaagcggcgagagcccagctattgttcctgacaagctcagctcctttggtgcttcttgtctggctccttctcatttcaccgacggacagtggggcctgtttcccggcgaaggtcagcaggccgcctcccactcagggggccggctgcggggcaagccctggagtccctgcaagttcggaaactccacaagcgccctggctggcccctctctgactgaaaagccttgggccttaggagccggggattttaatagcgcgttgaaggggtccccgggcttccaagataagctgtggaaccccatgaaaggagaggagggtcggattcctgccgctggcgcctctcaattggtcttctatcagcacaagaacttaaatcagcctaatcacggactcgccctgtgggaagctaaaatgaaacagcttgccgaacgcgcacgcgctcgacaggaagaggctgcgaggctcggcttaggccagcaggaggctaaactgtacgggaaaaagcggaagtggggggggaccgttgttgcagagccccagcaaaaggaaaagaagggggtggtacctacccgccaggccctagcggtgcctactgattcagctgtaacagtgagttcctacgcttacacaaaagtgaccgggccatactcccggtggatttag

SEQ ID NO: 132654 - DNA, 468 bp, Artificial Sequence
  Description of Artificial Sequence: Synthetic coding sequence
atgcgccacttaccttacttctgtagggggcaggtcgtaagaggcttcggccgagggagcaagcagctcggcatccctactgctaatttccctgagcaggtggtcgacaacttgcccgcggacatttcaaccgggatctattacggatgggctagtgtcgggagtggagatgtgcacaagatggtcgtaagtataggctggaacccttattataagaatacaaagaaaagtatggagacccatatcatgcatacattcaaagaggacttctatggagagatcctcaacgtagctatcgtcggatatctccggcctgaaaagaacttcgattccctcgagagcctgatctccgctatccaaggtgacatcgaagaagccaagaaaaggctggagttacctgagcacctgaagatcaaggaggataacttcttccaggtgagcaaatccaagatcatgaatggacactag

SEQ ID NO: 132655 - DNA, 969 bp, Artificial Sequence
  Description of Artificial Sequence: Synthetic coding sequence
atggctgcaagtggcgagccccagcgacagtggcaggaagaagttgcagctgtagtggtcgtgggctcttgcatgacggatcttgtttcccttacttctcggctacctaaaacaggtgagaccatacacggacacaagttcttcatcgggtttggcggcaaaggagcaaaccagtgtgtgcaagccgcaagacttggagctatgacaagcatggtgtgtaaggttgggaaagacagcttcgggaatgactacatcgagaacttgaaacagaatgatatctcaacggagttcacatatcagaccaaggacgcagctaccggcacagcctcaatcatcgtaaacaacgaagggcagaacatcatcgttattgttgctggtgcaaatctgctgcttaacactgaggacttgcgcgccgcagcaaacgtcatttcacgcgctaaggtaatggtttgtcagcttgagatcacccctgccactagtcttgaagccttgacaatggcacgaagaagtggcgtcaagactctctttaatccggcccccgccatagcggacctggacccacagttttataccctgtccgatgtgttttgctgcaacgagagcgaagcggagatcctgactgggctgacggtgggcagcgcagctgacgccggggaagctgccctggtgctcctcaagagaggctgccaggtcgtcatcattactctgggggccgaggggtgtgtggtcttgtcacaaaccgagccagagcccaaacacatacccactgagaaggtgaaggctgtcgacactacaggcgccggagatagttttgtgggtgccttagccttttatctggcttactatcctaatctgtcactcgaggacatgttaaaccggagcaacttcatcgcagcagtgtctgtgcaggccgcaggtacacaatcttcctacccatacaaaaaagatctccctctcactttgttttag

SEQ ID NO: 132656 - DNA, 861 bp, Artificial Sequence
  Description of Artificial Sequence: Synthetic coding sequence
atggccgcatccggggagccccagcgacagtggcaggaggaggtcgctgcagtggtcgtcgtaggatcgtgcatgaccgatcttgtaagcctcactagtcgcctcccgaaaaccggcgagactatccacgggcacaaattctttattggctttggggggaagggtgctaatcaatgtgtccaagccgccagactgggagcgatgacctctatggtatgcaaagtaggtaaggacagtttcgggaacgactatatcgagaaccttaagcagaacgatatttcaaccgagttcacgtatcaaacgaaggatgcagccacaggtactgcctcgatcattgtgaacaatgagggccaaaatattattgtcattgtcgctggggccaatctgctactgaatacagaagatttaagagccgccgctaacgttataagccgggcaaaggtgatggtgtgtcaattagaaataacacctgccaccagcctggaggcgttgactatggctagacgatcgggcgtgaaaaccctcttcaaccctgctcccgctatagccgacctggacccgcagttttataccctgtccgatgtcttttgctgtaacgaatcggaggcagaaatcctgaccggcctcactgtgggctcagccgctgatgccggcgaagcagctttggttctgttgaagagaggatgccaagtagtaattatcacgctgggcgctgaaggatgtgtggtgctgagtcagacggagccagaacccaagcacatcccaactgagaaagtgaaggcagttgacacaacatgtagacctggttctaggcccaaaagcgaggcagcatccgtgaagaaacagaagcattacaagtag

SEQ ID NO: 132657 - DNA, 861 bp, Artificial Sequence
  Description of Artificial Sequence: Synthetic coding sequence
atgagttggctcctctttctggctcacagggtcgccttagctgctctcccatgccgtcgtggtagtcgaggattcggtatgttctacgcagtgcggcgagggcgcaaaaccggagtctttctaacttggaacgagtgtagagcacaggtggatcgatttcctgccgcaaggtttaaaaaattcgctaccgaggacgaggcctgggcctttgttaggaaaagcgctagtccagaagtctccgaagggcacgaaaaccagcacggacaggaatccgaggcaaaggcgagcaagcgtctgcgggaaccacttgacggcgatggtcatgagtcggctgaaccctacgctaagcacatgaaaccctccgtcgagccagcacctccagtctcgagggacacattctcttatatgggagattttgtggtggtctatactgacggctgttgttcaagcaatggcagaaggcggccccgagccggtattggggtgtactggggccccgggcatcccttaaatgtggggatacgcctccccggacgccagaccaatcagcgggctgagatccatgcagcttgcaaggccatcgagcaggcgaagacacagaatataaataaactcgtactgtacacggattcgatgttcactatcaacgggattaccaattgggtccagggttggaaaaagaacggatggaaaactagcgcgggcaaggaagtgatcaataaggaggatttcgttgccctggagaggctcacccaaggaatggatattcaatggatgcatgtgcctggccattctggattcattggaaatgaagaagcagataggctggccagggaaggtgctaaacagtctgaggattag

SEQ ID NO: 132658 - DNA, 1683 bp, Artificial Sequence
  Description of Artificial Sequence: Synthetic coding sequence
atggaattccggcaggaggaattcagaaaattggccggtagggctctcgggaagcttcataggctgcttgaaaagaggcaggaaggcgcagagactctggagctcagtgcggacggcagaccagtcacaacgcagacacgggacccacccgttgtagattgtacctgttttggtctgccacgcaggtatatcattgcaatcatgagcggactggggttctgcatctcctttgggattagatgcaacttgggagtggcaatcgtgtccatggtcaacaactccaccacacatcgagggggacacgtggtggtccagaaggcacagttttcatgggaccccgagactgtggggctaatccacggttcattcttttggggctacatagtgactcagatccctggcgggtttatctgtcaaaaattcgcagccaatagagttttcggttttgcaatcgttgcaacaagcaccctcaatatgctcatccccagtgctgctcgagtgcactatggatgtgtgattttcgttagaattctgcaggggcttgtggagggtgttacgtatccagcatgccatggtatctggtccaaatgggcaccaccactcgaaagatcacgcttggccaccactgccttctgcgggtcttacgcgggggccgtggtcgctatgcctttggccggagttttggtgcaatattccgggtggtcttcagtgttttacgtctacggaagttttggcatattttggtatcttttctggcttctggtgagctacgaaagccctgcgttgcacccttccatatcagaggaagagcgtaaatacatcgaagatgccattggcgaatcggctaaactgatgaacccactcaccaagttctctaccccctggcgaaggttcttcaccagtatgcctgtgtatgccatcatcgtcgcgaatttttgccgttcatggacattctacctccttcttatatcccagccagcctactttgaagaagtatttggattcgagatttcaaaagtcggcctggttagcgcacttccccaccttgtcatgaccataattgtgccaatcggcgggcagatcgccgatttcttaagatcccgcagaattatgtcaaccacaaacgtgcgcaaactgatgaattgtggcgggttcgggatggaggctacattactgctggttgtggggtattcccatagcaagggagtcgctataagcttccttgtgctggccgtggggttctcaggctttgccatttccggattcaatgttaatcacctggatatagctcctaggtatgcaagtatacttatgggcatttccaatggtgtggggaccctgtctggaatggtgtgcccgatcatcgtgggcgccatgacaaaacataagacccgcgaggaatggcagtacgtgttcctcatagcttcgctggtgcactacggcggggtgatcttttatggagtgttcgcttctggcgagaaacagccatgggctgagcctgaggaaatgtcagaggaaaagtgtgggttcgtcggtcatgatcagttggcaggctctgatgacagcgagatggaagacgaggcagaacctcctggggccccacccgcaccccctccgagctatggggctacccactctacattccagccaccccgtccaccgcccccggtccgcgactactag

SEQ ID NO: 132659 - DNA, 939 bp, Artificial Sequence
  Description of Artificial Sequence: Synthetic coding sequence
atggctgcgggcgtcgattgcggagatggagtgggcgctaggcagcatgtgtttctggtgtcagaatatctcaaagacgcctcaaagaaaatgaaaaatgggctaatgttcgtaaagctcgtcaacccatgctcaggggaaggagcaatatacttgttcaatatgtgcctgcagcagctgttcgaagtgaaggtattcaaggaaaagcatcactcctggtttattaatcagagcgtgcagagcggagggctcctacactttgcgacacctgttgaccccctgttcttgttactgcactacctgattaaagcggacaaagaaggaaaatttcagccacttgaccaggtcgtggtagataatgtttttcctaactgcatcttactgctcaagttaccgggcctggaaaagctgctccaccacgtgaccgaggagaagggaaaccctgaaatagacaataagaaatactacaaatactcaaaagagaaaacactgaagtggctcgagaaaaaagtgaatcagaccgttgccgcactgaagactaataatgtgaacgtgagctcaagggtgcagtccacggccttttttagcggtgaccaagcgtcgactgacaaggaggaagactatataagatatgcccacgggctcatatctgattacatacctaaggaactctcagatgatctgtccaaatacttgaaactcccagaaccttccgccagcctgcctaaccctccgtccaaaaagattaagttgagcgatgagccagttgaagctaaggaggactataccaagttcaacacgaaagatttgaagaccgaaaagaaaaacagcaagatgacagcggcacaaaaagctcttgcaaaggtggataagagcggtatgaaatcaatagacacatttttcggggtgaaaaacaagaagaaaattggaaaagtgtag

SEQ ID NO: 132660 - DNA, 774 bp, Artificial Sequence
  Description of Artificial Sequence: Synthetic coding sequence
atggcagccggcgtcgattgcggtgacggggtgggcgcccggcagcacgtgtttcttgtatccgagtatctgaaggatgctagcaagaaaatgaaaaacggcctgatgtttgtgaagttagtcaatccctgttccggtgagggggcgatctacctgtttaatatgtgcctgcaacagctgtttgaggtgaaggtgtttaaagaaaaacaccattcctggttcataaaccagtccgtgcagtctggaggcttactgcatttcgccacacctgtggatcccctgtttcttttgcttcattacctgattaaggccgataaggagggcaagtttcagcctttggatcaggtcgtggttgacaacgtgtttccaaactgcatactgctcctgaagctccccggcctggagaaactgttgcatcatgttaccgaggaaaagggtaatcctgaaatagataataaaaagtactacaaatattccaaagaaaaaacactgaaatggctcgagaagaaagtgaatcagacagtggcggcccttaaaaccaataatgtgaatgtctccagccgcgtgcaatccaccgcgttcttctccggcgaccaggcctctactgacaaggaagaggactatattcggtacgcgcatggactgatcagcgactatataccgaaggaattgagtgacgatctgtctaaatatctgaaactgcctgaaccctctgcttcccttcctaacccaccctctaaaatggcagctcaaaggcagaagcgagggaaatag

SEQ ID NO: 132661 - DNA, 996 bp, Artificial Sequence
  Description of Artificial Sequence: Synthetic coding sequence
atggcagccggcgtggattgtggggacggcgtcggtgcccgccagcatgtgtttctcgtgtccgagtatcttaaagatgccagtaagaagatgaagaatggtttaatgttcgtcaaactggtcaacccgtgtagcggggaaggagctatctatttatttaatatgtgcctacagcagctgttcgaagtgaaggtgtttaaggagaagcaccactcctggtttattaaccaatctgtacagtccggcggcctgctccattttgccacgcctgtggatcctctctttctcctgctccattacttgatcaaggctgacaaggagggtaagttccagccgctggatcaagtcgtcgtcgacaatgtgtttcccaattgcatcttgctgctaaagcttccaggtttggagaagctgcttcaccatgttaccgaggaaaaaggcaatccggagatagacaacaagaagtactataagtactcgaaagaaaagactttgaaatggctggagaagaaagtgaatcagaccgtggcagcactgaagaccaataacgttaacgttagctcccgagtgcaatcaaccgccttttttagcggagatcaggccagtactgacaaagaagaggactacatcaggtatgcacacggcctcatcagtgactacatcccaaaggagcttagtgatgatttatcgaaatatctgaagttgcccgagccaagtgctagtctacccaaccctccctccaaaaaaataaagttgagtgacgagccagtggaggcaaaggaggattacacaaaatttaacacgaaggacctcaagaccgagaaaaaaaacagtaaaatgactgcggctcaaaaagccctggccaaagtcgacaagagtggcatgaaatctattgatacttttttcggcgtgaagaaaaagctggaacgcttcgagaccttgaaaatcaagtccagcaagaatatttgttttctccacgtgtctgtctgccctagctag

SEQ ID NO: 132662 - DNA, 495 bp, Artificial Sequence
  Description of Artificial Sequence: Synthetic coding sequence
atggagtccggcgacgaggctgccatcgaaagacaccgagtgcatttgcggagtgccactcttcgagacgccgtgcctgccacactgcatttgctgccgtgcgaagtagctgtcgacggacccgccccagtgggcaggttctttacgcccgcgataagacagggacccgagggcctggaagtgtcctttaggggtagatgcttgcgtggggaagaggtcgccgtcccccctggtctggtgggttacgtgatggtcaccgaggaaaagaaagtgtctatgggaaaacccgatcccctcagagattctgggactgatgatcaagaagaagagccactggagcgggacttcgatcgtttcattggtgcaacggcgaacttcagccgattcaccctctggggcctcgaaaccatcccaggccccgacgccaaggtccgaggcgcactaacgtggccatccctggcagccgcaatccatgctcaagtgcctgaggattag

SEQ ID NO: 132663 - DNA, 2226 bp, Artificial Sequence
  Description of Artificial Sequence: Synthetic coding sequence
atggagtctcgagaccataataatcctcaggagggacccaccagctcatcaggtcgaagagcggccgtcgaagacaatcacctgctgataaaggcggtgcagaacgaagacgtggatctggtacagcagttgttagagggcggtgcaaatgttaatttccaggaggaagagggaggatggaccccgttgcataatgcggtgcagatgagtcgcgaagacattgttgaactgctgctccggcacggagccgatccagtgttaaggaagaagaatggggccactccattcatactggctgcgatcgctgggagtgtgaagctccttaaattgtttctttccaaaggcgccgacgtcaacgagtgcgacttctacggttttaccgcttttatggaggctgcagtctatggtaaggtgaaggccttgaaattcctgtataaaaggggtgctaacgtgaaccttaggcgcaagacgaaggaagaccaggagcggctgcggaaaggaggggctacggcactgatggatgctgcagaaaagggccacgtggaggtgttgaagatcctgctggacgagatgggagcagatgtaaacgcctgtgacaatatgggccgcaacgctcttattcacgcccttttgtccagcgacgattcagacgtagaagcaatcacacatttgttactggatcacggtgccgacgtcaatgtgagaggtgaacgaggcaagacaccgctgatactcgccgttgagaagaagcatctaggcctggtccagcgcctcctggagcaggaacacattgagattaatgataccgactccgatggcaaaaccgccctgctgctggcagttgaattgaagctcaagaagattgcggagctgctttgcaaacgtggggccagcacagactgcggggacttagtgatgactgcgagaaggaattacgaccacagtttagtaaaggtgctacttagtcatggagctaaagaagacttccatcctcccgccgaagactggaaacctcagtcctctcattggggcgctgcactcaaggacctccatcgcatctaccgtcctatgatcggaaagctgaagttcttcatcgatgagaagtataagatcgcggatacatcagaggggggcatttacttaggcttctatgagaagcaagaggtcgctgtcaagaccttttgcgaaggctccccccgggcccagcgcgaagtctcctgcctccagtcttctcgtgagaactctcacctcgtgaccttttatggatccgagtcccacagagggcacctgtttgtgtgcgtgactttatgcgagcagacattagaggcctgtctcgatgtccatagaggggaggatgtcgaaaatgaggaggacgaatttgccagaaacgtgctgtcttccattttcaaggcagttcaagaattacacttatcatgtggttatactcatcaggacctgcagccacagaacatactcatcgatagcaagaaggcggcgcacctggccgactttgataagagcatcaaatgggccggggatccccaggaggttaaacgcgatctcgaagatctcggaaggttggtgctgtatgtggtcaaaaagggtagtatcagcttcgaggacctgaaagcccagtcaaatgaggaggttgttcagttgtctcccgacgaggagacaaaggatctgatccaccgattgtttcacccaggagaacatgtgagggactgcctgtcggatctgctcgggcatcccttcttttggacatgggagagtcgctatagaacgctgcgcaacgtcggtaatgaaagcgacattaaaactaggaagagcgaatccgagatcctccgcttactccagccaggcccaagtgagcattccaaaagcttcgacaagtggacgacaaaaattaacgaatgcgtgatgaagaaaatgaacaagttctatgaaaagcgaggaaatttctatcagaataccgtgggtgacctactgaagtttatacgaaatctcggggaacacatagacgaggagaaacacaaaaaaatgaagctcaaaattggcgatccctcgctctatttccagaagacatttcccgatctagtaatttatgtttacaccaagctgcagaataccgagtaccgcaagcatttcccccagacccatagcccaaacaaaccgcaatgtgacggagcgggtggcgcctcaggattggcaagccctggttgttag

SEQ ID NO: 132664 - DNA, 2226 bp, Artificial Sequence
  Description of Artificial Sequence: Synthetic coding sequence
atggaatctcgagatcacaacaacccacaggagggccccacaagctccagcggacgcagggctgccgtggaggacaatcacctgcttataaaagcggtgcaaaatgaggacgtcgatctggtgcaacagctgttggaggggggagccaatgtgaactttcaggaggaggagggggggtggacgccgctgcataatgctgttcagatgtctcgggaggacatcgtagagctgctcctcagacatggagcagacccggtactccgcaagaaaaatggcgccaccccatttatcctggccgcaattgccggatccgtgaagcttcttaaattgttcctatctaagggagcagacgtgaacgagtgtgacttctatggatttacagcctttatggaggcagccgtgtacggaaaggtgaaggctctgaagttcttgtacaagcgcggcgcaaacgtgaacctacgaagaaagacgaaggaagaccaggaacgcctccgaaaggggggagctacggcactcatggatgccgcagagaagggacatgtggaagttctgaagatactgctggacgaaatgggtgctgatgtgaacgcctgcgataatatggggaggaatgccctcatacatgccctgctttcctccgacgatagtgacgtcgaagcgatcacccacctgcttctggaccatggggctgatgtgaacgtgcgcggagagcgaggcaagacacctttaatccttgcggtggagaagaagcacctgggtctcgttcaacggctgctggaacaggagcacatagagatcaatgataccgactcagatggcaagacggcgttgctcttggccgtggagctgaagctgaagaagattgccgagcttctgtgtaaaaggggcgcaagtaccgactgtggagacctggtcatgactgctcgacggaattacgaccacagcctcgtgaaggtgttgctttcccacggagctaaggaagacttccaccccccagctgaggactggaagccccaaagcagccactggggtgccgcgttaaaggatctccatcggatctatcggcctatgatcggcaagctcaaatttttcattgatgagaagtataagatagcggatactagcgagggcgggatctatttggggttttatgaaaagcaagaggtggctgtcaagactttttgcgaagggtcccctcgagcccagcgggaggtgagctgtctccaaagttctcgcgagaattcccacttggtgacattctacgggagtgagagtcacagaggtcacctgtttgtctgcgtaaccctttgtgaacagaccttggaagcctgtctggacgttcacagaggcgaggacgtggagaacgaagaagatgaattcgcaagaaacgtactatcgagcatattcaaggctgtgcaggaactacacttgtcctgtggctacactcatcaggatctccagccacagaatatcttaattgactccaagaaagctgcacatctggccgatttcgacaaatccataaagtgggccggcgacccccaggaagttaagagggaccttgaggatctgggaagactggtcctgtatgtcgttaagaaggggtctatctccttcgaagacctgaaagcgcagtccaacgaggaggtagtccagctgtcacctgatgaggagaccaaggatctcatccaccgccttttccatccaggtgagcatgtacgggactgcctctcagacttgctgggccacccattcttttggacttgggagtctcgatacagaacattaagaaacgtggggaacgagtccgacatcaaaacacggaagtcagaaagcgagatcttgcggcttctgcagcccggcccaagcgagcatagtaagtccttcgacaaatggactaccaaaatcaacgagtgtgtgatgaagaaaatgaataagttctatgaaaaaagagggaatttttaccaaaacacagtcggggacctgttgaaattcattcgcaatcttggagaacacatcgatgaggagaagcacaagaagatgaagctaaaaattggcgatcccagcctgtatttccaaaaaacttttcctgatcttgtgatctatgtgtacactaagctccagaacacggaatatagaaagcatttccctcagacacatagccccaataaaccacagtgtgacggtgcgggcggcgcgtccgggttagcaagtcctggatgctag

SEQ ID NO: 132665 - DNA, 1959 bp, Artificial Sequence
  Description of Artificial Sequence: Synthetic coding sequence
atggagtcccgcgaccataacaacccacaggagggccctacgtcctcctcaggcaggcgcgcggccgtcgaggacaatcatttgctgatcaaggctgtgcaaaatgaggatgttgatttggtgcaacaattgctggaaggcggcgccaatgttaactttcaagaagaagagggtggatggactcctctccacaacgccgtacagatgagtagggaagacatcgtcgagctccttctaagacatggcgccgaccccgtgttacggaagaaaaacggagccacaccatttatcctggctgccatcgcgggctccgtgaaactgcttaaactgtttttaagcaaaggtgctgacgttaacgagtgcgacttttatggcttcaccgctttcatggaggccgccgtgtatggtaaagttaaagccctgaaattcctatacaaaaggggcgctaacgtcaacttgcgaaggaagactaaggaagaccaggaaagactacggaaaggcggcgcgactgctctgatggacgcagccgagaaggggcacgtcgaggtgcttaagatcctgctggacgaaatgggtgctgatgttaacgcctgtgataatatgggaaggaatgcactcatccacgccttgctgtcctccgatgattcagacgtcgaagccataacccacctgctgttagaccatggagccgatgttaatgtgcgcggcgaacgcgggaaaacacccctgatcttagctgtcgagaaaaagcacctggggctggtgcagcgcttgttggagcaggaacatatagaaatcaacgacacagactctgatgggaaaaccgctctgttgctggcagtggagttgaaactgaagaagatcgccgaacttctatgcaagcgcggagctagtactgactgtggagacctggtgatgactgcacggaggaactacgaccattcactggttaaggtgctgctgtcccacggcgctaaggaagattttcatccaccggccgaggattggaagccccaatcctcccactggggcgctgccctgaaggaccttcaccgaatttacaggcccatgataggtaagcttaaattttttatcgatgaaaaatacaaaattgcagatacatccgaaggtgggatctatctggggttctacgagaaacaggaggttgctgtgaaaactttctgcgagggctctccccgtgcccaaagggaagtatcctgccttcaaagttcacgagagaatagtcacttggttactttctatggcagcgaaagccaccgagggcatttgtttgtttgcgtgacactgtgtgaacagaccctcgaagcctgcttggatgttcaccgcggtgaagatgtggagaacgaagaagatgaattcgccaggaacgtgctgtccagtattttcaaagccgtgcaagagttacacctgagctgcggttatactcaccaggatctgcagccccagaatattctgatagactccaagaaggccgcccatctggctgactttgacaagtccataaagtgggcaggtgatcctcaggaggtaaaacgcgaccttgaagatctggggcgactcgttttatacgtggttaagaagggttccatttcctttgaggacctcaaggcccaatcaaacgaagaggtggttcaattgtctcccgatgaggagaccaaggatctgatccaccggcttttccacccaggggaacatgttagggactgtctgtcagacctacttggccacccctttttctggacttgggagagccgataccgtaccctccgcaacgtgggaaatgagtctgatataaagacacgcaagtctgagtctgagatcctgcggctgttgcagccaggcccaagcgaacatagcaagtctttcgacaagtggaccactaagatgagtaagctgaggcaccgccaaattatattcccaacaacacagaatcagtag

SEQ ID NO: 132666 - DNA, 465 bp, Artificial Sequence
  Description of Artificial Sequence: Synthetic coding sequence
atgatagggaaattgaaattctttattgacgagaaatacaaaattgctgatacttctgagggtggcatttacctgggcttctatgagaagcaggaagttgccgtcaaaacattttgtgagggcagccctagggcacagagggaagtctcttgcctgcagagttcccgagagaacagccacctggtcaccttttacggaagcgaaagtcacagaggccacctgttcgtttgtgtgacgttatgtgaacagacactggaggcttgcttggatgtgcacaggggtgaggacgtagagaacgaagaagatgagttcgctagaaacgtgctgtcctccatctttaaagccgtgcaagaactccatctgagctgtggatatacgcatcaggatctccagccacagaatatactcatcgggccttggaccgcgggcccattgtgcggcaaggaggggaaacacctgatctag

SEQ ID NO: 132667 - DNA, 465 bp, Artificial Sequence
  Description of Artificial Sequence: Synthetic coding sequence
atggctggccccgtcaaagaccgggaagcttttcaacgccttaatttcctgtatcaggctgcccactgtgtcttagcccaagaccctgagaaccaggcactcgctcgtttctattgttacacggagaggactattgcaaagagactggttcttagacgtgatcctagcgtgaagcgaacgctgtgccgtgggtgttcatctcttctcgttcccggactgacctgtacacagcgccagagaagatgtaggggccagcggtggacggtgcagacatgcctgacttgccaacgcagccagcgctttttaaacgatcctggacacctcttatggggcgaccgtccggaggctcagttgggatctcaggcagattccaagccactccaaccattgccaaacaccgcgcactcgattagcgataggctgcccgaggaaaagatgcagacccagggaagctcgaatcaatag

SEQ ID NO: 132668 - DNA, 489 bp, Artificial Sequence
  Description of Artificial Sequence: Synthetic coding sequence
atggctggacccgtcaaggaccgcgaagccttccagcggttgaacttcctttaccaggccgcacattgtgtgcttgcccaggaccccgagaatcaggccctggcacgattttattgctacactgagagaaccatcgcaaaaagacttgtccttcgcaggccattatcctcctctgcaccacgggacccaagtgtgaagcgaactttgtgcagaggttgctcttcacttctggtgccgggcttaacctgcactcagagacagagaagatgccgcgggcaaagatggaccgttcagacgtgtcttacatgccagcgatcacagagattcctcaatgaccctggacacctgctgtggggagacaggcccgaggctcagttaggcagccaggccgactccaagcccctccaaccactgcccaataccgcccattcgatctctgatcgcttacccgaagagaaaatgcagactaaaggcagcagcaaccagtag

SEQ ID NO: 132669 - DNA, 534 bp, Artificial Sequence
  Description of Artificial Sequence: Synthetic coding sequence
atggcaggcccagtgaaggatcgggaagcattccaaaggctgaattttctctatcaggtcagcctacgccagggaccccacggcgacggcgccagaagacccagggtgacggcgccgctgccccaagctgctcactgcgtgctggcacaggaccctgaaaaccaggctcttgcacgcttctattgctataccgagagaacaattgctaagcgcctcgtgctgcggagggatccttctgtgaagagaacactctgtcgtggatgctctagcctgctcgttcccggcctcacgtgtacccagcggcaacggaggtgcagggggcagaggtggactgtgcagacctgtctgacgtgtcaaaggtcacagagatttctgaacgaccccggtcacctcctttggggtgatcggccagaagcgcagttgggctcccaggccgacagcaagcctttgcagccacttcctaacaccgcgcactccattagcgacaggctgcccgaagagaaaatgcaaacccaaggctcctcaaaccagtag

SEQ ID NO: 132670 - DNA, 489 bp, Artificial Sequence
  Description of Artificial Sequence: Synthetic coding sequence
atggccgggccggtaaaagatagagaggcttttcaacggttgaattttctgtaccaagctgcccactgcgtcctagctcaggaccccgaaaaccaggcactcgcacggttttactgttacacagagagaaccatagctaaacgtctcgtattgagaaggccactatctagttccgcgcccagggatccttccgtcaaacgcacactgtgtagaggctgctcctctttgctggtcccaggacttacttgcacccaccgtcagcggagatgcaggggccaacggtggaccgtccagacgtgcctgacctgtcaacgcagccagagatttctcaacgacccaggccacctgctatggggagatagacccgaggcacaactggggagccaagccgactccaagcctctgcaacctcttccaaacactgcgcattctattagcgacagactgcccgaggagaagatgcaaacccagggcagcagtaaccaatag

SEQ ID NO: 132671 - DNA, 534 bp, Artificial Sequence
  Description of Artificial Sequence: Synthetic coding sequence
atggccggccccgtgaaggatagggaagctttccagcgactcaattttctttatcaggtttctctgcgacagggccctcacggcgacggcgctagacgaccccgagttactgctcccctgccgcaggcagcccactgcgtgctagcccaagaccccgagaaccaggccctggcgcgtttctactgttacacagaaaggaccatcgctaaacgactcgttcttaggagagaccccagcgtcaagcggactctgtgccgcggatgctcctcacttttggttccagggctaacttgcactcaaaggcagcgtaggtgccgggggcagaggtggacagtgcagacatgtctgacctgccaacgctcccagcggttcctgaacgatcccgggcatcttctgtggggcgataggcctgaagcgcagctgggctcccaggcggactcaaaaccattgcagccgttacccaatactgcccacagtattagtgatcggctgccagaagagaaaatgcagacgaagggctctagcaatcaatag

SEQ ID NO: 132672 - DNA, 465 bp, Artificial Sequence
  Description of Artificial Sequence: Synthetic coding sequence
atggccggaccggtaaaagaccgagaagcatttcagaggcttaacttcttgtaccaagccgcccattgcgtattggctcaggatcccgagaaccaagccctcgcccgattctactgttacacagaaagaaccattgctaagcgtttggtcctgaggcgggatcccagcgtcaaaagaaccttatgtagaggctgctcctctctgttggttccgggcctgacttgtacccacaggcagcgtaggtgtcggggccaaagatggactgtccaaacttgtctcacttgtcagagatctcagcgcttcttaaatgaccctggccatctgttgtggggggatagaccggaagcccaactaggcagtcaagccgacagtaagcctctccagcccttgcctaacaccgctcatagcatttcggatcgactgcccgaagagaaaatgcagacacagggcagttcgaatcagtag

SEQ ID NO: 132673 - DNA, 435 bp, Artificial Sequence
  Description of Artificial Sequence: Synthetic coding sequence
atggcagggcctgtcaaggaccgcgaggccttccagcggttgaacttcctgtaccaagccgcccactgtgtcctggcccaggaccctgagaaccaagcactggcccgattttactgctacacggagcgaactatcgccaagagactggtgcttaggcgagatccatccgttaaacggacgctgtgcagaggatgcagttctctgctggtgccggggctgacttgtacccagcggcagagaaggtgccgaggacagagatggacagtacagacctgcctgacatgccaaagaagtcagaggttcttgaatgaccccggccaccttttatggggcgaccgcccagaggcccagctgggaagtcaggccggagaacggttccagaccaccacaaccctggctaaacactccccactgcacttcaggcccccctcgtag

SEQ ID NO: 132674 - DNA, 465 bp, Artificial Sequence
  Description of Artificial Sequence: Synthetic coding sequence
atggctgggccagtaaaagatcgggaagcatttcagcgactgaattttctgtaccaggctgcccactgcgtacttgctcaagatcccgagaaccaggcactggccagattctattgctacacagagcggacaatcgccaagcgcctggtcctacgcagggacccttccgtaaaaagaactctgtgcagaggttgttcatcattacttgtcccggggctcacatgcacacacagacaacgccgctgccgaggccagcgctggactgtccagacttgcctgacatgccagcggtcacaaagatttctgaatgatccaggtcaccttctgtggggagatcgtcccgaggcccaactcggatcgcaagcggactctaagccactgcagcccctgcctaacaccgcccattccatctcagatagacttcccgaggaaaagatgcaaacacagggatcatcaaatcagtag

SEQ ID NO: 132675 - DNA, 465 bp, Artificial Sequence
  Description of Artificial Sequence: Synthetic coding sequence
atggcgggccctgtcaaggatcgcgaagccttccaacggctcaattttctgtatcaagcggcccactgcgtgcttgctcaagatccggagaatcaagccctggctcgcttttactgctacacagagagaacaattgcaaaaaggctggtgcttcggcgagatcccagcgtgaagcggacgctttgtagggggtgtagttctctgctcgtccccggcctgacgtgtactcagagacagcggaggtgtagaggacagcggtggacagtacagacgtgtctcacctgtcaacggtcccagagattcttaaacgacccaggccatttgttgtggggcgatcgcccagaggcacagctgggctcccaagcggacagcaagcccctgcagccactacctaataccgcccatagcataagtgatcggttgcctgaggaaaaaatgcagaccaagggcagctccaaccagtag

SEQ ID NO: 132676 - DNA, 534 bp, Artificial Sequence
  Description of Artificial Sequence: Synthetic coding sequence
atggccggtccagtgaaagatcgcgaagccttccaacggctgaacttcttataccaagtaagcctgagacagggcccccacggcgatggagcgagacggccacgggttacagccccgctgccacaggctgcacactgtgtcctggctcaggatcccgaaaatcaggctcttgcccgcttctattgctacactgagaggacaatagctaagaggttggtgctgaggcgtgatcctagcgttaaaaggaccttatgtagaggatgttccagtcttctcgttccagggttgacctgcacacaccgacaaagaagatgcagggggcaacgttggacggttcaaacgtgccttacatgtcaaagatctcaacgtttcctaaacgatcctgggcatttgctgtggggtgataggccggaggcacagttgggatctcaggcagattccaaaccactgcagcccctgcctaacactgcacattccataagtgaccggctgcccgaagagaagatgcaaacacagggctcctcaaatcagtag

SEQ ID NO: 132677 - DNA, 435 bp, Artificial Sequence
  Description of Artificial Sequence: Synthetic coding sequence
atggcgggccctgttaaagacagggaggctttccaaaggttgaattttttgtaccaggcagcccactgcgtcttggcacaggaccccgagaaccaagctctggccaggttctattgttataccgagcgcaccattgccaaacggctggtgttgcgcagggacccatctgtgaaacgcactctctgcagaggctgctccagtcttctcgtcccaggtctaacctgcacacatagacagaggcgctgccgagggcaaagatggaccgtgcagacgtgtctgacctgccagaggtcgcagcgctttctgaatgacccaggtcatttactatggggtgatcgcccagaagcccagctgggcagccaggctggagaacgcttccagacaacgaccacgttagctaagcattcaccacttcactttaggcctcccagttag

SEQ ID NO: 132678 - DNA, 465 bp, Artificial Sequence
  Description of Artificial Sequence: Synthetic coding sequence
atggcgggcccggttaaagacagggaggcctttcaacgcctcaatttcttatatcaagccgctcactgcgtgctggcacaagatccagaaaatcaggccctcgcgagattctattgttatactgagaggaccattgcaaagcggctggtcctccgcagagacccaagtgtcaagagaactctttgtcgcggttgcagctctctcttagtgccaggtttgacttgtacacagcggcaacgccgctgcaggggccagagatggaccgtgcaaacctgcctgacgtgtcagaggagtcaacgattcctcaatgacccgggccatctgctctggggagatagaccagaggcgcagctgggctctcaagcggacagcaagcctcttcagcccctgccgaacaccgctcactccatcagtgatcggcttccagaggagaaaatgcagactcaggggagcagcaatcagtag

SEQ ID NO: 132679 - DNA, 489 bp, Artificial Sequence
  Description of Artificial Sequence: Synthetic coding sequence
atggcagggcccgttaaggaccgggaggccttccagcggctcaatttcctgtaccaggcagcccactgtgtccttgcacaggacccagaaaaccaggcattagctcggttttattgctacaccgaacgcacaattgcgaaaagattagtattaagaaggcccttatcgagctcagcaccacgagacccatccgtgaaaagaacactgtgccgggggtgctcaagcctcctcgtccccggtcttacctgcacgcagaggcaacggcgttgcagaggacagcgctggactgtccagacctgtcttacctgtcagcgaagccaacggttcctgaatgaccccggccacctgctctggggcgatagacctgaggcccaactgggctctcaggcagactccaaaccactccaaccactcccaaacaccgctcatagtatcagcgatcgattgcctgaagagaagatgcagactcagggtagttctaaccagtag

SEQ ID NO: 132680 - DNA, 435 bp, Artificial Sequence
  Description of Artificial Sequence: Synthetic coding sequence
atggctggacctgtgaaagacagagaggccttccagcgccttaatttcctgtatcaggccgctcactgtgttctggctcaggacccagagaaccaagccctggcccgcttttattgttacaccgaaaggactattgctaagcgcctagtgttgagacgggatccctctgtgaaacgtacattatgtagagggtgctcctccctgctcgttcccgggctcacttgtacacacagacagcgacgatgcagagggcagcggtggaccgtccaaacatgcctgacgtgccagagaagtcagagatttctgaacgaccccgggcatctactctggggtgacaggccagaagcacaactgggatcacaggcaggtgaacggtttcaaactacaaccactctcgcgaaacacagtcctctgcactttagaccccccagctag

SEQ ID NO: 132681 - DNA, 534 bp, Artificial Sequence
  Description of Artificial Sequence: Synthetic coding sequence
atggccggcccggtgaaagacagggaagctttccaacgcctgaactttctgtatcaagtgtctcttcgccagggacctcatggggatggtgcccggaggcctcgcgtcactgcccccctgccccaggccgctcattgcgttttggctcaggaccccgagaatcaggctttagcacgtttctactgttatactgagcgcacaatagcaaaaagactggtactcaggcgtgatcccagcgtgaagcgcaccctctgcagaggctgcagctctctgctcgtgcccgggctgacttgtacccagagacaaagacgatgtcgtggccaacgttggaccgttcagacttgcctgacctgccagagatcccagcgcttcctgaacgatcctggacatttgctatggggagaccgccccgaggcgcaattaggaagccaggctgacagtaagcccctccaaccgcttcccaacaccgcgcacagtatttctgatcggctgcccgaggaaaaaatgcagactcagggctcatcaaaccaatag

SEQ ID NO: 132682 - DNA, 489 bp, Artificial Sequence
  Description of Artificial Sequence: Synthetic coding sequence
atggcgggtcccgtcaaggaccgcgaggcctttcagcgcctgaatttcttgtaccaagctgcccactgcgtactggcgcaggatccagagaaccaggctttagcccgattttactgttacactgagagaactatcgccaaacgcctggtcctcagaaggcccctgagctcaagtgctccaagggatcctagtgtgaaacgaaccttatgtcgagggtgcagttccctgctggtgccagggctaacctgtactcataggcagcgtcggtgccgcggccaacgctggaccgtacagacttgcctcacgtgtcagaggagtcagcgctttctcaacgaccctggccatctcctgtggggggatcgacctgaagcccagctggggtctcaggcagactcgaagcctctgcaacccctaccgaacacggcacactcaattagcgatcgcctccccgaggagaaaatgcagactcaggggtcttctaaccagtag

SEQ ID NO: 132683 - DNA, 534 bp, Artificial Sequence
  Description of Artificial Sequence: Synthetic coding sequence
atggcaggccctgtgaaagaccgcgaggcatttcaacgtctgaactttctatatcaggtgtcccttagacaggggccccatggagatggggccagacgacctcgagtcacggcgccacttcctcaagccgcgcactgtgtgctggcacaagacccagaaaatcaggctttggcccgcttctactgctacacagagcggacgatagctaagagactggttctcagacgcgacccgtctgtgaaacgtacgctttgtcgcgggtgcagttccctactggtaccagggttaacttgcacgcagagacagcggagatgtagggggcagcgctggacagtccaaacctgcctcacttgccagcggagtcagcgctttctcaatgatcctggccatctactttggggggatcgccccgaggctcagttgggttcccaggctgacagcaagcctctgcagcccctgccaaatactgcccactccatctccgatcgccttcctgaggagaagatgcaaactcagggctccagtaatcagtag

SEQ ID NO: 132684 - DNA, 489 bp, Artificial Sequence
  Description of Artificial Sequence: Synthetic coding sequence
atggccggtcctgtgaaggatcgcgaagccttccagagactgaatttcctctaccaagccgcacattgcgttctggctcaggaccctgaaaaccaggcccttgcccgattttactgctacaccgagcggacaatcgcaaaaaggcttgttctcaggagacctcttagtagttccgccccaagggatccttcagtcaaaaggacactgtgtcgcgggtgctccagtcttctggtcccaggcctgacctgcactcagcgccaacggcgctgtagaggccagcgctggacagtgcagacctgtctgacctgtcaacgaagccagcgttttcttaacgatcctggacacctgctgtggggagatagacctgaggctcaactgggaagtcaggccgactccaaacctttgcagccactgcctaacacagctcattccatctcagatagacttcccgaggaaaaaatgcaaacacagggatcctcaaatcagtag

SEQ ID NO: 132685 - DNA, 465 bp, Artificial Sequence
  Description of Artificial Sequence: Synthetic coding sequence
atggctggacccgtaaaggaccgggaggccttccagagacttaacttcctgtaccaagctgctcactgcgtcctggcacaggacccagaaaaccaggctctcgctcggttctactgctataccgaaaggaccattgcgaaaagactggtactccgccgtgaccctagtgtaaagagaacactctgcaggggatgctcctcattgctggttcccggcctcacctgtactcatcgacaaaggcggtgtcggggccaaagatggacggtccagacctgcctgacctgccagcgaagtcagcggttcttgaatgatccagggcacctactgtggggagatcgccccgaggcgcaactggggtcccaagccgacagcaagcccctgcagcccctgccaaacacggctcactctatttcagacaggctccccgaagagaagatgcagacccagggctctagcaatcaatag

SEQ ID NO: 132686 - DNA, 435 bp, Artificial Sequence
  Description of Artificial Sequence: Synthetic coding sequence
atggctggcccagtaaaagaccgtgaagcctttcaacgactcaattttctctaccaagccgcgcactgcgtgttagctcaggatccagaaaaccaggctcttgcacggttctattgttatactgagaggaccatcgcaaaacgcctagtattgaggcgagatccttccgtgaagcgcacattatgtagaggctgttcctcacttctggtgcctgggctgacttgtactcagcgccagcgaagatgcaggggacagcggtggacagttcagacgtgtttgacatgccagcggagccaacggttcctgaacgaccccggacatttgctgtggggggacaggcccgaggcccagttgggttcacaggcgggtgaacggtttcagacgaccactaccctcgccaagcattccccgctccacttccgcccaccaagctag

SEQ ID NO: 132687 - DNA, 435 bp, Artificial Sequence
  Description of Artificial Sequence: Synthetic coding sequence
atggctggcccggtgaaggaccgggaagcctttcagagacttaattttctgtatcaagctgcccactgcgtgttagcacaggatcccgaaaaccaggcactcgctaggttttattgttatactgagagaactattgcaaagcggttagtgttgagaagagatccaagcgtgaaacgtactctgtgccggggatgttcctctctgctggtgccaggcctcacttgcacccagagacagaggaggtgcaggggccagcggtggactgtacaaacgtgtctgacatgtcagcgcagccagcgattcttgaacgaccctggacacctactctggggcgaccgaccagaggcccagctggggtcacaagccggcgagcgatttcagacaacaacaactctcgccaagcattcccccctacactttaggcccccgagttag

SEQ ID NO: 132688 - DNA, 435 bp, Artificial Sequence
  Description of Artificial Sequence: Synthetic coding sequence
atggctgggccggttaaggaccgggaggccttccagcgactcaattttctctatcaggctgcgcattgcgtgctcgcacaggatcccgaaaatcaagcactagctaggttctattgttatacggagcgcaccattgcaaagcgcctcgtgctcagaagggacccctctgttaagcgcactctctgtagaggatgctctagcctgctggtcccgggtcttacttgcacgcaaagacagcgccggtgccgggggcagcgttggaccgtccagacgtgtctgacatgtcaacgctcccagagatttctgaatgatcccggccacctcctatggggcgacagacctgaagcccaattgggttcccaggccggtgagcggttccagacgacgaccacacttgcgaagcactcacccctgcattttcgccccccaagttag

SEQ ID NO: 132689 - DNA, 534 bp, Artificial Sequence
  Description of Artificial Sequence: Synthetic coding sequence
atggccggcccagtcaaggatagagaggcattccagagactcaactttttatatcaggtatctctacgccagggaccccacggagacggagcgagacgccctcgcgtgactgcaccactgccccaagctgcccattgtgtgctagctcaggacccagagaaccaagccttggccagattctactgctacacagaaagaacaattgctaaaaggcttgtgctgcgcagagacccatctgtgaagagaaccctttgtagagggtgctccagccttttggtgcctggactcacttgcactcaccgccagcgccgttgtagaggccagcggtggaccgtgcagacctgtctgacgtgtcagaggtcccagagattccttaacgatcctgggcacttgctatggggggataggccggaagctcagctggggtctcaggcagatagcaagcccttgcagccactgcctaacacagcgcatagtatcagtgatcgactcccggaagagaagatgcagacacagggctccagcaaccagtag

SEQ ID NO: 132690 - DNA, 435 bp, Artificial Sequence
  Description of Artificial Sequence: Synthetic coding sequence
atggccgggcctgtgaaagatagggaagccttccaacgcttgaattttttgtatcaagctgcacattgtgttctcgcccaggatcccgagaatcaagctctagcccgcttctattgctatacagagaggactatcgccaagcgactggtgctcaggcgtgatccatccgtgaagagaacactatgcaggggctgtagcagcctgcttgtccccggtttgacttgcacccaccgtcaacggcgttgccgggggcagcggtggacggtgcagacttgcctcacatgtcagcgatcccagaggttcctaaacgatcctgggcatcttctgtggggcgataggccagaagcccagttaggatcccaggccggtgagaggttccagacgacaaccacgttagctaagcacagcccgctccatttccggcccccctcgtag

SEQ ID NO: 132691 - DNA, 465 bp, Artificial Sequence
  Description of Artificial Sequence: Synthetic coding sequence
atggccgggcccgtgaaggatagagaagctttccagcgactcaacttcctgtaccaggccgcccactgtgtcctggcccaggatcccgaaaaccaagctctggcccgcttctattgctacaccgagagaaccatcgccaaacgtttggttcttcgccgcgacccttctgtcaaacgaactctgtgcagaggatgctcatctctactcgtgcctggcctgacctgcacccagagacagcggaggtgcaggggacagcgatggaccgtccagacctgcctgacgtgtcagcggagccaaagatttctgaacgacccaggccatctcctgtggggggaccgccccgaagcacagctgggatcacaagctgattctaagccgctgcaacccctgcccaacacagcccatagtatcagcgacagattgcccgaggaaaagatgcaaacacaagggagctccaaccagtag

SEQ ID NO: 132692 - DNA, 534 bp, Artificial Sequence
  Description of Artificial Sequence: Synthetic coding sequence
atggccggcccagttaaggatcgtgaggccttccaaagacttaattttctatatcaagtctccctccggcaaggaccccacggtgacggagcccgacggccacgcgtgactgcacccttgcctcaggctgcacattgcgtccttgcccaggatcctgagaaccaggccctggccagattttattgctacactgaacgtaccatcgctaagcgtcttgttctccgaagggatcctagtgtaaaaagaacactgtgcagaggctgcagcagtctactggttcctggcctcacgtgcactcacaggcagagacgctgccgcggacagaggtggaccgttcagacatgcttgacatgccagcgttcccaacggttcctgaacgacccgggacacttactctggggagatagacctgaggcgcagctcggctcacaggcagactctaaaccattgcaacccctccccaacaccgctcactccatctcagacagactccccgaggaaaaaatgcagacccaggggtcgtccaaccagtag

SEQ ID NO: 132693 - DNA, 489 bp, Artificial Sequence
  Description of Artificial Sequence: Synthetic coding sequence
atggcagggcccgttaaagaccgggaagctttccaacgcctgaactttctgtaccaggccgcccactgtgttctagcacaggatccagaaaaccaggcgttggccaggttctattgttataccgaacgaaccatcgccaaacggttggtacttagacgccccctctcctcttctgcaccccgcgatccctccgtgaagaggacactgtgcagagggtgtagctctctcctggttcccggattgacctgcacccaaaggcagcgtcggtgtaggggccagcggtggaccgtgcaaacctgtttaacttgtcagaggagtcaaaggttccttaacgaccccgggcatcttctctggggcgatagacctgaagcccaacttggctcccaggccgacagtaaaccactgcaaccactgcccaacacagcccatagcataagcgaccgcttacccgaggagaaaatgcagacacagggatcttctaaccagtag

SEQ ID NO: 132694 - DNA, 489 bp, Artificial Sequence
  Description of Artificial Sequence: Synthetic coding sequence
atggccggccccgtcaaagatcgggaagcgttccaacgcctaaatttcctttatcaagccgcccactgcgtactcgcgcaagatcccgagaaccaagcgctggctagattttactgttacactgaaaggacaatcgcaaaacggctggtgctgcggaggcccttgtcaagctcggcccctcgggacccctccgtgaagcgcaccctctgtaggggctgttccagtctgctggtacctggcctcacctgtacacatcggcagagacggtgccggggccagcgatggaccgtgcagacttgtctgacatgccagagaagtcaacgctttctaaacgacccgggccacctgctttggggtgataggccagaggcgcagctggggagccaggccgattccaagcccctgcagcccctgccgaatacggcacacagcattagcgaccggctccctgaggagaaaatgcagacccaagggagctctaaccagtag

SEQ ID NO: 132695 - DNA, 765 bp, Artificial Sequence
  Description of Artificial Sequence: Synthetic coding sequence
atggcggtctttgcagacctggacttgcgcgctggtagtgatttgaaggcactcagaggtttagtcgagacggccgctcatcgtgaattgccaaggttgcgggcttggcctacctcatgtcacccagaccaccgggcaactctccggataggctacagcgtcgtggccataaatcacatagtggacttcaaagagaagaaacaggaaattgagaaaccagtggcggtctcagagctgtttaccacgctgccaatagtacaaggcaagagcagaccaatcaagatcttgacaaggctgaccattattgtctccgatcctagccactgtaacgtgctgcgagcgacatcaagccgggccaggttgtatgacgtggtcgcagtgttcccgaaaactgagaaactcttccacatcgcctgcactcatctggacgttgatctggtctgtatcaccgtaactgagaagctacccttctacttcaagcgaccacctattaatgttgctatcgatcgcggcctggcattcgagcttgtgtattctcctgcaatcaaggattcaactatgagacggtacaccatctccagtgctctgaacctcatgcaaatttgtaaaggtaagaatgttatcatttctagtgccgccgagagacctctggagatccgagggccttatgatgtggcaaaccttggcctgctctttgggctgagcgagagtgacgccaaagctgccgtgtctacaaactgtcgagccgctctgctgcatgggtag

SEQ ID NO: 132696 - DNA, 807 bp, Artificial Sequence
  Description of Artificial Sequence: Synthetic coding sequence
atggccgtattcgccgacctggatttgcgggctggatccgacctgaaggcactccggggcttagttgaaacagccgcccacttgggatacagcgttgtggcgataaatcatattgtcgacttcaaagagaaaaaacaggaaatcgagaaacccgttgcagtctccgagctcttcactaccctgcctatcgtgcagggaaaatctcgccctattaaaatcctcaccagattgacaatcatagtgtctgatccctcacattgcaatgtcctgcgggcaacatcctccagggcgaggctctacgacgtagttgctgtgtttcccaagaccgagaagctcttccacattgcctgtacacatttggacgttgatctggtgtgtataaccgtgacagagaaactccctttctatttcaagagaccccctataaatgtggccatcgaccgcgggttggctttcgaactggtgtattctccagccatcaaggactctacaatgcgacggtacaccatcagttcagctttgaacctaatgcagatatgcaaggggaagaatgtgattatttcttccgcagccgaaaggccgcttgagatccgcggcccatatgacgtggccaatcttgggctgctattcggacttagcgagagcgatgccaaagctgcggtgagtacaaactgcagggcggccctgttacacggggagacaagaaaaacggcctttggcattatttcgaccgtaaagaagcctcggccttcggaaggtgacgaggactgcctcccagcatcaaaaaaagcaaaatgcgaagggtag

SEQ ID NO: 132697 - DNA, 768 bp, Artificial Sequence
  Description of Artificial Sequence: Synthetic coding sequence
atggcagtgttcgccgacctggacttgagagctggaagtgatctgaaagctctgagaggcctggtagagaccgccgcccacctcgggtattccgtggtggcaattaatcacatcgttgatttcaaagagaaaaagcaagagatcgaaaaacccgttgcagtgagcgagctattcactacgctgcctatcgtgcagggcaagtcgagaccgataaaaatactcaccaggttgaccatcatcgtcagcgacccttcacattgtaatgtgctcagggcaacttcaagtcgggcccgcctgtacgacgtcgtggcagtgttcccaaagactgaaaaactattccacatcgcctgtacgcatctcgatgtggacctggtctgtatcacggtgacagagaagttacccttttactttaagaggcctcctatcaatgttgccattgacagaggcctggctttcgaattagtctatagccctgcaattaaggattcaacaatgcgccggtacactatcagtagtgccctgaacttgatgcaaatatgtaagggcaagcctttggaaatcagaggcccttatgacgtggcgaatctgggactcctttttggccttagcgaatctgacgcaaaggcggccgtgagcaccaactgtcgagccgctcttcttcacggagagactagaaagacagccttcggtataattagtaccgtgaaaaagccaaggccttccgagggggacgaagactgcctgcccgccagcaagaaggccaagtag

SEQ ID NO: 132698 - DNA, 969 bp, Artificial Sequence
  Description of Artificial Sequence: Synthetic coding sequence
atggcagtgttcgctgatctggacctaagagcgggcagcgacctgaaggcactgagggggctggtggaaaccgcagcgcatctgggatattcagtggttgctattaatcacatcgtggacttcaaggaaaagaagcaagaaattgagaaaccagtcgctgtatctgaactgttcacgacactgcctatagttcagggcaaaagtcgccccattaaaatactgactaggctgaccataatagtgagcgacccttcccactgcaacgtcctgcgggccacatcctcacgcgctcgactgtacgacgtagtggcagtgtttccaaaaaccgagaaactgtttcacatcgcttgcacccatctggacgtggatctggtgtgcattacagtgactgagaagttgccattctactttaagcggcccccaatcaacgtggcgattgatcgggggttggctttcgaactggtctactctcccgcaattaaagactcaacgatgagacgttatacgataagctctgctctgaatcttatgcagatatgcaagggtaagaacgtgattattagttcagcagcggagcgccccctagagatacggggaccctacgatgtggctaacctgggtctgctttttgggttgtcagaatccgacgccaaggccgccgtgtccacaaactgcagagcagctctcctgcatggggagacccggaagaccgcattcggcataattagcaccgtgaaaaagccaaggccctctgaaggcgacgaggactgcttacctgcgtcaaagaaggcgaagtggagccattcagttactcaggccggcgtgcagtggcataacctgggtagtttacagcctctgccgttgggcctgaaaccatcatcgcatctttctctcccaaggaccaggatccaacagagacagctgctgatctctcatcagcgagaccacacgccaaagaaccgcctgtag

SEQ ID NO: 132699 - DNA, 639 bp, Artificial Sequence
  Description of Artificial Sequence: Synthetic coding sequence
gaaattgaaaagcctgttgccgtgagcgaattgtttacaactctgcccatcgtgcagggcaaatctagaccaattaaaattctgaccaggctgaccattatcgtgtccgacccatcacactgcaatgtgctgagggccacctcaagtcgcgctagattgtatgatgtggtcgccgtatttccgaagacagaaaagctctttcatatcgcatgcacgcatctcgatgtggaccttgtttgcattaccgtgaccgaaaaattgcccttctatttcaagcgtccaccgattaacgtggccatcgacagaggcttggcctttgagctggtgtacagtccagccatcaaggattctacaatgaggcgctatacaatctcttccgctctaaatctcatgcagatctgcaaggggaaacctttagaaattcgagggccatatgatgtcgctaatctggggttactgtttggactctccgaaagcgatgccaaggccgccgtgagcaccaactgcagagccgctttgttacacggggaaacccgcaaaaccgcgttcggcataatctctaccgtcaagaaacctcgcccttctgagggcgacgaggactgcctgcctgcctcaaaaaaagcaaagtgcgagggctag

SEQ ID NO: 132700 - DNA, 852 bp, Artificial Sequence
  Description of Artificial Sequence: Synthetic coding sequence
atggccgctgccccacaggcccctgggagaggcagcctgaggaaaactcgccccctcgtagttaaaacgagtctgaataatccctacattatcaggtggtccgccttggaatccgaagatatgcacttcatactgcaaaccctcgaagataggttgaaagctattggcctgcagaaaattgaagacaaaaaaaagaagaacaaaacaccattcttgaaaaaagaaagccgagagaagtgcagtatcgctgtcgacatatctgagaaccttaaggaaaagaaaacggatgctaagcagcaagtgtccgggtggacccccgctcatgtccggaagcaactcgctatcggcgtaaatgaggtgacccgcgccctagagcggagagagctgcttttagtgctagtctgtaaaagtgttaagccggcaatgatcacttcccatttgatccaactctctctgtcacgaagcgtacccgcttgccaggttccaagacttagtgagcggatcgcccctgtgatcggcttgaaatgcgtgcttgcactagcctttaagaaaaacacaaccgatttcgtggatgaagtgagggctataatccccagggtgccgtcgctgtccgtgccttggctgcaggaccgcatcgaggattctggcgagaacctcgagacagagccactggaaagccaggatcgtgagttactcgacactagcttcgaagacctgtccaagccgaaaagaaaacttgcagacggaaggcaggcttcagtcacactacaacctttgaaaatcaagaagcttatacctaatcctaacaaaattcgcaaaccccccaaatctaagaaagcgaccccaaagtag

SEQ ID NO: 132701 - DNA, 504 bp, Artificial Sequence
  Description of Artificial Sequence: Synthetic coding sequence
atggcagccgccccccaggccccaggtcgaggatctctacggaaaacccggcccctggtcgtgaaaacctctctcaacaacccctacatcattcgctggtcagccctagagagcgaggatatgcacttcattttacaaaccctagaagaccgactcaaagctattggcctacagaagatcgaagacaaaaagaagaaaaacaagaccccttttctgaagaaagagtcgcgcgagaaatgttctattgcggtggatatttcagagaacctgaaggaaaagaagactgatgccaaacagcaggtttccggatggacacccgctcacgtgcggaagcagctagcaatcggtgtgaatgaggtgacacgagcactagaaagaagggaactcctgctcgttctagtgctgacactgctcccccggctagagtgttctggggtgatcccagcacactgcaacccagcctcttgggtgcaggcgattctgctgccgcagccgccggaatag

SEQ ID NO: 132702 - DNA, 852 bp, Artificial Sequence
  Description of Artificial Sequence: Synthetic coding sequence
atggcggcagcaccccaggcacccggtagaggctccctgcgtaaaacaaggccacttgtggtgaagacgagcttaaataacccttacattattagatggtcagcactcgagagcgaagatatgcacttcattctgcagacactcgaagatcgcctgaaggccatagggctgcagaagattgaagacaagaagaaaaagaataagacacccttcctgaagaaagagtcgcgggaaaagtgctccatcgctgtagacattagcgaaaacttaaaagagaagaagacggacgctaagcagcaagtgagcggatggacgcccgcacacgtgcgaaagcagctagccatcggggttaacgaggtgaccagggctctcgagcgcagggaattgctgctagtgctggtgtgcaagtcagtcaaacctgcgatgattaccagccatctgatccagctgagcttgtcacggtctgtgccagcctgtcaggtccctcgcctctctgaaaggatagcccccgtgatcggattgaagtgtgtgctggcactggccttcaaaaaaaacactactgactttgtggatgaagtgcgcgcaatcattccccgcgtgccttccctttccgtgccctggctccaggaccggattgaagatagtggggagaacctagaaaccgagcccctcgagtcccaggatcgggaactgttagacaccagcttcgaagacctgtctaagcccaaaagaaaattagcagatggtagacaagcctctgtgactctgcaaccattgaaaataaaaaagctcataccaaaccccaacaagattcggaagccacccaagagcaaaaaagccacaccgaaatag

SEQ ID NO: 132703 - DNA, 852 bp, Artificial Sequence
  Description of Artificial Sequence: Synthetic coding sequence
atggccgctgcccctcaagcgccaggccgtggctctctaaggaaaactcggcctttagtcgtgaaaacatctctgaacaacccctacattatacggtggtccgcgctggagtccgaggacatgcattttattctccagaccctcgaagacaggctcaaggctatcggcctgcagaaaatcgaagacaaaaaaaaaaagaacaaaacacctttcctcaagaaagagtcaagggagaaatgtagtattgccgtagacatttcagaaaatcttaaggagaaaaagactgacgctaaacagcaagtctccggatggactcccgcccacgtgcgcaaacagctggctatcggcgtcaatgaggtgactcgcgcactggagagacgcgaactgttacttgtgctggtgtgcaaatccgtaaagcccgcaatgattacaagccatttgatccagctgagcctttcccgctctgttcccgcttgtcaggttcccagactgtctgaacggatcgccccagtgatcgggttgaagtgcgtattagcactggcctttaagaagaacacaaccgacttcgtggatgaagtacgggctatcatccctagagttccctccctgagtgtcccctggctacaggaccgcatcgaggattctggcgaaaatctggagacagaacctctggagtctcaggatagggagctcttggataccagctttgaggacctgagtaaacctaaacgaaagctcgcagatgggcgccaggcatctgtgaccctgcagcctctgaagatcaagaagttaattcctaacccaaataaaatccgcaagcctcctaagagtaagaaagctacccctaagtag

SEQ ID NO: 132704 - DNA, 510 bp, Artificial Sequence
  Description of Artificial Sequence: Synthetic coding sequence
atggctgccgcacctcaggctccaggccgagggagcttaagaaaaaccagacccctcgttgtgaaaaccagtctcaacaatccgtacataataaggtggtctgcactggaaagcgaagatatgcactttatacttcaaacgttagaggataggctcaaagcaatcggactccagaagatcgaagacaaaaaaaagaagaacaaaactcctttcctgaaaaaagagtctagggagaaatgttcaattgccgtggatattagcgaaaatttaaaagagaaaaaaactgacgctaagcaacaggtgagcggttggacacccgcccatgtgaggaaacagctggcaattggcgtcaacgaagtaactagagccctggaaaggagagagctgttgctcgtcctcgtctgtaaatctgttaaacctgctatgataactagccatttaatacaactgtccctctccagatccgtgcccgcatgccaggtgccacgcttgagcgaacggatcgcctag

SEQ ID NO: 132705 - DNA, 1092 bp, Artificial Sequence
  Description of Artificial Sequence: Synthetic coding sequence
atggctacccttcggagactgcgagaagccccaagacacctgcttgtctgcgaaaagtccaactttggaaaccataaatctagacacagacacctggtgcagacccactattacaattaccgagtgagctttctgatcccagaatgcggaatactctctgaggagctaaaaaatctggtgatgaacacagggccttactattttgtaaagaacctgcccctacacgagctgatcacacccgaatttataagcacttttattaagaaaggctcttgctatgccctaacttacaatactcacatcgatgaggataatactgtagccctgctcccaaatgggaaactgatcctgtccctcgataaagacacctacgaggaaactggtctccagggccaccccagtcaattcagtggccggaaaataatgaaatttatcgtgagcatcgacctgatggaactgtctctcaacctggactctaaaaaatacgagagaatctcttggtcatttaaggagaaaaaacctctaaaatttgactttctgttggcctggcacaaaaccggtagtgaggagagtacgatgatgagttatttcagcaagtaccaaatccaggaacaccagcctaaggtggccctctctactttacgcgatctgcaatgtcccgtactgcagtcatcagagctggagggtaccccagaggtctcctgcagggcgttggagcttttcgactggttgggcgctgttttcagcaatgtggacttgaacaatgaacctaacaattttatttcgacttactgctgtcccgaaccaagcaccgtggtggctaaggcgtatctttgcacaatcactggcttcattctgccggaaaagatctgtctcctgctggaacacctctgtcactactttgatgaaccaaagctggcgccctgggtgacactgagtgtgcagggattcgccgacagtccagtcagctgggagaagaatgaacatggatttagaaaaggtggcgagcatttgtacaatttcgtcatctttaataatcaggactactggttgcagatggcagtgggagctaatgatcattgccctccatag

SEQ ID NO: 132706 - DNA, 912 bp, Artificial Sequence
  Description of Artificial Sequence: Synthetic coding sequence
atgaatactggtccctattattttgtcaaaaacctccccctccacgagctgatcactcccgagttcatctcaactttcattaagaagggaagttgctacgctctgacttataacactcacattgacgaggacaacacagtggctttattacctaatggtaaactgatcctctcgttggataaagatacttatgaggagactggcttgcaaggacacccctcacagttctcaggaaggaagataatgaagttcattgtgagtatcgacctcatggagctcagcctcaatctggattccaagaaatatgagcgcatttcctggagcttcaaggagaaaaagcccctcaaatttgattttttattggcttggcacaagacagggtctgaggagagtactatgatgtcttatttctcgaaataccagatccaagagcatcagccgaaagtagcgctctccaccctgcgcgatctgcaatgccctgttctgcagtcgtctgagcttgagggcactccggaggtgtcatgtcgtgccttagagctctttgattggctgggtgcggtgttttcaaacgtcgatttgaacaacgagcctaataactttatcagtacatattgttgtccagagccttcaacggtcgtggcaaaggcatacctgtgtaccataacaggttttattctgcccgagaaaatttgcctcctcctggagcatctgtgccattacttcgacgagcctaaactggcaccttgggttactcttagtgtgcaaggctttgcagactctcccgttagctgggagaagaatgagcacgggttcagaaagggtggtgagcacttatacaattttgtcatatttaataaccaggattattggctgcagatggccgtcggggcgaatgatcattgtccaccttag

SEQ ID NO: 132707 - DNA, 717 bp, Artificial Sequence
  Description of Artificial Sequence: Synthetic coding sequence
atgagaccagccgccctgcgcggagccctattgggttgcttatgcctggccttgctgtgcctcgggggggctgacaagcggctcagagacaatcacgagtggaagaagttaattatggtgcagcattggcccgagacagtgtgcgagaagattcagaacgactgccgggacccacctgattattggactatccacggactgtggccagataagagcgagggctgcaaccgatcttggcctttcaacttggaagagatcaagaagaactggatggagatcactgactcgagcctaccatctcccagcatgggacccgcccctcctcggtggatgcggtcgacaccccgacggagcacactggccgaggcctggaacagcacggggagttggactagtacgggaggttgtgctcttccccctgctgcattgccaagcggggatttgtgttgtcgtcccagtctgacggctggctcccgtggggtgggggtggacttgaccgccttgcagcagctgctccacgtccactacagcgccactggcattattcccgaagaatgtagtgaaccaactaagccctttcagattatactgcaccatgaccatacggagtgggttcagagcattggtatgccaatctggacgatatcatcatctgaatctgccattggcaaaactcgcacccagccagcatgcgcagtgctaagccacgattcttag

SEQ ID NO: 132708 - DNA, 624 bp, Artificial Sequence
  Description of Artificial Sequence: Synthetic coding sequence
atgagaccggcagcactccggggggccctccttggctgtctttgcctggccttgctttgtctcggaggggctgataaacggctcagggacaaccacgagtggaaaaagcttataatggtccaacattggccggagaccgtgtgtgagaagatccagaatgactgtcgcgacccccctgactactggacaattcacggcctctggccagacaagtctgagggctgtaatcgcagctggccctttaacctggaagagatcaaaaagaattggatggagatcacagactcttccctgccaagcccgagcactgatctgctgcccgaaatgagagcatattggcccgatgtgattcacagcttcccaaatagaagtaggttttgtgggacttgtgccgcccaggtggatgccctcaacagccagaaaaagtattttggccgctcgctcgaactgtatagggagctagacttgaataggtgggtgaggccatcacccggctgtacaagccaatggggtagcctcctgtctcccaaaccagattcatggatccaaggttcaggctgcaggcctcactgtccgcccgcagcttccgcatgcgctctcttcggatactgggatcatagctag

SEQ ID NO: 132709 - DNA, 921 bp, Artificial Sequence
  Description of Artificial Sequence: Synthetic coding sequence
atgagacctgccgcactccgaggagctctgcttgggtgtttatgcctggccctgctgtgcctgggcggcgctgacaaacggctccgagataaccatgaatggaagaaactgatcatggtacagcattggccggagactgtgtgtgagaaaatccagaacgactgtcgtgaccctcccgactattggactatccacggactgtggcaagtgagccacacctcacgaagagggctgctgttcctattcaagaatatcttctccctttcgtcgcgtaatttttcattctattccctacaaacatcaatgaaaaagcccccccagccaagcctgatattcttaattttctcattcaaacccgataagtccgaaggttgtaacaggtcttggccatttaatcttgaggaaattaaagacctcttgcccgaaatgcgtgcttactggccagatgtaatccactctttcccgaaccgctctcggttctggaaacacgaatgggaaaaacacggaacctgtgccgcccaagtggacgcgctgaactcgcagaagaagtattttgggaggtctctggagctgtaccgggagttagacttgaactcagttctcctcaagctgggcattaaaccctccataaattactatcaagttgcggactttaaggatgcattagctcgagtgtacggcgttatccccaaaatccagtgtttacccccatcccaagacgaggaggtgcaaactatagggcagatagagctgtgcctcactaaacaggaccaacagctgcagaactgtacggaacccggtgaacagccttcacccaaacaggaggtttggctggcaaacggtgcagctgagagccggggattgcgcgtctgtgaggatggacccgttttctaccccccccctaaaaaaacaaaacactag

SEQ ID NO: 132710 - DNA, 771 bp, Artificial Sequence
  Description of Artificial Sequence: Synthetic coding sequence
atgagacccgctgcgttgaggggcgccttgctcggttgcctgtgcctcgctctcttatgtctcggcggggccgataaaaggcttcgagacaaccacgaatggaaaaaactgatcatggtccagcattggccagagactgtctgcgaaaagattcaaaacgattgtagggacccacctgactactggactatacacgggctgtggcccgacaagtcggaagggtgcaataggagctggccattcaatctcgaggagatcaaggatctgttgccagaaatgcgagcttactggcccgacgtcattcactcctttccaaaccggagtcggttctggaaacatgaatgggagaagcacggcacatgcgcggcccaggtggacgccctgaacagtcagaaaaagtacttcggtcgctctctggaactgtaccgggaactcgatctgaacagtgtgttactcaaattaggcatcaagccctcaatcaactattaccaggttgccgacttcaaggacgctttggctagggtttatggtgttatccctaagatacagtgccttcccccatctcaggacgaagaggtgcagacaattggtcagattgaactatgcttgaccaagcaagatcagcaactgcaaaactgcaccgaacctggagaacagcctagcccgaagcaggaggtgtggctagcgaacggggccgccgagagtcgagggctgcgtgtctgtgaggatggccctgtgttttacccaccgcccaagaaaactaaacactag

SEQ ID NO: 132711 - DNA, 765 bp, Artificial Sequence
  Description of Artificial Sequence: Synthetic coding sequence
atgagacctgcagcgctgaggggagctctgctgggttgtctgtgcctcgctctgttgtgcctgggtggcgcagataaaagactgagagacaaccacgaatggaagaagctcatcatggtacagcactggcccgaaaccgtctgtgagaaaatccaaaacgactgccgtgacccccccgactactggacaattcacggtctttggcctgataagagcgaaggatgcaaccgtagctggcctttcaatctagaggagatcaaggacttgctcccggaaatgagagcctactggccagatgtgatccattcgttcccgaatcggtcgcggttctggaagcacgagtgggagaaacatggcacctgtgccgcgcaggtggatgctctgaacagccaaaagaaatactttggtcgctctttggaactctatagggaattggatctaaactctgtgctgcttaaactgggcattaagccttctattaattattatcaggtggctgactttaaggatgcgcttgcaagagtgtatggcgtaattcccaagattcagtgtctgccacccagccaggatgaagaggtccagacaattggacagatcgaactctgcctaacaaagcaggaccagcagctgcaaaactgcactgagcccggcgagcaaccttcccccaagcaggaggtttggcttgcaaacggcgcagcagaaagccggggcctgcgggtctgtgaggatggccctgtcttctatcccccaccaaaaaaaacctag

SEQ ID NO: 132712 - DNA, 771 bp, Artificial Sequence
  Description of Artificial Sequence: Synthetic coding sequence
atgcgcccggccgccttgagaggcgcccttctgggctgtctgtgcctggccttgctgtgtcttgggggcgccgacaaaaggttacgcgataaccatgagtggaaaaagctcatcatggtacaacactggcctgagaccgtgtgtgagaagatccagaacgactgtagggacccccctgattactggactattcacgggctgtggcccgataagagcgaaggctgcaaccggagctggcctttcaacctagaggagataaaggatctgctaccagagatgcgcgcctattggcccgacgtgatccatagctttcctaaccggagtcgattttggaagcatgaatgggaaaagcatggaacatgcgccgcgcaggtagatgccctgaactcccaaaaaaaatactttgggcggtccctcgagctatatcgggaactcgatctgaactcagtcctacttaagctgggaatcaagccctcaattaattattaccaggtagcggactttaaggacgcattagcgcgagtctatggcgtgattccaaagatccagtgcttgccaccctcccaagacgaagaggtgcagaccataggacaaattgaattgtgtctgacaaagcaggatcagcaacttcaaaattgtaccgagcccggagagcagccttccccaaagcaagaagtctggctggcaaacggagcagccgaatccagaggactacgtgtctgtgaggatggccctgtcttctaccctccaccgaagaagacaaagcactag

SEQ ID NO: 132713 - DNA, 471 bp, Artificial Sequence
  Description of Artificial Sequence: Synthetic coding sequence
atggctcttgagaaatctctcgtgagactgctgctccttgtgctcattctcctggtacttgggtgggtgcagcccagcctgggtaaagaatcgcgggctaagaagttccagagacagcacatggactcggattccagtccttcgagctcttcaacttactgtaaccagatgatgcgacggcggaatatgacacaagggagatgcaagccagtcaacacctttgtccacgagcctctggttgatgttcaaaacgtttgtttccaagaaaaggtgacatgcaaaaacggtcagggaaactgttataagtccaattcttccatgcacatcactgattgcaggttaacaaatggtagccgctaccctaattgtgcctacagaactagccctaaggaaagacacatcatcgtggcttgtgaagggagcccctacgtcccagtccactttgatgcatccgtcgaagacagcacatag

SEQ ID NO: 132714 - DNA, 471 bp, Artificial Sequence
  Description of Artificial Sequence: Synthetic coding sequence
atggctctcgagaaatctctagtgaggctcttgcttctggtgttgattctcctggtactcggctgggtgcaaccgagcctaggcaaggagtctcgggctaagaagttccagcggcagcacatggattcagactctagcccttccagttcctccacatattgtaatcaaatgatgaggaggaggaacatgacacaggggcggtgtaagccagtgaacacgtttgtgcatgagcctctggtggatgtgcagaatgtatgctttcaggaaaaggtcacctgcaagaatggccaaggcaattgttacaaatctaactcgtccatgcatataactgactgccgcttgaccaacggctcccggtacccaaattgtgcttatcgtacatcccccaaggaaaggcacatcatcgtcgcatgcgagggctcaccttacgttccagtgcacttcgacgcgtcagtggaggattccacgtag

SEQ ID NO: 132715 - DNA, 471 bp, Artificial Sequence
  Description of Artificial Sequence: Synthetic coding sequence
atggcactggagaaatctctggtgagactcctgctgctcgtgctaatcctgcttgtcctgggatgggtgcaaccaagcttaggaaaggagtctagggcaaagaaattccagcggcagcacatggatagtgacagctccccttcaagtagtagtacttactgtaatcagatgatgcgaagacggaacatgactcaggggcggtgcaagccagtgaacactttcgttcatgaacctcttgtggatgtgcagaacgtttgtttccaggaaaaggtgacctgcaagaatggccaggggaattgttacaagagcaactcctctatgcacattaccgattgtcgcctcaccaacggatccaggtatcctaattgtgcataccgcaccagtcctaaggagcggcacatcatagtggcctgcgaggggtccccctatgtgcccgttcattttgacgcctctgttgaagactccacatag

SEQ ID NO: 132716 - DNA, 471 bp, Artificial Sequence
  Description of Artificial Sequence: Synthetic coding sequence
atggctctcgagaagagcctcgtcaggctgctgctgctggtgctgatactgttagtgctcggctgggtgcagccgagcttgggcaaggagagccgggctaaaaaattccagagacagcatatggattccgatagttctccatctagtagctccacttattgtaatcagatgatgcgcaggagaaacatgacgcagggcagatgtaaaccagtgaacaccttcgtacacgaaccattggtagacgtgcagaacgtgtgcttccaggagaaagtgacatgcaagaatgggcaaggcaactgttacaagtcaaactctagtatgcatattacagattgccgtctcactaatggatcacggtaccctaactgcgcttaccgcacttcgccaaaggagcgacacattatcgttgcatgcgaggggagtccgtatgtgccggtgcactttgacgcctccgtggaggacagtacatag

SEQ ID NO: 132717 - DNA, 486 bp, Artificial Sequence
  Description of Artificial Sequence: Synthetic coding sequence
atggtccccaaactgttcacatcccagatttgcctgctgctgttactgggcctgctggccgtggaggggtcccttcacgtgaagcctcctcagttcacgtgggctcagtggttcgaaacacagcatataaacatgacttctcagcagtgcactaatgccatgcaagttatcaataactaccaaagaagatgtaagaaccaaaacactttcctgcttaccacattcgcaaacgtggtaaacgtgtgtggaaaccctaatatgacttgtccttctaataagacgaggaagaactgccatcatagcggatcacaagtaccattaatacactgcaatttgacaactccttcaccacagaacatttcaaactgtcgctacgcccagacaccagccaacatgttttatatcgtggcttgcgacaatcgagatcagcgccgggaccccccgcaataccccgtcgtgccagtgcatctcgatagaataatctag

SEQ ID NO: 132718 - DNA, 483 bp, Artificial Sequence
  Description of Artificial Sequence: Synthetic coding sequence
atggttccaaagctgtttacaagtcagatttgtctgctgctgctgctagggttgatgggagttgaaggctccttgcacgctcgccctccacagttcactagagcccagtggttcgctatccagcatatcagcctgaatcccccaaggtgtacgatcgcaatgcgcgccatcaacaactaccgatggcgttgcaagaaccagaatacctttttgcgcacgaccttcgctaatgtggtgaatgtgtgtggtaatcagtccatccgatgcccacacaaccggaccctgaacaattgtcaccggagtaggtttcgggtccccctcctgcattgtgacctgataaaccctggtgcgcagaatatctcaaattgtacatacgcagatcgcccaggccgccgcttttacgtggtggcctgtgataaccgggacccccgggactcccccaggtatccagtggttccagtacatctggacaccactatatag

SEQ ID NO: 132719 - DNA, 444 bp, Artificial Sequence
  Description of Artificial Sequence: Synthetic coding sequence
atggccttgcagcgcacccatagcctgttgctgctgctcctgcttacgctgctcggccttggcctcgtccagcccagctacggacaggatggtatgtatcagaggttcctgcggcagcacgtgcatcccgaagagaccggagggagcgaccggtattgcaatctgatgatgcagcggcgcaaaatgacgctgtatcactgtaaaaggttcaacacatttatccacgaagatatttggaatattcggtctatttgctcgaccacgaatattcagtgcaaaaacggtaagatgaattgccacgagggtgtcgtgaaggtgaccgactgtcgagatacagggagcagccgcgctcctaactgcaggtatagggccatcgcttccactagacgtgtggtgatcgcatgcgagggtaatccccaggttccggtgcacttcgatggatag

SEQ ID NO: 132720 - DNA, 444 bp, Artificial Sequence
  Description of Artificial Sequence: Synthetic coding sequence
atggccttgcagcggacccatagtctcctcttattactacttttgactctgttaggcctgggcctcgtgcaaccaagttacgggcaggatggaatgtatcagagatttctgcggcagcatgtgcatcccgaggaaaccggaggttcggaccgctattgtaacttaatgatgcagagacgaaagatgactctatatcattgtaaacgctttaatactttcatacatgaggatatttggaatattcggagcatctgcagtaccaccaacatccagtgtaagaatgggaaaatgaattgtcatgagggtgttgtgaaggtcactgattgcagggacaccggatcgagtcgtgcccctaactgccgttaccgcgcgattgcttccacaagacgcgtagtgatcgcatgcgaaggcaatccccaggttccagttcactttgatggctag

SEQ ID NO: 132721 - DNA, 444 bp, Artificial Sequence
  Description of Artificial Sequence: Synthetic coding sequence
atggctctacagcggactcattcactgttgctgttattgttgcttacattgctcggtctgggtctcgttcagcctagttatggccaggacggcatgtatcagaggttcctacggcagcacgtgcatccggaggagaccggcggatccgaccgttactgtaacctgatgatgcaacgccggaagatgaccctgtaccattgcaaaaggttcaatacatttatccacgaagatatctggaacatacgctctatttgttctacaaccaatatccagtgtaagaatgggaagatgaattgccatgagggagtcgtcaaagtgaccgattgcagagacacaggttccagccgagcccccaattgcagataccgagctattgcttctaccagaagggtggtcatcgcctgtgaggggaacccccaggtccctgtccactttgacggctag

SEQ ID NO: 132722 - DNA, 465 bp, Artificial Sequence
  Description of Artificial Sequence: Synthetic coding sequence
atggccccagcccgggcaggctgctgccctctgctgctccttctcttagggctatgggtcgccgaggtgctggtccgtgccaaaccaaaagacatgaccagctcccaatggttcaagacacagcatgtccagccgtcaccacaggcctgcaattcggcaatgtccatcatcaacaaatatactgagaggtgcaaagacctgaatacatttttgcatgaacccttttcctccgtggccatcacctgtcagacgcccaatatagcgtgcaagaactcatgcaagaactgtcaccagtcgcacgggccgatgtccctgaccatgggagagctcacctccggaaaataccctaattgccgttataaagaaaagcacctgaataccccttatatagtcgcctgcgatcctccccagcagggagacccagggtatccgctggtacccgtgcaccttgataaggttgtgtag

SEQ ID NO: 132723 - DNA, 453 bp, Artificial Sequence
  Description of Artificial Sequence: Synthetic coding sequence
atggttctttgttttcccctgctgctcttgctcctggtactgtggggaccggtctgtccgttgcatgcttggcctaaacgcctcactaaggcgcactggtttgagatccagcatattcaaccgagtcccttgcaatgtaatagagccatgtccggcatcaataactacactcagcactgcaagcatcagaatacattcctgcacgactccttccagaacgtcgccgccgtgtgtgacctgctctcaattgtgtgcaagaatcgtaggcataattgccatcagagtagtaaacctgttaatatgacagattgccggttgacatccggtaagtacccgcagtgcagatactctgcggcagcccagtataaatttttcatcgttgcttgcgaccctccacagaagtctgaccctccatacaaattagtgcccgtccaccttgattccattctatag

SEQ ID NO: 132724 - DNA, 2271 bp, Artificial Sequence
  Description of Artificial Sequence: Synthetic coding sequence
atgccactcaggcccggaagtctggttcccgagggcgccggctttcccaaaatggctgccgacgtctcagtaacccaccggccacctctctctccaaaatctggcgcagaagtggaagctggggatgccgctgaacgccgcgcccccgaagaggaattgccccccctcgatcccgaagagatacggaagcgcctggaacatactgagaggcagtttcggaataggcggaaaatattgatcaggggactgcctggggacgtgactaaccaggaggtgcatgatctgctgagcgactatgagctgaaatactgttttgttgacaaatataaggggactgcttttgtaaccctgctgaatggtgagcaggctgaggctgctatcaacgcctttcaccagtctaggcttcgagaaagggagctatccgtgcagctgcagccgaccgacgccctattgtgtgtagctaacctgccaccatccctcacacagcaacagtttgaggaactggtgcggccatttggcagccttgagagatgctttctggtttacagtgaacgaaccggccaaagtaaaggctatggcttcgccgagtacatgaagaaggacagtgcagctagagccaagtcggatctcctcggcaagccccttggtcccaggaccctctatgtacattggactgacgccggccaactgacgcccgcactgctgcactcaaggtgtctgtgcgtggacaggctgcccccaggttttaacgacgtggatgccctgtgccgggcactttccgccgtccacagccctaccttctgtcagctggcctgcgggcaggatggccagctcaaaggattcgctgtactggagtacgaaacggctgaaatggcggaggaagcccagcagcaggcggacggtttgagcttagggggttcccatttgagagtgagtttttgcgcacctggtccccctggacgatctatgctcgccgcgctgatcgccgcgcaggccacagcgttaaatagaggaaaggggctgttgcctgagcctaatatcctacaactgctgaacaatcttgggccctccgcatccctccagttactgctgaaccccttgcttcatggcagcgccgggggaaaacaaggcctcctcggcgcgcccccagctatgccacttctgaacggaccagcgctttctacagccctgcttcaactggccctgcaaacgcagggtcagaagaaaccgggcatcctgggcgatagccccctgggggcactgcagcctggcgcacaaccagctaatccgctgctaggcgagctcccagcagggggcgggctgcctcccgagctccccccgcgcagaggaaaaccccccccacttctccctagtgtcctgggcccagctggcggggaccgcgaggccctcgggttaggtcctcccgccgctcagcttacacccccacctgcccctgtcggactgcggggttctggtctaaggggtttgcagaaggacagcggccccctcccaactccgcccggtgtatccctactgggagaacctcctaaggattacaggattcccttgaatccatatctaaacctgcatagtttgctgcctgcctccaatctggcgggaaaggaggcacggggttggggaggtgccggaagatcgaggcgaccagcggaagggccacccactaacccccccgcccccggcggcggatcttcatcatccaaagcattccagctgaagtccagattgttatcacctctgagttcagcaaggctgccgccagaacccgggctctctgacagttattcatttgattaccccagtgacatgggcccaagacggctcttctcccatccgcgcgaacccgccctcgggcctcatggacctagtagacataagatgtctcctccacccagtggattcggcgagcgaagttctggaggatctggagggggcccactttcccacttttactcaggaagccccacatcttactttacatctggcctgcaagctgggcttaagcagtcgcacctctctaaggccataggctcttccccattgggatcaggcgaagggttgctcgggctgtctcccggaccgaacgggcacagtcatttgttgaaaacacccctgggtggtcagaagcggtcatttgcccacctcctgccctctccagagccttctcctgagggatcttacgtcgggcagcactcacaggggctaggcgggcactacgccgatagctacctaaaaaggaagaggatcttctag

SEQ ID NO: 132725 - DNA, 1821 bp, Artificial Sequence
  Description of Artificial Sequence: Synthetic coding sequence
atggccgccgacgtgtcagtcacacacaggccccccctcagcccaaaaagtggcgcagaggtcgaagctggggatgccgcagagagacgagctcccgaggaagagctgcccccactggacccggaggaaatcaggaagcgccttgagcacacggagagacagttcagaaaccgccggaagatcctcattcgtggtctgccaggtgacgtaactaatcaggaggttcacgatctactctctgactacgagttaaagtactgcttcgtggataagtataaagggaccgcattcgtgactttactaaacggtgagcaggcagaggccgcaattaacgcattccatcaaagccggctgcgggagagagaactgtccgtacaactgcaacctactgatgctttactgtgcgtcgctaacttgcccccatcactcacacagcaacaattcgaagaactcgtacggccttttggaagccttgaacgctgtttcttggtctacagtgagagaacaggccagagtaaggggtatggattcgccgagtacatgaagaaagactccgctgcccgggccaaatctgacctgcttggaaaaccactcggcccaaggacactgtacgtccactggacagacgccggccagctgacaccagctttgctccatagccgctgcctatgcgtggacagactaccgcctggcttcaacgatgtcgacgctctgtgccgcgccctgagcgccgtccattcccccacattctgccagttggcctgtggtcaggatggccagctcaaaggatttgccgtacttgagtacgaaaccgccgaaatggccgaagaagcccagcagcaggccgatggcctctctctgggagggtcccacctccgggtgtcgttctgcgcccccggtcccccaggcagaagcatgctggcagcgctcatagccgcacaggcaacagcccttaacaggggaaaggggctactaccagaaccaaatatattacagttacttaataacctcggcccctcagcgagcctgcagcttctactcaaccctctccttcacggtagcgcaggaggaaagcagggactgctgggtgcacccccggccatgcctctgttaaacgggcctgccctctcgaccgccctgcttcagttagcgctgcagacacaggggcagaagaagccgggcattctgggggacagcccgttgggagcgttacagcccggagcccaacctgcaaacccccttctgggggagttgccagcggggggtggactgccccccgagctgccaccccgccgcggcaaacctcctccactactaccgagcgtgctagggccagctggtggggatagggaggcccttgggcttggccctcccgccgcccagctgacgccaccacctgcccccgttggcctgcggggttccggactccgcggcccactgagccacttttacagcggttcccctacctcctacttcacctctggcctccaggccggactcaagcagtcacacctgagtaaggctatcgggtcaagtcctcttggatcaggtgaaggactactgggattgagtccggggcctaacgggcactcccatctgttgaaggtccgagctggcgggggcgatatgcagggctgggaagccccggcccctcagcgtcctctcacccgtcccgccctacccagcgtaagtcgaccacactgggccgcgaggaacgccgctttgcctacttgttgcccacggccctcccctgcacaaaaggcagcaatgtgggctagcacacccagagcctctgccgccaccacgcggacgcctacatag

SEQ ID NO: 132726 - DNA, 2076 bp, Artificial Sequence
  Description of Artificial Sequence: Synthetic coding sequence
atggcagccgccgctggcgacggaggtggggaggggggggcagggctaggaagcgctgcaggtttagggcccgggcccggtttgagaggccagggaccaagtgcggaggctcacgagggggcccccgatcctatgccagccgcactccaccctgaggaggtggcagctaggctgcagagaatgcaacgcgagttgagtaatagacgaaagatcctggtcaaaaacctgcctcaagattccaattgtcaggaagtgcacgacctcctcaaggattatgatctgaagtactgctacgttgacagaaacaaaaggacagcttttgttaccctcctcaacggagagcaggcgcaaaatgctatccaaatgttccatcaatatagttttagggggaaggacttgatcgttcaactgcagcctactgatgcgttgctatgcataaccaatgtccccatctccttcacctccgaagaattcgaagagctcgtgagggcctatggcaatatcgaaaggtgtttcctcgtgtattcggaggtaactggccattccaaaggctacggatttgtggagtacatgaaaaaggatttcgcagcgaaggctcgcctggagcttctaggcaggcagctgggagcctctgctctgttcgcacaatggatggatgtgaatctgctcgccagcgagttaatacattccaaatgcttatgcattgacaagcttccctcggattatcgagattctgaagagctcctgcagatttttagcagcgtgcacaaacccgtcttttgccagctggcccaggacgagggctcttacgtgggcggctttgctgtggtcgagtactctactgcggagcaggccgaagaggtgcagcaggcagctgatggcatgacaatcaaaggttctaaagtgcaggtttcgttctgtgcccccggcgccccaggaaggtctacattagccgctctcatagcagcccagagggtcatgcacagcaaccaaaagggcctgctgcccgagcctaatccagtccagattatgaagtcactcaataatcctgctatgttacaggtcctgctacaacctcagctgtgtgggcgggccgtgaaaccagccgtcctagggactccccacagcctcccccatctcatgaatccctccatcagtccagccttcctacacttgaacaaagcccaccagagttcggtgatggggaatacatccaacctgttcttgcaaaacttgtctcatataccactggctcagcagcaactcatgaaattcgagaacatccatacgaacaataagcccggcttgctgggcgaaccacccgccgttgtcctgcaaacggccctcgggatagggtctgtattgccactgaagaaggaacttgggcatcaccatggggaggcccacaaaacttccagcttaatccccacgcagacgactataactgcagggatgggaatgctccctttttttcccaaccaacacatcgcgggtcaagctggaccagggcactctaacacgcaagagaaacagccagctactgtgggaatggctgaaggaaacttttccgggagccagccttatctccagagtttcccgaatttggcggctggaagcctcttagtcggacaccacaaacaacagcagagccagcctaaggggacggagatcagttctggggccgccagcaaaaatcaaaccagcttattgggggaacccccgaaggagatacgcctatccaagaatccatacctgaatctcgcctccgtcttgcccagcgtttgcctcagtagcccagctagtaagactaccctccataaaactggtattgcctcctccattctggacgccattagtcaggggtcagagtcccaacacgcgctggagaaatgtatcgcgtattccccccctttcggagactacgcgcaggtcagctcactcaggaacgagaaaagaggtagcagttacctgatctctgcccctgagggaggaagcgtggagtgcgtcgatcagcacagtcagggcactggggcatactacatggagacgtatctgaagaagaaaagggtgtattag

SEQ ID NO: 132727 - DNA, 2037 bp, Artificial Sequence
  Description of Artificial Sequence: Synthetic coding sequence
atggccgccgcggccggcgatggaggtggagagggcggcgcaggactgggatctgccgctggcctgggccccggaccagggctcagaggtcaaggaccatcagcagaggcccatgaaggggctccagacccaatgcctgccgctctccacccagaggaggtagctgcgcgattacaaagaatgcagcgtgagctatccaacagaaggaagattttagtgaaaaacttaccccaggattcaaactgccaggaagttcacgatctgcttaaggattatgacttaaagtattgctacgtcgacagaaataagcgcactgcctttgtcacactattaaacggggagcaggctcagaacgctattcaaatgttccaccagtacagcttcagagggaaggatcttattgtccagttacaacccacagacgccttgctatgtatcacaaatgttcccatcagctttacttcggaagagttcgaggagttggtgagagcatacgggaacatcgagaggtgctttctggtgtacagtgaggtaacagggcattccaagggctatggttttgtggagtatatgaaaaaggacttcgctgcgaaggccagactggagctgctcggcagacagctaggagcctccgccctttttgcccagtggatggacgtcaaccttctggctagcgagctgattcacagtaaatgcctgtgtatcgacaaattgccaagcgattaccgcgacagcgaagagctgctgcagatcttttcttcagtacataaacctgtgttttgccagcttgcccaagacgaaggatcctatgtgggcggctttgccgtcgttgagtattccaccgctgaacaagctgaagaggttcagcaggccgcagacggaatgacaatcaaggggagtaaggtgcaggtatctttctgtgcccccggcgcccctggtagatcaacactggctgctctcatagcagctcagagggtgatgcacagcaaccagaagggactcctacctgaaccaaaccctgtccagatcatgaaaagcctgaataacccagcaatgctgcaggtgttgttacagccccagctctgcggccgagcagttaaacccgccgtgcttggaaccccgcacagtctcccacatctcatgaacccaagcatttcgcctgcctttttgcatctaaacaaagctcaccagaacctatcacacatcccacttgcccagcaacaactgatgaaattcgaaaacattcacacaaataacaagccgggtctgctcggagaacctccggcagtggtgttacagacagccctgggaataggaagcgtactccctctaaaaaaagagcttggtcaccatcacggagaggcgcacaaaacctcttccctaattccgacgcaaactaccatcaccgcgggaatgggcatgctgcccttctttcccaaccagcacatcgcaggacaagctggtcccgggcattctaatacacaggaaaaacagcccgccactgtggggatggcagaaggaaatttcagcggatcccaaccgtatctgcaatctttccctaacctcgccgctggcagtctcctagtgggtcatcataagcagcagcagagccagcctaaagggaccgagatctcctccggcgccgctagcaagaaccagacaagtctgctgggagaacctcctaaggagattaggttatctaaaaatccttatctgaatctggcttccgtgctgcctagcgtctgcctctcctcccccgcgtctaaaaccaccctccacaagaccggaatcgcgtcctccatcctcgatgccatctcgcagggcagcgagtctcagcacgcacttgaaaaatgtatcgcctacagccctccattcggtgactacgcccaggtctccagcttgcgcaacgagaaaaggggctcatcgtacttgatcagtgcacccgaaggtggctccgttgagtgtgtcgatcagcattcccagggtacaggcgcatattacatggaaacctaccttaaaaagaagagagtttattag

SEQ ID NO: 132728 - DNA, 693 bp, Artificial Sequence
  Description of Artificial Sequence: Synthetic coding sequence
atgaccatcaaaggcagcaaggtccaggtctctttttgcgcacccggtgcccccggaaggagtacccttgctgccctgatcgccgctcagcgcgtgatgcattcaaaccagaaaggattgctgcctgagcctaatcctgtgcaaatcatgaaatccctgaacaatcccgctatgctgcaggttctgttgcaacctcaactgtgcggcagagccgtgaaaccggccgtcctgggaaccccacattcattaccccatctcatgaacccaagcatctccccagccttcctgcacctgaataaagcccaccagaatcagactagcctccttggagaaccgcccaaagaaatacgacttagcaagaacccttacttaaacttggccagcgtgctgccaagcgtgtgccttagctcaccagcctcgaagaccactctgcacaaaacgggaattgcatcttcaattctggacgctatctcccaaggcagcgagtcccagcatgccctcgaaaaatgcattgcttactccccgccttttggtgactacgcccaagtttccagccttagaaacgagaaacggggtagttcctacctaatcagtgccccagaagggggttccgtggagtgcgtggatcaacacagtcagggtaccggtgcctattatatggagacctacctgaaaaaaaagagagtttattag

SEQ ID NO: 132729 - DNA, 2379 bp, Artificial Sequence
  Description of Artificial Sequence: Synthetic coding sequence
atgcatgtcatcaaaagagatgggagacaggagcgtgtcatgtttgacaagattaccagtagaatacagaaactgtgttacggccttaatatggactttgtggaccctgcccaaattaccatgaaagtgattcagggactgtactccggagtgacgaccgtggagctggacacactggccgcagagacagcggctacactgaccactaaacaccctgactacgctattctggccgctcgaatagcggtgagtaacctacacaaagaaaccaagaaggttttctctgatgtgatggaggatctctacaattatattaacccacacaatggaaagcacagtccaatggtagccaagagcactctcgacatcgttctagcaaataaggacaggctcaattctgctatcatctacgacagagatttttcatataactattttggctttaagacgctggaacgctcctatctcctcaaaatcaatggtaaggtggcggagcgcccccagcatatgctcatgagggtgtctgtggggatccacaaagaggacatagacgcagctatagagacgtacaacctgctgtcagagaggtggttcacccatgcatcgccaactctgtttaacgccggcactaacaggccgcagctttcctcatgctttctgctcagcatgaaggacgattcaattgaaggaatctacgatacccttaagcagtgcgcgctgatctctaagtctgccggcggaattggcgtggcggtgtcctgtattagagccactgggtcatacatcgcaggaacaaatggtaattctaatggcctcgttcctatgctacgggtgtacaataacacagctagatacgtcgatcaagggggcaacaaaagaccaggggcatttgctatctacctggagccgtggcatctcgatatctttgaatttcttgacctgaaaaagaacactggtaaggaggagcaacgtgctcgcgaccttttcttcgccctgtggattccagacttattcatgaaaagggtagaaacaaatcaggactggtccttaatgtgtcctaacgagtgccccggcctggatgaagtctggggggaagagttcgaaaagctctacgcgtcctacgagaaacaagggagggtgaggaaggtagtcaaggcccaacagctttggtacgctataatcgagtcccaaactgaaaccggaacaccgtacatgctgtacaaggactcatgcaaccggaaatccaatcaacagaaccttggcactattaaatgttctaatctgtgcactgagattgtcgaatatacatccaaagatgaagtggccgtgtgtaacctcgcctctctggccctgaatatgtacgtgacttccgagcacacctatgattttaaaaagttagcagaagtcaccaaagtcgttgtgcggaatttgaacaagatcattgacattaactactacccggtgccagaggcgtgcttgtcgaataaaaggcatagacccattggtatcggtgtccaagggctggctgacgcattcattctgatgcgctatccctttgagtctgcggaggctcagctcctgaacaagcagatcttcgagaccatctactatggggctctggaggcgtcttgcgatctggccaaggaacaggggccatatgaaacttacgaaggaagccccgtctcaaagggaattcttcagtatgatatgtggaatgttaccccaacagatctctgggactggaaagtcttaaaagaaaagatcgctaaatacggaatccggaattcactcctgatcgcccctatgcctaccgcctctaccgcccagattctgggaaataatgagagcatcgagccttacacctctaatatttacacccgccgggtcctgtccggtgagtttcagattgtcaacccacacctgctgaaggacctgaccgaaagaggactgtggcacgaggaaatgaaaaatcagatcatcgcctgcaacggcagcattcagtccattcctgagattcccgacgacctcaaacagctttataaaacggtgtgggaaatcagtcagaagacggttctcaagatggccgcagaaaggggcgcattcattgaccagtcacagtcactgaatatccatatcgcggagcctaactacggtaagttgacctcaatgcatttttacggttggaagcagggcttaaagactggcatgtattatctaagaaccaggccagcagccaacccaatccagttcaccctgaataaagagaagttgaaagataaagagaaagtcagcaaggaggaggaagaaaaggagcggaataccgccgccatggtgtgctctctggagaaccgggacgaatgcctaatgtgtggatcttag

SEQ ID NO: 132730 - DNA, 2088 bp, Artificial Sequence
  Description of Artificial Sequence: Synthetic coding sequence
atggaagatttgtacaattacattaacccgcataatggaaagcactcccctatggttgccaaaagcaccctagacatcgttcttgcgaacaaggacagattgaactccgctattatatatgatagagatttctcctacaattattttggtttcaagactttggaacgttcatacctcctgaagataaatggaaaggtggctgaaaggcctcaacatatgctgatgcgagtgtccgtcggaatccacaaggaagatattgacgccgcaattgaaacatataatctcctgagcgagcgttggttcacccacgccagccccaccctattcaacgccggcacaaacagacctcaattatcctcgtgttttctgttgtccatgaaagatgacagtattgagggcatctatgacacactcaagcagtgtgccctgatctcaaaatccgccggaggaataggcgtggccgtgtcgtgcatccgggctactggtagctacatcgccggaacaaatggcaattccaatgggctagtgcccatgctgagagtctataataataccgcaaggtacgtggatcaaggaggcaataaacgtccaggcgcttttgccatttacctcgagccctggcacctcgatattttcgagtttctggacttaaaaaagaatactgggaaagaggaacagagggcacgggacctcttttttgctttgtggattcctgacctgtttatgaaaagggtggaaacaaatcaggattggtcactgatgtgtcctaacgagtgtcccggcctggacgaagtgtggggggaagagttcgaaaagctgtacgctagctacgagaaacaaggaagagtcagaaaagtcgtaaaggcccagcagctctggtacgccataattgaatcacagaccgagaccggcacaccttatatgctatacaaggattcatgtaataggaagagtaaccagcagaatctcgggacaatcaaatgctccaatttatgtactgagatcgtcgagtacactagtaaagacgaggtggcagtctgtaatctggcctcacttgccctgaatatgtatgtgacaagtgaacacacttacgattttaaaaaactcgcagaggtgacgaaagtggtcgttaggaacttgaataagattatcgacatcaactactatcccgtccctgaagcttgtctctctaataagcgacatcggcctattggcattggcgtgcagggccttgctgacgccttcatcttgatgcgttatccatttgagtccgcagaagcacaactgctaaacaagcaaatttttgagactatttactacggcgccttggaggcctcatgtgatctcgctaaggaacaaggtccctacgagacctatgaaggatcccctgtcagcaagggaatactacagtatgatatgtggaatgtaacaccaaccgatctgtgggactggaaggtcctgaaagagaaaattgccaaatacgggattcggaactctctcctgatagctcccatgcctaccgccagtacagctcagattctgggcaacaacgaatcaatagaaccatacacctccaacatatacacccgcagagtgctctcaggcgaattccaaatcgtgaacccccatctgcttaaagaccttacagagagggggctgtggcacgaagaaatgaagaaccagatcattgcctgtaatggctccatccagtctatccctgagattcccgatgacctcaaacaactgtacaagactgtctgggaaatttcgcagaaaaccgtgctaaaaatggctgccgaacgcggcgcatttattgaccagagccagtcgctgaatattcacatcgccgagcctaattatggtaaactgacatcaatgcatttttatggctggaagcagggactgaagacaggcatgtattatcttcgtactagacctgcagcgaaccccatccaattcacccttaacaaagaaaaactgaaggataaagaaaaggtttctaaggaagaggaggagaaggaacgcaatacagcggctatggtttgctcccttgagaaccgcgacgaatgtctgatgtgtggcagctag

SEQ ID NO: 132731 - DNA, 2118 bp, Artificial Sequence
  Description of Artificial Sequence: Synthetic coding sequence
gatggtcgacaagaacgggtcatgttcgataagatcacaagcaggatccagaaattatgctacggcttaaacatggattttgtggaccccgcccagattacgatgaaggtgattcagggactctactcgggagttaccacagtcgagctagatacattagccgccgagactgccgcaacactcaaaaccctggaacggtcttatttactcaaaatcaatggcaaagtggctgagagacctcagcacatgttgatgcgagtttcggtcgggatacacaaagaggacattgacgcggccatcgagacatataatctgctgagcgaacgatggtttacacacgcttctccaacgctgtttaatgccggcaccaacagaccgcagttgtccagctgctttctgctgagcatgaaagacgatagtatagaggggatctatgacactctcaagcagtgtgctctaatttctaagtctgctggaggtatcggcgtcgctgtgtcatgcatccgcgcgacaggttcgtatatcgcgggcaccaacggaaactcgaatggccttgtgcctatgctccgggtctacaacaacacagctagatatgtagaccagggtgggaataaacgccctggggcatttgcaatataccttgaaccctggcacttagatatttttgaattcctcgatctgaagaaaaataccggaaaagaagagcagcgcgcaagagacttgttctttgctctgtggattccggacttgtttatgaaaagggtagaaactaatcaggattggagtctaatgtgcccaaacgagtgtcccgggctggatgaagtgtggggagaggagtttgagaaactatacgctagctacgaaaaacagggccgggtgagaaaggtggtcaaagcccaacaactctggtacgccataatcgagtcccagaccgagaccggcaccccttacatgctttacaaagacagctgtaatagaaaaagcaaccaacagaacttgggcaccataaagtgtagcaacctgtgcactgaaatcgtggagtacactagcaaggatgaagttgccgtgtgcaacttagccagcctcgccttgaacatgtatgtgacatccgagcacacgtatgacttcaaaaagctcgcggaggtgaccaaggtggtggtgcgcaatctgaataaaattatcgacataaactactatccagttccggaggcatgcctgagtaataagagacaccggcccatcggcatcggggtgcagggcctggctgacgcattcattttgatgaggtatccatttgagtctgcagaggctcaactcctgaataaacagatctttgagacgatctattacggagccctagaggcatcttgtgatctggcgaaggagcagggaccgtacgagacctatgaggggagccctgtgtctaagggcatcctgcagtacgacatgtggaacgtgacccccacggatctctgggattggaaggtgctgaaggagaaaatcgctaagtacggaatccgcaactcactgctcatagcaccaatgcctactgccagcaccgcccagatcttgggcaataacgagagtatagagccttacacctccaatatttatactagacgcgtgctgtcaggcgaatttcaaatcgtgaacccacatctgcttaaggacttgacggaaagaggactttggcacgaagaaatgaagaaccagattattgcttgcaacggttccatccagtctatccccgaaatccccgatgacttgaagcagctgtataaaacagtatgggaaatctcccagaagacggtactgaaaatggcagctgaacgtggagctttcattgaccaaagccagagcctgaatatccacattgctgaacctaattatggcaaacttacttctatgcatttctacggatggaagcaaggactgaagaccggcatgtattacttgcgaactcgacctgccgccaaccccatacagtttaccctgaacaaggaaaagcttaaagacaaggagaaggtttctaaggaggaggaagagaaagagaggaacaccgcggccatggtctgctctctggagaaccgggatgaatgtctgatgtgtggctcctag

SEQ ID NO: 132732 - DNA, 1365 bp, Artificial Sequence
  Description of Artificial Sequence: Synthetic coding sequence
atgaagcgggtggaaaccaaccaggactggagtcttatgtgtccaaacgagtgtccaggacttgacgaggtgtggggcgaggaattcgaaaagctgtacgcgagttacgaaaagcaaggaagagtgaggaaagtcgtgaaagcccaacagttgtggtatgcaatcatcgagtcgcagacagaaactggaactccctacatgctgtacaaagactcatgcaacagaaagtcgaaccagcagaatttaggcactattaaatgcagcaacctgtgtacagagattgtggaatacacatcgaaggatgaagtagccgtttgcaacctggcctcactggctcttaacatgtacgtcacatccgagcacacttatgacttcaagaaattggccgaagttactaaggtcgtcgttcgcaacctgaacaagatcattgacataaattattatcctgtacccgaggcgtgcctgtcaaataagaggcataggccaattggaattggcgtgcaagggttagccgacgcttttattctcatgcggtacccttttgagtctgctgaggcccaacttttgaacaaacaaatcttcgagaccatttattatggcgccttagaagcatcctgcgacctggccaaagagcaagggccctacgaaacatatgaaggcagcccggtcagcaagggcattctccagtacgatatgtggaacgtcactccgaccgacctgtgggactggaaggtgctcaaggaaaaaatagccaaatatggaattcgaaactccctgctgattgcccccatgccaaccgcgtctaccgcccagatcctggggaacaacgaaagtattgagccttataccagtaacatttataccagaagagttctctccggcgaattccagatcgtgaatccccacctactcaaagacctgacagagagaggactctggcatgaggagatgaagaatcagatcattgcatgtaacggctcgatacagtcgatccctgagattccagatgatctcaaacagctctacaaaacggtgtgggaaatctctcagaagacagttctcaagatggctgctgaaagaggtgcctttatcgaccaatcacagtccttaaacatccatatcgcagaaccaaattacggtaaactgacttcaatgcatttctatgggtggaagcaaggtctaaagaccgggatgtattacctgcggactaggccagcggccaaccccattcaattcaccctgaacaaggagaagttaaaagacaaggagaaggtgagtaaggaagaggaggagaaagagcgcaacaccgccgcaatggtgtgctccctggaaaaccgagatgaatgtctcatgtgtggttcatag

SEQ ID NO: 132733 - DNA, 1170 bp, Artificial Sequence
  Description of Artificial Sequence: Synthetic coding sequence
atgttgagccttcgcgtgccgctggcacctataaccgatccccaacagttgcagcttagcccactgaaaggcctatcactggttgataaggaaaataccccaccagccctgtccggtacacgggtcctggccagcaagactgctaggagaatattccaagaaccgaccgagcctaagactaaggccgccgcaccaggggtggaagacgaaccactgctaagggagaacccacgacgattcgtcattttccctatcgaataccatgatatctggcaaatgtacaaaaaagccgaggcaagcttctggacagctgaggaagtggatctgagcaaggacatccaacactgggaatcacttaagccagaggaacggtacttcatttctcatgttctcgctttctttgccgccagcgacggaattgtgaacgagaacctggtcgagcgtttcagccaggaggtacagattacagaagcccgctgtttctacgggttccagatagcgatggagaatatccactccgagatgtactcccttctgattgacacttatataaaggatcccaaagaacgcgaattcctgttcaacgcgattgagacgatgccatgcgtcaaaaaaaaggccgattgggcgctgagatggattggcgataaggaggccacctacggcgagcgcgtagtagcttttgcagctgtggagggtatctttttttcaggatcctttgcgagcatcttctggttgaagaaacgaggactcatgccaggactaacatttagtaacgagttaattagtagagacgaaggactccactgcgactttgcatgcctgatgttcaaacatctagtccataagccttcagaggagagagtgagagaaattattataaacgcagtgcggatcgaacaggagttcctgacagaagctttgccagtcaaactaatcggcatgaactgtacgctgatgaaacaatacattgagtttgtggccgaccgcctgatgctcgaactggggttttcaaaggtgtttcgggtcgaaaaccccttcgatttcatggaaaatatttctctggagggcaaaacaaatttttttgagaaacgggttggggaataccagcgcatgggtgttatgagctctccgacagagaactctttcactctggacgccgatttctag

SEQ ID NO: 132734 - DNA, 1350 bp, Artificial Sequence
  Description of Artificial Sequence: Synthetic coding sequence
atgggcagagtaggaggaatggcgcagcctatgggcagagccggcgcccccaaacctatgggacgtgcaggtagcgccagacgcggaagattcaaggggtgttggtccgaaggatctcctgtccacccggtgcccgctgtgctctcctggcttctggcattgctgcgatgcgcgtctacgatgctctccctacgggtgcctctggcaccgatcacggacccccagcaactccagctgtccccccttaaggggctctcattagtggataaggagaatactcctcccgccttgagcgggactcgggtgctagcatccaagaccgctcggcgaatctttcaggagcctacggaaccaaagaccaaagcagccgcaccgggtgtggaggacgagcccctgctgcgtgagaaccccagaaggtttgtgattttccctattgaataccacgatatctggcagatgtacaagaaggcagaggcatctttttggaccgccgaggaagtcgatctgtccaaagacatccagcactgggagagcctgaagcccgaggagaggtacttcatctcacacgtgctggccttctttgcggcctccgacggaatagtaaatgagaacctcgtcgagcgattttctcaagaagtccagattacagaggcccggtgcttctacggctttcaaattgctatggaaaacattcactctgagatgtattctctcctaattgacacatacataaaggatcctaaagaacgggaattcctatttaatgccatcgaaactatgccttgcgttaagaaaaaggccgattgggcgctcaggtggattggagacaaagaagctacttatggcgagagggtggttgctttcgctgccgttgaagggatcttcttctctggatcctttgcctctattttctggctgaagaagagaggcctgatgccgggcttgacattctccaacgaactcatctcgagagacgaaggcctgcactgcgatttcgcatgtctgatgtttaaacatctcgtgcacaaacccagtgaggagcgggtgagagagatcatcattaatgccgtgagaatcgagcaagagttcctgactgaagccctaccggtgaagcttatcgggatgaattgtaccctgatgaagcagtacattgagttcgtggcagaccgcctaatgcttgagctgggttttagtaaagtctttagggtcgagaatccttttgactttatggagaacatctcgctagagggaaaaactaacttcttcgagaaacgcgtcggagagtatcagagaatgggcgttatgagcagtccaaccgagaacagcttcacactcgacgcggatttctag

SEQ ID NO: 132735 - DNA, 1056 bp, Artificial Sequence
  Description of Artificial Sequence: Synthetic coding sequence
atgggggaccctgagagaccagaggccgctggcctggaccaagatgaacggtcttcgagtgatacaaacgagtctgagatcaagagtaatgaggagccactgcttcggaaatcctcacgtcggtttgtgatcttccctatccagtaccctgacatctggaagatgtacaaacaggctcaggcctccttctggacagcggaggaggtcgatttaagtaaggatttaccacattggaacaaactcaaggccgatgaaaagtacttcatctcccatatcttggcattctttgcagcatcagacggaatagtgaatgagaatttggtcgaacgcttctcacaggaagtccaggtccccgaagcccggtgcttctatggctttcagatccttatcgagaatgtacatagtgagatgtactcactgctgatagacacctatattagagatccaaagaagagggaattcctgttcaatgcaatcgaaacaatgccttatgttaaaaaaaaggcggattgggctctgcggtggattgccgaccgaaagtcaacgttcggtgaacgggtggttgcattcgcagctgttgaaggggtgttcttctcaggctcttttgccgccatcttctggctgaagaagcgtgggctgatgcctgggcttacattcagtaacgagctcatcagtcgcgacgaaggactccattgtgacttcgcatgtttaatgtttcagtacctcgtaaataaacctagtgaggaacgggtgagggagattattgtggacgccgtcaaaatcgagcaagaattccttactgaagcgctgcctgttggtttgatcggcatgaactgtatcctgatgaagcagtacattgaattcgtcgccgaccggctcctcgtagaactcggcttttccaaagtgttccaggcagaaaatccattcgatttcatggagaatatttccttggaaggaaagaccaatttttttgaaaaaagagtctccgagtaccagaggttcgccgtaatggctgaaaccacagacaacgtcttcacgctcgacgcagacttttag

SEQ ID NO: 132736 - DNA, 900 bp, Artificial Sequence
  Description of Artificial Sequence: Synthetic coding sequence
atgggtgaccccgaaaggccggaggcagccgggttggaccaggatgaggtggacttgtctaaggatcttcctcactggaacaaactcaaggctgatgaaaaatacttcataagccacatcttggcattctttgctgctagtgacggtatagtgaacgagaacttggtggagcgtttcagtcaagaggtgcaggttcccgaggcccggtgcttttacggcttccagatcctcattgaaaatgttcactctgagatgtattctcttctaattgacacttacattagggatccgaaaaaacgggagttcttgttcaacgcgattgaaactatgccatacgtaaaaaagaaagccgactgggcactgaggtggatcgccgacagaaagagcacattcggggagcgggttgttgcatttgcggctgttgaaggtgtttttttcagtgggagctttgccgccatattttggctgaaaaagcggggcctcatgccaggtttgactttttcaaatgaactgatctcgcgagatgaggggctgcactgcgattttgcctgcctgatgtttcagtacctggtgaacaagcctagcgaagagagggtgagagaaattatagtggatgcggtcaaaatcgagcaggagttccttacggaagcactgcctgtaggccttattgggatgaactgcatacttatgaagcaatacatcgagttcgtggcggatcgactccttgtggaacttggcttctccaaggtgttccaggccgagaacccattcgacttcatggaaaacatctccctggaaggaaaaacgaactttttcgaaaagcgggtgtctgagtaccagcggttcgctgtgatggccgaaacaaccgacaatgtgttcaccctagatgctgacttctag

SEQ ID NO: 132737 - DNA, 420 bp, Artificial Sequence
  Description of Artificial Sequence: Synthetic coding sequence
atgggcgacccagagagaccggaggcggccggcctagatcaggatgaagggctccattgtgacttcgcatgcctaatgttccagtacttagttaataaaccaagcgaagagagagtgagagagataatcgtagacgctgtcaagatagagcaagaatttctcactgaggcactcccggtcggtctgatcggaatgaattgcatcttgatgaagcagtacatcgagttcgtggccgatcgtctcctcgtggaactcggattctctaaagtcttccaggcagagaatccttttgactttatggagaacatcagtttggaaggcaaaacaaatttcttcgagaagcgggtttctgaatatcagcgctttgccgtcatggcagaaacaaccgataatgtattcaccctagacgcagacttctag

SEQ ID NO: 132738 - DNA, 201 bp, Artificial Sequence
  Description of Artificial Sequence: Synthetic coding sequence
atgggcgaccccgagcgccccgaggccgctgggctagaccaggatgaggtcttccaggcagagaatccatttgatttcatggagaacatcagtttagaggggaaaaccaatttcttcgagaagagggtatcagagtatcagaggtttgcagttatggcagaaacaactgacaatgttttcacccttgacgccgatttttag

SEQ ID NO: 132739 - DNA, 132 bp, Artificial Sequence
  Description of Artificial Sequence: Synthetic coding sequence
atgggagatccagaacggcccgaggccgccgggctcgaccaggacgagaggtccagcagtgacacaaacgaatcagaaatcaagtccaatgaggagcctctcctccggaagagttctcggcgctctttttag

SEQ ID NO: 132740 - DNA, 894 bp, Artificial Sequence
  Description of Artificial Sequence: Synthetic coding sequence
atgtacaagcaggcccaggcttctttttggaccgccgaagaagtggatttaagtaaggatctgccccactggaataaactgaaagccgatgaaaaatacttcatttcacacatcttggctttctttgcagcatcagacggaatagtgaacgagaaccttgtggagaggttcagccaggaagtgcaggtgccagaagctagatgcttctacggattccagattctcatcgagaatgtgcattccgaaatgtatagtctactcatagacacgtacatccgcgatccaaagaagcgggagtttctgttcaacgcaatcgaaaccatgccctacgtgaagaaaaaggcggactgggcactgagatggattgctgatcgcaagtcaacattcggagagcgcgttgttgcttttgcggcagtagaaggagtattcttttctgggagtttcgcagcgatattctggctgaagaagagaggcctgatgcctgggcttactttctctaacgagctgatctcccgcgatgagggtctgcattgtgattttgcctgcttgatgttccagtacctggttaacaaaccttcagaggaacgtgtccgggagatcatcgttgacgcagtgaagattgaacaagagtttctcaccgaagcgttgccagtgggtttaatcggcatgaactgcatcctcatgaaacagtacatcgaatttgtcgctgataggttactagtcgagcttgggttctcaaaagtgttccaagctgaaaatcccttcgacttcatggagaatatttctctggaaggaaagacaaactttttcgagaagcgggtctctgagtaccaacggtttgccgttatggccgaaactaccgataatgtttttacactggatgcagacttctag

SEQ ID NO: 132741 - DNA, 1824 bp, Artificial Sequence
  Description of Artificial Sequence: Synthetic coding sequence
atggaagcgccagcagccggtttatttctgttgctactcctaggcacgtgggcccctgctcctgggtccgctagcagcgaagccccacctctgatcaacgaggatgttaagagaacagtggaccttagcagccatctggcaaaagttaccgctgaagtcgtgctagctcacctcggagggggcagcacaagcagggcaacctccttcctgttagcattagaaccagagttggaagcccggctggcccacctaggagtgcaggttaagggcgaggacgaagaggaaaacaatttagaggtgagagagactaaaattaaggggaaaagtggacggtttttcaccgtcaaactgcccgtggctctggatccaggggccaagatttccgtcatagtcgagaccgtgtacacccatgttttacacccctatcctacccaaatcactcagagcgaaaaacagttcgttgtcttcgagggaaatcactatttttacagcccctatccaaccaagacgcagaccatgcgtgttaagctcgcttcccgcaacgtggaaagttacacgaagcttggcaatcccacaagatcagaagatttgctcgactacggtccttttcgcgatgtgcccgcatacagccaggatactttcaaggtacactacgaaaataattccccttttctcacaatcacgtctatgactcgggttatcgaagtcagccattggggaaatatcgccgtggaggagaatgtagacttgaagcacaccggtgcagtcttaaagggacctttcagtagatacgattatcagaggcagcccgatagtggcattagctctattaggagtttcaagactattttacccgcggccgcccaggacgtctattaccgtgacgaaattgggaacgtgtcaacttcacacctgctgatactagatgactccgtcgagatggagatcagacccaggttccctctctttgggggctggaagacccattatatcgttggttataaccttccgtcatatgaatatctgtataatcttggagaccaatacgctctgaagatgcgatttgtcgaccacgtgtttgacgagcaggtgatagactcactgacagtgaagattatacttccagaaggcgcgaagaatattgagatcgatagcccgtacgaaatttcccgcgcccctgacgagctccactatacgtacctggacacattcggccggccagtgattgttgcatacaagaagaacctcgttgagcagcacattcaggatatagttgtgcattacactttcaacaaagtgctcatgctccaagaaccgctgctggtcgttgccgctttttatatcttattcttcacagtcatcatctatgtgcggctggatttcagtattaccaaagaccctgccgccgaggcacggatgaaagttgcatgcatcaccgaacaggtgcttacactggtgaacaagcggattggcttatatagacatttcgatgaaaccgtcaataggtataagcagtcccgcgatatctctacattaaacagcggcaaaaagtcgttggagactgagcataaggcgctcactagcgaaatcgcgctgctccaaagccgtttaaaaaccgaagggagtgatctgtgcgaccgcgtgagcgaaatgcagaagttggacgctcaggtgaaagagcttgttctgaaaagtgcagtggaggccgagcggctggtcgcggggaagctcaagaaggacacttacatcgagaatgaaaagttgatcagtggaaaacgtcaggaattggtcaccaagattgaccatattctcgacgctctgtag

SEQ ID NO: 132742 - DNA, 1308 bp, Artificial Sequence
  Description of Artificial Sequence: Synthetic coding sequence
atgcgcgtgaagctggcctcccgcaacgtggaaagctataccaagttaggaaacccaacccgatccgaggatctcctcgactatggccctttccgcgatgtgcctgcctacagccaggatacgtttaaggtccactacgaaaataactccccattcttgacgatcacctccatgactcgggttatcgaagtatctcattggggaaacatcgctgtggaagagaatgtggatctaaaacatacgggggccgttcttaaaggccccttctcccgttatgattaccagcgacaacctgactcaggtatttcaagcatacgcagcttcaagacgatcctaccagccgcggcccaggatgtatactaccgggacgagataggcaacgtttccacatcccacctgctcatcttggacgacagtgtcgagatggaaatccggcctagattccccctcttcggcggatggaagacccactatattgtcggctacaacctccccagctacgagtatctgtataatcttggtgaccagtacgctctgaagatgaggttcgtggaccacgtattcgatgagcaagtgatcgactccttgactgtgaaaattattctgccagagggcgctaagaacattgagattgacagcccatacgaaataagtagagcccccgacgaactgcattacacctacctagacaccttcggaagacctgtgattgttgcgtacaagaaaaacttggtggagcagcacattcaagacattgtcgtgcactacactttcaataaagtgttgatgctgcaggaaccattgctcgtcgttgccgcattttacatcttattctttaccgtgatcatatacgttcgcttggacttttcaattacgaaggatcccgctgctgaagcaagaatgaaagtagcgtgtattacagagcaagtgctgactctggtgaacaagcgtatcggactgtatcgtcatttcgacgaaaccgtgaacagatacaaacagagcagggatatctccactcttaacagtggcaaaaaatccttggagacggagcacaaggccctcacaagcgagattgccctactgcagtcccgacttaaaaccgagggctccgatttgtgtgacagggtgtccgaaatgcagaagttggatgcacaggtgaaagagcttgttttgaaatcggccgtggaagctgagcgtctcgtagcaggaaagttgaaaaaggacacttacattgaaaacgagaaacttattagcggtaagaggcaggagctcgtgactaagatcgaccacatccttgatgctctgtag

SEQ ID NO: 132743 - DNA, 1137 bp, Artificial Sequence
  Description of Artificial Sequence: Synthetic coding sequence
atgacacgagtgattgaggtctcacactgggggaatattgccgtggaagaaaacgtggacctgaaacatacaggcgcagtgttaaaaggacccttcagtaggtacgactaccaacgccaaccagactcgggcatttcctccattagatcattcaaaaccattctccccgccgccgcgcaggacgtttattaccgcgacgagattggtaatgtgtctacatctcacctacttatcctagatgacagtgtggaaatggaaattcgtccgcgctttccactatttgggggctggaagacccactatattgtgggatacaatttgccaagctacgagtacctgtacaatttgggcgatcagtatgcacttaagatgcgtttcgttgatcacgtgttcgacgaacaggtgattgacagcctcacggtcaagatcatacttccagaaggagccaaaaatattgagattgactctccctacgagattagtcgggcacctgacgaactacactatacgtacctggacaccttcggacggccagtgatcgtggcctacaagaagaatttggtggagcagcatatccaggacatcgtagtgcactatacttttaataaggtgcttatgctgcaggaaccactgcttgtggtggctgctttttacatcctattcttcactgtgatcatctacgtccgccttgatttctccattactaaggaccccgccgctgaggctcgcatgaaggtagcctgcattactgagcaagtcctgacactcgtcaataagcgcattggtctgtataggcatttcgacgagacagtaaaccgctacaagcaatctagggatatctctacactgaacagcggaaagaagtctctggaaacagaacataaagctctgacttcagaaatcgctctgctgcagtcccgtcttaagaccgaaggatccgacctttgcgatagggtgtccgaaatgcaaaagttagatgcacaggtcaaggagctcgtgctgaaatccgctgttgaagcagagcgacttgtcgccggcaaactgaaaaaggacacctatatcgagaacgaaaagctgatcagcggtaaaaggcaggagctcgtgacaaagatcgatcacatccttgacgctctgtag

SEQ ID NO: 132744 - DNA, 1746 bp, Artificial Sequence
  Description of Artificial Sequence: Synthetic coding sequence
atggaagctccagcggccgggttgttccttctgctgttactggggacatgggccccagcccccggctcagcctcatctgaagctcctccactgatcaacgaagacgtgaaacgaactgttgacctgtcatctcatctggctaaggttaccgctgaggtggttcttgcccatcttggggttcaggtgaagggggaagacgaggaggagaataacttggaggtgcgggaaacaaagattaagggcaaatctgggagatttttcacggtgaaactgccagtcgccttagatccaggcgctaaaatttcagtgatcgtagaaacagtatacactcacgtgctgcatccctaccctactcagatcacacagagtgaaaaacagtttgtcgtcttcgagggcaatcactacttctactctccatacccgaccaagactcaaaccatgcgggtaaaacttgcttccaggaacgtggaatcctatactaagctcggcaaccctaccaggtccgaggaccttttggactacggcccgttcagagatgtcccggcttattcccaggacacattcaaggtccactacgagaacaacagtcctttcctgaccatcaccagtatgacccgggttattgaggtcagtcactgggggaatattgcagttgaagagaacgttgatttgaaacacacaggcgccgttctgaagggcccattcagcaggtacgattatcagagacaaccagattcgggcatcagcagtatccgatcattcaaaacaattctgccagctgcagcacaggacgtgtactaccgcgatgagatcgggaatgtgagcaccagtcacctgctgattctggacgattccgtggaaatggaaataaggccaaggttcccattatttggagggtggaaaacccactatattgtgggctataatctgccttcctatgagtacctctacaatctgggtgatcagtatgcccttaagatgcgattcgtcgatcacgtatttgacgaacaggtgattgactctctgactgtgaaaatcatcctgcctgaaggcgctaaaaacatcgagatcgacagcccctacgaaataagtagggcacccgatgaactgcattacacctacttggatacatttggtcgcccggtgatcgttgcctacaagaagaacctggtagaacagcacatccaggacatagtcgtgcactatacattcaacaaggttttgatgcttcaggagccactgctcgtggtagccgccttctacatattatttttcactgtgatcatctatgttcgtctggatttctcaattacgaaggatcctgccgccgaggcaaggatgaaagtggcatgtatcacagagcaagtccttacactggtgaacaagcgtattggtctgtaccgacacttcgacgagaccgtgaaccggtacaaacagagtcgagacattagcacactgaacagcggaaagaagagcctggagactgaacataaggccctgaccagcgaaattgccctgttacagtcaaggttgaaaacagaagggtccgacttgtgcgaccgcgtatcagagatgcaaaagctggatgcccaggttaaggagttagtcttaaagagtgccgtcgaggccgagcggctcgtagccggcaaattaaaaaaggacacttacatcgaaaacgaaaagctgattagcggaaagaggcaagagctggtgaccaagatagaccatatactcgacgccctgtag

SEQ ID NO: 132745 - DNA, 1896 bp, Artificial Sequence
  Description of Artificial Sequence: Synthetic coding sequence
atggcacctcccggcagtagcactgtttttctgttagcactcacaatcattgcaagcacttgggctctgaccccaactcactatctgaccaagcacgacgtcgaacggcttaaagcctccttagataggccctttaccaacctggaatccgccttctactcaattgtaggcctgtctagcctgggggcacaggtgccagatgccaagaaggcatgcacttacatcagatcaaacctggacccttccaacgttgattccttgttctacgctgcgcaggccagccaggccctttctggttgcgaaatcagcatctccaacgaaactaaagacctattgcttgccgccgtttctgaagactcctctgttacacagatctaccatgcagtcgccgccctgtctgggttcggcctgccactggccagccaggaagctctgagtgcgctgacagcccggctgagcaaagaagaaacagtcttggccacagttcaggcacttcagactgcaagtcatctgtctcagcaagctgacctgcggagtatcgtggaagagatcgaagatctggtcgctcggctggacgagctcggaggagtttatctccagtttgaggagggactggagactacagccctatttgtggcagccacatacaagctaatggaccatgtgggcacagagccttccatcaaggaggaccaggtaatacagcttatgaacgccatatttagcaagaaaaattttgagtctctgtcagaggccttttccgtagcatctgcagcggccgtcttgtcccataatcggtaccacgtgcccgttgtggtcgtccccgagggttcagcatctgatactcacgaacaagctattctgaggttacaagtaactaatgtgctctcccagccgctgacgcaagccacagtgaagctggagcacgcaaagtccgtggccagtcgggctacagtacttcagaagactagtttcactcctgttggtgatgtatttgagctgaacttcatgaatgttaaattttcctccggctattatgactttcttgttgaagtggagggcgataaccggtatattgcaaatactgtagagctccgtgtgaagatctctacagaggtgggaattaccaatgttgacctatcaacggtcgacaaggaccaatcaattgcccctaaaaccacccgagtgacctatcccgcaaaagctaaggggacattcatcgctgactcacaccaaaattttgcccttttcttccagctggtcgatgtgaataccggcgccgaactgacgccccaccagacattcgtgcggctgcacaatcagaagactggccaggaggtagttttcgtggctgaacctgataacaagaatgtgtataaatttgaattggacacctcagagaggaaaatagagttcgattcggcctccggtacttacaccctttacctcatcattggcgacgccactctcaagaacccaattctctggaacgtggcagatgttgtgataaagttcccagaagaagaggcccccagcacagtcctgagccagaacttatttacccccaagcaagagattcaacacctgttcagagaacctgaaaagcgcccccctaccgttgtgtccaacactttcaccgccctcatattaagcccactgctgcttctgttcgccctgtggatccgaattggcgccaacgtatccaattttacttttgcgcctagcacaataatcttccacctcggccacgcagccatgctagggttgatgtatgtatattggacccaactcaatatgttccagactctaaagtatttagccatcttaggttccgtgacctttctggctggcaaccgaatgttggctcaacaggccgtgaagaggaccgcccactag

SEQ ID NO: 132746 - DNA, 1038 bp, Artificial Sequence
  Description of Artificial Sequence: Synthetic coding sequence
gtctcaccacaaggtagctctacagtgtttctgcttgccctgactattattgcctctacatgggccctgacacctacacactacttgacgaaacacgatgttgaacgactgaaggcctctcttgatcgtccttttactaatctagagtctgctttctactctatcgtcggactttcatctctcggcgcccaggtcccagatgccaagaaggcctgtacatatatccgctccaatttagacccatccaatgtcgattccctgttctatgcagctcaggctagccaggccctgagtggatgtgagatctccattagtaatgagactaaagatctcctgctggcggccgtcagtgaagactccagcgtgacccaaatatatcacgcagtggctgctctctccggctttggcttgccactggctagtcaagaagcactatctgctctgaccgcacgtctctcgaaagaggagactgttttggcccgggtctggtccacggtgttagagagccgatcactgtttagcaagcgtaccgtccaggccctacagacagcgagccatttgtcacaacaagctgatctgcggtctatagttgaggaaatagaggacctggtcgctcggcttgatgaactgggtggggtgtatttgcagttcgaggaaggcctggaaactaccgctctcttcgtggccgcaacatacaaactcatggaccacgtgggtaccgaacctagcattaaggaagatcaggtcattcaattaatgaatgccattttttccaaaaaaaatttcgagtcactctcggaagcatttagtgtggcttccgctgcagctgttttgtcgcataacaggtatcacgtcccagtggttgtggttcccgaagggtccgcctctgacactcatgagcaggctattctaaggctgcaggtcactaatgtgttgtctcagcctctcacccaggcgaccgtaaaactggagcatgccaaaagtgtcgcatctcgggcaacagtcctccaaaaaacttcatttactcccgtggggtag

SEQ ID NO: 132747 - DNA, 1848 bp, Artificial Sequence
  Description of Artificial Sequence: Synthetic coding sequence
atggccccgccagggtcgagcactgtctttctgctggcactcacaattattgcctcaacctgggcactcactccaactcattatttaacaaagcacgacgtcgagagattgaaggccagtcttgataggccctttacaaatctagagtctgctttctacagcattgttggcctatcatcgctaggggcacaggtccccgacgcaaaaatttccatcagcaatgagactaaagacttattgctggcagcagtttcggaggatagttcggtaacacaaatctatcatgctgtggctgcactatctggttttggactgccgctggctagtcaggaggccctcagtgctttgaccgcacggttgtcgaaagaagagacagtgttagcgactgtccaggcattacagacggcctcacatctcagccagcaggccgatttgaggtcaattgtggaagagatcgaggatcttgtggctcggctggacgagctgggtggggtgtatctccagtttgaagaaggcctggagacgaccgctttattcgtggccgctacctataagctgatggaccacgttgggaccgaaccttccattaaggaggaccaggtgattcaactgatgaatgccatcttctcgaaaaaaaactttgagtccctgtcagaagcctttagcgtcgcatccgctgctgctgtgctgtctcacaacagatatcatgtgcctgtggtggttgtgcctgagggatcagcgtctgatacgcacgaacaggccattcttcggttgcaggtgaccaacgtcctgtcgcagcctcttacacaggctactgtaaagctcgaacacgcaaaatcggtcgcatctagagctacagtcctgcaaaagacttctttcacccctgttggagatgtcttcgaactcaattttatgaacgtaaaattttcttccggctattatgattttctcgtggaagttgaaggcgacaacaggtacatcgcaaatacggttgagttgcgggttaagatctccaccgaggtaggaattactaatgtcgatctgtccaccgtggataaagaccaatctatcgctccaaagacaactcgggtgacatatcccgccaaggccaagggaacattcattgccgatagtcaccagaacttcgcgctgttcttccagctggttgatgtcaataccggcgctgaactcaccccccaccaaacatttgtgcggttacacaatcagaaaaccggccaggaggtagtgtttgtggccgagccagacaataaaaacgtttataaattcgagctggatacttccgagcggaaaatcgagtttgactccgccagtgggacctacacattatacttgattatcggagatgccaccttaaagaatcccattctctggaatgtggccgacgtggtcatcaaatttcctgaggaggaagccccttcaacggtccttagtcagaatctgttcacacctaaacaggaaattcagcacctgttccgcgagcctgagaagaggcctcctaccgttgtctctaacacattcactgccctgattctctctcctttgctgcttctttttgccctgtggatcaggatcggcgcgaatgtgagcaactttaccttcgcgcctagcactattatcttccacctaggccatgcagccatgttgggcttaatgtacgtctattggacccagctgaacatgtttcagaccctgaaatacctggcgattttgggcagtgtgaccttcttggcagggaataggatgctggcccagcaggcagtgaaaagaattgcagcagagcagtctagccgtctggccaagtataggacccttcgaacagcccactag

SEQ ID NO: 132748 - DNA, 441 bp, Artificial Sequence
  Description of Artificial Sequence: Synthetic coding sequence
ggaacctacacactgtatctcatcattggagatgccacacttaagaaccccatactctggaacgtcgccgacgtagttatcaaattccctgaggaggaggcccccagcaccgtgctgagtcagaatctcttcacccccaagcaggaaattcagcacctgttcagggagcctgagaagagacctccaaccgtggtgtcaaatacatttaccgccttaatcctctccccgctccttctgctgtttgccctctggatcaggatcggtgctaacgtgagcaatttcactttcgcacccagtactatcatttttcatctagggcacgccgagcagcacattagctctaggcgcaagatggagatactgaagactgaatgtcaggaaaaggaatctcgtaccatccacagcatgaggaggaaaatggagaaaaagaattttatttag

SEQ ID NO: 132749 - DNA, 1038 bp, Artificial Sequence
  Description of Artificial Sequence: Synthetic coding sequence
atggcccccccaggttcatccacagtgttcctgctggctttaaccatcattgcaagcacctgggctctgacaccgactcactatttgaccaagcacgacgtggaaagactcaaagccagcctcgacaggcccttcaccaatcttgaatccgcattttactccattgttgggctgtcaagtctgggcgcacaagtgcccgacgctaagaaagcttgtacctatatccgctctaatctggacccgtcaaatgtggacagtctgttttacgctgcccaggcgagtcaggccttatcagggtgtgagattagcatatccaacgagacaaaagatctgttgttagctgcagtgtctgaagacagttccgtcacacagatctaccacgccgtggccgctcttagtggtttcggcttgcctcttgcctcgcaggaggccttgagcgcccttacggctaggttatccaaagaggagaccgtcctcgcacgggtgtggagcaccgttctggagagcaggtccctgttttccaaacggactgtacaagcactccagacagccagccatctttctcaacaggcagacctgagaagcatcgttgaagaaatcgaagatctggtcgcgcggctggacgagctggggggtgtgtacctgcaatttgaggagggattggagactacagcactcttcgtggctgcaacctataaacttatggaccacgttggcactgaaccgagtattaaagaagatcaggtgatacagctgatgaacgcaattttttctaaaaagaacttcgagtctctgtccgaagcttttagtgtggcttctgctgctgctgtgctcagccacaatagataccatgtgccagtggttgtggtgcccgagggctctgcctccgatacacatgaacaggccatcctccgcttgcaagtcacaaatgttttgtcccaacccctgacacaggccaccgtcaagctggagcacgctaaatctgtagccagtagggccactgttctacagaaaacgtcctttacccccgtgggctag

SEQ ID NO: 132750 - DNA, 417 bp, Artificial Sequence
  Description of Artificial Sequence: Synthetic coding sequence
gaacttgacactagtgagcggaagattgaatttgatagcgcttcaggtacttatacactatatctgattataggggacgcgaccctgaagaatccaatcctatggaatgtggctgatgtagttatcaaatttcccgaagaagaagcgccttcgactgtattgagccagaaccttttcactccaaagcaggaaattcaatggatccggatcggcgcgaacgtctcgaactttacattcgctcctagcaccatcatctttcatctgggacatgccgcaatgctgggcttaatgtatgtatactggacccaactgaacatgttccagaccctgaagtatctcgctatcctggggtcggtgacctttctcgcgggcaaccggatgctcgcccagcaggccgtcaagagaaccgctgagtag

SEQ ID NO: 132751 - DNA, 417 bp, Artificial Sequence
  Description of Artificial Sequence: Synthetic coding sequence
gagctggacacaagtgaacggaaaatcgaatttgactcagcgagcggcacatacacgttgtatcttattatcggcgatgccacactgaagaacccaatcttatggaacgtggctgatgttgtaataaagttccccgaggaggaggctccaagcacagtgctgagccaaaacttgttcacccccaagcaagaaattcagtggattagaatcggcgcaaacgtttctaactttacttttgcccctagtaccatcatatttcatctaggtcatgccgccatgctagggctaatgtatgtctactggacccagctcaacatgttccaaacactgaaatacctggccatattgggatcagtcactttcctggctggaaaccggatgctggcacaacaggctgtcaaacgcacagcacactag

SEQ ID NO: 132752 - DNA, 504 bp, Artificial Sequence
  Description of Artificial Sequence: Synthetic coding sequence
atgcaacggaccgtgcaagctctgcagacggcctctcacctctcccagcaggccgatctccggtctattgtggaagagattgaggatctcgtggccagactggatgaactgggaggggtctatctgcagtttgaggagggtctcgagaccaccgccctgtttgtggccgctacctataagctcatggatcacgtcggaactgagccgagcatcaaggaagaccaggttattcagctgatgaacgccatcttctccaagaagaatttcgaaagccttagcgaagcgttctccgtagcctctgccgctgccgtgctgagccataacaggtatcacgtgcccgtcgttgtcgtgccagaggggagtgccagtgatacccacgagcaagcgatcctcaggctgcaggtgacaaatgttctcagccagcccctgacccaggccacagttaaactggaacatgcaaaatcagtggcatctcgagctacggtcctgcagaagacttcttag

SEQ ID NO: 132753 - DNA, 444 bp, Artificial Sequence
  Description of Artificial Sequence: Synthetic coding sequence
tgaggaacttacacactgtacttaattattggtgatgcaacgttgaagaaccccatactgtggaacgttgcggacgtagtgatcaagtttccagaagaggaggcaccatcaactgtcctttcccagaacctgtttacacccaaacaagagattcagcacttgttccgcgaacccgagaaaaggccgcctacagtggtgagtaacacctttacagctcttattctgtctcccctgttgctcttgtttgcactgtggattcgcattggggctaacgtgtctaattttactttcgccccttcgaccatcatatttcaccttggacatgcagagcagcatatctcttcaagaaggaagatggagatcctcaagacagagtgtcaggagaaagagagcagaactatccactccatgcgaaggaagatggaaaagaaaaattttatatag

SEQ ID NO: 132754 - DNA, 936 bp, Artificial Sequence
  Description of Artificial Sequence: Synthetic coding sequence
atgcagcgtcccggtccatttagcaccctctacggccgggtgctcgcgccactgccgggccgggccgggggcgctgcgtcaggaggtggcggcaattcctgggacttgccgggttcccatgtaagattacctgggcgcgctcagagcggtaccagagggggggccggtaacaccagcacatcctgtggcgattccaactccatttgtccagccccatctaccatgtccaaggcggaagaggcgaagaagttggccggaagagccgcagtggagaaccatgtccgcaacaaccaggttctcggtatcggttccggatctaccatcgtgcatgccgtacaacggatcgctgagcgggtgaagcaggaaaatctgaatctggtctgtattcccaccagctttcaggccagacagctgatactccagtacgggttaaccctgtcggacctagataggcaccctgaaatcgacctggcaatcgacggtgctgatgaagtcgacgcagacttaaatctgatcaagggaggtgggggatgtctaacccaagagaaaatagtcgcaggctacgcgagccggttcatagtgattgcggatttcaggaaagattccaagaatctaggagaccagtggcataaggggataccgattgaggtgattccaatggcgtacgtgcccgtgtctagagctgtgtcccagaagttcggcggggttgttgagctgagaatggccgttaacaaagcgggaccagtcgtcacagacaacggaaactttattctcgattggaagttcgacagggtccataagtggagcgaggtaaatactgccatcaagatgatcccaggagtggtggacaccggtctgttcatcaacatggccgaaagggtttatttcggaatgcaagacggttcagtcaacatgcgcgaaaaacccttttgctag

SEQ ID NO: 132755 - DNA, 534 bp, Artificial Sequence
  Description of Artificial Sequence: Synthetic coding sequence
gcccgtcagctgatcttacagtacggcttgaccctgtctgatctcgatcgacatcccgagatagatcttgctatcgacggagcagacgaggtcgatgcagacctgaacctcattaagggcggcggcggatgcctgacccaggagaagatcgtggctggctacgcatctcggtttattgttatagcggactttcgaaaggattccaagaatctaggggatcaatggcacaaagggattcccatcgaggtgattccaatggcctatgttcctgttagccgggcagtgagccagaagtttggaggggttgtggagcttcggatggccgttaataaggcaggccccgtcgtgaccgataacggtaactttatcctggattggaaatttgatcgtgtgcataagtggtccgaggtcaatacagccatcaagatgattcccggcgtggtggataccggtctgttcatcaatatggcagagcgtgtctactttggtatgcaggatggtagcgtcaatatgagggagaaacccttctgctag

SEQ ID NO: 132756 - DNA, 492 bp, Artificial Sequence
  Description of Artificial Sequence: Synthetic coding sequence
atgcgcatcgaaaaatgttacttttgttccggcccaatttacccagggcacggcatgatgttcgttcgcaacgattgcaaagttttccgtttttgcaagtccaaatgtcacaagaactttaaaaagaagcgcaatcccaggaaagtgagatggaccaaggctttccgaaaagccgccggtaaggaattgactgttgacaattcctttgaattcgaaaaacggcgtaatgagcctattaagtaccagagggagctctggaacaaaactatcgacgcaatgaagcgcgtcgaggagataaaacagaaaagacaagctaagttcatcatgaatcgcctgaagaaaaacaaggaactccaaaaggtgcaggatatcaaggaagtgaaacagaatattcatctcattcgcgccccgttagcaggcaagggaaaacagctggaggagaagatggtgcagcagctgcaggaggatgtcgatatggaggatgctccatag

SEQ ID NO: 132757 - DNA, 1161 bp, Artificial Sequence
  Description of Artificial Sequence: Synthetic coding sequence
atgtgctcaagtgtcgcagctaaactgtggtttctcacagacagacgcatacgggaagattatccgcagaaggagattctacgagccctgaaagcgaaatgctgcgaggaagaattggatttcagagctgttgtgatggatgaggtggtcctgacgatcgagcaaggtaaccttggcttgaggatcaatggtgaactcatcaccgcataccctcaagttgtggtggtgagagtgccgaccccatgggtacagtcagactcagatataactgtgctgagacacctggagaagatgggttgccgactgatgaaccgccctcaggcaatcctcaactgtgttaataagttttggacatttcaggaacttgctggtcacggagtgcctctgcctgataccttttcatacgggggtcatgagaacttcgccaagatgatagacgaagctgaagtgctagagttcccgatggtggtgaaaaatacaagaggacatcgaggcaaggcggtgttcctagcacgtgacaagcatcatttggcagatttgtcacacctgatacgccacgaagcaccttatctcttccaaaagtacgtgaaagaatcccacggacgcgatgttcgcgtcattgttgtgggtggcagggtggtggggaccatgttgcgatgtagcacggatggaaggatgcagagtaattgctcgctcggtggtgtcggcatgatgtgcagtctgtctgaacagggcaaacagctcgcaattcaggttagcaatatcctgggaatggacgtgtgcggcatagacttactcatgaaggatgacgggtcattttgcgtgtgcgaagcgaatgcaaatgttggattcatagcctttgataaagcctgcaacctggatgtcgccggcattatcgcagattatgctgcgtctctcctgccctccggacgcctgactcgccgaatgtcactcctgtccgttgtatccaccgcgtcagagacaagtgaacccgaactcgggccacccgcatctacggccgtcgataacatgagcgcctcatcctcaagtgttgattccgaccccgagtctaccgaaagagagctcctcaccaaacttcctggaggtctatttaatatgaatcagctgttagccaacgagatcaagttgttggtcgactag

SEQ ID NO: 132758 - DNA, 1161 bp, Artificial Sequence
  Description of Artificial Sequence: Synthetic coding sequence
atgtgctcttccgtagcagccaaactgtggtttctgaccgacagaagaattagagaagactacccccagaaagaaatactcagggcccttaaggcgaagtgctgcgaggaggaactggatttccgggcagttgtgatggacgaagtagtactgacaatagagcaaggaaatttgggactcaggatcaacggggaactcatcacagcctacccgcaggtagtggtggtgcgtgtccccaccccctgggtgcaatctgattccgatattaccgttttgagacacctggaaaaaatgggctgtagattaatgaacaggcctcaggccattctaaattgcgttaataagttctggacctttcaagagctcgcaggccatggagtgcctctccccgacaccttctcctatggtggtcatgagaacttcgctaagatgatcgatgaggcggaagtgttggaatttcctatggttgtaaagaacactagaggccaccgtggtaaagctgttttcctggcaagagataagcatcatctggcggacctgagccacctgattcggcacgaagccccctatttatttcaaaaatacgtcaaagagagccacggccgggacgtccgtgtaatcgtggtgggaggacgagttgtgggcacaatgcttcgctgttctacagacggccgaatgcagagcaattgtagcctgggtggcgtgggaatgatgtgctccctgagtgagcagggcaaacaacttgcaatccaggtctcgaatatcctcgggatggacgtgtgcggcatcgatttactgatgaaagacgatggaagtttctgcgtgtgtgaagctaatgccaacgtgggatttattgccttcgataaagcctgcaatttagacgttgctgggattatcgcagattatgccgcgagcctgttaccctcaggcaggttgacacggcggatgtcccttctttcagtggtgagtacggcctcagaaactagcgagccagagctgggacctcccgctagtaccgccgtggataacatgtccgcgtcctctagttccgttgacagcgacccggagtccacggagagagaattgctgaccaagttgcccggtggtctgtttaacatgaatcaactgttagccaatgaaattaagctgctagtcgattag

SEQ ID NO: 132759 - DNA, 1161 bp, Artificial Sequence
  Description of Artificial Sequence: Synthetic coding sequence
atgtgctcttccgtagccgcaaagctgtggttcctgaccgataggagaatcagagaggactacccacagaaagagattctgagagctctgaaggctaagtgttgcgaagaggaattggacttccgcgcagtggtgatggacgaggtcgtgctgactattgaacagggaaatctgggtctgagaattaacggagagctgattactgcttaccctcaggtcgtggttgtccgagtccccacaccctgggttcagagtgactcagacattacggttttgcgacatctggaaaagatggggtgtaggttgatgaacagaccacaggcaatcctcaactgcgtaaataagttctggacctttcaggaattggctgggcatggagtgccattaccagacacctttagttatgggggacatgaaaactttgctaagatgatagatgaggccgaggttttggagttccctatggtggttaagaacaccagaggacaccgtggcaaagccgtattcctggcaagggataaacatcacttggcagacctaagtcatctgatccggcatgaggccccatacctgtttcagaagtatgtgaaagagagtcacgggcgggatgtaagggtgattgtggtcggaggcagggtcgtgggcaccatgctgcgctgcagcacagacggtcgaatgcaatccaactgcagcctgggaggagtgggaatgatgtgtagcttgtccgagcagggcaagcagctggctatccaagtgtccaacatattggggatggatgtgtgcgggatagacctactcatgaaggatgacggctcgttttgtgtgtgtgaggctaatgcgaatgtgggcttcatcgctttcgacaaagcttgcaacttggacgtagcaggtatcattgccgactacgccgcatccctgttaccttccgggcggctcactcgaaggatgagcctcctttctgtggttagtacggctagcgaaacctccgagcctgagctggggccccccgcatcaactgccgtcgacaatatgtccgctagctcctcctctgtcgattccgaccccgaatccactgagcgcgaattgctcactaaattgcctgggggcttattcaatatgaatcagttgctagccaatgaaataaaactgctggtcgactag

SEQ ID NO: 132760 - DNA, 288 bp, Artificial Sequence
  Description of Artificial Sequence: Synthetic coding sequence
atgtgcagttccgtagccgcaaagctgtggttcctgaccgacagacgcattagagaggactacccacagaaagagattttgagggctttaaaggccaaatgctgcgaagaggaactcgacttccgagctgtagtgatggatgaagtcgtgttgacaatcgagcaggggaatctggggcttcggatcaatggagaactgattacggcctatcctcaggtggttgtagtccgtgtacctacgccctgggtgcagtctgattccgacataacagtcttacggcacctttag

SEQ ID NO: 132761 - DNA, 345 bp, Artificial Sequence
  Description of Artificial Sequence: Synthetic coding sequence
atgtgcagctccgttgcggccaagttgtggttcctgacggaccggagaattcgggaagactatccacagaaagagatcctaagggcactaaaggctaagtgctgcgaagaggagctcgacttcagggccgtggtgatggacgaagtcgttctgactatagaacagggaaacttgggattacggatcaacggtgaacttatcaccgcttacccacaggtcgtggtggtgagggtgcctacgccatgggtgcagtccgatagtgatataacggttctccggcatctggagaagatgggatgccgccttatgaaccgacctcaagccattctgaattgcgttaattag

SEQ ID NO: 132762 - DNA, 645 bp, Artificial Sequence
  Description of Artificial Sequence: Synthetic coding sequence
atggggaggaggccagcccgttgctatcgctattgtaagaataagccctatcccaaatcacgcttttgcagaggcgtacctgacgctaagatcagaattttcgacctcggtagaaagaaggcaaaggttgatgagttccctctctgcggccacatggttagtgacgagtacgagcaactatccagtgaggcccttgaagctgcacgcatatgtgccaataaatacatggtgaagagttgtgggaaagatggatttcatatcagagtgcgtcttcaccctttccatgtgatccggatcaacaagatgctgtcctgtgctggcgcagaccggttgcagaccggcatgcggggcgcattcggcaaaccccaggggacggtggcgagggtccatatcggacaggttattatgagcattcgcacaaagctacaaaataaggaacacgtcattgaagccctccggagagcaaagtttaaatttcctgggcgccagaagatccacataagcaaaaaatggggattcactaagttcaacgctgacgagttcgaagacatggtggccgaaaagaggcttatacctgacggctgtggagtgaagtacatccccaatcggggacccttagacaaatggcgggcactgcacagctag

SEQ ID NO: 132763 - DNA, 645 bp, Artificial Sequence
  Description of Artificial Sequence: Synthetic coding sequence
atgggccgacgcccggcccgttgttacagatattgtaagaataaaccataccccaagtctcggttctgccgcggagtcccggatgcaaagatcaggatcttcgacctcggacgcaagaaggctaaagtagatgagttcccactgtgtgggcacatggtgtccgatgagtatgaacaactgtcctctgaagccctggaagcagcccgcatctgcgccaacaagtatatggtgaagagttgcgggaaagacggcttccatatcagggtcagactccacccattccatgtcatacgcattaataaaatgctatcttgcgcgggggccgaccgtctgcaaacaggcatgcggggtgccttcgggaagccacaaggcacagttgcgcgcgtccacatcgggcaggtaatcatgagtatccgaaccaagctccaaaataaagaacacgtgattgaggcactcagacgagcgaagtttaagttccctggcagacagaagatccacattagcaagaagtggggattcaccaaatttaatgctgatgagtttgaggatatggtagctgaaaaaagactcatacctgatggctgcggggtcaagtatattccaaaccgaggacctctggacaaatggcgggcacttcactcgtag

SEQ ID NO: 132764 - DNA, 645 bp, Artificial Sequence
  Description of Artificial Sequence: Synthetic coding sequence
atgggcaggagaccagccagatgttaccgatattgcaaaaacaaaccctacccaaagtcacggttctgcagaggagtccccgacgccaaaatccggatcttcgacttaggacgcaagaaggctaaggtcgatgagttcccactttgcggacatatggtatctgacgaatacgaacagctgagttccgaggccttagaagccgcaagaatctgcgcgaacaagtacatggtgaaatcttgtggcaaagatggattccatatcagagtgcgactccacccctttcacgtcatcaggattaataaaatgctgagttgtgctggagctgatcgcctgcaaacggggatgcggggtgcttttggtaagcctcagggcacagttgccagagttcacatcgggcaggtcattatgagcatccggacaaagctgcaaaacaaagaacacgtgattgaagccctaagacgagctaagttcaagtttccgggccggcagaaaatccatatttccaaaaagtggggattcacaaagtttaacgcagacgagtttgaagacatggtcgccgaaaagcggctgattcctgatgggtgtggagtcaagtatattccaaatcgaggccctctggacaagtggcgggctctccattcttag

SEQ ID NO: 132765 - DNA, 606 bp, Artificial Sequence
  Description of Artificial Sequence: Synthetic coding sequence
atggggaggcggccagcgagatgttaccggtactgcaagaataaaccctacccaaagtccaggttttgtagaggcgtgccagatgcaaagattaggatctttgacctcggtaggaaaaaagccaaagtcgatgaattccccctctgcggacatatggtgagcgatgagtacgaacagctctcttcagaagccctggaggccgcacggatttgcgcaaacaagtatatggtgaagagttgcggcaaggatggattccacattcgggtgaggctccacccttttcacgtcatcaggattaacaagatgctgagctgcgccggagcagacagactccagacaggtatgaggggagcttttggaaagcctcagggcaccgttgctcgcgtccacataggccaggtgatcatgtctatcagaacaaagctgcaaaacaaggagcacgtaatagaggctctcagacgtgccaagttcaagtttccaggtcggcagaaaattcatatcagcaaaaaatggggcttcactaaatttaacgctgacgaatttgaggatatggtggctgaaaaaagactgatcccagatggatgtggcgtaaaatacatcccctag

SEQ ID NO: 132766 - DNA, 327 bp, Artificial Sequence
  Description of Artificial Sequence: Synthetic coding sequence
cctaagagtcgcttctgtcgcggggtgcctgacgcaaagatacggatctttgacctggggagaaagaaggcgaaagtggacgagttcccactgtgtggacacatggtttccgatgaatacgagcaattgagcagcgaagctctggaggctgcccggatctgcgcaaataagtacatggtaaagtcctgtggtaaggatggctttcatatcagggtacgcctgcacccttttcatgtgattcgcattaacaaaatgctctcatgtgccggagccgaccgacccacccttctgtgtcaatgctgggaaaccagccgcaacacgtcgtag

SEQ ID NO: 132767 - DNA, 546 bp, Artificial Sequence
  Description of Artificial Sequence: Synthetic coding sequence
atgggtaggcggcctgccaggtgctacagatactgtaagaacaaaccttacccaaagtcgagattctgtcggggcgttccggatgccaaaatcaggatatttgacctgggacgtaagaaggcaaaggtggacgagtttcctttatgcggacacatggtgtcggacgaatacgaacagctgtcttcggaggcactagaagctgcgcgcatctgtgccaacaagtacatggtgaagagttgcggcaaggacggattccatattagggtgcgcctccatcctttccatgttatcagaatcaataagatgctctcctgtgcaggagccgatcggtcaaccagtcagcggtctggcgcctccccaagttctatgcttatgaaccttaagacttggtggctgaaatctgggtcatcccagatggctgttggttcatcgacttctccaattgtcgccctatggaccagcggtggcccctgtactcacgagggctttcagtgcgctgcacctctgctgatactgacgaacaagttctactttctctccacctag

SEQ ID NO: 132768 - DNA, 537 bp, Artificial Sequence
  Description of Artificial Sequence: Synthetic coding sequence
atggcccaggatcagggggagaaagagaaccctatgcgggaactacggattaggaagctgtgcctaaatatctgcgtaggagagagtggggaccgcctgactcgcgctgccaaggtgctcgagcaactcacaggccaaacacccgtgttctcgaaagccagatacacagtccgctctttcggcatccggagaaacgagaaaatagcggttcattgcactgtgcggggcgcaaaggctgaagagattctggagaagggcctcaaagtgagggagtacgagctccgaaagaacaattttagtgacaccggcaacttcggtttcggaatccaagagcatatcgatctcggaattaaatacgatccttccatcggcatttacgggctagacttttacgtggtgcttggaaggcctggattttcgattgcggacaagaagcgaaggaccggatgtattggcgctaagcatcggatctcaaaagaggaggccatgagatggttccaacagaagtacgatggcattattctaccgggaaagtag

SEQ ID NO: 132769 - DNA, 396 bp, Artificial Sequence
  Description of Artificial Sequence: Synthetic coding sequence
caagatcaaggcgaaaaggagaatccaatgagggagttgcggattagaaaactctgcctgaacatttgcgtaggtgagagtggagatcgactcactagagccgccaaggtgctagagcagcttactggtcagacgccggtttttagcaaggctaggtacacagtgaggagtttcggaattaggagaaacgaaaaaattgccgtgcactgtactgtgcggggcgctaaggctgaggaaattttggagaaggggctgaaggttcgcgaatacgaactccggaagaataactttagcgatactggcaattttggtttcggcatccaagagcatatcgatctgggaattaagtatgaccctagcattggaatatacggattggacttttatgtagtgtag

SEQ ID NO: 132770 - DNA, 525 bp, Artificial Sequence
  Description of Artificial Sequence: Synthetic coding sequence
caggatcagggagagaaggaaaaccccatgagggaactaaggatcagaaaattatgcttgaacatttgtgtgggggagagcggggaccgactgacgcgtgctgcaaaggtgcttgaacaactgacgggccaaacgcctgtattcagcaaagctcggtataccgtgcggtcttttgggatccggcgaaatgaaaagatagccgtgcactgcaccgtccgaggcgcgaaagcggaggaaatcttggaaaagggactcaaggtccgcgagtacgagctgcgaaagaacaattttagtgatacggggaattttggctttggaattcaagaacacattgatctcgggatcaagtacgacccgtctattgggatatatggcttggacttttatgtggtgctcggacgtccaggcttctccattgctgacaagaaaagacgcactggatgcattggggcgaagcatcgcatcagtaaggaggaggccatgaggtggttccagcagaaagtaaagttgatttatctgaagtag

SEQ ID NO: 132771 - DNA, 498 bp, Artificial Sequence
  Description of Artificial Sequence: Synthetic coding sequence
atgccccctaaattcgatcccaatgaaatcaaagtggtctatctgcggtgtaccgggggggaagtgggggctacatccgccctggccccaaagataggacctctagggctgagccctaagaaggttggggatgatatcgcaaaggctaccggcgattggaagggtttgaggattaccgtgaagctaaccatacagaacaggcaagcccaaatcgaagtcgttccctcagcttctgcactgatcatcaaggccctgaaggaaccaccgcgcgaccgcaagaagcaaaagaacatcaagcattcaggcaatatcacattcgatgagattgttaacatagccagacaaatgaggcatcgctccctggcacgagagctatctggtacaatcaaggagatcctcggcaccgcccagtccgtgggttgcaatgtcgacgggagacaccctcacgacataatcgacgacatcaattcaggagccgtcgaatgccccgcctcttag

SEQ ID NO: 132772 - DNA, 399 bp, Artificial Sequence
  Description of Artificial Sequence: Synthetic coding sequence
atgcccccaaagtttgaccctaatgaaataaaagttgtgtatctacggtgtaccggcggtgaagtcggagctacctccgccctcgctcccaagatagggccccttgggttgatagaagttgtgccgagcgcatcagccctgatcattaaagcacttaaagaaccacctagggatcggaaaaagcaaaagaatattaagcattctgggaacatcacattcgacgagatcgtcaacattgccagacaaatgaggcatagatctctggcaagggagctgtctgggacaatcaaggagatcctggggaccgctcaaagcgtagggtgtaacgttgatggtagacatccgcatgatattatagatgacatcaactctggggctgtggaatgccccgcatcatag

SEQ ID NO: 132773 - DNA, 636 bp, Artificial Sequence
  Description of Artificial Sequence: Synthetic coding sequence
atggcacctagccggaatgggatggttttaaagcctcactttcacaaggattggcagaggcgcgtggccacttggtttaaccagccggctcggaagatccgtagacgcaaagccagacaggcgaaagcgcggagaatcgctccacgaccggcctcaggccctattcgccccattgtgaggtgtccaacagtcagatatcacaccaaggttagggccggccgaggcttctcacttgaggaactacgggtcgccggcatccacaagaaagtagctcggacaatcggaatcagtgtggatcccagaagaagaaacaagagtacagaatctctgcaagccaatgtacagagattaaaggagtaccgatccaagttgatcctgtttccgagaaagccttccgcaccaaaaaagggggattcaagtgcagaggaactgaaactggccactcagttgactggccctgtcatgcccgtccgcaatgtgtacaaaaaagaaaaagccagggtgattacggaggaggagaagaactttaaagctttcgccagcttgagaatggcgagggcaaatgcccgactgttcggaattcgggctaaacgggccaaagaggcagcagaacaagacgtcgaaaaaaaaaagtag

SEQ ID NO: 132774 - DNA, 636 bp, Artificial Sequence
  Description of Artificial Sequence: Synthetic coding sequence
atggccccaagtagaaatggcatggtcttgaagcctcacttccacaaagattggcagaggcgagtcgccacttggtttaaccagcctgcccggaagattaggcgaagaaaagcgcgccaagcgaaggctaggaggattgcccctcgcccggccagcggccccattcgaccaatagttcggtgccctaccgtccgataccataccaaggtgagagccggccgagggtttagcctggaggaactcagagtcgcgggaatccataaaaaggtcgccaggactatcggcatatctgttgatccccggcgaaggaataaatccacagagagcctacaggccaacgtgcaaagactaaaggagtacagatccaaattgattttgttcccacgaaaaccgagtgcccccaaaaagggtgattcttccgccgaggagctgaaactggcaactcagctcacaggccccgtcatgcccgtgcgcaacgtctacaaaaaggagaaggcacgagtaatcaccgaggaggaaaaaaattttaaggcatttgcaagtctgcgtatggcgagggcgaatgcccgcctgtttggtattcgggccaagagggcgaaggaggcggctgagcaagacgtggaaaagaaaaaatag

SEQ ID NO: 132775 - DNA, 495 bp, Artificial Sequence
  Description of Artificial Sequence: Synthetic coding sequence
atggcgcccagcagaaatggaatggtgttgaagcctcacttccataaggactggcaacggcgggtggccacctggtttaaccagccggcccgcaaaatccgccggcggaaagccaggcaagcgaaagcacgcaggattgcccctcggcccgcttccggccccattcgtcccatcgtccggtgtccaacagtgcggtatcacaccaaggtgcgtgctggaaggggtttctcactggaggaactcagagtagccggtattcataaaaagggcgattcatctgccgaggagctgaagttggccacacagctcactgggcccgtcatgcctgtgaggaacgtgtataaaaaggagaaggcgcgcgtgataacggaggaagagaagaatttcaaagcatttgccagccttcggatggcgagggccaatgccaggctctttgggatccgagcaaagagggccaaggaggccgctgaacaagacgtcgagaaaaagaagtag

SEQ ID NO: 132776 - DNA, 615 bp, Artificial Sequence
  Description of Artificial Sequence: Synthetic coding sequence
atgggggcatacaagtacattcaggagctttggagaaagaaacagagtgacgtgatgaggtttcttctgagggtacgttgctggcagtacagacagctgagtgcactccacagagcacccaggccaacaaggccagataaagcacgccggctggggtataaggctaagcaaggatacgtaatctaccggattcgtgtgaggcgagggggacggaaacgcccggtgccaaaaggggcaacctacggcaagcctgtgcaccacggcgtgaatcaattaaagttcgcccgaagcctgcagtctgtggcagaagagcgggccggcagacattgcggcgccttaagagtcctaaattcttattgggtgggtgaggatagcacctataaatttttcgaagtcatcctcatcgatccctttcataaagctattaggcggaaccctgacactcagtggatcaccaaacccgtgcataaacatcgtgagatgaggggcctcaccagcgctggcagaaagtctcgagggcttgggaaagggcacaaattccaccatactatcggaggcagcagaagggctgcatggcgacgcaggaacacgctacagctgcatcggtatcggtag

SEQ ID NO: 132777 - DNA, 615 bp, Artificial Sequence
  Description of Artificial Sequence: Synthetic coding sequence
atgggggcctataaatatattcaggagttgtggaggaagaagcaaagtgatgttatgcgctttctgctgcgggtcagatgctggcagtaccggcagttatccgctctgcatagggctcccaggccaacacgtccagacaaagctcggcgactggggtacaaggctaaacaagggtacgtgatttatagaattagagttcgacgagggggtcgcaaacgtccagttcctaaaggagccacttatggcaagccggttcaccacggcgtgaaccagctgaagttcgcccggtcactacagagtgtggccgaggagagagcaggtcgtcactgcggtgccctgagagtgttgaattcctattgggtgggcgaagactccacatataagttcttcgaggtgatcctcatcgacccgtttcacaaggccattagacgtaaccccgacactcagtggatcacgaagcccgtacacaagcatcgggaaatgcggggactcacttctgctggacggaaatcgcggggcctgggcaaggggcacaaattccaccacaccattggcggctctagacgcgctgcatggcggcgaaggaatactctacagttacatcggtacaggtag

SEQ ID NO: 132778 - DNA, 528 bp, Artificial Sequence
  Description of Artificial Sequence: Synthetic coding sequence
atgggggcgtacaaatatatccaggagttgtggagaaagaagcaatccgacgtgatgaggtttctgctccgcgtgaggtgttggcagtatcgccaactgagtgcgctacaccgagcaccccgacccactcgaccagacaaggcccgccgactggggtacaaagcaaaacagggatacgtgatctatagaataagagttcgcagggggggaagaaagcggcccgtgcctaagggcgcaacctacggaaaacccgtgcaccacggcgtgaaccagctgaaattcgcacgttcgctgcagtctgtggccgaagtgaacgctggccgccactgtggcgccctccgcgtgctgaacagctactgggtgggcgaggactccacttataaattcttcgaggttatcctgattgaccctttccacaaggcaatacgccgcaacccagacacgcaatggattactaaaccagtccataaacatcgggagatgcgcggcctaaccagcgcggggaggaagtcgagggggttgggatag

SEQ ID NO: 132779 - DNA, 615 bp, Artificial Sequence
  Description of Artificial Sequence: Synthetic coding sequence
atgggcgcatacaaatacatccaggaactgtggcgcaagaagcaatcagatgtaatgaggtttcttctgagggtcagatgttggcagtatcgccaactatctgctctgcacagggcaccacgacccacgcgacctgataaagcccgccggctgggctacaaagccaaacaaggctatgtaatatacagaatccgagtgagacgcggcgggcgaaagcggccggtgcccaagggggccacatatgggaaacccgtgcatcatggtgtgaaccaactgaagttcgctagaagcctgcagtctgttgcagaagaacgagccggacgccactgcggggccttgagagttctgaatagctactgggtaggcgaagactccacctataagttcttcgaagtgatcttaatagacccattccataaggcaatccggcgcaaccccgatactcagtggattacaaagcctgttcacaagcaccgcgaaatgcgggggctcactagcgctggaaggaagtctaggggcctgggcaaaggtcacaaatttcatcatactatcggcggttcaaggagagccgcctggcgcaggagaaataccctccagctccaccggtaccggtag

SEQ ID NO: 132780 - DNA, 615 bp, Artificial Sequence
  Description of Artificial Sequence: Synthetic coding sequence
atgggtgcctacaaatatatccaggaactatggaggaagaagcaatccgacgtcatgcgtttcctactccgcgtgagatgctggcaataccgccagctgtccgccttgcacagggctcctcgtccaacccgcccagataaggcccggcgcctggggtacaaggctaaacagggttatgtgatataccgtatacgagtgcggagaggcggccgcaagcgcccagtgccgaaaggcgctacctacggtaagcccgtgcaccatggggtgaaccagctgaaatttgctaggtccctgcagtctgtagcagaggaacgcgccggccggcactgcggcgcactgcgagtactgaacagctactgggttggggaagactccacctataagttttttgaagtcattttgattgatccgtttcataaggctattcgcaggaaccccgatacccagtggattacgaaacctgtccacaagcaccgtgagatgcgagggctgactagcgctggccggaaatcccgtggtctgggcaagggccacaagttccatcatacaattggggggtctagacgtgctgcatggagacgtaggaacacgctgcagttgcaccggtataggtag

SEQ ID NO: 132781 - DNA, 402 bp, Artificial Sequence
  Description of Artificial Sequence: Synthetic coding sequence
atgggggcatacaaatatatccaggagttatggagaaagaagcagtctgatgtgatgcgcttcctgctgagagtgagatgctggcagtacagacaattatctgcccttcacagagcacctcgaccgacgagaccagataaagctagaaggctaggctataaagcaaagcagggctacgtgatctaccgaattagggtcaggaggggcggtcgcaagcgacctgtgcctaaaggggcaacctatgggaaacccgttcatcacggagtaaatcagcttaagtttgctaggtctttgcagtctgtggccgaggaacgcgcgggacgtcactgcggcgctctgcgggtgctcaattcgtattgggtcggggaagatagcacatataagttctttgaagttatttag

SEQ ID NO: 132782 - DNA, 525 bp, Artificial Sequence
  Description of Artificial Sequence: Synthetic coding sequence
atgggggcctacaagtacatccaggaactttggcggaagaaacaatccgatgttatgagattcctccttcgagtgagatgttggcagtaccggcagttgagcgccctacatcgcgcccctagaccaactcgccccgacaaagcacgtcgcctcggttataaggcgaaacaggggtatgttatctacaggatcagagtccgtcgcgggggacgcaagaggccagtaccgaagggcgccacatatggcaagcccgtgcatcatggcgtgaatcagctcaagttcgccagaagcctccagagcgtggcggaagagagagccggtcgccactgcggagctctcagggtgttgaactcatactgggtgggcgaggattcaacatacaagttctttgaggttattttgattgatcctttccacaaagccataaggaggaaccctgatacacagtggatcacaaaacctgtgcataaacacagggagatgcgcggtctgacaagcgctggccgtaagtctcggggactctag

SEQ ID NO: 132783 - DNA, 615 bp, Artificial Sequence
  Description of Artificial Sequence: Synthetic coding sequence
atgggcgcttacaagtacattcaagaactgtggaggaaaaaacaaagcgacgtgatgcggttccttttacgggtccgatgttggcagtatcgccagctctctgccctccaccgggctccaaggcccactagacctgataaagctaggcgccttggatataaggctaagcaaggatacgtgatctataggattcgcgtccgaagagggggtcggaaaaggcctgtgccaaaaggagccacatacggcaaaccagtgcatcacggtgtgaaccagttaaagtttgcaaggagcctccagagtgtggctgaggagcgcgccggaaggcactgcggggcattaagggtgttgaactcctattgggtcggagaggactcaacatacaaattttttgaggtgattttgattgacccattccacaaagcgatccgacgcaaccctgatactcagtggataacaaagcccgtgcacaaacaccgagagatgagggggctgactagcgccggtcgaaaaagccgcggtcttgggaagggtcacaagttccatcataccatcggcggctctcgacgtgccgcttggcgtcggcgaaacaccctgcaactacaccgatacaggtag

SEQ ID NO: 132784 - DNA, 180 bp, Artificial Sequence
  Description of Artificial Sequence: Synthetic coding sequence
atgggagcttacaagtatatccaggagctgtggagaaaaaagcaaagtgatgtcatgcggtttttactgcgagtccgttgctggcaataccgtcagttatcggcgcttcacagagcacctaggcccacaagacccgataaagccagaaggctgggttataaggctaaacagggcacctag

SEQ ID NO: 132785 - DNA, 438 bp, Artificial Sequence
  Description of Artificial Sequence: Synthetic coding sequence
atgggcgcctacaaatacattcaggaactgtggaggaaaaagcagagtgacgtgatgcggtttctgctgcgcgttcgctgctggcagtatagacaactgagcgccctgcaccgcgctccacggcctacaaggcctgataaggccagacgcctgggttataaggcgaaacaagggtacgttatctaccgtatccgagtgaggagaggtgggcgtaaaagacccgtgcccaaaggagctacatacggtaagcctgtgcatcacggtgtcaatcagttgaaatttgctaggtctctacagagcgtggctgaagaacgcgctggaagacactgcggggcccttcgggtgctcaattcctattggatggaatcccatagtcacagcgggggatctgccgttggacagagcagactcaccgccacttccgtctcacgggtctag

SEQ ID NO: 132786 - DNA, 495 bp, Artificial Sequence
  Description of Artificial Sequence: Synthetic coding sequence
atgggagcttacaagtacattcaggaactgtggcgaaagaagcagagcgatgtgatgcggttcctgctgcgcgtccggtgctggcagtacagacagctgtctgctctgcacagggctccacgccccacaaggccggataaggctcgtaggctaggctacaaagctaaacagggctacgtcatttatagaattcgcgtgcgacgggggggacggaaacggccggtaccaaaaggggccacgtatgggaaaccagttcaccatggagtaaatcagttgaaatttgcccgtagcttacagtctgtggccgaggaacgcgctggccggcactgtggggcactgcgagtccacaagcacagggagatgaggggactcacgtcagcgggtcgaaagtctaggggattaggaaagggccacaaatttcaccataccattgggggctcgaggagagccgcctggcgtagaagaaacacactgcaattgcacaggtaccgatag

SEQ ID NO: 132787 - DNA, 441 bp, Artificial Sequence
  Description of Artificial Sequence: Synthetic coding sequence
atgcatattcgcaaagccacgaaatatctaaaagatgtaaccttacaaaagcaatgcgtacccttcagacggtataatggaggggttggcagatgtgcccaagccaagcagtggggatggacccaaggtcgctggcccaagaaaagcgccgaattcctgttgcacatgctaaagaatgctgagtccaatgctgagttaaaggggctggatgtggatagcttggtgatcgagcacatccaggtcaataaggctcccaagatgcgccggcgcacctacagagcccatggacggattaacccgtatatgagttccccctgtcacatcgagatgattctcaccgagaaagagcagatcgttcccaaaccagaggaggaggtggctcaaaagaagaagatcagccaaaagaaacttaaaaagcagaagctgatggcgagggagtag

SEQ ID NO: 132788 - DNA, 555 bp, Artificial Sequence
  Description of Artificial Sequence: Synthetic coding sequence
atggtccggtacagcctggatcccgagaatccgactaaatcctgtaaaagcagaggttccaacctgagagtgcacttcaagaacactcgcgaaaccgcccaggccatcaagggcatgcatattcgcaaggcaacaaagtacttgaaagacgtgacacttcagaaacagtgtgtgccctttcgtaggtacaatggcggagtggggcgctgcgcccaagcgaaacagtggggttggacgcaaggacggtggcctaaaaaatcggcggagttccttttacacatgcttaaaaatgctgagtcaaatgccgaattaaaaggattggatgtggatagcctcgtgattgagcacattcaggtcaacaaggcaccaaagatgaggcgtcggacctacagagcccacgggcggatcaatccttacatgtcgagtccctgtcatattgagatgatactgactgagaaggagcagatcgtgcccaagccggaggaagaggtggcacagaagaagaagatctcacagaagaagctgaaaaagcagaaactaatggccagagagtag

SEQ ID NO: 132789 - DNA, 555 bp, Artificial Sequence
  Description of Artificial Sequence: Synthetic coding sequence
atggtcaggtatagccttgaccccgagaatccaacgaaaagttgcaaaagtaggggaagcaacctgagggtacactttaagaatacccgtgagacagcccaggctatcaaggggatgcatattcggaaggctactaaatacctcaaagatgtcaccttgcagaaacagtgtgtgcctttccggaggtataacgggggcgtaggccgctgtgcacaggctaagcaatggggttggactcagggcagatggcccaaaaagtccgccgagtttctgctccatatgttaaaaaacgccgaatcaaacgccgaactgaaggggttggatgtcgactcattggtaattgaacacatccaggttaacaaggcacccaaaatgagaaggaggacgtatagggcccacgggagaatcaatccgtatatgtcttctccttgccacatcgagatgatcttgactgaaaaggagcagatcgtgcccaagccagaggaggaggtggcccaaaaaaaaaaaattagccagaaaaaactgaagaagcaaaaactgatggcgcgtgaatag

SEQ ID NO: 132790 - DNA, 573 bp, Artificial Sequence
  Description of Artificial Sequence: Synthetic coding sequence
tgacctcagggggttgatatccggcacaacaaagacaggaaggtacggagaaaagagcctaagagtcaggatatttacctgcgcttgctggtgaaattatacaggttccttgccaggcggaccaattccacgtttaatcaggtggtgctgaaacgcttgttcatgtcaaggacaaacagaccccctctgtccctttctcgaatgattcgtaaaatgaagttacctggtagagaaaacaaaaccgccgtggtcgttggtactattacagatgacgtaagagtgcaggaggttccgaagttgaaggtttgcgctttaagagtcacgtctcgggcccgttccagaatcctaagggctggggggaagattctcacatttgaccagcttgcacttgactccccaaaaggatgcgggacggtcctcctttctggccctaggaagggaagagaggtgtaccgacatttcggcaaggcaccagggacaccacattctcatacgaagccctatgtgaggagtaaaggccgtaaattcgaaagagccagaggcaggagggctagcaggggctacaaaaattag

SEQ ID NO: 132791 - DNA, 408 bp, Artificial Sequence
  Description of Artificial Sequence: Synthetic coding sequence
atgggggtggacattagacataataaggacaggaaggtcaggagaaaggaacctaaaagtcaggatatataccttaggctcctggttaagttgtacaggtttctggctagaaggactaatagcactttcaaccaagtggtgctaaagcggctctttatgtcccggactaatcgaccgcccctgagcctaagcagaatgatccgcaaaatgaaacttccaggaagggagaataagaccgccgttgttgttggcactattactgatgacgtgcgtgtgcaggaagtcccgaagttaaaggtgtcatggcgcgggctggggagacccatccgccccctgttatactgtgctgtgctatgctgtgccgtgctctgctgtctagtgcatccccagagctgtcatcggtggtag

SEQ ID NO: 132792 - DNA, 567 bp, Artificial Sequence
  Description of Artificial Sequence: Synthetic coding sequence
atgggagtggacatccgacacaacaaggaccgaaaggtgagaagaaaagagccgaaaagccaggacatttacctcagacttcttgtgaagctgtaccgttttttggcgcggcggacgaatagcacattcaaccaggtagtgttgaaaagactcttcatgagcagaaccaaccgcccacctctctcactgagccgtatgatccgcaagatgaagctccctggcagggagaataagactgctgtcgttgtcggaactatcaccgatgatgttcgggtccaggaggtgcctaagctgaaggtctgcgccctgcgggtgacctcacgcgcccgatcccgcatcctgcgggcaggcgggaaaatccttacctttgatcagctggccttggactctccaaagggatgcggaacagtgctgttatcaggtccacgcaaagggcgcgaggtgtataggcactttgggaaggcccctggcacaccacactcacatactaaaccttacgtgaggagcaaaggtaggaagtttgaacgagcacggggtaggcgggcctcccgcgggtacaaaaactag

SEQ ID NO: 132793 - DNA, 480 bp, Artificial Sequence
  Description of Artificial Sequence: Synthetic coding sequence
atgctgtacaggtttctggccagacggactaacagcactttcaaccaggtggtgctcaagcgtttgtttatgagtcggactaatagacctccacttagcctcagtagaatgatcagaaaaatgaagcttccaggcagagaaaacaagactgccgtcgtcgtcgggacaattaccgatgacgttagggtgcaggaagttcccaaattgaaagtttgtgccctccgtgtaaccagcagagcaagaagtagaatcctccgcgccggaggcaaaatcttaactttcgatcagctggctctggacagtcctaaagggtgtggcaccgtgttactctctggccctaggaaaggcagagaggtataccgtcactttggaaaagctcctggaacaccccactcacacacaaaaccttacgttcggagcaaggggcggaagtttgaacgcgctcggggaaggcgggcttcacgcgggtacaagaactag

SEQ ID NO: 132794 - DNA, 795 bp, Artificial Sequence
  Description of Artificial Sequence: Synthetic coding sequence
atgaatattttgcctaagaaatcttggcacgtacgcaacaaagacaatgtggcacgggtcagacgagacgaggcccaagcaagggaggaggaaaaggagcgggaacgtagggttttactggcccagcaggaggccaggaccgagtttctgcgcaagaaagcacggcaccagaattctctgcctgagctagaagccgctgaggctggcgcccccggttctggacccgttgatctctttcgtgaacttctggaagaagggaagggtgtgattcgtggaaataaagaatatgaagaagagaagaggcaggagaaagagcgacaggagaaggctttggggatcctcacctacttgggccagagcgctgccgaagcccaaacacagcccccgtggtaccagctcccaccaggccggggaggcccaccccccgggccagctccggacgagaaaattaaaagcagactggatccactgagggagatgcagaagcacttagggaagaagcgtcagcacggaggtgacgaggggagccgttccaggaaggagaaagaaggtagcgagaaacagcggcccaaggagcctccatctctggaccagctgagagccgaacgactacggagagaggccgccgaaaggagtagggctgaggccctcctggcacgtgtccaaggacgcgcacttcaagagggacaaccggaagaggacgagactgacgatagacgtcgccggtataacagccagttcaacccccagcttgctagacggcccagacagcaagacccccatcttacccactag

SEQ ID NO: 132795 - DNA, 465 bp, Artificial Sequence
  Description of Artificial Sequence: Synthetic coding sequence
atgaaggccagcgggacactgagggaatacaaggtcgtcggtaggtgccttcccacgcctaaatgtcacacaccccccctgtacaggatgcggatttttgctcctaaccatgtggtggccaagtctcgcttctggtatttcgtatcgcaattaaagaaaatgaagaagagttctggggagatagtctactgcgggcaggtattcgagaaaagccccttacgggtcaaaaattttgggatctggctacggtacgattctagatcaggaacgcacaatatgtaccgcgaatatcgagacctgactaccgccggtgccgtaacccagtgctaccgagacatgggggccagacaccgcgccagagcgcattccatccagatcatgaaggttgaggagattgccgctagcaagtgccgccggcagcacaaacctcggttcaccaccaagagaccaaacacatttttctag

SEQ ID NO: 132796 - DNA, 1278 bp, Artificial Sequence
  Description of Artificial Sequence: Synthetic coding sequence
atggggggcggggacctgaatctgaagaaatcttggcaccctcaaacactccgcaacgtggagaaagtgtggaaagctgagcaaaagcacgaagccgaacgtaagaagatcgaggaacttcagagagaactcagagaagaaagagcacgggaggagatgcagcgctatgcagaggatgttggagccgtgaaaaaaaaggaggagaagttggattggatgtaccaaggccccggcgggatggtgaaccgcgacgagtatctgttgggtcgacctatcgacaaatatgttttcgaaaaaatggaagagaaagaagcaggttgctcttcagaaactggtttgctccctggatcaatctttgcacctagcggcgcaaatagtctgctggatatggctagtaagatcagagaagatccactgtttattataagaaaaaaagaggaagaaaagaaacgcgaggtgctgaacaaccctgtgaaaatgaaaaaaatcaaggagctgctgcagatgagcttagagaagaaagagaagaagaagaagaaagagaaaaaaaagaagcacaagaagcataaacaccgatcctcatcttctgacaggagttctagcgaggacgagcactctgccggtcgtagccagaagaaaatggctaattcatcgcccgtgctcagcaaggtgcctgggtacgggctccaagtccgaaacagtgatcgaaatcagggcctacaggggcctttaactgccgaacagaagcgcggtcatggtatgaagaaccactccaggagtaggtccagtagccactcccccccccggcacgcatccaaaaaatccacaagggaagccggatctcgagaccggcggtccaggtcattgggcaggcgctctagatcacctagaccctccaaactgcacaactcgaaggtgaaccggcgggagactggccaaacacgctctccctctccaaagaaagaagtctatcaaagacgccacgctcccggctatacaaggaaactgagcgccgaggaacttgagcggaagaggcaggagatgatggagaacgccaagtggcgcgaggaggagcgacttaacatcctcaaacgacacgctaaagacgaggaaagggaacaacgtttggaaaagctcgactcccgggacggtaaattcatccaccgcatgaaattagagagcgcatctacatcttccctggaggaccgcgtaaaacgtaacatatacagcctgcagcgtacctctgttgcactggagaagaactttatgaaaagatag

SEQ ID NO: 132797 - DNA, 483 bp, Artificial Sequence
  Description of Artificial Sequence: Synthetic coding sequence
atgacaaatacgaagggaaaacgacggggaactagatatatgtttagtcgcccttttaggaagcatggggtggtaccactggctacgtacatgaggatctataaaaagggggacattgtggacattaaaggcatggggactgtgcagaagggaatgccgcacaagtgctaccacgggaagactggaagggtttacaatgttacacaacacgctgtcggaatagtagtgaataagcaagtgaaaggcaaaattctcgctaagagaataaatgtgaggatcgaacacattaaacactctaaatctagggattccttcctgaagcgggtcaaagaaaatgatcagaaaaaaaaagaagcgaaagaaaagggcacatgggtccagctaaaacggcagccagctcccccccgggaggcccactttgtgagaaccaatggcaaggagccggaacttctcgaacccattccatacgaattcatggcatag

SEQ ID NO: 132798 - DNA, 483 bp, Artificial Sequence
  Description of Artificial Sequence: Synthetic coding sequence
atgaccaacactaagggcaagcgtcgcgggacgcgctatatgttctctcgaccattccgcaagcacggcgtggtgcctctggcgacatatatgagaatatataagaagggggatatcgtagatatcaaaggaatgggaacggtgcagaagggtatgccccataagtgttaccatggcaaaaccgggcgagtatacaatgtgactcagcacgcggtgggcatcgtcgtgaacaagcaggtcaagggtaagattttggcaaagcgaattaacgtcaggattgagcatatcaagcacagcaagtccagagatagttttctgaaaagagttaaggaaaatgaccaaaagaaaaaggaggccaaagaaaaaggcacctgggtgcaactcaaacgccagccggctcctccacgagaagcccacttcgtcagaacaaatggcaaagaacccgagttgctggagccaataccatacgaattcatggcatag

SEQ ID NO: 132799 - DNA, 483 bp, Artificial Sequence
  Description of Artificial Sequence: Synthetic coding sequence
atgacaaacacgaagggcaagagaagaggaaccagatacatgttctcaagaccctttagaaaacacggtgtggttccacttgcaacttacatgagaatctataagaagggcgatatcgtggatatcaaggggatgggcactgttcaaaaaggcatgccccataaatgttaccacggtaagacagggagagtctacaacgttactcagcacgctgttggcattgtggtgaataaacaggtgaagggaaaaattctcgcgaagcggattaatgttcgcatcgagcatatcaaacattcaaaatctagggacagcttcctaaaacgtgtgaaggagaacgatcaaaaaaaaaaagaggctaaagagaaggggacatgggtccagctaaagcggcagccagcccccccaagggaggctcatttcgtgcgtaccaatggcaaagaaccagagctactagagccgatcccctacgaattcatggcctag

SEQ ID NO: 132800 - DNA, 483 bp, Artificial Sequence
  Description of Artificial Sequence: Synthetic coding sequence
atgaccaacactaagggcaagcggagaggtaccagatatatgttctcaaggccgtttagaaagcatggggtcgttcccttagcaacctatatgaggatatataagaagggagacattgtggatatcaagggtatgggcactgtccagaaggggatgccccacaagtgttatcacggcaaaaccgggcgggtgtacaatgtcacccagcacgccgttggcattgtggttaataaacaggtcaaagggaagatcctggctaaaagaattaacgttcgtatcgaacatattaagcattccaagtctagggacagctttctcaagagagtcaaagagaacgaccagaagaagaaggaagccaaggagaaaggtacttgggttcagctgaagaggcaacccgctcctcctagagaggcccatttcgtcagaacaaatggcaaggagcctgagctcctggagccgattccttacgagtttatggcctag

SEQ ID NO: 132801 - DNA, 972 bp, Artificial Sequence
  Description of Artificial Sequence: Synthetic coding sequence
atggctgctcctaagggtagtttgtgggttcggactcaacttggtctgcccccactcttgctccttaccatggctttagccggagggtcaggaaccgcttccgctgaagcctttgattctgtgctgggggacactgcttcctgccatagagcatgccagctgacatatcctctgcacacctaccctaaagaggaagagctgtatgcttgccaacgcggctgcaggctgttcagcatttgccaattcgttgacgatggaattgacctcaatcgtacaaagctggaatgcgaatctgcttgtacggaggcttactcccaaagcgacgagcaatacgcctgccatctcggatgccagaaccagctgcccttcgccgagttacggcaagagcaactgatgtcactgatgcccaagatgcatcttctattcccccttacgctggtcagatctttctggtcagacatgatggatagtgctcagtcctttattacaagttcttggaccttctacctgcaggcagacgacggcaagatagtgattttccagagtaagcccgaaatccagtatgctcctcatctcgaacaagagcctacaaatcttagggagagcagtctttccaaaatgtcttatctgcaaatgagaaattcacaggcgcacaggaattttctggaagatggcgaatccgacgggtttctgcggtgtctgagtctcaacagtggctggattctcactacaactctagttctgtctgtcatggttctgctatggatttgttgtgccacagtggccacagctgtagagcagtatgtaccttctgagaaactctccatttatggcgacctggaatttatgaacgaacagaaattaaatcggtacccagctagctccttggtggtagttagatcaaaaacagaagaccacgaggaggctggcccactgcccacaaaggtcaatctggcacattcggaaatctag

SEQ ID NO: 132802 - DNA, 276 bp, Artificial Sequence
  Description of Artificial Sequence: Synthetic coding sequence
atggccggttcccggagggagtgtaggcggggaggatcatctggggccaagttcaggatttcgttaggtctgcctgtcggtgcggttattaactgtgcggataatactggagcgaagaacctgtacataatctctgttaaaggcatcaaaggtagactcaaccgactcccggctgccggagtgggcgatatggtgatggcaaccgttaaaaagggaaaacccgagttaagaaaaaaggtacatcctgccgtggtcatcagacagagaaaaagctag

SEQ ID NO: 132803 - DNA, 423 bp, Artificial Sequence
  Description of Artificial Sequence: Synthetic coding sequence
atgtcgaaacgcggcagaggaggatcatccggggccaagttccgcattagtctcggactgccggtgggcgcggtgattaactgtgccgataataccggggcaaaaaacctgtacattatctccgtcaaaggcattaagggccgcttgaaccgccttcccgccgccggggtcggcgacatggtgatggctaccgtgaagaaaggcaaacctgagcttcggaaaaaggtccatccagccgtggtgattcgccagcggaaaagctatcggcgtaaggacggtgtttttctgtactttgaggacaatgcaggggtaatcgtcaataacaaaggagagatgaaggggtccgccattacaggcccggttgccaaggaatgcgctgatctgtggccaagaattgcttccaacgcaggctccatagcttag

SEQ ID NO: 132804 - DNA, 345 bp, Artificial Sequence
  Description of Artificial Sequence: Synthetic coding sequence
atgtctaaaagaggcagagggggaagtagcggagctaagtttcgcatatctctgggcctcccagtgggcgcagtaatcaattgtgctgataatacaggcgcaaaaaacctttatatcatttctgttaagggcatcaaaggcaggctcaatcgtctcccagccgctggggtaggggatatggtgatggccactgtgaagaaggggaagccagaacttcgcaagaaggtcctgctgtgccatacaggatggagcgctgttactcctcttaaacttacagtgacattaaattgttggacgtggaacccacctgcagtggctttcaaagggctccagctccaggtgtag

SEQ ID NO: 132805 - DNA, 423 bp, Artificial Sequence
  Description of Artificial Sequence: Synthetic coding sequence
atgtcaaagagggggcggggcggaagctccggggcaaagtttcgcatttcactgggcctgccagtgggagctgtcatcaattgcgctgataacacaggggctaaaaacctctacatcatttctgtgaaaggtatcaaaggtcgtctgaatcgcttgcctgccgctggggtgggtgatatggtcatggctaccgtgaaaaaaggcaaacccgaactgcgcaaaaaagtccacccagccgttgtgatccgccagagaaagtcttatcgacgcaaggatggcgtctttctttattttgaagataatgccggagtcatagtgaataataagggtgaaatgaagggaagcgcaatcactgggcctgtcgctaaagagtgcgccgacttgtggcctcgaattgcctcaaacgcaggaagcatcgcatag

SEQ ID NO: 132806 - DNA, 477 bp, Artificial Sequence
  Description of Artificial Sequence: Synthetic coding sequence
tgactggtcggtgcgccatgcccgagggcctcccccgccccacctaaggcagaagcgaaggccaaagcactgaaagcaaaaaaggctgtgttgaagggcgtgcactcacacaagaaaaagaagataaggaccagccctactttccggcgccccaagactctgagattgaggcggcagccgaagtaccccagaaaatctgctccccggcggaacaaactggaccattacgccattattaaattcccgttgactacagaatcggccatgaagaaaattgaagataataatacacttgtgttcattgtagatgtaaaggccaataagcatcagattaagcaagctgtgaagaagttatacgatatcgatgttgctaaggtgaacacactgatcagacccgatggagaaaagaaagcatatgtgcgcctcgctcccgattatgatgctttagacgtggctaataagattggaatcatctag

SEQ ID NO: 132807 - DNA, 477 bp, Artificial Sequence
  Description of Artificial Sequence: Synthetic coding sequence
atgagcccaggactggttgtgcttcgatgggctcctgctccgcccaaggccgaggctaaagccaaggcactaaaagccaaaaaggccgttctgaagggagtgcactcccacaagaaaaaaaagattcgtacttcacctacattcagacggccaaagaccctgcgtctccgacggcagcctaagtatccgcgaaagagcgccccgagacggaataaacttgatcactacgctataatcaagtttccgttaaccactgagtctgccatgaagaagattgaggataataacactctggtgttcatcgtcgacgtgaaagctaataaacaccagatcaaacaggccgttaagaagctctatgatatcgatgttgcaaaagtgaatactctgattagaccagatggagaaaagaaggcctatgttcgcctggctccagactacgacgccttggatgtagccaacaaaatcggtatcatctag

SEQ ID NO: 132808 - DNA, 585 bp, Artificial Sequence
  Description of Artificial Sequence: Synthetic coding sequence
atgcacccccttgttggggccccctgcccacgcgcctgtaaagaactggtgccctctgcgctaaccattttcctcctcgtgcacgttcagccaggctacattacacgaccctcactgcggtcagttgtgctgcggtgggctccggcccctcccaaggctgaggctaaggccaaagctcttaaagcgaagaaggcggtcctcaagggagtccattcccacaagaagaagaaaattcgtacttctcccacttttcggcggcctaaaacactccgattgcggcggcagcctaaatatcctagaaaatctgcccccagacgcaataagctcgatcattacgctatcatcaaatttccactaacgacagaatcagctatgaagaagatcgaagataataataccttggtttttatagtcgatgtcaaagcaaacaaacatcaaatcaagcaggcagtgaagaagctgtacgatatcgacgtggccaaggtaaatacattgattaggccagatggtgagaaaaaggcttacgtgcgccttgcaccagattacgacgccttagacgtggcaaacaaaatcggcatcatttag

SEQ ID NO: 132809 - DNA, 471 bp, Artificial Sequence
  Description of Artificial Sequence: Synthetic coding sequence
atggctcccaaagcaaagaaggaagcacctgcgcccccaaaagctgaagccaaggcaaaagccttgaaagcaaagaaggcagtgcttaaaggggtgcattcccataagaaaaagaaaattagaacgagtcctaccttccgccgacctaagacactacggctaagacgacagcctaaataccctagaaagtcagcccctagaaggaacaaactagaccactatgccatcattaaattcccgctgaccactgagtctgcaatgaaaaaaatcgaagacaataacacactggtctttatcgtggacgtgaaggcaaacaaacatcagatcaagcaggctgtaaaaaaattgtacgatatcgatgttgcaaaggtgaataccctgattcggccagatggggagaaaaaggcctacgtgcgcttggcacctgactacgacgcccttgatgtcgcaaacaagattgggatcatctag

SEQ ID NO: 132810 - DNA, 474 bp, Artificial Sequence
  Description of Artificial Sequence: Synthetic coding sequence
atgaaagttgagttgtgctcctttagcggctacaagatttaccctgggcatggaagacgttacgcccgcaccgacgggaaagtctttcagttccttaacgccaagtgtgaatcagccttcttgagtaaacgaaaccctaggcagatcaactggacggtgctctaccgacggaaacacaagaagggacagagtgaagagatccagaagaagcgcacgcggagggccgtcaaatttcagcgagcaattaccggggcctctctggcagatatcatggctaaacgtaatcagaaaccagaagtccgcaaagcgcagcgggaacaggcgatcagggccgccaaggaagccaagaaagctaagcaagcctccaaaaagaccgccatggccgcagccaaggctcccaccaaggcagccccaaaacagaagatcgtcaagccagtgaaagtgtccgccccaagggttggcgggaagcgctag

SEQ ID NO: 132811 - DNA, 453 bp, Artificial Sequence
  Description of Artificial Sequence: Synthetic coding sequence
atgaaagtcgagctatgctcattctccgggtacaaaatctacccgggccacgggagaagatacgcacgaaccgacggcaaggtgttccaatttctcaatgcaaagtgcgaaagcgccttcctttctaagcgcaatccaagacagataaactggaccgtgctgtatcggagaaaacacaagaaagggcagtcggaggaaattcaaaaaaaaaggactcgccgcgccgtaaagtttcaacgtgccatcactggcgctagcctggccgatatcatggccaaacgaaaccagaagcccgaggtgcgcaaagcgcaacgcgagcaggctataagagctgcaaaggaagcgaaaaaggccaagcaggcctcgaagaaaaccgcaatggccgctgccaaggtcatcatgggctttctttattttttagagcagtacaataggaagatatttttcttttag

SEQ ID NO: 132812 - DNA, 438 bp, Artificial Sequence
  Description of Artificial Sequence: Synthetic coding sequence
atgaaattcaatccattcgtgaccagtgataggtctaaaaacagaaagcggcacttcaacgctccatcccatattaggcgcaagatcatgtccagccccctgtccaaagagctgaggcagaaatataacgtgaggagcatgccgattcgcaaggacgacgaggtgcaagtggtacggggccactacaaaggacagcagattgggaaggtcgtgcaggtctataggaagaaatatgtcatatatatcgagagggtgcagcgtgaaaaggccaatggaaccaccgtacatgtgggcattcacccttcaaaggtagtaatcacaaggctgaagctggacaaggaccgcaaaaagatcctcgagcgtaaagccaagtctagacaagtcgggaaagaaaaagggaaatacaaggaggagactattgagaaaatgcaggagtag

SEQ ID NO: 132813 - DNA, 411 bp, Artificial Sequence
  Description of Artificial Sequence: Synthetic coding sequence
atggggaaatttatgaagcctggcaaggtggtgctggtccttgctggcaggtactcaggcagaaaagccgtaatcgtaaagaacatcgacgatgggacttccgatagaccatattcacacgccctggtggccggcatcgaccgttacccccggaaagttaccgccgctatgggcaaaaaaaaaattgctaaaagatctaagattaagagtttcgtcaaggtctataattacaatcacctgatgcccacacgatactcagtcgacatcccactggataagaccgtggtgaataaggatgttttccgcgatcctgctctgaagcgaaaagccaggcgcgaggccaaagttaagtttgaagaacggtataagactggaaagaacaagtggttctttcagaaactccgcttctag

SEQ ID NO: 132814 - DNA, 447 bp, Artificial Sequence
  Description of Artificial Sequence: Synthetic coding sequence
atgcctagcagactgcgaaagacccggaaactgagaggacacgtttctcacggtcatggccgaattgggaagcaccgcaagcatcctggcggcaggggtaatgctggcggccttcaccaccacagaatcaattttgataaataccaccctggatatttcgggaaagttggcatgaaacactatcatttgaaaagaaatcagtctttttgtcccacagttaacctcgataaattgtggaccctcgtctctgaacagacaagggtgaatgcagcaaagaataagactggtgccgcacccattatagacgttgtacgctctggatactacaaggtgctgggcaaaggaaagcttcccaagcaaccagttattgtaaaggcgaagttcttcagtcgccgggctgaagaaaagattaagagcgtcggaggcgcttgcgttctagtggcttag

SEQ ID NO: 132815 - DNA, 327 bp, Artificial Sequence
  Description of Artificial Sequence: Synthetic coding sequence
atgcctagcagactcagaaaaacacgaaagctgcgtggccacgtctcccacggccatgggagaattggcaagcacaggaaacacccaggaggcagaggcaatgcgggtggcttgcaccaccaccgcattaactttgataaataccacccaggatactttggtaaagtgggaatgaagcactatcacctgaagcgaaaccagagtttttgcccaacggtgaacttggacaagctgtggacattggtcagcgagcagacaagggtcaacgccgctaaaaacaaaaccggcgcggctccaataatcgacgtcgtgaggagcgtgtcttag

SEQ ID NO: 132816 - DNA, 414 bp, Artificial Sequence
  Description of Artificial Sequence: Synthetic coding sequence
atgtccgctcaccttcagtggatggtcgtgagaaactgctcctcattcctcattaaacgcaataaacagacctattcgacagagcctaacaacctcaaggcgcggaattccttcaggtacaatgggctcatccatcgcaagacggtaggagttgaacctgccgcggatggtaaaggtgtggtggtggtgatcaagcgcagatctgggcagcggaaacccgcaacaagttacgtgcgcaccaccatcaataagaatgccagagcaactctgagctccattagacacatgatcagaaagaacaaatacaggcctgatctaagaatggcagccattcggagagcttctgcaatcctgagatcgcagaaaccagtgatggttaaacgaaagaggactagaccaactaagtcatcttag

SEQ ID NO: 132817 - DNA, 210 bp, Artificial Sequence
  Description of Artificial Sequence: Synthetic coding sequence
atgtcggcccatttgcagtggatggtcgttcggaattgcagcagttttctcatcaagcgaaataaacagacttatagcacagagcccaacaacctgaaggcccggaatagcttccgctacaatgggttaatacatagaaaaacggttggggttgagccggctgctgacggtaagggtgtcgtggtagtcattaaacgtagatccgagtag

SEQ ID NO: 132818 - DNA, 264 bp, Artificial Sequence
  Description of Artificial Sequence: Synthetic coding sequence
atgtccgcacatctgcagtggatggtggtaagaaactgtagctcattcctgatcaaaagaaacaagcaaacctactcaaccgaaccaaacaatctgaaagcccggaatagttttcgctacaatggacttattcatcggaagactgttggggtagagccagcagccgacggcaagggagtggtggttgtgattaagcgccgtagcggagagttctgcctcgtttgggcccgggagagacctctgagccgtgtctgggaactgtag

SEQ ID NO: 132819 - DNA, 510 bp, Artificial Sequence
  Description of Artificial Sequence: Synthetic coding sequence
atgtcggcccaccttcaatggatggtcgtgcggaactgctctagtttcctgatcaaaagaaataaacagacttactccaccgaacctaataacttgaaagctcggaactcctttcggtacaacggcctcattcatcggaaaaccgtcggggtggagcccgcagccgacgggaaaggcgttgtcgtggttataaagaggcgtagcgggcagcgaaaaccagcaacttcttatgtacgcacaacaatcaataagaacgctagagccactctctccagtatcaggcatatgatcaggaagaataaatatcgacccgatctccgcatggacatgctcgccagcactgggtctggtctgtgttgtagcgtggctgtccagccttgggcctctagcagcacatctctatgcttacgtaccctgatttgcaacatgagagtggataggccgtactattccggcctgatgcgcagacttaacgtacagaaccttttggattgcgctcataagtcatag

SEQ ID NO: 132820 - DNA, 510 bp, Artificial Sequence
  Description of Artificial Sequence: Synthetic coding sequence
atgtcagcacacctgcaatggatggtcgtcagaaactgcagctccttccttatcaaacgtaataagcagacatactctaccgaaccaaataacctcaaggctcgaaatagttttagatacaatggactgatccatcggaaaacagtgggcgtggagcctgccgctgacgggaaaggtgtagtagtggtgattaagagaagaagcggtcaacgcaagccggctacctcttatgttcgaactaccatcaataagaatgcccgtgccaccctgtctagcattaggcacatgataaggaagaataaataccgtcctgaccttaggatggacatgctggcttctactggatccgggctgtgttgctctgtggccgtgcaaccttgggcaagcagttccacatccttatgtctccgcacgctgatctgcaatatgcgtgtggatcggccctactactctggacttatgcgacgactgaacgtgcagaacctcctcgactgcgctcacaaatcatag

SEQ ID NO: 132821 - DNA, 414 bp, Artificial Sequence
  Description of Artificial Sequence: Synthetic coding sequence
atgagtgctcatctgcagtggatggtggtcaggaattgtagctcctttctgatcaaaaggaataaacagacctactccacggaaccaaataatttgaaggcgcggaactcatttcgctacaacggcctcattcaccgcaagacagtgggggtggaaccagccgccgacggcaaaggagttgttgttgtgatcaagagacggagtgggcagcggaagccagccacttcatacgtccggacgactatcaacaaaaatgcacgggcaacgcttagtagtatccgccacatgatccgcaagaataaataccggcccgatctccgcatggccgctatcaggcgggcatcagctatcctaaggagccaaaaacctgtcatggtgaagagaaagcggaccagacctacaaagagttcatag

SEQ ID NO: 132822 - DNA, 492 bp, Artificial Sequence
  Description of Artificial Sequence: Synthetic coding sequence
atgtccgctcacctgcagtggatggttgttagaaattgcagtagtttccttatcaagcgtaacaagcagacctacagcaccgagcccaacaacctcaaagccaggaattccttcaggtacaacgggctcatccaccgaaaaacagtgggggtcgagcctgcagctgatggcaagggagtcgtggtggtcatcaaacgccgaagtggccaacggaagccagcaacctcttacgtccggacaacaatcaacaagaatgctagagccacgctgagctcaattaggcatatgatcaggaaaaataaatataggcccgatttgaggatggtttcctggggactcggcatcagactcggcgagacgggacagtgctgtggggaaggccctcccactacggggtgtaacatgggctggcgcggaatggattcatgtttccaacctactccccacacccagcattggcctcggggcaggctcgttgagtgtatgggctag

SEQ ID NO: 132823 - DNA, 480 bp, Artificial Sequence
  Description of Artificial Sequence: Synthetic coding sequence
atggctaagtcaaagaaccacactacccacaaccagagccggaagtggcacaggaatggtatcaagaaacctaggtcccagagatacgaatccttgaagggcgtggatccgaagttcctgaggaacatgcgtttcgctaaaaaacacaacaaaaaggggctcaagaaaatgcaggcgaacaacgctaaggccatgtcagcccgcgccgaggccatcaaggcattggtgaagcccaaagaagtgaaacctaagataccaaaaggggtttcccgtaaactggatagactggcctacattgctcaccctaagttaggaaagcgcgcaagagcaagaattgcgaaggggctcaggctgtgtcggcctaaggctaaagccaaggccaaggccaaggaccaaacaaaggcccaggcagctgcgccggcttcagtgccagctcaggcaccaaaacgcactcaggcaccgacgaaagcgtctgagtag

SEQ ID NO: 132824 - DNA, 480 bp, Artificial Sequence
  Description of Artificial Sequence: Synthetic coding sequence
atggctaaatcgaaaaaccacaccacccataaccagtctcgaaaatggcaccgtaatgggatcaaaaagccccggagccaacggtacgaaagccttaaaggggtagatcctaaatttctgagaaacatgagattcgcaaaaaagcacaacaagaaaggcctcaagaagatgcaggcaaataatgctaaggcaatgtctgctcgcgcagaagctatcaaagccctggtgaagccgaaggaggtgaaaccaaagatccctaagggagtctccagaaagttggatcgcttggcctatattgcccatcccaaattggggaaaagagcccgggcccggatcgcaaaggggctgcgactgtgtaggcctaaggcgaaagctaaggctaaagcaaaagaccagaccaaggcccaagctgccgcccctgcaagcgtcccagcacaagcccccaaacgcactcaggcccccacaaaggctagcgaatag

SEQ ID NO: 132825 - DNA, 480 bp, Artificial Sequence
  Description of Artificial Sequence: Synthetic coding sequence
atggcaaagtcaaagaaccatactacccataaccaaagcagaaaatggcacagaaacggaatcaaaaagccgagatcgcagagatatgagtctctcaaaggcgtagaccccaaattcctcaggaacatgcgcttcgcaaagaaacataacaagaagggccttaagaaaatgcaagcaaataacgcgaaggcaatgtctgctagagccgaagcgattaaggcattggttaagcccaaggaggtaaaaccaaaaatacctaaaggggtcagcaggaagttggatcgcttagcatacattgcacaccctaaattgggcaagagggctcgcgccaggatcgctaaggggttacggttgtgtagaccgaaagctaaggctaaagctaaggccaaagaccagacaaaagcacaggctgcagctcctgcaagtgtgcccgctcaggccccgaagagaacccaggcccctaccaaagcttccgaatag

SEQ ID NO: 132826 - DNA, 480 bp, Artificial Sequence
  Description of Artificial Sequence: Synthetic coding sequence
atggctaagagcaaaaaccacacaacgcacaatcagtcccgcaagtggcataggaatgggattaagaagccccggtctcagcgttatgagtctctgaagggagtcgaccccaagttcttgaggaacatgcggtttgccaagaagcacaataagaaaggcttgaaaaagatgcaggccaacaatgctaaggccatgtcagccagagccgaggcaattaaggccttggtgaagcctaaagaagtgaagcctaagataccaaagggagtttcacggaagcttgaccgcctggcatatatcgcccatcccaagctcggtaaaagggcacgcgccagaattgcgaaaggcttgcggttgtgccgcccaaaggctaaagcaaaggcgaaggctaaggaccagacgaaggcgcaggccgcggcccccgcctccgtgcccgcccaggctcccaagcgcacgcaggcccccactaaggcttcagagtag

SEQ ID NO: 132827 - DNA, 480 bp, Artificial Sequence
  Description of Artificial Sequence: Synthetic coding sequence
atggccaagtccaagaaccacacaacccataatcagtcgaggaagtggcatcgaaatggcatcaaaaaacctagaagccagagatacgaaagcctgaagggggtggacccaaagtttctgcggaatatgcggtttgctaaaaagcataataaaaaggggctcaagaagatgcaggccaataatgccaaagctatgagcgcacgcgccgaggcaattaaggccctcgttaagcccaaggaggtgaagccaaaaattcctaagggggtgagtaggaagctggataggctcgcctacattgcacacccaaagctgggaaaacgggcccgagcgcggattgctaaagggctccgcctgtgccgaccgaaggcgaaagctaaagctaaggcgaaggaccagaccaaagcccaggcggctgcgccggcttcggtgcccgctcaggcacctaagagaacccaggccccaaccaaagcctcagaatag

SEQ ID NO: 132828 - DNA, 480 bp, Artificial Sequence
  Description of Artificial Sequence: Synthetic coding sequence
atggctaaatccaagaaccacacaactcataatcagtctaggaagtggcataggaatgggataaagaaaccgcgctctcagcggtatgagagcttgaagggagtggacccaaaatttttaagaaatatgcggtttgcgaaaaagcataacaaaaagggccttaaaaaaatgcaagcaaacaacgccaaagccatgtccgccagagctgaggccattaaggctctcgtaaagccgaaggaggtgaaacctaaaattcccaaaggagttagccgcaagctggatcgtctggcatacatcgcccatccgaaactcggcaagagagcccgtgccagaatcgctaaaggacttcgactctgccggcccaaggcaaaagctaaagctaaagccaaggatcagactaaggctcaagcagccgccccagcctccgttcccgcacaggctccaaagaggactcaggcccccactaaggcaagcgagtag

SEQ ID NO: 132829 - DNA, 648 bp, Artificial Sequence
  Description of Artificial Sequence: Synthetic coding sequence
atgccattccatcctgtaacagctgctttgatgtatagaggaatttacaccgtccccaacctgctttccgaacaaaggcccgttgacatcccggaggatgaactggaggagatcagggaagctttcaaggtgtttgatcgggatggcaatggcttcatctcaaagcaggaattaggcaccgccatgcgttctttgggatatatgccaaacgaggtcgaactcgaagtgattatccaaaggttggatatggacggggatggccaggtcgactttgaagaattcgtcaccctccttggacctaagctctcaacgtctggtattcccgaaaaattccacggaaccgactttgacaccgtattctggaagtgtgacatgcagaagcttacagtggatgaacttaaacggctgctgtacgatacattctgcgagcacctttcaatgaaagacatcgagaatatcatcatgacagaagaggagtctcacctcggaacagcagaggaatgtcccgtagacgtcgagacatgttccaatcagcagataagacagacctgtgtccggaaaagcctcatttgtgcttttgcaatcgcctttattatttccgtgatgctgattgccgccaaccaggtgcttcgcagtggaatgaaatag

SEQ ID NO: 132830 - DNA, 1056 bp, Artificial Sequence
  Description of Artificial Sequence: Synthetic coding sequence
atgacacacatcgtgagagaagtcgatagaccgggcagtaaggtcaacaaaaaggaggtggtggaggctgtgacaattgtggagacaccgccaatggtggtggttggaatcgtggggtatgtagaaaccccacggggtctgcgtactttcaaaacagtgtttgctgaacatatcagcgatgaatgtaagagacgtttttataagaactggcataaaagcaagaaaaaagcttttacgaagtactgcaaaaaatggcaggacgaggacggaaagaaacagctcgaaaaagacttctcttccatgaagaagtactgtcaagtgatcagagtgatcgctcatacccagatgagactactgccactgcgacagaagaaagcccatttgatggaaatacaagtaaatgggggcaccgtcgctgagaagctggattgggccagggaacgcctggaacaacaggtcccagtgaatcaagtgtttggtcaggacgagatgatagacgtcatcggtgttacgaaaggaaaaggttataagggcgtcactagccgctggcacaccaagaagcttccaagaaagacacaccgcggcctccgcaaagttgcatgtatcggagcgtggcaccccgcacgtgtagccttcagtgtggctcgtgcgggccagaaagggtatcatcatagaacagagattaacaaaaagatctacaaaattggccaggggtatctgatcaaggatggcaaactcataaaaaacaacgcttccacagattatgatttatcagacaagagtatcaatccccttggcggtttcgtacattatggggaagtcaccaacgattttgtgatgttaaaaggttgcgtggtggggaccaagaagcgggttctcactttaagaaagagcctccttgtgcagaccaaaaggagagcattggagaaaatagacctgaagtttattgacaccacaagcaagtttggacacgggagattccagactatggaagaaaaaaaagcctttatgggccctctgaaaaaagaccgtatagctaaggaagaaggagcatag

SEQ ID NO: 132831 - DNA, 348 bp, Artificial Sequence
  Description of Artificial Sequence: Synthetic coding sequence
atggttgctgccaagaaaacaaaaaagtcattggagtccattaactcgcggctccagctcgtgatgaaaagtggaaagtacgtgctgggatacaagcagactttaaaaatgattcgacaaggcaaggcaaaattagtgattctcgcaaataactgtcccgctctgcggaagtcagagattgagtactacgccatgcttgctaaaaccggggtgcatcactattccggaaataacattgagttgggcaccgcatgtggaaaatattacagagtgtgcacgctggccatcatcgatcccggagattccgacatcatcagaagtatgccggagcaaactggagaaaagtag

SEQ ID NO: 132832 - DNA, 348 bp, Artificial Sequence
  Description of Artificial Sequence: Synthetic coding sequence
atggtggccgccaaaaagacgaaaaagtccctggagtccattaatagcaggctccagctggtgatgaaatcagggaagtacgttctgggctacaaacagacgttaaaaatgatccgccagggcaaagctaagctggtaattctggccaacaattgtcctgccctcagaaaaagcgaaatcgagtattatgcaatgttagctaagaccggcgtacatcactacagcggtaataacatagaactcggaaccgcctgcggaaagtattatcgagtctgtactctggcaattattgatccaggcgacagtgatatcatccgctccatgcccgaacagaccggcgaaaagtag

SEQ ID NO: 132833 - DNA, 345 bp, Artificial Sequence
  Description of Artificial Sequence: Synthetic coding sequence
atggtggctgcaaaaaaaacaaaaaagtctttagagagtatcaactctcgcctccaattggtgatgaagagcggtaagtacgtactggggtataagcaaaccctcaagatgattcggcagggaaaagcaaaactggtgattctggctaacaactgccctgctctgagaaaaagcgagatagaatattatgcaatgctggccaaaacgggcgtccaccattactcaggtaacaacatcgagctcggtacagcttgtggcaagtactaccgagtgtgcactcttgcgatcatcgaccccggggattctgacattatcagaagtatgcctgagcaaacgggtgaatag

SEQ ID NO: 132834 - DNA, 285 bp, Artificial Sequence
  Description of Artificial Sequence: Synthetic coding sequence
atgagcggaagactgtggagcaaagccattttcgcaggatacaaacgtggactgagaaatcagagagagcacactgctctgcttaaaatcgagggggtgtacgccagggacgaaaccgagttttatctgggcaaacgttgcgcatatgtgtataaagccaagaataataccgtcacaccagggggaaaacctaacaaaacaagggtgatctggggaaaagtgactcgcgcgcatggaaactccggcatggtgagggcgaaattccgcagcaatttaccggcgtag

SEQ ID NO: 132835 - DNA, 333 bp, Artificial Sequence
  Description of Artificial Sequence: Synthetic coding sequence
atgtctggtcgcctgtggtccaaagctatctttgcaggctacaagaggggcctgcgtaaccagcgcgaacacactgcactccttaagatcgagggggtctacgcccgggacgagacggaattttaccttggaaagagatgtgcgtacgtgtataaggcgaaaaacaacacagtcacgccaggtgggaagcccaacaagacgcgagtaatctggggaaaagtgacgcgtgcccacggaaattctggcatggtcagggcaaaattccggtccaacctgcctgccaaagctattgggcaccggataagggtgatgctataccccagcagaatctag

SEQ ID NO: 132836 - DNA, 333 bp, Artificial Sequence
  Description of Artificial Sequence: Synthetic coding sequence
atgtcaggacgactgtggtccaaggctatttttgctggctacaagaggggactgcgaaaccagcgggaacatactgccttgctcaagatagaaggggtgtacgctagggacgaaaccgaattctacctcggcaagcgatgtgcttacgtctacaaagcaaaaaataacacagtaactccgggggggaagccaaataaaacccgcgtgatctggggtaaagtcaccagagcacatggcaactccggcatggtccgtgccaaatttcgcagtaatctaccagccaaagcgatagggcataggattcgagtgatgttatacccctctagaatatag

SEQ ID NO: 132837 - DNA, 396 bp, Artificial Sequence
  Description of Artificial Sequence: Synthetic coding sequence
tgattgccatttgcaagccgttttctcagcttccgagcagattccgctcacgccagcatggtcaacgtacccaaaaccaggaggactttttgtaagaagtgtggtaagcaccagcctcacaaggtaacccagtacaaaaagggaaaggacagtctctacgcacagggcaaacgaagatacgacagaaagcagtccggttacgggggacagacaaagccgatcttcaggaagaaggccaagactactaaaaagatcgtgttacggctggaatgcgtggagccgaattgtcgtagtaaacgcatgcttgcaattaaacgctgtaagcactttgagttgggtggggacaaaaaacggaaggtttataactatggatggaaagtgcaaagcttctcttag

SEQ ID NO: 132838 - DNA, 429 bp, Artificial Sequence
  Description of Artificial Sequence: Synthetic coding sequence
atgattgcgcccaccgacagccacgaagaagtccggtctggtaccagctacattcttcctttcgcttcacgattcctctcttttagggcagattcggctcacgctagcatggttaatgtgccaaaaacacggaggaccttttgtaagaagtgcggaaagcaccagcctcacaaagtgacccagtataagaagggcaaagacagcctctacgcacagggtaagcgccgctacgatagaaagcagtccggttacggtgggcagaccaagcccatatttaggaaaaaggccaaaactacaaaaaaaatcgttttgcggctggaatgtgtggagccaaattgcaggagcaagcggatgctggctataaaaagatgcaaacattttgagctcgggggcgataaaaagcgtaaaggacaggtgatccagttttag

SEQ ID NO: 132839 - DNA, 321 bp, Artificial Sequence
  Description of Artificial Sequence: Synthetic coding sequence
atggtgaacgttcctaagacccggaggaccttttgtaaaaagtgtggcaagcaccaaccccataaggtaacacagtacaaaaaggggaaagactcgctatatgcgcaggggaagagaagatacgaccggaaacagagtggatacggaggacagaccaaacctatttttcgtaagaaagctaaaacaacaaaaaagatagtgcttcgattagaatgcgtcgagccgaactgtcggagtaaacggatgctcgctataaagcgctgcaaacattttgagctcggtggcgacaagaagcgcaagggacaagtaattcagttttag

SEQ ID NO: 132840 - DNA, 321 bp, Artificial Sequence
  Description of Artificial Sequence: Synthetic coding sequence
atggtgaacgtccccaagacgcgtcgcaccttctgcaaaaaatgtggcaaacaccagccccataaagtgactcagtacaagaaaggtaaggactctctttacgcccaaggcagaagaaggtacgacaggaagcaaagcggctacgggggccagacaaagccaatctttcggaagaaagccaaaacaactaagaaaatcgtgctgaggctcgaatgtgtggagcccaattgccggagtaaacgcatgcttgctataaaacggtgcaaacatttcgaattggggggcgacaagaaacggaaaggacaggtcatccagttttag

SEQ ID NO: 132841 - DNA, 294 bp, Artificial Sequence
  Description of Artificial Sequence: Synthetic coding sequence
atgacaaaaggaaccagttcgttcgggaagcgccgaaataagacgcatactctttgcaggcgctgcggcagcaaagcctatcacctgcagaagagcacctgcggcaaatgcggctatcccgcaaagaggaagcgtaagtataactggtccgccaaggctaagaggcgcaacacgacaggaacaggacggatgcgccatctgaagattgtgtatcgcaggtttcgacacggatttagggaaggcacaacccctaaacccaagagggctgcagtggccgcatcgtcctctagttag

SEQ ID NO: 132842 - DNA, 207 bp, Artificial Sequence
  Description of Artificial Sequence: Synthetic coding sequence
atggtaaaaaaaatagagatttctcagcacgccaagtacacctgttcgttttgtggtaaaacgaagatgaagaggagggctgtcgggatttggcactgtggctcttgcatgaagactgtcgcaggaggtgcttggacatataacactacctccgccgtgacagtgaagtcagccattagacgtctcaaggagctgaaggaccagtag

SEQ ID NO: 132843 - DNA, 279 bp, Artificial Sequence
  Description of Artificial Sequence: Synthetic coding sequence
atggcgaaacgaactaaaaaagttgggatcgtggggaagtacggcacccgctacggtgctagtctccgtaaaatggtcaagaaaatcgaaatttcacagcacgctaaatacacatgctccttctgcgggaagaccaaaatgaagaggagagccgtcgggatatggcactgcggctcatgtatgaagaccgtcgcaggcggcgcttggacatacaatactacaagtgccgttacggttaagtcggccatccggcggctgaaggaattaaaggatcagtag

SEQ ID NO: 132844 - DNA, 213 bp, Artificial Sequence
  Description of Artificial Sequence: Synthetic coding sequence
atgccgcggaaaatcgaggaaatcaaggacttcttactcaccgctcgcagaaaagatgccaagtccgtgaaaatcaaaaaaaataaggataatgtgaagttcaaagtgaggtgtagcaggtacctatacactctggtgattacggataaggaaaaggccgagaaattaaagcagagcctgcccccgggtttagccgtcaaagaactgaaatag

SEQ ID NO: 132845 - DNA, 213 bp, Artificial Sequence
  Description of Artificial Sequence: Synthetic coding sequence
atgccaagaaagatcgaagagattaaggatttcttacttaccgcgcgacggaaagatgctaaatcagtcaagataaagaagaacaaggacaatgtgaagttcaaagtccgctgctcccgttatttgtatacactcgtaatcaccgacaaggagaaagccgagaaattgaaacagtcattgccgccagggctggccgtcaaagaactcaagtag

SEQ ID NO: 132846 - DNA, 213 bp, Artificial Sequence
  Description of Artificial Sequence: Synthetic coding sequence
atgccccgtaaaatcgaggaaattaaagattttctcctgacagctaggcgaaaggacgctaaatctgtgaaaatcaagaaaaataaagacaacgtgaagttcaaggtcaggtgcagccgctacctatataccttggtcataaccgataaggaaaaggccgagaaactgaagcagagccttccacccggtctcgcagttaaagagctcaagtag

SEQ ID NO: 132847 - DNA, 156 bp, Artificial Sequence
  Description of Artificial Sequence: Synthetic coding sequence
atgtcatcccacaagaccttcacgatcaaacgcttcctggctaagaagcagaagcagaataggcctatccctcagtggattcagatgaagcccggtagcaagatccgctataattccaagcggcgacactggcgccgaactaagcttgggctgtag

SEQ ID NO: 132848 - DNA, 156 bp, Artificial Sequence
  Description of Artificial Sequence: Synthetic coding sequence
atgtcctcacataaaacctttacaatcaaacggtttctggctaagaaacagaagcagaatcgccctatcccacagtggattcagatgaagcctggtagtaagattcgctacaatagtaaacgccgccactggaggagaaccaaattggggctctag

SEQ ID NO: 132849 - DNA, 156 bp, Artificial Sequence
  Description of Artificial Sequence: Synthetic coding sequence
atgtcttcccacaaaactttcacgatcaaacgctttctggcaaagaagcagaaacagaaccggcccatccctcagtggatacagatgaagcccggaagcaaaatccggtacaactccaaacggcgccattggaggcggacaaaactcggcctgtag

SEQ ID NO: 132850 - DNA, 1284 bp, Artificial Sequence
  Description of Artificial Sequence: Synthetic coding sequence
atggcctgtgcaagacccttgatcagtgtgtacagtgaaaaaggcgagtctagcgggaagaatgttacgctccccgcggtctttaaagcgcccataagacctgacattgttaatttcgttcatactaatcttcggaagaataacaggcagccgtatgccgtcagcgagctggcgggtcatcagaccagcgccgagtcatggggtacaggccgggccgttgcacgtattcctagggtgagaggtggggggactcatcgctccggacaaggggctttcggtaacatgtgtcgggggggccgtatgtttgctcctacaaaaacctggaggcgctggcaccggcgagtaaacacaacccaaaagcggtatgccatctgttccgcacttgcagcgtctgcactccccgcccttgtgatgagcaaaggacaccggatcgaggaggtgccagagctgccgctggtagttgaggataaagtcgaagggtacaaaaagaccaaagaggccgttctgttactgaagaaactgaaggcttggaacgatatcaaaaaggtgtacgcttcccagcggatgcgcgcggggaagggcaagatgcgcaatagaaggaggattcaacgccgcggaccttgtattatatataatgaagacaacggaattattaaggcatttcggaacatcccgggcataactctcctcaacgtgagtaagttgaatatccttaagctggctcccggaggacacgtcggccgcttttgtatctggacagaaagcgcctttagaaagctagatgagctgtatggaacttggaggaaggcagccagcctgaagtccaactataacttacccatgcacaagatgattaacacagacctctccaggatccttaagtcccccgaaatccagcgggccctgcgggcccctcgcaagaaaatccacaggagagtgctgaaaaagaaccccctcaaaaacctgagaattatgctaaagcttaacccatatgccaaaaccatgcgcaggaatacaatcctgcggcaagcgcgcaatcataagctcagagtggacaaagcagccgctgctgctgctgctcttcaagcgaaatcagacgagaaggccgcggtggctggaaaaaagcccgtggttggtaagaaaggcaaaaaggctgcagtgggcgtcaaaaaacagaagaaacccttagtcggcaaaaaggcagccgctaccaaaaaacctgcacctgagaaaaagcctgctgaaaagaaaccgactacagaagagaaaaagcccgcggcttag

SEQ ID NO: 132851 - DNA, 1221 bp, Artificial Sequence
  Description of Artificial Sequence: Synthetic coding sequence
atggcctgcgcccggccgttaatatctgtgtactcggagaaaggggagagcagcgggaaaaatgtaacgttgccagccgtcttcaaggctcccatccggcctgatatagtgaattttgtccatacgaacctacgtaagaataaccgccaaccttatgcggtcagcgagcttgccggccaccagacatccgcggagagctggggtactggtagagctgtggccaggatcccgagagtgcgcggtggcgggacacataggtcaggacagggagcatttgggaatatgtgtagaggcggtcgcatgttcgcacctaccaagacctggcgacggtggcataggcgcgtaaacactacacagaagcggtacgcaatctgttctgcgctggccgcgtctgccttgccggcgctggtcatgtcaaaggggcacaggatcgaggaggtgcccgagctgcctctcgtcgtggaagataaggtggaaggctataagaagacaaaggaggcagtgctgctgctaaaaaagttaaaggcttggaatgacatcaagaaagtatatgcttcccagaggatgcgcgctggcaagggaaaaatgagaaatcgcagacgtatccagagaagaggtccatgtatcatatataatgaagataacggtatcatcaaggcctttcggaacatccctgggattacactattgaatgtctccaaactgaacattttgaagctcgctcctggaggccacgttggacggttctgcatttggactgagtctgcatttaggaagttggatgagctgtacggaacctggagaaaggcagcatccctgaagagcaactacaacctgcccatgcacaagatgattaacaccgatttgagccgcattcttaagagtcctgaaatacagcgggcactgagagcacctaggaagaaaatccacagaagggttctcaagaaaaaccctttgaagaacctccgcatcatgctcaagctgaatccctacgctaaaactatgcgacgtaacactatactccggcaagcccggaaccacaaactgagagtggacaaggcggccgctgccgccgccgctctacaggctaagagtgatgaaaaggctgctgtagcaggaaaaaagcccgtcgtaggcaagaaaggtaagaaagctgctgttggcgagaaaaagcctgcagagaaaaaaccaaccaccgaagagaagaagcctgcagcttag

SEQ ID NO: 132852 - DNA, 456 bp, Artificial Sequence
  Description of Artificial Sequence: Synthetic coding sequence
atggcttgtgcccggcctttgatctctgtctactctgagaaaggagagagcagcggcaaaaatgtgacattaccagctgtgttcaaggcccccatccggcccgatatcgtgaatttcgtgcacaccaacctgaggaagaacaaccgacaaccctatgctgtgtctgaacttgctggccaccagaccagtgctgagagctggggcacaggccgtgcggtcgcacggattcctagagtgagaggtggcggtactcaccggtctggccagggcgcttttgggaatatgtgtagaggaggcagaatgttcgctcccacgaaaacttggagaaggtggcaccgcagggtgaatacaacccaaaagcttgagaaccacgtggaggccaagccaatttgcaaagaccatgcgcctgagcaccattcttccccagggcaagaatcacaggctccaggagggtag

SEQ ID NO: 132853 - DNA, 78 bp, Artificial Sequence
  Description of Artificial Sequence: Synthetic coding sequence
atgagggcaaagtggcgaaaaaagcggatgcggaggttgaaaagaaaaagacgcaagatgcggcagcggtctaaatag

SEQ ID NO: 132854 - DNA, 78 bp, Artificial Sequence
  Description of Artificial Sequence: Synthetic coding sequence
atgcgggcaaagtggcgcaaaaaacgaatgaggcggcttaaaaggaagcggcgaaaaatgaggcagagatcgaagtag

SEQ ID NO: 132855 - DNA, 381 bp, Artificial Sequence
  Description of Artificial Sequence: Synthetic coding sequence
atgatcgtgcgggtgacaaaccgcgatattatctgtcagattgcctacgcccgtatcgagggggatatgattgtgtgcgctgcctatgcccacgagctgcccaagtatggggtcaaagtgggactcacaaactatgccgcagcctattgtactggtcttttactcgctcggcggcttctgaacaggtttggcatggacaaaatttacgagggacaggttgaagtcacaggggacgagtacaacgtagagagcatcgacggacaaccaggcgccttcacctgttatctggatgcagggctggcacgtactacaaccggcaataaagtgtttggggcgctgaaaggcgctgtggatggcggtctcagtatacctcaccgctag

SEQ ID NO: 132856 - DNA, 894 bp, Artificial Sequence
  Description of Artificial Sequence: Synthetic coding sequence
atgggatttgttaaggtcgtcaaaaacaaagcctatttcaagcggtaccaggtgaagtttagaaggcggagggagggcaagacggattactacgcccggaaacgtctggtcatccaggacaaaaacaagtacaacacgcctaagtaccggatgatcgtgcgcgtcaccaatagggatattatatgtcaaattgcttatgcccggatcgagggagacatgatcgtctgcgccgcttatgcacatgagcttcccaaatacggcgtcaaagtgggactgacaaactatgcggctgcctattgtactggtctgttgctggcccgcagactgctcaaccggtttggtatggacaagatctacgagggccaagtggaagtgactggtgacgaatacaacgtggagtctatcgacggccagccgggggcctttacttgctatctggatgcagggctggccaggactaccaccgggaacaaagttttcggggccctaaagggtgccgtggacggaggactatccatcccccactctaccaagagattccccgggtatgactcggagtcaaaggaattcaacgctgaggttcatcgtaaacacatcatgggccagaacgtagccgactacatgagatatctgatggaagaggacgaagacgcatataaaaagcagttttcccagtatattaaaaactccgtgacccccgacatgatggaagaaatgtacaagaaggcacacgcagccatccgggagaatcctgtctacgaaaaaaagccgaaaaaggaagtaaaaaagaagagatggaatcggcctaaaatgtccctggcacagaaaaaggaccgggtcgcgcagaaaaaggcatcatttttaagagcgcaggagcgggcagcggaaagttag

SEQ ID NO: 132857 - DNA, 744 bp, Artificial Sequence
  Description of Artificial Sequence: Synthetic coding sequence
atgattgttagagtcaccaatcgcgatataatttgtcagatcgcttacgccaggatcgagggggatatgatcgtctgtgccgcctatgctcatgagttacctaaatacggcgtgaaagttggcttaacaaactatgccgccgcatactgtaccggcctgctcctggcgagacgcctgctgaataggtttggcatggacaagatctacgagggccaggttgaggtcaccggagacgaatataacgtcgaatctatcgatggccagcccggcgcatttacatgttatcttgacgccggattagccaggacgaccactggcaacaaggtctttggtgctctgaagggtgcggttgacgggggattatctatccctcacagtacaaagcgctttcccggatatgatagcgaatcgaaggaatttaatgccgaagtacaccggaagcatataatgggacagaatgtcgccgattacatgcgctatctgatggaggaggacgaggatgcttacaagaaacaattcagccagtacatcaagaacagtgtcacccccgacatgatggaggaaatgtacaaaaaggcccacgccgccattcgggaaaatccagtttacgagaaaaaaccgaaaaaagaggtgaagaaaaaaaggtggaacagacccaaaatgagtttggcccagaagaaggaccgcgtggctcagaagaaagccagctttctgcgagcccaagaacgggctgcagaaagctag

SEQ ID NO: 132858 - DNA, 867 bp, Artificial Sequence
  Description of Artificial Sequence: Synthetic coding sequence
atggctggcgaaaaagtcgagaaacccgacacaaaggaaaagaagccagaggccaagaaagtggacgccggagggaaagttaagaaaggaaatctgaaggccaagaaacccaagaaagggaagccccattgttccagaaatcccgtgttggttcggggaatcgggaggtactcccgatccgccatgtacagccgaaaggccatgtacaaaaggaaatattcagccgctaagagtaaggtggagaagaaaaagaaggagaaggtgctagctaccgtgactaaacccgttggaggcgataaaaacggagggacacgagtggtgaagctgagaaagatgcctcggtactaccccactgaggacgtgccacgcaaactcctcagccacggaaagaaaccgtttagccagcatgttcgtaaattaagggcgagcatcacccccggcaccatactcatcatcctgaccggccgacacaggggcaaaagagtcgtcttcctgaagcagctggcctcaggcctgctcctggtcactggcccactcgtgttgaaccgcgtgcccctgcgtagaacccatcaaaagttcgtgatagccactagcacgaaaatcgacatatctaatgtgaaaattcctaagcacctgacagatgcatactttaaaaaaaaaaagttgcggaaacctaggcaccaggaaggggagattttcgatacagagaaggagaagtacgagattacagagcagcgcaagattgatcagaaggctgtggattcccagatactgcccaagataaaggccattccccaactgcaaggctacctgagaagcgtgttcgccttgaccaacggcatctatccccacaaactggtcttttag

SEQ ID NO: 132859 - DNA, 867 bp, Artificial Sequence
  Description of Artificial Sequence: Synthetic coding sequence
atggccggagagaaggtcgagaagcctgacactaaggaaaaaaaacccgaagccaagaaggtggacgctggtggcaaggtgaagaagggaaacctgaaagccaaaaaaccaaagaaggggaaaccacactgtagccgaaaccccgtgctcgtaagaggaatcggacggtactctcggtctgcaatgtattctagaaaggcgatgtacaagaggaaatacagtgccgccaagagcaaagttgaaaaaaagaagaaagagaaagttctcgctactgtcactaagccggtgggtggagacaaaaacggggggactcgagtggtaaaacttaggaaaatgccgcgttactatccaactgaagatgtccctaggaagctgctctcccacggaaagaagcctttttctcagcacgtcaggaagcttcgcgcttccatcaccccgggcaccatccttattatccttacagggcgtcatcgagggaagagagtggtgtttttaaaacagctggcatctgggctccttctggtaaccggtccactcgtgcttaaccgtgttcctctgcgaagaacacatcagaagttcgtgatagcgacctccacaaagattgacatctccaacgtgaagattcccaaacatctgaccgacgcctatttcaagaagaaaaaactgaggaaaccccgacatcaggaaggggagatctttgataccgaaaaggagaagtacgaaattactgaacagcggaagatcgatcagaaagcagtggattcacagatcctccccaagattaaagccattcctcaattacagggttacctgcgcagcgtattcgccttgacaaatgggatctatcctcacaagttggtgttttag

SEQ ID NO: 132860 - DNA, 318 bp, Artificial Sequence
  Description of Artificial Sequence: Synthetic coding sequence
atggctggggaaaaagtcgagaagccagacactaaggagaagaagcctgaagccaagaaagtggatgccggcggaaaggtgaaaaagggcaatctaaaggctaagaaacctaagaaaggaaagccacattgctcaagaaaccccgtgttggtgcggggtatcggaaggtactccagatccgcaatgtacagcaggaaagcaatgtacaagcggaaatactctgccgctaaaagtaaggttgaaaagaagaagaaagagaaggtcctcgccacagtgaccaagcctgtggggggggataaaaacggaggtacacgttag

SEQ ID NO: 132861 - DNA, 219 bp, Artificial Sequence
  Description of Artificial Sequence: Synthetic coding sequence
atggctggcgagaaagtggaaaaacccgataccaaagaaaagaaaccggaggcaaaaaaggtcgatgccggcggcaaggtgaaaaagggcaacctaaaggccaagaagcccaagaaaggcaagccacactgttcaagaaacccagtgctcgtcagaggaataggacgctattctcgctctgcgatgtactccaggaaagcaatgtataagcgcaagtag

SEQ ID NO: 132862 - DNA, 480 bp, Artificial Sequence
  Description of Artificial Sequence: Synthetic coding sequence
atggcaggcgaaaaggtggaaaagcccgacacgaaagagaagaagcctgaagccaagaaggtggacgctggcggtaaggtgaaaaagggaaatctgaaggcaaaaaagcctaagaaaggcaagccacactgcagtaggaatccagtgctggtcagaggtatcggtaggtactcccgaagcgctatgtattccaggaaagctatgtataagcggaagtactcagccgctaagtctaaagtggagaagaaaaagaaggaaaaagtgttagctacggtgacaaaaccagtgggtggagacaagaacggtggcacgagggtggtcaagctgagaaagatgccaaggtattatccaacggaagacgtgccccgcaaacttctgtcacacgggaaaaagccattttctcagcatgtgcggaaattgcgggctagcattacgccaggcaccatcctaataatcctgaccggccggcaccgcggctag

SEQ ID NO: 132863 - DNA, 345 bp, Artificial Sequence
  Description of Artificial Sequence: Synthetic coding sequence
atggctggcgagaaagtcgaaaagccggacactaaggaaaagaaacccgaagcaaaaaaggtcgacgccggcggaaaagttaagaagggcaatttgaaagccaaaaagccaaagaagggcaagcctcattgttcaagaaatcccgtactggtacggggtattgggaggtactcaagatctgccatgtattctcggaaagctatgtataagagaaaatattcagccgccaagtccaaagtcgagaaaaaaaaaaaggaaaaggttctggccaccgttacaaagcctgtggggggagacaaaaacggtggaacacgtgtggtcaaactgaggaagatggtccgatag

SEQ ID NO: 132864 - DNA, 345 bp, Artificial Sequence
  Description of Artificial Sequence: Synthetic coding sequence
atggctggcgagaaggtggagaaaccggatacgaaagaaaaaaagcctgaagctaagaaagtggatgcagggggcaaggtcaagaaaggcaatcttaaggccaagaaaccaaagaagggaaagcctcattgtagccgtaaccccgtgctggtgcggggaatcggcagatatagtagatccgctatgtacagtcgaaaagcaatgtataaaagaaagtacagtgcagctaaatccaaagtggagaaaaagaaaaaagagaaagtcctggctaccgtgactaagcctgtcggcggagataaaaatgggggaacccgcgtggtaaaactgagaaagatggtacgctag

SEQ ID NO: 132865 - DNA, 747 bp, Artificial Sequence
  Description of Artificial Sequence: Synthetic coding sequence
atggagggcgttgaggaaaagaagaaagaggttcccgccgttcccgaaacacttaaaaagaaacgcaggaattttgccgagctcaaaatcaagcgcctgaggaaaaaattcgcgcagaagatgttacgcaaagcgcgtagaaagctgatctacgagaaggccaagcactaccacaaggagtatagacagatgtataggacagaaatccggatggccagaatggctagaaaggctgggaatttctatgtgcccgcggagccgaagctggccttcgttatccggatacggggaattaacggcgtttcgccaaaagtgaggaaagtcctccagctgcttcggctgagacagattttcaacggcacgttcgttaaactcaacaaggcgagtattaatatgctgaggattgttgagccctacatcgcttggggctaccccaacctgaaatcggtcaacgagctgatctacaaacgcggctacgggaaaataaacaaaaaacgaattgcgctaacagacaatgctctgatcgcaaggtcactgggaaagtatggcattatctgcatggaagatttgatacatgagatttacaccgtggggaaaagatttaaggaagcgaataacttcttatggccattcaaactgtcttcccccagagggggtatgaaaaaaaaaaccacccactttgtggaaggcggggatgctggaaacagagaggatcaaatcaacagactgattcgaaggatgaattag

SEQ ID NO: 132866 - DNA, 456 bp, Artificial Sequence
  Description of Artificial Sequence: Synthetic coding sequence
atggccccactgtatcaagcggcaggcaaaggggatgtaccaaccaagaggccgcctgttctaagagctggggttaacaccgtcacaaccctagtggagaataagaaagcccagttggtggtaatagcccacgatgttgaccctatcgagcttgtggttttcttgcccgccttatgcagaaagatgggtgtgccatactgcattatcaaaggcaaagcacgcctgggcagactggtgcacaggaaaacatgtaccacagtggcgttcactcaggtcaatagtgaggataagggggccctggccaagcttgtagaggcaattcggacgaattacaatgacagatatgacgagataaggcggcattggggcgggaatgtattaggacccaagtccgtggcccggattgcgaagctggaaaaggctaaggccaaagagttggccactaaattgggttag

SEQ ID NO: 132867 - DNA, 801 bp, Artificial Sequence
  Description of Artificial Sequence: Synthetic coding sequence
atgcccaaaggaaagaaggctaaaggcaaaaaggttgccccagctccagcagtggtgaaaaagcaggaagccaaaaaggttgtgaatcccctcttcgagaaacgccctaaaaatttcggaatcggacaggacatacaacccaaaagggacctgactcgcttcgttaagtggccccggtacattcgactgcagagacagcgcgcaattttatataaacggctgaaggtgccacctgctataaaccaattcacacaggctctggaccggcagaccgccactcaactactgaaattggctcacaaatacaggccagagacgaaacaggagaagaaacagaggttgctcgcccgcgccgaaaagaaagcggccggtaagggcgacgtgcctactaagcggccacccgtcctgcgggccggcgtgaataccgtgactactctcgttgagaacaagaaagctcagttggtcgttattgcgcatgatgtcgatcccattgagttggtggtcttccttcccgcactttgcagaaaaatgggtgttccttattgtattattaagggcaaggcacggctgggcaggttggtacatcgtaaaacatgcacaacagtggcttttacacaagttaatagcgaggataagggagcgctggccaagttagtggaagccatccggacgaactacaatgaccggtacgacgagatccggcgtcactggggaggcaatgtactggggccgaagagcgtcgcccgtattgccaagctggaaaaagccaaagcaaaggagctggcaaccaagctgggctag

SEQ ID NO: 132868 - DNA, 576 bp, Artificial Sequence
  Description of Artificial Sequence: Synthetic coding sequence
atgcttgtgcggctcaacgtacgctgcagttgtagaggcgtggtgctgggcgggtgtcggaaactgctggcctccctggttcagcccaagggaaaaaaggcaaaaggcaagaaggtcgcacccgccccagcagttgtcaagaagcaagaagcaaaaaaagtcgtcaatcccctgtttgagaagcggcccaaaaatttcggtatcggtcaggatatccagccgaagcgagatctgacacggttcgtcaagtggccccgatacatccgactgcagcggcagcgggctatcctctataagagacttaaggtgccgcctgctatcaatcaattcacacaggccctcgaccgacagaccgctacgcaactgcttaagctggctcacaaatatcgcccagagactaaacaagagaaaaaacaaagacttttagctagggccgagaagaaggcagcaggaaagggcgacgttcccactaaacggcctcctgtgctgagggccggagtaaatacagtaacaaccctggtggagaataagaaagcccaactggtcgtcatagcccacgacgtcgaccctatatag

SEQ ID NO: 132869 - DNA, 774 bp, Artificial Sequence
  Description of Artificial Sequence: Synthetic coding sequence
atgggaagagtcataagaggccaaaggaagggcgctggatctgtttttcgtgcccacgtcaaacaccggaagggggccgcccgtcttcgggctgttgacttcgcagaaaggcatggatacattaaaggtattgtgaaagatatcatacacgatcccggcagaggggcccccctggccaaggttgtcttccgcgatccttataggttcaagaagaggactgaactcttcattgccgcagaaggaattcatacagggcagtttgtctactgtggtaagaaggcccaactgaatattggaaatgtgctccctgtgggaactatgccagaagggaccatagtgtgctgtcttgaagagaagccaggggatcgcggtaagttggcacgggcaagtggtaattacgcgacagtgatctctcataatccagaaaccaagaaaacccgcgttaaactaccaagtggctccaagaaagtgatttcctcagcaaaccgggcggtggtcggggtcgtggctggaggagggcgaatcgacaagccaattttgaaggctggacgcgcctaccataagtacaaggcaaagagaaattgctggccacgggtgaggggggtggccatgaacccagtggaacatccttttggaggggggaaccatcaacacattggcaagccctcaaccatccggagagatgcccccgccggtcggaaagtagggttaattgctgccaggaggaccgggcggttgcgcggcactaagacggtgcaggaaaaggagaactag

SEQ ID NO: 132870 - DNA, 774 bp, Artificial Sequence
  Description of Artificial Sequence: Synthetic coding sequence
atgggcagagtgattcggggacagcgcaagggcgctggctctgtgttcagggcccatgttaagcacaggaaaggggcagcaagactgagagctgttgatttcgctgagagacacggatacatcaaaggcattgtgaaagatattatacacgaccctggccgcggtgctcccctcgcgaaggttgtctttcgagatccatacagatttaagaagagaaccgaactcttcattgctgctgaaggtattcacactggtcagttcgtatattgtggcaaaaaagcgcaattaaacattggaaacgtcctgccggtaggaacaatgcccgaaggcacgatcgtttgctgcctggaggaaaaacccggcgacagaggaaagctcgcacgtgcatcaggcaattacgccacagtcatttcacataaccccgaaaccaagaagacacgggtcaagctgccaagcggttctaaaaaagtgattagctccgcaaaccgcgccgtggtcggggttgttgccggtggcggtaggatcgacaaacctattctgaaggctgggagggcttaccacaagtacaaagcaaagaggaattgttggccccgggttcgcggagtcgccatgaatcccgttgagcatccgtttggtggcgggaaccaccagcacatcggcaagcccagcacaattagacgcgatgcgcctgcaggccgtaaggttggcctgattgccgcacggcgaaccggacgcctacgcggcaccaaaaccgtgcaagagaaggaaaattag

SEQ ID NO: 132871 - DNA, 579 bp, Artificial Sequence
  Description of Artificial Sequence: Synthetic coding sequence
atgaagacaatcttgtctaatcaaaccgtggatatccctgagaacgtggatattacgctgaagggcaggacagtcatcgtcaagggacccagaggaaccctccgccgggactttaatcatattaatgtggaactgtcactgctgggtaaaaagaaaaagagactgagagtggataaatggtggggtaacaggaaagagttggccacagtccggactatatgctcccatgtacaaaatatgatcaaaggcgtgaccttgggattcagatacaaaatgaggtcagtgtacgcccattttcccattaatgtcgtcattcaggaaaacggctctcttgtggaaattcgcaatttcttaggtgaaaaatatattcgacgggttcgtatgagaccaggtgtggcctgttccgtgtcacaggctcagaaagatgagcttatcctcgaaggcaacgacattgaactggtctccaactccgcagcactcattcaacaagctactacagtcaagaacaaggatatacgaaaatttctggacggcatatatgtgtcagagaagggcaccgtgcagcaggccgatgaatag

SEQ ID NO: 132872 - DNA, 444 bp, Artificial Sequence
  Description of Artificial Sequence: Synthetic coding sequence
atgaagactatcctttctaaccaaacagtcgacatcccggagaacgtcgacattaccttgaagggacggactgtcattgtcaaagggccacgcggtacgctgcgacgcgacttcaaccacattaacgtcgagctgtctttactcggcaagaaaaaaaaacgcctacgggttgataagtggtgggggaataggaaggagttggccactgtgagaacaatctgttctcacgtgcagaacatgataaagggggtaaccctgggctttagatataaaatgcgaagtgtgtatgcacacttccctattaatgtggttattcaggagaacggtagcctggttgaaatcagaaattttttaggagagaagtatatcagaagagttcgcatgagacctggtgtggcgtgttttaagttctctggctttgactcagcctcacataactcatag

SEQ ID NO: 132873 - DNA, 579 bp, Artificial Sequence
  Description of Artificial Sequence: Synthetic coding sequence
atgaaaactatactgtccaaccagacagttgacatcccagaaaatgtggatataaccttgaaggggagaaccgtgatcgttaagggtcctcgggggaccctcagacgcgacttcaaccatattaacgtcgagttaagtctgctgggcaaaaagaaaaagcgcctgcgcgtggacaaatggtggggcaaccggaaagagttggccactgttcgcaccatctgcagccacgtccagaatatgatcaagggcgtgactttaggtttccgctacaaaatgcggagcgtctacgcgcactttcccattaacgtggtgatacaggaaaacggatcactggtagagatacgcaatttcctcggcgagaagtatattagacgcgtccgaatgcgccccggcgtggcttgctctgtgagtcaggctcagaaggatgagttgattctggaggggaatgacattgagctggtgtctaatagtgccgccctgatccaacaggcaacaaccgtgaagaataaggatattcggaagttcctcgatggaatttacgtgagcgaaaaggggacggtccagcaggctgacgaatag

SEQ ID NO: 132874 - DNA, 501 bp, Artificial Sequence
  Description of Artificial Sequence: Synthetic coding sequence
atgaagaccatcctatctaatcaaacggtggatattcccgagaacgtggatataacattgaagggacggaccgtcattgtgaagggcccaaggggaactctacgacgtgacttcaaccacatcaacgtggagctgagcctccttggcaagaaaaaaaagaggcttagagtggataagtggtgggggaataggaaggagctcgccacagtgaggaccatttgctcccatgtacagaacatgattaaaggagtcactctgggattcagatacaagatgagatctgtctatgcgcattttccgataaatgtagtgatccaagagaatgggtctctagtcgaaatcagaaactttcttggcgagaagtacatccggagggttagaatgcggcctggcgtggcctgttccgtctcacaggcccaaaaggacgagctgatactggagggcaatgatattgaactggtatccaacagtgccgcattaattcaacaggccacaacttag

SEQ ID NO: 132875 - DNA, 498 bp, Artificial Sequence
  Description of Artificial Sequence: Synthetic coding sequence
atgctcatgccaaaaaaaaatcgcattgccatatatgaactgctgttcaaggagggcgtgatggtagccaaaaaagacgtgcatatgcccaagcacccagagttggctgacaagaatgttccaaacctgcatgtaatgaaggcgatgcagtctctcaagtctagaggttacgtgaaggagcagtttgcctggagacacttctactggtacttaacaaatgagggtattcaatacctccgggattatttgcatctccctccggagattgtgcccgctacactccgtaggagccgaccagaaacaggaagaccgcggccaaaagggctcgagggagagaggcctgcaaggctcacccgcggtgaggcagaccgggacacttatagaaggagtgcagtccctcctggcgccgacaagaaggcagaggcaggagcagggagcgctactgagtttcagtttcgaggcggctttggccgcggcagaggccagcctccccagtag

SEQ ID NO: 132876 - DNA, 477 bp, Artificial Sequence
  Description of Artificial Sequence: Synthetic coding sequence
atggcggacattcagacggaaagagcttatcaaaaacagcccacaatctttcagaacaagaagagggtcctgttgggcgagaccggtaaagaaaagcttccacgatattacaagaatattggcctgggatttaagaccccaaaggaagctattgaaggtacctatattgataaaaaatgcccattcactggaaacgtgagcatcagggggagaatactgtccggcgttgttactaaaatgaagatgcagcgcacaatcgtgatcagacgcgattaccttcactacatccgcaagtacaaccggtttgaaaaacgccataaaaatatgtccgtccacctctccccttgctttagggatgtccagatcggcgacatagtcaccgtcggcgagtgtcggcccctgtccaagaccgtgagatttaacgtgctgaaggtgactaaagccgctggaaccaaaaagcagttccagaaattctag

SEQ ID NO: 132877 - DNA, 423 bp, Artificial Sequence
  Description of Artificial Sequence: Synthetic coding sequence
atgacaagcatgacccagtcccttagggaggtgataaaggcgatgacgaaagctcggaacttcgaacgggttttgggcaaaattactctggtatcagccgcccccggcaaagtgatctgcgaaatgaaagtggaagaagagcacacaaacgccatagggacgctgcacgggggtctgacggccactctggtggacaatatcagtaccatggcccttctctgtactgagcggggagccccaggggtgagtgttgatatgaacatcacctatatgagcccagccaagctgggagaggacatagtcatcacagcgcatgttctgaaacaaggcaaaaccctcgcatttacatcagtagacctgactaataaagccaccggtaagctgatcgcccaaggtagacatactaaacatttgggcaattag

SEQ ID NO: 132878 - DNA, 456 bp, Artificial Sequence
  Description of Artificial Sequence: Synthetic coding sequence
atgggacgaatgcatgcccccggtaagggtctttctcagtctgccctgccttacagacgctccgtgcctacctggcttaaattgacttcggacgacgtcaaggagcagatatacaagctagctaaaaagggactcacacccagccagatcggcgtgatcttacgcgactcccacggagtggctcaggtgagatttgtgaccgggaacaagatactgagaatcctgaagtctaagggcttagctccggacctccccgaagacttgtaccacctcattaagaaagctgtggccgtacggaagcaccttgaacggaatcggaaagacaaggacgctaaattcagactgatactgattgagagccgcattcatcgcctcgcacggtactataagacaaagcgggtgttgccgcctaactggaagtacgaaagcagcacagcttcggccttagtggcctag

SEQ ID NO: 132879 - DNA, 456 bp, Artificial Sequence
  Description of Artificial Sequence: Synthetic coding sequence
atggccccccgcaagggcaaggagaaaaaggaagaacaagtgattagtctgggaccccaagttgcagagggggaaaatgtcttcggcgtctgccatatcttcgcatccttcaacgatacgttcgtgcacgtgacagacctctctgggaaggaaaccatctgtcgcgtcaccggtggtatgaaagtgaaggcagaccgagatgagtcttccccctatgccgccatgctggcggcacaggacgtggcccagaggtgtaaggagctggggatcaccgcattacacattaagctgagagctacagggggaaaccggacgaagacccccggtcccggcgcccagtcagcacttcgagccctcgcccgctctggtatgaagatcgggcgcatcgaggatgtcacacctatcccctctgactcaactcggcgaaagggaggccgccggggcaggcgcctctag

SEQ ID NO: 132880 - DNA, 456 bp, Artificial Sequence
  Description of Artificial Sequence: Synthetic coding sequence
atggcacctaggaaagggaaagagaagaaagaagaacaggtgatatcactgggtcctcaggtagctgagggtgagaacgtgtttggagtatgtcacatctttgcctcctttaacgatactttcgtccacgtcacagatctctctggtaaggagacaatatgtagagtcacgggagggatgaaagtgaaagcggaccgcgatgagagtagtccatacgccgcaatgctcgccgcccaggacgttgctcagcgctgcaaagagttgggaattaccgccctccacatcaagctgcgcgccacaggaggaaataggacgaaaacccccgggccaggcgcacagtccgcattgcgggcactggcccggagcggcatgaaaatagggcggatcgaggatgtaacacctatcccctccgattcaacccggcgaaaaggggggcgccgaggacgccggttgtag

SEQ ID NO: 132881 - DNA, 456 bp, Artificial Sequence
  Description of Artificial Sequence: Synthetic coding sequence
atggcccctcgcaaaggcaaagaaaaaaaggaggagcaggtcatttccttgggcccccaagttgctgagggcgaaaacgttttcggggtctgtcatatcttcgcctccttcaacgacacattcgtccacgttaccgacctttcgggcaaggaaaccatctgccgagttacaggcggtatgaaagtcaaagctgaccgtgacgaatcatccccatacgccgcgatgctggcagcacaggatgtggctcagcgatgcaaagaactgggcataaccgccctgcatattaagttgagggcaaccggaggcaaccggacaaagactccaggccccggagcccagtccgccttacgggccctcgcgagaagcggcatgaaaattggcaggatcgaagacgttactccgattccttctgactctaccagaaggaagggcggaagacgcggtcggcggctgtag

SEQ ID NO: 132882 - DNA, 456 bp, Artificial Sequence
  Description of Artificial Sequence: Synthetic coding sequence
atggccccgaggaaaggcaaggagaagaaggaggagcaggtgatcagccttggccctcaggtggctgaaggtgagaacgtctttggcgtgtgccatatctttgcttcttttaacgataccttcgttcacgtcacagacttatctggcaaagaaaccatctgcagggtaaccggggggatgaaggttaaagccgaccgcgatgagtctagcccttacgcggctatgctcgccgctcaggacgtcgcacagcgttgcaaggaattgggtatcaccgcactccacattaagctaagggctacgggcggcaaccgcaccaaaaccccaggcccaggggctcagagcgccctgcgtgccctggctcggtctggaatgaaaattggacggattgaggacgtcacacccatcccatccgattcaacacgcagaaaaggcggacgccggggaaggcgtttgtag

SEQ ID NO: 132883 - DNA, 6912 bp, Artificial Sequence
  Description of Artificial Sequence: Synthetic coding sequence
atggccagctctgtcgctccatatgagcagttggttcggcaggtcgaggctcttaaggctgagaactcccatttaagacaggaactgcgcgataactcaagccatctcagtaaactcgagactgaaaccagcggaatgaaggaggtgcttaagcatctgcagggaaaactggaacaggaggcacgagtgctggtgagctccggacagactgaggtgctggagcaactcaaagccctgcaaatggatatcacgtccctatacaacctcaagtttcaaccccctactctaggtcccgaaccggcagcccgtacccctgaaggtagtccagttcacgggtcgggtccgagtaaagattcttttggcgagctgagccgcgccacaatcagactcctagaagagctggatagagagcgttgtttcctgctgaatgagattgagaaggaagagaaagagaagttgtggtactattcacagctccagggcctcagcaagaggctcgacgagctccctcacgtggagacccaattcagcatgcagatggatctgatcagacagcagctggaatttgaggctcaacacatcaggtccctgatggaagagagatttggaaccagtgacgaaatggttcagcgtgcccagatcagggcttccaggctggagcagatcgacaaggagttattagaagctcaggacagagtgcagcagacagagcctcaagcccttctggctgtaaagagtgtccctgtggacgaagaccccgagaccgaagtgccaacacaccccgaagatgggaccccacagccggggaacagcaaagtggaagttgtgttctggttgctcagtatgttggctacacgagaccaggaagatactgcgcggactcttctcgctatgtcctctagtccagaatcatgcgtggcaatgaggcggtctggctgcctgcctctcctattacaaattttgcacggcaccgaagccgcagccgggggtcgtgcaggcgccccaggagctcccggcgctaaggacgccagaatgcgagcaaacgctgccctccacaatattgtgttctcacagcctgatcaggggttggctcgcaaggagatgcgggtgcttcatgtactcgagcagataagggcatattgtgagacatgttgggattggctccaagcgcgcgatggaggtcccgaaggcggcggagccggcagcgctccaatcccaatcgaaccccagatttgtcaggccacttgtgctgtgatgaagctttcttttgatgaggaatatagaagggccatgaatgaattaggggggctccaggccgtggccgagctgctgcaagtcgattacgagatgcacaaaatgacacgggatccccttaatctggctttgaggaggtatgctggaatgacactgaccaacctgacatttggcgacgtcgcaaacaaggccactctgtgtgctcgacgcggatgcatggaggccatcgtggcacagttggcaagcgactcagaggaactccatcaggtggttagcagtattttacgtaatctgtcctggcgggctgatattaactccaagaaagtgctcagggaagccgggtctgtgacagctctggtgcagtgcgtcctgcgggctaccaaggaatcaacgctcaaatccgtgctgagcgctctctggaatctttcagcacacagcactgagaataaggctgccatttgccaagttgacggcgcactgggttttctggtgagcactcttacctataagtgccagagcaattccttggccataatagagagcggcggcgggatcctccggaacgtgtcaagccttgtggccactcgtgaggattatcggcaggtcctgcgcgatcataactgtctgcaaacactgttgcagcatctgacatcacattcacttacaatcgtctctaatgcttgtggcacgctatggaacctgagcgctcgttcagccagagaccaggaactgttgtgggatctgggcgccgttgggatgctgcgcaatttagttcactctaaacataaaatgatagcaatgggcagcgctgctgctttgagaaacctgttagctcaccgccccgccaaacaccaggctgctgcaaccgctgtgtcccctggttcttgtgttccatccctctacgttcggaaacagcgggccctggaagcggagctggatgctcgccacctggctcaggcattagagcacttggaaaagcaggggcctccagccgccgaagccgcaactaaaaaacccttacctcctctcaggcacctggatggcctggcccaggattacgcaagcgacagtgggtgttttgatgacgatgatgcgccgtcctctttagcggccgccgctgctacaggagaacccgcgagccctgccgcactgagcctctttctcggctctccctttctgcaaggacaagccttagcaaggacccctccaacgcgacgcggcggcaaagaggccgagaaagataccagcggagaggctgctgtagcagcgaaggcaaaggctaaactggccttggccgtggccaggatagaccagctcgtcgaagacatctctgcactccacactagcagcgacgacagcttttcgctgtcttcaggcgatcccgggcaagaggcaccacgggaggggagggcacagtcatgctctccctgcagggggccagagggcgggaggcgagaagccggttcccgcgcccatccattactccggctgaaagccgcccacgccagtctctccaacgactcacttaattcggggagcgcatccgatggctactgccctcgggaacacatgctcccatgccctcttgctgctctggcttccaggcgtgaggatccgcgatgcgggcagccgcgaccatccagactggacttggatctgcctgggtgtcaggccgagccgcccgcccgcgaagcgacctctgccgatgctcgtgtcagaactatcaagctaagtcccacctaccagcacgtccctctgcttgaaggcgccagtcgcgctggtgcggagcctttggctggtcccggcatcagccctggcgcccggaagcaggcatggctaccagccgaccatctctctaaggtgcctgaaaaactcgctgctgctcccctctctgtagccagcaaagccctccaaaaattagccgcccaggaagggccattgtctcttagccgctgctcatctctgtcctcactgagctccgctggcagacccggaccgagtgaggggggggaccttgacgattctgattcttctctcgagggattagaagaagccggacccagtgaggctgaactggactcaacttggcgcgcccctggggctacatccctccccgtagccatcccggcacctagacggaaccgcggaagaggcctgggtgtcgaggacgccaccccatcctcatccagtgagaactatgtccaggagaccccgctggtcctgtcccgctgttctagcgtgtcttccctgggatccttcgaatccccgtctatcgccagtagcattccatccgagccctgctctggacaggggtcagggaccatctcaccatccgaattgccagactcgcctggccaaaccatgccaccatctagatccaagacgcctcccctagctcctgcacctcaaggcccgccagaggccactcaatttagtctccagtgggagtcctacgtgaaacgcttcctggacatcgctgactgccgggaaagatgccgcctcccaagtgaactggacgcagggtccgtacgctttacagttgagaagcctgatgaaaacttctcatgtgcctcaagcctttctgcactcgcactgcatgagcattatgtacagcaggatgtggagctgaggttactgccctccgcctgtcctgagcgcgggggcggcgccggcggcgccggactgcatttcgccggccatcggcgaagggaagaaggcccagcccccaccggctctcgaccgaggggtgctgccgaccaagagctggagctcctgagagagtgtctgggcgctgccgttcctgcccggctgcggaaggtcgccagcgccctggtgcctggccgccgggccctgcccgtccctgtctacatgttggtgcctgctccggcccctgcccaggaggatgacagttgtaccgattcggctgaggggacacctgtgaacttctcttccgctgcctcgctgtccgacgagacgctgcaaggtcctccgagagatcagcccggagggccagcagggcgccaacgacctacagggcgacctacaagtgcccggcaggctatgggacatcggcataaggccggtggggcagggcggtcagccgagcaaagtagaggagcggggaagaatagagccggactggagttgcctctgggcaggccaccaagtgctccggcagataaggatggaagtaaacccggtcgaaccaggggtgacggagccctgcagagcctttgcttgaccacaccaactgaagaagccgtgtactgcttctacggaaacgacagcgacgaagagccaccagcagccgctcctacccctacccatcgacggacaagcgccattccccgcgccttcaccagagaacgccctcaaggtaggaaggaagcccccgccccatctaaggcggcacctgctgcaccacctcccgcacgtactcagccaagtctgatcgcagatgagacgcccccctgttattctttgtcaagctccgcatcgagcttgtctgaacctgagccctctgaaccgcccgccgtgcatcccagaggaagggaaccagcggtaaccaaagacccaggcccaggagggggtagggacagtagtccctctccaagagccgcggaagagctactgcaacgctgtatctctagtgcgctgcctcgcagacgacctccagtgtcaggattaagacggaggaagcctcgtgctacccggctggacgaacgccctgcagagggttcgagggaaaggggagaagaagctgccggcagcgaccgcgcatctgaccttgacagtgttgagtggcgggccattcaggaaggggcaaactccattgtaacctggcttcatcaggctgccgctgccacacgggaggcatcctctgagagcgactctatactgagctttgtctccggattatctgtgggttcaacactgcaaccacctaagcaccgtaaggggaggcaggccgagggggaaatggggtccgcccggaggcccgagaaaaggggcgcagcgagtgtcaagacctctggatccccccgctcccctgcggggccagaaaaacccagaggcactcagaagaccaccccaggagtacccgctgtgctgcgagggcgtaccgtaatttacgttccttcacccgcccccagggcccagcctaagggtacccctggtcctagagccaccccccgcaaggtggcgcccccatgcctggcccaacccgctgcgccggcgaaagtgccctcacctggacagcagagaagcagatctctgcatcgacccgctaagacttccgagctcgccacactcagccagccccctagatcggctaccccacccgcccgcctggcaaagactccctcttcctcgtcaagccagacgtcccccgcgagtcaacctctgccccgaaaaagaccacctgtcacccaagcagctggtgcgttgccaggcccaggagcctctccagtaccaaaaacgccagctcgcactctcttggctaagcagcacaagacacagcggagccctgtgcgcataccatttatgcagcgccctgccaggcgcgggccacccccattggcccgtgccgttccagaaccaggacctcgtggcagagccggcacagaggccggacccggggctagaggcggtagacttggcttggttcgcgtcgccagtgctttaagctctggttctgagagctctgatcgttctgggttcagacggcagctgaccttcatcaaggaaagccctggactgagaaggcgacgctccgaactgtcgagtgcggaatcagctgctagtgcaccccagggcgcttcgccccgccgcgggaggcctgcactgcctgctgtgttcctgtgcagtagccgatgcgaagaattaagagcggcacctaggcagggaccagcacccgcccgtcagagacccccagcggcacgaccgtctcctggtgagcgacctgccagacgcaccacttctgaaagccctagccgcctcccagttagagcgccagccgcccgccccgaaacggttaagcgctatgcttctttgcctcacatctccgttgcaagaaggccagatggcgctgtaccagcagcaccagcttctgctgatgcagctagaaggtcatccgacggcgagccaagacctctccctcgagttgctgcacccggaaccacttggaggagaatacgagacgaagacgttccccacatactcaggagcactctcccagcaacagctttgcccctgcgcggctccacaccagaagatgcccccgccggaccacctcctcgaaagacttccgatgcggtggtccaaaccgaggaggtggcagctcccaaaaccaactcttccactagtccgagcctggagaccagagagcccccaggagcaccagccggcggacagctgtctctcttaggatccgatgtagatgggccgtctctcgctaaggcaccgatttccgcacctttcgtgcatgaaggtctgggcgttgccgttgggggcttcccagctagcagacacggctccccctcaaggagcgccagggtcccaccattcaactacgtgccctcccccatggtggtcgctgccactaccgactctgctgccgagaaagctcctgcaaccgctagcgctactctgttagaatag

SEQ ID NO: 132884 - DNA, 438 bp, Artificial Sequence
  Description of Artificial Sequence: Synthetic coding sequence
atggctgaggtcgagcagaaaaaaaagcgcacgttccggaagtttacatacaggggcgtggacttagatcaattactggatatgagttacgaacaattaatgcagctgtattcggccaggcagaggcggcggcttaatagagggctacgccggaaacaacatagccttctgaaacgcctgcggaaagctaaaaaggaagcccctccaatggagaagccagaggtggtgaaaacccacctcagagatatgatcattttaccagagatggttggtagcatggtgggggtttacaatggaaaaactttcaaccaggtggaaattaagcctgaaatgattggacactatctgggagaattttccattacctacaaaccagtcaagcacgggcgcccaggaattggagccactcactcttcccgatttattcctctcaagtag

SEQ ID NO: 132885 - DNA, 393 bp, Artificial Sequence
  Description of Artificial Sequence: Synthetic coding sequence
atggtgcggatgaatgtcctggctgacgcgctgaagagcatcaataatgccgagaaaaggggcaagaggcaggttctgatccgcccttgctcgaaagtcattgtgagattccttacagtgatgatgaagcatggctacatcggagagttcgaaattatcgatgatcaccgggccggcaaaatcgtcgtaaacttgaccggacgtctcaacaaatgcggcgtgatcagtcctcgctttgatgtgcaactgaaagaccttgagaagtggcaaaataatctcctgccgagtagacaattcggtttcattgtgttgaccactagcgcaggcattatggatcacgaggaggctcgcagaaaacatacgggtgggaaaatcctcggattcttcttctag

SEQ ID NO: 132886 - DNA, 393 bp, Artificial Sequence
  Description of Artificial Sequence: Synthetic coding sequence
atggtgaggatgaacgtgctcgcagacgccttgaaatcaatcaacaatgccgagaagagaggaaaacggcaggtgctcatcaggccttgtagcaaggtaatcgttcgcttcctgacagtcatgatgaagcatggttatattggtgagtttgaaatcattgatgaccacagagcagggaagatcgtggtgaatctgactggccgccttaacaagtgcggtgtgatcagcccccggttcgacgtccagctaaaagatctggagaagtggcaaaacaatctccttcctagtagacagttcggatttattgtgttaacgacatctgcaggaatcatggaccatgaggaagccaggcgtaagcataccggaggcaagatccttggcttcttcttttag

SEQ ID NO: 132887 - DNA, 441 bp, Artificial Sequence
  Description of Artificial Sequence: Synthetic coding sequence
atgccctcaaagggtccattacaaagcgtacaggtttttggacggaagaagacggccactgcggtggcacactgtaagcgcggtaacggcttaatcaaggtgaatggtaggcctctcgagatgatcgagccccgaacccttcagtacaagctactcgagccagtgttgcttctgggcaaggaacggtttgccggcgtggacatcagagtgcgagttaagggcggggggcacgttgcccagatctacgccatcaggcaaagcatcagtaaggccctcgttgcctattatcagaagtacgtcgacgaagctagcaagaaggagattaaagatattctaatccaatacgatcgaacactgctcgtagcggaccccaggagatgcgagtctaaaaaatttgggggccctggtgcccgggcaagatatcagaaatcatacaggtag

SEQ ID NO: 132888 - DNA, 459 bp, Artificial Sequence
  Description of Artificial Sequence: Synthetic coding sequence
atgccgagcaagggtcccctgcagagtgtacaggtgtttgggcggaaaaagacggcgactgccgtagcccactgtaaaagaggcaacgggctgatcaaagtgaacgggcgacctctggagatgatcgagcccaggacactacaatacaaactgcttgaacccgttctgttattaggaaaagaacgatttgccggcgtggatatccgggtgagagttaagggcgggggccatgtggctcaaatttatggcgagagccaggaactgggcgcttggaggcgatggctgtgggagggcggattacactccgctcctgtgcctttcaactgtgtatctttctcacagctcagcgtgtcaccctcacctaagccatggtggccaattacccggaacatgtggatgcgtctgccacgtcgacgatctaagacctcatccagcagtatgactggaccatgctggtag

SEQ ID NO: 132889 - DNA, 408 bp, Artificial Sequence
  Description of Artificial Sequence: Synthetic coding sequence
atggggcgggtccggaccaaaactgtcaagaaagccgccagggtaatcattgagaaatattacacaaggcttggcaatgattttcataccaacaaacgcgtttgcgaggaaatagcaatcattccatcaaaaaagctgcggaataagattgccggttatgtgacacatctgatgaagcgaatccaacgagggcctgtgagaggtattagcattaagctccaagaggaggagagagaaagacgggataactacgtgcctgaagtatcggcactggaccaggagataatcgaggtcgaccccgacacaaaagaaatgcttaagcttctagactttggttcactctcaaatctccaggtgacgcaaccaactgtagggatgaattttaagacaccgaggggtccagtatag

SEQ ID NO: 132890 - DNA, 300 bp, Artificial Sequence
  Description of Artificial Sequence: Synthetic coding sequence
atggatctcatcgggtttggatatgcggcactggtgactttcggctctatcttcggatataagaggagaggaggcgtcccctcactgatagccgggctgtttgtgggctgcctagccggttacggcgcatacagggtctccaatgacaaacgggacgtgaaggtctccctgttcaccgctttttttctcgccactataatgggtgtgcggttcaagaggagcaagaagattatgccggccgggctagttgcaggactaagtctgatgatgatcctgcgtctggtactgctcctgctttag

SEQ ID NO: 132891 - DNA, 459 bp, Artificial Sequence
  Description of Artificial Sequence: Synthetic coding sequence
atgtcactggtgataccagagaagttccaacatatccttcgggtgctcaacacaaacatagacggccgacggaagatagctttcgccattactgcgataaagggagtcgggagacggtatgcacacgttgtgctgagaaaggccgatattgatctgacaaagcgtgctggggagctgaccgaagacgaggtcgagagggtgataacgatcatgcagaacccgcgtcagtataagataccagattggtttctgaatcgccagaaggacgtgaaggatggaaagtattctcaggtcctcgcaaacggcctcgacaacaaacttcgcgaggacttagagcgactaaagaagattcgcgcacacaggggccttcggcatttctggggtctgcgtgtgcgcgggcagcataccaagacaactggacggaggggaaggacagtcggtgtcagcaagaagaaatag

SEQ ID NO: 132892 - DNA, 459 bp, Artificial Sequence
  Description of Artificial Sequence: Synthetic coding sequence
atgtccctggtaattcctgagaagttccaacacatactcagagtgttgaatacaaacatagacggccgaaggaagatcgccttcgccatcacggctattaagggggtgggcagacgatatgcacatgttgtacttcggaaggcagacatcgatctgactaagcgagctggtgaattaaccgaggacgaggtggagagggtcataaccatcatgcagaatccaaggcaatataaaatacctgattggttcctgaacagacagaaggacgtaaaagacggaaaatattctcaggttttggcgaatgggctcgataataagttgcgggaagatctcgagcggctcaagaagattcgcgcccatagagggcttcgccatttctggggcttacgagtgcgggggcagcacactaagaccacagggcgcaggggcagaaccgtcggggttagcaaaaagaagtag

SEQ ID NO: 132893 - DNA, 105 bp, Artificial Sequence
  Description of Artificial Sequence: Synthetic coding sequence
atgtccctggttataccagagaaatttcagcacattctgagggtgctgaacactaacatagacggaagacgtaagatcgcattcgcaattaccgcaatcaaatag

SEQ ID NO: 132894 - DNA, 459 bp, Artificial Sequence
  Description of Artificial Sequence: Synthetic coding sequence
atgtctctggttatccccgagaaatttcaacatatcctgcgcgtgctaaacactaacatcgacggacgccgcaaaatagccttcgcaattaccgctatcaagggggtggggcggaggtatgcgcacgtggttctgaggaaagccgatattgacctaaccaaaagggcaggcgaactgactgaggacgaggtggagcgggtgatcactattatgcagaacccaaggcagtacaaaatccctgattggtttctgaaccgacagaaagatgtgaaagacggcaaatacagtcaagtgttagcgaatggcctcgacaacaagctcagagaggacttggagcgcctgaagaagattagagcccacagaggtctcaggcacttttggggactccgagtaagggggcagcacacaaaaacgacaggcagacgcgggcgtaccgtgggcgtatccaaaaagaaatag

SEQ ID NO: 132895 - DNA, 459 bp, Artificial Sequence
  Description of Artificial Sequence: Synthetic coding sequence
atgagcctcgttatcccggagaaatttcagcatatcctgagagtgctcaatactaatatagacggtcgccggaagattgcgtttgctatcacagccataaaaggggtgggcaggagatacgcccacgtggtgttacgtaaggccgacatcgacctcactaaacgggccggcgaactgaccgaagacgaggtcgagcgcgtgattaccattatgcagaatcctcgacagtacaagatccctgactggttcttgaatcggcagaaagacgtgaaagatggaaagtacagccaagtcctcgccaatggacttgataataaattgcgagaagacctggagaggttgaagaaaatcagagcccaccgaggcctccgccacttttggggattgcgagtgcggggacagcacactaaaacaaccggtcggagagggcgcacagtgggagtgagcaagaaaaagtag

SEQ ID NO: 132896 - DNA, 249 bp, Artificial Sequence
  Description of Artificial Sequence: Synthetic coding sequence
atgcagaacccccggcagtataagatccccgattggtttctgaatagacagaaagatgtgaaggacgggaagtatagccaggtccttgcaaacgggcttgacaataaactcagagaagatctcgagcgactcaagaaaatccgtgctcaccgtggcctgagacacttttgggggctgcgagttcgcggacaacatactaaaactactggcagaaggggcagaacggtgggagtttctaagaagaaatag

SEQ ID NO: 132897 - DNA, 249 bp, Artificial Sequence
  Description of Artificial Sequence: Synthetic coding sequence
atgcagaatcctcgccagtacaagatccccgactggtttcttaataggcaaaaggatgtgaaggatgggaagtacagtcaagtactcgccaatggattggataacaagttgagggaggacctggagcgactgaaaaaaatcagagcccaccgcggcctgcggcatttctggggcctgagggtgagaggtcagcataccaagacgacaggacgcagaggccgcaccgtgggcgtgtctaagaagaaatag

SEQ ID NO: 132898 - DNA, 249 bp, Artificial Sequence
  Description of Artificial Sequence: Synthetic coding sequence
atgcagaaccccaggcagtacaaaattcccgactggtttctgaatcggcaaaaagacgtgaaggatgggaagtactctcaggtgttggcaaatgggctggacaataaactgagagaggacctggaacggttaaagaaaatccgcgcccatcgaggcctgcggcatttctggggccttcgcgtgcgggggcagcataccaaaacaaccgggaggaggggccggaccgtcggcgtaagcaaaaaaaagtag

SEQ ID NO: 132899 - DNA, 249 bp, Artificial Sequence
  Description of Artificial Sequence: Synthetic coding sequence
atgcaaaatcctaggcagtataaaataccggattggtttctgaatcgccagaaagacgtcaaggatggaaaatacagccaagtactcgccaatggcctcgacaacaagctgagagaagatctagaaaggttaaagaaaattcgcgcccacagaggactaagacatttttgggggctgcgagtacgcggccaacacacgaagacgacaggtcgccgcggcaggaccgtaggcgttagtaagaaaaagtag

SEQ ID NO: 132900 - DNA, 249 bp, Artificial Sequence
  Description of Artificial Sequence: Synthetic coding sequence
atgcagaatccaaggcagtacaaaattccggattggttcctgaacagacagaaagacgtcaaggacggaaagtactcccaggtactggcgaatggactcgataataagctgcgggaagacctagaacggttaaaaaagatccgtgcccacaggggcctcagacacttttggggactgagagtcagagggcaacacactaagactacaggcaggcgggggcggacagtgggagtttctaagaagaagtag

SEQ ID NO: 132901 - DNA, 648 bp, Artificial Sequence
  Description of Artificial Sequence: Synthetic coding sequence
atgtactcttttatgggaggaggtctattttgcgcctgggtcgggaccattctgctcgtggttgctatggctacagaccattggatgcagtataggctgtctggatcttttgcccaccagggcctgtggaggtattgtctcgggaataaatgttacctacaaaccgactcgattggtgagcctcctggccaggggcctggccgggcatggggcaagtctcgagccgatctcggcgcccaggggcacctgtacagccgctggcggactctgaggctgaaggagggcaagggggccacacaggcatattggaatgcgacccgcgcatttatgattctctctgcactctgcgccatcagtggcattataatgggcatcatggcatttgcccatcaaccaacattcagccgcataagcaggcccttcagcgccggaattatgtttttctcttccactctgttcgtcgtgctggccctggccatctacacaggagtcacagtctcatttctgggacgccggttcggcgattggcgattctcctggtcctacatcctgggctgggtagcggtgctgatgacctttttcgcaggaattttttatatgtgcgcctatagggttcacgagtgccggcggttgagcactccccggtag

SEQ ID NO: 132902 - DNA, 438 bp, Artificial Sequence
  Description of Artificial Sequence: Synthetic coding sequence
atgcctggggtgacagtgaaggatgtgaatcagcaagagttcgtacgagcacttgcagcttttctgaagaaatcaggcaaactgaaagtccccgaatgggtggacacagtgaagctggcaaaacataaggaactagccccatatgacgagaactggttctatacacgagcagcatccactgccagacacctctacctcaggggcggggcgggggtggggagtatgactaaaatctacggcggaagacagaggaacggggttatgccctcccacttctcccgcggttctaaaagtgtggctagacgggtgttgcaagctttagagggcctcaagatggtggaaaaggaccaggatggcggccgaaagttgaccccacagggccagagagatttggaccgcattgcgggccaggtggcagccgccaacaagaagcactag

SEQ ID NO: 132903 - DNA, 411 bp, Artificial Sequence
  Description of Artificial Sequence: Synthetic coding sequence
atgagcgcggcattactgaggagaggacttgagcttttagccgctagtgaggcccccagggaccctcctggacaggccaagcctagaggtgcccctgtgaagcgcccgcgcaaaaccaaggctattcaggcccagaaattgagaaatagtgctaagggcaaagtccccaagagcgcactggatgagtacagaaaaagagagtgtcgggatcacctaagagtgaatctgaagtttctgacccgtacgaggtctaccgtggccgaaagcgtttctcagcaaatcctgcggcagaacaggggtcgtaaagcctgcgataggccggttgcgaagacaaaaaaaaagaaggccgaaggtaccgtgtttactgaggaagactttcagaagttccaacaggagtactttggatcatag

SEQ ID NO: 132904 - DNA, 882 bp, Artificial Sequence
  Description of Artificial Sequence: Synthetic coding sequence
atggccgatgatgcaggggcagccggagggcccggaggcccaggcgggcctggcatgggaaacaggggtggcttccgcggcggcttcggctcaggtattcgtggacgcggcaggggccgtggccggggccgaggacggggtagaggggctagaggcgggaaagctgaggacaaggagtggatgccagtcacgaaacttgggaggctggtcaaagacatgaaaattaagtcactcgaggaaatttatctattcagtttgcctataaaagagtcggagataattgacttcttcctgggcgctagcctgaaagacgaagtgctgaaaattatgccggtgcagaagcagacgcgtgcgggacagaggacaaggttcaaggcttttgtcgccatcggcgattacaatggacacgtgggactgggtgtgaaatgtagtaaggaagtagcaactgcaatccggggcgcaattatcctggccaagctgagcattgtgcccgtacgtagaggctattggggcaataagatcggcaaaccccataccgtgccctgtaaagtcacaggtcgctgtgggtccgtgttggtgcggctgatccccgccccccgtggtacaggaattgtatcagccccagttcctaaaaaactcctcatgatggccggcatagatgactgttacacatccgccagaggatgcaccgcaacactgggcaactttgccaaggcgactttcgacgccatttctaagacctattcctacctcaccccggatctgtggaaagagaccgtgtttacaaaaagcccttaccaggagttcaccgatcatctggtgaaaacccatactagggtgtctgtgcagcgaacacaggcgcctgcagttgctactacatag

SEQ ID NO: 132905 - DNA, 708 bp, Artificial Sequence
  Description of Artificial Sequence: Synthetic coding sequence
atggccgatgatgctggagcagccggaggccctggcggacccggcggcccaggcatgggtaaccgtgggggtttcagagggggattcgggtcaggaatcaggggcaggggacgcggcagaggccgcggaagaggccgcggacggggcgctaggggaggtaaggcggaggacaaggagtggatgccagtgacaaaacttgggcgtcttgtgaaggatatgaaaataaagtccctcgaggagatctatctgttttcgttgcctatcaaagaatcggagattatagacttcttcctgggcgcctccctcaaggatgaagtcctgaaaattatgccagtgcaaaagcagactagagcagggcagcggacacgctttaaagttaccggaaggtgcggcagcgtgttggtaagactgattcccgccccaaggggcacagggatcgtgagcgccccagtaccaaaaaagctcctcatgatggctgggatagatgattgctacactagcgcaagagggtgtacagcaacgttaggcaattttgctaaagctacctttgacgctatcagtaaaacgtatagctacctcacccctgacctctggaaggagaccgtgtttaccaagagcccttaccaggagttcaccgaccacctggtgaagacccacactcgagtgtcggttcagcggactcaggcacccgcagtggcaactacttag

SEQ ID NO: 132906 - DNA, 537 bp, Artificial Sequence
  Description of Artificial Sequence: Synthetic coding sequence
atggctgatgatgccggagcagcagggggtcccgggggaccaggaggtccgggaatgggcaataggggaggctttcgggggggattcggtagcggcatccgcggccggggaaggggccgcgggagaggccggggaagggggcgaggcgcgcgcggcggcaaggctgaggacaaggaatggatgcccgtgactaaactcggacgtctggtgaaggatatgaagataaagtcactggaagaaatctacctgttctctctgcccatcaaggaaagtgaaattatcgatttttttcttggagcaagcttgaaggatgaggtgctcaaaattatgccagttcaaaaacagacacgcgctgggcagcgtacacgattcaaagtaccagggtgtcccggcggtggctgcgcagggctagctgggaccttatccgctcttcattcttgcacatggttgcatccttgcgactttaggaatggggagagagagaaacgatcgcctcaggacctggggtgggctctgttgtggccacttttcccctag

SEQ ID NO: 132907 - DNA, 588 bp, Artificial Sequence
  Description of Artificial Sequence: Synthetic coding sequence
gttaccaagttggggagactcgtgaaagatatgaaaatcaagtctctagaggaaatatacctcttcagtctgccgatcaaggcatttgtagccataggggactataatgggcacgtcggactgggggttaagtgcagtaaggaggtcgccacggcgataaggggagcaataattctggcgaaactgtctattgtgccagtccggcggggttactggggcaataaaattggaaaacctcatacagtaccttgcaaggtgacagggaggtgtgggtcagtgctggtgagattaatacccgctccaaggggcacagggatcgtttcagcaccggtgccaaagaaactgctgatgatggcaggcattgatgactgttatacttctgcgcggggttgtaccgccaccttgggaaacttcgctaaagccaccttcgatgccatcagcaagacctattcctaccttacccctgatctttggaaggagactgtctttaccaaatcaccttaccaggagtttaccgatcaccttgtgaagactcacactagggtctccgtgcagcggacccaggcccctgcagttgcgaccacctag

SEQ ID NO: 132908 - DNA, 360 bp, Artificial Sequence
  Description of Artificial Sequence: Synthetic coding sequence
atggccttcaaggatactggtaagacgcctgtagagcctgaagtggccattcacagaattcggattaccctcacgagccgaaatgtgaaatcccttgaaaaagtctgcgctgacttgatcaggggagcgaaggagaagaatctgaaagtgaaaggaccagtgcgcatgcccactaagactctgcggatcaccacaaggaaaaccccatgcggggaaggatctaagacttgggatcggttccagatgaggattcacaagaggctcatagatttacactcacccagcgagatagtcaagcagatcacaagcatatctatcgagccgggagtagaggttgaagtgaccatcgctgacgcctag

SEQ ID NO: 132909 - DNA, 429 bp, Artificial Sequence
  Description of Artificial Sequence: Synthetic coding sequence
atggcctttaaggataccggtaagacaccggtggagccagaggtggctatacaccggatacgaatcaccctgaccagtaggaatgtaaagtcgttggagaaggtgtgtgccgacctgatccgcggcgcaaaagagaagaacctgaaagtcaagggacccgtgcgaatgcccacgaagaccctgcggattaccaccaggaagaccccctgcggtgagggaagcaaaacctgggatagatttcaaatgcgtatccataagcggctgatcgacttgcattcaccaagcgaaatagtgaaacagatcacctcaatttctatcgagcctggcgtagagctgatagagtcaacagatgcagagccgatggatactgagggccaacagtatacactgaggtccgtgtttgagtccccagggacctgcccgttttag

SEQ ID NO: 132910 - DNA, 360 bp, Artificial Sequence
  Description of Artificial Sequence: Synthetic coding sequence
atggccttcaaggatacagggaaaacacccgtagagccagaagtcgcaatccaccgtatcaggatcaccctgacatcacgcaacgttaaaagcttagaaaaggtgtgcgccgatctcatcagaggtgcaaaagagaagaacctgaaggtcaaaggacccgtgcgcatgcctacaaagaccctgcgcatcacaactcgcaaaacgccatgtggtgaggggagcaagacctgggatagatttcagatgagaatccacaaaagacttattgaccttcatagcccaagcgagatcgtgaaacaaatcacatctatttctatagagcccggggtagaagtggaggtgacgatcgccgacgcgtag

SEQ ID NO: 132911 - DNA, 252 bp, Artificial Sequence
  Description of Artificial Sequence: Synthetic coding sequence
atgcagaatgatgccggagaattcgtcgacctctatgtgccgcgcaaatgcagcgcatcaaaccggataataggcgctaaagaccatgcaagcattcaaatgaatgttgccgaggtggacaaggtcaccgggcgctttaatgggcagtttaagacctacgccatctgcggcgcaatccgccgaatgggggaatcggatgacagcatattgcggttggccaaggcagatgggatagtctctaaaaatttttag

SEQ ID NO: 132912 - DNA, 294 bp, Artificial Sequence
  Description of Artificial Sequence: Synthetic coding sequence
atgcaaaatgatgccggcgagttcgtggacctatatgttccgcgtaaatgttcagcctctaacaggatcatcggtgccaaagaccacgctagcattcaaatgaacgttgctcgattaacccggtctcaggctggattaatggcatcactcaagttgatgctgagcgcagggccatttgtcgggtgggtgtcacagatgatcccatttagcgattggccccggcgatggcaccgactgaaggaattgttaactggggaaaatcatcgatgcggcattttcgtgatcaataagtag

SEQ ID NO: 132913 - DNA, 252 bp, Artificial Sequence
  Description of Artificial Sequence: Synthetic coding sequence
atgcagaacgacgccggggaattcgtggacctgtacgtaccacggaaatgtagcgcctccaatagaatcattggagcgaaagatcacgctagcatccagatgaacgtggctgaggttgacaaggtcaccgggaggttcaatggccagtttaagacatacgccatttgcggggctattcggcgcatgggcgaaagtgacgactctattttacgtctggccaaggctgatggaatagtttctaagaatttttag

SEQ ID NO: 132914 - DNA, 201 bp, Artificial Sequence
  Description of Artificial Sequence: Synthetic coding sequence
atgcaaaacgacgcgggcgagttcgtggacctgtatgtcccacgcaaatgtagcgccagcaaccggattatcggcgcaaaagaccatgcgtcaatccaaatgaacgtggctgaggtgtcttgggaaccggggcgccgtgagggatgtgatatctgtgcagggaaggccggctgccctattgttgaggagcctctgggatag

SEQ ID NO: 132915 - DNA, 273 bp, Artificial Sequence
  Description of Artificial Sequence: Synthetic coding sequence
atgcagaacgacgcaggcgagtttgttgatctctacgtgccacgtaagtgctcagcatccaatagaattattggggccaaggatcatgcctccatccagatgaatgtcgccgaggttgataaggttactggcaggttcaacggccagtttaagacctatgccatttgcggagccatcaggaggatggtgagcgtctctttggggtttgctcaccacttcgggacttcatggacactaccatgtgcactcgaatgtgttatggttcccgaatag

SEQ ID NO: 132916 - DNA, 246 bp, Artificial Sequence
  Description of Artificial Sequence: Synthetic coding sequence
atgcagaatgacgccggcgaatttgtggacctgtatgtccctagaaagtgctctgcctccaacaggatcatcggagctaaggatcatgcgagtattcaaatgaatgttgcagaggttgataaagtgaccggccggttcaacggccagttcaagacttatgccatctgtggggctatcaggcgaatgggggaaagcgacgacagtatcctgcgcctggccaaagccgatggcatcgtatccaagtag

SEQ ID NO: 132917 - DNA, 432 bp, Artificial Sequence
  Description of Artificial Sequence: Synthetic coding sequence
atgggaaagtgcaggggactacggacagcaaggaagctgcgttctcataggagagaccagaagtggcacgacaaacagtacaaaaaagcccatttgggaactgcactgaaagctaatcccttcggcggagcgtctcatgccaagggcatcgttctggaaaaagtaggtgtggaagccaaacaacccaacagtgctattcgaaagtgcgttagggtccagctgatcaagaacggtaaaaagatcactgcctttgtgcctaacgatggttgcctgaactttatagaagaaaatgacgaagtactcgtcgccggttttggtaggaagggacatgcagtgggtgacatacctggtgtccgattcaaagtggtgaaagtagcaaacgtgagtctgctagctctgtacaaaggaaaaaaggaacggccacgcagttag

SEQ ID NO: 132918 - DNA, 393 bp, Artificial Sequence
  Description of Artificial Sequence: Synthetic coding sequence
atgaacgacacggttactatcagaaccaggaagttcatgactaatagacttttgcagaggaaacagatggtgatcgacgtccttcaccctggcaaagcaaccgtgcctaaaacggaaatcagggagaaacttgcaaagatgtataagactacccctgacgttatttttgtcttcggctttagaacgcactttggcggcggaaagacgaccggattcggcatgatctacgacagtctcgattacgctaagaaaaacgagcccaaacacaggcttgctagacatggtctgtatgagaagaaaaaaacctccaggaagcaaaggaaggaacggaaaaacagaatgaagaaagtccggggcactgcaaaagcgaatgtgggagccggaaagaaatag

SEQ ID NO: 132919 - DNA, 402 bp, Artificial Sequence
  Description of Artificial Sequence: Synthetic coding sequence
atgaatgacactgtgaccataaggaccaggaaattcatgaccaatagactcctgcagcgcaagcagatggtgatcgacgtgttacacccaggaaaggctacagtcccaaaaacggaaatacgcgagaagctggctaaaatgtataaaacaaccccggatgttatcttcgtttttggatttagaacacattttggggggggcaaaaccacagggttcggaatgatttacgactccctggactatgcaaagaagaatgagcctaagcatcgactcgccagacatgggctctacgagaaaaagaagacctcacgtaaacagcgcaaagaacgcaagaataggatgaaaaaagtgcggggaacagccaaggcaaatgtgggcgctgggaagaagcctaaagaatag

SEQ ID NO: 132920 - DNA, 399 bp, Artificial Sequence
  Description of Artificial Sequence: Synthetic coding sequence
atgaatgacaccgttacgattcgcactcgcaagtttatgacaaaccgcctgctgcaaagaaagcaaatggtgatcgatgtgctgcatcccggaaaagccacagtacccaagactgagattcgagaaaaactggccaagatgtataaaaccacccctgatgttattttcgtgttcggcttccgcacacacttcggcggtggtaagacaactgggttcgggatgatttacgatagccttgactatgcaaagaaaaatgaaccaaagcaccggcttgcccgtcatggcctgtacgaaaaaaagaaaacatctagaaagcagagaaaggaacgaaagaacaggatgaagaaagtccgcggcacagctaaagctaacgtgggcgccgggaagaaacaaaaatag

SEQ ID NO: 132921 - DNA, 396 bp, Artificial Sequence
  Description of Artificial Sequence: Synthetic coding sequence
atgaacgatactgtgacgattaggacccgcaaatttatgacaaatcggctcttgcagaggaagcagatggtgattgacgttttgcatccgggaaaagcaaccgtgcccaaaacagagatccgagagaaactggccaaaatgtataaaacaacacccgacgtaattttcgtattcggctttagaacccactttggcggtggaaagaccaccggatttgggatgatctacgactcgctcgactatgcaaaaaagaatgagccaaagcatagactagcacgccatggactgtatgaaaagaagaagacgtccaggaagcagagaaaggaacgcaaaaaccgaatgaagaaagtgaggggaaccgccaaggccaacgtgggcgctggtaagaagcagtag

SEQ ID NO: 132922 - DNA, 870 bp, Artificial Sequence
  Description of Artificial Sequence: Synthetic coding sequence
atgaatgacaccgtaaccattcgtacgaggaagttcatgactaacaggctccttcagaggaagcagatggtgattgacgtgctgcaccctggcaaagcaactgtcccaaagacagagatccgcgagaagctggctaagatgtacaagacaacacctgacgtgatcttcgtttttgggttcaggacccactttggaggcggcaagacgacaggtttcggtatgatctatgattctctcgattacgcaaaaaagaatgaaccgaagcacagattggcacggcacggcctctatgagaaaaagaagacgtcccgaaaacagagaaaggaacggaagaacaggatgaaaaaagttagaggcacagcaaaggcaaatgtgggggccggaaaaaagatgcgcgaactgggcctgggagttcaagctctggggcgtatatctcaggaggagcgctgtacggatgtaaagaattcaaaagcgcgcgagtccagaggggtcgtctggcaagtcgaagtgccaggtccgtggtccgtgtggacctgtggcagactgaggagggggtgcggtaagtacctacaggtcgcagtgacctggaggaaaaccgagaaccgcgagcagtgttgtcaggcctgcctcctggaaagagctctggtgcgaaacggggccttcatgtcaccagcctcacccgcccccgcagggtctcctcatccggtcgatggcgatctggtccttcatctgccagaggcgctgagcgctacactgactctgtccccacacatacaggcgataaataagtccttcggaccattcttcgagatccatcaggaaagttcatgcttttcgcctcccagttgtttaagcgggctggggcactag

SEQ ID NO: 132923 - DNA, 378 bp, Artificial Sequence
  Description of Artificial Sequence: Synthetic coding sequence
atgccacctaaggacgacaagaagaagaaggacgctggtaaaagtgctaaaaaagacaaagacccagtgaacaagagcggaggcaaagccaaaaaaaaaaaatggagtaaaggaaaagtgagagacaagctgaataacctggtactctttgataaagccacctacgacaaactctgcaaggaagttcccaattataagctgatcacacccgccgtggtgagcgagaggctcaagattcgcggttcactggctagggccgccttacaagagctgctgtcaaaggggctgatcaagttggttagcaaacacagggctcaggtgatctatacacggaacacaaagggcggggacgctcccgcagccggcgaggatgcttag

SEQ ID NO: 132924 - DNA, 348 bp, Artificial Sequence
  Description of Artificial Sequence: Synthetic coding sequence
atgacaaagaaacgtagaaataatggtagggcaaagaagggcaggggacacgttcagcctatacggtgtactaactgtgcacgttgtgtacctaaggataaggctattaaaaagtttgtcatccggaatatcgtggaagcagccgccgttcgggatatcagtgaggccagcgtattcgacgcctatgtgttgcctaaactatatgtcaagctacactactgcgtgagctgtgccatccacagtaaagtggtgcgaaatcggagccgagaagcgcgcaaggatcgcaccccacccccgaggtttaggccagcaggggctgcacccagacccccccctaagcccatgtag

SEQ ID NO: 132925 - DNA, 348 bp, Artificial Sequence
  Description of Artificial Sequence: Synthetic coding sequence
atgacaaaaaaacggcggaataatggccgggcgaagaaaggacgtggccacgtgcaaccgatacgatgcacaaactgcgcccgctgcgttcccaaggataaagctatcaagaaattcgtaatcagaaacattgtcgaggctgctgccgttcgtgacatcagtgaagcctctgtgtttgatgcttacgtcctcccaaaactgtatgtcaagctgcattattgcgtgtcttgcgcgatccattccaaggtggtccgaaatcgcagcagagaagcacggaaggacaggacaccaccaccaaggttcagacctgcaggcgctgcacctcgccctcctccgaaacccatgtag

SEQ ID NO: 132926 - DNA, 255 bp, Artificial Sequence
  Description of Artificial Sequence: Synthetic coding sequence
atgcccttagcaaaagatcttctacacccttcacccgaagaagaaaagagaaagcacaaaaaaaagaggttggtgcagtccccaaatagctattttatggatgtgaaatgccccggctgctataagattacaactgtctttagccacgctcagacagtcgtcctctgcgttggatgcagtactgtgctctgtcagccgactgggggcaaggctcgtttaacagaaggatgcagcttcaggcgcaagcagcactag

SEQ ID NO: 132927 - DNA, 201 bp, Artificial Sequence
  Description of Artificial Sequence: Synthetic coding sequence
atgcccctggccaaagacttgctacacccaagtccagaagaggagaaaaggaaacacaaaaagaagcgattggtgcagagcccaaattcgtacttcatggacgtgaaatgcccaggtgaagaaaccgcatgttgttctggagaaagcactggtccacagcaactagagaacgtggtagtccttgccgtgtcttacccctag

SEQ ID NO: 132928 - DNA, 255 bp, Artificial Sequence
  Description of Artificial Sequence: Synthetic coding sequence
atgcccctggcgcgagatttgttgcacccctccctggaagaggaaaaaaagaaacacaaaaaaaaaaggctcgtacagtcacccaatagctatttcatggatgtcaagtgtccaggttgttataaaatcaccaccgttttcagccacgcccaaacagtcgtactctgcgttggttgcagcactgttttgtgtcagcctactggaggaaaagcaaggctgacagaaggatgttcttttcgcagaaagcagcactag

SEQ ID NO: 132929 - DNA, 159 bp, Artificial Sequence
  Description of Artificial Sequence: Synthetic coding sequence
atggacgtcaagtgtccaggctgttacaagattactaccgttttttcacatgcccaaaccgtcgtgttatgtgtgggctgctctactgttctgtgccaaccgaccgggggcaaggcccgactgactgagggatgctcattccgtcgaaagcagcattag

SEQ ID NO: 132930 - DNA, 159 bp, Artificial Sequence
  Description of Artificial Sequence: Synthetic coding sequence
atggacgtaaagtgtccaggatgctacaagataaccacggtgttctcccacgcacaaactgtcgtgctgtgtgtaggatgtagcactgtgctttgtcagccaacgggcggcaaggcccgcctcacggaggggtgttcctttagaaggaagcagcactag

SEQ ID NO: 132931 - DNA, 303 bp, Artificial Sequence
  Description of Artificial Sequence: Synthetic coding sequence
atgtgccagcggtgcggactgaagctgatcgttataatttgcttctttgtgcagctcgcccgtgatctgctccatccaagcctggaggaggagaagaagaaacataaaaaaaagcggctggttcagagccctaacagctactttatggacgtcaaatgccctggctgctacaaaatcaccacagttttttcacatgcccagactgtggtgctgtgcgtcggatgttcaactgtcttgtgccagcctaccggcgggaaagcccgcctcactgaaggttgtagcttcagacgcaagcagcattag

SEQ ID NO: 132932 - DNA, 210 bp, Artificial Sequence
  Description of Artificial Sequence: Synthetic coding sequence
atggatacctcacgggtgcagcccatcaagctggctagagtgaccaaggtactgggccgaacgggtagccagggacagtgtacgcaagtacgcgttgaatttatggatgacacaagtaggtccattattagaaatgtgaaaggcccagtgagggagggcgatgtgctcaccctgctcgaaagtgagagggaagcgagaaggctgcggtag

SEQ ID NO: 132933 - DNA, 366 bp, Artificial Sequence
  Description of Artificial Sequence: Synthetic coding sequence
atggttccattcaatgatctttatagtggaccggatactttctcggaatttatatccgcatcgcatagcgccgttccattcaggggccctccattgctgctgccccccctgcgctggggccctgtcggagcaagggggatccacggaaggcacgaacccatccatcatccacagtgcaaacgcccaagggcccgcgggaggagagcacatccattcggcgtccgggcccgatctcccgaggtggctctaagcctagccgcccgttgggttctggacgtgggcttcgaccaccttgccgatgggaacggactctcacaaagcgccccattcttctgcccaccacacgtgacagaaatgctcctgtag

SEQ ID NO: 132934 - DNA, 210 bp, Artificial Sequence
  Description of Artificial Sequence: Synthetic coding sequence
atggataccagtagagtacaacctatcaaactcgcaagggtgaccaaggtcttgggccgcacaggatcccagggacagtgcacccaggttagagtcgagtttatggacgatacctctcgctcgattatcagaaatgtcaaaggacctgtgcgcgagggcgatgtcctcactcttctcgaaagtgagagagaagctcggcgcctgagatag

SEQ ID NO: 132935 - DNA, 171 bp, Artificial Sequence
  Description of Artificial Sequence: Synthetic coding sequence
atgggacatcaacagctgtactggtcccatccgcgcaagttcgggcaaggaagccgctcatgccgcgtctgctcaaaccgccatggactgattagaaaatacggattgaatatgtgccgacagtgtttccgccagtatgccaaagatattggatttatcaagttggactag

SEQ ID NO: 132936 - DNA, 204 bp, Artificial Sequence
  Description of Artificial Sequence: Synthetic coding sequence
atgggccaccaacagttgtattggtcccacccacggaagtttggccagggctcccgtagttgcagggtctgcagcaacagacacggacttatcagaaagtacggcttaaatatgtgtaggcaatgttttcgccagtatgcaaaggatatcgggttcattaaaaaggacttgtcctgtctcccatggcattgcctgtggcgatag

SEQ ID NO: 132937 - DNA, 780 bp, Artificial Sequence
  Description of Artificial Sequence: Synthetic coding sequence
atggctgttcaaattagcaagaaacgcaaattcgtggccgacggcatctttaaggccgaattgaacgagtttctgacaagagagctcgcagaggatggttactcaggcgtcgaggtgcgggtgaccccaacgaggacagagattatcatccttgcaactcgaacacaaaacgtcttaggtgaaaaagggagaagaatccgggagctgactgccgtagtccaaaaaagatttggatttccagaggggagcgttgaactgaaaatcatggtgatggtgacgggctatccattgttaccactgaagctgtatgccgagaaggtcgccactcgtggcctgtgcgctatcgctcaagctgaaagtttgaggtacaaactgctgggagggctggccgtgcgcagagcttgttacggggtcctgcgctttatcatggaaagtggagctaaaggctgcgaggtggtggttagtgggaagctgagaggccagcgcgctaaatctatgaaatttgtggatgggcttatgattcactctggagacccagttaactactacgttgacacagccgtgcggcacgtactgctgcggcagggggttttgggcatcaaagtgaagatcatgttgccctgggatcccacgggtaaaattggccctaagaagcctttgccggatcacgtgtctattgtggagcccaaggacgagattctgcctaccactcctatctcagagcagaagggcgggaaaccagaacctcctgcaatgcctcaaccagtgcccactgcctag

SEQ ID NO: 132938 - DNA, 732 bp, Artificial Sequence
  Description of Artificial Sequence: Synthetic coding sequence
atggcagtccagatttctaaaaagaggaagttcgttgcagatggcatatttaaggctgaattgaacgaatttttgaccagggaactggctgaggatggatacagcggcgtggaagtccgtgtgacccctacgcgcacagaaatcatcattctcgccacccggactcaaaacgtcctcggggaaaagggccgacgcatcagagagctgactgcagtggtacagaagcggtttggttttcctgagggctccgtcgagctgtatgcagagaaggttgctacgaggggactatgcgcaatcgcacaggcagaatccctgaggtacaaactgctaggggggctggccgttcgccgggcttgctacggtgtgttgagatttattatggagagcggagcaaaaggttgtgaagtcgtggtttcaggcaagcttagaggccagagagcaaagtccatgaaattcgtggacggactaatgatacattcaggagaccccgtgaactactatgttgataccgccgtgcggcacgtgcttttaagacagggggtgttgggcattaaagtcaaaatcatgctcccctgggaccctaccggaaagatcgggcctaaaaagcctttgccggaccacgtgtctatcgtcgaaccaaaagacgagatactgccaactactcctatctcagagcaaaagggcggaaaacctgagccccccgcgatgccacagcccgtccccactgcctag

SEQ ID NO: 132939 - DNA, 732 bp, Artificial Sequence
  Description of Artificial Sequence: Synthetic coding sequence
atggcggtgcagatcagtaagaagcggaaatttgtagccgatgggatcttcaaagccgagctaaatgaattccttacaagggagctagccgaggacggatatagcggcgttgaggtccgggtgacaccgacaaggaccgagatcatcattcttgccacgcggacccagaatgtccttggggagaaaggacgacgcattagagagctcacagccgtggtccaaaaaagattcggcttccccgaaggctctgtggaactctacgcggaaaaagtcgcaactcgtggcctgtgcgctatagcccaagccgaaagcctgcggtataaattactgggcgggttggcagtgagacgggcctgttacggtgtccttcgcttcataatggaaagtggcgccaaaggttgcgaggtcgtcgtgtccggcaagctgagagggcagcgcgcaaagtccatgaaatttgtggacgggctgatgattcattccggggacccagtgaattactatgtggatactgcggtgagacacgtgctcctgaggcagggggtgcttggaattaaagtgaagattatgctgccctgggaccccacagggaagatcggcccaaagaagccattgcctgatcacgtttcaatagtggagcccaaagatgagatcctgcccactactcccatcagcgaacagaagggagggaaacccgagccaccggctatgccccagcctgtgcctactgcgtag

SEQ ID NO: 132940 - DNA, 732 bp, Artificial Sequence
  Description of Artificial Sequence: Synthetic coding sequence
atggccgtgcagatctcgaaaaagagaaaattcgtggcagatgggattttcaaggcagaattgaacgaatttttgacccgggagctggccgaggacggctactccggtgtggaggtccgcgttactcccaccagaacagagatcattatcttagcaacgcgcactcagaacgtgctgggagagaaggggcgccgaatccgcgagctgacagccgttgtccagaagcgctttggtttccccgagggatctgttgagctgtacgccgaaaaagtcgcgacccgcggcctctgtgccattgctcaggcggagagtctgcgatataaactgttaggaggtttggcggtgcgaagagcctgttacggagtgctccgattcatcatggagtctggcgcaaaaggatgcgaggtggtggtttctggaaagttaagaggacaacgtgccaaaagcatgaagttcgttgacggacttatgattcactccggagacccagtgaattattacgttgatactgccgtgcgacacgtgttgttgagacagggcgtgctaggcatcaaggtgaagatcatgctcccttgggatcccacaggcaaaataggccctaaaaaacctctcccagatcatgtatccatcgtggagcctaaagatgaaatcctcccaaccacaccaatctcggagcagaagggtggcaaacccgagccccccgcaatgccccagccagtaccaaccgcctag

SEQ ID NO: 132941 - DNA, 795 bp, Artificial Sequence
  Description of Artificial Sequence: Synthetic coding sequence
atggccgtgggtaagaataaaagattgaccaaaggagggaaaaagggggctaagaaaaaggttgtggatccattttctaaaaaagattggtatgacgtaaaagcgcctgctatgtttaacatccgtaacataggcaaaacgctggtcacaaggacgcaaggaacaaaaatcgcctcagacggactcaaaggcagagtgtttgaggtgtctttggccgacttgcagaatgacgaggtcgcattccgaaaatttaagctgattactgaggatgtgcaggggaaaaactgtttgacgaacttccacggcatggatctcacgagagataaaatgtgctcaatggtcaaaaagtggcagaccatgattgaggctcacgtggatgtcaaaaccactgatgggtatctgcttagactgttctgcgtgggtttcaccaagaagagaaataaccagattcggaagacttcctatgcccaacaccaacaggtccgtcagatcagaaagaagatgatggaaattatgacgagggaggttcagaccaacgacctgaaagaagttgtgaacaagctgattcctgactcaattgggaaggatatagaaaaggcgtgccaaagcatttacccacttcacgacgttttcgtccggaaagtgaagatgctgaagaaacctaaattcgagttagggaaactaatggaattgcatggggagggtagcagcagtgggaaggcaactggagatgagactggcgccaaagtggaaagagcggacgggtacgaaccgcctgtccaggaaagcgtctag

SEQ ID NO: 132942 - DNA, 528 bp, Artificial Sequence
  Description of Artificial Sequence: Synthetic coding sequence
atggcagtggcaaaaaaaaaagtggtcgatcctttcagtaaaaaagactggtacgatgttaaggcccccgcgatgtttaatatcaggaatataggcaagacgctcgtgacgagaactcagggaacaaagattgcctccgatggcttgaaggggcgtgtgttcgaagtgtcactggcagacttgcagaacgacgaggtggcttttcgtaagtttaagctcatcacagaagacgtgcaaggtaagaactgcttgaccaacttccatggaatggatctaactcgggacaaaatgtgttcaatggttaaaaagtggcagacaatgattgaagcgcacgttgacgtcaagactacggatggatatttgctcagactgttctgtgtgggcttcaccaaaaagaggaacaaccagatcaggaagacgagctatgctcagcatcagcaggtccgacagattcgtaagaagatgatggagatcatgactcgcgaggtgcagacaaacgacctcaaggaggtcgtcaacaaactttag

SEQ ID NO: 132943 - DNA, 684 bp, Artificial Sequence
  Description of Artificial Sequence: Synthetic coding sequence
atgtttaacatccggaatatcggaaaaacgctcgtgactaggacccagggaacaaaaatcgcatcagacgggctgaaaggacgtgtattcgaggtttctctggcagacctgcagaatgacgaggtggcctttcgaaagtttaaacttataaccgaagacgtgcaaggaaaaaattgtttgactaactttcacggtatggatctgactagggacaaaatgtgcagtatggtgaagaaatggcaaactatgatcgaggctcatgtagacgtaaaaaccaccgacggctatctgctgcggctgttttgtgtgggttttaccaagaagaggaataatcaaattaggaagacatcctacgctcagcatcaacaggtacgccagatccggaaaaagatgatggaaattatgacaagagaagtccaaacgaatgacctgaaagaagtggtgaataagctcatccctgactcaatcggaaaggatatcgaaaaagcgtgccagtcaatataccctttgcacgatgtttttgtgcggaaagtcaagatgctgaagaaaccgaaattcgagctcggaaaactaatggagctacatggcgaggggagctcctccggcaaggcaacgggtgacgagaccggagctaaggtggagcgggctgatggctacgagcctccagttcaggaaagcgtatag

SEQ ID NO: 132944 - DNA, 438 bp, Artificial Sequence
  Description of Artificial Sequence: Synthetic coding sequence
atgatcgaggcacacgttgatgttaaaaccacagatgggtacttactgaggctattctgcgttgggtttactaaaaagcgcaataaccaaattcgaaagacaagctacgcacagcaccaacaggtgcgacagatcagaaaaaaaatgatggagataatgacccgtgaagttcagactaacgatctgaaggaagtagttaacaaactcattcctgattcaatcggaaaggacatcgagaaggcttgccaaagcatctatccgctccatgatgtgtttgtcaggaaagtgaagatgttgaagaaaccaaaattcgaactggggaagcttatggagctgcatggtgagggctcttcctccgggaaggctacaggcgatgagaccggggcaaaggtagagagagccgatggctatgaaccccccgtccaggaatcggtgtag

SEQ ID NO: 132945 - DNA, 684 bp, Artificial Sequence
  Description of Artificial Sequence: Synthetic coding sequence
atgtttaacataaggaacatcggtaagacactcgtgacgaggacccaggggaccaaaatcgccagcgacgggcttaaggggcgtgtctttgaggtcagtttggcagacctgcagaatgacgaggttgcttttcggaagttcaagctgattaccgaagacgtgcagggcaaaaattgtctgacaaacttccacggcatggacctgacccgggacaagatgtgctcgatggtgaagaagtggcagactatgatcgaagctcacgtcgatgtgaaaaccacggacggctacctgttgcgcttattctgcgtcggtttcacgaaaaaacgaaacaaccaaatccgaaagacatcgtacgcccagcaccagcaagtccgacagatccgaaaaaaaatgatggaaatcatgacaagagaagttcagacgaacgatctgaaggaagtggtgaataagctaataccagactcgattggcaaagacatcgaaaaagcctgtcaatctatatacccgctccacgatgtcttcgtgagaaaggtgaagatgctgaagaagcctaagttcgaattaggtaagttaatggagctccatggggagggctctagttctggaaaggcaacgggggatgaaaccggtgcaaaagtggagagagccgacggatacgagccaccagtacaggagtctgtttag

SEQ ID NO: 132946 - DNA, 627 bp, Artificial Sequence
  Description of Artificial Sequence: Synthetic coding sequence
aagcgcctcacgaaagggggcaagaaaggcgctaagaaaaaagtggtcgacccatttagtaagaaagattggtatgacgttaaagccccggctatgtttaatatcagaaacattggcaaaacactcgtgacccgcacacaaggtacaaagattgcctccgacggcttgaaaggacgtgtgttcgaaacaatgatcgaggcacacgtggacgtgaagactacagatggctatctcctgcggctcttttgcgtcggcttcactaaaaagaggaacaaccagattcggaagacctcttatgcccagcatcagcaagtaagacagatccggaaaaagatgatggaaatcatgactagggaagtccagaccaacgatctcaaagaagtagtgaataaattgattcctgatagcatagggaaggacatcgagaaggcctgtcaatcgatctatcctctgcacgacgtgttcgttagaaaagtgaagatgctgaagaagcctaagtttgagctgggtaagctgatggagctgcatggcgaaggctcgagctcaggtaaggcgactggggatgagacaggcgccaaagtcgagcgcgcagatggttatgagccccccgtccaggaaagtgtctag

SEQ ID NO: 132947 - DNA, 792 bp, Artificial Sequence
  Description of Artificial Sequence: Synthetic coding sequence
atggccaggggccccaagaagcacctcaagagagtggccgcccccaaacattggatgctcgacaagctgaccggcgtgtttgctcccagaccttcaaccgggcctcataagctgagagagtgccttccactgatcattttcctgaggaatcgattgaaatacgcgcttaccggagatgaagtgaagaagatctgcatgcagaggtttataaaaatcgatgggaaggttaggaccgacataacctaccccgcaggctttatggacgtcatcagtattgacaaaacgggcgaaaacttcagactaatatatgacaccaaagggcgatttgctgtccaccggattactccagaggaggctaagtataaattgtgtaaagttagaaaaatctttgttggaacgaagggtatcccccacctggtgactcatgatgctaggacaatccgttatcctgacccgctcatcaaagtcaacgatacaatccaaatagatttggagaccggcaaaatcacagatttcatcaagtttgatactggtaatctttgtatggtgacaggaggtgccaacctgggccggatcggtgtgatcacaaatcgagagaggcacccagggagttttgatgttgtccacgttaaggacgccaacgggaacagctttgcgacccgactcagcaatattttcgtgattgggaaagggaacaagccatggatcagtctgccacggggcaagggtattcgcctgactattgctgaggaacgggataagcggctcgcagcaaaacagtccagtggctag

SEQ ID NO: 132948 - DNA, 369 bp, Artificial Sequence
  Description of Artificial Sequence: Synthetic coding sequence
atggcacgggggcccaagaagcatttgaagagagtggccgctcccaaacactggatgttagataagttaactggcgttttcgcgcctaggccttccacaggtcctcacaaacttcgcgagtgcctgccgttgatcatttttctccgcaacagactgaaatatgctttaaccggcgatgaagtgaagaagatctgcatgcagcgatttatcaagattgacggaaaagtacggacagatattacctaccctgccgggttcatggatgtcatttctatcgataagactggcgaaaactttcgtctgatttacgacacaaaggggaggtttgcggtgcaccgtatcactcctgaggaagcgaaaccctgttag

SEQ ID NO: 132949 - DNA, 792 bp, Artificial Sequence
  Description of Artificial Sequence: Synthetic coding sequence
atggcccgcggacccaagaagcacctcaagcgggtcgccgctcctaaacactggatgttagacaaattgactggagtgttcgcgcccaggccgagtacaggcccccacaaacttagggagtgcttacctctgatcgttttcctgagaaatagattaaagtatgcactcaccggcgatgaggtgaaaaaaatctgcatgcagaggtttatcaagattgacgggaaggtacgcgtcgatgttacctatcccgccggctttatggacgttatcagcattgagaagacaggggagcactttcggctagtgtatgacacaaagggaagatttgccgtgcatcgcatcacagtggaggaggccaagtacaagctgtgtaaagtcaggaagattactgtcggtgtcaagggtattcctcaccttgttacccatgacgcgcgtaccatacgttacccagacccagtgataaaagtgaacgacaccgtgcagattgatcttggtacaggtaagattatcaactttatcaaattcgataccggtaatctgtgcatggtgataggcggcgctaacttgggccgagttggagtgatcactaatcgggaacgtcatcctggtagctttgatgtagttcacgtcaaggacgccaacggaaactcctttgccacaaggctgagcaacatctttgtcatcggtaacggcaacaagccatggatatctctcccgcgtgggaaggggatccgcctcacggtcgccgaggaaagggacaaacgcctcgcaactaagcaatcgtcagggtag

SEQ ID NO: 132950 - DNA, 789 bp, Artificial Sequence
  Description of Artificial Sequence: Synthetic coding sequence
atgctaggcagaccagccaaattcagcaaggcccggggaccaaagaaacatcttaaaagagttgccgcgcctaagcactggatgcttgataagctgaccggagtctttgcaccacgtccttcgactgggcctcacaaactgagagaatgcctgcctctcatcgtgtttctacggaacaggttgaagtatgcactcacaggcgatgaggtcaaaaaaatttgcatgcagaggtttatcaagatagacgggaaagtgcgcgtggatgttacctaccccgcaggattcatggacgtgattagcattgagaagactggagaacattttaggctggtgtatgacactaagggaagatttgctgttcacaggatcaccgtcgaagaagcaaaatacaaactctgcaaggtccgcaaaatcacagttggcgtaaagggtatcccccatctcgtgactcacgatgctaggacaatccgttatccggaccccgtcatcaaggtgaatgataccgtgcagattgatctcgggacgggtaaaatcatcaattttatcaaatttgataccgggaatctttgtatggtgatagggggtgccaacctggggcgggtgggtgttataaccaatcgagagcgccacccgggatctttcgacgtggttcatgtgaaggacgccaacgggaactccttcgcaacgcggctgagtaatatattcgtaatcggcaacggaaacaagccttggatcagtttacctcgcggaaagggaattcgtcttactgtggctgaggagagggattag

SEQ ID NO: 132951 - DNA, 792 bp, Artificial Sequence
  Description of Artificial Sequence: Synthetic coding sequence
atggccagggggccaaagaaacacctaaaacgtgtggctgcccccaaacattggatgctagataaactcaccggtgtgtttgctccaagaccaagcactggtcctcacaagttgcgcgagtgtctgccgctgatagtgttcctcagaaatagactgaagtatgcacttacaggggatgaagtaaaaaagatctgcatgcaacacttcctcaagattgatggaaaggtacgtgtggatattacatatcccgccgggtttatcgacgtgatttcgattgaaaagaccggggaacattttcgcctcgtgtacaataccaagggatgttttgccgtgcacaggattaccgttgaggaagctaagtacaaattatgcaaagtacggaagatcacggtgggaacgaagggcatacctcatctggtcacccatgacgcacgcacaattaggtaccctgaccctctgataaaggtcaacgacaccgtgcagattgacctgggtacaggaaagatcaccagctttataaagtttgatacaggaaacgtgtgcatggttatcgcgggcgcgaacctcggtagggtcggagtgatcaccaatcgggaaaggcatcctggcagctgtgacgtcgtgcacgttaaggacgccaacgggaacagctttgccaccaggatttccaatatcttcgtcattggcaacggcaacaaaccctggatttctctacctcgtggtaaagggatcaggctcactatcgctgaggaaagggataagcgtctggccgccaagcagtcatcaggctag

SEQ ID NO: 132952 - DNA, 615 bp, Artificial Sequence
  Description of Artificial Sequence: Synthetic coding sequence
atgaccgagtgggagaccgccgcgcccgctgtcgctgaaactccagacattaaacttttcggcaaatggagcactgatgacgtccaaattaatgacatttctctacaagattacatcgccgtgaaagagaagtacgcaaagtatcttccccattctgccgggcgctatgcagcaaaacgcttcagaaaggcgcaatgtcctattgtggaaaggctgacaaactctatgatgatgcatggccggaataatggcaagaagctaatgactgtgcgtattgttaagcatgcctttgagatcatccacctcctaaccggtgaaaatcccttgcaggttttggtcaacgccatcattaactcaggccctagagaagattccacgcgtatcgggcgagctggcactgtgagacgccaggccgtcgatgtatctcctctgcggcgcgtgaaccaggccatatggttactctgtaccggagctcgggaggccgccttccgcaacatcaagaccattgcagaatgtttggctgatgaactcatcaacgcggcgaaagggtcctctaattcttatgccatcaagaaaaaggacgagttagagagggtagcaaagagtaatcgctag

SEQ ID NO: 132953 - DNA, 615 bp, Artificial Sequence
  Description of Artificial Sequence: Synthetic coding sequence
atgaccgaatgggaaaccgccgctccagcagtggctgagactccagatattaagctgttcggaaagtggtccacagatgatgtccagatcaacgacatctccctgcaggactacatagcagtgaaagaaaagtacgccaagtatctgccacacagtgccggtcgctacgccgccaagcgcttccggaaagcccagtgccctatcgtagagcgcctaacaaactcaatgatgatgcacggccggaataacggcaaaaaactgatgacagttagaattgtcaaacacgccttcgaaatcattcatctgctcaccggcgagaatcctttgcaggtgttggtgaacgctatcattaatagtggaccacgcgaagacagtactcgaattggaagagctggtactgtgaggaggcaggctgtagatgtctcccccctccgccgggtcaaccaggccatttggcttctgtgtacgggcgctcgggaggccgccttcaggaacatcaagaccatcgccgagtgtttggccgatgagttgatcaacgcggccaagggctctagcaattcatatgcaattaagaagaaggatgaactcgaaagggtggctaaaagtaaccgctag

SEQ ID NO: 132954 - DNA, 657 bp, Artificial Sequence
  Description of Artificial Sequence: Synthetic coding sequence
atggccaccgaagttgctgcagatgctctaggcgaggaatggaaagggtacgtggtccggatcagcggggggaacgacaaacagggattccccatgaagcagggcgtgctgacccatggcagagtgcggctgctgctctcaaaaggacactcatgttacaggcctcgcaggactggggagcgcaaacgcaagtctgtgcggggatgcatcgtcgatgccaatctgtccgtacttaacctggtaattgtcaagaaaggcgaaaaagacatcccaggcctcactgataccacggttccccgcaggctagggccaaagagggcttccaggatcagaaaactgttcaacctctcgaaggaagatgatgtgcggcagtacgtcgtgaggaagccgctcaataaagaagggaagaaacccagaactaaggctccaaagatacaacggttagtcaccccacgggtcctacagcataaaaggaggcggatcgcacttaaaaagcagcggactaagaaaaacaaggaagaagcagcggaatacgcgaaactacttgctaagagaatgaaagaggcgaaggagaaacggcaggagcaaattgctaagcggagacgcctgtcgagtttgagagccagcacctctaagagcgagtcttcacagaagtag

SEQ ID NO: 132955 - DNA, 276 bp, Artificial Sequence
  Description of Artificial Sequence: Synthetic coding sequence
atgaagcttaacatctcctttccagccactggctgccagaagttgatcgaagttgacgatgagagaaagctcagaactttctacgagaagcgtatggccactgaagtggccgctgatgccctgggagaggaatggaaagtgaaagtggacaagctgttgcaggtattcaaatccgagacggtgaatgctatcgggaactggtatctggaatggggttccgattcggggttttggctgcttacatttgggaaattgttgcccaatgccaccctgtag

SEQ ID NO: 132956 - DNA, 657 bp, Artificial Sequence
  Description of Artificial Sequence: Synthetic coding sequence
atggctactgaggtcgctgctgatgccctcggggaggaatggaagggctatgtggtgcgcatcagcggcgggaatgacaaacagggtttccccatgaagcagggagtcctcacacacgggcgcgtgcgtctcctgctgagcaaaggacactcctgctatagacccaggcgaacaggggagcggaagcgcaaaagtgtgcggggatgcatcgttgatgccaatcttagcgtgctaaacctggtgattgtaaagaagggagaaaaagacatccccggtctcacagacactactgtgcccagaagattagggcctaagagagctagcagaatccgcaaactctttaacctgtctaaagaagacgacgtccgacagtacgtggtccgcaagcctctcaataaagaaggcaaaaaacctaggaccaaggctcctaagatccagcggctggtgacccctcgggtgctccaacataagagaagaaggatcgctttgaagaaacagaggaccaagaaaaataaagaggaggccgctgagtacgcgaaattattggctaagaggatgaaggaggctaaggaaaaacgtcaggagcagatcgccaaacgtcggcgtctctctagtctgcgcgcgtctaccagtaagagcgagtcttctcagaagtag

SEQ ID NO: 132957 - DNA, 750 bp, Artificial Sequence
  Description of Artificial Sequence: Synthetic coding sequence
atgaagctgaatatcagctttcctgccaccggctgccaaaaactgattgaagttgacgatgaaagaaagcttcgtaccttttacgaaaagcgaatggccacagaggtcgccgctgatgcactcggcgaggaatggaagggatatgtggttcgcattagtggcggcaacgataagcagggatttccgatgaaacagggggtcctaacacatggtagggttcgacttttgctgtccaaggggcatagttgttacagacctcgtagaactggagaaaggaagagaaaatccgtcaggggctgcatagtggacgccaatctgtccgtgctgaatttagttatagttaaaaagggcgaaaaggatatccccggcctgacagacactaccgtccctcgcagattaggccctaagcgagctagtcgaatcagaaagctcttcaacctgtcaaaggaagacgatgtgaggcagtacgtggtgcgaaagccactcaacaaagaaggcaagaaacccaggaccaaagcccctaagatacagaggctggttaccccccgggtgctgcaacacaagaggagaaggattgctctcaaaaagcagcgtaccaaaaagaataaggaggaggcagccgagtatgccaagctccttgcaaagcgcatgaaggaagctaaagaaaagcgacaggagcagatcgccaaaagaagacgcttatcctcacttcgtgcatccactagcaagtctgaaagttcacagaaatag

SEQ ID NO: 132958 - DNA, 585 bp, Artificial Sequence
  Description of Artificial Sequence: Synthetic coding sequence
atgttttcatcttctgccaagattgtgaagcctaatggtgaaaagcctgatgagttcgagtctgggatttctcaggccctgctggaactggagatgaattccgatttaaaagcccagctgagagaactgaacataactgccgccaaggaaatcgaggtgggaggcgggagaaaggcaataattatctttgtgcctgttccccagttgaaatctttccagaaaatccaggtcagactcgtgcgcgaactagagaagaagtttagtgggaagcacgtggtttttatcgcacagcggcgcatactgcccaaaccaacaaggaagtccaggaccaaaaataaacagaaaaggccccgatcccgaacactgactgctgtgcatgacgccatcctcgaggatctggtatttccatccgaaatcgtgggtaagcggatacgtgtaaagctggatggctctaggttaatcaaggtccacctggataaggcacagcagaacaatgtggaacacaaggtagaaacattcagcggggtgtacaagaaactcaccggcaaggacgtgaactttgagtttcctgaattccaactgtag

SEQ ID NO: 132959 - DNA, 585 bp, Artificial Sequence
  Description of Artificial Sequence: Synthetic coding sequence
atgtttagttcgagcgcaaaaatcgtgaaacccaacggagaaaagcctgacgagtttgagtcaggtatttcccaggctttgctggagctcgagatgaactcggatctcaaagcacagctgagggagcttaacattacagccgccaaagaaattgaggtgggaggagggagaaaggccatcattatatttgtgcccgttccacagctgaaaagctttcagaagatccaggtacgcctcgttcgcgaactcgaaaagaagttttcaggcaaacacgttgtgtttatcgcccagcggcggattctgccaaagcccactcggaagtctagaaccaagaataagcaaaaaaggcctcggagtcggacactcacggccgtacatgacgccatcctggaagacctagtgttccccagtgagatcgttggtaaacgtatcagagttaagttagatggctcacgcctgattaaagtgcacttggacaaggcacaacagaacaatgtggagcacaaggttgagactttttcaggtgtgtataagaaattaaccggaaaagatgttaatttcgaatttccggagttccaactttag

SEQ ID NO: 132960 - DNA, 585 bp, Artificial Sequence
  Description of Artificial Sequence: Synthetic coding sequence
atgttctcctcctctgcaaagatagtaaagcccaatggggaaaagccggatgagtttgaatccggtatatcacaggctctcctggaattagagatgaacagcgatctgaaggcccaattgcgggaattgaacattactgcagccaaggagatcgaagtcgggggcgggcgcaaggccattattatcttcgtgccagtacctcagttgaaatcgttccagaaaattcaggtcagactcgtgagggaactggaaaaaaagttttctggtaaacatgtggtcttcatcgcccagagaaggatcctgccaaagcctaccaggaagagtcgcacaaagaataaacagaaacgccccagatcccgcacactgacagccgttcatgacgccatacttgaagaccttgtctttccatcagagattgtgggcaaacgcattagagtaaagttggacggaagcagactcatcaaggtccacctggataaggctcagcagaacaatgtggaacacaaggtggagaccttttcgggcgtgtataaaaagctaaccgggaaagatgtcaattttgaatttccggaatttcaactctag

SEQ ID NO: 132961 - DNA, 567 bp, Artificial Sequence
  Description of Artificial Sequence: Synthetic coding sequence
atgggcatatctcgcgataactggcataagagaaggaaaacaggcggtaaacgtaagccctaccataagaaaaggaaatatgaattagggaggcccgccgctaatactaaaatcggtcctagacgtattcacacagttcgagtgagaggagggtgcacacggaaaactcggatcatcgatgtggtgtacaacgccagcaacaatgagctggtccgcaccaaaaccctggttaaaaactgtattgtgctgatcgactcaacaccttaccggcagtggtacgaaagccattacgccctacccctgggtcggaaaaagggcgcaaaactgacgcccgaggaagaagaaatcctgaataaaaagcgatccaaaaagatccagaaaaaatatgatgaaagaaagaagaacgcaaaaatttctagcctgctggaagaacagtttcagcaggggaaacttctggcgtgcattgctagcagaccaggccagtgcggtagagccgatgggtacgtactcgagggcaaggaattagaattctacttacgcaagatcaaagctcggaagggtaaatag

SEQ ID NO: 132962 - DNA, 627 bp, Artificial Sequence
  Description of Artificial Sequence: Synthetic coding sequence
atgggaatcagcagggacaattggcacaagcgacgcaaaactgggggcaaacggaagccttatcacaagaagcgtaaatacgagctgggcagacccgccgctaacaccaagattggccctagaagaatacatacagtgagggtccgcggtggaaacaaaaaatacagggccttaagattagatgtcggaaatttcagctggggcagcgaatgctgtactcgtaagactcgaataatcgacgtggtgtataatgcttccaataacgagctcgtcagaaccaagaccctggtcaaaaattgcatcgtgctaattgactccaccccttataggcagtggtacgaatcccactatgctctgccactggggcgcaagaagggcgcgaagctcacccccgaagaggaggaaattctaaataaaaagcgtagcaaaaagattcagaagaaatacgatgagcggaagaaaaatgcaaagatcagctctttgcttgaggagcagtttcagcagggaaaattgttagcctgcatcgcatcacgccccggccagtgtggtagagccgatgggtatgttttggaagggaaggaactggaattctacctacgtaagattaaagccagaaagggaaagtag

SEQ ID NO: 132963 - DNA, 585 bp, Artificial Sequence
  Description of Artificial Sequence: Synthetic coding sequence
atgcctgtggccagatcttgggtctgcaggaagacatacgtcaccccccgtcggccattcgagaaatccaggttagaccaggaactaaaattaatcggagagtatggcctgcgtaataaacgggaggtatggagagtgaaattcacactggctaaaatacgtaaggccgcacgggagctgctcactctggacgagaaggatccacgaagactctttgagggaaatgccctactcagacgtttggtccggatcggagtcctggacgaaggcaagatgaaactggactatatcctcgggctgaaaatcgaggattttctggagcggcgcctgcagacccaggtgttcaaactaggtttggctaagtccatccaccacgccagggtcctgattagacagcgacatattcgagtcagaaagcaggtggtgaacatccctagttttattgtgaggttggattcacaaaagcatatcgacttctctttgcgttctccctatggcggtggccggccaggcagggttaaaagaaagaatgcaaaaaagggccagggcggagcaggggccggcgacgatgaagaggaagactag

SEQ ID NO: 132964 - DNA, 585 bp, Artificial Sequence
  Description of Artificial Sequence: Synthetic coding sequence
atgccggtggctcgttcatgggtgtgccggaaaacctacgtgactccaaggaggccttttgaaaaaagccggctggaccaggagctcaagctgattggagaatatggcctgcggaacaagagagaggtttggcgagtgaaatttactctggcaaaaatccgcaaagcggcccgagagctcctgaccctagacgaaaaggatccaaggcgccttttcgaaggtaatgctcttctccgacgactcgtgaggataggcgtgttagatgagggaaaaatgaaacttgattacatcctcggactgaagattgaggatttcttggagcggagacttcagacccaggtgtttaagctagggctagccaaaagtatacatcacgcaagagttctgatccgacagcggcacattagggtacgtaagcaggtcgtcaacatcccttcgttcattgtccggctagactctcagaagcatatcgacttcagtctgaggtccccatacggaggcgggcgtccaggaagggtgaagcgcaagaatgccaaaaagggccagggtggtgctggagccggcgacgacgaagaggaagactag

SEQ ID NO: 132965 - DNA, 585 bp, Artificial Sequence
  Description of Artificial Sequence: Synthetic coding sequence
atgcctgtggccagatcatgggtatgccgaaaaacctatgtgacacctaggagacctttcgagaaatcacggctcgatcaggagctgaagcttattggggagtatggactgagaaacaaaagagaggtttggcgtgtcaagttcacattagcaaagatccgaaaagctgcgcgcgagctactgaccctggatgagaaagacccacgacgtttgttcgagggaaacgctctcctgagacgacttgttcgcattggagtactggatgaagggaaaatgaaattagactacatactcgggctgaagatagaagattttctcgagagacgcttgcagactcaggtcttcaagttaggattggctaaatcaattcatcacgcccgagtccttatcaggcagcgacacattcgggtccgcaagcaagtggtgaatataccgtctttcatcgtgcggttggatagccaaaagcacatcgacttcagtttgagatccccgtatggcggagggcgacctggtcgggtcaagcgcaaaaacgcaaagaaaggccagggcggcgctggcgctggcgacgacgaagaggaggattag

SEQ ID NO: 132966 - DNA, 420 bp, Artificial Sequence
  Description of Artificial Sequence: Synthetic coding sequence
atgccggtcgcccggtcctgggtgtgtaggaaaacctatgtgacccctcgcaggcctttcgagaaatcccgcctcgatcaggaattgaaactgattggagaatacggcctccggaataaaagagaagtttggcgggttaaattcaccctggcgaaaatcaggaaagccgctcgagagctcctaacattggacgaaaaagatcctcgccggctttttgaagggaacgccctcctgcggagactcgtgcgtattggagttctcgacgagggaaagatgaaactagactacattctcggattgaaaatcgaggattttctcgaacggcgcttacagacacaggtctttaagctcggccttgccaaaagtattcatcacgcccgtgtgctgattcgccagcgacacatcagtccgagacgctag

SEQ ID NO: 132967 - DNA, 420 bp, Artificial Sequence
  Description of Artificial Sequence: Synthetic coding sequence
atgcctgtggcccggtcctgggtctgtcgaaagacatatgtgactccgagaaggccatttgagaaatctcgtctggaccaagagcttaaactcatcggagagtacggattaaggaataaacgcgaagtgtggcgagtcaagtttacattagctaagatccgaaaagccgcgagagaactcttgaccttggacgaaaaggaccctcggcgcctgtttgagggaaatgccctgttgcgtcggttagtgaggatcggggttctcgatgaggggaaaatgaagttagattacatattggggcttaagattgaagatttcctcgaacgtcgcctacagacccaagtctttaagctgggacttgctaagagcattcaccacgcccgcgtgctcatcaggcaacggcatatcagccctcggagatag

SEQ ID NO: 132968 - DNA, 471 bp, Artificial Sequence
  Description of Artificial Sequence: Synthetic coding sequence
atgcccgtcgctcggtcttgggtgtgtcggaagacttatgttacacctagaagacccttcgagaagtctagattggaccaggagctgaaattgatcggagaatacggactgcggaacaagagagaggtctggagagttaagtttactctggctaaaatcagaaaggccgctcgagagctccttacgctggatgagaaggatccacgacgactatttgagggaaatgcactactccgacggctcgtccgtatcggggttctcgatgagggtaagatgaaactcgattatatcttaggtttaaaaattgaagattttctggagagaagactgcaaacacaggtgtttaagctgggactcgccaagagcattcaccacgccagggtcttaatcaggcagcgtcatatacgttaccacctgggctgggccccagagagtagcagcacctgtccatctgatgggtgcccacactag

SEQ ID NO: 132969 - DNA, 420 bp, Artificial Sequence
  Description of Artificial Sequence: Synthetic coding sequence
atgccggtggcccggtcttgggtctgtaggaaaacatacgtgacgccacgtcgtccattcgaaaagtccaggcttgatcaagagcttaaactcatcggtgagtatggcttgagaaataagagggaggtgtggcgggtgaagtttaccttggctaagatccgtaaagccgccagggaactcctcacccttgatgaaaaagatcctaggcgactgttcgaaggcaacgctcttttgagacgtttagtcaggattggtgtgcttgatgaggggaagatgaaactcgactacatcctgggactgaagatcgaggacttcctagaaagaagactgcagactcaggtgtttaaactaggacttgctaaatccatacaccatgccagagtccttataagacagaggcatatcagtcccaggcgatag

SEQ ID NO: 132970 - DNA, 2844 bp, Artificial Sequence
  Description of Artificial Sequence: Synthetic coding sequence
atggcgacccgagttcgaaccgctagcatctgggtccccccgctccaggaacgtaactcttcctgggacagaatccgtaaactgcagggacaggagagcattttgggtcagggtacgccaggcctgcagccactgcccggtacccccagacagaagcaaaagagccgaaggatcgaaaaagtgttggagtggcttttcatctcccaggaacaacccaagatcaccaagtcctggggacctctgagcttcatggatgtgttcgtggactttacatgggaagagtggcagctgttggaccccgcacaaaaatgtctgtaccggagcgtaatgcttgagaattattcgaatctggtgagcctaggttatcagcacaccaagccagatatcatctttaaattggagcagggggaggagctgtgcatggtgcaggcacaggtacccaaccagacctgccctaacaccgtttggaaaatcgatgatcttatggattggcatcaggaaaataaagataagctgggtagtacagccaaaagtttcgagtgcacaacttttggtaaattgtgcctcttatcaacaaagtaccttagtcgccagaagccccataagtgtggtacccatgggaagtcgctgaaatatatcgacttcaccagcgactatgcccggaacaaccccaatggctttcaggtacacgggaagagtttcttccacagcaagcatgagcagaccgtcatcggaatcaaatactgtgaatccattgagtccgggaagacagtgaacaaaaagagtcagctgatgtgtcagcagatgtacatgggagagaagccctttggctgttcttgttgtgagaaagccttctcatccaagagctacctgctggttcaccaacagacccacgccgaagaaaaaccttacggatgtaatgagtgtggaaaggatttctccagcaaatcatacctgatagtccaccaacgtattcacacgggggagaaactgcacgagtgctccgaatgcagaaaaacattttctttccacagccagctggtcatccaccaaagaatccacactggcgagaatccttacgaatgttgcgagtgtggcaaagtcttttctaggaaagatcaattagtgtcgcaccaaaaaactcactcgggccaaaaaccatatgtctgtaatgagtgtgggaaggcctttgggctcaagtcccagcttataattcatgaacgcatccacaccggggagaaaccgtatgagtgtaatgaatgccagaaggcattcaacactaaaagcaaccttatggttcaccagcgtacacacaccggggaaaaaccttatgtatgtagtgattgtggcaaggcgttcaccttcaagtcacaactgatagtccaccagggaatccataccggtgttaagccatacggttgtatccagtgtggcaaaggcttcagcctaaaatcgcagttaatcgtgcaccaacgctcccataccggcatgaaaccgtatgtctgcaatgaatgtggcaaagcctttcgcagcaaatcctatctgatcatccataccaggacacacacaggtgagaagcttcatgaatgcaataactgtggcaaggcattctcctttaagagtcagcttatcatacaccagagaatacacacgggcgagaacccctatgagtgccacgagtgcggaaaagcatttagtaggaagtaccagctgatctcccatcaacgcactcacgccggtgagaaaccttacgagtgcacagactgcggaaaagcctttggacttaagagccagctcattattcaccagagaacccacactggagagaaaccattcgagtgttcagaatgccagaaggcatttaacacgaaaagtaatcttattgtgcatcagaggacccataccggcgagaagccctatagctgtaatgagtgtggcaaagcatttacttttaagtcccagctgatcgtccataaaggggtacataccggagttaagccatacggctgctcacaatgtgctaagacattctccctgaagagtcagctgattgtacaccagagatcgcatactggagtcaaaccctacggctgcagcgagtgtggaaaggcgtttcgcagtaagtcatatcttattatccacatgcgtacgcataccggcgagaagcctcatgagtgccgggaatgtggcaaatctttctcctttaatagccaacttattgtgcatcaacgcatccatactggtgagaacccatacgagtgctctgaatgtggaaaagctttcaaccgaaaggaccagcttatcagccaccaaagaacccacgcaggagagaagccttacggatgcagtgaatgtggcaaagcattttctagtaagagctacttaatcatccacatgagaactcattctggggagaaaccttacgaatgcaatgaatgtggtaaggctttcatttggaaaagcttgctgattgtgcacgaacgcactcatgcaggcgtcaacccttataagtgctcgcagtgcgagaagtccttttcagggaagttgaggctgctcgtgcaccaacgcatgcacacaagagagaagccttatgaatgctcagagtgcggaaaagcatttattaggaacagccagttgatcgttcaccagcgcactcactcaggggaaaagccttacggttgcaatgagtgtggcaaaactttcagccagaaatctatcctctcggcccaccagagaacacacaccggggaaaagccatgcaaatgtactgagtgcggaaaagccttttgttggaagagccagctcattatgcatcagcgcacgcacgtggacgataaacattag

SEQ ID NO: 132971 - DNA, 768 bp, Artificial Sequence
  Description of Artificial Sequence: Synthetic coding sequence
atgccccgagaagaccgggccacctggaagagcaattacttcctaaagataattcagctcctggacgactatccaaagtgcttcatcgttggcgcagacaacgtcgggagcaagcagatgcagcagattcggatgtcactgagggggaaggcagtggtccttatgggaaagaataccatgatgcgcaaagcaattcgtgggcaccttgagaataacccagccctggaaaagctgctcccgcacatccgcggaaatgttggcttcgttttcactaaagaggatctgaccgagatacgggacatgctccttgctaataaggtgcccgcagcagctagggctggcgctatcgccccctgcgaggttactgtgcccgcccagaataccggcttaggaccagaaaaaacatcttttttccaggcactcggcattaccacaaagattagccggggaacaatagagatcctgggtgtcaggaacgtggccagtgtgtgcctacagatcgggtacccaaccgtggcgtccgtgccccatagtatcatcaatggttataagcgcgtgcttgctctcagtgtggagaccgactacacattccccctggccgagaaagtgaaagcatttctggccgatccctccgcatttgtggctgccgcccctgtcgcagccgcaaccacggctgctcctgcagccgcagccgcccctgctaaagtggaggctaaggaagaatccgaagagagcgatgaggatatgggttttggtctttttgactag

SEQ ID NO: 132972 - DNA, 954 bp, Artificial Sequence
  Description of Artificial Sequence: Synthetic coding sequence
atgccaagggaggatcgcgctacctggaagagtaactatttcctaaaaatcatccaactgctggacgattatcctaagtgctttatcgtcggagcagataatgtgggctccaaacagatgcaacagatccggatgtcacttaggggtaaagcagtagtcctgatgggtaagaatacaatgatgcgtaaagccatcagaggtcacctagaaaacaatccagcacttgaaaagctgttgcctcacatcagaggaaacgtgggtttcgtgttcactaaagaggacctgactgagatccgggatatgctgctggcaaacaaggtgcctgcggccgcgcgcgctggtgccatcgccccttgcgaggtgacagtaccagcccagaacacaggactggggcctgaaaaaactagtttcttccaggcccttggaattactaccaagatctctagagggaccattgagatacttagcgatgtccagttgatcaagacaggtgataaagtgggggccagtgaggccacgttgctgaatatgctgaacatatctccctttagctttggcctcgtcatccagcaggtgttcgataacggaagtatttacaacccagaggtgctggatatcactgaagagactctccattcccgttttctagaaggcgtccgaaacgtcgctagcgtgtgcttgcagattggttatccaacggtggcctccgttcctcactcaatcatcaatgggtacaagagagtactggctttgagcgttgagacggattatacctttcctttagccgagaaggtcaaggcctttctcgccgacccttctgcttttgtggccgctgcccccgttgctgccgccacaacggcagcccccgcagcagcagctgctccagcgaaagtggaggccaaggaggaaagcgaggagtcggacgaggatatgggcttcggtctcttcgactag

SEQ ID NO: 132973 - DNA, 954 bp, Artificial Sequence
  Description of Artificial Sequence: Synthetic coding sequence
atgccccgcgaggaccgcgcgacctggaagtccaattatttcctcaagatcatccaactgctggatgactacccgaaatgttttatcgtgggggcagacaacgtgggctctaagcagatgcagcagataaggatgtcgctgaggggtaaggccgtcgtgcttatgggcaagaacacgatgatgcgcaaggctatccggggacacttggagaacaatcccgccctggaaaagctgcttccgcacatccgggggaacgtgggctttgtttttactaaagaggacctcaccgagattcgtgatatgctattagcaaacaaggtgccagcagccgctcgcgctggggcaatcgccccatgcgaggtgacagttccagcccagaataccggcttgggccctgaaaagacatctttcttccaggctctcggtattacgaccaagatctcaagggggacaatcgagatcctcagtgatgtccagcttataaaaactggggacaaggtcggggcaagcgaggctactctgttgaacatgctaaatatatcccctttctcgtttggattggttatacaacaggtgttcgataatggatctatttataatccagaagtgctggatattactgaagagaccctacacagcaggtttctcgagggcgtccgaaatgtggcttctgtgtgtctccagatcggttatccgaccgtcgcttctgtgccgcatagtattattaatgggtataaacgagtgttagccttgtcagtggaaacagattataccttcccgctcgcagaaaaggtcaaagctttcctggctgacccaagtgccttcgtggcagctgctcccgtggctgccgcaactactgcagcccctgccgctgcagcagcacccgctaaggtcgaagccaaggaagaaagtgaggagagcgatgaggatatgggctttggactgtttgactag

SEQ ID NO: 132974 - DNA, 345 bp, Artificial Sequence
  Description of Artificial Sequence: Synthetic coding sequence
atggccagcgtgagcgagctggcatgcatctattctgcccttatactgcatgatgacgaagtgaccgttactgaagataaaattaatgcgctgatcaaggctgctggagtaaacgtggagcccttctggcctggattgtttgcgaaggcgctcgctaatgtgaacattgggtccttaatatgcaatgtcggtgccggaggaccagcccctgcagcaggtgccgctcccgccgggggcccagccccaagtactgccgcagccccagcggaagagaagaaagtggaagccaaaaaggaagagagtgaagagtcggacgatgacatggggtttgggctcttcgattag

SEQ ID NO: 132975 - DNA, 270 bp, Artificial Sequence
  Description of Artificial Sequence: Synthetic coding sequence
atggccagtgtaagtgaattggcctgcatctactccgccctgatcctgcatgatgacgaagtgacagtgaccgctctggccaatgtaaatataggcagcctcatctgcaatgttggcgccgggggccccgctcccgccgctggtgctgcccctgccggtgggcctgccccaagtaccgcagctgcacccgcggaggagaaaaaagtcgaggccaagaaagaggagtcagaggagtctgacgatgacatgggattcgggctgttcgattag

SEQ ID NO: 132976 - DNA, 2277 bp, Artificial Sequence
  Description of Artificial Sequence: Synthetic coding sequence
atggcacccgccatgcagcccgctgaaattcaatttgctcagagactggcctcatccgagaaggggattcgcgacagggctgtcaagaaactgagacaatatatctccgtgaaaacacagagggaaacaggcggcttttcgcaggaagaactactcaagatctggaaagggctgttttactgtatgtgggtgcaagatgaacccctcctgcaagaggaacttgctaatactatagcacagctggttcatgcagttaataattctgcagcacagcatttgttcattcagaccttctggcaaactatgaacagggaatggaaggggattgacaggctgagactcgacaagtattatatgttaatccgcctggttctccggcagagcttcgaggtgctgaagaggaacggatgggaggaaagtcgaattaaggtgtttcttgatgttctaatgaaggaagtcctgtgtcctgagtctcagtctcctaatggcgtacgattccatttcatcgatatctatctagatgaactgtcaaaagttgggggtaaggaactcctcgccgatcagaacctcaaatttatcgaccctttctgtaaaatagcagctaagactaaagaccatacactcgtccaaaccatcgcgagaggcgtgtttgaggcaatcgtggaccagagccccttcgttccagaggaaacaatggaagagcagaagactaaagttggggacggcgacctatctgccgaagaaattcctgagaacgaggtttctctgcgtcgggctgtgtcaaagaagaaaacggctcttggaaagaatcactcacgcaaggacgggctttcagatgaacgcggcagagatgattgcgggacttttgaggacaccggtccccttttgcaatttgattataaggcggtggcagatagactgctcgagatgacatccaggaagaataccccgcacttcaatagaaaaaggttatctaaactgattaaaaagttccaggacctctcggaggggagctcaatatcgcaactttcctttgcagaggacatttctgccgatgaagacgaccagatcctctcccaggggaagcataaaaaaaaaggcaataagctgctggaaaagacaaatctcgagaaagagaaaggctccagagtgttctgtgtagaggaggaggattccgagtcctcactacagaagcggagacggaagaagaaaaaaaagcatcaccttcagcccgagaatcccggtccaggtggcgcagcaccatccctcgaacaaaatcggggccgcgagcccgaggcaagcggtctcaaagccctgaaggctagggttgcggaaccaggagcagaggcaacttccagcaccggagaagagagcggcagcgaacatccccccgctgttcccatgcataataagcggaaacgccccaggaagaagtccccaagagctcacagggaaatgttggaatcagcagtgttgcccccagaggacatgagtcagtcaggcccttcaggttctcacccccaggggcctcgaggatccccaactgggggggcccagctgctcaagcgcaagaggaaattgggcgtggtccctgtaaacggctctggactctccaccccggcctggccccccctgcagcaagagggcccccctacaggccctgccgagggcgccaactctcacacaaccctgccgcagcgacggcgcctgcagaagaagaaggctggtcctggatctctcgagttgtgcggcctgccttctcaaaaaactgctagcctgaaaaagcgcaaaaaaatgcgcgtgatgagtaaccttgttgaacataatggtgtgttagagtccgaagccgggcagccccaggccttagggtcatctgggacatgttcttccttgaaaaagcagaaactgcgcgcagagagcgactttgttaagttcgataccccattcttacccaaaccactctttttccgacgagccaagagttcaaccgccacccatccaccgggacccgcggtccagttgaacaagacaccatctagctccaaaaaagtcaccttcgggctgaaccgaaacatgacagcggaattcaagaaaacagataagtccatccttgtgtcccccaccggaccttccagggtcgcctttgatccagaacagaagcccctgcacggagttctgaagacgcccacatctagtccggcgagtagccctttggttgccaaaaaaccattgactacaacccctcggcgccgtcccagagctatggacttcttctag

SEQ ID NO: 132977 - DNA, 780 bp, Artificial Sequence
  Description of Artificial Sequence: Synthetic coding sequence
atgcccggcgctaactatcgcgctggggctggggccggagctggagccagacgtcctcgcggtgcccgggaccgcgaggaagacggagggggattggaacccgccgcggtggccagagacttgcttcgggggaccagcaacatgtcctttgaagaattactggagctgcagtcgcaggtgggaaccaagacttacaagcagcttgttgcaggaaatagcccaaagaagcaggcctcccgtccccctatccagaacgcctgcgtggccgataagcatcgccctctggagatgagcgctaagatccgggtaccattcctgcgccaagtagttcccatctcaaagaaggtagcccgcgatccgcgttttgacgatttgtctggcgagtataacccagaagtttttgacaagacatatcagtttctgaatgacattagggccaaggagaaagaattggtgaagaagcagctgaaaaagcacctctcaggagaagagcatgagaaactgcagcagctcctacaacggatggagcagcaggagatggcccagcaggaaagaaaacagcaacaggaactccacctggctttgaagcaggagcgccgtgcccaggcacaacaggggcatagaccctactttcttaaaaagagcgagcaacgccagctcgcactcgccgaaaagttcaaggaattgaaaagaagcaaaaaactggagaatttcttatcacgcaagagaagacgcaatgctggcaaagatcgcaggcatctaccgctgagcaaagagtag

SEQ ID NO: 132978 - DNA, 4233 bp, Artificial Sequence
  Description of Artificial Sequence: Synthetic coding sequence
atggacatttacgacacccaaactcttggtgttgtggtgttcggaggattcatggtggtgagcgccattggaatatttctggtgagcacattctcaatgaaagagacctcttatgaggaggcactagccaaccagcgcaaggagatggctaagactcatcaccagaaggtcgaaaagaagaagaaggagaaaaccgtggagaagaagggaaagaccaaaaagaaggaggagaagcccaacggtaaaattcctgatcatgaccccgcacctaacgttaccgttctgttgagggagccagttagggcacctgctgtcgccgtagcacccaccccagtccagcctccaattattgtggctccggtggccacagtcccagcaatgccacaggaaaaactcgcttcaagccctaaggataaaaaaaagaaggagaagaaggtagcaaaagttgaaccagcagtcagttccgtggtgaattcaatccaggtacttactagtaaagccgccatccttgagaccgctccaaaagaagtgcccatggtcgtcgtccccccagtgggcgcaaaggggaacactcccgctactgggaccacgcaggggaagaaggcggaagggactcagaatcagtccaaaaaagccgaaggagctcctaatcaaggcaggaaagcagaggggacaccaaaccagggaaaaaagactgaaggaactccaaatcagggcaagaaggcagaggggacaccaaatcaaggtaaaaaggctgagggcactcccaatcagggaaagaaggctgagggagcccagaatcaaggcaagaaggttgatactacccccaatcagggaaagaaggtggagggcgcccccacacaggggcgcaaggccgagggcgcacagaatcaggctaagaaggtggaaggggcacaaaaccagggcaagaaggcggagggtgcgcaaaatcaaggcaagaaaggggaaggagcccagaatcagggcaagaaagcagaaggggcccagaatcaagggaagaaggccgagggtgctcagaatcagggcaagaaggctgaaggggctcaaaatcagggcaaaaaagccgagggtgcccagaatcagggaaagaaagctgagggagcacagaatcaggggaaaaaaagcgagggagctcaaaatcaggggaaaaaggttgaaggcgcgcagaatcaggggaagaaggccgagggggcccagaaccaggggaagaaagccgagggcgcgcagaaccagggaaaaaaggccgaaggcgcacagaaccagggcaaaaaggccgaaggtgcacaaaatcaaggaaagaaggccgaaggggctcagaatcaggggaaaaaagccgagggagcacagaaccaaggaaaaaaagccgagggcgctcagaatcagggtaagaaagtggagggcgctcagaaccaggggaagaaggccgagggagctcagaatcaggggaagaaggccgagggcgcacaaaaccagggaaaaaaagcagagggtgcgcaaaatcagggacagaaaggtgaaggggctcaaaaccagggcaagaaaaccgagggggctcagggtaagaaggcagagcgttcgcccaatcagggaaagaagggggaaggggccccaatccaggggaaaaaagccgactcagtggccaatcagggcactaaagtggaaggcatcacgaaccagggaaagaaggctgagggctctcccagcgaaggcaagaaagcagagggctcacctaatcaaggcaaaaaggccgatgccgccgcaaaccaaggcaaaaagacagagagcgcaagcgttcaaggtcggaacactgacgtcgcacagtcgcccgaggcccccaaacaggaggcacccgctaagaaaaaatcaggatcaaaaaaaaaaggggagcccggccccccagatgctgatggccccctgtatctcccgtacaaaactcttgtgagcactgtgggcagcatggtatttaatgagggtgaagctcaaagactgatagaaattttgtccgaaaaggccggcatcatccaagatacctggcataaggctacacaaaagggagatcctgtggctatcttgaagcgccagctcgaagaaaaagaaaaactgctggccacagaacaggaggacgccgcagtcgccaaaagcaagctccgagaactcaacaaggaaatggcggcggaaaaggccaaagcagccgcaggagaagccaaggtgaaaaagcagctggttgccagagaacaggagatcactgccgtgcaggctcgtatgcaggcatcttatcgggagcacgtcaaagaggtgcagcagctgcagggcaagattagaaccctgcaggaacaattagaaaatggtcccaatacccagctggcccgcctccagcaggagaactccatcctccgcgatgccctcaatcaggccacaagccaggtggagagtaagcagaatgctgagctggcaaaattacgccaggaactgagtaaggtgagcaaggagctggtggagaaatctgaagccgtgaggcaggacgaacagcaaaggaaggccctggaggctaaggcagcagctttcgagaagcaggtcctgcagctacaggcgtctcacagggaaagcgaggaagccttacagaagagactggatgaggtgtcccgagaactgtgtcacacgcaaagcagccatgcttcattgcgggcagacgcagaaaaagcccaggaacagcagcaacagatggccgaactgcacagcaaacttcagagctccgaagcggaagtacggagtaaatgtgaagagctgtccggtcttcacggtcagctccaggaggcacgggctgagaattcacagcttaccgagagaatccggtcaattgaggccttactggaggctggccaggccagagacgcccaggatgtgcaggccagtcaggccgaagccgaccagcaacaaactcggctcaaagagctggaatctcaggtgagtgggctcgaaaaagaagccattgaacttcgtgaagccgtcgagcagcagaaggttaagaacaatgatctgcgcgaaaagaactggaaggccatggaggccctggccaccgcggagcaagcctgcaaggaaaaactgctgtccctgacccaagcaaaagaggaaagtgagaaacagctgtgcctgatcgaagcgcagactatggaggctctgcttgctttgttgccagagctgagtgtgctggctcagcagaattacacggagtggcttcaggatctcaaggaaaaaggtccgactcttctgaagcatccccctgcccctgcagagccttccagcgaccttgcctccaagttgcgagaagccgaggagactcaatcaactctccaggcggagtgcgaccagtacagaagcattctagccgagacggagggtatgctcagagacctgcagaagtcagtcgaggaggaagagcaggtgtggcgggctaaagtgggtgcagcagaagaagagctgcagaaatctcgggtgaccgttaagcatctcgaggagatcgtcgagaaattaaagggggagcttgagagcagcgaccaagtccgagagcatactagccacctcgaagcagagctggagaagcacatggccgccgcctccgccgagtgccagaactatgccaaagaagtggccggcctaagacaacttctcctagagagtcagtcacagctggatgccgcgaagagtgaggctcaaaaacaatccgacgagctggcactcgtcagacagcagctgtcagaaatgaaaagccatgtcgaagacggggatatcgcaggagcgccggccagcagtccggaggctcctccagcagagcaggaccccgtgcagctcaagacccagctggagtggaccgaggcgatcctcgaggatgagcagacacaacggcagaagttgactgctgaatttgaagaagcacagacgagcgcctgcagattgcaggaagagctcgaaaaattaagaacggccggacccctcgaatcatcagagacggaggaagcatcccagttgaaggaacggctggagaaagaaaagaaacttactagtgacctcggccgagccgctactaggctacaggaacttctgaaaaccacacaagagcaattggccagagaaaaagacactgtgaagaagctccaggaacagttggagaaggccgaggatggaagttcttctaaggaggggactagcgtgtag

SEQ ID NO: 132979 - DNA, 2934 bp, Artificial Sequence
  Description of Artificial Sequence: Synthetic coding sequence
atggatatttacgacacacagaccctgggcgtcgtggtgttcggcggatttatggtcgtaagtgcaatcggcattttcctggtctccaccttcagtatgaaagaaacaagctatgaagaggcccttgcaaaccaaagaaaggagatggccaagacgcaccatcagaaagtggagaaaaagaagaaggagaagaccgtggaaaaaaaaggcaagactaagaagaaggaagagaaaccaaatggcaagataccggatcatgaccccgccccgaacgtcactgttctgctgcgcgagcccgtgagagcacctgcagtcgctgttgcccccactcctgtgcagccacctatcatcgtggcgcccgtggctaccgtccccgccatgccccaggagaagctggcgagtagccccaaggataagaagaagaaagagaaaaaagtcgccaaggtggaaccagcggtgtcatcggtggttaattccattcaggtgctcacgtccaaggccgcgattctggagacagcccccaaggagggtagaaataccgacgtggcccagtcccccgaagctcccaaacaggaagccccggctaagaagaaatcaggcagtaagaagaagggcccacctgacgccgacggccccctgtacctaccatataaaactctcgtgtcaacggtgggtagtatggtgtttaacgaaggcgaagcacagcgccttatcgagatcctgagtgagaaagccggtatcatccaggacacttggcataaggccacacagaaaggagatccagtcgccatccttaaacggcaacttgaggagaaagagaaacttctggctactgagcaggaggatgcagcagtggcaaaaagtaagctacgggagttgaataaggaaatggccgccgaaaaagcaaaggccgccgccggagaggccaaagtgaagaagcagctcgtggcgagggagcaggagattaccgctgtgcaagcacgcatgcaggcctcctatcgggagcatgttaaagaggtgcaacaattacagggaaagattcggacccttcaggaacagctagagaacggccccaatacccaactggcaaggcttcagcaggaaaatagcatcctccgtgacgccctgaaccaagccacaagccaggtcgagagtaaacaaaatgctgagttagccaaactacgccaggaactgtctaaagtctcaaaggaattggtcgagaagtcagaggcggtgcggcaggatgaacagcagcgaaaagcactcgaagctaaagcagcagcttttgagaagcaggttcttcagttgcaggcatcccaccgcgaaagtgaggaggctttgcaaaagaggctggatgaggtctcgcgtgaactctgccatacacagtcctcccacgcatctctcagagccgacgccgagaaagcccaggagcaacagcagcagatggcagagctgcatagtaaactgcagtcaagcgaggcggaggtccggtctaagtgtgaggagctgtccgggctacatggtcagttgcaggaagcccgcgccgaaaactctcagctgaccgagaggataagaagtatcgaagctctgctggaagcaggacaggcgcgggacgcacaggacgtgcaggcgtctcaagcggaggcggatcagcaacaaacccgcctgaaagaattagagtcccaagtgagcggactggaaaaggaggcgatcgaacttagggaggcagtagaacagcaaaaagtcaaaaacaatgacctaagggagaagaattggaaggcaatggaggcactcgccaccgccgaacaggcgtgtaaagaaaagctgctgtctctgacccaggcaaaagaagagagcgagaagcagctgtgcctaatcgaggcccaaacgatggaagctcttctcgcactcctgcctgagctgtctgtgcttgctcagcaaaactacacagaatggctccaggatctcaaagagaagggaccaaccctgcttaagcatcctcccgcacctgccgagccaagctctgatttagcctcaaagttgagagaagcggaagagacccaaagcactctgcaggccgagtgcgatcaatataggagtatcctagctgagaccgaggggatgctgagagatctccaaaagagcgtcgaagaggaggagcaggtctggcgggccaaggtaggtgcagccgaagaagagttgcagaaatcaagggttacggtaaagcacctcgaggagatcgtggaaaagctgaagggagaactggagtcctcggaccaggtcagggagcatacttctcatctggaggccgagctggagaagcatatggccgccgcttcagctgaatgccagaattatgccaaggaggtggcaggtctgaggcagctactgctcgaaagccagtcacaactggatgcagcgaaatccgaagcgcagaaacagagtgatgaattggcgctggtcaggcagcagctgtccgagatgaagagtcacgttgaggacggcgatatcgcaggcgcccctgcttcatctcccgaggctccacccgcagagcaggatcccgttcagttaaaaacccagttggaatggacagaggcgatcttggaggatgaacagacccaacgtcagaagctaaccgcagaattcgaagaagcccaaacaagtgcatgccggcttcaggaggagctggagaaattgaggaccgccggcccgttagagtctagcgaaactgaagaagccagtcagctgaaggaaagactcgagaaagagaaaaaattgacttccgacctcggccgcgcggcgactcgcctgcaggagctgctaaagacaacacaagagcagctcgctcgagagaaggacacagtgaaaaaactgcaggaacagttggagaaagccgaggacgggtcttcgagtaaggaggggaccagcgtttag

SEQ ID NO: 132980 - DNA, 2934 bp, Artificial Sequence
  Description of Artificial Sequence: Synthetic coding sequence
atggacatttacgatacccaaacactcggggtggtggtattcgggggcttcatggtagtgtccgccatcggtattttcctggtgtcaacgttctctatgaaggaaacttcatacgaagaagccctggccaatcagcggaaggagatggctaaaacccaccaccagaaggtcgagaagaaaaaaaaggaaaagaccgtcgaaaaaaagggtaagaccaaaaaaaaagaggagaagcctaacggcaagatacctgaccacgacccagcccccaacgtgaccgtgctactgcgggagccagtaagggcgccagctgttgccgtggcccctacgcccgtgcagccacctataatcgttgcccccgtggccacagtgcccgccatgccccaagagaagttggcctcctcccccaaggacaagaaaaaaaaagagaaaaaggtggcaaaggttgagcctgccgtgtcaagcgtggttaacagtattcaagtgctcaccagcaaggccgctatccttgagacagctcctaaggaaggaagaaacaccgacgtggcccagagtcctgaggctcccaagcaggaggcacccgctaagaagaagagcggctccaagaaaaaaggaccaccagacgcagatggacccctgtacttgccatacaaaaccctcgtgagcaccgtggggtccatggtgttcaatgagggtgaagctcagcgtctgatcgagatcctgtctgagaaggcgggtatcatccaggatacctggcacaaggccacgcagaagggcgatcccgtagcgatcttgaagaggcagctcgaggagaaagagaagttgctggcgacagaacaggaggatgcagccgttgctaagagtaagttgcgcgaactcaacaaggaaatggcagccgaaaaggctaaagctgccgcaggagaggcaaaggttaaaaaacagctggttgctagggaacaggaaatcaccgcggtgcaggccaggatgcaagcgagttatagagagcatgtgaaggaagtgcaacaacttcaagggaagatccgcactctgcaggaacagctggagaatggtcccaacacccagctggcaaggctccagcaggaaaattccattctacgggatgcgctcaatcaagccacatcccaggtggaatccaagcagaatgccgagctagccaaattaagacaggaactttcaaaggtgtctaaggagcttgtggaaaaatcagaagctgtcaggcaggatgaacaacagcgtaaggctcttgaggctaaggcggccgcgtttgagaagcaggtgctgcagctgcaagcttcacatagagaaagcgaggaggccttgcagaaaaggctggacgaggtctccagagagctgtgtcacactcagagctctcacgcatctctgcgtgcagacgccgagaaagcacaggagcagcagcagcagatggctgagctccatagcaaactacagtccagcgaggcagaagtgcggagtaaatgtgaagaattaagcggacttcatggacagctgcaggaagcgagggccgagaactcgcagcttacagagaggattaggagtatcgaggctcttctggaggctgggcaggcccgtgacgcacaagacgtccaggcctcccaggctgaggctgaccagcaacaaacacgtctaaaagagctggagtcacaagtgtcaggactagaaaaggaagccatcgaactgagagaggcagtcgagcagcagaaagtgaaaaataatgacctcagagagaagaattggaaggctatggaggcccttgccactgccgaacaagcctgtaaagaaaaactgctgtctctcacccaggccaaagaggaatctgagaaacagctgtgcctgatagaagcccagacaatggaggccctcctcgccctgttgcccgaattgtccgtgctggcccagcaaaactatacggaatggttacaggatctgaaagaaaaagggcccaccttgctcaagcatccacccgctccagctgagcctagtagcgatcttgcaagcaaactgcgcgaagccgaggaaacccagtcaactctgcaggccgaatgcgaccagtacaggtcgatcctggctgaaaccgagggcatgcttcgggaccttcagaagtccgtggaggaagaggaacaagtctggcgtgccaaggttggggccgccgaagaggagcttcagaagtccagggtcacggtgaagcatctggaggagatagtagagaaactgaaaggtgagttggagagtagcgaccaggtccgcgagcacacgtcacatctggaggccgagctggaaaaacatatggcagcagcctctgcggaatgtcagaactatgccaaggaagtcgccggcctccgccagttgctgctggagagtcagtcccaactggatgcagctaagtcagaggcacagaaacaatccgatgaactggccttggtaaggcagcagctgtctgagatgaaatcccatgtggaggatggagacatcgcaggggctccggcttcctcgccagaggctccaccagctgagcaggaccccgttcagctcaaaactcagcttgagtggacggaggccatactcgaagacgaacaaactcaaaggcagaagctaacagccgagttcgaggaggcccagacctccgcttgcagactccaggaggagctggaaaaactaagaacagccgggccactggagtcatccgagaccgaagaggcttcacagctaaaggaaagactggagaaggaaaagaagctgacttcagacctgggcagggcggcaacccgcttacaggagctgttaaagacaacccaggaacagctggccagagagaaagacacagttaagaaactgcaagaacagctcgagaaggcagaggacggcagtagctccaaggaagggacgagtgtgtag

SEQ ID NO: 132981 - DNA, 4233 bp, Artificial Sequence
  Description of Artificial Sequence: Synthetic coding sequence
atggacatctacgatacccagacactcggagtggtcgtgtttgggggattcatggtggtctcagcaattgggatattcctcgtgagtacgttctctatgaaggagacgtcttacgaggaggctcttgcaaatcagcggaaggagatggctaagacccatcaccaaaaagttgagaaaaaaaaaaaggagaagactgttgaaaaaaaggggaagacaaagaaaaaggaggaaaagccgaacggaaaaatccccgaccacgacccagcccctaatgtgacagttctgctgagagagcccgtgcgggcacccgcagtggccgttgcgccgaccccggtacagcccccgatcatagtggcgcctgtagctactgtgccagccatgcctcaggagaagctggctagttcacccaaagacaaaaagaaaaaggagaaaaaagtcgcaaaagttgaacctgctgtctcgtctgtggtgaactcaatccaggtcctgacaagtaaagctgccattctggaaaccgcccctaaagaagtacctatggtggtggtgcctccagttggggccaagggaaacacacctgctaccggtacaactcaaggcaagaaagcagagggaacacagaaccagtcaaagaaggccgaaggcgcacctaaccaaggccgcaaagcagagggtactcccaaccaaggcaaaaagacggaaggcacacctaaccagggcaagaaagccgagggaacacctaatcagggaaagaaggccgaagggacccccaatcagggcaagaaggctgagggcgctcagaatcagggcaaaaaggtcgatacaacgccaaaccagggcaagaaagtcgagggcgcacctacccaagggcgaaaagcagaaggagctcagaatcaagccaagaaagttgaaggggcgcagaatcaaggcaagaaagctgaaggcgcacaaaatcagggcaaaaaaggagagggcgcacaaaaccaaggtaagaaggctgagggtgcccagaaccagggcaaaaaagccgaaggggctcaaaatcaggggaaaaaggccgaaggggcccagaatcaaggcaagaaagcagagggtgctcagaaccagggcaagaaggctgagggagcccagaatcagggtaagaagtcggagggcgcccaaaatcagggcaaaaaggtagagggagcgcagaaccagggaaagaaagctgaaggcgcccagaaccagggaaaaaaggccgagggagctcagaatcagggaaaaaaggcagaaggtgctcagaaccaggggaagaaggcagaaggcgcacaaaaccaaggcaagaaggccgagggagcgcagaatcagggcaagaaggcggagggtgctcagaaccaggggaagaaagctgaaggcgcacagaaccaggggaagaaagtggaaggtgcgcaaaatcaaggcaaaaaggcagaaggtgcccagaaccaaggcaagaaagcagagggggcccagaatcagggaaagaaggccgaaggtgcgcaaaaccaaggacagaaaggcgagggggcacaaaatcaaggaaagaagactgaaggtgctcaagggaagaaggcggagcgcagccctaatcagggcaagaagggcgaaggagccccgattcaaggtaaaaaggccgatagcgtcgcgaatcagggcactaaggtcgaggggataactaaccagggcaaaaaggctgagggctcaccatctgaaggcaagaaagcggagggaagtcccaaccaggggaaaaaagccgatgcggcagccaatcagggaaagaagacggaaagcgcatcagtccagggacggaataccgatgtagcacagagcccagaagcaccaaaacaggaggcccccgcgaagaagaagtctggctcgaaaaaaaagggagagcccggccccccagatgctgatgggccactgtatctgccctataagacactagtgagtactgtcggaagtatggtattcaacgaaggagaggcgcaacgcctgatcgagattctctccgaaaaggcagggataatccaagatacatggcataaggccacccagaagggggatcctgtggccatcttaaagagacagctcgaggagaaggaaaagctcctggcgaccgagcaggaggacgcagctgtggctaagtctaaactcagagaactgaacaaagagatggctgctgaaaaggccaaggccgcagctggagaggcaaaggtgaaaaagcagcttgttgcacgggagcaagaaattaccgccgtgcaagcaaggatgcaggcatcatatagggaacatgtgaaggaagtgcagcagttgcagggtaaaatccggactttgcaggagcaactcgaaaacggacctaacacgcaacttgctcgactgcagcaggagaactcaatactaagggatgcactgaaccaagctacatcccaggttgagtcaaagcaaaatgctgaactcgccaaattgagacaagaactgtcaaaggtgtccaaggagctggttgagaaatccgaggctgtccggcaggacgaacagcaacgtaaagctctggaagccaaagctgcagcctttgagaagcaagtgcttcagctccaagcttcccatcgcgagtcagaggaagctctccaaaaacgtctggacgaggtaagccgggagctttgccacacacagtcgtctcatgcctctcttcgggcagacgctgagaaagctcaggagcagcaacagcaaatggccgaactgcattcaaaattgcagagtagcgaggcagaggtcaggtctaagtgtgaggagctgtctggacttcacggccagctccaggaggcaagagcggaaaactcacagctgactgaacggatacggtctattgaggctttgctggaagctgggcaagcgcgggacgcccaggacgtgcaggccagccaggcagaggccgatcagcaacagacacggctcaaggagcttgagagtcaggtctcaggactggaaaaggaggcgatcgagctccgagaagcagtggaacaacagaaggtcaaaaataacgatcttcgagagaagaattggaaggccatggaagccctcgcgacggctgagcaggcctgtaaggagaaacttctgagcctaacccaagccaaggaggaatctgagaaacagttgtgcctgatcgaggcgcagaccatggaggccttactggcactccttccagaactctctgtgcttgcacaacaaaattataccgagtggcttcaggacctgaaagagaaaggacctaccttgttgaagcacccaccggcacccgctgagcccagttctgatctcgccagcaaactgcgggaggctgaggagactcagtctactctgcaggccgaatgtgaccagtaccggagtattctcgccgagaccgaaggcatgctcagggaccttcagaagagtgtcgaggaagaagagcaggtgtggcgggcgaaggtcggagccgctgaggaagagttgcagaagtcccgtgtgacagtgaaacacttagaagagatcgtcgagaaattgaagggcgagttggaatcgtctgaccaggtgcgggagcacacctcacatctcgaagccgagctggaaaaacacatggctgcagctagcgccgagtgtcaaaactatgctaaagaggttgccgggttgcgccagctgctgctagagagtcaatctcagctggatgccgcaaagtccgaggcacaaaagcagagcgatgaactggcgcttgtgaggcagcagctgtcagagatgaagtcccacgtggaggacggcgacatagccggagctcccgcatcttcccctgaggccccacccgccgagcaggatcctgtgcagcttaagacgcagttggagtggaccgaggcgattctcgaagacgagcagacgcaacgacagaaactgactgccgagtttgaagaggctcagacaagcgcgtgccggcttcaggaggaactcgagaagcttcgaaccgctggccccctggaaagctccgaaacggaggaagcttctcagctgaaggagcgactggagaaagaaaaaaaactcacctctgatctgggaagagccgctacgaggctccaggagctgttaaagactacccaggagcagttggcccgagagaaggatactgtgaaaaagctgcaagaacagctggaaaaggctgaggatggttcgtcgtccaaggagggcactagcgtgtag

SEQ ID NO: 132982 - DNA, 903 bp, Artificial Sequence
  Description of Artificial Sequence: Synthetic coding sequence
atggacatctacgatacccagaccctgggtgtggtagtttttggcggcttcatggttgtgtcagccatcggtatcttcctggtgtctacgtttagcatgaaggagacttcttacgaggaagctctagccaatcaaaggaaggagatggctaagacccaccaccagaaggttgagaaaaaaaaaaaggaaaaaaccgtagagaaaaagggcaaaactaaaaagaaggaagagaagccaaacgggaaaattcctgatcacgaccccgcccctaacgttactgtcttgctccgagaaccggtgagggcccccgcagtggcggtggcccccacccccgtgcaacctcccatcatcgtggcccctgtggctacagtgccagctatgccacaggagaagctagcctcctcacctaaagacaagaaaaagaaagagaaaaaagtagccaaggtcgaaccagccgttagcagtgttgtgaatagcatccaggtgcttacgtctaaggcagcaattctcgagaccgcgccaaaggaggtacccatggtagtcgtgccccctgtgggtgccaagggaaatacacccgccaccgggactactcaaggaaaaaaagctgaaggcacacagaaccagtccaaaaaggccgagggagctcccaatcaggggcgcaaagccgaaggaactccgaaccagggtaaaaagacagagggaacacctaatcagggaaaaaaagccgaggggactccaaaccaaggaaagaaggccgagggcactccaaaccagggaaaaaaagccgagggcgcccagaaccaaggcaagaaggtcgacacgaccccaaatcaagggaagaaggtggagggcgcccccacacagggaaggaaggcagaaggagcccagaaccaagccaaatag

SEQ ID NO: 132983 - DNA, 2256 bp, Artificial Sequence
  Description of Artificial Sequence: Synthetic coding sequence
atggtctttaacgaaggcgaagcccagagactgatagagatactgagcgagaaggccggaattattcaggatacatggcataaagccacccagaagggggaccctgtggcaattctgaagaggcagctcgaggagaaggagaaactcctcgctacagagcaagaggatgctgccgtcgcaaaatcaaagctgagggagctgaacaaggagatggcagccgaaaaggccaaggccgccgctggtgaggcaaaagtcaaaaaacagctggttgcacgcgagcaggagattactgctgtccaggctagaatgcaggcttcttacagggaacacgtgaaagaggttcagcagcttcagggtaaaattcggacactacaagaacagcttgaaaatggccctaacacacagttggcgcgcctgcagcaggaaaattctattctgagggatgccctcaaccaggctacaagccaagtcgaatccaaacaaaatgccgaactcgctaagctgcgtcaggagcttagcaaagtgagtaaagaactggtagagaagtccgaggcagttcgacaagacgagcagcagcgcaaggccctggaggcaaaggcggctgcgtttgagaaacaggtcctgcagctccaggcatctcatcgtgaatccgaagaagcattgcaaaaacggctcgatgaggtgtcacgagaactgtgccacacccagtccagtcacgcatctctgagagccgacgccgagaaagctcaggagcagcagcagcaaatggcggaactgcacagcaaactccagtcgagcgaggcagaggtacgctccaagtgcgaggagctctctggtttgcacggacaactgcaggaggctcgggctgaaaacagccagctaactgagagaatccggtccattgaggctcttttggaggccggccaggcccgtgacgctcaggatgtacaggcgtctcaggcagaggccgaccagcagcaaactaggcttaaagaactggagagtcaagtgtcagggctcgagaaggaagccatcgaactcagagaggccgtggaacagcagaaggtgaagaataacgacctgcgcgagaaaaactggaaggccatggaggctttagctactgcagaacaggcctgtaaggagaagttgctctctctgacccaagccaaggaggaatcagaaaagcagttatgcttgatcgaggcccagacaatggaagcactcctggcactcttgcctgagttatctgtcctggcacagcagaattatacggagtggttgcaagatttgaaggaaaaggggccaactctcctgaaacatccacccgccccagctgagccatcttccgatctcgcctctaagcttagggaagccgaagagactcagagcaccctgcaggcagaatgcgatcaatatcgctccatcctggccgagaccgaaggcatgttgcgggatctccagaagtcagtggaggaggaggagcaggtgtggcgagcaaaagtgggcgccgccgaggaggagcttcagaaatctcgtgttacagtcaagcatctggaggaaattgtcgaaaaattgaagggggagctggaatcttcagatcaggtcagggagcacacttcacacctggaggcggagctggagaagcatatggctgccgcgagtgccgagtgccaaaattatgcgaaggaggtggccggtctcagacaactcctactcgagtctcagtctcaactggatgccgctaaatctgaggctcagaagcagagtgatgaactggctcttgtccggcagcagctttccgagatgaaatcccacgtggaagacggcgacatcgcaggagccccagcgagctcccccgaagcaccccctgctgagcaggatcctgtccagctgaaaacccagctggagtggactgaggccatcctggaagacgagcaaacccaacgccaaaaactaacggctgaattcgaggaggcccagactagcgcttgccggctgcaggaggagcttgagaagcttcgaaccgccggcccgctcgaatcaagtgaaaccgaagaggcctcacagctcaaggaacgccttgagaaagaaaaaaaactaacctcggacctcggaagggctgcaaccagactccaggagctcctgaaaactacacaggagcaattggccagggagaaggataccgtgaaaaaattgcaggagcagctggagaaagccgaagatggatcttcaagcaaggaggggacatcagtgtag

SEQ ID NO: 132984 - DNA, 663 bp, Artificial Sequence
  Description of Artificial Sequence: Synthetic coding sequence
atggcttccgggtgtaagatcggccccagcatccttaactcggacctggcaaatctcggcgcagagtgcctcagaatgctcgacagtggcgcagactatctccacctggacgtgatggacggctatatgcacatgatggtttcaaaacccgagcagtgggtgaaacccatggcagtggcaggggcgaatcaatacacctttcatctggaagctaccgagaaccccggcgctctgattaaagatatcagagaaaatggaatgaaaagttgctctgtcacgcaagctgaggtccagtggcactcccagggccccctacaggtcggattagcaattaagccaggcacctccgtggaatacttagcaccgtgggcaaatcaaatcgatatggcgttggtcatgactgtagagcctggcttcggagggcaaaaattcatggaagacatgatgcccaaagtgcattggttaaggacccaattccctagcctggacatcgaggtagatgggggcgtggggcccgataccgtgcacaagtgtgctgaagctggcgctaacatgattgtatcagggtccgcgattatgaggtccgaggatccaagatccgtcatcaacctgctgaggaatgtctgctccgaggccgctcaaaaacgttcactggatcggtag

SEQ ID NO: 132985 - DNA, 687 bp, Artificial Sequence
  Description of Artificial Sequence: Synthetic coding sequence
atggccagtggctgcaaaataggaccctccatcttgaattcagatctggctaatctgggggccgaatgtctgagaatgctggattcaggggcggactacttgcacctggacgttatggatgggcattttgtgcccaatataacatttggtcacccagtggtcgagtcattgcgtaagcagctgggccaggaccctttttttgatatgcacatgatggtatccaaacccgagcagtgggtcaagccaatggctgtggctggcgctaatcagtacacttttcatcttgaggccaccgaaaaccctggcgcgctgattaaagacatccgagagaacggtatgaaggtgggccttgcgatcaagcccggcacctcagttgagtatctcgccccgtgggctaatcagatcgacatggctctggtgatgaccgtggagccgggctttgggggtcaaaagtttatggaggacatgatgcctaaagtgcactggctccgcacccagtttccaagtctggatatagaggttgatggaggcgtgggcccagacactgtgcacaaatgcgcagaagccggcgccaacatgattgtgtcaggatctgccatcatgcgctcagaagatccgcgctccgtcatcaacctgttacgcaacgtgtgttctgaagccgcgcagaagcgctctctggacagatag

SEQ ID NO: 132986 - DNA, 537 bp, Artificial Sequence
  Description of Artificial Sequence: Synthetic coding sequence
atgcacatgatggtttctaaaccggagcagtgggtgaagccaatggccgtggctggggcaaatcaatacacttttcatctcgaggcgacggagaatcctggagccctgatcaaagacattcgagagaacggcatgaaatcttgtagtgtcacccaggcggaagtccaatggcactcacaggggcccctccaggttggattggctatcaagcctggcacctcagtggagtatttggctccctgggccaaccagatcgatatggctctggtgatgactgtggaacccggtttcggcgggcaaaagttcatggaggacatgatgccaaaagttcactggttgaggacccagttcccttctctagatatcgaggtagatgggggtgttgggcctgacacagttcacaaatgcgcggaagccggagcaaatatgattgttagtggttctgctattatgagaagcgaggacccccgttcggttatcaacctcctcagaaacgtctgcagcgaggctgcccaaaagaggtcactggaccgctag

SEQ ID NO: 132987 - DNA, 537 bp, Artificial Sequence
  Description of Artificial Sequence: Synthetic coding sequence
atgcacatgatggtatcaaaacctgagcaatgggtcaagccaatggcagtggctggggctaatcagtacaccttccacttggaagcgactgagaatccaggtgcacttattaaagatataagggagaacggcatgaaatcttgtagcgttacacaggctgaggtccagtggcactcccaaggaccacttcaagttgggctcgcaatcaagcccggaacatccgttgagtatttggcgccgtgggccaatcaaatagatatggccctggtcatgacagtcgagccagggtttggcgggcagaaattcatggaggacatgatgccaaaggtacactggctgaggacccagtttccgagtttggacatcgaagtagacggaggcgtgggacccgacactgttcacaagtgcgccgaggctggcgccaacatgatcgtttccggctccgcaatcatgaggagcgaggatccccgaagtgtgataaacttgctccgcaacgtctgtagcgaggcagcacagaagagatctctggatcgatag

SEQ ID NO: 132988 - DNA, 285 bp, Artificial Sequence
  Description of Artificial Sequence: Synthetic coding sequence
atgcacatgatggtttccaaacctgaacaatgggtcaaaccaatggcagtcgccggtgctaatcagtatacgtttcacctggaggccaccgaaaacccgggcgccttgatcaaggacatacgcgaaaacggaatgaagagttgctctgtgacgcaagctgaggtgcaatggcacagccagggtccgctccaggtgggattggcaataaagcctggcacctcagtggaatacctggctccatgggctaaccagatcgatatggcactggtcatgacagtggagtag

SEQ ID NO: 132989 - DNA, 537 bp, Artificial Sequence
  Description of Artificial Sequence: Synthetic coding sequence
atgcatatgatggtttccaaaccggagcagtgggtaaagccaatggctgtggccggtgctaaccagtacacatttcatctggaagcgaccgaaaatcctggagcactaataaaagatataagggaaaacggaatgaaaagttgcagcgtgactcaggcggaggtccagtggcacagtcagggcccacttcaggtgggcctggcgataaagccgggaacatccgttgaatatcttgcgccctgggcaaaccagattgatatggctctagtaatgaccgttgagcccgggtttgggggacaaaagtttatggaggacatgatgccaaaagtccattggctacggactcaatttcccagtctggacatcgaggtggatggtggggtggggcccgacactgtacataaatgtgcagaggccggtgcaaacatgattgtatccggaagtgctatcatgaggtccgaagatccgaggtccgttattaacctgctgcggaacgtatgtagcgaagctgcccagaagcggtctctggacaggtag

SEQ ID NO: 132990 - DNA, 600 bp, Artificial Sequence
  Description of Artificial Sequence: Synthetic coding sequence
atggcttctggatgcaaaattggaccgtctatactcaacagtgacttggctaatctaggagccgagtgccttcgaatgcttgattcaggcgccgactatcttcatctcgatgtgatggacggccactttgtgcccaacatcactttcggacacccagtggttgaatccctgaggaagcaactgggccaagatccatttttcgatatgcatatgatggtgagtaaaccggagcagtgggtgaagccgatggccgtggccggagccaaccagtacaccttccatctggaagcaactgagaacccaggggctctcataaaagatattagggaaaacgggatgaaggtgggactggcaatcaaacctgggacctcagtagaatatctggccccctgggcaaatcagatcgatatggcgctcgtaatgaccgtggagccaggctttgggggacaaaaattcatggaggatatgatgcctaaggcaggcgcaaatatgattgtgagcggtagcgccatcatgaggtctgaagatcccaggtcagttataaatctactgaggaatgtctgctcagaggccgcccagaaacgatctttggaccgttag

SEQ ID NO: 132991 - DNA, 3159 bp, Artificial Sequence
  Description of Artificial Sequence: Synthetic coding sequence
atgcgagaggccgcagaacggagacaacagctgcagttggagcacgaccaagccctggccgtgctctctgccaagcagcaggaaatcgacttactacagaagtcaaaagtccgcgagctagaggaaaaatgtcgcactcagtctgagcagttcaacctgttgtcccgtgacttggagaagttccgccagcatgctggcaaaatcgatttgctgggcggctcagccgttgctccactcgatatcagcacagccccaagcaagccatttccccagttcatgaatggtctggctaccagtctgggaaaaggacaggagtccgcaataggcggaagcagcgctatcggtgaatacattcggccactccctcaaccaggagacagaccagaacccttatcagccaagccaaccttcttgagccgctctggtagtgctcgctgtcggtcggagtccgacatggagaatgaacgcaatagtaacacatctaagcagagatattcgggaaaggtacacctttgcgtagcccgttattcttataatcccttcgacggccccaacgagaatcctgaagccgagctccctttgaccgccggtaaatacctgtatgtgtatggtgatatggacgaagatgggttctacgagggagaactgctggatggacaacggggcctcgtcccctcaaactttgtggattttgtacaggataacgaatctcgactagcttccacactgggtaacgaacaagatcaaaattttataaaccacagtgggattgggcttgagggtgaacatatattagacctgcacagtccaacgcacatcgatgcaggtattactgataattccgcaggcactttagacgtgaacatcgatgatattggcgaagacatagttccataccctcgtaagatcacactaatcaagcagctggcgaagagcgtcattgttggctgggagccaccggctgtccccccaggctgggggactgtgtcctcttataatgtgctggtcgataaggaaacgcgtatgaacctaacactcggatctcgaacgaaagccttgatcgagaaattgaacatggctgcgtgcacgtatcgtattagcgtacagtgtgttacctcaagggggtcgtcggacgaactgcagtgtacacttctcgtgggcaaggacgtcgtggtcgccccatcccacctcagagtggataacatcacccagatctccgcccaactcagctggctccctacgaattcaaactatagccatgttatttttctaaatgaggaggagttcgatatcgtgaaggccgccaggtacaaatatcagttttttaatctgcgacccaacatggcgtacaaggtgaaggtgctggctaagcctcaccagatgccctggcagctgcccctagagcaacgtgagaagaaggaggcgtttgtcgaattcagtacgctaccagccggtcctcccgctcctcctcaggatgtgacagttcaggccggagttactccggctacaataagagtttcatggcgccctcccgtgctaactccaacgggattgagcaatggcgccaatgtgactggctatggagtctatgcaaaagggcagagggtggcggaagtcatctttcccactgctgactccaccgcagtggaactagttcggcttcgcagcctggaggcaaagggtgttacagtgagaaccctgtctgctcagggcgaatctgtcgatagcgcagtggccgctgtgcctcctgagctactggtcccacccacacctcacccacggcccgccccacaaagtaaacccctggcctcttctggggtacccgaaacaaaggatgagcacctgggcccccatgctcgtatggatgaagcctgggagcagtcccgcgcccccggccctgtgcacggacacatgcttgaaccccccgtagggcctggaagaagatccccttcgcctagccgcatcctgcctcaaccacagggaactccagtgtccactacagtagccaaggcaatggcaagggaggccgcccagcgagtcgccgagagcagccggcttgaaaagaggagcgtgtttctggaacgctcaagcgctgggcagtacgccgcttcagacgaggaggacgcatacgatagtcccgactttaaaaggagaggtgcctcagtcgatgatttcttgaaaggaagtgagttgggaaaacagccgcactgctgtcacggggacgaatatcacactgagtctagtaggggcagcgatctatctgatatcatggaggaggatgaggaggaactgtattccgaaatgcagttggaggacggaggacggaggcggcccagcggaacaagccataatgccttgaaaattctgggcaacccagcctccgcaggacgagtcgaccacatgggacgacgctttcccaggggaagcgctggtccacagagatccaggccagtgacagtgccctcgatcgacgattacggccgggatcggctaagcccggatttttacgaggagtccgagacggaccccggcgccgaagagctcccagcccgtattttcgtcgccttattcgattatgaccccctaaccatgagtcccaacccagatgcggctgaggaagagctgccttttaaagagggacagatcataaaagtatatggagataaagacgcagacggcttttatagaggggaaacatgcgctaggctcggcctgatcccttgcaacatggtgtcggaaattcaagctgacgacgaggaaatgatggatcagctgctgagacaaggcttcctgccccttaatacgcccgttgagaagatcgagagaagtcgaagaagcggaagaagacattctgtatctacacgccggatggtggcactctacgactatgatccgcgggagtccagtccgaacgtcgacgtagaggcagagctaacgttttgcacaggagacattatcacggttttcggagaaattgacgaagatgggttctactacggcgagctgaacggccagaaagggcttgttccgagtaatttcctcgaagaggtccccgacgacgtagaggtttacttgtctgacgctccttctcactattcacaggacaccccaatgcggtcaaaagccaagagaaaaaaatccgtccacttcactccgtag

SEQ ID NO: 132992 - DNA, 1938 bp, Artificial Sequence
  Description of Artificial Sequence: Synthetic coding sequence
atgaacgggttagcaaccagtcttgggaagggccaagagagcgcaattggggggtcatctgccatcggagagtacattcggcctctgccccagcccggggacaggcccgagccccttagcgccaagccaacctttttgagcaggtcgggatcggcaagatgcaggtcagagtctgacatggaaaacgaaagaaacagcaacacatcgaaacagcgctactctggcaaagtgcatttgtgtgttgccagatactcctacaatcctttcgacggccccaatgagaatccagaagcagagcttccccttaccgcgggtaagtacttgtatgtatatggtgacatggacgaggatggcttctacgagggagaactgctggatggccagcggggtctggtgccttctaattttgtggacttcgtgcaggataacgaaagcagactagcctctactttaggaaatgagcaggaccaaaatttcattaatcattcaggtatcggtctggaaggggagcatattttggacctgcacagcccaacacacatcgacgctggaatcaccgataactccgctggtaccctcgacgtcaacatcgatgatatcggagaggatatcgtaccctacccccgcaagattactttgatcaagcaattagccaaaagtgtcattgttggctgggagccccctgccgtgcccccgggttggggaacagtaagttcctacaacgtcctcgtggacaaggagacccgaatgaatctcaccctgggaagtcgcacaaaggcactgatcgaaaaactgaatatggcagcctgtacctatcgcatctcagtgcagtgtgtaacaagccggggcagtagtgacgagttacagtgcacactgcttgtaggcaaggacgtcgtggtggccccaagccatttacgggtagataatataacccagatttctgcccagttaagttggctgcccactaattcaaactattctcacgtaatctttctgaatgaagaagagttcgacatcgttaaggccgctaggtataagtaccagtttttcaatctacgccctaacatggcctataaagtgaaggtgctcgcgaagccccaccagatgccttggcagctccccctcgaacagagggagaaaaaggaagcctttgtggaattttcaacactccctgcgggaccaccagctccgccgcaagatgtaactgtgcaggccggagtgactccagccacaattagggtaagctggaggcctcccgttctgactccaaccggtctctcaaacggtgcgaacgtgacgggttacggagtgtatgcgaagggccagcgcgtggcagaggtgatcttcccaacagcagactcaactgctgtcgagctggtgcgcctgcgatcattagaggcaaagggagtgaccgtgagaaccttatccgctcagggtgagtctgtggactccgcagttgcggctgtgcctcctgagcttttggtcccacccacgcctcaccctcgtcccgcgccccagtccaaaccactcgcttccagcggagtgcccgaaactaaggatgaacacctggggccacatgctagaatggacgaagcttgggagcaaagccgagctcctggcccggtccatggccacatgctggagcctccggtgggacctggccgccggtccccgtccccctcccggatcctgccccaaccacagggcacaccagtgtcgacaactgtggccaaggcgatggccagagaagccgctcagcgcgtggctgaaagcagtcgtctagagaagcgttctgtgtttttagagagatcctcagccggccagtacgcagcttcggacgaagaagacgcttatgatagccctgattttaagagacggggcgcttccgttgatgatttcctgaaaggttccgagcttggaaagcagatggcctcttag

SEQ ID NO: 132993 - DNA, 1938 bp, Artificial Sequence
  Description of Artificial Sequence: Synthetic coding sequence
atgaatggattagcaacatcactgggtaaaggccaggaaagcgcaatcggggggagttcagccataggagaatacattcgcccactacctcagcctggagaccgaccagagcctctcagcgctaaacctacattcctatcaagatccgggagcgcacggtgccgctccgagtccgacatggaaaacgagcggaactccaacacctcaaaacagcggtacagcgggaaagtgcatttgtgcgtggcccgctatagctacaatcccttcgacggccctaacgagaaccctgaagccgaactgccactgactgccggaaagtacctgtacgtgtacggggatatggatgaggatgggttctacgagggagaacttctcgacggacagagaggacttgttcccagtaatttcgtggacttcgttcaggacaacgagagccgcctcgcctcgacgttgggcaacgaacaggatcagaatttcatcaaccatagcgggattggactcgagggagagcatattctcgatctgcattcacccacacacattgacgccgggatcacagacaactctgccggcacattagacgtcaatatagacgatatcggggaagacatcgtgccatatccgaggaaaattactcttataaaacaactggccaagtcagtgatcgtggggtgggagccacctgccgttccacctggatggggtactgtgagctcgtacaacgttctggtagacaaagagacacgaatgaaccttactctgggtagcaggaccaaagccctaattgaaaagcttaacatggcagcttgtacctacagaatctcggtccagtgcgtgaccagtagaggttcaagcgatgaactgcaatgcaccttactcgtgggcaaagatgttgtcgttgccccatcccacctgcgggtagataatatcacccagatctctgcccagctatcctggttgcctacaaattctaattattctcatgtcatcttcttaaacgaggaagagttcgacatcgtgaaagctgcacgctacaaatatcagttttttaacctcaggcctaacatggcttacaaagtgaaggttttggctaaaccacatcaaatgccatggcagttgcccctggagcagcgggaaaaaaaagaggcttttgtggagttctctactttgccagctggtccacccgcccctcctcaggacgtcaccgttcaggcgggggttacacccgccaccatacgagtctcctggagacctcctgttctgacccccaccggcctgagcaacggcgccaacgtgaccggctatggcgtgtacgccaaaggccagcgtgtggcagaggttatctttccaactgcagatagtacagccgttgagcttgtgaggctgagaagcttggaagccaagggcgtgactgtgcggaccctttctgctcagggcgaatccgtcgacagcgcagtcgctgccgtgcctcctgaactcctggtcccacccacccctcatccaaggcccgccccccagtcaaaacccctggcgtcctccggcgtgcctgagacaaaggacgaacacttgggacctcacgcacgcatggacgaagcctgggagcagtcgagagcgccggggccagtgcacgggcacatgttggagcccccagtggggccaggccgccggtctcccagtccaagcagaatcctgccccagccccaggggactcctgtgtccacaactgtggccaaggcaatggcccgagaagccgcccagcgggttgcagagtcttcgcgtctggagaagagaagcgtattcctcgaaaggtcgtccgccgggcagtacgcagcaagcgacgaagaggacgcgtatgacagtcctgacttcaaaagacggggcgccagtgtggacgactttctaaaaggttcagaattgggaaagcagatggtgagctag

SEQ ID NO: 132994 - DNA, 4638 bp, Artificial Sequence
  Description of Artificial Sequence: Synthetic coding sequence
atgcagcgagagagggaagccgagattcgccaactccttagatggaaggaagccgagcagcgccagttgcagcagctcctgcatcgggaacgagatggcgtggtccgccaggctcgcgagctgcagcggcaacttgccgaggaactcgtgaaccgtggacactgctcccggcccggcgcttcagaagtttcggccgcacagtgcagatgtaggttacaagaggtcctcgcgcagctgcggtggcagaccgacggggagcaggccgcccgcatccgctacctgcaagcagctctcgaagtcgagcgacaactcttcctgaaatacatacttgctcattttcgtggccatcccgcactcagtgggtcgcctgaccctcaagcagtccactccttagaagagccattgccccagacttcttctggaagttgtcacgctcctaagccggcttgccagctggggagcctcgactccctgagtgcagaggttggtgttaggtcaagatctctcggcttggtgtccagcgcctgctcatcttcaccagacggcttgctaagcacacatgcttcctcccttgactgcttcgcaccagcatgttcacgaagcctggacagtactcgcagcttgccaaaagctagcaaaagcgaagagagacccagcagtcccgatacgtctactcctggctcacggcggctatctcccccaccatctcctttgccccctccgccgccgccttcagcccaccgtaagctcagcaaccctcgggggggagaggggtccgagtcccaaccctgtgaagtgttaacaccaagtccccccggactgggccatcacgagctcatcaagctgaactggctgctggccaaagctctgtgggttcttgcccgccgctgttacacgttacaggcagaaaataaacagctccgccgagccggatgtccttatcaggcagatgagaaagtaaagagactgaaagtaaagagggctgagctcacaggactcgccaggcggctggccgatcgagcccgaaagctgcaggagacgaacctccgagcagtgagtgctccaatccccggtgaaagctgtgcgggcttggaactctgtcaggtgttcgcaagacagcgcgctagagatctgagcgagcaagcgtccgcccctctcgccaaggataagcagatcgaggagttaagacaggaatgtcacctgctgcaagctcgcgtggccagtggcccctgctctgaccttcacacaggccgaggtggaccctgcacccagtggcttaatgtgagagacctcgaccgcttgcagcgcgagtcccaaagggaagtgctgaggcttcaacgacaactgatgctgcagcaaggcaacgggggtgcctggcccgaggcgggggggcagtctgctacctgtgaggaagtgcgccgccaaatgctggctctggaaagagagctggaccagaggcggcgcgaatgtcaagaactgggcgcccaagccgctcccgctagaagaagaggggaagaggctgaaactcagctgcaagcggctctactcaaaaacgcttggctggccgaggagaacggcaggcttcaggccaaaaccgactgggtacggaaggtcgaggcggagaactctgaggtcagggggcacttgggacgagcgtgccaggagagagatgccagtggactgatagcggagcagcttctgcagcaagcagcgagaggacaggataggcagcagcagcttcagagggatccgcagaaggcattgtgtgacctacaccccagctggaaggagattcaagcgctgcagtgccggccagggcacccgcctgagcagccctgggaaacttcccagatgccggaatctcaggtgaaaggaagcagaagacccaaatttcacgcccgaccagaagattacgctgtgtcccagccaaaccgtgatatccaggaaaagagggaggcctcactcgaagagtccccagttgccttgggcgagtctgcttctgtgccccaggtgagtgagaccgtgcccgcgagtcagccgctgtccaagaaaacttctagtcagtccaactcctctagcgagggatcaatgtgggccaccgttccttcaagcccaaccttagatagagacacagccagtgaagtggacgacttggagcctgactctgtaagcctggccctggaaatgggcgggagcgcagccccggctgcaccaaagctcaaaatctttatggctcagtataattacaacccattcgaaggacccaacgaccaccctgagggcgaattacccctgactgccggagattacatctacatttttggcgatatggatgaagatgggttttacgagggagaactcgaggacggtagacggggcctggtgccttccaatttcgtggagcagatacccgacagttatatccctggttgtttgcctgccaaatctcctgacctcgggccctcacagctccccgctggccaggacgaagcccttgaggaagactccctcctgagcgggaaagctcagggagtcgttgaccgcgggttatgtcagatggtacgtgttgggtcaaaaacagaggtggcaactgagatcttggacacaaagactgaagcatgccaattgggactgctgcagtccatggggaagcaaggtctgtcaaggcctctgttgggcaccaaaggcgttcttagaatggcccctatgcagctacacctccagaacgtcacagccacctcagccaacattacttgggtgtactccagtcaccggcacccacatgttgtgtatctcgacgaccgggagcatgcacttacgccagcgggtgtgtcctgctacacattccagggtctttgtcctgggacccattaccgtgcccgggtagaagtccggctccccagagatcttctccaagtgtattggggtacaatgagcagtaccgtgacatttgatacgttgcttgccggaccgccgtatccccccttggatgtcttggtggagaggcatgcttctcccggtgtattagtggtttcatggctaccggtaactatcgactctgcaggatcctctaatggagtgcaggtgaccggctacgcggtgtatgccgacgggcttaaagtctgcgaggttgcagatgccaccgctggttccaccttgctagagttctcccaactacaggtgcctctcacttggcagaaagtgtctgtcagaaccatgtcactgtgcggcgaatctctcgattccgtcccagcacagattcccgaggatttcttcatgtgtcatagatggcctgaaaccccacctttctcttatacttgtggagatccctccacttacagggttacctttcctgtgtgtcctcaaaagttaagtctggcgcccccgtccgccaaagctagcccacacaatcctggcagttgcggcgaacctcaagccaagttcctggaggccttcttcgaagagccccctaggagacagtcacctgtgtccaatctagggtcagagggggagtgtcccagtagcggtgccgggagtcaggcgcaagagttggcggaggcctgggaaggatgcagaaaagacctcctgtttcagaagagcccacagaaccatcggccacctagcgtatccgaccaaccaggagaaaaagaaaactgctctcagcatatgggcacaagcaagtccccagctccggggttcattcacctacgcacagaatgcgggccccgcaaggaaccatgccaggaaaaagctgctttggaacgtgtactcaggcagaagcaggatgctcagggcttcacgccaccccagctgggcgcctctcagcagtacgctagcgattttcacaatgtgctgaaagaggagcaagaggcactgtgtctcgacctgtggggaactgaaaggcgggaggagaggagagaacccgaaccccattcccggcagggacaggctctaggggttaaacgggggtgccaactccacgagccgtcttctgctctgtgccccgccccttccgccaaggtcattaagatgcccagaggcggcccacagcaactgggaacaggcgctaatactccagcccgagtctttgtggccttaagcgattataatcctctcgtgatgtctgctaacctgaaggcagcggaagaggagctggtgttccagaaacgacagctgttgcgtgtatggggctctcaggatacacacgacttttacctgtcagagtgcaatagacaggtgggaaacatacccgggcgactggtggcagaaatggaggttggaaccgaacagactgataggcggtggaggtctcctgcccagggcaatctacccagcgtagcacacctggaagactttcaaggcctgactattccccagggctccagcctggtgttgcaaggaaactcaaagcggttgccattatggacgcctaaaattatgatcgctgccttggactatgatcctggggacgggcaaatgggaggacaggggaaaggaaggctggcccttcgggcaggcgatgtggtgatggtctatgggcctatggatgaccaggggttctattacggggaactgggcggtcacagaggcctggtcccagcccacctgttagatcatatgtcactgcacggccactag

SEQ ID NO: 132995 - DNA, 4920 bp, Artificial Sequence
  Description of Artificial Sequence: Synthetic coding sequence
atggctaaagatagcccaagccccttgggagcttcacccaagaaaccagggtgttcctctcccgccgctgccgtgcttgaaaaccagcgaagagaactcgagaagctccgagccgagctcgaggccgagagggctggatggcgcgccgaacggagacgattcgctgccagggaaagacagctaagggaagaggccgagagagaaaggaggcagcttgccgaccgcctcagaagcaagtgggaggcccagcgaagccgggagctgagacagttacaggaggaaatgcagcgggaacgcgaggcagagatccgtcagcttctgcgatggaaggaagcagagcagcgccagctccaacagctgctgcatcgggaaagggacggggtagtgcgccaggcaagggagttacagcgtcagttggccgaggagttggttaaccgcggacactgctcaaggccaggggccagcgaggtgtccgccgcgcaatgccggtgcaggcttcaggaggtcctggctcagctgcgttggcagacagatggcgaacaggccgctcgcattaggtatctgcaggctgctttggaagtggagcgccagttgttcctgaagtatatcctggctcactttcggggccatcccgccctcagtgggagtcccgacccccaggccgtgcattccttagaagagcccctcccacaaacttcttcagggagctgtcacgcccctaaacccgcctgccagctcgggagcctggacagcctctccgcagaggtgggcgtgcgttctcggtctctagggcttgtatcttctgcgtgcagttcctctcctgacggcctgctttctacacatgcctcttctctcgactgtttcgccccggcttgctccagatctcttgactcaacacgctccctgccaaaagcgtctaaatccgaggaaagacctagcagccctgacacatccacacctgggagccggagactgtcgccaccgccgtcgcccctgccgcccccgcctccaccctccgcccatcgtaagttatccaatcccaggggtggagagggctcggagtctcagccgtgtgaagtgctgaccccctcaccccctggactgggacaccatgagcttataaaactcaactggcttctggcaaaagccctgtgggtgcttgctaggaggtgttacacactgcaggccgagaacaagcagctgcgtagagccggctgtccataccaggcagatgagaaggtgaaacggttaaaggtgaaacgcgcagaactgactggtcttgcccggcgcctggctgaccgagccagaaaactgcaggagacaaatcttcgggccgtttcggcccccattcctggtgagagctgtgcagggctggaactgtgccaggttttcgccaggcagagagctagggaccttagcgaacaggcaagcgcccctctcgccaaggacaagcagatcgaagagttgagacaggagtgtcatttactgcaagcacgtgtcgcatccggtccctgtagcgatttacacacaggccgtgggggcccttgtacgcagtggctcaacgtgagagacttggaccgattacagagggaaagccagcgggaggtgctgcggctccagcggcaactgatgctgcagcaaggtaacggaggggcttggcctgaggcggggggccaaagcgcaacttgtgaagaagttagaagacagatgctcgcactcgagagggagctggaccagaggcggcgcgagtgccaagaactgggggcccaggcagcaccagcccgcagacgcggcgaagaggcagagacccaactccaagctgcgcttcttaagaacgcttggctggccgaagaaaatggcagactccaagcaaaaaccgactgggtccggaaagtagaggctgagaattccgaggtccgaggccacttgggccgggcatgccaagagcgcgacgcttccgggttgatcgccgagcagcttttgcagcaggcagctcggggccaagatcggcaacagcagctccagcgggaccctcagaaggctctgtgtgacctacatcccagttggaaggagatccaggcattgcagtgccgccctggacacccacccgaacaaccttgggagacgagccagatgccggagtcccaggttaagggctccagaaggccaaaatttcacgcccgtcctgaggactacgccgtaagccagcccaatcgggatattcaggagaagagggaggcaagcctcgaggagtctcctgtggcactgggtgagtctgccagcgtgcctcaggtgtctgaaacagtcccagctagccagcccttgagtaaaaagactagctcacagtccaatagctcttccgagggtagtatgtgggcaaccgttccaagtagccccactctggacagggacacagcctccgaagttgacgacctggagccagatagcgtgtctcttgccctggaaatgggtgggtccgccgctcctgcagcgccaaagctgaagattttcatggctcagtacaattacaatccgtttgaggggcccaacgaccacccagaaggtgaactcccactgacagcgggcgactacatctacatctttggagatatggacgaagacgggttttatgagggagagctggaagacggaaggcggggcttagtgcctagtaatttcgtggagcaaatcccggactcatacatacctgggtgtctccctgccaaatctcccgatctgggcccttcacagctacctgcgggacaagacgaggccttggaagaggacagcctgctgtccggaaaagctcagggcgtggtcgaccggggcttgtgccagatggtccgcgtgggtagcaagacggaagtcgccaccgagatcttggacaccaagactgaagcctgtcagttgggtctgttacagtctatgggtaagcaaggtttgagccggcccctgctggggaccaagggcgtgctccggatggcacccatgcaacttcacttgcagaatgtgacagcaacatccgctaatatcacctgggtatactcttcccacaggcacccacacgtggtgtacctggatgatcgggagcatgcacttactcccgcaggagtctcatgttacaccttccaggggctctgtccaggtacgcattatcgggctagagttgaagtgcgactgcccagagatctgctgcaagtctattggggcacaatgagttctaccgtgaccttcgacactttattagctggccccccttacccccctctggatgttctggtcgaacgacacgccagccccggagtgctggtcgtgagctggctacctgtgacaattgatagtgcgggttcgagcaacggcgttcaggtcacaggctacgcggtgtatgccgacggcctgaaagtctgtgaagtggccgacgctaccgctggcagcacactgctcgaatttagtcaattgcaggtccccctgacgtggcagaaagtgtccgtccgcacaatgtccctctgcggcgaaagcctggactccgtgcccgcgcagatccctgaagacttctttatgtgtcatcgctggcctgaaaccccaccattctcatatacttgtggagacccctcgacttaccgcgtcaccttccctgtatgcccccagaaactgtctctggctcctccatctgccaaggcaagtcctcataacccgggctcatgcggcgaacctcaggctaagtttctggaagctttcttcgaggagcctcctcggcgccagtcccctgtttctaacctgggttccgaaggagagtgcccaagtagtggcgccggctcccaagcccaggagctggctgaggcgtgggaaggatgcaggaaagacctgttgtttcagaagagtccccaaaaccaccgccctcctagcgtcagtgatcagccaggagaaaaggagaactgcagccagcacatggggacgagtaagagtccagcccccggatttatacacctgagaacagagtgtgggccaagaaaggagccctgtcaggaaaaagcagctctagaaagagtcctccggcagaaacaggatgcacaagggtttaccccacctcagctcggggcgagccagcaatacgcaagtgactttcacaatgtccttaaggaagagcaggaggccctgtgtctcgatctgtgggggaccgagcgcagggaggagcgcagggaaccagagccccacagtagacagggccaggcccttggcgttaagcggggatgtcagttacacgaaccctcgtccgcactctgccccgctccaagcgctaaagtcatcaaaatgccaaggggaggacctcagcagctcggtactggggcgaacacccccgctcgtgtgttcgttgctttaagtgactacaatccattggtcatgtccgctaacctgaaagccgcggaagaagagcttgtctttcaaaagcggcaacttttgcgggtgtggggctcccaggacacccacgatttttacctctccgagtgcaatagacaggttgggaacattcccggtcggcttgtagctgagatggaggtgggcaccgaacagactgataggcgttggcgcagtccagcccagggtaacctgccctcggtcgcacatctggaggacttccaggggctaaccatcccgcagggctcttccctggttctgcagggaaactccaagcgcctcccactctggactcccaaaataatgattgccgcattggattatgatcctggcgacgggcagatgggggggcagggcaaaggcagactggcacttagggccggggacgtcgtaatggtctacggacctatggatgatcagggcttttattacggggagcttggaggacaccggggactggtgcctgcccacctcttggatcacatgagtctgcatggtcactag

SEQ ID NO: 132996 - DNA, 4638 bp, Artificial Sequence
  Description of Artificial Sequence: Synthetic coding sequence
atgcagcgtgaacgcgaagctgaaatacggcagctgctgaggtggaaagaggcagagcagcgccaattacaacaacttttacacagagagcgtgatggggtggtaagacaggccagagaactccaacgccagctcgccgaggagctagtgaacaggggccactgctctcgacccggcgcttccgaggtgtcagccgcacagtgtcgctgcagattacaagaggtgctggcgcagttgcggtggcagaccgacggggagcaggcagcccggatccgctatctgcaggccgctctcgaagttgagcggcagttattcctgaaatacatcctcgcccactttagaggccatcctgccctgagcgggtctccagatcctcaggccgtgcactccctggaggagcccttacctcagacatcatccggatcttgccacgctccgaagccggcctgccagttggggtcgcttgattctctgtcggctgaagtaggtgtgcggtcccgtagcctcggcctggtgagtagcgcatgctctagttctcccgatggtctcctgtctacccatgcctcttctctcgattgctttgcccccgcctgcagccggagcctagattctacgcgctcgcttccaaaggctagtaagtccgaagaaagacctagcagtccggacaccagtacaccagggtcaagaagactctccccaccccctagtcccctgcccccaccaccccctcccagtgcccaccgcaaattgagcaatccgaggggaggtgaggggtctgagagccaaccttgtgaagtgctgactccaagccctcccgggctcggccaccatgaactgataaagcttaattggcttttggcaaaggctctgtgggttcttgcacgtcgttgttataccctgcaggaggaaaataaacagctccgtcgcgccggatgtccctaccaagcagacgaaaaagtcaagcgccttaaggtgaaacgggcagagttgaccggattggctagaagactagccgatagagcacgggagctgcaagaaacaaacttacgagcagtgagtgcacccatccctggcgaatcttgtgcagggcttgaactgtgtcaggtgttcgctcgacaaagggctagggatctgtcagaacaagccagtgcccctctcgccaaagataagcagattgaagagttgcgccaggagtgtcacctcttgcaggcacgcgtggcctcaggcccatgctccgatctgcacaccggccgcggtgggccgtgtacacagtggcttaacgttagggacctggaccgtctgcagcgcgaatcccaaagagaagtgttgaggcttcaacgccagctgatgctacagcagggcaatggcggtgcatggccagaagccggggggcagtccgctacatgcgaggaggtgcgcaggcagatgcttgctttagaacgggagttggatcagaggagacgagagtgccaggagttaggaactcaagccgcacctgcacgcaggcggggagaggaagccgaaacacagctccaggcagctttgctaaaaaatgcatggctcgcagaggaaaatggtcgccttcaggcaaaaaccgactgggtcagaaaggtggaagctgaaaatagcgaagtccggggccatctggggagggcatgtcaggaaagagatgccagcggacttatcgcagaacagctgctccagcaggctgcccgcggtcaggacaggcaacagcaactgcagagggatccacaaaaagccctatgtgatttgcacccctcatggaaggaaattcaagccctccaatgccgacccggccatccacccgaacagccttgggagactagtcagatgcccgaatcacaggtgaaggggtctcgtagaccgaaattccatgctcggcccgaggactacgctgtgagtcaaccaaatagagacatccaggaaaagcgtgaagccagtctggaagaaagtccagtagctctgggcgaatccgcttccgtgccacaagtttctgagaccgttcccgccagccagccattgtcaaagaaaacttcttctcagtctaactcgtctagtgaggggtccatgtgggcaacagtgcctagtagtcccacgctggatagggacacagcttcagaggtcgatgatctcgagccagatagtgtctctctggcactggagatgggaggctcagccgcacctgctgcaccgaaactgaagatttttatggctcagtataactacaacccgtttgaggggccaaacgatcaccctgaaggggaactgcccctaaccgctggtgattacatttacatctttggagacatggacgaggatggcttttatgagggtgaactggatgacggccggagaggattggtgccttcaaacttcgtcgaacagattcctgactcatacattcccgggtgcttacctgccaagtccccagacctgggcccgtcgcagttaccggctggccaggatgaggctctggaggaggatagcttgcttagcggcaaagcacaaggcatggtggacaggggactgtgccagatggtacgagtcggttcaaagacagaagtagcgacagagattcttgatacaaagacggaagcatgtcagctcgggctcctgcagtcaatgggcaagcagggcctctcgagacccctgctgggtaccaaaggagttttgcgcatggcgcccatgcagcttcacctccagaatgtgactgctacttccgccaatataacctgggtctactcgagccaccgtcatccacacgtggtgtatcttgatgatcgcgaacacgcactgacccccgcaggagtgagctgttatacgtttcagggcctgtgccccggcacacattacagggtccgggtcgaagttcgcctgccctgggacctgctacaggtctactgggggaccatgagctctacggtcaccttcgacactctcttagctggcccaccttaccctccattggaagtgcttgtagaaaggcacgcctccccgggcgtcctcgtagtaagctggttacctgtgacgattgactcggcaggatcatcaaacggtgtccaggtgaccggctacgccgtgtatgctgacggtctgaaagtatgtgaggtggccgacgctaccgccggaagcactgtcctcgaattttcacagttacaggtgcccttgacctggcagaaggtaagtgtcaggactatgtcattatgcggagagtcccttgattctgtccccgcccagatccctgaagattttttcatgtgccaccgttggcctgagacgcccccttttagctacacttgcggagacccatctacatacagggtcaccttcccggtgtgcccacagaaactgtctctggcaccaccgtctgccaaagcatccccacacaaccccgggtcatgcggcgagccgcaggctaaattccttgaggctttcttcgaggagcccccgcgaagacagagcccagtgtccaatctcgggagcgaaggggaatgtccctcgtctggtgcggggagccaggcccaggaactggccgaagcgtgggagggatgtagaaaggacctactgttccagaaatctcctcagaatcaccggcctccaagcgtaagcgatcagcctggggaaaaagagaattgttaccaacacatgggcactagcaagagtccggcccccggctttattcatctcagaaccgaatgcggacccaggaaagaaccttgccaggagaaagccgccttggagcgagtgttgcgccaaaaacaagatgcccaggggttcaccccaccccaactcggtgctagtcaacaatacgctagtgacttccacaacgttctgaaggaggagcaagaggctctttgtttggacttaagaggaacagagcgccgtgaggaaaggcgggagcctgagcctcatagccggcagggacaggccctcggtgtgaagcgcgggtgccagctgcacgagccctcttccgccctctgcccagcgccatctgctaaggtcattaagatgccccgtggcggtccgcaacagctgggcaccggggccaatactcccgcccgcgtgtttgtggcgttaagcgactacaatccgctggtcatgagcgccaacctcaaggccgccgaggaggagttagtttttcagaaaagacagctcttacgcgtttggggcagtcaagacacacacgatttttatctgtcagagtgtaacagacaggttggcaacatacccgggagactagtagccgaaatggaagttggcaccgagcaaacagaccgacgctggaggagcccagctcaaggtcaccttccttccgtggcacatctcgaagatttccaaggtcttacaatccctcagggctccagcctggtgcttcaaggcaactctaaaaggctgcccctgtggacacccaaaattatgatcgccgccctggattatgatccaggggacggccagatgggtggacagggcaaaggccgcctcgccttgagggccggtgatgtcgtgatggtctacggtcctatggatgatcagggcttttattacggagagctgggggggcacagaggcctggtgcccgctcatcttctggatcacatgtctctacatggccactag

SEQ ID NO: 132997 - DNA, 4920 bp, Artificial Sequence
  Description of Artificial Sequence: Synthetic coding sequence
atggccaaagattcaccctcccccctcggtgcctctcccaagaagcccggttgctcaagccccgccgcggccgtgcttgagaaccagaggcgagagcttgagaagctgcgcgcagagttagaggctgagagagctggatggagagctgaaaggcgcagattcgccgccagggaaaggcagctccgagaggaggccgaacgcgagcgcagacagcttgcggacagacttaggtccaagtgggaggcccagaggtccagagagttgagacaactgcaggaggaaatgcagcgagaacgggaagcagagatccgccaattgctgcgatggaaagaggcggaacaaagacagctgcagcagttgctgcatcgcgaaagggatggagtggttcgacaggcccgtgaactgcagcgccaattggctgaggaattagtgaaccgcggccactgtagcaggcccggcgcctccgaggtcagcgcagcacagtgtcgatgcagacttcaggaggtgctagcacagctgcgctggcaaacagacggagagcaggctgcaaggataagatacctccaggccgctcttgaagtggaacggcagcttttcctgaagtatatcctggcccatttcagaggccatccagctttatctggtagcccagatccacaggcggtccattcccttgaggaacctcttccacagacaagcagtgggtcctgccacgctccaaagcccgcttgccaactgggctcactggactccctgtccgccgaggtaggcgtaaggagccgcagtctcggcctcgtgagcagcgcttgctcctcttcacctgatggcttgctcagtacccacgcttcctcacttgactgtttcgcaccagcctgcagccgcagtctggacagtaccaggtcacttcccaaagcctccaagagcgaggagagacccagctcccccgatacttcgacacccgggagccgaagactaagccctccaccctccccactgcctccaccccccccgcccagcgcacatcgcaagctatccaacccacgcgggggggaggggtctgaaagccaaccatgcgaagttcttacacccagcccaccgggcctaggacatcatgaactgatcaagctcaactggctactggcaaaagccctgtgggtccttgctcgccgatgctacacactgcaggaggaaaataagcagctcagacgtgccggatgcccatatcaagccgacgaaaaggtgaaaagactgaaggtgaagagggccgagctaaccgggttggcgcgacggctggctgacagggcaagagagctgcaggagaccaacctgagagctgtaagtgcaccaattccaggggagagttgcgccggcttagaactatgccaggttttcgccagacagcgcgccagggacctgtccgaacaggcaagcgctcccctggcaaaggataagcagattgaggaactcagacaggaatgccacctcctgcaggccagagtcgcctcaggtccttgtagtgaccttcacactggccggggcggaccctgcacacagtggctcaatgtgcgggacctcgataggctacagcgcgaatctcagagagaggtgctgagactgcagcgacagctaatgctccagcagggcaacggtggcgcgtggccagaggccggagggcaaagtgccacttgcgaggaagtgcggagacagatgctagccctggaacgcgagctcgaccagagaaggcgggaatgtcaagagctggggacccaagcagcccccgctaggcgccgaggggaagaggccgaaacacagttgcaagccgctctgctgaagaatgcatggctggctgaggaaaacggtcgcctgcaggctaaaacggactgggtccgtaaggtggaggcagagaattccgaggtccggggccatctgggcagggcgtgccaggagagagacgcctccggactgattgcagagcaattgttacagcaggccgcgagaggacaagacagacagcagcagctgcagagggatccgcagaaagctctctgcgatttacatcccagctggaaagagattcaagctctgcagtgcagaccagggcaccctccagaacagccatgggagacaagtcagatgcccgaatcccaggtgaagggctcccgacgccccaaattccacgcacgccctgaggattacgccgtgtcacagccaaacagggacatccaggaaaagagggaagcttcactcgaggaatcgccagtcgcgcttggggagtcagccagcgtacctcaagtctccgagaccgtgcctgcttcacaacccctgtccaaaaaaacttcctctcagagtaactcttcttctgaaggctctatgtgggcaacagtaccgagttcaccaacgctggaccgcgacaccgcatctgaggtcgacgacctggagccagacagtgtttcactcgctttggagatgggcggaagtgccgcccccgctgcgcctaaattgaagattttcatggcccagtataactacaacccattcgaaggcccgaatgaccatcccgagggcgagctgccgctgactgccggggactacatatacattttcggagatatggatgaggatgggttctacgagggcgagctggacgacggccggcgtggactggttccttctaatttcgtcgaacagatccctgactcatacatccctggctgtctgcccgccaaatcccccgacctcggcccctcacagttgcctgccggacaagacgaggcgctggaggaggactctttgctttctgggaaagcacaggggatggtggaccgaggtctctgtcagatggtgcgtgtcggaagcaaaacggaggttgccaccgaaatactggatacaaagaccgaggcttgtcagctaggcctacttcagtcgatgggaaaacaggggttgagccgcccattgcttggtactaagggagttctacgcatggcccccatgcagctgcacctgcagaatgtcaccgctacatccgcaaacatcacctgggtgtattcatcccaccggcaccctcacgtcgtgtatttagatgatcgagaacatgccctgacacccgcaggcgttagctgctatacattccaaggtctgtgtccagggacacattatcgcgtccgggtggaagttcgactgccttgggacctgctccaggtatattggggaacaatgagctccactgtgacatttgacacacttctcgcagggcccccctatccacctctggaagtcctcgtggaaagacacgcaagtcccggtgtgttggttgtatcctggctcccggtgaccatcgactccgctggcagcagcaatggagtgcaggttacaggctatgcggtgtatgccgacggcctgaaagtttgtgaggtcgcagacgcaacagcgggctccaccgtccttgagttcagccaattgcaggtgcctctcacatggcagaaagtatccgtgcgtaccatgagcctttgcggggagtcattggactccgtcccagcccagattcccgaggacttcttcatgtgccacagatggcccgaaacaccccccttcagctatacatgcggcgatcctagtacatatcgggttacttttcccgtatgtcctcaaaaattatctctagcacccccctctgccaaggcctccccacacaaccccgggtcctgcggggagcctcaggcaaagttcctcgaagctttctttgaggaaccgcctcgcaggcagtctccagtctctaatctgggaagcgagggagagtgcccatcatccggagctggctcccaggcgcaggaactggcggaggcttgggaaggctgccgcaaagacctcctttttcagaagagcccccagaaccatcggcctcctagcgtatctgaccagcctggagagaaggagaactgctatcagcatatgggcacatcaaagtcacctgcaccaggcttcatacacctgcgcacagagtgtggccccagaaaggagccttgccaggaaaaggccgccctcgagcgcgtattacgacaaaagcaggatgcccagggattcactccgccccaactgggtgccagtcagcagtacgcatccgattttcacaatgtgctcaaggaggagcaggaagccctgtgcctggacctgcgtggtactgaaaggagggaggaaagaagggaaccagagccccactctaggcagggacaagctctgggcgtcaaaaggggatgccagctgcatgaaccctcttcggctctatgcccggcgccttctgctaaggtgatcaaaatgccgcgcggaggaccccaacaacttggtacgggggcaaatacacccgcaagggtcttcgttgctctcagtgactataatcctctggtgatgtctgcaaatctgaaagccgcagaagaggagctggtttttcagaaacgccagctgctgcgcgtgtggggatcccaagacactcacgatttttacctcagtgaatgcaataggcaggtcgggaacattccaggccgactcgtcgctgaaatggaggtcggcacagaacagactgatcgtcgatggagatcacctgcccaaggacacttgcccagcgttgcccacctggaagacttccaagggctgactattcctcaggggtcaagcctggttcttcagggcaattcaaagagactacccctctggaccccaaagattatgatagcagctcttgattacgacccgggcgatggtcagatgggtgggcagggaaagggaagattagctctgcgggcgggggatgtcgtgatggtttacggacccatggatgatcaaggattttattacggcgagctgggcggacaccggggcctggtccccgcacacctcttagaccacatgtccctgcatgggcattag

SEQ ID NO: 132998 - DNA, 4638 bp, Artificial Sequence
  Description of Artificial Sequence: Synthetic coding sequence
atgcagcgcgagagggaagcagagattcgccagctccttaggtggaaggaggcagaacaacgacagttgcagcaattgctgcatagagaaagagatggagtggtccggcaggcacgcgagctgcagcgccaactggcagaagaacttgtcaacagggggcactgtagcagacccggtgcctccgaagtttcagccgctcagtgtagatgtagactgcaggaagtactggcccagctgaggtggcaaacagacggggagcaggctgcgagaattaggtatcttcaggccgccctggaggtggagaggcagttgtttctaaagtacatcttagctcacttccgcggccatccagccctgtccgggtcgccagatccccaggccgtgcactcactggaggaaccattgcctcagacaagcagcgggagttgccatgcgcctaagcctgcctgtcagctcggtagcctagatagtctgagcgccgaagtgggcgtacgaagccggtcgctggggcttgtgagcagcgcttgcagttcatcaccagacggattgctttccacgcacgcctccagcctggactgttttgctcctgcctgcagccggagtctggattcaacccgctccctgccaaaggcttccaaatccgaagaaagaccctcctccccagacacatctacaccaggctcaagacgcctctcccctcctccttcccccctgccacctcccccaccacctagcgcacatcggaagctgagcaacccacgtggaggagagggctccgagagccaaccgtgtgaagtcctgacacccagcccaccaggtctggggcaccacgaattgataaagcttaactggctgctggcgaaagccttatgggtgctggctagaaggtgctataccctccaggaagaaaacaaacagctccgccgagccggctgcccgtatcaggctgacgaaaaggtgaagagactcaaagtgaaaagggccgaactaactggccttgcgaggagactggccgaccgagcccgcgagttacaagagacaaatctgagggcagtaagtgctcctatccctggagagtcatgtgcagggctggagttatgccaggtgtttgcccggcagcgagcaagagacctgtcagagcaggcatccgcccccctggctaaagataaacagatcgaggagctcagacaagaatgtcatctgcttcaggccagggtggcgtcagggccctgctctgatctccacacagggcgcggaggtccttgtactcagtggttgaacgtgagagatctcgaccgcctgcagcgtgaatcacaaagagaagtgctccggctgcagagacagctcatgctgcaacagggtaacggaggtgcttggcctgaagctggcgggcagtcagccacatgcgaggaggtccggagacagatgttggccctggaacgggaactggaccagcggcgtcgggagtgtcaagagctgggcacccaggctgccccagcacgaaggaggggagaagaggccgaaacacagctacaggcggccttgctcaaaaatgcttggctagccgaagagaacggtaggctccaagcaaaaaccgactgggtccgaaaggtggaggccgagaactctgaagttagggggcacctgggccgcgcatgtcaagaaagggacgcctctgggctgatagctgagcaactcttgcagcaagcagcaagaggccaggacagacaacagcagctgcagagggatcctcagaaggcgctttgcgacctgcaccctagttggaaagaaattcaggcactacagtgtcgacccggtcatcctcccgaacagccctgggagacgagtcagatgccagagtctcaagtgaaaggcagccggcggccaaaatttcacgctcgaccggaagattacgctgtttcccagcctaaccgggatattcaagaaaagagagaggcttcactcgaagagagtccggtggctttgggcgagagcgcctcggtcccccaagttagcgagactgtgcccgccagtcaaccactgtccaagaagacgtcttctcagtcaaacagctcctccgaggggtccatgtgggcgacagtcccctcctctcctacgctagaccgcgacaccgcgagcgaggtcgacgaccttgagccggatagtgtgagccttgcactggaaatggggggttcggccgcaccagccgccccaaagttgaagatttttatggcccagtataattataatccatttgaggggcctaatgaccacccagagggagagctgcctttgactgcgggtgactatatatatatattcggtgacatggacgaggacggcttctacgaaggcgaactggatgacggcaggcgcggattggtgccgtccaatttcgttgagcaaatcccagacagttacatacccggatgtctgcccgcaaagtcaccagacctcggcccctctcagttgcccgccggacaggacgaagccctggaagaggactccctcctttccggtaaagctcaggggatggtggataggggcctgtgtcagatggtccgcgtggggtccaagacagaagtggctaccgagatcctggacaccaagaccgaggcatgtcaactcgggctcttgcagtctatgggcaagcagggactgagtagaccactccttggtactaaaggcgtgctgcgaatggcacctatgcagctccaccttcaaaatgtcacggctacatccgctaatattacatgggtctacagctcccacagacacccccatgtcgtgtacctcgatgatagagagcatgccctgaccccggcgggcgtttcctgttatacttttcaaggcctgtgtcctggaactcattaccgtgtccgggtcgaagtgcgattgccatgggatctgttgcaggtctattgggggaccatgtcctctactgtgactttcgacactctcctggcggggcctccgtatccacccttggatgtgctggtagagagacacgcgtcaccaggtgtcctagtggtgtcatggctaccagttaccatagactccgcagggtccagtaatggcgtgcaggtgaccggatacgcagtctatgcggacggcctcaaggtgtgcgaagtggccgacgctaccgccgggagcactgtcttagaattctctcagcttcaggtgcccctgacctggcagaaggttagtgttcgaacaatgtctctttgcggggagtcactggattccgtgccagcacagattcccgaggatttcttcatgtgtcatcgctggcccgagaccccgccgttcagttacacgtgcggagatccctccacatatcgcgtgaccttccctgtgtgtccccagaaactgagcctcgctccacccagcgccaaggccagtccacacaatcctgggtcttgtggtgagccgcaggcaaagttcctggaagctttctttgaagaaccaccacggcggcagagcccagtgtcaaacctggggtctgaaggggaatgccccagtagcggagcaggcagccaggcccaagagttggccgaggcctgggaaggctgccgtaaagacctcctgtttcagaaaagtcctcagaaccatcgccccccctctgtgtccgatcaacctggcgagaaagaaaattgttatcagcatatgggaacttctaagtcccctgcccctggtttcatccatctcaggaccgaatgcggacctcggaaagagccatgtcaggaaaaggctgcacttgaaagggtattgcgccagaagcaggatgctcaggggttcactcctccacaactgggcgcttctcagcagtatgctagcgatttccacaacgtactgaaagaggaacaagaagccctctgccttgatttaaggggtacagaacggagggaggaacgacgcgagccagaaccacatagccgccagggccaagccctgggagttaaacgagggtgtcagctgcatgaacctagcagcgccctgtgccccgccccatccgcaaaggttatcaaaatgcctcgcggaggaccacagcagctgggtaccggcgccaacactcccgctagggttttcgtggccctgagcgattacaatccccttgtcatgtcagctaaccttaaagcagcagaagaagagttagtttttcaaaagagacagttacttcgcgtgtggggaagccaagatacccacgacttctatctgtctgagtgtaatagacaggtgggaaacattcctgggaggttggtcgccgagatggaggtggggacggaacaaacagaccggaggtggcgcagtccggcacagggacaccttccgtccgtggcccacttggaagactttcaggggctgattattccccagggaagcagcctcgtgcttcagggaaacagcaagcgcttaccattgtggaccccgaaaattatgatcgccgccctggattacgacccaggggacggccagatgggggggcagggaaagggccggctcgctctgagggcaggtgacgtggtgatggtctacgggcccatggacgaccaggggttctattatggagagctcggaggtcaccgcggcctggtcccagcccacctgctggatcacatgagtcttcatggacactag

SEQ ID NO: 132999 - DNA, 4920 bp, Artificial Sequence
  Description of Artificial Sequence: Synthetic coding sequence
atggctaaagactcgccatctcctctgggggcttcccctaagaaacctggttgttccagccccgcagctgccgtcctggagaatcagcggcgggagctggagaagctgagagcagagctcgaagccgaacgggccggctggcgcgcagaacgccgtcggttcgccgctcgcgagaggcagctgagagaggaggcagagagagagagacggcagctcgcagaccgcctgaggagcaaatgggaagcacagagaagcagagaactcaggcagctccaggaggaaatgcaacgcgagagagaagcagagatacggcagttactccgttggaaggaagctgaacagcgtcagctccagcagctcctgcacagagaaagagacggcgtagttagacaggcgcgagagctccagagacagttggcagaagagttagtcaaccgagggcattgctctagacccggagcttccgaggtgtcagcagcccagtgtaggtgcaggctgcaggaggtccttgcacagctgcgctggcagactgatggtgagcaagccgcacgcattcgctatcttcaggctgccctggaggtagaaaggcagttgtttcttaagtatattctcgcccacttccggggccaccccgccctaagcggatcaccagatccccaggcagtgcacagtctcgaggagccactaccccaaacttcctcagggagctgccacgcaccaaagccggcatgtcagctgggctctcttgattccctgtctgctgaggttggagtgcgcagccgttctctgggcctggtaagctcagcttgctcttctagtcctgatgggctgctctctacccacgcttccagcctggactgctttgcgcctgcttgttctcgatcgctggatagtacccggagtctccctaaggcctccaaatctgaagaaaggcccagcagcccggacacctctaccccaggttccaggcgcctgagtcctcccccatctcccctgcccccacccccacccccttctgcccacagaaaattgtctaatccaaggggtggagagggatcagagtctcagccatgtgaggtgttaactccaagccctccagggctcggccatcacgagctaattaaacttaattggctcctggctaaagccctttgggtgctggctcgtagatgctacacattgcaagaagagaacaagcagctgcggagggctgggtgtccttaccaagccgatgagaaggtgaaacgcctgaaagtgaagagggctgaactgacagggctcgctaggcgcttggctgaccgggcgcgtgagctgcaagagaccaacctgagggctgtgagcgctcccatccctggcgagagctgcgccgggttggaattatgccaggtgttcgcccgccaaagagcaagggacttgtccgagcaggcgtctgccccactggccaaagataagcagatcgaagaactccgccaagagtgccatttgctccaagcgagggtcgctagtggcccttgtagtgacctccacaccggccgaggaggcccatgtactcagtggcttaatgtaagagatttagatagactgcagagggagtcacagcgggaggtactgcgccttcaacggcagctgatgctgcagcagggcaacgggggggcctggccagaggcgggagggcagagtgcaacttgcgaggaggtccggcggcagatgttggcactggagcgggaactggaccagcggcgtagggagtgtcaagagctgggtacccaggccgcacccgcccgccggcgcggggaggaggctgagactcagctacaggcagctctgctgaagaacgcttggctcgcggaggagaatgggagattgcaggccaagacggactgggtgcgcaaggttgaggccgaaaattccgaggtgagaggccatctagggcgagcttgtcaggagagggacgcctctggacttatagctgaacagctcctgcagcaggcggccagagggcaggatcgccaacagcaactgcagagagaccctcaaaaagctctgtgtgatcttcacccatcttggaaggagatccaggccttgcagtgtagaccaggccacccgcccgagcagccatgggaaacttctcagatgcctgagtcccaagtgaaaggaagccgccgtccaaagttccacgcgaggccagaggattacgccgtgtctcagcccaatagggacattcaggaaaaaagagaggcttctctcgaagagtctccagtcgccttaggggagtccgcttccgtgccccaagtcagcgagactgtccccgcctctcagccactgtctaagaaaacatcttcccagagcaacagctcatctgagggctctatgtgggccacagtaccttcttcgcccactctcgatcgagatacagcctccgaagttgacgacctggagcccgacagcgtcagcctggctttggagatgggaggtagcgctgcacctgctgcccccaaactgaagatcttcatggctcagtataactataatccctttgagggtccaaacgaccacccagaaggggagctgcctctgactgctggagactacatctatattttcggagatatggatgaggacggcttctacgaaggcgaattggatgacggaaggagaggcctggttccaagtaatttcgtggaacagattcccgatagctacatcccgggttgtttgccggctaaaagcccagacctggggcccagccaactcccagccggacaggatgaagccttagaagaagactccctcctgtctgggaaagcccagggcatggttgatcgcggactgtgccagatggtacgagtgggctctaaaacggaagttgctactgagatcctggacactaagacagaggcctgccaattaggactcctccagtccatgggcaagcagggcctcagccgcccgctgctgggcacaaagggcgttttaagaatggccccaatgcaattgcacctacagaacgtgacggctacctccgctaacatcacttgggtgtactcatcacaccggcaccctcatgttgtgtacttggatgaccgcgaacacgccctgacccccgctggcgtctcatgctatacatttcaggggctttgtcctggaacacactatcgggtgcgtgtcgaagtgcggctgccctgggatctgctgcaggtctactgggggaccatgagtagcaccgtgacttttgacaccctgctcgctggccctccttacccgccactcgatgttctggtcgagcgccatgctagccctggggtactagtggttagctggctgcctgtgaccatagattcggcggggtcctctaatggagttcaggtcaccggctacgccgtttatgctgatggcctcaaagtgtgcgaagtggcagacgccactgctggttccaccgttctagagttctcacaattgcaagtcccattaacctggcagaaggtttccgttaggaccatgtctctatgtggagagagcctagactccgtgccagctcaaatcccggaggatttttttatgtgccataggtggccagagacaccacccttttcctacacatgcggagatccttccacctaccgggtaacctttccagtctgcccccaaaaattgagtctggcacccccaagcgcaaaagcatccccacataaccccgggtcctgcggggaaccccaggcaaagttcctagaagccttcttcgaggagcctcccagacgtcaaagccctgtcagcaatttgggcagcgagggcgaatgtccttccagtggagctggaagtcaggcccaggagttggcagaggcgtgggagggctgccgaaaggatctgctgttccagaagtctccacagaatcacagacctccttctgtgagcgatcagcctggcgagaaggagaactgctatcagcacatggggacatcaaagtcacctgcccctggcttcattcacctgcgcactgaatgcgggccacgtaaggaaccttgtcaggaaaaagctgccctcgagagagtcttgagacaaaagcaggacgcgcagggtttcactccccctcagcttggggcttcccagcagtatgcttcagactttcacaacgttctgaaagaagagcaggaagcactgtgcctggatttgcggggaacggagaggagggaagagagacgggaaccagaaccacactcccgccagggccaggcactcggggtcaagcgaggctgccagctgcacgaaccgagtagcgcgctctgcccggcgccaagcgccaaggtcattaaaatgccaaggggcgggccacaacaacttggtaccggagctaatacaccggcccgcgtcttcgttgctctatccgattacaaccccctggtcatgagcgccaaccttaaggcggcagaggaagagctggttttccaaaaaaggcagcttcttcgcgtttggggaagtcaagatacacacgatttctatttgagcgagtgcaaccgccaggtggggaacatcccagggcgcttggttgccgagatggaggtcggtaccgaacagacagacagacggtggcggtccccagcccaaggccacctccccagtgtggcacatttggaagattttcagggactgattatccctcaaggtagcagtctggtcctccaggggaattcaaagaggcttcctctctggacacccaaaataatgatagcagccctggattatgatccgggagacggacagatgggcggccaagggaaaggccgtctcgccctgcgcgcgggagacgtagtgatggtgtacgggccgatggacgaccaggggttttactatggcgagctgggaggccatagaggactggtgccagcccatctgctggatcatatgtctcttcacggacactag

SEQ ID NO: 133000 - DNA, 3402 bp, Artificial Sequence
  Description of Artificial Sequence: Synthetic coding sequence
atgcctgtgcaggccccacaatggactgattttctaagctgtcccatctgcacgcaaacatttgacgagaccattagaaagccgatatctctaggctgtgggcacaccgtctgtaagatgtgtctcaacaagttgcatcgcaaggcttgtccgtttgatcagaccaccataaacacagacatcgaattgctacctgtgaacagtgccctcttgcagctcgttggagcgcaggtccctgagcagcagcccatcaccctgtgcagtggagtggaagatactaagcactatgaggaggcaaagaaatgtgttgaagagcttgcgctgtacttgaaaccgctttctagtgccagaggtgtgggtctcaattctacgacccagtctgtcctgtcaagacccatgcagcggaagctggtgaccttggtccattgtcagttagttgaggaagagggccgaatccgtgctatgcgagcagctaggagtctgggggagcggaccgtgacggagctgatcttgcaacatcagaatcctcaacaactgtccagcaacctgtgggcagcagttcgggcaaggggttgccagtttttagggccagctatgcaggaagaagcactaaaactcgtgttactggccctggaagatggcagcgctttgagccggaaggtgctggtgcttttcgtagttcagagactcgagcctcgttttcctcaggctagcaagacgtcaatcgggcatgttgtgcagctgctctatcgggcgagttgttttaaagtcacaaagcgcgacgaagattcttctctgatgcagctcaaggaggaattcagaacatacgaggccctccgccgggagcacgatagccaaattgtgcagattgctatggaggcggggcttcggattgcacccgaccagtggtcgtcccttctctatggcgaccagtctcacaagtctcacatgcagagcatcatagataagctgcagacccctgctagctttgcccagagcgtccaagagttgacaattgccctgcagagaacaggcgacccagccaatcttaaccgccttcgcccccatttagagctcttagctaacatcgacccctccccggacgcaccaccccccacctgggaacagctggagaacggactcgtggcagtgcgaacagttgtccacggtttagtggactacatacaaaatcatagtaaaaagggagcagatcagcagcagccacctcagcactcaaaatacaaaacctacatgtgccgggacatgaaacagcggggtggttgtccaagaggcgcttcctgcacattcgcacacagtcaggaagaacttgagaaatttagaaagatgaacaaaaggctcgtaccgaggaggcccctgagtgccagcctcggacagctgaatgaggtgggccttccctcggccgccatactacctgacgagggcgctgtagatttgccatcacggaaaccgcccgctctgcctaatggaatcgtgtccaccggaaatacagtgactcagctgatacccaggggaacggaccccagctacgactcgagcctgaaaccaggtaaaattgaccatttaagcagcagcgctcccggatcaccccctgaccttctggaaagcgttcctaaatctatctccgccctgcccgtgaatcctcattcaatacccccacggggacctgccgatttaccacctatgccggtcaccaagccattacagatggtgccaagagggtctcagctgtaccctgcacagcagaccgatgtttattatcaagacccacgtggagccgcccctcctttcgaacccgcaccctaccagcagggcatgtattataccccccctcctcaatgcgtctccagattcgtcaggccgccgccgtcagcgcccgaacccgcccctccctacctggatcactaccccccctacctgcaggagagagtagtcaatagtcagtacggcacccagccccagcagtatccccctatctatccttcccattacgatggccgccgggtgtaccctgctcccagctacactcgtgaagagatcttccgggaatcgccaatccctatcgagatcccaccggccgctgtccccagttacgttccggaatcaagagagagatatcagcagatcgaatcgtattatcctgttgctccccacccgacacaaatacgccctagctacctacgcgaacctccatattcgagactgcctccccctccacaaccacatcccagtctggatgagttgcatcgtaggcgcaaagagatcatggcccagctggaagaaagaaaggtaatcagccctccccccttcgccccgtctccaaccctgcctcccacgtttcatcccgaagaattcctagatgaggacttgaaggttgctggaaagtacaagggaaatgattattcccagtactcgccctggtcctgcgacactattggatcctacattggcaccaaagatgctaaaccaaaagatgtagtggccgctggctccgttgagatgatgaacgttgagtcaaagggcatgagagaccagcggctagacctgcaaagacgggccgccgagacgtcagatgacgatctcatcccattcggagatcgcccgacagtgtcgcgcttcggggccatctcccggacatcgaaaacaatctatcaaggagcaggaccaatgcaggccatggcaccccagggtgctcccactaaaagcattaatatatccgactactctccttacggcacacacggcggctggggggcttccccctattctcctcaccagaacatcccatcacagggacacttctccgaacgtgagcgcattagtatgagcgaagtggcctcccacggcaagccgcttccatccgcggaacgcgagcagctgcggctagagctgcagcagctgaaccaccagattagccagcaaactcagctgcgcggactcgaagccgttagtaatcggttggttttgcagcgggaggctaacacattagcagggcaatcacagccgccaccacccccaccgccaaaatggccaggcatgatttcatccgagcagctgtccttggaactccatcaggtggaaagagaaatcggtaagcgtactcgggaactatctatggagaaccaatgctctttagacatgaagagcaagctgaacacttctaaacaagccgaaaacggacagcctgaaccgcaaaacaaggttcctgccgaggacctgaccttaaccttctccgacgtaccaaatgggtccgccttaacacaggagaatatatctctcttaagcaacaaaacttcgtcgctgaatctgagcgaggatccagaaggtggaggggataacaacgattcccagcggtccggtgtgacaccatcgtccgcaccctag

SEQ ID NO: 133001 - DNA, 3378 bp, Artificial Sequence
  Description of Artificial Sequence: Synthetic coding sequence
atgccagtgcaggcaccccagtggaccgactttctctcctgtcccatctgcactcagacctttgacgagacaattcgcaagcccatcagtctgggttgtggccataccgtgtgtaaaatgtgcctgaataagctgcacaggaaggcttgcccgttcgatcaaactactattaatacagacatcgaattgctcccagtaaattcggctctgttgcagctggtcggtgctcaggtgcccgagcaacagccgataacactctgttccggagtcgaagataccaagcattacgaggaggctaagaagtgtgtggaggagctcgcactctatctgaagcccctgtcttccgcgcgcggggtgggtcttaacagcactacacagagcgtgctgtcccgacctatgcagcggaagctggttacactggttcattgccaactcgtggaagaagagggccgaattagagctatgcgcgccgcccggtccctgggcgaacggacggtgaccgaacttattttgcagcatcagaatccacagcaactgtcttcaaatttgtgggccgccgtgcgcgcccgcgggtgccagttccttggacccgccatgcaagaggaggctttgaaactcgtgcttcttgcccttgaggatggtagcgccctctctagaaaagtattggtgctgttcgtggtgcagcgactggagcctcggttcccacaggcgtccaagacctctatcggccacgttgtgcaattgctttatagagctagttgtttcaaagtcacaaaacgggacgaagattcatccctaatgcagctaaaggaggagtttagaacctacgaagcactccgcagggagcatgattcgcagatcgttcaaatagcaatggaggctggattgcgaatcgcccccgaccagtggtcttcacttttgtacggtgaccaatctcataagtctcacatgcagtccattattgacaaattgcagacaccagccagctttgcacagtccgtgcaagagctgactatagctctgcagcgcacaggcgaccccgcaaacctgaataggcttcgacctcatctagaactcttggccaatatcgaccccagccctgacgcgcctccccctacatgggagcagctcgagaatggcctagtggctgtccgaacggtcgtgcatgggctggtggattacatacagaatcactcaaagaaaggcgcggaccaacagcagccccctcagcatagtaagtataagacatatatgtgtagggatatgaagcaacgtggcggctgtcctcgcggtgcgagctgtacatttgcacattcacaagaagagcttgagaagttcaggaagatgaacaagaggttggtccctaggcgacctttgtccgcctcactgggtcagctaaatgaagtaggtctgcctagcgcagccattcttcctgacgagggggctgttgatctccccagcaggaaacctcctgccctccccaacggcatcgtgtctacaggcaataccgtgactcaactcattcctagaggtacggatccctcctatgactcatccctgaagcctggcaaaatcgatcacttgtcttcatccgccccgggcagcccaccggatctcttagaatcggttcccaagagtatcagtgctctaccagtgaacccgcacagcattccacctcggggccctgccgatctgccccctatgcctgtaaccaaaccgctgcagatggtgcccaggggcagccagttatatccagcgcaacagactgacgtgtattaccaagatcccagaggggccgccccacctttcgagcctgcgccataccagcaggggatgtattacaccccacccccgcaatgtgtgtctcgcttcgtcaggcccccgccctcagccccggagccagcgccaccgtatctggaccattaccccccctatttacaggaaagggtggtaaactctcaatatgggactcagccgcaacaataccccccaatctacccgtcccactacgatggacgacgggtttatccagctcccagttacaccagggaagagatcttcagagaatcaccaatccctattgaaattccacccgcggccgtgccttcttatgtgccggagtcaagggagagataccagcaaatcgagtcttactaccctgtcgccccccatcctacgcaaatcagaccttcgtatctgagagagcccccatacagcaggctcccgccaccaccccagcctcacccctccctggacgagctacaccgccggcgcaaggagatcatggcccagctcgaggagcgaaaggtgatttcaccacccccattcgccccctctccaactctacctccaaccttccatcccgaggagttcctggatgaggacctcaaagtggctggcaagtacaaagggaacgactattcacagtacagcccttggtcttgtgatactattggttcctatatcggcactaaggacgctaaaccaaaggacgtagttgcagctggatctgttgagatgatgaacgtggagtctaaaggtatgagggatcagcggctggatctgcagcggcgggcagccgagacttccgatgatgacctgattcctttcggggatcgacccactgttagcaggtttggggctatttctcgtaccagcaaaacaatctaccagggtgcaggaccaatgcaggcaatggctccacagggcgccccaacgaagagcattaacatctcagactacagcccctatggtacacacgggggctggggggctagcccctattcaccccaccagaacatcccatctcagggacacttctcggagcgggaacggatctcaatgtccgaggttgcatcacatgggaaaccacttcccagtgccgagagagagcaactgaggctcgagcttcaacaattgaatcatcagatatcccagcaaacacagctgcgaggcctcgagagggaagccaacacgctcgccggacaaagtcagccccctccccctcccccccccaaatggccgggcatgatttcatctgaacaactgtcactcgaactccaccaagtcgaacgagagatcggcaaacgaacgagagaactcagcatggaaaaccagtgctccctggatatgaagtcaaagttgaatactagcaaacaagctgagaacggtcagcctgaaccccagaacaaggttccagccgaagacctgacactgacattttctagcgacgtccccaacggatcagccctgacccaagagaatatctctctgttgagtaataagacctctagcttgaatctctcagaagatcccgagggaggcggggataacaacgactcccagcggagcggtgtcactccctccagcgccccgtag

SEQ ID NO: 133002 - DNA, 3402 bp, Artificial Sequence
  Description of Artificial Sequence: Synthetic coding sequence
atgcctgtacaggcccctcagtggaccgatttcttatcatgccctatttgtacccagactttcgacgagaccataagaaagcctatttctctggggtgtggtcacaccgtgtgtaaaatgtgtttgaataagctgcacaggaaggcctgcccgttcgaccagacaacaattaacacggacatcgagctgctgccagtcaactctgcattactgcagctggtgggggcccaagttcccgagcagcagcccattactctttgcagtggcgtggaggacacaaaacattacgaagaagcaaaaaaatgcgttgaggaactggcactatatctgaaacccctgtctagtgcaaggggcgttggtttgaactccaccacccagagcgtgctttcacgcccaatgcagcggaagctggtgactttagtgcactgtcaattagtagaggaagaggggcggatcagggctatgcgggctgccagatccctgggcgagcgtacagtgactgaactcatcctccagcatcaaaacccgcagcagctgagctcgaacctgtgggccgccgtgagggcacgtggatgccagttcttaggccccgcaatgcaggaggaagccctgaagctcgtcttactggctctcgaggatggaagtgccctgagcagaaaagtgttggtgctgtttgtcgtccaaagacttgaacccaggttcccccaagcttcaaagacttccatcgggcacgtggttcagcttctttaccgcgcttcttgctttaaagtcaccaagcgcgacgaggactcgtcgctcatgcagctgaaggaagaattcagaacctatgaagcacttcgccgggagcatgactcccaaatcgtgcagattgccatggaggctgggctccgtattgcacctgaccagtggagttcgttgttatatggtgatcagagccacaagtctcatatgcaatcaataattgacaagttgcagactccagcgagctttgcccagtctgtacaggaattaacgatagcgcttcaacggactggagatccagccaatttaaataggctcagaccccatctggaactcctggccaatatagatccttcacctgacgcacctcccccaacatgggagcagctcgagaacggcttggttgccgtacgaactgttgtgcacggcctggtcgactatattcagaaccattcaaagaaaggagctgaccaacaacagcctccacagcactcgaagtacaaaacatacatgtgtagagatatgaagcagcgcgggggctgtcctcggggtgccagctgcacctttgcacatagccaggaagagctagagaagtttaggaagatgaataaacgacttgtgccgaggaggcctctctccgcgagtttgggtcagctgaacgaggtgggactgccctcagccgctatattacccgacgagggcgccgttgacctgccgtcacggaagccgcccgcattacctaacggcatcgtgtccactggcaatactgttactcaattaataccccgcgggacagatccatcatacgactcttccttgaagcccggtaaaatagaccatttgagcagctccgccccagggagtccccctgacctgctggaatcagtacccaagtctatatccgccctgcccgtaaacccccacagtatcccacctcggggacccgccgatctgccccccatgccggtaactaaacccctgcagatggtgccccgcggaagccaactgtatcctgcccaacagaccgatgtttattatcaggatccacggggcgctgctcccccatttgagcctgctccttaccaacagggaatgtattacaccccaccgccccagtgtgtcagtcggttcgttaggccccctccctctgctcccgagccagcacctccatacttggaccactaccctccctatctgcaggagagggtcgtgaactctcagtacggcactcagccgcagcagtatcccccaatatatccaagtcactatgacggccgccgagtgtaccccgccccaagctataccagggaggaaatatttcgcgagagcccaataccgattgaaatacccccagcggcggttccctcctacgtgcccgagagcagagaacggtaccagcagattgaatcttactatccagtagctccacaccctacacagattcgccctagctacttgagggagcctccatatagcagactgcctcctccaccccagccacatccaagcttggatgaactccataggcggaggaaagaaattatggcgcaattagaggagaggaaagttataagccccccacctttcgctccgtctccaaccctccctccgaccttccatccagaagagtttctggatgaggatctaaaggttgccggtaaatataagggcaacgactatagccagtattccccatggagctgcgacaccatcggctcttacattggaaccaaggatgccaagcccaaggatgtggttgccgcggggtctgtcgagatgatgaatgtcgaatcaaagggcatgagggatcagcggctggatctacaaagaagggctgccgagacaagcgatgatgacctcatccccttcggcgatcggccaaccgtgagtcgctttggcgctatatcccggaccagcaaaacgatctaccaaggggcgggacccatgcaagcaatggccccacagggggcacccaccaagagtattaacattagtgactacagcccttacggtactcacggcggttggggggcttcaccatactccccacaccagaacatccccagtcagggtcacttttctgaaagagaaagaatttccatgtcggaagtcgcttcccatggcaaaccgcttccctctgcagaacgcgagcaacttcgccttgagcttcaacaattaaaccaccagatatctcagcaaacccagctgcgcggtctagaggcggtgtcaaaccgcttagtgttgcagagagaggccaacacactcgcggggcagagccaaccccctccacctccacctccaaaatggccaggcatgatttcctctgaacagctgagtcttgagctccatcaggtggaacgtgagattgggaagcgtaccagagaactctcaatggagaaccagtgttcccttgacatgaagagcaagctcaatacttctaagcaggccgagaatgggcagccagagcctcaaaacaaggtgcccgctgaggatctcactcttacattctcagacgtaccgaacgggtctgcccttacccaggagaacatctcactcctgagcaacaaaacgagcagcctaaacctgagtgaggaccccgaaggaggcggagataataacgattctcagaggagtggtgtgacgccgagctctgccccctag

SEQ ID NO: 133003 - DNA, 984 bp, Artificial Sequence
  Description of Artificial Sequence: Synthetic coding sequence
atgtgggccacctgctgtaattggttctgccttgatgggcaaccggaggaagtcccccccccccagggcgccagaatgcaagcttattctaatcccggatattccagtttcccatcacccacggggctagagccaagctgcaaatcatgtggtgcccattttgcaaataccgcgcgtaagcaaacttgcctagactgcaaaaaaaacttctgtatgacgtgctcgtcccaagtggggaatggaccaaggctgtgcttactgtgccagcgctttcgagccaccgcatttcaaagagaggaattgatgaagatgaaggttaaggatcttagagactacctctctctacatgacattagcactgaaatgtgccgggagaaagaagagctggtgcttcttgtcctcgggcagcagcctgtgatctcacaagaagacagaacgcgcgcttcaaccctgtccccagactttcctgaacagcaggcctttctcacacaaccccactccagtatggtgccacccacatcacctaatctgccaagcagctctgcccaggcgacgtctgttccccctgctcaagtccaggaaaaccagcagtctattgattctgaggactcatttgtgcccggacgacgcgcctcactgagcgatctgaccgatcttgaggatatcgagggacttaccgtgcgtcagctcaaggagattctcgcgcggaacttcgttaattacaaaggatgctgcgaaaaatgggagctcatggagagggttacaaggctgtataaggatcaaaaaggcctgcaacatctgggaggtgctgtcccatcaggactagaggagaatctgtgcaagatttgcatggacagcccaattgactgcgtgttgctggaatgcggacacatggtaacttgcaccaaatgcggtaaacggatgaatgagtgtccaatttgtcgccagtatgtcattcgggccgtgcacgtctttcggtcctag

SEQ ID NO: 133004 - DNA, 1092 bp, Artificial Sequence
  Description of Artificial Sequence: Synthetic coding sequence
atgtgggcgacttgttgtaactggttttgtctcgacggccaaccagaagaggtgccgccgccccagggagctcgcatgcaagcctattctaacccaggctactcttcttttccgtcgcccacagggctcgaaccgtcctgtaagagctgcggagcgcattttgctaacaccgctaggaaacaaacatgtctggattgtaagaagaacttttgcatgacctgctcttcccaggtgggtaatggccctcgattgtgcctcctgtgtcagcggttcagggcaactgccttccagcgggaggagcttatgaaaatgaaagttaaggatcttcgggattacctctccttgcacgatatcagcaccgaaatgtgcagagagaaggaagagctggtgctgctagtcttgggccagcagcccgttatttcacaggaggatagaacgcgagccagtacactgtcgccggatttcccagaacagcaggcatttttaactcagccacacagctctatggtgccacctacatccccaaacttacctagctcctccgcacaggcaacctctgttccccccgctcaggtgcaggagaatcaacaggctaatggacacgtaagtcaggatcaggaggaaccagtttatttggagtccgttgcacgagtgccggccgaggacgagacccaaagtatcgattcagaggacagcttcgttcccggacgtcgggctagtcttagcgacctcaccgatctcgaagacatagaaggcctgaccgtcaggcagcttaaggagattctcgccaggaactttgtgaattacaagggctgttgcgagaagtgggagctgatggaaagggtcacaaggctgtataaggatcagaaaggtctgcagcatttggtgtcaggggcagaggaccagaatgggggggcagtaccttcaggcctcgaggagaatctgtgtaagatctgtatggatagccctattgattgcgtgctgctcgaatgcggccatatggtgacttgcacgaaatgcggtaaacgtatgaatgaatgcccaatatgtagacagtacgtaattcgggccgtccacgtgtttcgttcctag

SEQ ID NO: 133005 - DNA, 1068 bp, Artificial Sequence
  Description of Artificial Sequence: Synthetic coding sequence
atgtgggcaacgtgttgtaactggttctgtctcgacggccagcctgaggaagtgccgccaccacagggagcaagaatgcaggcctactcgaaccccggctacagtagcttcccttcccccacagggttagagccttcgtgtaagagctgtggcgctcacttcgccaacacagcaaggaaacagacctgcctagactgcaaaaagaacttttgcatgacatgtagcagtcaggtaggcaatgggccccggctctgcctgctttgccagaggttcagagcgacagcgttccagcgtgaggaactcatgaagatgaaagtgaaggatctgagggattacttatccctccacgatatctccacagagatgtgccgcgaaaaagaggaacttgtcttgcttgttttgggccaacagcccgttatctctcaggaagatcgcacccgagcatcaactctcagccccgattttccggaacaacaagcttttctgactcagccccatagtagcatggtgccccccactagcccaaacctcccttcctctagtgctcaggccacttccgtgccccctgctcaggtgcaagagaaccagcaggctaacggccatgtatcccaggatcaagaggaacctgtgtaccttgaatcggtcgctcgagtccctgctgaggatgaaactcagtccattgacagtgaagattctttcgtgccgggaaggcgcgcatccctgtcagacctcaccgatttggaggacatcgaaggacttactgttcggcagttgaaggaaattctggcgaggaatttcgtaaactacaaaggctgctgtgaaaagtgggagctgatggagagggttactagactgtacaaggaccagaagggcttgcagcatttagggggagctgtgcccagcggcctcgaggaaaatctctgtaaaatttgcatggacagtcctatagactgcgtccttctagaatgtggacacatggtcacctgtactaagtgcggtaagagaatgaacgagtgccccatttgccgccagtacgtgattcgagcagtccacgtgttccgctcttag

SEQ ID NO: 133006 - DNA, 1092 bp, Artificial Sequence
  Description of Artificial Sequence: Synthetic coding sequence
atgtgggctacgtgttgcaactggttctgcttggacggccagccagaggaagttcctccacctcagggggcgcggatgcaggcttactcgaaccccggatactcgtcgtttccatctcctactggcctggagccaagctgcaagtcgtgcggggcacattttgcaaataccgccagaaagcagacatgcctagattgcaaaaaaaacttctgcatgacatgtagcagtcaggttggaaatggcccccggctgtgcctactttgtcaaaggtttcgagccacagcttttcagagggaggagctgatgaagatgaaggtgaaggatttgagggactatctgagtctgcacgatatttcaacagagatgtgccgcgaaaaagaggaactagtcctgctggtgctcggtcagcagcccgtgatcagtcaggaggatcgtacgcgagcttctacactatcccctgatttcccagaacagcaggctttcctcacccagcctcatagtagtatggtcccaccgacatcccctaacctcccttcgtccagtgcccaggctacaagcgtgcctccagcccaggtgcaagaaaaccagcaggccaacggtcacgtgtcccaggatcaagaggaacctgtctacctcgaaagcgtggccagagtccccgcagaggatgagacacagtccattgacagtgaagattcattcgtgcctggcagaagagctagcctcagtgacctgactgatctagaagacatcgagggtttgactgtgcggcaactaaaggagatattagctcgtaactttgttaactataaaggctgttgtgagaagtgggaattaatggagagggtgacaaggctatacaaggatcagaaaggattgcagcacctggtgtccggcgccgaagaccagaacgggggtgctgttcctagcggactggaagaaaacctgtgcaagatatgtatggacagtcccatcgattgcgtcctacttgaatgcggccatatggttacttgtactaagtgtggaaagcgtatgaatgaatgtcctatctgtcgacagtacgtgatcagggctgtacatgttttccgttcttag

SEQ ID NO: 133007 - DNA, 816 bp, Artificial Sequence
  Description of Artificial Sequence: Synthetic coding sequence
atgtgggcgacatgttgcaattggttttgcctggacggccagcctgaggaagtccccccaccacagggggccaggatgcaggcctattcaaaccccggttattcctcattccctagccctaccggcttagagccctcttgtaagtcatgcggcgctcacttcgccaacacggctcggaaacagacctgtctggactgtaagaagaacttttgtatgacatgttcttcccaggtggggaacggaccaagactgtgcctgctctgtcagcggttcagggccacagcatttcaacgagaggaattgatgaagatgaaggtgaaggacctgagggattatctgagcctccatgacatcagcacagagatgtgccgagaaaaggaggaactggtgttattggtgctgggccagcagcccgtaatatctcaagaggatcgaacccgggccagtacattaagcccggacttccccgaacagcaggccttcctcacacagccccattcctctatggtgcccccaacgtcccccaacctgcctagctcatctgcacaggccacatccgttccccccgcccaggtccaggagaatcagcaggcaaatggccacgtctcccaggatcaggaggaacccgtctatcttgaaagcgttgcgagggtgcctgccgaagatgagacacaatcaattgactccgaagactccttcgtacctgggaggagagcatctctttctgaccttaccgacctcgaggatatcgagggactgaccgtgcgacagctgaaggagatcctggccagaaacttcgtcaattacaaggggtag

SEQ ID NO: 133008 - DNA, 402 bp, Artificial Sequence
  Description of Artificial Sequence: Synthetic coding sequence
atgtgggctacctgctgtaactggttctgcctcgatgggcagcccgaggaagttccaccaccccagggggctcgcatgcaggcgtattctaatcctggctacagtagtttcccatcccccacagggttggaacccagttgtaaatcatgcggcgcacattttgcaaacaccgcacggaagcaaacctgcctcgattgtaagaagaatttctgcatgacttgctctagccaggtggggaatggtcctcggctctgtctgctgtgccagaggttcagagcaaccgccttccagagagaggagttgatgaaaatgaaggttaaggatctcagggattacctgagccttcatgatatcagtaccgagatgtgtcgcgagaaggaggagctggtgttactggtgtag

SEQ ID NO: 133009 - DNA, 570 bp, Artificial Sequence
  Description of Artificial Sequence: Synthetic coding sequence
atgtgggctacctgttgtaattggttctgcctcgatggccagcccgaggaggtgcccccaccccaaggagcaagaatgcaagcctactctaacccaggctattcttccttccccagccctactggactagagccctcgtgcaagtcctgcggggcgcattttgctaacacggctaggaaacagacatgcttggattgtaagaaaaatttctgcatgacgtgctcttcacaagtggggaacggccctcggctgtgtctgctttgccagcgctttagagctacagctttccagagggaggagctcatgaagatgaaagtgaaagatctgcgtgattacctaagcctgcacgatatcagtacagaaatgtgtcgggagaaagaagagcttgtgctgctggtcctagggcagcagccggtcatcagtcaagaggaccgaacccgggccagtacactgtcacccgatttccccgaacagcaggcgttccttacccagccccatagtagcatggtgcctccaaccagccctaaccttccttccagcagtgcacaagctaccagcgtgcccccgtag

SEQ ID NO: 133010 - DNA, 138 bp, Artificial Sequence
  Description of Artificial Sequence: Synthetic coding sequence
atgtgggcaacatgttgtaactggttctgcttggatggccaacctgaggaggtccctcctccccagggagctagaatgcaagcatatagcaaccccggctactctagcttcccaagtccaaccggactcgagccttag

SEQ ID NO: 133011 - DNA, 2124 bp, Artificial Sequence
  Description of Artificial Sequence: Synthetic coding sequence
atgagtggctccagacaggcagggtccgggagcgctggaacgtcaccaggcagcagcgcagcctctagtgtgacaagcgcatcctccagcttaagctctagtccttccccaccatctgtggctgtaagcgccgcagctttagtctccggaggggtagctcaagctgccggtagtggagggctcggcggccccgtgcgcccagtattagtggctccggccgtgtccggatccggagggggtgctgttagtacagggctaagtaggcattcttgcgcggccagacccagcgctggagtcggggggtcttcaagttccttgggatcaggcagtcgcaagcgtcctctcctggctcccttatgtaacgggttaatcaactcgtacgaagacaagtcgaatgactttgtgtgcccgatttgtttcgatatgattgaggaagcctatatgacaaaatgtggtcacagcttttgttacaagtgtatccaccagtcattggaagataataatagatgccctaagtgtaattatgtggttgacaacatcgaccacctgtatcccaattttctcgtaaacgagttgattctgaaacagaagcagcgcttcgaggagaaaaggtttaaactcgatcactctaatggccaccgctggcagatattccaggactggttagggacagaccaggacaacttggacctggctaacgtcaatctaatgctggaactgctggtgcaaaaaaagaaacagttggaagccgagtcacacgccgcccaattgcaaattctaatggaatttctcaaagtggcacgaaggaataaacgggaggagatgtccgggctatatagccctgtgtcggaggacagtacagtcccgcagttcgaggcaccctccccctcacactcttctatcattgactctactgaatattctcaaccccccggtttcagcggaagctcacagaccaagaaacagccctggtataactccactctggcttcccgtcgaaaacggctgacagcccacttcgaggaccttgagcagtgctatttcagtacccgcatgtcgcgtattagtgacgactcacgaactgcatcacaattagacgaattccaggaatgcctatccaaattcaccagatacaactcagtccgacctcttgctaccctctcctatgcgagcgatctgtataatggcagtagcatcgtatcctctatcgagtttgaccgcgattgcgattacttcgcaattgcgggggtgaccaaaaagattaaggtgtatgagtacgacacagtcatccaggacgccgttgacatccactaccctgagaacgaaatgacttgcaatagcaaaataagttgcatttcttggtctagttatcataagaacctccttgcgtccagcgattacgaggggacagtcattctgtgggacggctttacgggacagagatctaaggtttatcaagaacacgagaaacgatgttggtcggtggactttaatctcatggatcctaagctcctcgcgagtggctccgatgacgccaaggtcaagctgtggtccaccaaccttgacaattcagtcgcttcaatcgaagccaaagccaatgtgtgctgcgtgaaattctctccatccagtcggtaccacttagcctttggttgtgccgatcattgtgtccactattatgatctgagaaataccaaacaaccgatcatggtttttaagggtcacagaaaggcagtctcatatgctaaattcgtgagcggagaggaaatcgtcagcgccagcactgacagccagttgaagctgtggaacgtgggcaagccgtattgcttgaggtctttcaaaggccatataaatgaaaaaaattttgtcggactagcttcaaatggtgattatatcgcatgtggaagcgagaacaattctctctatctgtattacaaagggctctcgaaaacacttctgacctttaagttcgacaccgtcaaatccgtcctggacaaagatcgcaaagaagatgacaccaacgagtttgttagcgccgtctgttggcgagctctccccgacggggaatctaacgtcctcatagcggcgaactcacagggaactattaaagttttagaacttgtctag

SEQ ID NO: 133012 - DNA, 1521 bp, Artificial Sequence
  Description of Artificial Sequence: Synthetic coding sequence
atggagttcctgaaggtcgccaggcggaataaacgcgaacagctggaacagattcagaaggagctcagtgtcctggaggaggacatcaagcgggttgaagagatgagtggcctatattctcctgtgtctgaggactcgaccgtcccccagtttgaggctccttccccctctcattccagcataatcgattcaacggagtactcacagcctcctggtttctccgggtcttcacaagccggcgtgcagtggcggtacttaggatccttacagccccccccccccagatataagcgatttagctgtctcaccctcccgagtagctgggattacaggcggttgcccccccacttaactaagaagcaaccatggtacaacagcacccttgccagtagacgcaaaagactgaccgcccatttcgaggacttggagcagtgctacttctcgactaggatgagccgcatctcagacgatagtaggacagccagtcagctagatgagtttcaggaatgcttgagcaaatttacccgttacaatagcgttagacctctggccaccctgtcctacgcatcggacctttataacggctcctcaatagtgagctccatcgagtttgaccgtgattgtgattattttgccattgcaggggtgactaaaaaaatcaaggtttacgagtatgatactgtgatacaggacgcggtggacatccactaccccgaaaacgagatgacgtgcaacagtaagataagctgcatctcttggtcctcataccataagaatcttctggcgtcctccgactacgagggaaccgtgattctatgggacgggttcactggacagcgtagtaaagtttaccaagaacacgaaaagagatgttggtccgtcgattttaatctgatggatccaaagcttctggcctctggctcggatgatgccaaagtcaaactatggtcaaccaacctcgataatagtgtggcttccatagaggcaaaagccaacgtctgctgcgtgaagttttcgcctagtagcaggtaccacttggcctttggatgtgccgatcattgtgtacactattacgatctgcggaataccaagcagccaataatggtgtttaaaggacaccgcaaagcagtaagttacgcaaaattcgttagtggcgaagagatcgtttcagcttctaccgatagccagttaaagctgtggaatgttggcaagccgtattgcctgcggtcgttcaagggtcatattaatgagaaaaacttcgtgggacttgctagtaacggggattatattgcctgtgggtcggaaaacaactccttgtacttgtattacaaagggctctcaaagaccctacttacattcaagttcgacacagtgaagagcgtgttggataaggataggaaggaggacgataccaatgaatttgtgagcgccgtttgttggcgggcactccccgacggggagagcaacgtgctgatcgccgcaaactcgcaaggcaccattaaggttttggctctcctttag

SEQ ID NO: 133013 - DNA, 2196 bp, Artificial Sequence
  Description of Artificial Sequence: Synthetic coding sequence
atgagcgggtccagacaagcaggctccggaagcgcagggactagcccaggctcctccgccgctagctccgtcacaagtgcctcctccagcttaagcagctctccttctccgccttctgttgcagtatcggctgctgcattggtgtccggtggcgtggctcaggccgccggttccggcgggctgggcggccctgtaagacccgttcttgtggcccctgccgtatccgggtcaggcggaggggcggtctctaccgggctgtcaaggcatagctgcgccgcccgcccttcagccggcgtgggcgggtcttcatcatcgctcggctctggctctagaaagaggccattgctcgctcccctgtgtaatgggctgataaacagttatgaggataagagtaacgatttcgtttgcccgatttgttttgacatgatcgaggaagcctatatgacgaagtgcggccactcattttgctacaagtgcatccatcagagtttggaggacaacaataggtgtcctaagtgcaattatgtggttgacaacatcgaccatctgtacccaaacttcctggtcaatgagcttattttaaaacagaagcagcgctttgaggaaaaacgcttcaaactggatcacagtgtgagttctaccaacggccatagatggcagatattccaggactggctgggaaccgaccaagacaacctggacttagcaaacgtcaacctgatgctggaactgctcgtacaaaagaagaagcagctggaggctgagtcacatgctgcgcaactccaaatcctcatggagttcttgaaggttgctcgacgaaacaagagggagcaattggaacaaatccagaaagaactatcagtgctggaagaagacattaagagagtcgaggagatgtcaggcttatactcaccggtttccgaggattctacggtgccacagttcgaggccccaagcccatcacacagctctatcatcgatagcaccgaatattcgcagcctcctggctttagcggctctagtcagactaagaagcaaccatggtacaatagtacactggcctcccgtcggaaaagactaacagcgcattttgaagaccttgagcagtgctacttcagcacccgcatgtctaggattagcgacgacagtagaaccgcctctcagctggacgagttccaggagtgcctgtccaaattcacgagatacaatagcgtgaggcctctggccactttgagctacgcaagcgatctgtacaacggctctagcattgtctcatcaatagagttcgacagagattgtgactacttcgccattgcaggggtgacgaagaaaattaaggtgtacgagtatgatacggtgattcaggatgcggtggacattcactaccccgagaatgagatgacctgcaattcaaagatctcctgtatatcgtggtcgagctaccacaagaacttgctggcgtcttcagattatgagggaacggtgatcctttgggacggattcactggacagagatctaaggtgtaccaggaacacgagaaacggtgctggagcgtggactttaacctcatggatccaaagcttctggccagcgggagcgacgacgccaaagtcaagctatggagcacgaatctggataattccgtcgcctctatcgaggccaaggcgaacgtttgttgtgtaaagttctcaccttcttctcggtaccatctggcgttcggttgtgctgatcattgcgtgcactattacgatttacgaaatactaagcaaccaatcatggtgttcaaggggcaccggaaggccgtgtcctatgccaaatttgtctccggtgaagagatcgtgtcagcctccacggacagccagttgaaactatggaatgtcggcaaaccctactgcttgcgcagcttcaagggtcatataaatgagaaaaacttcgtgggactggccagtaatggggattacatcgcttgcggtagcgagaataattccttatacctgtattacaaaggcctgagtaagaccctgctgacattcaagttcgacactgttaaatcagtgctcgataaagacaggaaagaggacgacaccaatgaattcgttagcgcagtctgctggcgcgccctgccggatggtgagtcgaacgtgttaattgcggcgaattcacagggaactatcaaggtgctggagctggtgtag

SEQ ID NO: 133014 - DNA, 774 bp, Artificial Sequence
  Description of Artificial Sequence: Synthetic coding sequence
atgagcggtagtcgtcaggccggcagcggtagtgctgggacatctcctggtagctctgcagcaagcagcgtgacttcagcgtcatctagcttgtcaagcagcccatcccctccttctgtggctgtgagcgcagccgccctagtgtctggcggcgtggcccaggccgccggttcaggaggattgggcggtcctgtgagaccagtcctggtggcgcccgcggtatcggggtccggagggggagccgtgagtacaggattaagtagacattcatgcgctgccagaccctctgcgggggttggcggtagcagcagttccttgggctctgggtcccgaaagcgacctttactggcccctttgtgcaatgggctgatcaactcctatgaagataaaagtaacgacttcgtgtgtcctatttgcttcgatatgattgaagaggcatatatgacaaaatgcggccacagtttttgctacaagtgcattcaccaatcattggaggacaataaccgctgtccgaagtgtaattacgttgttgataatatagaccacttgtacccaaattttttagtgaatgaattgatcctgaagcaaaaacagaggttcgaggaaaaacggtttaagcttgaccactcagtcagcagcacgaatggccacaggtggcaaattttccaagattggctcggtactgaccaggataacctggacctggcaaatgtaaacctgatgctggagctgttggttcaaaagaacaagaagaagaagaagaaaaagaaatag

SEQ ID NO: 133015 - DNA, 2325 bp, Artificial Sequence
  Description of Artificial Sequence: Synthetic coding sequence
atggctcacgaagccatggaatacgacgtgcaggtgcagttaaatcatgccgagcagcagcccgccccagcagggatggcatctagccagggaggaccagctctactgcagcctgtgcccgcggatgtggtgagttcacaaggcgtacctagcatcctccagcccgctcctgctgaggtcatttcctctcaagcgacccctccacttcttcagcccgctccccagctttcggtggatctaactgaggtcgaagtgcttggtgaggacaccgtagagaatatcaatccacggacctccgaacagcacagacagggctccgatggaaatcacacaatacctgcctcaagtctgcacagcatgacgaactttatttcaggactgcagaggctgcacggcatgttggaattcctgcgcccttcttcatctaaccatagcgtcggccctatgcggaccaggcggagggtcagcgcctcccggcgcgcccgggctggggggtctcagcggaccgacagcgcccggctgagggccccactggacgcctacttccaagtgagcaggacacaacccgacctacctgccactacttacgattccgagacaaggaacccagtgtccgaggagctacaggtttctagtagttctgattctgatagtgatagttctgccgagtatggaggtgtagttgaccaagctgaagaatcaggggcggtgattttagaagagcagcttgccggggtttccgcagaacaagaggttacctgcatagacggagggaagacattaccaaaacagcccagtcctcagaaaagcgagccgctcctccctagcgccagtatggatgaagaggaaggcgatacttgcacaatatgtctcgagcagtggactaacgcaggggaccacaggctcagtgccctccggtgcggacacttgtttgggtataggtgcatctccacatggctgaaaggccaggtgcgcaagtgtcctcaatgtaacaagaaggctaggcacagcgacatcgtggtgctgtacgcgagaacactgcgcgctctggataccagtgagcaggaacggatgaaaagctctcttctgaaggagcagatgctcagaaaacaggcagaactcgaatccgcccagtgccgacttcagttgcaggtgcttactgacaagtgcacaaggctgcagcgtcgggttcaagacctgcagaagctcacctcacaccaatctcagaacttgcagcagccaagaggtagtcaggcctgggtgctctcctgcagtccgtctagtcagggacagcataaacataagtaccattttcaaaagaccttcactgtttcccaagccggtaactgcagaatcatggcttactgtgatgccctcagctgcctggtcatatcacagccttccccccaagccagctttctgcccgggttcggtgtgaaaatgctgagtactgccaatatgaagtcttcccagtacattccaatgcacgggaagcagatcagggggctagctttctcaagctatctgcggggacttctcctgtctgcatccctagacaacacaatcaagctgacttctctggaaactaatacggtggtccagacatacaatgctggccggccagtatggtcttgttgttggtgtctggatgaggcaaattatatttacgccggtttggccaacggaagcatactggtttacgacgtcagaaatacatcttcccacgttcaggagctcgtggcccaaaaagcccgctgtcctcttgtgagccttagctatatgccacgcgctgcaagcgccgctttcccatatggtggtgtcctggccgggacgctggaggacgcatccttctgggaacaaaaaatggatttttcgcattggccacacgtgctccccctggagcccggcggatgtatcgatttccaaaccgagaattcttctagacattgcttggttacgtacagaccagataagaatcacactactattcgtagtgtcttgatggagatgtcttatcgcctggacgatacgggaaatccaatatgtagttgtcagcctgtccataccttttttggggggcccacgtgtaagctcctcactaagaatgctattttccagtccccagagaacgatgggaacattttggtttgcacaggcgacgaggccgctaatagcgccctgttatgggacgctgcttctggaagcctcctccaagacttgcagaccgaccagcctgtcctggacatatgccccttcgaggttaatcggaactcttatctggcaactttgaccgagaaaatggtacatatttacaaatgggagtag

SEQ ID NO: 133016 - DNA, 792 bp, Artificial Sequence
  Description of Artificial Sequence: Synthetic coding sequence
atggcccatgaggccatggaatatgatgtgcaggtgcagctcaatcacgccgagcagcagccagcaccagctggcatggctagctctcaagggggtccagcactcttgcagcctgtgccagcagacgtagtttcgagtcaaggcgtaccaagcatcctccagccggctcccgccgaggtgattagctcacaggctacaccccctctccttcaaccggcaccccaactgagcgtggatctgactgaggtggaggttctcggggaggacaccgttgagaacattaatccccgcacctcagagcagcataggcagggatcagatggaaatcacacaattccagcctctagtttacactctatgcccctagaacccggaggctgcatcgacttccagaccgagaactcgtctagacactgtcttgtaacctatcgccccgacaagaaccacacaactattcggagcgtgttgatggagatgagctaccggttggacgacaccgggaatccgatttgcagctgtcagcctgttcatacttttttcggcggacccacatgtaaactccttactaaaaacgctatctttcagtctccggaaaacgacggcaatatccttgtctgcactggtgacgaggcagctaattcggccttgctgtgggacgcagcctccgggtctctgctccaggatctgcagacagaccaacctgtgctggatatctgccctttcgaagtgaaccgcaattcttacttagccactctcaccgagaaaatggtccacatatacaagtgggaatag

SEQ ID NO: 133017 - DNA, 2058 bp, Artificial Sequence
  Description of Artificial Sequence: Synthetic coding sequence
atgaatcagtccagatctcgctccgacggcggcagcgaggaaacactgccccaagaccacaatcatcacgagaatgaaagacgttggcagcaggagagactgcatcgggaggaagcttactatcaattcataaacgagttgaatgatgaggattatcgattgatgagggatcacaacctccttggcacccccggggagatcaccagtgaggaactccagcagagattagatggcgtcaaggaacaattggcctcccagcctgatctgagggacgggactaattatcgtgattccgaggtcccccgcgagagcagccacgaggactccttgttggagtggctgaatactttccggcggactggcaacgccactagaagcgggcagaacggaaaccagacatggcgagccgtttctcgtacaaacccaaataacggggaattcagattcagtcttgagattcacgtcaatcatgaaaacagagggtttgaaatacatggagaagactacacagatattcccttgtcggactccaatagagatcacacagccaaccgtcagcagaggtcaacaagccctgttgcacgcaggacccgctctcaaacgtctgtaaacttcaatggctcttcatcaaacatcccgcggacccgtctagcaagcagaggacagaaccctgctgaggggtcttttagtaccttgggaaggctacggaacgggataggcggggccgctggcatccccagggccaatgcgagcaggactaatttctcatcccacacaaaccagtccggcggtagtgagctgcgccagagagagggtcagagattcggcgctgcccatgtgtgggagaatggtgctcggtcaaatgtaacagtgcgtaacacgaatcaaaggctggaaccaattcggctccggagtacaagtaatagccgcagtcgttcccctattcagcggcaaagtggtaccgtatatcataattctcaaagggaatccagaccagtacagcagacaacacgccgatcagttcggcggcgcggcaggacacgcgtttttcttgagcaggaccgagagcgggagagaagggggaccgcttatacgccattttctaacagtaggcttgtgtcaaggatcaccgtggaggaaggcgaagagagcagtcgaagctcgaccgcagttagacgacacccaacaatcactcttgacctgcaggtccgccggattcgcccaggggaaaacagagaccgagacagtatcgcgaacaggaccagatctcgtgtaggactggccgagaataccgtcacaattgagagcaactcaggagggttcaggagaactatttctcgactcgaacgcagcgggattaggacgtacgtgtccaccatcacagttccattacgacgcattagcgagaacgagctggtagagccttcatcggtggcgcttcgttcaatcttacgccagatcatgaccggctttggggaactctcgtctctgatggaggccgattccgaatccgagctccagagaaacgggcagcatctgcctgacatgcattcggaactgtccaacttgggcacggacaacaaccggtctcagcaccgcgaaggttcaagtcaggatcgccaggctcagggagacagcacagagatgcacggagaaaacgagactacacagccccacactagaaacagcgattctaggggggggcggcagctcagaaaccctaataatctagttgaaacagggacactgcccatactgaggttagcgcatttctttttgcttaacgaaagtgatgacgatgatcggattaggggcctcactaaagaacagattgacaacctgtcaacacgtcattatgagcacaattccatagactctgagctcggcaagatctgtagcgtttgtatctcggactatgtgactgggaacaaattaaggcagctgccatgtatgcacgagttccatattcactgtattgaccgttggctatccgaaaactgcacttgccctatctgccggcagccagttttggggagcaatatagcgaacaatggatag

SEQ ID NO: 133018 - DNA, 2058 bp, Artificial Sequence
  Description of Artificial Sequence: Synthetic coding sequence
atgaaccaatcgcggtcccgcagcgacggtggcagtgaagaaacactgccccaggatcacaaccaccacgagaatgagcgacgctggcagcaggagagactccatcgagaggaggcatattaccaatttatcaacgagttaaacgacgaagactataggttaatgagagaccataatctgctaggaactcctggcgaaataacgtccgaagaattgcagcaaaggttagatggcgtcaaagagcaattggcaagtcaacccgatttgagggacggtaccaactatcgcgactccgaagtgcctcgagagagttctcatgaagactccctgctcgagtggctaaatactttccggcgaaccgggaatgccacaagatctgggcagaatggcaaccagacttggagagctgtttctcgcactaatccgaacaatggtgaattcaggttttcactcgaaattcacgtgaaccatgagaatagggggttcgaaatccatggggaagactatacagacatcccactttctgattctaaccgcgaccacaccgccaaccgacagcagcggtcgacatccccagtggcaagaaggactcgatctcaaaccagcgtgaacttcaacggctcctccagtaacatcccacggacaaggctggcgtcccgggggcaaaacccagccgaagggagcttttccacactcggccgactgcgcaatggaatcggcggcgctgcaggaatacctagagcgaatgcctcacggacaaatttcagctcgcatacgaaccagtccggaggctcagagctcagacaacgggagggacaacggtttggggccgcacacgtctgggagaatggggcaaggtcgaacgtgaccgtccgcaataccaaccaacgcttagaacccatccggctccgctccacgtcaaatagcaggtcccgatctcccatccagaggcagtctggaacagtctaccacaattcccagcgcgaatccaggccggtccagcagactaccaggcgcagcgtacggaggaggggccgaacacgggtttttttggagcaggatcgggaacgagaaaggaggggcaccgcatacactcccttctcaaactctaggcttgtgagccgtatcaccgtggaggagggggaggaaagtagcaggagtagcacagccgtcagaagacatccgacaataacgttggacttgcaggtgaggcgcattcgcccaggcgagaatcgtgatagggacagtatagcgaatcgaaccagatcacgtgtgggacttgccgagaacacggtaactatagagtctaattccggcggttttcgccggaccattagtcggttagagcggtctgggatccgaacctacgtctccacaatcactgtgccgctgcgtaggatctccgagaacgagttagtcgagccatcctcagtggcgctgagatccattctgaggcagatcatgacgggtttcggcgaactgagctctcttatggaagctgattcagaaagtgagctgcaacggaacggacaacatctccctgacatgcactccgagctgtctaatctgggaacggacaataatcgatcccaacatcgggaggggtcctcacaagatcgacaggcccagggggactccaccgagatgcatggtgaaaacgagactactcagccccatacgagaaactcagacagccggggaggaagacaactacggaatcctaataacttggtcgagaccggaacactgcctatcctgaggttagcgcatttttttttactgaatgagagcgacgatgatgatcgcatccgcggactgacaaaagaacagatcgacaatctgtctacacgccattatgagcataattcaatagactctgagctggggaaaatctgcagcgtctgcatttctgactacgtgactggaaacaagctgcggcagttaccttgtatgcatgaatttcacatccactgtatagataggtggctgagcgaaaactgtacctgccctatctgccgacaaccagtccttggttccaacatcgcgaataacggttag

SEQ ID NO: 133019 - DNA, 2058 bp, Artificial Sequence
  Description of Artificial Sequence: Synthetic coding sequence
atgaaccaatcccgctccaggtctgatggaggatccgaggagaccctccctcaggaccacaaccatcacgagaacgagcggaggtggcagcaagagcgcctgcacagagaagaggcttactaccagttcattaacgaattgaacgacgaagactatcgacttatgagagaccataacctgttgggcacccctggcgagatcacatccgaagagcttcaacagagactcgacggagtaaaagagcaactcgcgagtcagcccgacctgagggacggcaccaattatcgcgacagtgaagttcccagggaatccagccacgaagactctttgctcgagtggctcaacacgtttagaaggaccgggaacgccacaagaagtgggcagaatggaaaccagacgtggcgggcagtgtccagaactaatccaaacaatggcgagtttaggttttccttagaaatccacgtgaaccatgagaaccgggggttcgaaatccatggggaagattatacggatattccactgagcgattcaaatcgtgatcacacagccaacagacaacagagatccacctccccagtggccagacggacaagaagtcaaactagcgtcaactttaacggaagctcctctaacattcccaggacccgcctcgcaagtcgcgggcaaaatcccgctgagggatctttcagcacattgggcagactaagaaatggcatagggggcgctgccggaatcccccgggccaacgcctctcggacaaacttcagtagccacaccaatcagtccggagggtccgagcttcgccagcgcgagggacagagatttggagcagctcacgtctgggagaacggcgcccggagcaacgtcactgttcgcaatacaaatcagcgactggagcccattcgcctacgaagtacttcaaatagcaggtcacggtccccgattcagaggcagtctggcacagtgtaccacaactcacaacgcgaatcaaggcctgtgcagcagacaaccaggcggagtgtgcggaggcggggacgcactcgggtctttctggagcaagaccgggaacgggagcgaagggggactgcttataccccattcagcaatagtcgtttggtctctcggatcaccgtcgaggagggcgaggaatcctcccgctcatcaactgccgtcaggaggcatcccaccattacccttgaccttcaagttcggcggatcagacccggggagaatcgcgaccgggattcaatcgcgaaccgtacccgttctcgagtgggcctggcagaaaatactgtgacaatagagagtaactcaggcggttttcgacgaacaattagccgtttagagcgatctggaatcagaacatatgtttcgactattaccgtgcctttgcggcgtatcagcgaaaacgaactggttgaaccttcctccgtggcattacggtctatactacggcagatcatgactgggttcggtgaactcagttctctaatggaagccgactccgaatccgagcttcagcgaaatggtcagcaccttcctgatatgcattccgaactgtcgaatctcggcactgacaataatcggtcacagcatcgcgagggcagttcccaagaccgccaggctcagggcgactctacagagatgcatggagaaaacgagacgactcagccacacactcggaattccgactctcgcggtgggcggcagctcaggaacccaaataatcttgtggagaccggcactttgccgattctgagactggctcatttttttttgctgaacgagtcagatgatgacgacagaatccggggcctgacgaaggagcagatagataacctgagtacacggcactatgagcataatagcatcgatagcgaactcggcaaaatctgttctgtgtgcataagcgattacgtcaccggaaataaacttagacagcttccctgcatgcacgagttccatattcattgtatcgatcggtggctgtctgagaactgcacttgtccaatatgcagacagccggtgctgggaagcaatatcgccaacaacggttag

SEQ ID NO: 133020 - DNA, 990 bp, Artificial Sequence
  Description of Artificial Sequence: Synthetic coding sequence
atgcaacttgaggtcgacaagatgggaactaagctaggcgagttgttggttagccggattaccgtcgaagagggagaagaaagctccaggtctagcacagcagtgagacgccaccctactatcacgctggatttgcaggtgcggaggatcagacccggagaaaatcgggacagagactcaattgctaaccggactagatcacgggtgggattagctgaaaatactgtcactatcgaatcgaattctgggggtttcaggagaaccatttcacggctggaacgttcaggtataaggacatatgtgtctactatcactgtcccgctccggagaatctctgaaaatgagctcgtcgagccctcttctgttgccctgagaagcatcctgcgacagataatgaccgggtttggcgagctttcgagccttatggaggccgactctgagagcgaactgcaaagaaatggccaacacctgcccgacatgcattccgagctgtcaaacctggggaccgacaataaccgctctcagcaccgggaagggagtagtcaagaccgacaggctcagggagactctaccgaaatgcacggggaaaatgagactacacaaccccacaccagaaactccgactcaaggggcggaaggcagttgcggaatcctaataacctggttgaaactggaaccctcccaattctcagactggcacattttttcctgctcaacgagtcagacgatgatgaccgaatccgcggtctcaccaaagagcagattgacaacctctccacccgtcactatgaacacaacagtatagattctgagttggggaaaatatgctccgtctgcatttcagactacgtgactggcaacaagctgcgtcagctgccttgtatgcatgagttccatatacactgtatcgatcgctggctcagtgagaactgtacctgccccatatgtagacagccagtcctgggcagcaatatcgccaataatggatag

SEQ ID NO: 133021 - DNA, 1221 bp, Artificial Sequence
  Description of Artificial Sequence: Synthetic coding sequence
atgaccaccccagccaacgctcagaatgcgtccaagacctgggagctcagtctctatgagctccaccgaacacctcaagaggctattatggacggcaccgaaattgctgtctcccctcggtccttacactctgaactcatgtgtccaatctgtttggatatgctgaagaatactatgacaaccaaagaatgcttacaccggttctgcagcgactgtattgtgacagcccttcggagcggaaataaggaatgccccacatgccggaagaagttagtcagcaaacggagtttaaggcctgatcctaatttcgatgcgctgatttctaagatttatccaagtcgagaggagtatgaggcccaccaggatagggtactcatacgactcagtagactccacaaccagcaggctctctcgagcagcatcgaggaaggactccgaatgcaggcgatgcacagagctcagagggtgagaagaccgattccagggtctgatcaaacaaccactatgtcgggaggcgaaggcgaacctggggagggcgaaggggatggcgaggacgtatcttccgatagtgcacctgactctgcgcctggacctgcgcccaaacgaccccggggaggaggagccggaggaagttctgtgggcactgggggcggcggtaccggaggagtgggcggcggagctggttcggaagactcgggcgaccgaggaggcaccctgggtggcgggaccctgggaccccccagcccacctggagctccctctccgccagaacctggtggggaaatagagctcgtttttcgcccacaccccttactcgtggagaagggagagtactgccagactaggtatgtaaagaccacaggtaacgcaacggtggatcacttatccaagtacttggccctaaggattgccctggagaggagacagcagcaagaggccggtgagccggggggcccgggagggggagctagcgacactggagggcccgacggttgtggaggggagggaggaggagcgggaggcggggatggccctgaggagccggccctgccttcgcttgagggggttagcgaaaaacaatacacaatttacattgcccccgggggaggtgcctttaccacactgaacgggtccttaaccctggaacttgtgaatgaaaaattttggaaggtgtccaggcccctggaactatgctacgccccaaccaaggacccaaaatag

SEQ ID NO: 133022 - DNA, 1221 bp, Artificial Sequence
  Description of Artificial Sequence: Synthetic coding sequence
atgacgactcctgctaatgcccagaacgcctcaaagacttgggagctctcactatatgaactacatcggacacctcaggaggccattatggacggcaccgaaatcgctgtaagccccagaagcctgcactctgagctcatgtgcccgatctgcctggatatgctgaagaacaccatgaccactaaggaatgtctccataggttctgtagcgattgtattgttactgccctcagatccggaaacaaagaatgtcctacctgcagaaaaaaactggtcagcaagagatctttgcgtccagatcctaatttcgatgctctgatctcaaaaatatatcccagcagggaagagtacgaagcgcaccaagatagggtgctgattcgcttatcaaggctgcacaatcagcaggccctgtcatcctcgatcgaggagggcctgaggatgcaagcaatgcaccgcgcgcagagggtaagaagacccattccagggtctgaccagactacaactatgtcgggcggagaaggggaaccgggggagggggagggggacggggaggacgtgtcttctgatagcgcccctgactccgcccctggaccagccccaaaaaggcctagaggagggggcgccggggggagctccgtcgggaccgggggcggtgggacgggcggagtgggggggggtgctggatccgaagatagcggcgacagggggggaaccctggggggcggcactctcgggcccccaagcccacccggcgccccctcacccccagagcctggaggcgaaattgaactggtgttcagaccgcatccccttctcgtggagaaaggtgaatactgccaaacgaggtacgtcaagactacaggcaacgctactgtggaccacttgtctaaatatttagccctgcgcattgcccttgagaggcgacagcagcaggaggcaggggagcccggaggtcccggaggcggcgcatcggacaccggaggtcctgacggctgtggcggcgaagggggaggcgccgggggcggggacggacccgaagagccggccctgccttccttagagggggtcagtgagaagcagtataccatctacattgccccaggggggggggcatttacaacccttaatggcagcctgaccctcgaactcgttaatgagaagttttggaaggtcagtcggcctctggaactgtgctatgctccgaccaaagaccctaaatag

SEQ ID NO: 133023 - DNA, 1221 bp, Artificial Sequence
  Description of Artificial Sequence: Synthetic coding sequence
atgaccactcctgccaatgcccagaatgctagtaagacctgggaactgagcttgtacgagctgcatcgaacaccacaggaggccatcatggatgggacagaaattgcggtgtcgccccggagccttcattccgagctgatgtgccctatatgtctagacatgctaaaaaacaccatgacgaccaaggaatgccttcatcgcttttgttctgactgcatagttacagcacttcgatccggcaacaaagagtgtcctacctgccgcaagaaacttgtgtctaagcggtcgctaagacccgatccgaactttgacgctctgatttcaaagatctaccctagtagagaggagtatgaggcacatcaagatcgggtgctgatccgtctcagtcggttacacaaccagcaagccctctcctcaagcatcgaggagggattgagaatgcaagctatgcacagagcccagcgagtgcgccggccgatacccggctctgaccagactactacgatgtctggtggcgaaggggagccaggggaaggggaaggggacggagaggacgtgtccagtgattccgcccctgattcagcacctggtcctgcacccaagagaccccgagggggaggcgccggcggaagctctgtggggaccgggggtggcggaacagggggcgtgggcggcggcgcagggtccgaggatagcggagaccgtggaggtacccttggtggcggaaccttaggccctccatctccacccggagccccttcccctcctgagccagggggtgagattgagctggtgtttagaccacatccgctgctggtggaaaaaggggagtattgtcagaccagatatgtcaagacaacgggaaacgcgaccgtcgatcacctgtcaaaatacctggcattaaggatagccctggaacgtcggcagcagcaagaggccggtgagccagggggccccggcgggggcgccagtgataccgggggtcccgatggatgcgggggagaggggggtggtgccggcggcggggatgggcccgaagaacccgcactgcctagtctagaaggcgttagcgaaaagcagtacacaatttacatcgctccgggaggtggggcctttactactcttaatgggtcacttaccttggaactggtaaatgaaaaattttggaaagtttcccgaccactagaactgtgctatgctcccaccaaggatcctaagtag

SEQ ID NO: 133024 - DNA, 1221 bp, Artificial Sequence
  Description of Artificial Sequence: Synthetic coding sequence
atgactactcccgcgaacgcgcagaatgcctccaagacctgggagctttccctgtacgagttgcatcggacaccacaggaggccatcatggatgggactgaaattgccgtctcccccagatccctccacagcgagctaatgtgtcctatctgcctcgatatgctgaagaatacaatgacaaccaaggaatgtctgcatagattctgcagtgattgcatcgtgactgcactgcgttccggtaacaaggagtgtccaacatgtcggaaaaagctggtgagcaagcgatcattgagacccgatccaaattttgatgctctgatcagtaaaatatacccaagcagagaggagtacgaagcgcatcaagacagggtcttgatccgtctgtctcgcctgcacaaccagcaagctctctctagtagtattgaggagggattgcgaatgcaggcgatgcatagggcccagagagttcggcgccctattccgggcagtgaccagaccactactatgagtggtggagagggagagcctggagagggtgaaggcgatggcgaggacgtttcaagcgacagcgctcctgatagtgcccctggccctgctcccaagaggcccagaggaggcggcgcaggaggcagctctgtaggcactggtggtggagggacgggtggcgtagggggtggtgccggctcagaggattccggagacagaggtggtactctcggcggtggcactttgggcccgcccagccccccgggtgccccttctcctcctgagccggggggcgagatcgaattagttttccgtccgcacccgttgcttgtggaaaaaggcgagtactgtcaaacccgatatgtgaagacaacaggaaacgccacagtggaccacctgagcaagtatttggctttgaggatagcattggaacgccgccagcagcaggaggccggcgagcccggcggccccggtggtggtgcatccgataccggtggtccggatggctgcgggggcgagggagggggggcagggggaggtgatgggcctgaagagcccgcccttccatcgctcgagggcgtgtctgagaagcagtacacaatatatatcgcacctggggggggtgcttttacgaccctgaatggcagtctcacactcgagcttgtcaatgagaaattctggaaggtaagtcggcccctggagctgtgttatgcaccaacgaaagatcccaagtag

SEQ ID NO: 133025 - DNA, 1221 bp, Artificial Sequence
  Description of Artificial Sequence: Synthetic coding sequence
atgaccactcctgccaatgctcagaatgcaagcaagacctgggagctgagtttatacgagttgcaccggacaccacaagaagccattatggacgggacagagatcgccgtatcaccgagaagcctacacagcgagctgatgtgccctatctgcctagatatgcttaagaacaccatgacgacaaaggagtgtctgcatagattttgctctgattgtattgtcacggcgctgagaagtgggaacaaggaatgccccacgtgccgcaaaaagcttgtgtctaaacgcagcttgaggcccgatccgaactttgacgcccttattagtaaaatctatcccagccgcgaagagtacgaggcccaccaagatcgggtgcttatcaggttaagtagactgcataatcagcaggccttaagttcctccattgaggaaggccttaggatgcaggccatgcacagggctcagagggtgaggcggccgatacctggctccgatcaaacaactactatgtcggggggggaaggcgaacctggtgaaggtgaaggggatggggaggatgtttcctcagactccgccccagactctgcgcccggaccagccccgaaacgacctagaggcgggggcgccggcggatcaagtgtcggcactggagggggagggacggggggggttggcgggggggcgggctcggaggactccggcgaccgcgggggaacgcttggagggggtacgctaggccccccttctcccccgggcgccccctcaccacctgagcccgggggtgagatcgagttggtgttcaggccccaccccctcctagtggaaaagggcgagtattgccaaacacgatacgtgaagaccacaggaaacgccactgtggatcacctgagcaagtacttggcactgcgcattgctttagagcggaggcaacagcaggaagcgggagaacccggaggtccaggaggtggcgcttcagacactgggggacccgatgggtgtggcggtgaaggcggtggggctggaggcggcgatggccctgaagaaccggcactcccttcattggagggggtcagtgaaaagcaatacacgatctacattgcaccaggagggggggccttcactacgctgaacggaagccttacccttgagttagtcaatgagaagttttggaaagtgagccgacccctcgagctctgctacgcgcccactaaggatcctaagtag

SEQ ID NO: 133026 - DNA, 1221 bp, Artificial Sequence
  Description of Artificial Sequence: Synthetic coding sequence
atgacaacaccagcaaatgcccaaaacgctagcaagacatgggagcttagcctgtatgagctgcacaggacaccccaagaggccataatggatggaactgaaatcgctgtgagcccaagatcgttacactcagaactcatgtgccccatttgcctagatatgctaaagaacactatgacaacgaaggagtgcttgcacagattttgctctgattgtatcgtaacggcgcttagatccgggaataaggagtgccccacctgtcggaaaaaactcgtgtcaaaacgatcactgcggcctgatcctaattttgacgctctgattagtaagatatatcctagcagggaggagtacgaggcacatcaggatcgggttttgataagactcagtaggttacataaccagcaggctctcagctcctctatcgaagaaggcttgaggatgcaggcaatgcaccgcgcacagcgggtcaggcgccctatccccggcagcgatcagaccactactatgagcggcggcgagggtgagccaggcgagggagagggggatggcgaagatgtcagcagcgattctgcgcccgactccgcccccggacctgcccctaagcggcctcgaggcggaggtgctggaggctctagcgtaggcacaggaggaggcggtactggaggcgttgggggaggagcaggcagcgaagatagtggcgatagggggggcactctgggcggtggtacactcggtcctcctagtcctcctggtgcaccaagtcctcccgaacctggaggggagattgaactcgtttttagaccccatccccttttggtagaaaagggcgagtattgccagaccaggtatgtgaagacaaccggaaatgccacggtcgatcacttgagcaaatatctggcacttcgcatcgcactagagcgtaggcaacagcaggaagccggcgaaccagggggccctggcgggggggcaagtgacacaggaggccccgatgggtgtgggggcgaaggcggcggggcaggtgggggtgacgggcccgaagaacctgccctcccctcattagaaggggtgtctgagaaacaatatacaatctacattgcaccaggaggaggggctttcacaaccctgaatggctccctgaccctcgagcttgtgaacgagaagttttggaaggtttcgagaccacttgaattgtgctacgcccccaccaaagatcctaaatag

SEQ ID NO: 133027 - DNA, 465 bp, Artificial Sequence
  Description of Artificial Sequence: Synthetic coding sequence
atgggaaactgccttaagagtcctacatcagacgacatttctttgctgcacgagtcacagagcgatagggcctcgttcggagagggaacagagccagaccaagagcccccacccccatatcaggaacaagttcccgttccagtgtatcaccccactccctcacaaactaggttggcgacccagctcactgaggaggagcagattaggattgcacagaggatcgggttgattcagcacctaccaaagggagtttacgatccaggcagggatgggtcagagaagaaaatccgcgagtgtgtcatctgcatgatggattttgtttacggcgacccaatcaggttcctcccatgtatgcatatctatcacctggattgtattgacgactggctcatgagaagctttacctgtccgagctgtatggagccggtggatgctgccctgctctcatcgtacgagaccaattag

SEQ ID NO: 133028 - DNA, 1896 bp, Artificial Sequence
  Description of Artificial Sequence: Synthetic coding sequence
atgccccgccctgctctgagcgtcacctccttctgccataggttaggcaagagagaaaggaagcaaagtttcatgggcaattcaggaaattcttggagccacaccccttttcccaaactcgaactggggctcggcccgcagccaatggctcccagggagctgccaacttgttctatatgtctggagaggttgagagaccctatttctctagattgcggtcatgacttctgcatacgatgtttctccacacaccgtcttcctggatgcgaacctccctgttgtccagaatgcaggaagatctgtaaacagaaacggggcctgcggagtctcggagagaagatgaaacttctgccgcagagacccttgccgcctgcactccaagaaacttgcccagttagagcagaacccctcttgctcgtacgaatcaatgcttccggcgggctcatcctgcgcatgggagccatcaaccggtgtttaaagcaccccctcgcaagagatacaccagtctgtttgctggcagtgcttggagaacagcacagtggtaagagcttcctcctcaatcatcttttgcaggggctgccaggcctcgagagcggcgagggtggacggccccggggaggcgaggcttcactccagggatgcaggtggggtgcaaatggcctggctaggggaatttggatgtggtcccacccgttccttctgggcaaagaaggcaagaaggtcgccgtctttctagtggatactggcgacgccatgtcaccagagctgtcgcgagaaactagaattaaactttgcgcacttaccacgatgctgagcagctatcagattctctcgacgagccaggaacttaaagatacagacctggactacttagaaatgtttgttcatgtggcggaagtgatgggcaagcactatggaatggtcccaattcagcacttggatctgctagtgagagactcttctcaccctaataaagcaggtcaaggccatgtgggaaatattttccaacgccttagcggtcggtaccccaaggtacaggaattattgcaaggcaaaagggccagatgttgtctgctcccggctcccggcagaaggcgcatgaatcaaggacatgcaagtccgggcgacaccgatgatgacttcaggcatctgctaggtgcatacgtgtcagatgtgctgtccgccgcccctcaacacgctaagagcagatgtcaaggatattggaacgaaggcagagccgtggccaggggcgatcggcgactgttgacaggccagcagctagcacaagaaattaaaaatttaagcggctggatgggacggaccggcccgggatttacttcaccggatgagatggcagcacaacttcacgacctcagaaaggtggaagccgcaaaacgggaatttgaagagtacgttcgccagcaggacgtcgctaccaagagaattttctccgccctgcgtgttctccccgacaccatgagaaacctgttaagtactcagaaagatgcaatactcgctcggcacggggtcgccttactgtgtaaaggacgcgaccagaccctggaagccttagaagcagagctgcaggccacggctaaagcatttatggattcatataccatgcggttctgcggacacttggctgctgtgggcggggcagtgggcgctggattaatggggttggcaggcggggtggtgggtgccggtatggccgccgccgctctggcagccgaggccggcatggtcgcagcgggggccgcggttggcgccactggtgcagccgtcgtgggtggcggggttggggccgggctggccgctaccgtggggtgtatggaaaaagaagaagatgagaggctcctcgagggcgatcgcgagcctctgctgcaggaagaatag

SEQ ID NO: 133029 - DNA, 687 bp, Artificial Sequence
  Description of Artificial Sequence: Synthetic coding sequence
atggccgcccagcagagggactgcggcggcgcggcccaactggctggccccgccgccgaggccgaccctctcggccgtttcacatgcccagtgtgcctggaggtttacgagaaacccgttcaggtgccctgtgggcacgtattttgcagtgcgtgtctccaggagtgtctaaaacctaagaaacctgtttgtggcgtgtgcagaagtgccctggcccctggcgtgagagccgttgaactagaaaggcagattgaaagtacagagacaagctgtcatggttgcagaaagaacttttttttgtctaagattcggagtcacgtggcgacgtgctctaaatatcagaactatataatggagggagtaaaagcaaccatcaaggacgcgtcattgcagcctcgcaatgtgccaaaccgttatacattcccttgcccctactgccctgagaagaatttcgatcaggaagggttagtggaacattgcaaacttttccactccaccgataccaaaagtgtggtttgtcctatttgcgctagcatgccctggggcgaccccaattaccggtctgcaaatttccgggaacatatccaacggagacacaggttctcctatgacacattcgtcgactacgacgtggacgaggaggatatgatgaatcaagtcttgcagcgctccattatcgatcaatag

SEQ ID NO: 133030 - DNA, 576 bp, Artificial Sequence
  Description of Artificial Sequence: Synthetic coding sequence
atggccgcacagcagcgcgactgcggaggtgccgcacagctcgcgggaccggccgctgaggccgaccctctgggccggttcacctgtcccgtgtgcctggaagtttatgagaaaccagtgcaagtcccgtgtggacatgtcttctgctctgcctgtttgcaggaatgcctgaagcctaaaaagccagtgtgcggtgtgtgtcgctctgcattagccccgggagtccgagccgtggagcttgagcgccagatagaatccacagagaccagctgccacgggtgtaggaagaatttctttctgtcaaagattaggtcccacgtggccacctgtagcaagtaccagaactatataatggaaggggttaaggcaaccatcaaagatgcatccctccagcccagaaacgtccctaaccgctacaccttcccctgcccatattgcccagagaagaacttcgaccaggaaggactcgtggaacattgcaaacttttccattcaactgacacgaagagcgtgacctccgagcagagcccttgccttctctctgtttcctgctatcgggcgtctattacctactag

SEQ ID NO: 133031 - DNA, 1287 bp, Artificial Sequence
  Description of Artificial Sequence: Synthetic coding sequence
atggggcccccacccggcgctggcgtctcttgccgaggtggatgtggatttagccggctcctggcctggtgttttttgctggcgttgtcccctcaagccccaggctcacgtggtgcggaggccgtatggacagcctacctgaatgtgagttggagggtcccgcacacaggcgtcaacagaacggtgtgggagctgtccgaggagggagtgtacgggcaagattcccccctggagcccgtggccggcgttttagtcccaccagatggtcccggcgccctgaacgcatgtaaccctcataccaacttcacagtccccaccgtctggggtagtacagttcaggtaagttggctggccttaattcagagggggggcggctgtacgtttgcggacaaaatccatttggcatatgagcgaggagcctccggcgccgtcatatttaatttccctggcacacggaacgaagtaattcctatgagtcacccgggggcggtggatatcgtggctatcatgattggtaaccttaaggggactaagatcctgcagtctatacaacgtggcattcaggtgacgatggtgattgaggtcgggaagaaacacgggccttgggtgaatcattactcaattttcttcgtcagtgtttccttcttcataattactgccgctaccgttggatattttatcttctactccgcccggcggcttagaaacgctagggcccagtcgagaaagcagcggcagctgaaagcagatgctaagaaggccattggtagactccagttacggaccctgaagcagggcgacaaggagataggtcccgatggtgattcctgtgccgtgtgcatagaactgtacaaacccaacgacctggtaaggatcttgacatgcaaccatatttttcataagacatgtgtagatccttggctcctggagcacaggacctgccccatgtgtaaatgcgacatcctcaaggctcttggcatcgaagtggacgtggaggacggtagcgtttcactccaggtgcctgtgtccaacgagattagtaacagcgcctcttcgcacgaggaagataatcgcagtgaaacagcttcatcgggttacgcgtctgtccaaggcacggacgaacccccactggaagaacacgtgcaatcaacaaacgaatcccttcagctggtgaaccacgaggcaaattccgttgctgtagacgtaattccacatgtcgataatccgacttttgaagaggacgaaacacccaaccaggaaaccgccgtacgggaaatcaaatcgtag

SEQ ID NO: 133032 - DNA, 1209 bp, Artificial Sequence
  Description of Artificial Sequence: Synthetic coding sequence
atgaaccaggagaatcggtcctcctttttctggcttctggtgatctttacttttctgctgaagatcaccgcaagttttagcatgtccgcttacgtgacggtgacctactacaatgagacctctaattacactgctatcgagacttgcgagtgtggcgtttacggactcgcctcgccagtggccaatgcgatgggcgttgtgggtatccctaagaacaataactaccaagcatgcgaccataataccgaattttctaatactaaaaagccgtggatcgcacttatagaacgcggtaattgtacatttagtgaaaagatccagactgctggacgtcggaacgcggacgcggtggttatctataacgcccctgagaccggtaatcagactatccaaatggcaaatttcggtgccgtggacattgtggccatcatgatcggcaacctgaagggcaccaagatcctgcagtcaatccagcgcgggatacaggtaacaatggtgatcgaagtcggaaagaagcatgggccctgggtgaatcattattcaatcttcttcgtgagtgtgtccttcttcatcattacagccgccacagttggttactttatattctattcagcaaggagactccgcaacgctagggcacagagccgcaagcaacgccaactcaaggcagacgccaaaaaggcaattggacggctgcagcttaggacactgaagcagggggacaaggaaattggtcctgacggtgactcttgcgctgtttgtatagagctgtacaagccgaacgacctagtgaggatcttaacatgtaaccatatttttcacaaaacctgtgtggatccttggctgctcgagcacaggacctgtcccatgtgcaaatgcgacattctcaaggctctgggcattgaggtggacgtagaggacggcagcgtgagtcttcaggtgcctgtttcaaatgaaatctccaattctgcttctagtcacgaagaagataataggagcgaaaccgcgtccagtggttatgcttccgttcaggggacagatgaacctcctttggaggaacatgttcagtccactaacgagtcgctgcagctggtgaatcatgaggcaaattcagtagccgtagacgttattccacacgttgacaaccctacatttgaggaagacgaaacaccaaatcaggagactgccgttagggaaataaagagttag

SEQ ID NO: 133033 - DNA, 750 bp, Artificial Sequence
  Description of Artificial Sequence: Synthetic coding sequence
atgagcgcatatgtgacggtcacgtactacaatgaaacgtccaattataccgctatcgaaacctgcgaatgcggcgtctatggcctcgccagccccgtcgccaacgccatgggagttgttggtattcccaagaataacaattaccaagcttgcgatcataacacggaatttagcaatacaaagaagccttggatcgcactgatagaacgaggcaactgcacttttagtgagaaaattcaaacagctggtcggcgtaatgcagacgcagttgtcatatacaacgcccctgaaaccggcaatcagaccatccagatggccaactttggcgcagtggacatcgttgccattatgatcggtaatctaaaaggtacgaagattctgcagtcaattcagcgcggtatccaggtgactatggtcatcgaggtgggcaaaaagcacgggccctgggtcaaccattactcaattttttttgttagtgtgagcttcttcatcattacagcggctaccgtggggtatttcatcttctatagcgcgcgacggttgcggaatgccagagcccagagccgcaaacaacggcagctgaaagcagatgctaaaaaagccatcggcaggcttcaactccgcaccctgaaacagggcgataaggagatcggacccgacggggacagttgtgctgtttgtatcgaactctataaacctaacgatctggtgaggatactcacctgtaaccatatcttccacaagacatag

SEQ ID NO: 133034 - DNA, 633 bp, Artificial Sequence
  Description of Artificial Sequence: Synthetic coding sequence
atggctgggctgggcctgggctcagctgtcccggtatggcttgcagaagatgatctcggttgcataatctgtcaagggctgctggactggccagcaacgttaccctgtggacatagcttctgtagacactgcttggaggcactgtggggtgcgcgcgatgcccggagatgggcctgtcccacttgcagacaaggcgctgcccagcagccccacctgcgtaaaaacaccctgctgcaagacctagctgataagtacaggagggccgctcgggaaattcaagccgggagcgaccccgctcattgtccgtgtccaggctccagtagcttgagcagcgccgcagcccgcccccgaaggcgcccagagctccagcgtgttgctgtagagaagtcaatcaccgaagtcgcccaggagctcactgagttagttgagcatttggttgatatcgtgagaagcctccagaatcagcgacctttatctgaaagcggacctgacaacgaactcagcatcctaggtaaagagaattcatggaagcccaggctgccaccccatgcccactgcttaacccgggccaccttacactcaggggagcttctcggactgctaagtggaccctccatccagccactgacttag

SEQ ID NO: 133035 - DNA, 1299 bp, Artificial Sequence
  Description of Artificial Sequence: Synthetic coding sequence
atggccggcctgggcttgggatcagccgtacctgtctggcttgccgaagacgatcttggatgtattatctgtcaaggactgctggattggccagcgacgctgccatgcggtcattctttttgcagacactgccttgaggctctctggggggcgagagatgcacggcggtgggcctgccctacctgccggcagggcgcagctcaacaaccgcatcttaggaaaaacacactgctacaggacttggcagacaagtacagaagggcagctcgggagattcaggcagggtcagatcctgcgcattgcccatgccccgggtcctcctctctctcgtctgcggccgctcgccctcgaaggcgccccgaactgcaaagagtcgcagttgagaagtccattacggaagtggctcaggagctgacagagctggtggagcacttggtcgatattgttaggtccctgcagaaccaacggcccctttctgagtccggccctgacaatgagctgtccatcttgggtaaagcattctccagtggtgtggatttgagcatggccagtccgaagctcgtgacctccgatactgccgcaggcaaaatacgtgacattctgcacgacttagaagagattcaagaaaagcttcaagagagtgtgacctggaaagaagctcccgaggcacagatgcagggtgaactactggaggctccttcctcgagctcctgcccactgcccgatcagagccaccccgctttgaggagagcaagccgctttgctcagtgggcaattcaccccaccttcaacctcaagtccttgtcatgctctttggaagtgtccaaagattccagaacagtcactgtctcacaccggcctcagccctaccgctggtcatgcgagaggttctcgacctcacaggtgctatgctctcaggctttgagcagcggaaagcattattgggaagtcgacacaagaaattgctcccactgggccgtgggtgttgcctcttgggagatgtccagagatcaggtgcttggccgcaccatggatagctgttgcgttgagtggaaaggtacctctcagctatcagcatggcatatggtcaaggagaccgtactcggctctgatcggcctggggtcgtgggcatttggcttaacctggaggaaggcaagttggcattctacagcgtcgacaaccaggagaaactcctctacgagtgcactataagcgcctcttccccgctgtatcctgcattttggctctatgggctgcaccccgggaattacctgataataaagcaagtgaaggtgtag

SEQ ID NO: 133036 - DNA, 255 bp, Artificial Sequence
  Description of Artificial Sequence: Synthetic coding sequence
tagaaagaagccccagaggcccagatgcagggaagcttgctcccgagactggaatgttctggtacaatcacggcggcaagcatctcccaggcgcaggagaattcttggaagccccggctgccaccccacgcccactgtctgactcgagctaccctgcattcaggggaattactgggtttgctcagcgtgcccccccgcggtgaattaatcgcaaaagctaaacaggtcgagactttggatcctagagccctttag

SEQ ID NO: 133037 - DNA, 291 bp, Artificial Sequence
  Description of Artificial Sequence: Synthetic coding sequence
gctcagcagcctcatttgcggaagaacaccctgctgcaggacctggcagacaaatatcgtcgagcggcccgcgaaatacaggccggaagcgaccctgcccattgcccctgccctggcagctccagcctatcgagcgctgccgctagaccgcgtagaaggccagagctgcagcgggagaacagttggaagccccggctgcctcctcacgctcattgtctcacgagagcaacactgcattctggggagttattgggtctcttatccggcccatctatccagcccctgacctag

SEQ ID NO: 133038 - DNA, 861 bp, Artificial Sequence
  Description of Artificial Sequence: Synthetic coding sequence
atggctgggcttggactgggcagtgccgtgccagtctggcttgcagaggacgatctcggctgtatcatatgtcagggcttactggactggcctgcgacgttaccatgcggccactctttttgtagacactgtctggaggcattgtggggcgcaagggacgctagacggtgggcctgtcccacatgtaggcagggcgcagcacagcagccacacttgagaaagaacacactgctgcaagacttagccgataaatatagaagagccgcaagagagatccaagcaggaagcgacccagcccactgcccttgccccggatcctcaagcctttcaagcgccgcagcccgcccccgccggcgtcccgagctgcaaagggtcgctgtggagaaaagcatcacagaggtcgctcaagaactcaccgaactggttgaacacctagtcgacattgtgagaagtcttcagaaccagcgacccctgtctgagagcgggcctgataacgaattgtccatcctcggcaaggccttctctagtggagtagacctctccatggccagtccaaagctggtgacctcggacacagcggctggaaagattcgcgacatcttgcatgacttggaggaaatacaggaaaagcttcaggaatcagtcacttggaaggaggcccccgaagctcaaatgcagggttctctgttaccccggctggagtgtagtggaaccatcacggctgcaagtattagccaggcacaggagaactcttggaagccaagactgccccctcacgcacactgcctgacaagagccacattgcattcaggagaattgttaggactgctgagcggaccttccatccagccgctcacttag

SEQ ID NO: 133039 - DNA, 756 bp, Artificial Sequence
  Description of Artificial Sequence: Synthetic coding sequence
atggcctcgcctaaactggtgaccagcgacaccgccgcaggaaagataagagacatcttgcacgacttagaggagatccaggagaagctgcaagaaagtgttacttggaaggaggccccagaagcccagatgcaaggagaattgttagaggccccaagctcatccagctgcccccttccggaccagagtcaccctgccttgagacgggcttccaggttcgctcaatgggccattcatccaacttttaatctgaaatccttgagttgctcactggaggtttctaaggactcacgcaccgttactgtaagtcatagaccacagccgtatcggtggtcctgcgagaggttctccacatcccaagtactatgttctcaggccctcagttcgggaaaacactactgggaggtggacacacgcaactgctctcactgggctgttggggttgccagttgggaaatgtccagagaccaggtcctgggtaggactatggactcttgttgcgtggaatggaaaggcactagtcagttgtcagcatggcatatggtgaaagaaacggtgctagggagtgataggcctggcgttgtgggaatttggctcaacctcgaagagggtaagctcgccttctactccgtggacaaccaggagaagctgctgtacgaatgtaccatttcggcatcatccccgctctaccccgcattttggttatacggtttgcaccctggtaattatctgatcatcaagcaggtcaaagtatag

SEQ ID NO: 133040 - DNA, 1995 bp, Artificial Sequence
  Description of Artificial Sequence: Synthetic coding sequence
atggcggctgtgggacccccccagcagcaggttagaatggcccaccaacaggtgtgggctgctctggaagtcgcgctgagggtgccgtgtctatacattattgatgctatattcaacagctacccagacagcagccaaagcagattctgtattgtgctacagatctttctccgcctgtttggagtgttcgccagttccatagttttgattctcagccagaggagcctcttcaagttttacacatatagctccgccttcctcctcgctgccacttcagtcttagttaactattacgccagcctgcacattgatttctacggagcctataatacatcagcctttggcatagagttgctcccgaggaaaggaccttcactttggatggctctcatcgtgttacagcttacctttggcatcggatatgtcaccctcctgcaaatccactctatatactcacaacttatcatcctggacctgttggtccccgtgattggtttaattacagaactccccttacatatacgggagacccttctttttacttcttcccttattctcacactgaacacagtgtttgtgctagctgtcaaactcaaatggttctactattcgacgcggtacgtatatctgttggtgcggcacatgtatcgaatctatgggctccagctgctcatggaggatacatggaagcgcatcaggttccccgatatactgagagttttctggttgacacgggtaacagctcaggctaccgtcctcatgtacattctacgaatggctaatgagaccgattccttcttcatttcttgggacgatttctgggacctcatttgcaatttgatcatttcaggctgcgactcaacactgacagtgcttggcatgagcgctgtcatcagtagcgtggcgcattatctcggcctgggcatcctggcttttattgggtccactgaggaagatgaccgccggctcgggtttgtggcacccgtcctttttttcatcctcgcacttcaaacagggctgtctggcctgagaccagaagagaggctgatccgcctatcaagaaatatgtgcctgctgttgaccgcagtattacatttcattcatgggatgactgatccagtgcttatgagtctttccgctagccacgtatcaagctttcgcaggcacttccctgtgctgttcgtgagcgcctgtctctttatcctgccagtgttactgtcatacgtcctctggcaccactacgccttgaacacctggctgttcgctgtcactgccttctgtgtggagctgtgccttaaagtgatcgtaagtctcacagtgtataccctcttcatgattgacgggtactacaatgtgttatgggaaaagctcgacgactatgtttattatgtccggagcacgggaagtataatcgaattcattttcggggttgttatgtttggcaacggcgcctacaccatgatgtttgagtcagggtctaagattcgcgcattcatgatgtgtcttcatgcctactttaacatatacttgcaagctaagaatgggtggaaaacttttatgaaccggaggacggccgtgaaaaaaataaacagcctcccggagataaaaggctccaggctgcaagagatcaacgacgtgtgcgctatatgttatcatgaattcactacatcagctcgaataacaccgtgcaatcactattttcacgcactctgcttgagaaaatggttgtatatacaagatacctgcccaatgtgtcaccagaaggtgtacatcgaagatgacatcaaagataactcaaatgtatcaaacaataatggctttattcccccaaacgaaaccccagaggaggcagttcgtgaggcggccgctgagagcgatagggaactgaacgaagatgattccactgattgcgatgacgacgtacagcgtgaacggaacggggtgatacagcacaccggcgccgccgccgaggagttcaatgacgacaccgattag

SEQ ID NO: 133041 - DNA, 1425 bp, Artificial Sequence
  Description of Artificial Sequence: Synthetic coding sequence
atgtcatctgaagatagggaagcacaagaggatgaactgctcgcactggcctccatctatgatggggacgagtttagaaaggccgagagcgtgcagggaggcgagacacgcatttacttggatctcccccagaattttaaaatctttgtgtctggtaactccaatgaatgtctccagaactccggtttcgaatacacgatttgctttctccctcccttggtcctgaattttgagttgcctcccgattacccttcaagctccccaccaagcttcacccttagtggaaaatggcttagccctacgcagctgagcgctctgtgtaagcatctagataatctgtgggaggagcatcgcggtagtgtggtcctgtttgcgtggatgcagttcctcaaggaggagacactagcgtatctcaacatcgtatcacccttcgagttaaagattggctctcagaagaaggtacagcgcagaactgcccaggcatccccaaatacagagttagacttcggaggcgcagccggatccgacgttgaccaggaagagatagtcgacgagcgggcagtccaggacgtggaaagcctgtccaatttgatccaagagattctcgacttcgaccaggcccagcagatcaaatgctttaactccaagttgttcctgtgtagcatttgtttctgtgaaaagcttgggagtgaatgcatgtactttttggagtgccgacacgtctactgcaaggcatgcctaaaggactattttgaaatccagatcagagatggacaggtgcaatgtctgaattgccccgagcctaaatgtcccagcgtagcgacaccaggccaagtgaaggaacttgttgaagccgaactgttcgccagatatgacaggcttttgctccagagtagtttggacctgatggcagacgtggtctattgtcctcggccatgctgtcaactccccgtcatgcaggaaccaggatgtaccatgggaatttgttccagttgcaacttcgccttttgtactctgtgccggcttacctatcatggagtgtcaccctgcaaagtaaccgcggagaaattgatggacctacggaacgagtacctgcaggctgacgaagccaacaagcgcctgcttgaccagcgctatggcaagagagttattcagaaagccctggaggagatggagtctaaagaatggctcgagaagaattcaaaaagttgtccatgctgcgggacccctattgagaagctggatggctgtaataagatgacttgtaccggctgtatgcagtatttctgctggatatgcatgggcagtctctctagagcaaacccgtacaagcacttcaacgatccgggcagcccctgtttcaaccggctattctacgctgtagatgttgacgacgacatttgggaagacgaagtggaagactag

SEQ ID NO: 133042 - DNA, 1425 bp, Artificial Sequence
  Description of Artificial Sequence: Synthetic coding sequence
atgtcatctgaggatcgcgaggcacaggaagacgagctcttggccctcgcctcaatttacgatggtgatgagttccggaaggccgaatctgtacagggaggggaaacccgcatttacttggacctgccccagaatttcaaaattttcgtgagcggaaattcaaatgaatgcttacagaactccggatttgagtacacaatctgtttcttacccccgttggtgctgaacttcgaactcccacccgattacccctcctcaagtcccccaagcttcactctgagtgggaaatggttgtctcccactcagctatccgcgctatgtaaacatctggataatctgtgggaggagcaccggggatcagtcgtcctttttgcttggatgcaattcctgaaagaagaaacactggcatatctgaacatcgtctcaccttttgaactgaagattggtagccagaagaaggtccagagacggactgcccaggcctctccgaacactgagctcgacttcggcggggccgcaggtagcgatgtggatcaggaagagattgtggacgaaagggccgtccaggacgtagaatcattgtcaaacctgatccaggaaattttagattttgaccaggcccagcaaataaaatgcttcaatagtaaacttttcctgtgcagtatctgtttttgcgaaaaactcggttccgagtgtatgtacttccttgagtgtcggcacgtgtattgcaaagcttgcttaaaagactatttcgaaatccagattagagacgggcaggtacaatgcctgaactgccccgaacctaaatgtccatcagtggccacacctggccaggtaaaggaattggtagaagccgagctttttgcccgttacgacagactcctgcttcagtcctccctcgatctgatggctgacgtggtctactgtcctaggccctgttgccagctccctgtgatgcaggaacccggatgtacaatgggaatatgcagtagctgtaactttgctttctgcactttatgtcgcctgacatatcacggtgtgtcaccctgtaaagtgacggccgagaaattgatggacctgagaaacgagtacctacaggcagacgaggctaataagcgtctgctcgatcaacggtatgggaagcgcgtgattcagaaagcgctggaagaaatggaatctaaagaatggctggaaaagaactctaagtcttgcccatgctgtgggacacccattgagaaactggacggctgcaacaaaatgacatgtacagggtgcatgcagtacttctgctggatctgcatgggctcactgagtagagccaacccctacaaacacttcaacgaccctggttcaccatgctttaacaggctgttttacgccgtagatgtggatgatgatatatgggaggatgaagtggaagactag

SEQ ID NO: 133043 - DNA, 1047 bp, Artificial Sequence
  Description of Artificial Sequence: Synthetic coding sequence
atgcaattcctcaaggaggaaactctcgcctacctgaacatcgtgagtcctttcgagttgaagatcggaagccagaaaaaagtccagcgtcgaaccgcacaggccagtcctaataccgaactggacttcggaggggcagccgggtctgatgtggaccaggaagaaatagtcgacgaacgagcagtacaggatgtggaatccttgtcaaacctgatccaggaaattctggatttcgatcaggcccaacaaatcaagtgttttaactcaaaactctttctctgcagcatttgtttctgcgaaaaactcggaagtgagtgcatgtactttcttgaatgccggcatgtctactgcaaggcttgtcttaaggactattttgagattcaaatccgcgacggacaggtacagtgcctgaactgccccgagcccaagtgtccaagcgttgccacccctggccaggtcaaagaactcgtggaggcagagcttttcgcccgctacgataggttgctgcttcaatcaagcctggaccttatggctgacgtggtgtactgcccgcgcccttgttgccagttgcccgtgatgcaagaaccagggtgcacaatgggcatctgtagttcatgtaactttgccttttgtactctctgtaggctgacgtaccacggtgtgtccccctgcaaagtgactgcagagaagttaatggacctccgcaatgagtaccttcaagccgatgaggctaataagcgtctgttagatcagcgatacggaaagagagtaatccagaaggccttggaagagatggaatctaaagaatggctggagaagaattcaaagtcctgcccatgctgtgggacacccattgagaaactcgacggctgcaataaaatgacatgtactggatgcatgcaatacttctgctggatctgcatggggtctctatcccgggccaatccctacaaacatttcaacgatccaggttccccttgctttaatagactcttctatgcggtcgatgtggacgacgacatttgggaggacgaagtggaggattag

SEQ ID NO: 133044 - DNA, 897 bp, Artificial Sequence
  Description of Artificial Sequence: Synthetic coding sequence
atgagctcagaggatagagaggctcaggaggacgagctcctcgcattggcctctatatatgacggtgatgaattccggaaagccgaatccgtacagggaggcgagacaagaatctacctggacctacctcagaacttcaagattttcgttagcggaaatagtaacgaatgtttacagaattcggggtttgaatacactatttgcttcttgcctccgctggtgctgaacttcgaactaccaccagactatcccagtagctcacctccatccttcaccttgtcgggcaaatggttgtcgccgacacaggttaaagagctggttgaggccgaactttttgctcgctacgataggctgttgctgcagagctctttggacctaatggccgatgtcgtatattgtccgaggccatgttgccaactgcctgtgatgcaggagcccggatgcactatgggaatctgtagctcctgcaactttgccttctgcaccttatgtcgcctcacctaccatggcgtctcaccatgcaaagtgaccgcggaaaagcttatggaccttcggaacgaatatctgcaggccgacgaagccaataaacgactgttagatcagcggtatggcaagcgcgtaatccaaaaagctttggaagagatggagtctaaagagtggcttgagaaaaattcaaagtcttgcccgtgttgcggcacgccgattgagaagctcgacggctgcaacaagatgacctgcactggctgcatgcagtacttctgctggatctgtatgggcagcctttctcgtgcaaacccctataagcatttcaatgaccctggttccccttgcttcaacaggctgttttatgctgtggacgtggacgatgacatatgggaagatgaggtagaggattag

SEQ ID NO: 133045 - DNA, 1425 bp, Artificial Sequence
  Description of Artificial Sequence: Synthetic coding sequence
atgtcatctgaggaccgagaggcacaagaggatgaactgcttgcgttggcatctatctacgacggagacgagttcaggaaggcagaatccgtccaaggcggtgagacacgcatttacttggacctgccacagaatttcaagatcttcgtcagtggcaattctaacgaatgtctgcaaaacagtgggttcgaatacacaatttgttttctaccacctttggtcttaaactttgagttgccaccagactatccttcaagctctccaccctcctttaccctgagcggcaaatggctttctcctactcagttgtcagcactgtgcaagcatctggataatctgtgggaggagcatcgtggctccgtcgtgcttttcgcctggatgcagttcttaaaggaagagacactcgcatacctgaatatagtgtctccgtttgagctgaaaatcggctctcagaaaaaggtacagcggaggacggctcaagcctcccccaataccgagctggatttcgggggagcagctggaagcgacgtggaccaagaggagatcgtcgacgaacgagcagttcaggatgtcgaaagtctgagtaaccttattcaggagatcctggattttgatcaggcccaacagatcaaatgtttcaactctaaactctttctttgttcgatatgcttctgcgaaaaattggggagcgagtgtatgtatttcctcgagtgccgccatgtgtattgcaaggcttgcctcaaagattactttgaaatccaaatccgagacggccaggttcagtgtttgaattgccctgaaccgaagtgcccaagcgtggccacaccaggtcaggtgaaagaactggtagaagccgagctgttcgccagatacgacaggttgttattgcaatcgagcctcgatctcatggcagacgtagtatattgcccacgtccatgttgccagctcccagtaatgcaagaacctgggtgcacaatggggatttgttcttcttgcaacttcgccttttgtacactgtgcagactcacttaccacggagtgtctccttgtaaggtgactgcagaaaagctgatggatttaagaaatgagtaccttcaggctgacgaagccaacaaacgcctgctggaccagcgctacggaaaacgcgtcatccagaaggccttggaggagatggaatccaaggagtggctcgagaagaattccaaatcctgtccgtgttgcggaacccccattgaaaagctcgatggatgcaataagatgacctgtaccgggtgcatgcaatacttttgttggatctgcatggggtctttgtctagggccaacccttacaagcatttcaacgatcctgggtcaccgtgttttaatcgactcttctatgccgtggatgtcgacgatgatatctgggaggacgaggtggaggactag

SEQ ID NO: 133046 - DNA, 1425 bp, Artificial Sequence
  Description of Artificial Sequence: Synthetic coding sequence
atgtcttcagaagatcgcgaggcccaggaggatgagctgctggcactcgctagcatatatgatggggacgagtttagaaaggcggagtctgtccagggcggggaaacacggatttatctggatctcccccagaattttaagatcttcgtgtccggcaatagtaacgaatgtctgcagaacagcggcttcgaatatacgatatgcttcctgccccccctggtgctgaatttcgaattgcccccagattaccccagtagttcgccgccgagctttacgctttcggggaagtggctgtcccctacgcagctgtcagcactctgtaagcacctcgataatctttgggaggagcaccgcggttccgttgtgctgttcgcttggatgcagttcctcaaggaggagactttggcatatctgaacatcgtctccccgtttgagctgaagataggctcacaaaagaaggtgcagcggcgcacggcccaggccagtccgaatacagaactcgacttcgggggggccgccggaagcgatgtagatcaggaagagatcgtggacgaaagagcggtccaagatgtggaatccctatctaatctgattcaggaaatcttggatttcgaccaggcccaacaaatcaaatgcttcaacagcaagcttttcctatgctcgatatgtttttgcgaaaaactcgggtcagaatgcatgtactttttggagtgcaggcatgtgtattgcaaagcttgtctgaaggactattttgagatacagattagggatggacaggtccagtgcttgaattgcccagaaccaaagtgcccatccgttgctactcctggtcaggtaaaagagctggtggaggcggagttgtttgcccgctatgacaggctgctgcttcagtcttcgctcgaccttatggcggacgtggtgtactgtcctcgcccctgctgtcagctgccagtgatgcaggaacctgggtgcaccatgggaatctgttcctcctgtaattttgcattctgcaccctctgccgccttacttatcacggggtttcgccatgtaaggtcacagcagagaaactgatggatctcagaaacgaatacctgcaggccgacgaagctaacaaaagactgctggatcagcgttatggcaaacgggtcattcagaaagcattggaggaaatggaaagcaaagaatggctggaaaagaatagcaagtcttgtccctgttgcgggacccctattgagaagctggatgggtgcaacaagatgacctgtacaggctgcatgcaatacttttgttggatttgtatggggtctctctctcgtgcaaatccgtataaacattttaacgatcctgggtccccatgttttaaccggcttttctacgccgtcgatgtggacgatgatatctgggaagatgaagtcgaagactag

SEQ ID NO: 133047 - DNA, 48 bp, Artificial Sequence
  Description of Artificial Sequence: Synthetic coding sequence
atgagtagcgaggaccgtgaggcacaggaggacgaactgctggcctag

SEQ ID NO: 133048 - DNA, 399 bp, Artificial Sequence
  Description of Artificial Sequence: Synthetic coding sequence
atgagtagcgaggaccgggaggctcaagaagatgaacttctcgccctcgcatccatttacgatggcgacgagttccgaaaagccgaaagtgtgcaggggggcgagactaggatttacttagatctgccccaaaatttcaaaatcttcgtgagtggtaattcaaatgagtgcctccagaacagcggatttgaatataccatctgctttctgcctccgctggtgctgaattttgaattgcctccggactatccgtcatcaagtcctccaagctttacgctgagcgggaaatggctttctcccactcaactgagcgccctctgcaagcatttggacaatctttgggaggaacatcgcgggagcgtcgtactcttcgcctggatgcagttcctcaaggagtag

SEQ ID NO: 133049 - DNA, 516 bp, Artificial Sequence
  Description of Artificial Sequence: Synthetic coding sequence
atgtcttcagaggaccgggaagctcaggaagacgagttactggctcttgcttccatttatgacggggacgaatttagaaaagctgaatcggtgcaagggggggaaactaggatatatctggatcttccgcagaatttcaagatctttgtgagtgggaactctaatgagtgcttgcagaatagtgggtttgaatacactatctgttttttgccccccctggtgctgaatttcgaactccctccagattaccctagtagctcaccaccctccttcaccctgtccggcaagtggctttccccaactcagctttccgccctgtgcaagcatctggataacttgtgggaggaacaccggggttctgttgttctctttgcatggatgcaatttctgaaggaggaaactctcgcatatctcaatatcgtgagtccctttgaactgaaaatcggatcccaaaagaaagtgcagcggagaactgcccaagccagtcctaacacagagctggattttgggggttag

SEQ ID NO: 133050 - DNA, 558 bp, Artificial Sequence
  Description of Artificial Sequence: Synthetic coding sequence
atgagtagcgaggaccgcgaggctcaggaggatgagctcctggccctggcatccatatacgatggcgacgagttccgaaaggctgaaagcgtacagggtggagaaaccagaatctacttagatctacctcagaacttcaagatctttgtgagtggaaacagtaatgagtgtttgcagaacagtggctttgagtataccatatgcttcctgccacccctagtgctgaacttcgagctgccgcctgattaccctagcagcagtcccccctcttttacattgtctgggaaatggctgtctcccactcagctctcagccctgtgtaagcatctggataatctctgggaagaacaccgcggaagcgtggtcctgttcgcatggatgcagtttttgaaagaggaaaccttggcttacctcaacattgtttctcccttcgagctcaaaatcggcagtcaaaagaaagtccagagacgcaccgcacaggctagtcctaacactgaactggactttggtggcgccgcaggctcggatgtcgatcaagaagagatagtggatgagtag

SEQ ID NO: 133051 - DNA, 186 bp, Artificial Sequence
  Description of Artificial Sequence: Synthetic coding sequence
atgtcaagcgaagacagagaagcacaggaagatgagttgctggccctggcatctatttacgacggggacgaatttcggaaagccgagagcgtccagggcggagagacacgcatctatctggaccttccacagaattttaagattttcgtctccggtaactcgaatgagtgcttacagaatagttag

SEQ ID NO: 133052 - DNA, 837 bp, Artificial Sequence
  Description of Artificial Sequence: Synthetic coding sequence
atgagctctgaggatagggaggctcaggaagacgagctgctggctttggccagtatctacgacggggacgaattccggaaagctgaatcagtgcagggaggcgagacccgcatttatctggatttgcctcagaactttaagatttttgtgtcagggaatagtaacgagtgcttgcaaaacagcggcttcgaatacaccatctgcttcttaccaccactggtactgaacttcgagctgccacccgactacccatcgtcttctccaccttctttcaccttgtcagggaagtggctgagccccacgcagctatccgccctgtgcaagcatctggacaatctgtgggaggaacacagaggaagcgtggtgctctttgcatggatgcagttcctcaaagaggagactcttgcctacctcaacatagtgagcccatttgagctgaaaatcggatcccagaagaaagtgcaacggcgtactgcccaggccagccctaataccgaactggactttggcggagctgcaggaagcgacgtcgatcaagaggagattgtggacgagcgtgccgtgcaggacgtagagtctctgagcaacctgatccaagagatactcgactttgatcaggcccagcagatcaagtgtttcaactcgaaactgtttctttgctccatttgtttctgtgagaagctgggctctgaatgcatgtatttccttgagtgtagacacgtttattgtaaggcctgtttaaaagattactttgagatccagatcagggacggtcaggtgcaatgtttaaactgcccggaaccaaagtgcccaagcgttgccacaccgggccagtag

SEQ ID NO: 133053 - DNA, 300 bp, Artificial Sequence
  Description of Artificial Sequence: Synthetic coding sequence
atgagctcagaagacagggaggcccaggaggatgagttattagcattagccagcatctatgacggggacgagttcaggaaggcagagtcagttcagggtggggagacaaggatatatctggatctaccccaaaacttcaaaatttttgtatccgggaactccaacgagtgccttcaaaactcaggattcgaatatacgatttgctttctgccccccctcgtcctgaattttgagcttcccccagactacccaagtagctctcctccctcatttacattgtccgggaaatggctgagctag

SEQ ID NO: 133054 - DNA, 516 bp, Artificial Sequence
  Description of Artificial Sequence: Synthetic coding sequence
atgtccagcgaggaccgtgaggcccaggaggatgaactgctggccctggcatcgatttacgacggggacgagtttagaaaagctgagtcagtgcaaggtggggaaacaaggatctacctcgatcttcctcaaaattttaagatctttgtgagcgagaagttgatggacctcagaaacgagtatctgcaggctgacgaggctaataagaggcttctcgaccagcgatacggcaagcgtgtgattcagaaggcattggaagagatggaatctaaggagtggctagagaagaattctaagtcctgcccttgttgcggcactccaatcgagaaacttgatggttgtaataagatgacatgtactggctgcatgcaatatttttgctggatatgtatgggatcactcagccgagctaacccatacaagcacttcaatgatccagggagcccgtgcttcaaccgcctgttttatgctgtcgacgtagacgacgatatttgggaggacgaggtggaggattag

SEQ ID NO: 133055 - DNA, 1077 bp, Artificial Sequence
  Description of Artificial Sequence: Synthetic coding sequence
atggccgggtgcggggagatcgaccactcgattaatatgttgccaactaacaggaaggccaatgaatcctgctccaatactgcaccaagtctgacagttcctgagtgtgcgatctgtctgcagacatgcgtgcacccagttagtttaccctgcaagcacgtcttctgttacctgtgcgttaagggggcgagctggctgggcaaaaggtgtgccctttgccggcaggagattcccgaagatttcttagataagcccactctgctcagcccggaggaactgaaggcagcatccagggggaatggcgaatatgcctggtattatgaagggaggaacggctggtggcagtacgacgaacgcacaagccgggaattggaagacgcttttagtaagggcaagaaaaacaccgagatgctgatcgcagggtttctctatgtagctgacctggagaatatggtgcagtaccgccgaaatgagcatgggcgaaggagaaagattaagagggatatcatagacattcccaaaaaaggagtagccggcctgcgactggattgcgacgcgaacacagtgaacttggcccgcgaaagcagcgcggatggtgcagattcagtcagcgcccaatccggggccagcgtacagcctcttgtaagcagcgtgagacccttgactagcgtagacggacagctgacatctccggccactccatcacccgacgcgtccacctcgcttgaagattcattcgctcacctgcagttatccggcgacaatacggccgagaggtcccaccgtggggaaggcgaagaggatcatgaatcgccaagctcgggaagggttccagccccggatactagtatcgaagaaacagagtcggatgcgagctctgactctgaagacgtttctgcagtggtggcccagcactctcttacccagcaacggctgctggtgtcaaatgccaatcagactgtgcctgatcgaagcgaccggtcaggcacagacaggagtgtagcgggcgggggcactgtgtctgtgtctgttagatcgcgacgccccgacggacagtgtacagttacagaagtttag

SEQ ID NO: 133056 - DNA, 1077 bp, Artificial Sequence
  Description of Artificial Sequence: Synthetic coding sequence
atggctgggtgcggggagattgatcactccatcaacatgctaccaactaatcgcaaggcaaatgagagttgttccaatacggctccttccctgaccgtgcctgagtgcgccatctgtctacaaacctgtgtgcacccagtgtccctgccttgtaaacatgtgttctgctatctgtgcgtcaaaggggcttcatggttgggtaagcgctgcgccctttgcaggcaggagattcccgaagactttctggataagcctactctgctatctcctgaagaactcaaagcagccagtaggggcaacggggaatacgcgtggtattatgagggaaggaacgggtggtggcaatatgatgaaaggactagccgggaactggaggatgccttcagcaaaggcaagaagaataccgagatgctcatagcaggattcctgtacgtggcagatctagagaacatggtgcagtatcgcaggaatgagcacggacgccgaaggaaaataaagcgcgatataatagacattccgaaaaaaggagtggcaggtctccggcttgactgtgacgccaacactgtcaatttagcccgagagtccagtgccgacggcgccgacagtgtcagtgcgcagagtggggctagcgttcagccacttgtttcatccgtgcggccgttgactagcgtggatggccagctcacttcacccgccacgccctctccggatgcctctaccagcctcgaagattctttcgcccacctgcagctcagtggggacaacaccgcagaacggtcacatcggggagagggcgaagaagatcacgagagcccctcaagcggtcgcgtacctgcccccgatacaagcatagaagaaaccgaatcggatgcttcatccgacagtgaagatgtttccgcagtagtggcacaacactcccttacgcagcagcggctcctggtgtctaacgcaaaccagacagtgcccgaccggtcagatcggagtgggaccgacagatcggtggctggcggcgggaccgtgtccgtgtcggtacgatcccgacgtcccgatggacagtgtaccgtgactgaggtgtag

SEQ ID NO: 133057 - DNA, 1080 bp, Artificial Sequence
  Description of Artificial Sequence: Synthetic coding sequence
atgatggccggttgtggcgagattgatcattcaatcaacatgctgcctacaaataggaaagctaacgaatcctgttccaatacggctccttcgctgactgtgcccgagtgcgccatctgcctgcagacttgcgttcaccctgtcagtctaccgtgcaagcatgtcttctgctacctctgcgttaagggggcttcgtggctcggtaagcggtgtgccctgtgtaggcaggagattcccgaggacttcctggataaaccgacattgctgtcgcccgaggagttgaaggctgcatccaggggcaacggggagtatgcctggtactatgaagggcggaatggctggtggcagtatgacgagcgcacaagcagagaactcgaggacgccttcagtaaaggcaaaaaaaacaccgagatgctcatagctggtttcctgtacgttgccgatctggagaacatggtgcagtatagacggaacgaacatggccggcgcagaaaaatcaaaagggatattatcgacattcctaagaaaggcgtcgcaggtctgcggctcgactgcgacgctaacaccgttaacttagcccgtgagtcctccgccgatggagccgactccgtatctgcgcagagcggagccagcgtccagccactcgtttcctctgtgaggccactgacatcagtcgacgggcaactgacaagtcccgccaccccgtccccagatgcttccacgagcctggaggattcctttgcccatctccaattaagcggcgacaatactgccgaaagatctcacagaggggagggagaggaagatcatgaatcccctagttctgggcgcgttcccgcccccgatacctcaattgaggagaccgagtctgatgcctccagcgattccgaagatgtatctgctgtggtggctcagcattctcttacccagcagagattgcttgtttcaaacgcgaatcagactgtacctgatagatcagacaggagtggcaccgaccgaagcgtggctggaggcggcaccgtaagtgttagcgtgcgttcaaggaggccagacggacagtgtactgtcacagaagtctag

SEQ ID NO: 133058 - DNA, 1716 bp, Artificial Sequence
  Description of Artificial Sequence: Synthetic coding sequence
atggccctgcccaaggacgccattccctcactttctgagtgccagtgtgggatctgtatggaaatcctggtggagcctgtgaccttaccctgtaatcatacactctgcaaaccatgctttcaaagcactgtcgaaaaggcaagcctgtgctgcccgttctgccgtagaagagtaagctcctggacacggtaccacacaaggcggaactcgttagtgaacgtagagctctggactattatacagaagcattacccacgggaatgtaagctaagagcgtctggacaggagagcgaagaggttgccgatgactaccagcccgtccgcctgctgagcaagccgggcgagctgcggcgggaatacgaggaggaaatttctaaagtggcagcagaaaggcgggcctccgaggaagaagagaacaaagcctccgaggagtatatccaaagattactggccgaggaggaggaggaagaaaaacgtcaggctgagaagagacgccgggccatggaggaacaactcaaaagtgacgaggaactcgcccgaaaactgagcattgacattaacaacttttgtgagggatctatctctgcctctccactcaacagtcggaagagtgaccccgtgacaccaaaatccgagaagaagagtaagaataaacagagaaacaccggggatatccaaaagtacctgacccccaaatcacagtttggttccgctagccattcagaggctgtgcaggaggtgcggaaggatagcgtgtctaaagatatagacagcagcgacaggaaaagccctacgggacaggacacagaaatcgaagatatgcccactttgagtccccagatcagcctcggcgtcggggagcagggcgcagattcctccattgagtctccaatgccctggctctgcgcgtgcggagcggaatggtaccacgaaggaaacgtcaagacccgaccatctaaccatggtaaagaattgtgtgtattgagccatgaacgcccgaaaacccgggttccatacagcaaagagactgccgtaatgccctgcggaaggaccgagagcgggtgtgcccccacttcaggagtgacccagaccaatggcaataataccggcgagacagagaatgaggagtcttgtctgctcatttctaaagaaatctccaagcgaaagaatcaggagagctcttttgaagctgtcaaggatccatgcttttctgcaaagcgacggaaggtgtcacctgaatcttcccccgaccaggaggaaacagaaatcaacttcactcagaagttgatcgatctggaacacctgctttttgagaggcacaagcaggaagaacaggaccggctgctcgccctgcagctacagaaagaagttgataaggagcaaatggtccccaacagacagaagggatcccccgatgagtaccacctccgggccacatctagtcctccagacaaggtcctgaatggacagaggaagaacccaaaggacgggaatttcaaacggcagacccatacaaagcatcccactccggaaaggggatcccgagataagaatcgtcaagtgtctctgaagatgcagctgaagcaatcagtgaatcgccgcaagatgcctaattcgactcgggatcattgtaaggtgtccaagtccgcccactccctccaaccttccatatcccagaaatccgtttttcagatgtttcaacgctgcaccaagtag

SEQ ID NO: 133059 - DNA, 1716 bp, Artificial Sequence
  Description of Artificial Sequence: Synthetic coding sequence
atggccctcccaaaggacgccattccatcactgtctgagtgtcagtgcgggatttgcatggagattctggttgaacccgtgacactcccatgcaaccatacactgtgtaagccttgcttccagagtaccgtggaaaaggcgagtctttgttgtccgttctgtcgcaggagggtttctagctggacacgctatcacactagaaggaattctcttgtcaacgtggagctgtggacaatcattcagaagcactatcctagagaatgcaagctccgagcgagtgggcaggagagcgaggaagttgctgacgactaccaacctgtaaggctcctgagtaagccaggagagctgcggcgggagtatgaggaggagatctcgaaagtggctgcagagagacgagcatccgaagaggaagagaataaagcatctgaagagtatatacaacgcctgttagctgaggaagaggaagaagaaaaaaggcaggccgaaaaaaggcgcagagccatggaagaacagttaaagagcgacgaagaacttgcacggaaactcagcattgacataaataatttttgcgaggggtctatctccgcatcccccctgaactcccggaaaagtgacccggtgacccctaaatcagaaaaaaaaagtaaaaacaagcaaagaaacacaggagatattcagaagtatctgacgcctaagagccaatttgggtccgcttcacactccgaggctgtgcaggaggtcaggaaggattctgtgtcgaaagatatagattccagtgataggaagagccctacaggccaggatacggaaattgaggacatgcccaccctgtctcctcaaatcagtctgggcgtgggagaacagggggccgactcttctatagaatctcccatgccctggttgtgtgcctgcggcgcagagtggtaccacgaagggaacgtgaagaccagaccctccaatcacggcaaagagctctgcgtgctttctcacgagagacctaaaactcgagttccctacagtaaagaaactgcagttatgccctgcggtcgcaccgagtcaggctgcgcaccaacttcaggggtgacccagaccaatggaaacaacaccggagagactgagaacgaagagtcatgtttattaatctcaaaagagatctctaagcggaagaatcaggaatccagcttcgaagccgtgaaggacccgtgttttagcgctaagaggaggaaggtttctcctgagagcagtcccgatcaggaagaaaccgagatcaacttcacccagaagcttattgacctggagcatcttctgttcgagagacacaaacaggaggaacaggaccgtctgttagctcttcagctccaaaaggaggtggacaaggaacaaatggtgcccaataggcaaaagggatctcccgacgaataccacttgcgagctactagttcccctcctgataaagtgcttaacggacagcggaaaaatcctaaagatggcaattttaaaagacagacccacacaaagcatccaactccagagcggggatcgagggacaagaaccgtcaggtcagcctgaagatgcaacttaaacagtcagtcaacaggcggaaaatgccaaacagtaccagggaccactgcaaggtgagcaagagtgcccattcactgcagccttcaatctcacagaagagcgtatttcagatgtttcaacggtgtaccaaatag

SEQ ID NO: 133060 - DNA, 4872 bp, Artificial Sequence
  Description of Artificial Sequence: Synthetic coding sequence
atggccgccgaagcgtcaaaaactgggcctagcagaagctcctatcagaggatggggcggaagagtcagccatggggggccgctgagatccagtgcacgcgctgtggcaggcgcgtgagcagatctagtgggcatcattgtgagcttcaatgcgggcatgctttttgcgaattgtgcctgctgatgacggaagagtgtacaaccatcatctgtcccgactgcgaagtggccacagccgtcaacacacgccagcgatactaccctatggctggatacatcaaagaggatagcatcatggagaaattacagccaaagacgatcaagaactgttcccaggattttaaaaagacagccgatcaacttaccacgggccttgagcgatctgcctccactgacaagacactactgaactcaagcgcagtgatgctggacaccaatactgcagaagaaatagacgaagccctgaacaccgcacatcacagctttgagcagctgtccatcgctggcaaggccctagagcatatgcaaaagcagacgattgaagaacgcgagcgagtgatcgaggtggtggaaaagcagtttgaccaactccttgcatttttcgattcaaggaagaaaaacctttgcgaagagttcgctagaaccaccgatgactatctaagcaatctgataaaagcaaaatcctacattgaggagaagaaaaacaacctcaacgccgcaatgaacattgcccgggcattacaactgtcaccaagccttcggacatattgtgacctcaatcagatcattaggacgctgcaattaaccagtgactctgagttagcccaggtgagttccccccagctgcgtaaccccccccggctgagtgtgaattgttctgaaattatttgtatgtttaataatatgggcaaaatcgagttccgggatagcacaaaatgctacccgcaggagaatgagatccggcagaacgttcagaagaaatacaataataagaaggagctctcgtgttacgatacctatccgcctctcgagaaaaagaaagtggatatgtctgtgcttacctcggaagctcctcctccacccctgcaaccggagactaatgatgtacatcttgaagccaaaaattttcagccccagaaggacgttgcaaccgcttcccctaaaacaattgccgtcctgccacaaatgggatcatctccagacgtgattatcgaagaaatcatcgaagacaacgttgagtctagcgccgaactggtctttgtgtctcacgtgatagatccatgccatttctatattagaaaatacagccagattaaggatgcaaaggtgttggagaaaaaggttaacgagttctgtaataggtcttcacatctggatccatccgacattttagagctgggagcgcggatttttgtgtcatccataaaaaatggcatgtggtgccggggcacaattactgaacttatcccaattgaaggacggaatacccgcaaaccctgctctccaacccgactattcgtgcacgaggtagccttgattcagatatttatggtcgacttcggcaattccgaagtactgatcgtgaccggtgtggttgatacacatgtcaggccagaacattccgccaaacagcacatagctttaaacgacctgtgtttagtgctacgaaagagtgaaccctatacagaaggactccttaaagacattcagcccctggcacaaccttgctctcttaaggacatcgtcccgcagaattccaatgagggttgggaggaagaggctaaagtggaatttctcaagatggtaaacaataaggcagtctctatgaaggtcttccgggaggaggacggagtcctgattgttgatctgcagaaaccccccccaaacaaaatttcatctgacatgcctgtttcgttacgggacgccttagtgttcatggagttagccaaatttaaatctcaatcactgagaagccattttgagaagaacaccacacttcactatcacccacctatcctgcctaaagaaatgacggatgtgtcagtcacagtatgtcacattaattcaccgggggatttttatctgcagctcatagaaggactggatatcctcttcctgctgaaaaccatcgaagagttctataaatccgaggatggcgaaaatttagaaatcctttgtcccgtgcaggatcaggcctgcgtagctaagttcgaggacggtatatggtacagagctaaggtcattggactccccggccaccaggaggtggaggtgaaatatgtggattttggcaacaccgccaagataactattaaggatgtacggaaaatcaaagacgagttcctaaatgctcccgagaaagcaataaagtgcaaactggcctacatcgagccttacaaacgtacaatgcagtggagtaaggaggccaaggagaaatttgaagaaaaagcccaagataagttcatgacgtgttccgtgatcaagatcctggaggataacgttctccttgtggagctgtttgacagtcttggggcgcccgagatgactaccacaagcatcaacgaccaactcgtgaaagaaggattagcgtcttacgagatcggctatattctcaaagacaacagccagaagcatatcgaagtgtgggacccttcccctgaagaaatcatatcaaatgaggtgcacaacttgaacccagtgtccgctaagtcactccctaacgaaaattttcagagcctttacaacaaggaactgccagtgcacatctgcaacgtgataagtcccgagaagatttatgtgcagtggcttctgacagaaaacctcctcaattccctggaggagaaaatgatcgccgcctacgaaaattccaagtgggaacccgttaagtgggaaaacgacatgcactgcgccgtcaagattcaggacaaaaaccagtggcgtcgagggcaaataatcaggatggttacagatactctggtggaggtgctgctgtacgacgtgggtgtggagctggtagtgaatgttgactgccttcgcaagttggaagagaaccttaagaccatgggacggttatcattagagtgctcactcgtggacatccggcctgccggtggttctgataagtggacggcaactgcctgcgattgcctctcactgtacctcacaggggcagtggcaacaataatattacaggttgactcagaagagaacaacacaacttggcccctgccagtgaagatattttgccgtgacgagaaaggggagagagtagacgtaagtaaatacctgatcaaaaaagggctagctctgcgagagcgccggatcaataacctcgacaattcccatagtctctctgagaagagcttagaagtgcctctggaacaggaagactccgtagtaacaaattgcataaagactaacttcgatcccgataagaagactgccgatatcatctctgagcaaaaggtcagcgagttccaggagaaaatcttggagccccggacaacccgcggctataagccaccagctattccaaacatgaatgtgtttgaagccactgtaagctgcgtgggggacgatggtactatctttgttgtcccaaagctgtcagaatttgagttgatcaagatgactaacgaaatccagtcaaacctgaaatgtctaggattgctggagccctacttctggaagaaaggtgaggcctgtgctgtgcggggatctgacacactgtggtaccgagggaaggtgatggaggtggtcggaggcgcagtacgcgtgcagtatctggatcatggctttacagagaaaatcccccaatgccacctgtaccccattttgttgtaccccgacatccctcaattttgcattccatgccaactacacaacacaaccccagtggggaacgtgtggcagcccgatgccatcgaggtgttgcaacaactgctgtccaagagacaggtggacattcacatcatggaattgccaaagaatccatgggaaaagttaagtatacacttgtattttgatggaatgagtttatcatactttatggcctattataagtattgtacaagtgagcataccgaagagatgctgaaagagaaacctcggtcagaccacgacaaaaagtacgaggaagaacagtgggagatccgctttgaggaattgttaagtgcagagacagacacgcctctgctccctccatacctcagtagctctttgccttcccctggagagctctacgcagtgcaagtaaagcatgtcgtttcccccaatgaagtctacatctgtttagattcgatcgaaacatccaaccagagcaatcaacattccgacaccgatgacagtggggtctcaggtgagtctgagagcgagagcttagacgaagctctccaaagggtaaacaagaaagtggaggcccttcccccccttactgacttccggacagagatgccttgtttagccgaatatgatgacggtctgtggtatagagcaaagattgtagccattaaggaattcaacccactttccattttagtgcagttcgtggactatggctctaccgcaaagctcactctgaataggctatgccagattccgtcacacttaatgcggtacccagccagagcgattaaggttctgctggccgggtttaaacctccattgcgcgatctcggagaaacacggataccatactgtcctaagtggagcatggaggccctgtgggccatgattgattgtctgcagggaaagcagctttatgcagtctcgatggctcccgctccagaacagatagtgacgctgtacgatgacgagcaacacccagtgcacatgccgttagtggagatgggcctggccgacaaagacgagtag

SEQ ID NO: 133061 - DNA, 1350 bp, Artificial Sequence
  Description of Artificial Sequence: Synthetic coding sequence
atggcggctgaagcttcgaagacagggccctcccgcagttcatatcaaagaatgggacgcaaatctcaaccatggggggcagccgagattcagtgtactcgatgtgggcgaagggtctctagatccagcggacatcattgtgagctgcaatgtggacacgccttctgcgaactttgccttttaatgaccgaggaatgtaccacaattatctgccctgactgcgaggtggccacggccgttaataccaggcagcgctactatcccatggcaggctatatcaaggaggatagcatcatggaaaagctgcagcccaaaacaattaaaaactgctctcaggactttaaaaaaaccgctgaccagctgactaccgggctagagcgctcagcctccacagacaaaaccctccttaattccagcgctgtgatgctcgacactaacacggcagaggagattgatgaggccctgaatactgcacaccatagctttgaacagttatccatcgctggaaaggctcttgaacacatgcaaaagcagaccattgaggagagagagagagtgatagaagtggtggagaaacagtttgatcagctgctcgcattcttcgactcccggaaaaagaacttatgcgaggagtttgccaggactactgacgactaccttagcaacttgattaaggctaaatcttacatagaggagaagaaaaataacttgaacgccgccatgaacatcgctagggccctgcaacttagtccttccctgcggacctattgcgatcttaaccaaatcatcagaacactacaactcactagcgattccgagctcgcacaggtgagctcaccgcagctgcggaacccgccacgattgtctgtcaactgttctgaaataatctgtatgttcaataatatgggtaaaattgagtttagagacagtaccaagtgctacccacaggaaaatgagatcaggcaaaacgtgcagaaaaagtacaataataagaaagaactgagttgctatgacacctatcctccacttgagaaaaaaaaagtggacatgtcagtgttgacaagcgaggcacctcctccaccgctgcaaccagagacaaatgacgtccacctcgaggccaaaaatttccaaccccagaaggacgttgcaacagcgtccccgaaaactatagctgtgttgccccagatgggctcaagcccggatgtaattattgaagaaattatagaagataatgtcgaaacatgcggcaccgacgatctgggtgagactcctagatacccaaaaaagcctttgcagaagaattcatccgtgccattcggttcaaaggccgataccgtgacaactgtgtag

SEQ ID NO: 133062 - DNA, 4746 bp, Artificial Sequence
  Description of Artificial Sequence: Synthetic coding sequence
atggccgccgaagcctctaagaccggcccctcaaggtcatcataccaaaggatgggacgaaagtctcagccgtggggcgccgctgagatccaatgcacccgatgcgggcgccgggtttctcgatcttcaggacaccactgtgaacttcaatgcggacacgcattctgtgaactgtgcctacttatgaccgaggagtgcactactatcatctgccctgactgcgaggtggcaacagcagtcaataccagacagcgttactaccctatggctggctatataaaagaggattctattatggaaaagctgcagccgaagacgatcaaaaattgcagtcaggacttcaagaaaactgccgaccagctgaccaccggcctggagagatcagctagcaccgataagaccctccttaactcatccgcagtgatgctagacacaaataccgccgaggagatcgacgaggctctgaacacagcccatcactcttttgagcagctgtctatagcaggtaaggcgctggagcacatgcaaaaacaaaccattgaggaacgggaacgcgtgatcgaggtagttgagaaacaatttgaccaactgctggccttctttgactcacgaaaaaagaacctctgcgaagagtttgcccggactaccgatgattatctctcaaacctgatcaaggctaagtcttacattgaggaaaaaaaaaataatcttaacgctgcgatgaatatagcaagagccttgcagctgtcaccttcgctgagaacctactgcgacttaaatcagattatccgcaccctgcagcttacatcggacagcgagttagcgcaggtgtcttcgcctcagctgagaaaccccccgcgcctgtctgtcaattgctccgagataatatgcatgtttaataatatgggaaaaatcgaattccgggacagcactaaatgttacccacaggagaatgaaataagacagaatgttcagaaaaaatataataacaagaaagaattgagctgctatgatacgtatccaccccttgaaaaaaagaaggtcgatatgagcgtacttacctcggaggctcctccaccgcctcttcaacctgaaactaatgacgtccatctggaggctaaaaacttccagccccaaaaggatgtagcaacagcttccccgaaaacaattgccgttttacctcagatgggatcctctcccgacgttattattgaggaaattatcgaggataacgtggagagtagcgctgagcttgtattcgtcagccatgtcatcgatccgtgtcacttttatatccgaaagtactcacaaattaaagacgctaaagtgttggaaaagaaagtcaacgagttctgcaatcgcagttcacaccttgaccctagcgacattctggaactcggcgccaggatattcgtgagttctattaaaaacggaatgtggtgccgcggcacaataactgagttgattcccatagaagggcggaacacccggaagccttgtagcccaaccaggctgttcgtgcatgaggtggccctcatacaaattttcatggtggattttgggaactctgaggtgcttatagtcacaggggtggttgatacccacgtgcgccccgaacattctgccaagcaacacattgccttgaacgacctttgtctggtgctgcgaaagtcagaaccttacacagaaggactactcaaagatattcagccattagcgcaaccctgtagcctgaaagacatagtgccccaaaattccaatgagggatgggaggaagaagcaaaggttgagttccttaagatggtcaataacaaggctgtgagcatgaaagtgttcagagaggaggatggtgtactcatagtggacctgcagaaaccgcctcccaataagatttctagtgatatgcccgtttcactacgggatgctttagtgttcatggagcttgcaaaattcaagtctcaatcacttcggagccattttgagaagaacaccacactgcactaccatccaccaatcttgcctaaagagatgactgatgtcagcgtcactgtttgccacatcaactcacccggggatttttacctgcagctaattgagggactcgacatcctttttcttctcaaaacgattgaagaattctacaaatccgaagacggtgagaacttggaaattctgtgtcccgtgcaagaccaggcatgcgttgctaagttcgaagacggcatatggtatcgtgccaaggtgataggacttcccgggcatcaagaagtagaggtgaagtatgtagactttgggaatactgctaagatcactatcaaggatgtgagaaagataaaagatgagttcttgaacgcccccgaaaaggccatcaagtgtaagctggcttacattgaaccttacaagaggacgatgcagtggagtaaagaggcaaaagaaaagttcgaagaaaaggcacaggacaaattcatgacctgtagcgtcattaagattctggaggacaacgtgctgctggtggaactgttcgactctctgggtgcccccgagatgaccaccacatcaataaatgaccagcttgtgaaagaggggctcgcttcctatgaaattggctacatattgaaggataactcccagaaacacatagaggtgtgggacccttctccagaagagatcatcagtaatgaggtgcacaacctaaatcctgtttccgccaaaagtcttcctaatgagaacttccagtccctgtataacaaggaactcccggtccacatctgcaacgtgatcagtcccgagaagatctatgtgcagtggctcctgacagagaatctcttgaattcactggaggagaagatgatagctgcttacgagaatagcaaatgggagcccgtgaagtgggaaaatgatatgcactgcgccgttaagatccaggataaaaatcagtggcgtagaggacagatcatcaggatggtcactgacacactggtggaagttttgctatacgacgtcggcgtcgaactggtggtaaacgtggactgtctgcgcaagcttgaggagaaccttaaaactatgggtcgcttgtccctggagtgtagcctggtggatatcaggccagcagggggctccgacaagtggacagctacagcatgtgactgcctcagcctgtacctgaccggagctgtagccacaatcatcttgcaggtcgattccgaagagaacaacacaacatggccccttccagtgaagattttctgccgagacgagaagggcgagagagtcgatgtctccaagtacctcataaaaaaaggtttggctcttagagaaagacgaatcaacaatttagacaatagccatagtctctctgaaaaaagcctcgaggttcctctggaacaggaggactccgtcgttacaaattgtatcaaaaccaattttgacccagacaagaaaactgctgacattatttctgagcagaaggtttcagaattccaggagaagattctcgagccacgaacaacccgtgggtataaaccaccagcaatacctaacatgaacgtatttgaggccaccgtgtcttgtgtgggcgatgatggtaccatctttgtcgttcctaaacttagtgaattcgagcttatcaaaatgacaaatgaaattcagtcaaacctgaagtgcctgggcttgctcgagccctatttttggaaaaaaggcgaagcatgcgccgtcagagggtctgacacattatggtacagaggtaaggtcatggaggtggtgggtggcgctgtgcgtgtccagtatcttgatcatgggttcaccgagaagattccccagtgtcatctgtatcctattctcttatatccagacatacctcagttctgcatcccctgccaactccacaatacaacccccgtgggcaacgtgtggcagcccgatgcaatagaagtcctccagcagctcctctctaagcgtcaggtggacatccacatcatgaaaccaaggagcgaccatgataagaaatacgaggaggaacagtgggaaataaggttcgaagagttactgtcagccgagacggatactccattgctccctccctacctgtcaagctctcttccttcacccggggaactctatgccgttcaggtgaaacatgtggtgagtcctaatgaagtatacatctgcctcgacagcattgaaacttctaatcaatcgaaccagcacagtgataccgacgactctggcgtgagcggggaatctgagtcagaatcactcgacgaagcactccagcgggttaataagaaggtggaggccttgcccccgctgactgacttcaggacagagatgccctgtctcgcagagtacgatgatggcctttggtaccgcgccaaaatcgttgctattaaggagttcaaccctctatctattctcgtacaattcgtggattatggttctaccgccaagctcaccctcaaccgcctctgccagattccctctcacctgatgcgctatccggctagggcaattaaagtgttgctggccggcttcaaaccccccctccgagatctgggcgagaccaggatcccctactgtccaaagtggtccatggaggcgctgtgggccatgatcgattgcctgcaaggaaagcagctctacgcagtctccatggcaccggcgcccgagcagattgtgacactgtacgatgatgagcagcatccagttcacatgccgctggtcgagatgggacttgccgacaaggacgaatag

SEQ ID NO: 133063 - DNA, 3207 bp, Artificial Sequence
  Description of Artificial Sequence: Synthetic coding sequence
atgttggatacgaacactgctgaagaaattgatgaagccctcaatacagcacaccacagcttcgaacagctgtcaattgcaggtaaagcccttgagcacatgcagaaacagactattgaagagcgggagcgggtaatcgaggttgtcgaaaaacaattcgaccaactgttggccttttttgactcaagaaaaaaaaacctttgtgaagaatttgcccgcactacagatgattacctctctaaccttattaaggctaagtcctatattgaagagaagaagaataatctcaacgctgcaatgaatatagctcgggcattgcagctgagtccatcgctgcggacgtattgcgacctgaatcaaatcattcgcactctgcaactgacaagtgacagcgaacttgctcaggtcagctcacctcagctgaggaacccaccgcgcctgagcgtgaattgtagcgagattatttgcatgttcaacaacatgggcaaaattgagttcagagactccactaaatgctatccccaagagaacgagattcgccagaatgttcagaagaagtacaacaataagaaagagctgtcctgctatgacacttaccctccactggagaagaagaaagtggatatgagcgttctgaccagtgaggcccctccccctcccttgcagcctgagaccaacgatgtccacctagaggcaaaaaattttcaacctcagaaggacgttgctacagcctccccgaagaccatcgctgtcctgccccagatgggttccagccccgacgtgatcatcgaggagattattgaagataacgtggagtcttccgcagagctggtatttgtcagccatgtgatcgatccatgtcacttttacatcagaaagtattcccagattaaggacgccaaggtgttagagaaaaaggtcaacgagttctgtaaccggtcaagccacctggatcccagcgatattttggaactgggcgccagaatcttcgtcagctccatcaagaatggtatgtggtgtagaggcactattactgaactgattccaatcgagggaaggaacactcggaagccatgctctccaactcggttattcgtgcacgaggtggcactgatccagatcttcatggtcgacttcggaaactctgaggtcttaatcgtcacgggagtcgtggatacgcatgtccgaccagagcactccgctaagcagcacattgcccttaacgacttgtgcctggtcctccgtaaatccgagccatataccgaaggcctgctcaaggatatacagccgctagcacagccatgttcactgaaggacatagtcccccaaaattctaatgaagggtgggaggaggaggccaaggttgaattcctcaaaatggtgaacaataaggccgttagtatgaaagtgtttcgggaggaagacggagtgctcattgtcgacctccagaagccaccacccaacaagatttcgtccgatatgccagtcagtctcagagatgccctggtgttcatggaactggctaagttcaaatcacagtcccttaggtcacatttcgagaaaaacaccaccctgcactatcatccgccaatcctccccaaggaaatgacagacgtgtcggtcacagtatgccacattaatagccccggcgatttttacctgcagctgatagaaggactggacatcctgttcctcttaaaaacaattgaggaattctacaaatctgaggacggcgagaacctcgagattctctgccccgtgcaggatcaggcatgtgtcgccaaatttgaagacggcatctggtatcgagccaaagttatcggactgccaggacaccaggaagttgaggttaagtacgtggacttcgggaacaccgcaaagataactattaaagatgtgcgaaagataaaggatgagttcttgaatgcccccgagaaggccataaagtgcaagctggcgtatattgagccttataagagaaccatgcagtggtcgaaggaagctaaagaaaagttcgaggagaaagcgcaggataagtttatgacatgctccgtgatcaaaatcctggaggacaatgtgttgctggtggagttattcgactcactgggggcgccggagatgacaaccacatcaattaacgaccaacttgtgaaggagggcctagcctcctatgaaattggctacatcctcaaggacaactcccaaaagcacatcgaagtttgggatccgtctcctgaggaaatcatatctaacgaggtgcacaacctgaatccggtctcagccaaatctttaccaaacgagaacttccagtcactctataacaaggagctccccgtgcatatctgtaacgtcatcagcccagagaaaatctacgttcaatggctgctgactgagaatctgttgaattcgctggaagagaagatgattgctgcttatgaaaacagtaagtgggaaccagtcaaatgggagaatgacatgcactgtgccgtcaaaatacaggacaaaaaccagtggcgaaggggtcagattatccgaatggtgacggacaccctggttgaagtcctgttatacgacgtcggcgtggagctcgtcgtcaatgtcgattgcctgcggaaattagaagaaaacctaaaaactatgggccgactgtcgctggaatgttccctggtggacatcagaccagccggcgggtccgacaaatggacagccaccgcgtgtgactgtctttctttgtacctgaccggcgccgtggcaacgataatattgcaggtcgactcggaggaaaacaacactacctggcccctgcctgtgaagatattctgtagggatgagaaaggggaaagggttgatgtttccaagtacctcattaagaaaggtctcgcgttaagagagcggcgaatcaacaacctggacaacagccactccctttccgaaaagagcctagaggtccccttagagcaggaggattccgttgtgaccaactgcatcaaaacgaatttcgaccccgacaaaaagacggctgatattatctccgaacagaaggtgtcagaatttcaggagaaaatcctcgagcccagaaccaccagagggtacaagcctcctgccatacccaacatgaatgtttttgaagccaccgtgtcatgcgtgggcgacgatggaaccatcttcgtggtgcctaaactgagcgaatttgaactcataaaatag

SEQ ID NO: 133064 - DNA, 462 bp, Artificial Sequence
  Description of Artificial Sequence: Synthetic coding sequence
atggcatcgtactttgatgagcacgattgtgagccaagtgatccagagcaggagaccaggacaaacatgttgttagaattggctcgttctctgttcaataggatggactttgaggatctcggactggttgtggattgggaccaccatctgccccctccagctgccaagacggtggtggaaaatctacctagaaccgtgataaggggaagccaagccgagttgaaatgtcccgtgtgcctgctggaattcgaagaggaagaaactgccattgagatgccctgtcaccacctttttcattcaagttgcatactcccatggctatccaagaccaattcttgccccttatgtcgctatgagcttccaaccgatgacgatacttacgaggaacacagaagagataaagcaagaaagcaacagcaacagcacaggctcgaaaatctccatggtgcgatgtacacctag

SEQ ID NO: 133065 - DNA, 684 bp, Artificial Sequence
  Description of Artificial Sequence: Synthetic coding sequence
atggcctgcacaaaaacattacagcagagccagccaatatctgctggcgccactaccactaccactgctgtggccccagctggcggccactctggctccacggaatgcgacctcgagtgccttgtatgcagagaaccctactcgtgtcctagactcccaaagctcttggcctgtcaacacgccttctgtgcaatatgcctgaagcttcttctctgtgtgcaggacaacacttggtctataacatgtccactgtgtcgcaaggtgaccgccgtgccaggcggcttgatttgttcgctgagggatcatgaagccgtagtgggccagttagcacaaccctgcaccgaagtcagcctgtgcccccaggggctggtggatccagccgatttggctgcgggtcacccaagtctggtgggtgaggacgggcaggatgaggtgagcgcaaatcatgtggcagcccgcagactggctgctcatttgcttctcttggctctgttaattatactcataggacctttcatttacccaggagtcctgcggtgggtactaacattcatcattgccctggcccttctcatgagcaccttgttctgctgcctgccctcaacaagagggtcatgttggccatcttctaggacccttttctgtcgagaacaaaaacattcccacatcagcagcatagcttag

SEQ ID NO: 133066 - DNA, 795 bp, Artificial Sequence
  Description of Artificial Sequence: Synthetic coding sequence
atgtcacaggcagtacagaccaacggaactcagcccctgtctaaaacttgggagctaagtctatatgagcttcagcgtacaccacaggaggccatcaccgacggactggagatagtggtgtcacccagaagcctccatagcgagctgatgtgtcccatttgcttagacatgctcaagaatacaatgactacgaaggagtgtttgcacaggttctgcgccgactgcatcatcaccgctcttcggagtggccttcaaaggggaaagaagcaacagatcgaaaacggttctggcgcggaggacaatggcgattcttctcattgctcaaatgcctcaactcattctaaccaggaggccgggccatctaataagaggactaaaacatccgacgacagcgggcttgagctggataataataatgccgccatggcaattgatccagtgatggacggcgccagcgaaatcgagctcgtgttcagaccccatcccacacttatggagaaggatgactccgctcaaacaagatacattaaaacatcgggtaatgcgaccgtggatcacttgtccaagtacttggcagtgcggctcgcgttggaagagctgaggagtaagggtgagagtaaccagatgaacctcgataccgcctcagagaagcagtataccatttacatcgccacggcgagcggacaatttacagtcctgaacggaagcttctctcttgaactggtaagcgaaaagtattggaaggtgaataagcctatggaactgtactacgcccctactaaggagcataagtag

SEQ ID NO: 133067 - DNA, 1011 bp, Artificial Sequence
  Description of Artificial Sequence: Synthetic coding sequence
atgagtcaggctgtccagacaaacggtactcagccgctcagtaagacttgggagcttagcctgtacgagcttcagagaacaccacaagaggcgattaccgatggtctggagatcgtcgtaagtccgagaagtctgcatagcgagctgatgtgcccaatttgcttagacatgctgaagaacaccatgaccaccaaggagtgtctccacagattttgcgcggactgcatcattacagccttgagaagcggaaacaaagagtgtcccacgtgtaggaagaagttggtgagtaagcggagtctgagaccggatccaaacttcgacgcgctcatttctaagatttatccctcacgggacgagtatgaagcacaccaggagagagtactcgccaggataaataaacataacaaccagcaggccctgtcccacagcatcgaagagggtctaaagattcaagccatgaatagattacaacgcggaaagaaacagcagatcgagaacgggtcaggagcggaagataacggtgatagctcgcattgctctaacgcgagcacgcactcaaaccaggaggcaggccctagcaacaaaagaaccaagacttcagacgatagtgggctcgagctcgacaacaataacgccgcaatggctatcgaccctgtgatggatggagcctccgaaattgagctcgttttcaggccccaccccacgctgatggagaaggatgactccgctcaaacccggtatatcaaaacgtcaggcaatgcgaccgtggatcatctctccaagtatcttgctgtacggctggccttggaggaattgcgcagcaagggggagagcaatcagatgaaccttgacaccgcctcagagaaacaatatactatctacatcgctacggcctcgggccagttcactgtgctcaatgggtctttttcgcttgaattggtttcagagaagtattggaaggtgaataagcctatggagttatactatgcgcctactaaggaacacaaatag

SEQ ID NO: 133068 - DNA, 741 bp, Artificial Sequence
  Description of Artificial Sequence: Synthetic coding sequence
atgagccaggccgtccagacaaacgggactcaacccctcagcaaaacttgggaactctccttatacgagctccagcgaaccccacaggaagccattactgacgggctcgagatcgtagtgtcccctaggtctctgcactcggagttaatgtgccccatctgcctggatatgctgaagaataccatgactactaaggagtgcctccaccggttttgcgccgactgtattatcacagctttacgcagcggaaacaaggagtgtccaacctgccggaagaagctggtgtccaagcgctcactgcgaccagacccaaacttcgatgctctcatttccaaaatatatccatctcgagacgaatacgaggctcaccaagaacgagtcctggccagaataaacaaacacaacaaccagcaagcactctcacacagcattgaagaaggattgaagatccaggccatgaaccggcttcaacggggaaagaaacaacaaatcgagaatgggtctggggccgaagacaatggcgattcaagccactgctcaaatgctagcacccatagtaatcaggaagcagggcctagcaataaacggaccaaaacctctgacgactctgggctggagcttgataataataatgccgccatggctatcgaccctgttatggatggcgccagcgagattgagctagtttttagacctcatccaaccctgatggagaaagacgattctgctcaaacacgatag

SEQ ID NO: 133069 - DNA, 822 bp, Artificial Sequence
  Description of Artificial Sequence: Synthetic coding sequence
atggccaactgggtattctgtaatcgctgcttccagcccccgcataggactagttgcttctccctcaccaattgtggtcatgtgtattgcgacgcctgcctcgggaaagggaagaagaatgaatgtctcatatgcaaggccccttgtagaaccgtcctactgtcgaaacacactgatgcagatatacaggcattctttatgagtattgatagtttgtgtaagaaatacagccgagagacaagccagtacctgagactctcacgggggtgctgtcgcctcaaactgtgcccagcaaccagtagcaaggaagtgccgaggggttcaacccatgggtctcaggctgccgctagagaccctcaggagcactgggtgtctacaacccgtgccccgcgtccgggctgcagaagatcgcagtctcagcctgaagctcagggcaacacaattcaagacgcaccacacccacttactctgctgcacccatcccgcacacttattcatacgaaatccccttgggggcagaagctcttggagttcattaaacacgtctgttatcatcgccaccagagccacagaccctgcgcccctgggtggttttgccaggtgttgcagaggccgggcgccgtgagcggcgagaagacacagcagacaaggccggcaccccctgcaacatgcctgctttgcctatcttgtctgtccggctttcggcacggaccctggcgaagccaggcactcccatccgatttggttgcccctctgtttgttagctacacagtggaggtgagcataacaaacgccgggtggagttttcccgcggccgtctag

SEQ ID NO: 133070 - DNA, 699 bp, Artificial Sequence
  Description of Artificial Sequence: Synthetic coding sequence
atggccaactgggtgttctgtaacagatgttttcagccaccgcaccggacgtcctgctttagtttaaccaactgtggacacgtctactgcgacgcctgtctgggaaagggcaaaaaaaacgagtgtctcatctgcaaggctccttgccgtacagtactgctctcgaaacacaccgatgccgacatccaggccttcttcatgtcaattgactccttatgtaaaaaatactcccgcgagacgtctcagatcctggaattccaggaaaagcatcggaagagactgcttgcattctaccgtgagaaaatttctagacttgaggagagcttgagaaaatccgtattacagatagagcaactgcagagtatgaggagtagccagcagacagccttcagtacaatcaaatcttcagtgtcaacaaagccacacgggtgtctgctgcctccacacagttccgcccccgacaggctcgaaagtatggaagtagacttgtctccttcaccaattagaaagagcgagatcgcggcgggtcccgccaggataagcatgatatcaccaccccaggatggcaggatggctccctgtgctaggcgagtgtgccattttcaaaggtttactatgtttcttcatcgccggctgagttcactggcagcccctccttccgtccaattttggaaggcgagagggactcatcagctctag

SEQ ID NO: 133071 - DNA, 894 bp, Artificial Sequence
  Description of Artificial Sequence: Synthetic coding sequence
atggcgaattgggtgttttgtaacagatgtttccagccaccacacagaacgagctgtttctctctgaccaattgtggccatgtgtattgtgacgcctgtctagggaagggcaagaagaacgaatgcctcatctgcaaggccccatgccggaccgtgctcttgtctaagcataccgacgccgatatccaagcattctttatgtctattgatagcctgtgtaagaaatattctcgggagacttcccagattctggagttccaggagaagcaccggaagaggcttctagcattctacagggagaagatctctaggcttgaggagagcttacgtaaatccgtcctacagatcgagcagctgcagagcatgaggagctctcagcagaccgcctttagcaccattaagagctctgtttccacaaagcctcacggctgtctcctgcctcctcactccagtgctccagaccgactggagtcgatggaggtggacctgtcgccctcacctatccgtaaaagtgagatagctgccggccctgcacggatctccatgatctcacccccacaagacgggcgcatgggaccacacctcacagcttctttctgttttattccatggctgacattgtcgaagccgcccgtcccaggtgagtgtgtgatcagtcgggggagtccatgcttctgcatcgacgtttgccctcattggctgctgctgctggccttctcgagcggccgccacggtgaactgacaaactcaaaaactctgccgatttacgccgaggttcagcgagcggtgctgttcccgtttcagcaggccgaagggacgttggatacctttaggacgcccgcagtaagcgtggtgttcccactatgccaatttgaacgaaaaaagagcttctag

SEQ ID NO: 133072 - DNA, 3192 bp, Artificial Sequence
  Description of Artificial Sequence: Synthetic coding sequence
atggagtgcccttcctgtcagcacgtttctaaggaagaaactccaaagttttgcagccagtgcggtgagaggcttccacccgctgcgcctatcgccgattcagagaataataactccaccatggcatccgcttcagaaggtgagatggaatgcggccaagaattaaaggaggagggcgggccctgcctgttccccggcagtgatagttggcaggagaacccggaagagccctgctcgaaggcatcttggaccgttcaggagagcaagaagaaaaaacgcaagaagaaaaaaaaaggaaataaatccgcttcaagcgagctcgcctcactgcccctgagcccagcgtctccttgtcacctgacgctactcagcaatccttggccacaggacaccgccctgccacattcccaggctcagcagagcggccctaccggccagccatctcagcccccggggaccgcgactacaccactggaaggtgacgggctgtccgcccctacagaggtcggcgattcgccattgcaggcccaagctctgggggaagccggggtagccacgggctccgaggctcaatcctcgccacagtttcaggaccatactgaaggggaggaccaggatgcatccattccaagcgggggcagaggcctttcccaggagggaaccgggccgcctacctccgctggtgaggggcatagcagaactgaggatgccgcccaggaactgctcctaccagagagcaaaggagggtcatcagaacctggcacggaacttcagaccaccgaacagcaggcaggcgctagcgcctcaatggctgttgacgcagttgctgaaccagcgaatgctgtcaagggcgctggcaaggaaatgaaagagaagacgcagagaatgaaacagcctcccgcaactaccccaccgtttaaaactcactgtcaggaagcggagactaagaccaaggatgagatggcagccgccgaagaaaaagttgggaaaaatgaacagggggaaccagaggacctgaagaagccagagggcaagaacaggtccgcggctgcagtgaagaatgagaaagagcagaagaaccaggaggctgatgtgcaagaggttaaggcctcgaccctttcaccaggggggggcgtgacagtattcttccatgctattatctctctgcatttcccttttaaccccgacctgcacaaggtctttattcgaggtggggaagagtttggtgaatccaagtgggatagcaacatttgtgaattgcactacacacgtgaccttggccatgatcgcgtgctggtcgaaggcatcgtgtgcatcagcaagaagcacttagataaatacatcccatacaaatacgttatatataatggcgaaagctttgaatatgaattcatttataaacatcagcagaaaaagggggagtacgtgaaccgttgtctgttcataaaatcctcacttttggggtccggggactggcatcagtattatgatatagtgtatatgaaaccccacggacgtcttcagaaggtgatgaatcacataacagacgggccccgaaaagacctggtgaaaggaaaacaaatcgccgccgctttgatgctagatagcacattcagcattttgcagacatgggacaccatcaatctgaatagcttttttacgcagttcgagcaattttgcttcgtactccagcagccaatgatttacgaaggtcaggcacaactgtggaccgatctccaatatcgcgaaaaagaggtaaagcgctacctatggcagcatctgaaaaagcacgtcgtccctctgcccgacggtaagtcaaccgattttctccctgtggactgtcctgtaagatccaaacttaaaactggactcatcgtcctctttgtcgtggaaaagatcgagctcctgctggagggcagtctggattggctgtgtcacctgttaactagtgatgcttctagtcctgacgagtttcaccgagacctgtcgcacattcttgggattcctcagagctggaggctctacttagtgaacctgtgtcagcgctgtatggatacgagaacttatacctggctgggcgctttgcccgtattgcactgctgtatggagctggcgccacggcacaaagatgcttggagacagcctgaagacacgtgggccgccctggagggactgtccttttcaccatttagagaacagatgcttgacactagttccctgcttcagttcatgcgggaaaaacagcacttactgagcattgacgagcctctgttccggtcctggttctccttactccccttaagtcatctcgttatgtacatggagaactttatcgagcaccttggtcggtttcccgcccacattctggattgcctgtccgggatctattatcggctgcccggtctcgaacaagtccttaacacccaggacgtccaggacgtgcaaaatgtgcagaatattttagaaatgttgctgcggctattggacacctaccgcgacaagatccccgaggaggcattgtcgcctagctatctgaccgtatgtctgaaactccacgaggcaatttgcagcagcaccaagctcttgaagttttacgaactgcctgccctttccgccgaaattgtgtgtaggatgatccggctgctcagtctggtggacagcgcagggcagcgggacgagaccggcaacaatagtgtgcaaaccgttttccaagggacgctcgccgctaccaagagatggctacgagaagtcttcaccaaaaacatgctgacctcatccggagcctcattcacttacgtgaaggagattgaggtgtggaggaggttagtcgagattcagtttccagcagaacacggttggaaagagagtctcctgggagatatggaatggcgcctgaccaaggaagagccattgtcacagattacggcatactgcaactcctgctgggacacaaagggacttgaggactcagtggccaaaacatttgaaaaatgcattatcgaggcagtgtctagcgcgtgccaggttaataatctctctagctgggagaccgactcagggagtcagctctgctccgccatgacacagctgcgggcaatgaagcacccgttggggctatcttcgtccgccaactcggaaatcggaaaatgggccccttcttctttggccaaaggcaatggcgccgaaatctag

SEQ ID NO: 133073 - DNA, 9843 bp, Artificial Sequence
  Description of Artificial Sequence: Synthetic coding sequence
atggtgtgtgacggcgattgggaacactgttatctgcctagcgctttttcacagcacaaagttttcgtgactccacaggcacccctggaggccatacaggcttatctagctggtcattaccgagtacccaaacagaccctgagtgctgctgcagtgtttaatgataggctgtgtgtgggaatcgtggcgtccgaaagagcaggcgtggggaagtctctttatgttaagcgcctgcacgacaaaatgaagatgcagctcaatgtgaagaatgtacccctcaagaccatcaggttaatagatccgcaagttgatgaaagcagagtgttgggcgcactgctgccttttctcgacgctcagtaccagaaggtcccagttctcttccacctggacgtgacgtcatcagtccagacgggaatctgggtatttctgtttaagctgctaattttacagtatttaatggatattaatggtaaaatgtggctgcgaaacccatgccacctctacatcgtcgaaatcctcgagcgtcggacctcggttccatcacggtcgtcttctgcccttcggaccagagtgccacagttcagctttctcgacattttccctaaggttacctgcaggccgccaaaggaagtaatagatatggagctgtccgcgctacggagcgacacagaacccgggatggatctgtgggagttttgcagtgaaaccttccagcgtccttaccagtatctccgaagatttaaccaaaatcaggacctggataccttccagtaccaagaaggatcggtcgaaggcacacccgaggagtgtctccagcactttctcttccactgtggcgtgatcaacccttcttggtccgagcttaggaatttcgcacggtttctgaactatcagctccgcgattgtgaagcgagcctgttctgtaacccctcattcatcggggacaccctgaggggttttaaaaaattcgtcgtaacattcatgatttttatggcaagagattttgccaccccgtcattgcacaccagtgatcagagtcccggcaagcatatggtcactatggacggggttagggaggaagatttagcccctttctctctgaggaaaagatgggagagtgaaccacacccgtatgtgttctttaacgacgaccataccacaatgacattcatcggcttccatctccagcctaacatcaatggctcagtagacgccatctcacacctcacagggaaggtgatcaagagggacgtaatgacaagagacttgtaccagggcctgcttctgcaacgcgtcccctttaatgtcgatttcgataaattacctaggcataagaagctggagcgcttgtgccttaccctggggattcctcaggctactgacccagacaaaacctatgaactgactaccgataacatgctcaaaatcctagccattgagatgcgctttcgttgtggtataccagtgattataatgggcgagacaggatgtggcaaaacaagacttattaaatttctctctgacctgagacgtggtggcaccaatgctgacacgattaagctggtcaaggttcatggtggtacgacagctgacatgatctactcacgggtgcgcgaagccgagaacgtggctttcgccaacaaagaccaacaccagctcgacactatccttttttttgacgaggccaacaccaccgaagctatctcttgtatcaaggaggtcctttgcgatcacatggtcgatggccagcccttagccgaggacagcggcctccatatcatagcagcttgcaacccgtacaggaaacattccgaagagatgatttgccgactagaaagtgctgggttaggataccgcgtgtcaatggaggaaaccgcagaccggcttgggagtataccgctgcgccagctcgtctatagggttcacgctctgccaccctccctgatccctctagtatgggattttggccagttgtcggatgtggccgaaaaactgtatatccagcagattgttcaacgcctggtagagtcaattagcctggatgagaatggaacacgcgtcataactgaggtgctttgcgcctcccaaggcttcatgagaaagacagaggatgagtgttcattcgtgtccctcagagacgtcgaaagatgcgtaaaggtgtttaggtggttccacgagcactccgctatgctactcgctcagctgaatgcctttctgagcaagagtagtgtgagcaagaatcatactgagcgggaccctgttctgtggtcactgatgctggctatcggggtctgctaccacgcttcactggagaaaaaagatagttacagaaaagcgattgcccgattttttccgaagccttatgacgacagtagactgctcctcgacgaaattacaagggctcaggatctgttccttgatggagtgcccttgcgcaaaaccatcgccaagaatctcgccttaaaggagaatgtgtttatgatggtggtgtgtattgagttgaagatccccctgttccttgtaggaaaacccggttccagtaaatccctggcaaaaactatcgtggccgacgctatgcagggtccggccgcctactccgatctcttccgctctttaaaacaagtgcaccttgtaagtttccagtgttcgccccatagtacgcctcaagggattataagcacatttaggcagtgcgcgcggtttcaacaggggaaggatctgcagcagtatgtttcagtggttgtgctagatgaagtgggtctggctgaggactctccgaagatgcccctgaagacactgcacccactgttagaggatggctgtatagaagatgaccctgcccctcacaaaaaagtaggcttcgtgggaattagcaactgggccttggaccccgccaaaatgaatagggggatcttcgtgagccgtggttccccaaacgagacagaactgattgagagtgccaaaggaatctgcagcagcgacattttggtgcaggatagggtgcagggatactttgcaagttttgccaaggcctacgaaaccgtctgtaagaggcaggataaggaattttttggccttagggactattactcattaattaaaatggtatttgcggccgccaaggcttctaatcgaaagccgagccctcaggatatagcccaggcagtcctgagaaactttagtggaaaagatgacattcaggccctggacatttttttggctaatctcccagaggctaagtgctctgaggaagtttcacctatgcagcttatcaagcaaaacatttttggaccctcccagaaagtgccgggaggcgaacaggaggatgccgaatctcgttatttgttggtgctgaccaagaattacgtggcactccagatactccagcagaccttcttcgagggagaccagcagccagaaataatcttcggcagcggatttccaaaagaccaagaatacacccaactgtgcaggaacattaatcgagtcaaaatttgcatggaaaccggaaagatggtactgctgctgaatctccagaatttgtacgaatctctgtatgatgccctgaaccagtactacgtgcatctcggaggccagaagtacgtggatttgggcctcggaacccaccgcgtgaagtgccgggtccacccaaatttcaggctgatcgtgattgaagagaaggatgtagtgtacaaacacttccccatcccactgataaacagattagagaagcattacctcgacatcaatacagtgctggaaaagtggcagaaaagcatcgtggaggaactttgcgcatgggtggagaaattcattaacgtcaaggcccaccatttccagaagcgccacaaatacagcccatctgacgtgtttataggctatcattccgatgcatgcgctagtgtggtcctccaggtaatagaacgccagggtcctcgcgccctcactgaagaactgcatcagaaagtgagcgaggaggctaagtcaattttgctcaactgcgcgacccccgacgccgtcgtgagactctctgcgtatagcctcggaggatttgccgcagaatggctttcacaagaatactttcatcggcaaagacataactctttcgccgattttcttcaggcgcacctccacaccgcagacctagaacggcacgctatattcaccgagatcaccaccttcagtagattgctcaccagccacgattgcgagatcctggagtctgaggtcaccgggcgcgcacctaaacccaccctgctgtggctgcagcaattcgatacggagtactccttcctaaaggaagtgcggaattgcttaaccaatacggcgaaatgcaaaattttaatctttcaaacagactttgaggatggaatacggtccgcgcaactcatagcttccgccaagtacagcgtaatcaacgaaatcaataagattcgcgaaaacgaggataggatttttgtgtattttattactaaactcagccgcgtgggaagaggtactgcctacgtcggatttcacggaggtctgtggcagtccgtgcatatcgacgatttacgcaggagtacactgatggttagcgatgtcacaaggctccagcatgttacgatttcacagcttttcgctccgggtgatctcccagagctgggcttagaacatcgggctgaagacgggcatgaagaagcaatggaaactgaagcaagcacatccggggaggtggccgaggtggccgaagaagccatggagaccgagtcatctgagaaagtggggaaagaaacatccgagcttgggggctcagacgtttccatccttgatacaacccgactgctgagatcatgtgtgcagtcggctgtggggatgttacgcgaccagaatgagtcttgtacacgtaatatgagacgcgtagttctcctcctggggctgctaaatgaggatgacgcctgccatgcctcttttctgagggtgtccaaaatgcgactgtccgtattcctcaagaagcaagaggagagccagttccaccctctggagtggctcgccagagaggcttgtaatcaagatgcgcttcaggaggccggtaccttccgacataccctatggaagcgagtccagggagcggtcacccctctccttgcttccatgatcagtttcattgatcgggatgggaatctggagctcctgactaggcccgacacccctccctgggcgcgggacctttggatgtttatatttagcgatactatgttgctaaatattcccttggttatgaacaacgaacggcacaaaggagagatggcatacattgtagttcagaaccatatgaacctgtcagaaaatgcatctaataatgtcccctttagctggaagataaaagattacctagaggagctctgggtgcaggcccagtacatcacggacgcagaaggcctccctaagaagtttgtcgatatattccagcaaacccccctgggcaggtttctagcccagctgcatggagagcctcaacaggagctcctccagtgctatctgaaggacttcatcttgctcacaatgcgggtcagtaccgaagaggagctgaagtttctccagatggcactctggtcttgtactagaaagctgaaggccgcctcagaggccccagaagaagaggtgtctttaccttgggtgcatctcgcctaccaaaggtttcgttccaggttgcagaatttcagccgaatcctgacaatatacccccaggttttacacagcttgatggaagcccggtggaatcacgagctggccggctgcgaaatgacactggatgcatttgccgcaatggcatgtacagaaatgctcaccaggaatacattaaaaccttctccgcaagcatggctgcagctggtgaagaacttgtctatgcctctagagcttatctgttcggacgagcacatgcaggggtctggttccctggcccaggccgtgatccgcgaggtgcgtgctcagtggagccggatcttctcaaccgccctgttcgtcgaacacgtactgctgggaacagaatctcgcgtcccagagctccagggccttgtgaccgagcacgtgttcctcctggataagtgtttgagggaaaatagtgatgtgaagacacacggaccctttgaggccgttatgcggaccctttgtgagtgtaaggagactgcatctaagacactcagtcgatttgggatccagccgtgttcaatctgcttgggcgatgcaaaggatccagtgtgccttccctgtgaccatgtacactgcctgaggtgtctgcgcgcctggttcgccagcgagcagatgatctgcccttactgcttaacggccctgccggacgagtttagtccagctgtgtcgcaagcccatagagaagcgattgaaaagcatgccaggttccgccagatgtgtaattctttcttcgtggacctggtctcgactatttgttttaaggataacgcgccccctgaaaaagaagtaatcgaaagcctactgtcgctcttgtttgttcagaaaggaaggctaagggatgctgcccaacggcactgtgagcataccaaatcactgtctccatttaacgacgttgtggacaaaaccccggtgatacgttcagtgattctgaaattgctcttgaagtacagctttcacgatgtcaaggactacatccaggagtatttgactttgctcaaaaagaaagcctttatcaccgaggataagacagaactgtacatgctgtttatcaactgcctggaggatagcatcctggaaaaaacatccgcctactcccgcaacgacgagttgaatcatctggaagaggagggcagattcttgaaagcctattcacccgcttcccgcggccgcgagcctgctaatgaagcctccgtagagtacctgcaggaagtggcacggatcaggctctgtctcgaccgagccgccgactttctgagcgaacccgaaggcggtccagaaatggctaaggagaaacaatgctatctccagcaagtgaagcagttctgtatacgcgtggaaaatgactggcatcgagtttaccttgtaaggaaattgtctagccaaagagggatggagttcgtgcaaggtttgtcaaaacccggtaggcctcatcagtgggtgttccccaaggatgtggttaagcagcaaggtttaagacaggaccaccccggccaaatggatagatacttggtgtatggagatgagtacaaggcactgcgcgacgctgtggcgaaagctgttctggaatgcaaacctctgggaatcaaaacagcactgaaagcctgtaaaacccctcagagccagcagagcgcgtatttcctactcacactgtttagagaggtcgcgatcctgtataggtctcataatgcttccctccaccccacaccagaacaatgcgaggccgtgtcaaaattcatcggagaatgtaagattctctctccccccgacatttccaggttcgccacctcccttgtggataacagcgtgccactcctaagagctgggcccagtgactccaacctcgatggcacagttaccgaaatggccatccatgccgccgccgtgctgctgtgtggccagaatgaattgctggagccgctgaaaaatctggcattcagccccgccactatggcacacgcattcctccccacaatgcccgaagacttacttgcacaggctcgccgctggaaggggttagagagagttcattggtatacgtgtccaaacggtcatccatgtagcgtcggggaatgcggtaggccgatggagcaatctatctgtatagattgccacgcccctattggtggaatcgaccacaagccacgcgacggatttcatctagtcaaagataaggccgatcggacccagacaggacacgttttgggcaaccctcaacgaagggatgtggtgacatgcgatagggggctgccacccgtcgtattcctgctgatacggctgctaacccatctcgcgcttcttctgggtgcctcccagagctcacaggccctcattaatattattaaaccaccagttcgggaccctaagggatttctgcagcagcacattctgaaggatctagagcagctggctaaaatgctagggcacagtgccgatgagaccataggcgtcgtgcatctcgtcctgagacgcttactccaggagcaacaccagctctcctctagaagattgctaaacttcgacactgagctaagcacaaaggagatgaggaataattgggagaaagaaatcgctgccgtaatcagccctgagctggaacatctggataaaacacttcccaccatgaacaatctcatttctcaggataagcgtattagctctaacccggtggcaaaaattatttacggagaccctgtgaccttcctcccccatctgcccagaaagtccgtagtgcattgttctaagatctggtcttgtagaaagaggattacagtcgaatatctgcagcacatcgtcgagcagaaaaatggcaaggaacgcgtgccaattctctggcattttctccaaaaagaagcggaacttaggctggtgaaattccttcctgagatcctggctcttcaacgcgacctcgtgaaacaattccagaacgtgcagcaggtcgagtacagtagcatccgcggcttcttgtctaaacactcatctgacggtctgaggcagcttctgcataacaggatcaccgtctttctctccacctggaacaagctccggagaagcttggagaccaacggtgaaattaacctaccaaaggactactgtagcacagacctcgacctggataccgaatttgaaattctcctgccgaggaggcgcgggttggggctgtgcgctacagcgctggtcagctatctgattagactgcacaacgaaatagtgtatgcagtcgaaaagctgtccaaagaaaataattcatactcagtcgatgcggctgaagttacagagctgcatgtaatctcatatgaagtggaacgagatcttacgcccctcatactgtcgaattgtcagtatcaggtggaggaaggaagagaaacggtgcaggagtttgatctcgagaaaattcagaggcagatcgtttcaagatttttgcaagggaagccacgcttatccctcaagggaattcccaccctggtctaccgacatgattggaattatgaacacctctttatggacattaaaaataaaatggctcaggattcattgcccagctccgtcatctccgcaatttccgggcaattgcagtcatacagcgatgcttgcgaagtgctctcagtggtcgaagtaactctcggattcctgtcgaccgctggtggggacccgaatatgcaattgaatgtgtacacgcaggatattctccagatgggcgaccaaacaatacatgttttaaaagccctcaacaggtgtcagctcaagcacacaattgccctgtggcagttcctgtcagcccataagtcggagcagctgcttcgactgcataaggaaccattcggcgagatctctagtaggtacaaggccgacctgtcaccagaaaacgccaaactgctcagcaccttcctaaatcagactggcctggatgccttcttgctggaattacatgaaatgatcatactgaagttgaagaatcctcagacacagaccgaagagcgattccggccccagtggtcactcagggacaccttagttagttacatgcaaactaaggaatccgaaatcctgcctgaaatggctagtcagttcccggaagagatcttgctcgcgagctgcgtgtctgtttggaagacagcagctgtcctcaagtggaatcgggagatgcgatag

SEQ ID NO: 133074 - DNA, 4653 bp, Artificial Sequence
  Description of Artificial Sequence: Synthetic coding sequence
atggagtgtccgagctgccagcacgtgagtaaagaagaaacaccaaagttttgttcacagtgcggtgaacgattgcctcctgcagcacccattgccgacagtgaaaacaacaatagtaccatggctagtgctagtgagggggaaatggaatgtggccaagagttaaaggaagaaggtggtccctgcctcttcccagggtccgactcttggcaagaaaatcccgaagagccttgtagcaaagcctcatggactgttcaagaatcaaagaaaaaaaagcgaaaaaagaaaaaaaagggaaacaaaagcgcgagttccgaacttgcctcccttccactttcacctgccagtccctgccacctgaccctgctcagtaatccatggccacaggatacagcacttcctcacagccaagctcagcaaagtgggcctacagggcagccctcccagcctccgggcacggcaaccacgccgctcgagggcgacggacttagcgcacccacagaagtgggagatagcccacttcaggcccaagcccttggcgaagccggagttgcgacagggtccgaggcacagtcctctccgcagttccaggatcacaccgagggggaagaccaggatgcaagcatcccatccgggggtaggggtttaagccaggagggcaccggacccccgacctcagccggagaaggtcactccaggaccgaagacgctgcccaggagctcctcctcccagagtctaaggggggatctagtgagccggggaccgaactgcagacaactgaacagcaggcgggcgctagcgcctcaatggcggtggacgcggtcgccgagccagcgaatgcggtgaaaggcgccgggaaagagatgaaggagaaaactcagcgcatgaagcagccacctgcaacaaccccgcctttcaagacacattgccaggaagccgaaacaaagacaaaggacgagatggccgcggcggaggagaaggtggggaagaatgaacagggtgagccagaagatctgaaaaagcccgaggggaaaaatagatcggctgccgcagtgaagaacgaaaaggagcagaagaatcaggaagctgacgtccaggaggtgaaggcctctaccctgagtccagggggaggagtcaccgtctttttccacgccataatttcattgcactttccattcaatccagatctacataaggtttttatacggggtggagaagaattcggagagtctaagtgggactcaaatatctgcgagctccattataccagggatctgggtcacgaccgggtgctggtggaggggatcgtgtgcatctccaagaagcacctggataaatacatcccttataagtacgtcatctacaacggggaatctttcgagtacgaattcatttacaagcatcagcagaaaaaaggcgagtacgtgaataggtgcttgttcattaaatcttccctactgggaagcggggactggcatcagtactatgacatagtctacatgaagccacatggacgactgcagaaagtaatgaaccatattacagatgggcctcggaaggacctcgtaaagggaaagcagatcgccgctgctttaatgttggatagtacgtttagcattctgcagacttgggatacaatcaatctaaatagcttcttcactcagtttgaacagttctgcttcgtgctccaacagccaatgatttatgaggggcaggctcagctgtggacggatctccagtacagagaaaaggaggtgaaaagatatctttggcagcatttaaaaaagcatgtggtgccacttcctgacgggaagtccactgacttcttgcctgtcgattgtccagtccggtccaagctgaagaccggcctgatcgtgttattcgtggtggagaagatcgaactcttgttggaggggtctctcgactggttgtgtcacctgctgacttcagatgcctcttctcccgatgaattccatcgtgacctgtcgcacatcctgggaatcccacagagctggcgactgtatcttgtcaacctatgccagcggtgcatggacaccaggacgtacacatggctgggcgcactccccgtcctgcattgctgcatggaattagcccccaggcataaagacgcctggcggcagccagaggacacttgggccgcgctcgaaggtctatcctttagtccctttcgtgagcagatgctagacacatcatcactgctacagttcatgagagaaaaacagcatctgctgtctatcgacgaacctctgtttcgctcttggtttagcctgctgcctctttcacacctggttatgtacatggaaaacttcattgagcatctcggcagatttccggcccacattctggattgcttgtcgggcatatattatagactccccggcctggagcaggtcctgaacactcaagacgttcaggatgttcagaacgtgcagaatattctcgagatgctgctgaggctgttggacacctatagagacaagataccggaagaagccctcagtcccagctacctgacagtgtgtttaaaactgcatgaagccatttgcagcagcaccaagctcctgaagttttatgagctgcctgccctcagcgccgagatcgtgtgtcgaatgatccgactgctctcccttgtggatagtgcaggacaacgcgacgagactgggaacaactcagtgcagactgtgttccagggtacgctggccgcaactaagaggtggcttagagaagttttcacgaaaaatatgctgaccagcagcggagcctcttttacttacgtaaaggagatcgaggtgtggagacggttagtcgagatacagtttcccgcagagcatgggtggaaggagtcacttctcggcgatatggaatggaggcttactaaggaagagcccctctctcagatcaccgcctattgcaacagttgctgggacaccaaaggattggaagattctgtggcaaagacttttgaaaagtgtatcatcgaagccgtttcatccgcttgtcagtctcaaacttccatcctgcaaggcttttcgtacagtgaccttaggaagttcggcattgtgcttagcgccgtcattacaaagtcttggcctaggacagccgacaactttaatgacatccttaagcacctccttaccctggcagatgtgaagcatgtcttccggctgtgcggtaccgatgagaaaattttggcgaatgtgactgaggatgcaaaacggctcatcgccgtcgccgattccgtgttgacaaaggtggtgggagatcttttaagtggaacgatcttggtaggccagcttgagcttataatcaagcacaagaatcagttcctggatatctggcagttgcgggaaaagagtctgagcccccaagacgagcaatgcgccgttgaggaggccctcgactggcggcgagaggagctgcttctgttaaagaaagaaaagcgatgtgtggattctctgcttaagatgtgtggcaacgttaaacacctcatacaggtagacttcggggtgctggccgtgcgccatagccaggacctatcaagcaagcgactaaatgacacggtgacagttaggctttccacttcctcaaacagccaacgcgcaactcattaccacctgtcgtcacaagtgcaggaaatggcaggtaagattgacctgttgcgggattcacatatcttccagctgttctggcgcgaagctgctgagccgctgtccgagccaaaggaggatcaggaggccgccgagcttctgtcagagcccgaggaagagtctgaacgtcacattcttgaattggaagaggtttacgactatttgtatcaaccgtcataccgaaagtttattaagcttcatcaggacctaaagagcggagaagtgacactggcagagatcgatgtcatatttaaagatttcgtcaacaagtacacagatttagacagcgagctgaaaataatgtgtaccgttgatcatcaggaccagcgagattggataaaggatagggtggagcaaatcaaggagtatcaccatttgcatcaggcggtgcatgccgcgaaggttattctccaagtgaaagagagtctgggtctgaacggtgacttcagcgttctgaacaccctgcttaacttcaccgataatttcgatgactttcgacgcgaaacccttgaccaaattaaccaggaacttatccaggccaagaagcttcttcaggatatttcagaggccagatgtaaagggctgcaagcacttagcctcaggaaggagttcatttgctgggtgcgggaagcactcggcgggattaatgagcttaaggtatttgtggacttggcctctatcagtgcgggtgaaaacgacattgatgtggacagggtggcttgcttccacgacgccgtccagggatatgctagcttactttttaagttagacccgtccgttgacttctcagcatttatgaagcacttgaaaaagctatggaaggccctggataaagaccaatacctgcctagaaagcttgtgtctcttattctgtctctaatgcaaattctactcaacagagctctgttgtcaaacgtccgagcggtcaccgtggaaatggtcgcccatctgtgcggtagattcgttcattcaaggtttcagtag

SEQ ID NO: 133075 - DNA, 15771 bp, Artificial Sequence
  Description of Artificial Sequence: Synthetic coding sequence
atggagtgtccttcatgccagcacgtgtcaaaggaggaaacacctaaattttgttcccagtgtggcgaacgcctgccacccgcagcccccattgctgatagcgagaacaacaacagcaccatggcaagcgcctcagaaggggagatggaatgtggtcaggagctcaaggaagagggcggaccctgtctgtttcccggttctgacagctggcaggaaaatccagaggagccctgctcgaaggcttcctggaccgtgcaggaaggagctacttcagaagtgctggtcgacgcggctgtggatttgatatccgatgaatgggaagcagcaaatgcaattcctagcaagcgccggaagcaggatgcagctccattggaggcagccagcgtgcccagtgcagactgcgagcagtctaagaagaaaaaacggaaaaaaaagaaaaaaggcaacaaaagtgcatccagtgagttggcttccctgcctctctctcccgctagtccgtgccatctcacgcttttatccaacccatggccgcaggataccgctctgcctcacagccaagctcagcaatccgggcccactggccaaccatcccagccacctggaacggccaccacgcctctggagggagatggtttaagcgcccccaccgaagtgggagatagccccctgcaggctcaggcattgggcgaggctggggttgccaccgggtccgaggcccagtctagccctcagtttcaggatcataccgagggggaggatcaggatgcctccattccttcagggggaaggggcctctcccaagaaggaaccggcccacctacttcagccggcgagggccatagccgaactgaggacgctgctcaggagcttttgctgccagagagcaagggagggtcctccgagcccggcactgagctgcagacgacagagcaacaggccggggcgagcgcttccatggcagtcgacgcagtggcggaacccgcaaatgcagtgaaaggagcgggcaaggagatgaaggaaaagactcaaagaatgaaacagccacccgctacaaccccacccttcaaaacccattgccaagaggcggagactaaaaccaaagacgagatggcggcggctgaagagaaggtaggcaagaacgagcaaggcgaaccagaagacctgaaaaagcctgagggtaagaataggtctgctgccgccgtgaaaaatgagaaggaacagaaaaatcaggaagccgatgtccaagaagttaaggcctccacacttagtccaggtggcggagttactgtgtttttccacgctattatctcactgcatttcccctttaatcctgacctccacaaagtttttatacgcgggggcgaagaatttggcgaaagcaagtgggactcgaacatttgcgagcttcactacactcgagatctgggacatgaccgggtgttagtggaaggcatagtttgcatcagcaaaaaacacttggacaagtacattccctataaatatgtgatttataatggcgagtcattcgaatatgaattcatctataagcaccaacagaagaagggggaatacgtcaaccgctgcctgttcattaaatcctccctcctcggttccggtgattggcaccagtattatgatatcgtttacatgaagcctcacggccggctgcagaaggtgatgaaccacatcactgatgggccccgaaaggacctggtcaagggaaagcagattgccgcagcactgatgctagacagcacattttccattctccagacctgggacacaatcaatctgaactcattctttacccagttcgaacagttctgtttcgtactccagcaacccatgatctatgaaggacaggcccagctgtggacagatctgcagtaccgcgagaaggaggtgaaaaggtacctctggcagcacctgaaaaagcacgtggtacctctaccagacggcaagagtacagacttcctgcccgtggattgtcccgtacgctcaaagctgaaaaccgggctaatcgtcctgtttgtggtggaaaagattgagctgttgctggaggggtctctggactggctatgccacctccttacgtccgatgcctcctcgccagatgagtttcacagagatttgtcccacattttagggattccgcagagctggcgcttgtatctggtgaacctgtgtcagcggtgcatggatactagaacctacacatggttgggggcccttcccgtgttacattgctgtatggagctggccccacgacataaggatgcttggagacaaccagaagacacctgggccgcactggaaggcctcagcttcagcccttttagagaacagatgctagataccagcagtctgttacaattcatgcgcgagaagcaacatctgctgtccatcgatgaacccctgttccgctcctggttctcactgctcccgctctctcacctggtcatgtacatggagaactttatagagcacctgggccgtttccctgcacacatattagattgcctgtccgggatttactaccggttacccggcctggaacaggttctcaacactcaggatgttcaagatgtgcaaaacgtccagaacatactcgaaatgctgctgaggcttctggatacataccgggacaaaatccctgaagaagcgttgtccccttcgtaccttacggtgtgtctgaagctacatgaagccatctgctccagcaccaagctgctcaagttctacgaacttccagctctttctgccgaaatcgtatgcaggatgattagactgctgtcgctggtggacagcgctgggcagagggacgagactggcaataacagtgtgcaaacagtttttcagggcactttggcagccactaagcggtggctgcgcgaggtgtttactaagaacatgctgactagctctggagcgtcctttacctacgtgaaggagatagaggtgtggcgacgactcgtggagatccagtttccagctgagcatgggtggaaagaaagtcttctgggggacatggagtggcggttaacaaaagaagagcccctgtcacagattactgcctattgcaactcatgctgggatactaagggactggaggacagtgtcgccaaaaccttcgagaaatgcattattgaagctgtttcgtccgcatgtcaatcccaaacctctatcttacaaggcttctcttactcggacctccgaaagtttggcattgtcctctccgctgttatcacaaaatcctggccaaggactgccgataattttaatgacattttaaagcacctcctgacactcgctgatgtcaagcacgtttttcgattatgcggtacagacgagaagatcctggccaacgtgacggaagacgctaagaggctgatagctgtagctgactcagtgcttactaaggttgttggcgatctgctgtcgggcacgattttagtcggacagcttgaactgatcattaagcataagaatcagtttctggacatttggcagctgcgcgagaagagtctcagtcctcaggacgagcagtgtgccgtggaggaggcactggactggcgccgagaagaactgctgttgctgaagaaggagaagagatgcgtggactcacttttaaaaatgtgcggtaatgtgaagcacctgatccaggtggacttcggcgtcctggccgtgagacactctcaagacctcagctctaagaggctcaacgatacggtgacagtgagattatctacctcttcaaatagccagagagcaacccactaccacttgagtagtcaagtccaggagatggctggcaagatagaccttctcagggatagtcacattttccagctcttttggagagaggctgcagaaccactgtctgagccgaaggaggaccaggaggctgccgaactactgtccgaacctgaggaggaaagcgaaagacatatcctggagttggaagaagtgtatgattatctctatcagccatcctataggaagtttattaaactacaccaggaccttaagtccggtgaagtgacactagccgaaattgatgtcattttcaaagacttcgttaacaagtatacagatctggacagcgagttaaaaatcatgtgcactgttgaccaccaggatcaacgcgactggatcaaagatagggttgagcagattaaggagtatcaccaccttcaccaagcagtgcacgctgctaaggtgatcctacaagtgaaagaaagccttgggctgaacggagacttctctgtcttgaatacactattaaatttcaccgataattttgatgatttccgccgggaaactctagatcagataaatcaggagctgatccaggccaagaaactcctgcaggatatttcagaggcccgctgtaaggggttacaggcgctgagcctgcgcaaggagttcatctgctgggtccgggaggctcttgggggtattaacgaactgaaggtatttgtggacttggcctctattagcgcgggggagaatgacatcgatgttgaccgggtggcctgtttccatgacgccgtgcagggatacgcctcgctgctttttaagctagatccatccgtggatttttcggcattcatgaaacatttaaagaaactctggaaagctttggataaggatcagtatctacccaggaaactttgtgatagtgctcggaatttggaatggctgaaaaccgtaaacgagtcacacggttcagtagaaaggtccagcctgacccttgctaccgccatcaatcaaagggggatatacgtgattcaagcccccaagggcggccagaagataagtcccgacaccgtcttacacttgatcctaccagagtcgcctggctcacacgaggaatccagggaatactccctcgaggaagtgaaggagctattgaataaactcatgctcatgtcaggcaagaaggatcggaacaacactgaggtggaaaggttctcagaggtgttttgttcagttcagcgccttagtcaggcatttatagaccttcacagcgcagggaatatgctatttcgcacctggattgctatggcctattgttcccctaaacagggcgtttctttacaaatggatttcgggttggatctggtgacagaactcaaggaggggggcgatgtcaccgagctgctcgcagccttgtgccgccagatggagcacttcttagattcttggaaacggttcgttactcaaaagcgtatggagcacttctatttgaacttctacacagccgaacaactcgtctaccttagcacagaactccggaaacagcccccttccgacgccgccctgactatgcttagttttataaagtcaaactgcaccctccgagatgtgctcagagctagcgtcgggtgtgggtcggaagccgcgaggtatcgcatgagacgcgtcatggaagaactgccgcttatgctgctgtccgaatttagcctggtggacaaattgcgcatcattatggagcagagcatgagatgcctcccggcttttctgcccgattgcctagacttggagacactggggcactgcctggcacacctggccggaatggggggctctccagtggaaaggtgtttaccccgcgggctgcaggttgggcagcctaacctggtggtctgcggacactccgaagtgctgcccgctgcactcgcggtatacatgcagactccttcccagcctcttccaacctacgatgaagtgcttttgtgtacaccggcaactactttcgaggaggtggccctccttttgagacggtgtctcacgctgggttccctcggccataaggtttacagcctgctgttcgccgaccagctcagttatgaagtggctcgccaggcagaggagctgtttcataatctgtgcacacagcagcacagggaagactatcagctggtgatggtgtgcgacggtgactgggagcattgttatctgcctagcgctttttcccagcacaaggtgttcgtgaccccacaggcaccactggaggctattcaagcctacttggccgggcattaccgagtgccaaaacaaacactgtcggctgctgccgttttcaatgacagactgtgtgtagggatagtggcgtccgaacgggccggcgtgggaaaatctctctacgtaaaacgcttacacgataaaatgaaaatgcaactgaacgtcaagaatgttcccttgaaaacgatcaggcttattgaccctcaggtcgacgaatctagagtgctgggtgcactcctgcctttcctcgatgctcagtatcaaaaggtccccgttctttttcacctggacgtgacgtcatctgtgcaaaccgggatctgggtgtttctgtttaagcttctcatattgcagtatttgatggatattaatgggaagatgtggctgcgtaacccatgtcacctgtatatcgtcgaaatcttggaaagacgaacgagtgttcctagccgaagttcctctgccctgcggactagggtacctcagttttcattcttagacatttttccaaaggtcacttgtcggccccctaaggaggtgatagacatggagctttctgctctgcgctctgacaccgagcctgggatggatctgtgggagttctgctcagagaccttccagcggccttaccagtacctgcggcggttcaaccaaaaccaggatctcgacacatttcagtatcaagaagggtccgtggaagggaccccagaggagtgtctgcagcactttctgttccactgcggagtcatcaaccccagctggtctgagctgagaaatttcgctaggttcctcaactaccagctcagagattgtgaggcgtctctattttgcaacccatcattcatcggagacactctgagggggtttaaaaagttcgtggtgacttttatgatttttatggccagggacttcgccacgccatccctccacacatccgatcagagccctggaaagcatatggtcaccatggacggtgtccgtgaggaagatctcgccccgttttcattaagaaagagatgggagtctgagcctcatccttatgttttcttcaatgatgaccacaccacgatgaccttcatcggctttcacttacaacccaatataaatggctccgtcgacgctatcagccacttgacagggaaagtgatcaagcgagatgtcatgactagggacctctatcagggactgctactgcagcgggtgccgttcaacgtcgacttcgataaactcccacggcacaagaagctggaaaggctttgcctaactttaggaatcccacaagctaccgaccccgacaagacctatgaactcactactgacaacatgctcaagatcctggctatcgaaatgagattcagatgcggtatccctgtaattatcatgggtgagaccggatgtgggaaaacacggttgataaagtttctgagtgaccttagacgcggaggcacaaatgcggacaccatcaagctcgtgaaagttcacggcggaacgacagccgacatgatttactctagggtacgcgaggctgagaatgtggcctttgccaacaaggatcagcaccagttagacacaatcctctttttcgacgaggccaacaccaccgaggcaatttcctgcataaaggaggtgctgtgtgaccacatggtggacggccagcctctcgccgaggatagcgggctgcatattattgccgcctgcaatccgtatcgcaaacactctgaggagatgatctgtcgcctggagtccgccgggttggggtatcgtgtgtctatggaggagaccgctgatcgcctgggctcgattccattgcgccagttggtgtaccgagtgcatgcactaccaccctcgctgatcccactggtgtgggacttcggtcagttgagtgatgtggctgagaagctttacatacagcagatcgtccagcggcttgtcgaaagtatctccctggacgagaacggtacgcgggtgatcacagaggtcctctgtgccagtcagggcttcatgaggaaaacagaggatgagtgttcgtttgtctcccttagggacgtcgaacggtgtgtcaaggtgttcagatggttccacgagcacagtgctatgctgcttgctcagctgaatgcttttctttccaagagcagcgtctctaaaaatcacaccgagcgcgaccctgtcctttggtctctcatgttagcaatcggtgtatgctatcacgcatctctcgaaaaaaaagattcctatcgaaaggctattgctcgttttttccctaagccatatgatgattccagattgttgctagacgagattacgagagcgcaggatctctttcttgacggggtgccccttcgtaagaccattgctaaaaacctggccctcaaagaaaatgtattcatgatggtggtctgcattgagctgaagatacccctgtttctcgtagggaaacccgggagctccaagtcactcgctaagaccatagtggctgacgccatgcagggccctgcagcctattccgatttatttaggagcctcaagcaggtccatcttgtgtcttttcagtgcagcccacattccactccccagggtataatctccactttccggcagtgtgcgaggtttcaacagggcaaagatcttcaacaatatgtgagcgtcgtggtgttagacgaggttggcctggctgaggacagccctaagatgccgctcaagaccctccaccccctattggaagatggctgcattgaagacgatcccgcaccacataagaaagtggggttcgtgggcatatccaactgggccctggaccctgccaagatgaaccggggaattttcgtgtctagaggaagccctaacgagaccgaactgattgagagcgccaagggcatctgctccagcgatattctcgtgcaggacagagtgcagggctactttgcctcttttgccaaggcctacgaaacagtctgcaagcgccaggacaaggagttcttcggattgcgcgattattactccctgatcaaaatggtcttcgctgccgccaaggccagcaacaggaaaccctcacctcaagatatcgcacaggctgtccttagaaatttttcaggcaaggatgacattcaggcgctagatatcttcttggctaatctccccgaggccaagtgctctgaagaagtaagtcccatgcaacttataaagcaaaatatattcgggccttcgcagaaagtgcccggcggggagcaagaagatgctgagtcaagatacctgctggtcctcactaagaactatgtggcactgcagatactgcagcagactttctttgaaggcgaccagcagcccgaaatcatttttggaagtggctttcctaaagaccaggagtacactcaactgtgtcggaacatcaatagagtaaagatctgtatggaaacgggcaagatggtgctcctcttgaacctacagaacctgtacgagtccctgtacgatgctctgaaccaatactatgtgcacttaggaggccaaaagtacgtggacctcgggcttggaactcatcgtgtcaagtgccgtgtccatcccaacttcagactcatcgtgattgaagagaaagatgtggtttacaagcatttccccattccccttatcaatcggctcgagaaacattacctcgacatcaatacagtgcttgaaaaatggcagaaatcgatcgtggaagaattatgcgcgtgggtggagaagttcattaatgttaaggcccatcactttcagaagagacataagtacagtcccagtgatgttttcatcggctatcactcagatgcatgtgcctccgtggtgctgcaggttatcgaaagacagggccccagggctctcaccgaggagctacatcagaaggtctccgaggaggcaaagagcattctgctcaactgtgcaacacctgacgccgtcgtcaggctgtccgcctatagcctggggggattcgccgctgaatggctctcacaagagtatttccatcgccagcggcacaactccttcgcagatttcctgcaagctcatcttcacacggcagatctagagagacatgcaattttcacggagattacaaccttctcacgactattaacaagccacgattgtgagattcttgagtccgaggtcacaggcagagctcccaagccaaccttgctgtggctgcagcagttcgataccgaatactcatttctgaaggaggtccgaaactgcctgacaaatactgccaaatgcaaaattctgatctttcaaaccgatttcgaggacggcattaggagtgcacagcttatcgctagcgccaagtatagtgtgataaatgaaattaacaaaattcgcgaaaatgaagatcggatcttcgtgtattttattacaaagcttagcagagtcggccgaggcaccgcatacgtgggatttcacggaggtctgtggcagtcggttcacatagatgatctgcgccgctccaccttgatggtgagtgatgttaccagactgcagcatgtgaccatatctcaattattcgctccaggggatttgcccgaactaggcttggaacatcgcgcggaggacggtcacgaagaggctatggagacagaagcttccacctctggggaggtggccgaagtggccgaagaggccatggagactgaaagttctgagaaggtgggtaaggaaacatcggagttggggggttcggacgtgtccattctggacacaaccaggctgttgagatcttgcgtgcagagcgcagttggtatgctgcgcgaccagaatgagtcatgtacgagaaatatgcgacgtgtcgtcctactcctgggcttgctgaacgaagatgacgcatgccatgcttcgtttctccgcgtgagcaagatgaggttgtctgtgttccttaaaaaacaggaggagtcacagttccatcctctggagtggttggcccgggaagcttgcaaccaggatgcacttcaagaggcaggaaccttcagacacaccctttggaaacgggtacagggagcggtcactcctctgttggccagtatgatctcgtttatagacagggacggtaatctggaattgctgaccaggcccgatacccctccttgggctagagacctctggatgttcatttttagcgatactatgctcctcaacattccgctagttatgaataacgagcggcataagggggagatggcttacattgtggttcagaaccacatgaacctgtctgaaaacgctagcaataatgtgcctttctcttggaagataaaggactaccttgaagaactctgggttcaggcccagtacattaccgacgccgaaggcttgcccaagaagtttgtggacatttttcagcagacaccgctggggcgatttttggcccagctgcatggtgaacctcaacaggaactcttgcaatgttatttaaaagactttatcctgcttaccatgcgcgtatctaccgaagaagagttgaagttcctccagatggcactgtggtcctgtacgcggaaacttaaagctgcatctgaagccccagaagaagaagtatctctgccatgggttcacttggcttaccaacggtttcgaagtagactgcagaatttttccaggatcctgaccatatatccacaagtattgcatagcctgatggaggcacgctggaatcacgagttggctgggtgtgagatgacgctcgatgcctttgcagcaatggcgtgtactgagatgttgactagaaacactctgaagccctccccacaggcctggctgcaactggtcaaaaatctatccatgccattagagctcatctgttcagatgaacacatgcaggggagcggatccctcgcgcaggcagtgatcagagaggtgagggcccaatggtcccgcattttctccaccgctctctttgtggaacacgtcctgttgggtaccgagtcacgggtgcccgagttgcagggcctcgttacagagcatgtgtttctcctggataagtgtctgcgagagaactcggacgtgaagacccacggaccattcgaagccgtaatgagaaccctctgtgaatgtaaggagacggcctccaagacactatctcgcttcggaatccagccttgtagtatctgtctaggcgatgcgaaggaccctgtttgcctgccttgcgaccacgtccattgtctcaggtgtctgcgcgcctggttcgccagcgaacagatgatttgcccttattgtctcactgcacttccagacgagttttcccctgccgttagccaggcccaccgcgaggcaattgaaaagcatgccagatttcgacagatgtgcaatagcttttttgtcgacttagtttccacaatctgtttcaaggacaacgcaccgcctgagaaggaggtaattgagtccttgctatccctgcttttcgttcagaaaggaaggttgagggacgctgcccagcggcactgtgaacacacgaaaagtttgtcaccatttaatgacgtggtggacaaaactcccgtgatccgctcagtcatcctaaaactgctgctaaaatacagcttccatgacgttaaagattatatccaagagtatcttacgttactgaagaagaaggcctttataactgaggacaaaacagagctctacatgctgtttatcaactgcttggaagacagcatcctggaaaaaacatccgcgtatagcaggaacgacgaattaaatcacctagaggaggagggcagattcctgaaggcctacagccctgctagtagaggcagagagccagctaatgaggcatccgtggagtaccttcaagaggtagcccggattaggctgtgccttgaccgcgctgctgatttcctatctgaaccagaaggcggccctgagatggctaaggaaaaacaatgttaccttcaacaggttaaacagttctgtattcgagtcgaaaacgattggcaccgtgtatacctcgtgaggaaactgagtagtcagcggggaatggagtttgtgcagggactgtccaaacccggtagaccgcaccagtgggtgtttcccaaggatgtggtgaaacagcagggtctccgccaggaccatcctgggcaaatggacaggtatctggtgtatggggatgagtacaaggccctgcgcgatgcggtcgccaaagcggtgctggagtgcaaaccgcttggaatcaagactgctcttaaggcttgtaagacaccacaaagccagcaaagtgcctatttcctgctgactctgtttcgggaagtggctatactctatcgcagtcataacgctagcttgcacccgacgcccgaacagtgtgaagccgtctctaagttcattggcgaatgcaaaatacttagcccccctgatatctctaggtttgccacatctctcgtggataattctgttcccctcctgagagctggtccgagcgacagcaatctggacggaaccgttacggaaatggctattcatgcagccgccgttttgctttgtggacagaatgagcttctggaaccgctcaaaaacctggcattttctcccgcaaccatggcacacgcgtttctgcctactatgccagaggatctgcttgctcaagctcggcggtggaaagggctggagagggtccactggtatacatgcccaaatggccatccatgctccgtcggcgagtgcggaaggccaatggaacagtcgatatgtatcgactgtcatgccccaatcggaggcatcgaccataaacctcgcgatgggttccacctggttaaggacaaggccgaccgtacccagacaggacacgttttgggcaacccacagcgcagagacgtagtgacttgcgaccgcgggcttcctcccgtcgtgttcttactgatccgtttgttgacccatttggccctattgcttggagctagtcagagtagccaggcgctaatcaacatcattaaaccacctgtcagggaccctaagggattcctccagcagcacatcctgaaggatcttgagcagctggcaaaaatgctcgggcactctgccgacgagaccatcggcgtcgtacatctggtcctgcgcagactgttgcaggagcagcatcagctctcttcccgaaggctgttgaattttgacaccgagctctcaactaaagaaatgagaaataactgggagaaggaaatcgctgcggttatttcaccagaattggagcacctcgataagaccctaccgaccatgaataacttaatttcccaagacaagcgcatcagtagtaatcccgtagcaaaaatcatttacggcgacccagtgacgtttctcccgcatctgcctcggaaatccgtggtacattgctccaagatatggtcttgccgcaagcgtattacagtggagtatctccagcatatagtggagcagaagaacgggaaggagagggtacccattctttggcactttttgcaaaaagaggctgaactgcgcctggtaaaatttctgcccgaaattctggctctgcagcgtgacctggttaagcagtttcaaaatgtccagcaggtagaatactcatcgattcgtggcttcctgtccaaacattcaagcgacggactcaggcaactgttacacaatagaattaccgtattcctttctacctggaataaactccgaaggagtctggaaacaaatggggaaattaacctacccaaagactactgttccaccgacttggacctggatacggaatttgaaattctgctgcctaggaggcgaggactaggcctgtgtgccactgcgcttgttagttacctcattcgtttacacaacgaaattgtgtacgccgtggagaagctctccaaagagaataattcatattccgtggacgcagctgaggtgactgagttacacgtcatatcttacgaggtggaaagagacctgacaccattgatcctgagtaactgtcagtaccaggtggaagagggtcgggagacggttcaagaatttgacctggagaagatacagaggcaaatagtgagcagatttcttcaggggaagccgagactctctctgaagggcatccccaccctggtgtatcggcacgattggaactacgaacatcttttcatggacattaaaaataagatggcccaggatagtctccccagtagcgtgatcagcgctatcagtggtcaactacagagctactctgatgcttgtgaggtgctgagtgtggtggaggtgaccctggggtttttgagcactgccggcggagaccctaacatgcaactgaatgtgtatactcaggacattctccagatgggtgatcagaccatccatgtgctgaaggctttaaatcgctgtcagctcaaacacaccattgccctttggcagtttctgtcggcccataaaagcgagcagctcttgagactccacaaagaaccattcggagagatttcatcaagatataaggctgatctttcacccgagaatgctaaactgttaagcacattcttgaaccaaactggactggacgccttcctactggagcttcacgagatgatcatcctaaagctcaagaatccacagacacagacagaggagagattccgcccacaatggagtttacgcgatacactcgtgagttacatgcagactaaagagtctgagatcctgccggagatggcctcacagttccctgaggaaattctgctagcatcctgtgtctctgtgtggaagaccgctgccgttcttaaatggaaccgcgaaatgcgttag

SEQ ID NO: 133076 - DNA, 15624 bp, Artificial Sequence
  Description of Artificial Sequence: Synthetic coding sequence
atggaatgccctagctgccagcatgtctccaaggaggagactcccaaattctgctctcagtgcggggaacgactgccgcccgccgcccccatcgccgacagcgaaaacaacaattccacaatggctagcgcgtccgaaggagaaatggaatgtggccaagagctcaaggaggagggcggtccctgtttgtttccgggaagtgatagttggcaggaaaatcctgaggagccatgttccaaagcatcatggaccgtccaggaaagcaagaaaaaaaaacggaagaagaaaaagaagggcaacaaatccgcgagttcagagctcgcctcactcccactgtctcctgcttctccctgccatcttacgctactgtcaaatccctggccacaagataccgcactgcctcactcccaagcccagcagagcggtcccacgggccaacctagccaaccgcccggcaccgcgacgacccccctggaaggcgatggcctcagtgctcctaccgaagtgggagactccccgctgcaggcacaggctctgggagaggcaggggtggccaccgggtccgaggcccaatctagcccacaattccaagatcacactgaaggagaggatcaggacgcctccattccttctggtgggagagggctgtcccaagagggcaccggcccacccacgtccgctggagaaggccattcacggacggaggatgccgcccaggagctgcttctccccgagagcaagggcggatcaagcgagcctggcacagagctgcaaacaacagagcagcaggccggcgcgtcagcaagcatggccgtggatgccgtagcagagcctgctaatgccgtgaaaggggccggcaaagagatgaaggaaaaaactcagagaatgaaacagcctcccgccaccacccctccctttaaaacgcactgccaggaagccgaaactaagaccaaggacgaaatggccgccgctgaggaaaaagtgggcaaaaacgagcagggagagcctgaagatctgaagaaacctgagggcaaaaaccggtccgccgctgccgtcaaaaatgagaaggagcaaaaaaaccaggaggccgacgtgcaggaagtgaaggctagcaccttatcccctggagggggagttaccgtattcttccacgctatcatcagtctgcattttccgttcaacccagacctgcacaaagttttcattcgcggcggggaggagtttggcgaatccaaatgggattctaatatttgtgaactgcactacacaagagacttaggacatgacagagtgctggtggaagggattgtttgtatttccaaaaagcacctggacaaatacatcccctacaaatatgtgatctataacggagagagttttgagtacgaattcatatacaagcatcagcagaaaaagggcgagtacgtaaacaggtgcctattcatcaagtccagcctcctgggaagcggtgattggcaccaatactacgacatcgtgtacatgaagcctcacggaagactccagaaagttatgaatcatatcacggatggtccccgtaaggatttggttaagggaaaacagatcgccgcggcgttgatgctggacagtacctttagtattctgcagacctgggacactattaacctgaattcattctttacccagtttgagcaattctgttttgtcttacagcagccaatgatatacgagggccaggcacaactgtggacagacttacagtaccgcgaaaaggaggtaaagcgctatctgtggcagcatctgaaaaaacatgtggtgccccttccagatggtaagtcaaccgactttttaccagtagattgccctgtccgatccaagctaaaaaccgggttgattgtactgttcgtggtggaaaagattgaactgctgctcgaaggttcactggactggctgtgccacctgctcacatctgacgcctctagccccgacgagttccatagggatctgtcccacatactggggattcctcaatcttggcgtctgtatctggtgaatctatgtcaaaggtgtatggatacaaggacctatacgtggttaggagctcttcccgtgctgcactgctgtatggaactggcaccacgccacaaagatgcatggaggcagccagaggatacgtgggccgctttggaaggtctttctttctctcctttccgggagcaaatgctcgatacatctagcttattgcagttcatgcgcgagaagcagcacctgttgtctatcgatgagccactatttcgatcatggttcagcttactgccgctctcccacctggtaatgtatatggagaacttcatcgaacacctcggccgcttcccagcacacatcctggactgtctgagcggcatttactacagacttcccggcctcgaacaggtactcaatacccaagatgtccaagacgtgcagaatgtccagaacattctggaaatgctccttaggttactcgatacatatagggataaaataccggaagaagccctcagccccagctatttaactgtgtgtttgaaactgcatgaggctatttgctcatccacaaagcttcttaagttctatgagttgcccgccctttctgctgagatcgtatgtcggatgataaggctcttgagtttagtggactccgcaggccagcgggacgagaccggtaacaactccgtgcagacagtgtttcagggcaccctggccgcaaccaaacggtggcttcgggaggtgttcaccaagaatatgctcacttcttctggtgcctcttttacttatgtcaaagagattgaggtgtggcggcgactcgtggagatccaatttccggcggagcatggctggaaagagtccctgctgggagacatggaatggagactgactaaggaggagcctctttcccagattacagcttattgtaatagctgctgggacacaaagggattagaagacagtgtcgccaaaacattcgagaaatgcatcatagaggcagtgtccagcgcatgccagagccagactagcatcctgcagggcttcagctactcagatctgcggaaattcgggattgtgctttctgcagtgatcactaagtcttggccacggaccgccgacaacttcaacgacatcctcaagcacctgctgaccttggccgatgttaagcatgtatttaggctctgcggaacagatgagaagattctggctaacgtgactgaagacgctaagcgattaatcgccgttgccgactctgtgctgacgaaggtggttggtgatctgctgagcggtaccatcttagtgggacagcttgagctcatcatcaagcacaaaaatcaatttctagacatctggcagctaagggaaaaaagcttgagcccccaggacgagcagtgcgccgtggaggaagccctggattggcggagggaagagctcctgctgcttaaaaaggagaaacggtgcgtcgactcactgctaaaaatgtgcggaaatgtcaagcacttgatccaagtggactttggagttctggccgtcagacactcccaggatctatcatctaagcgtttaaatgatactgtgacagtccggctgagtacatcctctaacagccagcgggccacgcactatcacctgtcctcacaggttcaagaaatggccggcaagatagatctcctgagggacagtcacattttccaactgttttggagggaggcagcagagccactttctgagccgaaggaggatcaggaggctgccgagctcctgtctgagcctgaagaggaatccgaacggcatatactggaactcgaggaggtgtacgattacctctaccagcccagctataggaagtttatcaagctgcaccaggacttgaaatcaggagaggttacactcgcagaaatcgatgtcattttcaaggatttcgtcaataagtataccgatctggatagtgagttgaagattatgtgtacggtggatcatcaggaccagagggactggatcaaagaccgagttgaacagattaaagagtatcaccacctgcatcaggccgtccatgcagccaaagtgattctgcaggtaaaggagtccctgggactcaacggggatttcagtgtattgaacacgctgctgaacttcactgacaattttgatgacttcaggagggaaactctggatcagattaatcaggagctgattcaggctaaaaaactgttacaggatatatcagaagctcgatgcaaaggacttcaagctctgtctctgcgcaaggagttcatctgttgggtgcgagaggcgcttgggggcataaatgaactgaaggtattcgtggacctggcttccatctctgccggcgaaaatgatatcgatgtcgatagggtcgcatgttttcacgacgcagtccagggttacgccagcctgcttttcaagctcgacccctccgtcgatttctcagccttcatgaagcaccttaagaaactgtggaaagccctcgataaggaccagtaccttcctcgaaaactttgcgattcagcacggaacctcgaatggctgaagaccgtcaacgagagtcatggttctgtggaacgatctagcctgactctcgcgactgcaatcaatcagcgaggaatttatgtcatccaggcccctaaaggtggacagaagattagccctgatactgtgctgcacttaattctgcctgagagcccaggaagtcacgaagagagccgcgaatatagtctcgaagaagttaaggaactcctgaataagctgatgctgatgtctgggaaaaaagaccgtaacaacacggaagtggaacggttcagcgaagtgttttgtagcgtgcaacggttgagccaggcctttatagatctgcattctgcagggaacatgctgttccgcacgtggatcgccatggcctattgtagtcctaaacagggtgtgtctctgcaaatggacttcgggcttgatcttgtgaccgagctcaaagagggaggcgacgtcaccgagcttctggccgcactgtgtaggcagatggagcacttcctggattcctggaaaaggttcgttacccagaaacggatggaacatttttatctcaatttctatactgcggagcagctggtatatctgagcaccgagctgagaaagcagccaccttccgatgctgccctgacaatgctctcatttatcaagtctaattgcacccttcgtgacgtcctcagggccagcgtgggttgcggaagcgaggcagcgcgatacagaatgcggcgggtgatggaagagttgcccctgatgctgctctccgagttcagtttggtcgacaaactgagaattattatggaacagtcaatgaggtgtctgccggctttcctacccgattgccttgatctcgagactctgggccactgtctcgcccatctggccggcatgggaggctcccccgtagagcgatgcttgccacgtggcttgcaggtgggccaaccgaacctcgtcgtgtgcgggcactcggaagtcctccccgcagccctggccgtgtatatgcaaaccccctctcagcccttaccgacatatgatgaggtgttgttgtgcacccctgccacgacttttgaagaggtagccttgttattgagacggtgtttgactctgggctctctgggacataaggtgtatagcttactgtttgctgaccagttaagttacgaggtcgctcgacaggccgaggaacttttccataatttgtgtactcagcaacaccgtgaggactaccagttggtgatggtgtgcgacggggattgggagcactgttacctgccttcagccttttcacagcacaaggtctttgtaaccccccaagcccccctcgaagccatccaagcttacctcgccggtcactaccgcgtgcccaaacagacgttatctgccgcagctgtgttcaacgatagactgtgcgtgggaatcgtcgcaagtgaacgggccggagtgggaaagagcctgtatgttaagagactccacgataaaatgaaaatgcagctgaatgtaaaaaacgtcccactcaagaccattaggctcatcgacccccaggtcgatgaaagtcgtgtgcttggggctcttctaccctttctagatgcccagtaccaaaaagtacccgtcctcttccatctagacgtgacgtctagcgttcagactggtatttgggtttttctcttcaagctcctaattctacaatatctcatggatatcaacgggaaaatgtggctccgcaacccgtgccatctgtatatcgtggagatactggagcggcgcacaagtgtgccatccaggtcttcttccgccctgcggacccgggtgcctcaattcagcttcctcgatatcttccccaaggtcacctgtagaccgccaaaggaagtgattgacatggagctttctgctctgaggagcgacacagaaccgggtatggacctatgggagttctgttctgaaacattccagcggccataccagtacctgcgccgatttaatcagaatcaggatctggacacattccagtatcaggaaggctccgtcgaggggactcctgaagagtgcctgcaacacttcttgtttcactgtggtgtcattaacccatcctggagtgaactcagaaactttgcccgctttctgaactatcagttgagggactgtgaagcttcgctgttctgtaatccgtctttcataggcgacacactgcgaggatttaagaagtttgttgtgacattcatgatctttatggcccgggatttcgcgacaccaagtctgcacacaagtgatcaaagtccgggaaagcacatggtgaccatggacggagtgcgggaagaagacctggccccgttttcattgagaaaacggtgggagtctgaaccccacccatatgtcttctttaacgatgatcataccactatgacgttcatcgggttccatctacaaccaaatatcaatggtagtgttgacgccatttctcacctgacgggtaaggtaattaagagagatgtgatgactcgagatctgtaccagggactgctgctgcaaagggtcccttttaacgttgatttcgacaagctaccacggcataaaaaactggaaaggttgtgtctgacactcgggatacctcaagctacggaccccgacaagacttacgagcttaccacagataatatgctcaagatactggcaatagagatgcggtttcggtgtggcattcccgttattatcatgggcgagaccggctgcggaaaaacaagactgataaagttcctgtctgacctgaggagaggtggaaccaacgccgacaccattaaattggtcaaagttcacggaggcaccaccgcggacatgatatactcaagggttcgcgaagccgaaaatgttgcatttgccaataaagaccaacaccaactggatacaattttatttttcgacgaagccaatacaacggaggcaatctcctgtatcaaggaagtgctgtgcgaccatatggtggatggtcagccccttgccgaagactcaggacttcacatcattgccgcgtgtaatccttatcgcaagcacagtgaagagatgatttgccgcttggagagcgcaggccttgggtacagagtctcaatggaagagaccgctgataggcttggaagcatccccctcaggcagttagtgtaccgcgtgcatgctctaccgcctagcctaataccgctcgtgtgggattttggacagctttccgatgtcgccgagaaattgtatattcaacagatcgttcaacggctagttgagtccatctccttagacgagaacggcactcgcgttatcacggaggttttgtgtgcctcacaggggttcatgagaaagaccgaggacgaatgttcatttgtctccttgcgtgatgtggagcggtgtgtaaaggtgttcagatggttccatgaacatagcgccatgctgcttgctcagttaaatgcctttcttagtaagtcctccgtctctaagaatcataccgagcgtgaccctgtgctgtggtctctcatgctggccatcggcgtgtgctaccacgccagcctcgagaaaaaggacagttaccgtaaagccatagcaaggttcttcccgaaaccctatgacgactcacgactactcctggatgagataactcgggctcaagatctgttcctggatggggtccccctaagaaaaacaattgccaagaatttggccctgaaggaaaacgttttcatgatggtagtgtgcattgaactcaaaattccactgtttctggtaggcaaacctggctccagtaagagcctggctaaaaccattgtggccgatgcaatgcagggtccagcagcctacagcgaccttttccggagccttaagcaggttcatcttgtgtcttttcagtgttctccccatagcaccccgcagggaatcattagcacgttcaggcagtgcgctcggttccagcaggggaaggatctacagcagtacgtctctgtggtcgtgctcgacgaggtggggcttgccgaagattctccaaaaatgccactgaaaaccctccatcccttgctcgaggatgggtgcatagaggacgacccggctccccataagaaagtgggctttgtcggcatcagcaattgggcactcgaccctgccaagatgaacagggggatttttgttagccggggctctcccaatgagactgaactcattgagagcgccaaaggtatatgcagctcagacatcctggtgcaggacagggtccaaggctatttcgcttccttcgcgaaggcctacgagaccgtgtgtaagcgtcaagacaaagagttttttggtttgagggactactacagcctcataaagatggttttcgctgccgccaaagcctccaatagaaagccatctcctcaagacatcgcccaggctgtactgcggaacttcagcggcaaggatgatattcaggcactggacatattcctagccaatttgccagaggccaagtgttctgaggaggtgagtcccatgcaattgatcaagcagaatattttcgggccgtctcagaaagtcccaggcggggaacaggaagatgctgaatctagatatctgctggtactaacaaaaaattacgtggcgctgcagatcctgcaacagacattttttgagggggaccaacagcctgagattatcttcgggtccggctttcctaaggatcaggaatacacgcagctgtgcagaaacattaaccgcgtgaaaatttgcatggaaaccggaaaaatggtgttactgttgaacctccagaacctatatgagtctttatacgacgctctaaaccagtattacgtgcacctggggggacagaaatatgtagacctagggttgggcacccaccgtgttaagtgtagagtgcaccctaatttccgcctgatcgttatcgaagagaaggatgtggtgtataagcactttccaatccctctgattaaccgcttagaaaagcactacctcgacataaacaccgtcctggaaaaatggcagaaaagcattgtggaagagctgtgcgcctgggtggaaaaatttattaatgttaaagcacaccatttccagaaacgccataaatactctccatcagatgtatttatcggctatcacagcgacgcctgtgccagtgttgttctgcaagtgatagaacgacagggcccgcgcgccctgacggaagaactgcaccagaaggtctctgaggaagccaaatcaattttgcttaattgcgctacacctgatgccgtggtccggctcagcgcctattccctcggaggctttgcagctgagtggttgagccaggaatactttcaccggcaaaggcacaactccttcgccgacttcttgcaagcccacctgcacaccgcagacctggagcgtcacgccatctttacggagatcactaccttttcaagactcttgacctcccacgattgcgagatactggaatcagaggtgaccggacgggccccaaagccaaccctgctgtggctccagcagttcgacacagagtactcgttcttgaaagaagtccgaaattgtctcacgaacaccgccaagtgtaaaattctgatttttcagactgactttgaggacggcattcgcagcgcgcagctgattgcgagcgcgaaatactcagtgatcaatgagatcaacaagatcagggagaacgaggatcggatcttcgtctacttcattaccaaattatctcgggtgggccgcgggaccgcctacgtgggtttccacggcggtctttggcaatccgtgcacattgatgacctgcgacggtcgaccctcatggtctcagatgtaacccggctgcagcacgtgaccatcagccagctcttcgccccgggggatcttccagagctcggcttggaacatcgagcagaagacggacacgaggaggcaatggagaccgaagctagtacttcaggtgaagtggccgaagtggcagaggaggctatggaaacagaaagcagtgaaaaggtcgggaaagaaacctccgaactgggaggaagcgacgtttccatcctggatacaactcgtcttctcaggtcttgcgtgcagtcagcagtgggcatgttgcgagaccagaacgagagttgtacgcgcaatatgcgaagggtggtgttgctgctgggtctgctgaacgaggacgatgcctgccatgccagtttccttcgagtctctaaaatgagactttctgtgttcttgaagaagcaggaggaatctcaattccaccccctggaatggctcgctcgcgaggcatgcaatcaggacgctcttcaggaggcagggaccttccgtcatacactgtggaaaagggtgcagggggcggtaacaccactgctggcaagcatgatcagctttattgatcgcgatgggaatctggagcttctcacaagaccagatacacccccgtgggcaagggatctctggatgtttatcttttctgacacgatgctgttgaatataccgttagtaatgaataatgaaaggcataagggcgagatggcttacatcgttgtccagaaccatatgaatttgtcggaaaatgcctctaacaatgtgccattttcatggaagatcaaggattatctcgaggaactgtgggtgcaggcccagtatattacagatgccgaagggctgccaaagaaattcgtcgatattttccagcagacgcctctgggtagattcctggcccagctgcacggcgaaccccagcaggagttgttgcagtgttacctgaaggattttatcctcctgacgatgcgtgtttctaccgaggaggaactgaagttcctgcagatggccctctggtcttgtacacgcaagttaaaggctgcttctgaggcccctgaggaggaggtgagcctgccctgggtccatcttgcttaccagcgctttaggagcagattacaaaattttagtagaatactcacgatctacccacaggtcttacacagcctcatggaggctaggtggaaccatgaactagctggatgcgagatgacactcgatgcttttgccgctatggcatgcaccgagatgctgacccggaatacactgaaaccctcaccccaggcctggttacagctcgttaagaacctctccatgcccctggaattgatctgttccgatgagcatatgcaagggtccggcagcctggcacaggcagttattcgcgaggtccgggctcaatggagtaggatctttagcaccgccctgttcgtggagcatgtgttgcttgggaccgagtctcgagttcctgagcttcagggcctagtgaccgagcacgtttttcttttggacaaatgcctgagggagaacagtgacgtgaaaacccacggccctttcgaggcagtgatgaggacactgtgcgaatgtaaagaaaccgcctccaaaactctgtcgagatttggtattcagccatgctcgatttgtctgggagatgctaaggaccctgtctgcctaccctgtgatcacgtgcactgcttacggtgccttagagcctggttcgcaagcgagcagatgatttgcccttattgcctcaccgccttgccagacgaattcagccccgctgtttcacaggctcacagagaagcaattgagaagcacgcgaggtttcgtcagatgtgcaatagttttttcgtggacttggtgtccactatctgtttcaaggataacgcccccccggaaaaggaagtgatcgagtccttgctgagcctgttatttgtgcagaagggtagactccgggacgccgcccagcggcactgtgagcatactaagagtttgagcccgtttaacgatgtggtcgataagacccctgtgattcgctcggtaattctcaagctgctgctgaagtatagtttccacgacgtaaaggattacatacaggagtacctgacccttctgaaaaagaaagcttttataaccgaggacaaaaccgaactgtatatgctttttatcaactgcttggaggacagtatactcgagaagacttccgcatacagccggaacgacgaactgaaccaccttgaagaggagggtcgattcctcaaagcctattccccagccagcagaggtagggaaccagccaacgaggcaagtgttgaatatttacaagaggtggcccggattagactgtgcctcgacagggccgccgacttcctttctgagcccgaaggcggacccgagatggcgaaagagaaacagtgctacctgcagcaggtgaagcagttttgtattagggtggagaatgattggcatcgtgtgtatctggtcagaaaactgagttcacagcgggggatggaatttgttcaggggctttccaagcccggccgaccacatcagtgggtttttcccaaagacgtcgtgaaacagcaaggcctacggcaggaccaccccggacagatggatcgctatctagtatatggtgatgagtacaaggccttacgggatgctgtggctaaagcagtcttggaatgcaagccgcttggtattaaaacagccctgaaggcctgtaagactcctcaatcccagcagtcagcttacttcttactgaccctgtttcgggaagtcgccatactttaccgcagtcataatgccagccttcaccctacccctgaacagtgcgaggctgtgagcaagttcataggggagtgcaaaatcctctcacccccagacatatcacgctttgcaacatccctggtggataactcagtgcctttactgcgtgccggaccatccgattcaaatctcgatggcaccgtaaccgagatggccatccacgccgctgctgtgctgctgtgcggccaaaatgagctcctggagccactgaaaaatcttgcattttctccagccactatggcccacgcattcctgccaactatgcccgaggatttgctcgctcaggccagaagatggaagggccttgaaagagttcactggtatacttgccccaacgggcatccttgttccgtgggtgagtgtgggcgtcctatggagcagagcatttgtattgactgtcatgccccaattgggggaatcgatcacaaacctcgtgacggctttcacttagttaaggataaggcagaccgtacccaaactggccacgtcctcggaaatcctcagaggcgtgatgtcgtcacatgtgatagaggactcccacctgtcgtgtttctgttgatacgattgctgacccacctggcactacttttaggcgccagccagtcaagccaagccctcatcaacataattaagccgccggtacgagatccaaaaggatttctgcagcagcacatccttaaagatttagagcagctggccaagatgctcgggcactctgctgacgagaccatcggcgtcgtgcatctagtgctgcgcagacttctgcaagaacagcatcagctctcgtcgagacgtttactaaactttgacacggagcttagtactaaggagatgagaaataactgggaaaaggagattgcggccgtgataagtccagagcttgaacacctggacaaaaccttaccgacaatgaataacttgatctctcaggacaagcgcatctcctccaacccggttgcaaaaattatctacggcgatcccgtgacattcctaccacacctgccccgtaaaagtgtcgtgcactgttctaagatctggtcatgccgcaagcgtatcactgttgaatatcttcagcacatagtagagcagaagaatggcaaggagagagtgcctatactgtggcatttcctgcaaaaggaagccgagctaaggctcgtgaagttcttacctgagattctggctctgcaacgtgacctggttaagcagtttcaaaacgtccagcaagttgagtattcatcaattaggggctttttatccaagcattcctcagacggtctgcgccagctccttcataacaggatcacggtgtttctgtccacatggaacaagctgcgccgcagccttgagactaacggggagatcaaccttcctaaagactactgttccacggacttggaccttgacacagaatttgaaatattgttgccgcgacgaagaggtcttggcttgtgtgcaacagctctggtcagttatctgattcggctgcataacgagatagtgtacgccgtggagaaactgtctaaggagaataattcatactcagtagacgccgctgaggttaccgaactccacgtgattagttacgaagtcgaaagggatctcacacctcttatcctttccaactgccaataccaggtggaggaaggtcgggagacagtgcaggagttcgacctggaaaaaatccagaggcaaatcgtcagtcggttccttcaaggcaaaccaaggctgtctcttaaggggatccccacgttggtctaccggcatgactggaactacgagcatctcttcatggatataaagaataaaatggcacaggactccctcccctctagcgtgatttctgccatctctggacagctgcagagttactcagacgcatgcgaagtgctgagcgtcgtcgaagtgaccctcggattcttgagcacagccggtggtgaccccaacatgcagctgaatgtctatactcaagacatactgcaaatgggtgatcagaccatccacgtgctcaaagctctgaaccgttgccagctgaagcataccatcgccctgtggcaattcctctccgctcataaaagcgaacagcttttgcgtctgcacaaagaaccatttggcgagatcagcagtaggtataaagccgaccttagccctgaaaacgcaaagctgctgtcaacgttcctgaatcagaccgggctcgacgcttttttacttgaactccacgaaatgatcatcttgaagttgaaaaatccccagactcaaacagaggaacgctttagaccccagtggtcacttagagacaccctggtctcttacatgcagacaaaggagtccgagattttaccagaaatggccagtcaatttcctgaagagatccttcttgcctcctgcgtttctgtgtggaaaaccgccgcggtactaaagtggaatcgcgagatgcggtag

SEQ ID NO: 133077 - DNA, 2772 bp, Artificial Sequence
  Description of Artificial Sequence: Synthetic coding sequence
atggaggagggtaacaataacgaggaagtgatccatctgaacaattttcactgccatcgagggcaagagtggataaacctgagagacggcccgataacaatttcggattcttcggatgaagaacggatccccatgttagtcaccccagctccccagcagcacgaagaggaggacctggacgatgacgttatcctgactgaaactaataagccacagagaagtcggccgaacctgataaaacccgccgcccagtggcaggaccttaagcgcctcggtgaagaacgccctaagaagtctagagccgctttcgagtcagacaaaagctcctacttcagcgtgtgcaacaaccccctgttcgactctggcgcacaggatgatagcgaagacgactatggcgaattccttgatctggggcctcccggcatcagtgaatttaccaaaccctccggacagactgagcgggaacctaagccaggcccgtctcataaccaggccgcaaatgatatagttaacccgcggtcggaacaaaaggtgataattctggaagagggctcattactttacaccgagagtgacccacttgaaacgcagaatcagagcagcgaagatagcgaaaccgagctactctcaaacctcggggaatctgctgcactggctgatgatcaggccatcgaggaagactgctggctagaccacccgtacttccagagcttgaatcagcagccccgagagattaccaaccaagtcgtaccccaggagcgccagccagaggctgagctcggccgcttgctgtttcagcacgagtttcccggaccagccttccctcgcccggagcctcagcagggcggaataagcggtccatcaagcccacagccggctcaccctcttggggaattcgaggatcagcagctagctagtgatgatgaggaacccggaccagctttccccatgcaagagagccaggaaccaaacttggagaacatttggggccaggaggccgctgaggtggaccaggagctggtggaactcctcgttaaggaaaccgaggccagattccccgatgtggctaatgggttcatagaggaaataattcacttcaaaaattactatgatctgaacgttttgtgcaatttcctcctggagaatcctgactacccaaaaagagaagaccgaatcatcatcaaccccagttcaagtcttctcgcttcgcaggacgaaactaagcttcccaagatcgacttcttcgactatagtaagctgacccctctggaccagcggtgcttcattcaggccgccgatctcctgatggccgacttcaaggtgctgtcaagccaggacatcaaatgggccctgcatgagctcaaagggcattacgccattacacggaaggctttgtcggatgctattaaaaagtggcaagaactgtcacctgagacctccggcaagcgaaagaagcgtaaacagatgaaccaatacagctatatagatttcaagtttgaacaaggcgacatcaagattgagaaacgaatgttcttcctggaaaataagcggcgccactgccggtcctatgacagaagggccttattaccagccgtgcagcaggagcaggaattttacgagcagaagatcaaggaaatggcggagcatgaagacttcctcctagcactgcaaatgaacgaggaacaatatcaaaaggacggtcagctgatcgagtgtaggtgttgttatggcgaatttccattcgaggagctcacacagtgcgctgatgcgcacctgttctgcaaagagtgtcttatcagatacgcacaggaggctgtcttcgggtcagggaaactcgagctatcgtgtatggaaggttcctgcacctgttccttccctactagcgaattagaaaaggttctgccacagacaattctgtacaagtattatgaacgcaaggcagaggaagaggtggccgctgcctacgccgatgagctggtgcgctgtccctcttgctccttccctgccctgttggacagcgacgttaagcgctttagttgccctaatccacactgtagaaaggaaacatgcagaaaatgccagggcctgtggaaagaacacaacgggctgacttgcgaagagctggcagagaaggatgacattaaatatcgcacgtccatcgaagagaaaatgacagctgcccgtattcgaaaatgccataaatgcggcacagggcttatcaaatctgaaggctgcaaccgcatgtcctgtaggtgcggtgcccagatgtgttatctgtgtcgcgtgtccatcaacggatatgatcacttctgtcagcaccctcgctcgccgggggcaccatgccaggagtgctcccgatgttcattgtggaccgaccccacggaagacgatgaaaagttgatcgaagagatccagaaagaggctgaagaggagcaaaagaggaagaacggcgaaaatacctttaagcgtatcgggcccccactcgagaagcccgtggaaaaggtacagcgtgtcgaggccttacctaggccagtgcctcagaacttgcctcaacctcagatgccaccctatgcttttgcacatcctccatttccactgcccccggttcgccccgtgtttaacaattttccccttaatatggggcctatccccgccccttatgtgcctcctcttccaaatgttcgtgtcaattacgacttcggccccatacacatgcccctggaacacaacctaccgatgcactttggccctcagccgagacacagattctag

SEQ ID NO: 133078 - DNA, 63 bp, Artificial Sequence
  Description of Artificial Sequence: Synthetic coding sequence
atggaggaggggaacaacaacgaagaggtgattcacctcaataattttcactgccataggtag

SEQ ID NO: 133079 - DNA, 2601 bp, Artificial Sequence
  Description of Artificial Sequence: Synthetic coding sequence
atggaggagggaaataataacgaagaggtgatccacttgaataatttccattgccacagggggcaagagtggatcaacctgcgcgacggcccaatcaccatttctgacagttccgacgaggaacggatacctatgttagttactcccgccccccagcagcacgaagaagaggacctcgacgacgatgtgatattgacagaggacgactcggaggacgactatggggagttcctcgacctcgggccacccggcatatcagagtttacgaaaccatccggacagaccgagcgggagcccaagccaggaccatctcataaccaggcagccaatgacatcgtgaatcctcggtccgaacagaaggtcatcatcctggaagaagggagcctgttgtacaccgaatccgaccccctagagacacagaatcagtccagtgaggactcagaaacagagcttttgtccaacctcggtgaatcggccgcactcgctgacgaccaggccattgaggaggactgttggctcgaccatccctatttccaatcattgaaccagcaaccacgagaaatcaccaatcaagttgtaccccaggaacggcagcccgaagccgaactcggccgccttctcttccagcacgaatttccaggcccggcatttcctaggcccgaacctcaacagggcggcatctctggtcctagtagccctcagcccgcccatccactgggtgagtttgaagaccagcagctcgcctctgacgacgaggaacctggtcccgcattcccgatgcaggagagtcaggaaccgaacttggaaaatatttggggtcaggaggccgccgaggttgatcaggagttagttgagctgctcgttaaggagactgaagcacgattccccgacgtagcaaacgggtttatagaggagatcatccactttaagaattattatgatttgaacgtcctatgtaactttctgctggagaatcctgactaccctaaacgagaagacagaatcataattaaccccagttcatctctcctagccagccaggacgagaccaaactccccaagattgattttttcgattatagcaagcttacccctctcgaccagcggtgctttatccaggcagccgatctgctcatggctgacttcaaggtgctatcaagtcaggatataaagtgggcgctccatgaattgaagggccactacgctatcacacgtaaagctttatcagatgctattaagaagtggcaggagttgtccccggagacctcagggaagcggaagaaacgtaaacagatgaaccagtactcctatattgatttcaagttcgaacagggcgatataaaaattgagaagcggatgtttttcttggagaacaagcgacgacattgcaggtcctatgaccgaagggcactacttcccgccgtccaacaggagcaggagttctatgagcaaaagatcaaggagatggccgagcacgaagacttcctcctggcgctgcaaatgaacgaagaacagtatcagaaagacggccagctgatcgagtgccgatgctgttatggcgagtttccatttgaggagctgactcagtgtgcggatgcccacctgttctgcaaggagtgtctaatacggtatgctcaagaggccgtcttcggctcgggtaagctggagttatcctgtatggagggcagctgtacctgctcttttcccacctctgaacttgaaaaagtgctgccccagaccatactgtacaaatattatgagcgaaaagcggaagaggaagtggcggcagcttatgccgacgagctggtacgctgtccgtcctgtagttttcccgctttgctggactccgacgtgaaaaggtttagttgccctaatccacattgtaggaaggaaacttgccgcaagtgccaggggttgtggaaggaacataatggcctgacctgtgaggaactagctgagaaagacgatatcaagtaccggacaagtatcgaggagaaaatgaccgctgcccgcatccgtaaatgtcataaatgcggaaccggactgatcaagtccgagggttgtaataggatgagttgcagatgtggggctcaaatgtgttatctgtgcagggtgtcaatcaacggttacgaccacttctgccaacacccgcgatcacccggcgcgccttgtcaggagtgcagtaggtgctccctgtggaccgatcccaccgaggacgacgagaagctgatagaggagatccagaaagaggcagaggaggagcaaaaacgtaagaacggcgaaaacacatttaagcgcatcggacccccactcgaaaaaccggttgaaaaagtccaacgtgttgaagcccttccaaggcccgtgccccaaaacctgccccaaccacagatgccaccatacgcttttgcccaccccccgtttccgctccctcctgtacggcctgtgtttaataattttccattaaatatgggacccattcctgcaccttacgtgccccctctgccaaatgtgcgggtgaattacgacttcggccctattcacatgccactcgagcacaacttgcccatgcattttggccctcagcccagacatcggttttag

SEQ ID NO: 133080 - DNA, 2037 bp, Artificial Sequence
  Description of Artificial Sequence: Synthetic coding sequence
atggaagaagggaacaataatgaagaggtgatccaccttaataattttcattgtcacagaggacaggaatggattaacctgcgcgatggaccaatcacaatatctgattcctcagatgaagagcgtattcccatgctggtgacacctgcacctcagcagcatgaggaggaagatctggacgacgacgtgatactaactgaaacgaacaagcctcagcgctcaaggcctaacctgatcaagccagctgctcaatggcaggaagcagcagaagtggatcaggagttggtggaattactggtaaaggagacagaagccagattccccgacgtggccaatggctttatcgaagagattatccactttaaaaactattatgacctcaatgtgctctgcaacttcctcctggagaacccggattatcctaagagagaagataggattatcatcaacccatccagttctcttctcgctagtcaggatgagacaaagctgccaaagattgactttttcgactattcgaagttaactccactggaccagaggtgttttatacaagcagctgatctccttatggccgatttcaaggtcctgagttcacaggatatcaaatgggctctgcacgagctcaagggtcactatgcgatcacacggaaggcactgtctgacgcgatcaagaaatggcaggaactcagccctgagacatctggaaagagaaagaagcgcaagcagatgaatcagtactcatatattgattttaaattcgaacagggagatattaagatcgaaaagagaatgttctttctcgagaataaacggagacactgccgatcatatgatcggcgcgccctgctgccagcagttcaacaagagcaggagttctatgagcagaaaattaaggaaatggctgaacatgaggacttcctgctagctctccaaatgaatgaggaacagtatcagaaagacggccagctgatcgaatgtcgctgttgttacggggagttcccttttgaagaactaacccagtgcgctgatgcccacctcttctgcaaggaatgtttgattagatatgctcaggaggccgttttcggctctggtaagctcgagctgagctgcatggaggggagttgtacctgcagctttcctacaagtgagctagagaaggtcctcccacagaccatcctgtataaatactacgagcggaaggcggaagaggaagtagcggctgcgtatgctgatgagctggtccgatgtccatcctgctctttccccgccctgctcgatagcgacgtcaagaggttttcatgcccaaaccctcactgtcggaaggaaacctgccggaagtgccagggcctgtggaaagagcataacggattgacctgtgaggagctggctgagaaagatgatatcaagtatagaacctctatcgaagagaaaatgacggcggcccgcatccggaaatgccataagtgcggtactggtctcatcaaatccgaaggatgtaatcggatgagctgtagatgcggcgcccagatgtgctacttgtgtagggttagtatcaacggctacgatcacttttgtcaacacccaagatctcccggtgcgccctgtcaggagtgttctcgctgctcattatggacagatccaaccgaagacgatgaaaagctgatcgaggagatccagaaagaagccgaagaggaacaaaaaaggaagaatggggagaatacgtttaagcgaatcggaccaccattagaaaaacccgtagaaaaggtccagagggtggaagccctgcccagaccagttccccagaacttgccacagccccaaatgcctccttatgctttcgctcacccccccttccccctgcctccagtccggcccgtatttaacaactttcctctgaatatgggacccatccctgccccctatgtgcctcctcttccaaatgttcgcgttaactacgactttgggcccatccacatgccactggaacataatctgccaatgcacttcggacctcagccaagacacagattttag

SEQ ID NO: 133081 - DNA, 447 bp, Artificial Sequence
  Description of Artificial Sequence: Synthetic coding sequence
atgagttcagacttcccacattacaactttagaatgccaaacatcggatttcaaaatctgcccttgaacatctacatcgtcgtttttggaactgccattttcgttttcatcctatctctactgttctgttgctatctgatccgactgcgccaccaggctcataaggaattctacgcgtacaaacaggtcatcctcaaagagaaggtgaaggagctgaatctccatgaactctgcgcagtgtgcttagaggatttcaagccgcgcgatgagctgggaatctgtccttgtaagcatgcatttcacaggaagtgtctgattaagtggcttgaagtgagaaaagtatgtcccctttgcaatatgcctgtcctacagctcgcacagctgcatagcaaacaggacagggggccgccacagggccctctgcccggtgcagaaaacatcgtgtag

SEQ ID NO: 133082 - DNA, 447 bp, Artificial Sequence
  Description of Artificial Sequence: Synthetic coding sequence
atgtctagcgacttccctcactataatttcagaatgccgaacataggctttcagaatctcccactgaacatctacatcgttgtctttggcaccgcgatctttgtgttcatcctttccctcttattttgttgttacttgatcagattgcggcaccaagcccacaaagagttctacgcatataaacaggtcatcctgaaagaaaaggtgaaagagttgaatctgcatgagctctgtgcggtgtgtctggaggacttcaagccaagagatgaacttggaatatgcccgtgcaagcacgcattccaccgaaagtgtttgatcaaatggctggaggtccggaaggtctgccccttgtgtaacatgccagtccttcaactggctcagctgcactctaagcaagatagagggccaccccaaggtccactgcccggcgccgaaaacattgtctag

SEQ ID NO: 133083 - DNA, 510 bp, Artificial Sequence
  Description of Artificial Sequence: Synthetic coding sequence
atgctaaacaagtccggagaatcccgctacccggcactttttcctgtgttaggaggctcctcaatgtctagtgactttccacattacaactttagaatgcctaatataggattccagaatttacccctgaatatatacatcgtggtgtttggaactgccatatttgtgttcatattgtcgctcctgttttgttgctatttgattcggcttcgacaccaggcccataaggagttttacgcttataaacaagtgatcttaaaggaaaaggtgaaagaactcaatcttcatgaactctgcgcagtgtgtctggaggactttaaaccccgagacgagctgggaatctgcccctgcaagcacgccttccacagaaaatgcctgatcaagtggctggaagtgagaaaggtgtgccccttgtgcaatatgcctgttttgcaacttgcccaactgcattcgaaacaagaccggggtcccccacagggtccccttccaggagccgagaatattgtgtag

SEQ ID NO: 133084 - DNA, 510 bp, Artificial Sequence
  Description of Artificial Sequence: Synthetic coding sequence
atgctgaacaagtccggcgaatctaggtatccagccctgttcccagtactggggggaagtagtatgagcagcgatttcccccattataatttcagaatgcccaatattggcttccaaaatctcccattgaacatttatattgtggtgttcggaactgcgattttcgtgttcatcttaagcctgctgttttgttgttacctgatcagattgcgacaccaagcccataaagaattttacgcttataaacaagtcattctcaaggagaaggttaaggagctgaacctgcacgagctgtgcgccgtgtgccttgaagactttaagcctagagacgaactgggaatttgtccatgtaagcacgctttccacagaaagtgcttgatcaagtggttagaggtgagaaaagtgtgtcctctgtgtaacatgccagtcttacaactggctcagctccactccaaacaggaccggggcccaccgcaggggcccctcccaggtgcagagaacattgtttag

SEQ ID NO: 133085 - DNA, 1302 bp, Artificial Sequence
  Description of Artificial Sequence: Synthetic coding sequence
atggaggctgtgtatcttgtagtgaacgggctggggctcgttctggatgtgctaacactggtgcttgatcttaactttctactggtcagctccctgttagcctcgctggcatggctgttggccttcgtgtataatttgccccacacagttcttacaagtttgttgcacctgggccgaggggtgttgctgtcccttctcgccttaatcgaggctgtagtgcgattcacctgtgggggactccaagcactctgcactttactgtattcttgctgcagcggcctggagtccctgaaattacttggccatctcgcgtcccacggcgcccttagaagcagggaaattctccatcgaggcgtcctgaatgtcgtgtcttctggacacgcgctcctgagacaggcctgtgacatttgtgccatcgccatgtccctggttgcttacgtgattaacagcttggtaaatatatgtctcattggtacccagaacctgttttccctggtcctcgcgctttgggatgccgtgaccggacctctgtggcggatgacagacgtcgtggccgcctttctcgcacacatttcgtcatctgccgtggctatggccatattgttgtggacaccttgtcagctcgcactggagctgctcgccagtgccgctcgattactggcctcattcgtactcgtcaatttgacaggcctcgttctcctcgcttgcgttcttgccgtaactgtgacagtgctgcaccctgactttacgctgagactcgctacccaggccctgtcacagctgcatgctagacccagttaccaccgactgcgtgaggacgttatgcgcctgtccagacttgcgttgggctcagaggcttggagacgggtgtggtctagatcattacagctggcatcctggccaaatcgcgggggagcccccggtgcaccccagggagacccgatgagggtcttctcagtccgcactcgccgtcaggatactctccctgaggccggtcggcgtagtgaggcggaggaggaagaggcccgtacaatccgcgtgaccccagtgcgtggacgagaacgtctgaacgaggaggaacctccaggcgggcaggacccttggaagcttctaaaggagcaggaggaacggaaaaagtgtgtgatctgtcaagaccagtcaaaaactgtgttgctgctgccctgccggcacctttgcctgtgtcaagcgtgcacagaaattttgatgcggcaccctgtctaccaccggaactgcccactatgccggcgcggaatcctccagacactcaatgtgtacctttag

SEQ ID NO: 133086 - DNA, 3219 bp, Artificial Sequence
  Description of Artificial Sequence: Synthetic coding sequence
atgcctggcgaggaggaagagcgggccttcctggttgccagagaagaattggccagtgcgctgaggcgagactccggtcaggcattctctctggagcagctgcggccacttctagcgtcctccctcccacttgccgcacgttacttgcagctggacgcagcacgcctggtcaggtgcaatgctcacggggagccccgcaactatctgaatactctgtccacggcattaaatattctggagaaatatgggaggaatctactgagtccccaacgtccacgatactggcggggcgtaaagtttaacaatcctgtgtttcgctctaccgttgatgctgtacagggcgggcgggatgtgttgcgcctttacgggtatactgaagagcagcccgacggcttaagctttcccgagggacaggaggaacctgatgaacatcaggtggcaacagtgaccctggaggtcctgcttcttcgaaccgagctgagcctactgttgcagaacacccacccacgccaacaggccctcgaacagcttcttgaggataaggtcgaggatgacatgctacagctttcagagtttgatccccttctcagggaaatcgcacccggccctctcacaacaccttcagtgcctggatccacacccggcccatgcttcctgtgcggtagcgcccctgggaccttacattgcccgagctgcaagcaggccctgtgccctgcatgcgatcacctttttcacggtcatccttcccgagcccaccacctgcgtcaaacattgcccggcgtgctgcagggcactcatctgtctccgtctttgccagcaagtgcccagcccagaccgcagtcaacgtctctgttggcgctgggcgactccagcttatcctctcctaatcccgcatcagctcatctgccttggcactgcgctgcatgtgctatgctgaacgaaccatgggctgtcctttgcgtggcatgtgacagaccacgcgggtgcaagggactcggactggggaccgagggtccacagggcaccggaggtctggaacctgatctcgccaggggacggtgggcctgtcagtcctgtacatttgagaacgaagcggctgctgtgttatgttcgatctgcgagcgtccgagactggctcagccaccatctttagtggtagattctagagacgccggtatttgccttcaacctctccagcaaggggatgcactgcttgcatcagcccagtcccaggtatggtattgcattcactgcacgttttgtaatagcagtcctggctgggtgtgtgtcatgtgtaatcggaccagcagcccaattcctgcacaacatgccccccgtccctatgcttcctccctggagaagggccccccaaagccagggcccccaaggcgcctgagcgctcccctgcccagtagctgcggcgatcccgagaaacagcggcaggataagatgcgggaggagggattgcagctggtgtcaatgatacgggaaggtgaggccgctggggcctgtcccgaggaaattttttctgcactccaatacagcggaactgaggtgcctctccagtggctgcgctctgaactcccctacgtcctggaaatggtcgccgaacttgcaggccagcaagaccctggcctcggagccttcagctgtcaggaggcccggcgggcctggcttgatcgtcacggaaatctggatgaggctgttgaagaatgcgtaagaacccgcaggcgcaaggttcaagaactgcagtccctgggattcggaccggaggagggctcccttcaggctctgtttcaacacgggggagacgtctcgagagctttaacggagctccagaggcagaggctggagccatttagacaacgactgtgggatagcggtcccgaacccacgccctcttgggacggacctgacaagcagtcactcgtgcgcaggctgctggctgtttacgccctgcccagttggggccgggccgaattggccctgagtctgctgcaggagacgcccagaaactacgagctgggcgatgttgtcgaagccgtgcggcactcccaagaccgcgcgtttctgcgacgactgctagcacaggaatgcgcagtctgcgggtgggcactccctcacaatagaatgcaggctttaacttcatgtgaatgcacaatctgccctgattgcttcagacagcattttacgattgctctgaaagaaaagcacataacagatatggtgtgtcccgcctgcggccgacctgacttaaccgacgatactcaactgttgtcgtacttcagtaccctggatatccagttgcgggagtcattggagcctgacgcgtatgcccttttccacaaaaagctcacagagggcgtgctgatgcgcgaccctaaatttctctggtgtgcccagtgttcattcgggttcatttacgaaagagagcaactagaggctacatgtccccagtgccaccagaccttctgcgtccgctgtaagcggcagtgggaggaacaacatagaggacggtcatgtgaggattttcaaaattggaagaggatgaatgaccctgaataccaagcacaggggctggccatgtatcttcaggagaatggcatcgactgcccaaagtgcaagtttagttacgcattggcaaggggagggtgcatgcatttccactgcacccagtgtcgccaccagttctgttcaggttgttataacgcattttacgcgaagaacaagtgccccgagcctaactgtcgggtgaagaaatcattgcacggccaccacccaagggattgccttttttatctgcgagactggacagcacttcgcctgcagaagctcctgcaggataacaatgtcatgttcaacacggagcctccagcgggagcaagagccgtccctggtggaggctgccgcgtcatcgaacagaaagaggttcccaacgggctgcgcgacgaggcatgtggaaaggagactccagcgggctacgcgggcttatgccaagctcactacaaagagtacctcgtgtccctgataaacgcccactctctagatcctgccacattgtacgaggtggaagaactggagaccgcaaccgagcgatacctccacgtgaggcctcagccccttgcaggagaagatcccccagcgtaccaagctcgattgctacagaagcttactgaagaggtgcctctgggacagtccatccctcgtcgtagaaagtag

SEQ ID NO: 133087 - DNA, 1518 bp, Artificial Sequence
  Description of Artificial Sequence: Synthetic coding sequence
atgccaggcgaggaggaagaacgtgccttcctggtggctcgcgaagagttagcctccgcactcaggcgcgatagtggccaggctttttcccttgagcagctgcggcccctgctcgcatcctctctccctttggcagcaagatacctccaactggacgctgccaggctcgtcagatgtaatgcccacggcgaacctagaaattacttgaacactctgccgacaccatcttgggacggaccagataaacagtctttggtccgccgactgttggcggtatatgccctgccttcgtggggtcgggccgaacttgcattaagtctattacaggagactcctagaaactacgagctgggagatgtggttgaggctgtgcggcatagtcaggaccgcgcatttctaagaaggttactggctcaggagtgcgccgtatgtggttgggccctccctcataacaggatgcaggctctcacttcttgtgagtgcacaatctgccctgattgttttagacagcattttacaattgcccttaaggaaaaacatattacagacatggtctgcccagcctgtggcaggcccgacctcaccgatgacacgcagctcctgtcctatttttctaccctggacattcagctgagagaatctctggagccagacgcttacgctctgtttcataagaagctcacggagggagtgctcatgcgtgatccaaagtttctttggtgtgcgcagtgtagcttcggctttatctacgagagagagcaactggaagcgacatgccctcagtgtcaccagaccttctgtgtccgctgtaagaggcagtgcgaagacttccagaattggaagagaatgaacgatccagagtaccaggcccaggggctggctatgtacctgcaggagaatggcatcgactgtccgaaatgcaaattcagctatgccctggcacgtggagggtgcatgcacttccactgtacccagtgtagacatcaattctgcagcggttgctacaacgctttttacgcaaaaaataaatgccctgagcctaattgccgggttaagaaatctcttcacggtcaccaccctcgggattgtctgttctacttgcgcgactggacagctctgcggcttcagaagttactgcaggacaacaacgtgatgtttaacaccgaacctcccgccggggccagagccgttccaggcggaggatgccgcgtgatcgagcagaaggaagttcctaacggcctcagagatgaggcttgcggaaaggagacgccagccggctacgccggactgtgtcaggcccactacaaagagtatctcgtgtctcttatcaatgcccattcactggatcccgcaacactgtacgaggtggaagaactggaaaccgcgaccgagaggtatcttcacgtcagaccccagccactagccggggaggaccctcctgcatatcaggcacgcctgctccagaaacttacggaagaagtgccgctagggcagagtatcccccgaagaaggaaatag

SEQ ID NO: 133088 - DNA, 2766 bp, Artificial Sequence
  Description of Artificial Sequence: Synthetic coding sequence
atggatctctgcacacgcgctggggagccaagtctgacccagaacactcacccacgtcaacaagctctggaacaacttctggaagataaggtggaagacgacatgctgcagctgagtgaatttgatccgctgttaagagagatcgcaccaggccctttgactacaccttccgtcccaggcagcacccccggtccgtgctttctttgcgggagtgccccggggactctgcattgtccctcttgtaaacaagcactttgtcccgcttgcgatcatctttttcacggccatccatccagagctcaccacttacgccagacactgcccggcgtcctgcaaggcacacatctttcgccaagtttacccgcatcagcacagccaaggccacagtccacttccctcctggcgctgggcgattcgagtctgtcctcccctaatcccgcatccgctcatctgccatggcactgcgcagcctgcgctatgttgaacgaaccatgggcagtgctgtgtgtggcctgcgaccggcctcggggttgtaaggggttaggactgggcacggaagggccccaggggactggagggctcgagcctgacctggcccggggccgctgggcctgtcagagttgcacttttgaaaacgaagcagccgctgtcttatgctcaatatgcgagaggccacggctcgcacagcccccctccctagtggtagacagcagagacgcggggatatgtcttcagcccctccagcagggtgatgcgctactggcttctgcccagagccaagtatggtactgcattcactgcacgttctgcaacagtagcccaggctgggtgtgtgtgatgtgcaatcgcacctccagcccaatcccagctcagcatgcccctcggccctatgcctcttcactcgaaaagggcccaccaaaaccaggccctccaaggagactgagcgctcccctcccctccagctgcggtgatccagagaagcaaaggcaggataagatgcgggaagagggcttacaacttgtttcaatgatccgtgaaggggaggccgcgggagcttgccccgaagaaatctttagcgctctgcagtacagtggaacggaggtgccattgcaatggctccgcagtgagcttccatatgtcctcgagatggttgccgagttagccggccagcaggacccagggctgggggcatttagctgccaggaggcccgcagagcctggttggaccggcatgggaacctggatgaggcggtggaggaatgtgttcggacaaggaggcgaaaggtgcaagagttgcaatccttggggtttggccccgaggagggttccctgcaagccttatttcaacacggtggtgatgtatcgcgggcactgactgaacttcagagacagcggctcgagcctttcagacagagactgtgggattcagggccagagccaacccctagttgggacggtcctgacaagcagtcccttgtcagaagactgttggccgtgtacgccctccccagttgggggcgggcggaacttgccctctcactattgcaagagacgccccgcaattacgaacttggggatgtggtagaggctgttcgccactctcaggatagagcttttctccgccgacttctcgcacaggagtgtgccgtctgcggttgggcactgccccacaatcgaatgcaggctctgacctcctgtgaatgtactatctgtccggactgctttaggcagcattttacaatcgcgctgaaagaaaagcatatcactgatatggtttgtcctgcatgcggccgtccagacctgactgatgacactcagctactgtcgtatttctctacgctcgacattcagttgagggaaagcctcgaaccggacgcttacgcactgttccataagaagctgacagagggtgtgctgatgagggacccaaaattcctttggtgcgcacagtgcagctttggatttatctacgagcgcgagcagctcgaggccacctgtcctcagtgtcatcagacgttttgcgtgaggtgcaaacgtcagtgggaagagcagcatagggggagaagctgtgaggactttcagaattggaagcgcatgaatgatcccgagtatcaagctcaggggttggccatgtacctgcaggaaaacgggatcgattgtccaaagtgtaagttctcttacgcacttgcccgagggggctgtatgcactttcactgcactcagtgcagacatcagttctgcagtggctgctacaacgccttttacgctaagaataagtgtcccgaaccaaattgccgggtgaagaagagtctgcatggtcatcatcctagagactgcttgttctacctgcgggactggacagccctgcggctgcagaaactgcttcaggataacaacgtgatgttcaataccgagccgcccgccggtgcccgtgctgtacctggtggaggctgtcgcgtcattgaacagaaggaggttccaaacggtttacgggatgaggcctgtggtaaggagactccagccgggtacgccggactgtgccaagctcattataaggagtatctggtgtctcttattaatgctcattctttagacccagccaccctttatgaagtcgaggaattggagaccgccacagagaggtatctgcatgtccgtcctcagccactcgccggcgaagaccctcccgcatatcaggcaagactgcttcagaagctcaccgaggaagtgccgctggggcagtcgattcccagacggcggaagtag

SEQ ID NO: 133089 - DNA, 513 bp, Artificial Sequence
  Description of Artificial Sequence: Synthetic coding sequence
atgcctggggaggaggaagagcgcgcattcttggttgccagagaagaacttgcttccgcactgaggagggattcaggacaagccttttccctggaacagctccgaccactgttggcatcttctctacccctcgctgcaagatacctgcaactggatgccgcccgactcgtgaggtgtaacgctcacggggagcctcgcaactacctcaatactctgtccacagcgttaaatattctggagaagtacggtcgaaacctgttgtccccacaaagacctaggtattggcgcggggtgaagttcaataatcccgtctttcggagtactgtagatgccgtccagggtggccgcgatgtgctgcgtttatacggctacactgaggagcagccggatggcctgtcattccccgaaggacaggaagaacctgatgagcaccaggtggcgactgtgacactggaagtgttactgttgcgcacggaattgtcactgctcttgcagaatacacacccccggtag

SEQ ID NO: 133090 - DNA, 171 bp, Artificial Sequence
  Description of Artificial Sequence: Synthetic coding sequence
atgccaggggaggaggaagagcgagcgtttctggtggcgagggaggaacttgcctccgcccttcggcgagacagcgggcaggcattcagcctggagcagctgaggcctctattggccagttctctgcctctggcagcacgctacttgcagctcgatgcagctaggctgtag

SEQ ID NO: 133091 - DNA, 1122 bp, Artificial Sequence
  Description of Artificial Sequence: Synthetic coding sequence
atgcggaaggcgggcgcgacctcaatgtgggctagctgctgcggcttgctgaacgaagtgatgggaactggcgccgtcagaggccagcagtctgctttcgccggcgccacaggaccattccgatttacccccaacccggagttttctacatacccacccgccgcaaccgagggccctaacatcgtgtgtaaggcctgtgggttaagcttctcagtgttccggaagaaacatgtctgttgtgactgcaagaaagatttctgcagtgtctgctcagtgcttcaggagaacttaagacgctgctcgacttgccaccttctccaagaaaccgcattccagcggccacagcttatgcgtctgaaggtgaaggatctacggcagtatctgatactgcggaatattcctatcgatacttgtcgggaaaaggaagaccttgtggatttggtgctgtgccatcacggattgggatcggaggacgacatggatacatcgtcactaaacagctctagatctcaaacatcctcatttttcactcggagcttcttcagtaactatactgctccatccgccactatgagcagtttccagggtgagctgatggacggagaccaaacatctcggtcaggagttccagctcaggttcagtccgagatcacgtccgctaacacagaagatgacgacgacgacgacgacgaagacgatgatgacgaggaagagaacgctgaggacagaaatccggggttatcaaaggaacgcgtccgggccagcctgtccgacctttccagcctcgatgacgtagagggcatgagtgtgaggcagctcaaagaaatactggctaggaacttcgtgaattatagcggatgctgtgaaaagtgggagcttgtagagaaagtgaacagactgtataaggagaatgaggaaaaccagaagtcttacggggaaaggctgcagttgcaggacgaggaggatgactccctttgtcgaatctgtatggatgcagtaattgattgcgtgctgttggagtgcgggcacatggtgacctgcactaagtgtggcaagaggatgtccgagtgccccatatgcaggcagtacgttgtccgggccgtacatgtcttcaagtcttag

SEQ ID NO: 133092 - DNA, 1119 bp, Artificial Sequence
  Description of Artificial Sequence: Synthetic coding sequence
atgaaagctggtgcaacttctatgtgggcatcctgttgcggattattgaacgaagtcatgggaacaggtgctgtgaggggacagcaaagcgcattcgctggtgctaccggcccattccggtttaccccaaatcctgagtttagcacttacccacccgccgcgacggaaggacccaacatcgtatgtaaggcttgcgggttgtcttttagtgtgttcaggaagaagcatgtgtgttgcgattgtaaaaaggatttctgcagcgtgtgctccgtgctgcaggagaaccttaggaggtgtagtacatgccatctcctacaagagactgcttttcagcgcccacagttaatgagacttaaggtaaaagacctgcggcagtatttgattctcaggaacatccccatcgacacctgtcgcgaaaaggaggacctagtagatctggttctctgtcaccatggccttggcagtgaggacgacatggataccagttccctgaactctagtagaagccagacttcaagcttcttcacccgaagctttttctctaactataccgctcccagcgccacaatgtcctccttccagggagagctaatggacggcgatcagacaagccgaagtggggtgcccgcccaggtccaatcagaaatcacatccgcgaatacagaggatgacgatgatgatgatgatgaagacgacgatgatgaggaggagaacgctgaggacaggaatccggggctgagtaaagagagggtccgcgcgtcactaagtgatttgagcagcctcgacgatgtagaagggatgtcggtgcgccagctgaaagagattctcgcccggaacttcgtgaattactctggctgctgtgaaaagtgggagctggtggagaaggttaaccgtctgtacaaagagaacgaggagaaccagaaatcttacggcgaaagacttcagttacaggatgaagaggacgattcactctgcagaatctgcatggacgctgtcatagactgtgtcctgctcgaatgtggccacatggtcacttgcacgaagtgcggtaaaaggatgagcgagtgccccatctgtcgccagtacgtggtacgagcggtgcacgtttttaaatcctag

SEQ ID NO: 133093 - DNA, 1122 bp, Artificial Sequence
  Description of Artificial Sequence: Synthetic coding sequence
atgcgcaaggctggcgcgacatcaatgtgggcttcctgttgtgggcttctcaatgaggtcatgggcacaggtgcagtcaggggccaacaatctgcattcgcgggagccacaggccccttccgcttcacccccaatcccgagttctcaacttacccgcctgcagctaccgagggccccaacatcgtctgcaaggcgtgcggattatcattcagtgtgttcaggaagaagcacgtatgttgcgattgtaaaaaggatttctgctcagtgtgcagtgttctccaggaaaacctgcgtaggtgctccacctgccatttgctgcaagagaccgcgttccaaagaccacagctgatgaggctgaaggttaaggacctcagacagtatcttatactcagaaacattcctatcgacacttgccgcgagaaggaggacctagtggacctcgtgttatgccaccatggcctcggttccgaagacgatatggacaccagttccctcaatagtagccgatcccagacaagttcattcttcacgaggagctttttctctaactacaccgcccccagcgctacaatgagtagttttcaaggcgaactgatggatggcgaccaaactagccggtcaggggtgcctgcccaggtgcagtccgaaatcacatcggctaacaccgaggatgacgacgatgatgatgatgaagacgacgatgatgaagaggagaacgcagaggaccgaaatcctgggttgtccaaggaaagggttcgcgctagcctgagcgacctctcctccttggatgacgtggagggaatgagcgtgcggcagttgaaagagatacttgcccggaatttcgttaactactcaggctgttgtgagaagtgggaattggtggagaaagtgaataggctgtacaaagaaaatgaggagaatcagaagtcctacggggagcgcttgcagctgcaagacgaggaagacgactccctctgtcgcatctgcatggatgcagttatcgattgcgttctgctcgagtgcggccacatggttacatgcacgaagtgtggtaaacgaatgtccgaatgtcctatctgtaggcagtatgtagtcagggcagttcacgtctttaagagctag

SEQ ID NO: 133094 - DNA, 1548 bp, Artificial Sequence
  Description of Artificial Sequence: Synthetic coding sequence
atggcctgcaaaataagcccgggcgcaaattctgcaagtctgcctggacatccgaacaaggttatctgtgagcgcgtgcggctgcagagtttatttccactactgccatccgatcagaacactaccgtccaggaggacgctcattttaaggcctttttccagtccgaggattccccctcaccgaagaggcagcggctgtctcactccgtgttcgactatacaagcgccagcccagccccctcccccccgatgagaccgtgggaaatgactagtaatcgtcagccaccctcggtcaggccatcccagcatcacttcagtggcgagcgctgtaataccccagcccggaaccggaggagcccccccgtccgtcgacaacggggacgacgagatagactgtctcgtcacaattctatctcccaggatgaaaattaccaccatctaccgtacgcgcagcagcaggctattgaggagcctagagctttccatccgccaaatgtgagcccaagactgctgcatccagctgcccacccgcctcaacagaacgcggtcatggttgacattcacgatcagctccatcagggcacagtgcctgtctcgtatactgtgactactgtggccccacacggcattccactgtgtaccggccagcacattcctgcatgttcaacgcagcaggtgccggggtgcagtgtggtcttctcaggacagcaccttcccgtctgttccgtgccaccacctatgctccaggcatgcagtgtgcagcaccttcctgtcccgtatgcagcattccctccgttgatttcaagtgatccattcctgatccaccctccccacctgtctccccatcaccctcctcacctcccacccccaggccaattcgtgcctttccaaactcagcagtcacgaagtcccctacaacggatagagaatgaggtggagctccttggagaacatcttccggttgggggtttcacatatcccccgtccgcacaccccccaactctgcccccgagcgctccgctgcagttcctgacccacgatccgctgcatcaggaggtcagctttggcgtgccatatccaccatttatgccccgcaggctgacaggcaggtcgaggtaccgctctcagcagccaataccaccacctccttatcacccttcccttctgccttatgtcttaagtatgttgcccgtaccgccagccgttgggcctaccttctcatttgaactcgacgtggaagacggggaagtggagaattatgaagctctcctgaatctggctgagcgtctgggcgaggccaagccgcgaggactcaccaaagctgacatcgagcagttaccttcttacaggttcaatcctaacaatcaccagtctgaacaaacactgtgcgtcgtgtgtatgtgtgattttgagtcgcgtcagctgctgcgcgtcttgccatgtaatcatgaatttcatgcgaaatgcgtcgataagtggttgaaggctaaccggacctgtccaatttgtcgagccgacgcctcagaagtgcatagggactctgagtag

SEQ ID NO: 133095 - DNA, 1299 bp, Artificial Sequence
  Description of Artificial Sequence: Synthetic coding sequence
atgaggccgtgggagatgacatcaaatcggcagcccccctcggttagaccatcccagcatcatttttccggagagagatgtaacacacctgctaggaatagacggtcacctccggtgcgccgacagagaggccgacgggatcgcctatcgcggcataactccatctcacaggacgagaactaccaccatctaccttacgctcagcagcaggcaatagaggagccaagagcctttcaccctccaaacgtgagtccgaggctcctccaccccgcagcgcatcccccccagcagaatgccgtgatggtggatatacacgaccagctgcatcaaggtacagtgcccgtgtcttatactgttacaactgtggcaccccatggcataccactctgtaccggacaacatattcctgcatgttctacccagcaagtcccagggtgcagcgttgttttcagtgggcaacatcttcccgtgtgctctgtcccaccaccaatgctgcaggcatgcagcgtgcagcacctgcccgtcccttacgccgccttccctcctcttatctcaagcgaccccttccttattcacccgccccatctgagcccacatcatcctccgcaccttcccccacccggtcaattcgttccattccagactcaacaatctaggtcaccacttcagcgcatagagaacgaagtcgagctgttgggagagcaccttcccgtcggcggctttacatatccgccttccgcacatccacctactctccctccttctgcaccactccaatttttaacccacgatcctctgcaccaggaggtctcctttggcgtcccctaccctccgtttatgccccggagactaacaggcaggtccaggtaccgtagtcaacagcctataccgccccctccctatcacccaagcttactcccatatgtgttgtccatgttgccagtgccgccagcggtgggcccaacctttagtttcgaacttgatgtggaggacggagaagtggaaaattacgaggcattgctgaacctcgccgagagactcggagaggccaagccccgcggactgaccaaagctgacattgaacaacttcctagctaccgcttcaacccaaataaccaccagagcgaacagacactgtgcgttgtttgcatgtgcgacttcgagtctagacaattgctacgagtgctgccatgtaaccacgagtttcacgccaaatgcgtagacaaatggctgaaggcaaatcgcacgtgcccaatttgcagggccgatgcctcagaagtacatcgagatagcgagtag

SEQ ID NO: 133096 - DNA, 1398 bp, Artificial Sequence
  Description of Artificial Sequence: Synthetic coding sequence
atggcttgcaagagtgaagactcaccctctccaaagcggcagagactgagtcactccgttttcgattacacctccgcctcacctgctcctagtcctcccatgaggccctgggaaatgaccagcaatcgccagcctcctagtgtcaggccctctcagcaccacttcagcggcgaaagatgcaacacgcccgccagaaacagaagaagtccgcccgtcaggaggcagaggggacgcagggacaggctttcgagacataactcaatctcccaggacgaaaactaccaccacctaccttacgcccagcagcaagccattgaagagccacgcgccttccacccacccaacgtgagtcccaggctcctacaccccgcagcgcatccgccccagcaaaatgccgtcatggtagatatccatgaccagctgcatcaggggaccgttcccgtgagctacactgtaacgaccgtggcaccccatggcatccccctgtgtacaggtcagcacatccctgcttgttctacacagcaggtgcctggctgctccgtggtgtttagcgggcagcacctgcccgtttgtagcgtgcccccccctatgctacaagcttgttctgtgcagcatctcccagtgccgtatgccgcgtttccaccgctgatcagcagcgatcctttcctgatccaccccccacacctgtcgccccaccatcccccccacctccctccgccaggacagttcgttccgttccagacacagcagtccagatctcctctccaacggatcgagaatgaggtcgagctgctgggagaacacttaccagtcgggggttttacgtaccccccctccgcccacccaccgacgcttccaccatcagctccgctgcagtttctaacccacgatccgcttcaccaggaagtttccttcggggtgccgtaccctccatttatgcctcgacgattgacagggagaagtaggtaccgcagtcaacagcccatacctcctcccccatatcacccttctctgctgccctatgttctttccatgctgcctgtgcctcctgcagtcggccctaccttctcttttgaattggatgtggaagacggtgaggtggaaaactacgaggcgctcctgaatctggccgaaagactgggtgaggccaagccaaggggcctcacaaaagcggacattgagcagctccctagttaccggtttaacccgaacaaccatcagagtgagcagactttatgcgttgtgtgcatgtgtgactttgagagccggcagctcctcagagtcctcccttgtaaccacgaatttcacgctaaatgcgtggacaagtggctgaaagccaatcggacgtgccccatttgccgcgctgacgcctctgaggttcacagagactccgagtag

SEQ ID NO: 133097 - DNA, 1299 bp, Artificial Sequence
  Description of Artificial Sequence: Synthetic coding sequence
atgcggccctgggagatgaccagcaacaggcagccaccctcggtgcgcccctcccagcatcacttcagtggagaaagatgcaacactccagctcggaacaggcggagccctccggtcagacgccagcggggtcgccgcgacaggttgagtcgccacaactcaataagccaggatgagaactaccatcatttgccctatgctcagcagcaagctattgaggaaccaagggcattccacccgccaaacgtctcacctcgcctgttgcaccctgccgctcaccccccgcagcagaatgctgtcatggtggacatacacgatcagctgcaccagggaaccgtgcccgtttcttataccgtgactaccgtggctccccatgggataccactatgtaccggccaacatattccagcttgcagtacacagcaggtgccgggctgttccgtggttttttcagggcagcatctcccggtgtgttccgtcccgcctcctatgctacaagcctgctcggttcagcacttacccgtcccatatgcggctttcccaccgctcatcagctcggatccatttttaatacatccgccacatctatctccacaccacccccctcatctcccacctcctggtcagtttgtgccattccagacccagcaatccaggagcccattgcagcgcattgagaatgaggtggaactcctaggggagcatctacctgtgggcggatttacttaccccccctccgcgcacccacccacactgccaccctccgccccattgcagttcctgactcacgatcccctccatcaggaggtcagctttggggttccataccctcccttcatgccccgtagactcacaggccggtctagatacaggtcacagcagcccataccaccgcccccgtatcacccaagtttgctcccctacgtgctgagtatgctacccgtcccgcccgccgttgggcccactttctctttcgaactcgatgttgaggatggagaagtggagaattatgaggctttgctgaacctggccgagcggttgggagaggctaagccacggggcctgacaaaagcggatattgaacagctgccaagctaccgtttcaaccccaacaaccaccagagcgaacaaaccttatgtgttgtgtgcatgtgtgatttcgaatcacgccaactgctgcgagttctgccgtgcaaccatgagttccacgcaaagtgcgttgacaagtggctgaaagctaacagaacttgcccgatatgtagggcggacgcctcagaagtccacagggattcagagtag

SEQ ID NO: 133098 - DNA, 1320 bp, Artificial Sequence
  Description of Artificial Sequence: Synthetic coding sequence
atgcagcatacatgtacacaacaaaaaaaggtcacatataagcatattgccagattctcacctcggaaccggctttgtcaagcagatgcagtctttaacaacaatctggccggatttcaacttcaatccccaccagttcgtcgacagagagggcggcgtgataggttaagcaggcataattctatcagtcaggatgaaaattaccaccacttgccctatgcccagcaacaggctattgaggagcctagagcctttcaccctccaaatgtgagcccacgcctcttgcacccagccgcccaccccccacagcagaatgctgttatggtcgacatacatgaccagttgcaccaaggtacggtgccagtgtcctacactgtgactaccgtagccccacacgggatcccactatgcactggccagcatatccctgcttgtagcacacagcaagtgccagggtgtagtgtggtcttctctggacagcatttacccgtctgttctgttcctcctcctatgttgcaggcttgctctgttcagcatctgccggtaccctacgctgcctttccccctctgatctcctcggacccttttctaatccaccccccgcatctgtctccccaccaccccccacacctgccacccccaggccaattcgttcctttccagacacagcagtcccgcagccccttacagagaattgagaacgaagtggaactgttaggcgagcacctgcctgtgggcggattcacctatcctcccagcgctcaccctccgacattaccaccctccgctcccttgcaatttctcacccacgaccccctgcatcaggaagtttctttcggggttccgtatcctcccttcatgccccggcgcttgaccggtaggagccggtataggtctcaacagcctatacctccccccccctaccacccatccctcctgccttacgtcttatccatgctgcctgtgccgcctgccgttggcccaactttttcttttgagctggatgtcgaagatggagaggtagagaattacgaggcgctgttaaaccttgcagagagacttggagaagccaagccacgcgggctgaccaaggcagacattgagcagctgccttcctatcgatttaatcccaataatcatcagtccgagcaaacactgtgtgtggtgtgtatgtgtgacttcgagagccggcagctcctgagagtcttaccgtgtaaccatgagttccacgctaagtgcgttgataagtggctgaaggccaaccgaacttgccccatctgcagggccgacgcttccgaagtccaccgggattcagagtag

SEQ ID NO: 133099 - DNA, 999 bp, Artificial Sequence
  Description of Artificial Sequence: Synthetic coding sequence
atggtagatatccacgaccaactgcaccagggcacagtgcccgtgagctacaccgtgacgacagtcgcaccccacgggattcctctgtgcactggccagcatattcccgcttgcagtacacagcaggtccccggttgcagcgttgtcttctctggccagcacttgccagtgtgcagcgtgcccccaccgatgctgcaggcatgcagcgtgcaacacttgccggttccctacgctgctttcccccccctaatcagcagcgatcctttcctgattcaccccccacacctgagccctcaccaccctccccatttacccccgcctggccaatttgtgccatttcagactcaacaaagtcgatcaccacttcagcgtattgaaaacgaggtggagcttcttggggagcatcttcccgttgggggtttcacgtacccaccatctgctcaccctcccactctgccaccgtctgctcctctgcaatttttaactcacgaccccttacaccaggaagtgtccttcggagttccctacccaccctttatgccacggcgtctcaccggccgctccagatacaggtcgcagcagccaatcccgccccccccctatcatcctagcctcttgccatatgtgctatcaatgctcccggttccccctgccgtcggcccaacattttcttttgaactcgatgtggaggacggagaagtggagaactatgaagccctgctgaatctcgccgaaagactgggtgaagctaagccaagggggttgaccaaggcggatattgaacagttaccctcctaccgcttcaatccgaacaatcatcagagcgagcagacgttatgtgtggtgtgcatgtgtgattttgagtccaggcagttactgcgtgtgctgccctgtaatcatgagttccacgctaagtgtgtggacaaatggctcaaagccaataggacgtgtccgatctgcagggcagacgcttctgaagtgcaccgggactccgagtag

SEQ ID NO: 133100 - DNA, 1320 bp, Artificial Sequence
  Description of Artificial Sequence: Synthetic coding sequence
atgcagcacacctgtacgcagcagaaaaaggtcacttataagcacatcgccagattttcaccccggaaccgtctctgccaggctgatgcagtattcaataataatttggccggcttccagttgcagagtccaccagttcgtaggcagagagggcgtagagaccgactatctcgtcataactccatcagccaggacgagaactaccatcacctgccttacgcccagcagcaggctattgaagagccacgggcattccaccccccgaacgtctcccctaggctgctgcaccccgccgctcatccacctcagcaaaacgccgttatggttgacatacacgatcaattacaccaaggtaccgtgccagttagctatactgtcactactgtggcacctcatggcattcctttatgtacaggacagcatatccctgcatgcagtacccagcaggtgcccggatgcagcgtagtgttcagcggccagcatctgcccgtctgctctgtgccacctcccatgttgcaggcctgctcagtgcaacatctgcctgtgccctatgccgcttttcctccactgatctcctccgatccctttttgattcacccgcctcacctatcacctcaccacccccctcatctacctccgcctgggcagtttgtacccttccagacacaacagagccggagtccactgcagaggattgagaacgaagtcgaactgctcggagaacacctgcccgtcggaggtttcacttatccaccttctgcgcatccacccaccctgcctcctagtgcacctctccaattcctgacccatgatcccctgcaccaggaggtaagctttggtgtaccctaccctcctttcatgccacgccgactgaccgggcgcagccggtaccgttctcagcagccaatccctccgccaccataccacccatccctcctgccttatgtgctgtctatgcttcccgtcccccctgctgtcggtcctacattttcttttgagctcgacgttgaggacggagaggtcgaaaactacgaggcgctgttaaaccttgccgagcgtctgggtgaagctaaacccagaggactgactaaagccgatatagagcagttgccttcctatagatttaatcccaataaccaccagagcgaacaaacactgtgtgtcgtttgcatgtgcgattttgaatcaaggcagctcctgcgggtgttaccatgtaaccatgaattccatgcaaaatgcgtcgacaagtggttaaaggccaataggacttgcccaatttgtcgcgccgatgcaagcgaagtgcaccgggactcagagtag

SEQ ID NO: 133101 - DNA, 1299 bp, Artificial Sequence
  Description of Artificial Sequence: Synthetic coding sequence
atgagaccttgggaaatgacttccaatcgtcagccacccagcgttcggccctcacagcatcacttcagcggagagagatgcaacacccctgcgcgaaacaggcgttctccccctgtccggcgccagcgcggacgccgggatcgacttagcagacacaattctatttcacaagatgaaaattatcaccacctgccttatgcacagcagcaggcaatcgaggaaccacgggcttttcatccaccaaatgtctctcctcgtctccttcacccagccgcccatccaccgcagcaaaatgctgtcatggtggatatccatgatcagttgcaccagggcaccgtgcccgtgagttacaccgtcactaccgtcgcaccccacggcattcccttatgcacagggcagcacatccccgcatgcagtacacagcaagtgcctggttgtagcgtggtgttttcgggccagcatttaccagtgtgttccgtgccgcctcccatgctccaagcttgctcagttcagcatctcccggtgccttatgccgcattcccccctctgatctcaagcgatccgttcttaatccatccaccccacttgtccccacatcatcctccccatctacccccccccggccagttcgttccctttcagacacagcagagcagaagccctcttcaacgcatcgagaacgaagttgaactgttgggggaacatctcccagtgggcggattcacctatcccccgagtgcacaccccccgacacttccaccctctgcccccctccaattccttacccacgaccctttacatcaggaagtgagtttcggggtcccttatccgccttttatgcccagacggctgactgggaggtcgcgctatagaagccagcagcctattccaccacccccttatcatccctccctgcttccatacgtactttcaatgctgcccgtgccgccagccgtcgggcctacattcagctttgaactagatgtcgaagacggggaggtggagaactacgaagcactcctgaacctcgcagaacggctcggggaagcaaagccacgtggcctgaccaaggctgacatcgagcagctgccgagctatcggtttaacccgaacaaccaccaaagcgaacaaacactgtgtgtcgtgtgtatgtgcgattttgaatcgagacagctcctgagggtgttaccttgtaaccacgagttccatgccaaatgcgtcgataaatggctgaaggctaatagaacatgccctatctgccgtgccgatgcgtctgaagtgcaccgtgactctgagtag

SEQ ID NO: 133102 - DNA, 1263 bp, Artificial Sequence
  Description of Artificial Sequence: Synthetic coding sequence
atgtggtggcgcgacctgactcggttgcgcctgtggcttaaaagggaggccataccaggtgaaggaaggaaagctgcaaaagtgaatgccggtgtgggtgagaaaggcatttacaccgcttcctcccgcgggggccctccttccgcccgaagcaaagcagtgaccgttgtggccgagggggctgccagtcgttcctggctcagcatggacgcccctgaactggggccaggattggtcgagagactggagcaattagctacctgccccctttgtgggggcagctttgaagacccagttctcctggcctgtgaacattcattttgtcgcgcttgtcttgctaggcgctggggtacgccgccagccaccggtacagaagccagccctaccgcctgcccatgctgtggtctcccatgcccacggcgcagcctaagatcaaatgtaagactggctgtcgaggtgcgcatcagccgggagctccgtgagaaactggccgagccaggggctagagccggccgacgccgcggcggccgcataccaactatgggatgcctggatctgccaggcgaagacatgcggaagacctggaggcggtttgaggtgccaacttcgaagtcctcaaactctgaagatgacctgcccgaagattatccggtcgttaagaagatgctccacagactgacggccgacctgacgctggatccagggactgcacaccgcaggttgcttataagtgcagaccgccgatccgtccagcttgcaccacctggaacacctgccccaccagacgggcctaaacgattcgaccagcttcccgccgtattgggggctcagggcttcggtgccgggagacactgctgggaggtggaaactgccgacgctgcttcatgtcgagactcctcaggagaggatgccgacgacgaagaatcacactatgctgtgggggccgcaggcgaatctgtgcaacgcaagggttgcgttaggctctgccctgctggagctgtgtgggctgtagaaggaagaggaggccgattgtgggccttaacggctcccgaaccaacattgcttggtggagttgaaccgcccccaaggagaataagagtggacctcgactgggagcgcggtcgagtagccttttatgacgggcgttccctggacctgttgtatgccttccaggctccagggccgctgggcgagaggattttccctcttttttgcacctgcgacccacgcgccccactgcgcatcgtccctgctgaatcttag

SEQ ID NO: 133103 - DNA, 756 bp, Artificial Sequence
  Description of Artificial Sequence: Synthetic coding sequence
atgtggtggagggatcttactcgcttaaggctatggcttaagagggaagcaatcccaggtgagggcagaaaagcagcaaaagtgaacgccggcgtgggcgaaaagggcatttacacggcatcaagcaggggcgggccaccttctgccagaagtaaggcagtcaccgttgtcgcagagggagccgcgtctagaagctggttatccatggatgctcctgagctggggccggggctggtcgaacgcctggagcagctcgccacatgcccactgtgcggaggttcttttgaagaccccgtactcttagcctgcgagcattccttctgtagggcttgcttagcaaggaggtgggggacaccaccggccaccggaacggaagctagccctacagcttgtccctgttgcggtttaccttgcccccgaagatctctgcgcagtaacgtgcgcctggccgtcgaggtccgtatatctagagagcttctgttcgggggagggattccccactcctttctggggacccattcccatgcccattgccgaagcatcaatagcaatccccactttagacccaagatcatgagaccccacctggtctcaaccttcccacgcccatgtagtaagccgaacccatttctgccttctgggtcgcagaacctgctgtctcctacagccaccacggtcctacctgactttagccatagtaaccattctaggccagccatgggaaatagaccaagtcccagcgtcctggtcaaatag

SEQ ID NO: 133104 - DNA, 1065 bp, Artificial Sequence
  Description of Artificial Sequence: Synthetic coding sequence
atgtggtggagagatcttaccagactgcgactctggttgaagcgcgaggcaatacctggggaaggcagaaaggccgctaaggtgaacgcaggagtcggcgaaaaagggatttatactgcaagctctcggggagggccaccaagtgcccgttcaaaggccgttactgtggtggccgaaggggctgcatctaggtcttggctgtcgatggacgcaccagaactcggtcccggactggttgagcgtctagaacagctggcgacatgccctctgtgtggcggctcttttgaggacccagtcctccttgcatgcgaacattcattttgcagagcctgtctggcccggcggtggggtaccccacctgccaccggtacagaggcctcaccaaccgcctgcccctgctgcggactcccatgcccacggcgtagtttacggagtaatgtccgcctggccgtggaggtcaggatcagccgggaactgcgcgagaagctggctgaaccgggcgcccgggcaggtaggaggcgggggggaagaatccccaccatgggatgcctggatctccctggagaggatatgaggaagacctggcgccggtttgaagtgcctactcctaagtcctccaactcagaggacgacctccccgaagactatcctgtcgtgaaaaaaatgctccaccggttgacggctgacctgacattggatcctggcaccgcacatagacgactccttatttcgacagatagaagatcagtccagctggcacccccaggcacgcccgcgcctcctgatgggccaaagcggttcgatcagttacccgcagtgcttggcgcccaaggattcggagccggaagacactgctgggaggtcgaaacggcagacgctgcaagttgcagggatagcagcggcgaagacgaagacgacgaggaaagccactatgccgtcggagctgccggtgagtcagtgcaaaggaagggttgtgctcccggaccactcggggaacgaattttcccgctcttctgtacttgtgaccctagggcgccactgagaatcgtccccgcagagtcatag

SEQ ID NO: 133105 - DNA, 1065 bp, Artificial Sequence
  Description of Artificial Sequence: Synthetic coding sequence
atgtggtggcgcgatcttacccggttacggctctggctgaaacgggaggctataccgggggaagggcgcaaggcggcgaaggtgaatgccggcgtcggagagaagggcatctacactgccagcagccggggaggcccgccttctgctcgaagtaaggctgtgactgtggttgctgagggagccgcgtcacgttcgtggctgtccatggacgctccagagctaggacccggcctggttgagcgcctcgaacagctggctacctgccctttgtgtggtggctccttcgaggacccggtgctgttagcctgtgagcattccttctgtagagcttgtctggctaggcgatgggggactcccccagctacgggcactgaagcttctccaaccgcatgcccttgttgcggactgccctgcccaagaaggtcgctgagatcaaatgtaaggctggccgtggaggtacgcattagtagagagctgcgggagaaactcgcagagcctggggctagggctggacgacggcggggcggcagaatccccacaatgggctgcctggacttaccgggcgaagacatgcgtaagacatggaggagatttgaggtccctacgtctaaatccagcaatagcgaagatgatctccctgaggactacccagtggtgaaaaaaatgctgcataggctgactgctgacctcaccctcgatccaggtaccgctcacaggcgcctgctcatttcagctgaccgccggtctgtccagctcgcacctcccggcactcctgcaccacctgatggaccgaaaaggttcgatcagctccctgctgttctgggcgctcaggggtttggagccggtagacactgttgggaggtggagaccgccgacgctgcctcttgtcgtgacagtagcggggaggacgcggacgacgaagagtcacactatgccgtgggcgcagcaggggagagcgtccaaaggaagggctgcgccccagggcctctgggagagagaatctttcccctattctgtacatgtgaccccagagccccgctacggatagtgccagctgaaagttag

SEQ ID NO: 133106 - DNA, 1263 bp, Artificial Sequence
  Description of Artificial Sequence: Synthetic coding sequence
atgtggtggcgtgatttaacaaggctccgtctgtggctcaagagggaagcaattcctggggagggcagaaaggcagccaaggtgaacgcaggggtgggagaaaagggcatctatactgcttcaagtaggggcggcccaccatccgctaggagtaaagccgtgactgtagtggccgagggcgcagcctcaagaagctggctgagtatggacgcaccagaactcggcccagggctggtggagagactcgaacaattagccacctgcccactttgcgggggttccttcgaggatcccgtactcctggcttgcgagcattccttttgcagggcttgtcttgcaagacgctggggaactcccccagccaccggcacagaagcgtcaccaacagcgtgcccgtgctgcggccttccatgcccaaggcgttctctcagatctaacgtaaggctagccgtggaagtgagaatttcaagggaattgcgggaaaagcttgcagagcccggagctagagccgggcggcgtcgtgggggacgtatacccactatgggttgcttggacctgccaggcgaggatatgcgtaagacatggcgccggtttgaggttcccacccctaaatcctccaatagtgaggacgatctgcctgaggactatcccgtggtaaagaaaatgttgcaccggcttactgccgatctcaccctcgacccaggaacggctcacagacggctattgatatcaactgacagaaggtccgttcaacttgcaccccctggcactcctgcccctcccgatggccccaagagatttgaccagttaccagccgtgctcggggctcaagggttcggagcaggcaggcattgctgggaggtggaaacagcagacgcagcatcgtgcagagattctagtggtgaggacgaggacgacgaggagtcgcattatgccgtcggggcagcaggggaatccgtccagaggaagggttgcgttcgcctgtgtcctgccggtgccgtgtgggctgtagaaggccgggggggccgactgtgggccctgacggcccccgagcccacactgctgggaggcgttgagccaccccccagaaggatcagagtggacttggattgggagcgcggccgcgtcgcattttatgacgggagatctctggatctgctttacgccttccaggcccctggccccctaggggaaagaatctttcccctgttttgcacttgcgatcctcgggctcctctgaggattgtccctgcggaatcctag

SEQ ID NO: 133107 - DNA, 1065 bp, Artificial Sequence
  Description of Artificial Sequence: Synthetic coding sequence
atgtggtggcgcgacttaaccagactgaggttgtggctgaagcgggaagcaattcccggcgagggacgaaaagccgccaaggtcaatgcgggcgttggggagaaaggtatttacacggcttcctcccggggcggccctccttctgctcgctccaaagctgttactgtggtggcagaaggcgcggcctcccggtcatggttatcaatggacgcccctgagctggggccgggcctcgtggagagactcgagcagctggctacttgccccttatgtgggggttcctttgaagacccagtcttattggcttgcgaacacagcttttgccgcgcctgcctggcacgccggtgggggaccccacccgctaccggaaccgaggcctctcctacagcgtgtccatgctgcggactaccctgtccaaggcgatcactaagatctaatgtgcgcttagctgttgaggtaagaatatcaagagaactccgagagaagctcgccgaaccaggggctcgagctggtcggcgccgcggggggaggattcccactatgggctgcctggatttgcctggggaagatatgcgcaagacatggagaagatttgaggtacccacctcaaagagctcgaacagcgaggacgacctccccgaagactatcctgtggtaaaaaagatgttacatagattgaccgccgacctcacgctggatcctggcaccgcccatcgccggttgttgatttctgcagataggaggtcagtccagctcgctccacccgggacccctgctccccctgacggacctaagcggtttaaccaattgccagcggtactgggggcccagggattcggagcagggaggcactgctgggaggtcgaaactgctgatgcggcctcctgcagagacagtagcggagaagacgctgacgatgaagaatcccactacgctgtaggagctgccggggagtcggtgcagaggaaagggtgcgctccagggcctctgggagagcgaatctttcctttattttgcacctgcgatccgcgcgcccccctgaggatcgtgcctgcagaaagttag

SEQ ID NO: 133108 - DNA, 1263 bp, Artificial Sequence
  Description of Artificial Sequence: Synthetic coding sequence
atgtggtggcgagacctgacccgtctgcggctctggctcaaacgtgaggcaatcccaggtgagggaaggaaggccgctaaggtcaacgctggggtgggcgagaagggaatatacaccgcctcctccaggggcggaccgcctagtgcacgttctaaagcagttacagtcgtggccgagggggccgctagccgcagctggctctctatggatgcccctgagctgggacccgggctcgtcgaaaggctggaacagctggccacctgtcccttgtgtggagggagttttgaagatcccgtccttttggcttgcgaacattccttctgtagagcctgcctggcaagacgctggggcacgccgcccgcaaccggtactgaggctagccccacggcttgcccttgctgcgggctcccttgccctcggagatctctcagaagtaacgtccgactggctgtggaggttaggataagtcgggaactgagggaaaagttggccgaaccgggagcgcgagcgggtcggagaaggggaggccggattcctaccatgggctgtttggatctcccgggggaagacatgcgaaagacgtggcggagatttgaggtaccgaccagcaagagcagcaacagtgaagacgacttgcctgaggactacccagttgtcaaaaagatgctccatcgcctcacagcggacctcacgctcgaccccggcacagcacatagaagactgcttatctcagctgacaggaggagcgttcagctggcacctcccggcaccccagccccaccagacggcccaaaaaggtttgatcagctgcccgccgttttaggcgcacaagggttcggtgccgggagacattgttgggaggtggagacagccgacgctgccagctgcagggatagtagcggtgaggatgccgacgatgaagagtctcattacgccgtgggcgccgccggcgaatccgtccagaggaaaggttgtgtccgcctctgcccggccggggccgtttgggcagtgggagggaggggcggaagactgtgggctctcaccgctcctgagcccacgctgctcggtggagttgaaccaccgccgagacgtatccgtgtggatctcgactgggaacggggccgcgtggccttctacgatgggcgttctcttgatctgctatatgctttccaggcaccaggacccctgggagaacgtattttccctctgttctgcacatgcgacccaagggcacctcttagaatagtccctgccgagagctag

SEQ ID NO: 133109 - DNA, 1263 bp, Artificial Sequence
  Description of Artificial Sequence: Synthetic coding sequence
atgtggtggcgggatctgactcgactcagattgtggttaaagcgggaggctattcctggggagggtagaaaggccgccaaagtcaatgcaggtgtcggtgagaaaggtatctataccgcgtcctcccgtggaggacctccttccgcgcgttcaaaggctgtcaccgtagtggccgagggagcggcttctcggagctggttgtctatggatgctcctgagttgggcccaggcctggttgagcggctagagcagctggcaacttgccccttgtgcgggggtagtttcgaagaccctgttctgttagcttgcgagcattcattctgtcgcgcttgcctggctcggcggtggggcacacctccagcaacgggcaccgaagcgagccctacagcctgcccctgttgcggactcccttgtcctaggcggagtttgagaagcaatgtcagattggctgttgaggttagaataagccgcgaacttagagaaaagctcgccgagccaggcgccagggctggccggagacgcggcggccgcatacccacaatgggctgtctcgacctaccaggcgaggatatgaggaagacctggagacggtttgaggtgccaacctctaaaagtagcaattccgaagacgacttgccagaggattacccagtggtgaaaaagatgctgcaccgactaaccgccgacctcacgctagatcccggtacagcccaccgacgactgctcatttccgccgatcggagaagtgtgcagttagcaccacccggcactcctgcacccccggatggtcctaagcgcttcgatcagctgccagccgtactaggtgcgcagggttttggcgctggcaggcattgctgggaggtagagacagccgatgcggccagctgtcgcgactcgtctggagaagacgcagacgatgaggagtcccattatgctgtgggcgctgccggggaaagtgtccagaggaaaggttgcgtcaggctttgccccgcaggtgcagtatgggccgtggagggcagaggcggccgcttgtgggcgctgacggcccctgagcccactctgctcggtggcgttgaacctccgcctcgacgaatcagggtggatcttgattgggagagaggtcgggtcgctttttatgatggccggtctctcgacctcctttatgcctttcaggcccccggacctttaggagaaagaatcttccctctgttctgtacctgcgatccaagagcccctttgagaatcgtgcccgctgagtcatag

SEQ ID NO: 133110 - DNA, 1263 bp, Artificial Sequence
  Description of Artificial Sequence: Synthetic coding sequence
atgtggtggcgagatcttactcggctgcgcttgtggctcaagcgagaagccatccctggagaaggcaggaaagccgctaaagtaaatgctggcgttggtgagaagggtatatataccgccagttcgcgcggcgggccgccctctgcccgctctaaagccgtcactgttgttgccgaaggtgccgcaagtaggagctggttatcgatggatgctcctgagctgggaccaggactggtggagcgcctggagcagttggcaacttgccctctctgtgggggaagttttgaagaccccgtcctgctggcatgtgaacatagcttctgtcgcgcctgcctagctagacggtggggtacacctcctgcaaccggaacggaggcctctcccactgcctgtccctgttgtgggttgccgtgcccgcggcggagtcttagaagcaatgtcaggcttgctgtggaggttcggatctcccgcgaactccgggagaaattggccgagcccggcgccagagctgggcgaagacgcggtggtagaatccctacaatgggctgcctggacctgcctggggaagatatgaggaaaacctggcgaagattcgaggtccctactagcaaatccagcaactccgaggacgatttaccagaggattatccggtggttaaaaaaatgctgcatcgcctgactgcagatctcactttagaccccggcactgctcaccgtagactattgatctcagccgacaggcggagtgttcagctggctccccctggcactccagcgcccccagacgggcccaagcggttcgatcagctccctgccgtgctgggggcccagggcttcggcgcaggacgccattgctgggaagtagagacggccgacgccgcctcctgtcgagacagttctggcgaggatgctgacgacgaggagagtcactacgccgttggagcagctggggagagtgtacagcggaagggatgcgtgcgtttatgcccggctggtgcagtctgggccgttgaagggcgcggtggccggttgtgggcactgacagccccagaaccaactcttctcgggggcgttgaacccccacccagacgcataagagttgacttagattgggaacgaggtcgggtagctttttacgacggccggtccctggacctgctttacgcatttcaggcgccaggcccactcggtgagcgaatattcccgctcttctgcacctgcgacccaagggctccgctgagaatcgtgccagcggagagttag

SEQ ID NO: 133111 - DNA, 1065 bp, Artificial Sequence
  Description of Artificial Sequence: Synthetic coding sequence
atgtggtggagagacttgaccagactgagactgtggctcaagcgcgaggcgattcctggagaaggaaggaaagccgccaaggtaaatgcaggcgtgggtgaaaaaggaatctacacagcttcctcaagagggggacccccctcggccaggagtaaggccgtgactgtggtcgctgagggcgccgcatcacgatcttggctgagtatggatgctcccgagttagggcccgggttggttgagaggctggaacagttggcgacctgccccctgtgcggtggcagtttcgaggatcctgttttgctggcgtgcgagcattctttttgtcgcgcttgcctggccaggagatggggtacgcctcctgctacgggcactgaggcctcccctactgcatgcccctgctgtgggttgccttgtccacgacgctctctgagaagcaatgtgagactcgctgtggaagtgcgaatatctcgcgagctgagagaaaagttggccgagcctggggcccgggccggacggagacgagggggcagaattccaaccatgggctgtttggacctccccggcgaggatatgaggaaaacctggcggaggttcgaagttcccacctccaaaagtagcaattctgaagacgacttgccagaggattaccctgtggtgaaaaaaatgctgcatagacttacagccgatcttacactggaccctggaacagcgcaccggcgactcttaatctcggccgaccgaaggtctgttcagttggccccccctgggactccagccccccctgatggccctaagagattcgatcaacttcctgctgtcttaggagctcagggctttggtgccgggcgacactgttgggaggtggagacagctgatgcggcatcctgcagggatagctccggcgaggatgcagacgacgaagaaagtcattatgctgtgggggcagcgggtgagtccgtccagcgaaaagggtgtgcccccggacccttaggcgagcggatcttccctctcttctgcacctgcgatccccgtgcccccctgaggatcgtccccgccgagagttag

SEQ ID NO: 133112 - DNA, 1065 bp, Artificial Sequence
  Description of Artificial Sequence: Synthetic coding sequence
atgtggtggcgcgaccttacccggctgcgcctgtggctaaagcgagaggccatcccaggcgagggacgcaaagcagccaaagtcaatgcaggcgtaggagagaaaggcatttacaccgcaagcagccggggtgggcccccctcagcccgcagtaaagccgtcaccgtggttgccgagggagccgcctcccgcagctggctgagtatggatgcaccggagctcggcccaggactggtagaaagattagaacaactcgccacatgtcctctgtgcggcgggtccttcgaggaccccgtgctgcttgcttgtgaacattctttttgtcgcgcctgcttggcccggagatggggcactccaccagccacagggacagaggcctccccaaccgcctgcccctgttgcggactgccttgtcccagaagaagcctgaggtccaatgtgcggctggcagtggaggtcaggattagcagggaacttagggaaaagctagctgaacccggggcccgcgcaggaagacgcaggggcggccgaattcccaccatgggttgcctcgacttaccaggagaggacatgcggaaaacttggcggcggttcgaggtcccaacttcgaagtccagcaactcagaggatgacctccccgaggattatcctgtggtgaagaaaatgttgcatcgactcactgccgacttgaccctggaccccggaacagcccaccgccggttattgatttctgctgacagacggagcgtccagctcgctcccccaggcactcccgcacccccagacgggcctaagaggttcgaccaactgcccgcggtgttgggagcacaaggcttcggtgccggacgtcactgttgggaagtggaaaccgcagacgcggcttcatgcagggactctagcggagaagacgccgacgatgaggaatcacactacgccgttggggcagctggcgaatctgtccagcggaaaggctgtgcgcctgggccactgggcgaacggatctttccccttttctgtacatgcgatccacgcgcaccactcaggattgtgcctgcagaatcttag

SEQ ID NO: 133113 - DNA, 1065 bp, Artificial Sequence
  Description of Artificial Sequence: Synthetic coding sequence
atgtggtggagggacctgaccagacttcggttatggctaaaaagagaagcgatccctggggagggccgcaaggcagctaaagtcaacgctggggtcggtgagaaaggcatttacacagcgtcatctcgcggcggtccccctagcgcccgtagtaaagccgtgacggtagtggctgaaggagcagcctcccggagctggctaagcatggatgcacctgagctaggccctggtctagtagaaagactggagcagttagccacttgccctctctgtggcgggtctttcgaggatcctgtgctcttagcctgcgagcacagtttctgtagggcctgcttagctaggcggtggggcacaccaccggccactgggacggaggcctcgccaactgcctgcccttgctgtggacttccttgcccccggcgtagtttacgctccaatgtgaggctagcagtggaggttcgcatttccagggagctgagagagaagctggctgaacccggtgcccgggcgggtagaaggcgggggggccggatcccaacaatggggtgcctggacctacccggcgaagatatgcggaaaacatggagacgttttgaggtcccaactagtaagagttccaacagtgaagatgacctgccggaagactaccccgtagtcaaaaagatgttgcatcgcctgactgccgacttaacactggacccgggaactgcgcacagacggctgctcatctcggctgatcgtcgatcagtgcagttagctcccccaggaacgccggctcccccggatggcccaaaacgtttcgaccagctccctgctgtccttggagctcaagggttcggagcaggacggcattgctgggaggtggaaaccgccgacgcagctagctgccgggattcgagtggagaggacgcagacgatgaggagtctcactatgcggtaggcgctgccggtgaaagcgtccagcgtaagggctgtgcgcctggtcctctaggcgagagaatttttccgctcttttgtacatgtgatcctagggctcctctaagaatcgtacccgccgagtcctag

SEQ ID NO: 133114 - DNA, 1263 bp, Artificial Sequence
  Description of Artificial Sequence: Synthetic coding sequence
atgtggtggagagatttgactcgtctcagactgtggctgaagagagaagccatccccggcgaggggagaaaagctgcaaaagttaatgctggcgttggagagaagggcatctacaccgctagcagccgagggggacctcccagcgcacggtctaaggctgtcaccgttgtcgccgaaggagctgcctctagaagctggctgagcatggatgcacctgagctcggtcccggattggtggaaagactggagcaattagccacatgccctctgtgcgggggttcgttcgaggatcccgtcttgctggcctgcgagcactctttttgcagggcttgcttggctcgcagatggggcacccctccagctacaggcaccgaggcttccccgactgcgtgcccctgttgtgggctgccttgccccagaagaagcctacggagcaatgtgagactggccgttgaggtcaggatttcccgagagctccgggaaaagttggccgaaccaggagccagagccggccgccggaggggaggaagaatcccaaccatgggctgcttggatctgcctggcgaggacatgagaaagacttggcgacggttcgaggtgcctacctccaagagctcaaacagcgaagacgatcttcctgaagattacccagtagttaaaaaaatgctccaccggctaactgctgacttgacactcgacccgggaacagcacacaggagactgctgattagcgcagatcgccggagtgtccagctcgctccaccgggcacacccgcgcctcctgatggccctaagaggttcaaccaattgcctgctgttctaggcgcccagggatttggagctggcaggcattgctgggaagttgaaacagcagatgctgcctcttgccgggatagttctggagaagacgctgatgacgaagagagccactatgctgtgggcgctgcgggcgagtccgtacaacggaagggttgcgtgcggctgtgcccagcaggcgccgtgtgggccgtcgagggtcgaggtggacgtctgtgggctctcaccgctcctgaacctacactccttgggggggtggaacctcctcccagacggatccgagtggatctggactgggagaggggcagagtcgccttttacgacggaaggtctcttgacctgttgtatgctttccaggctccagggccgcttggagagcgaatctttccactgttttgcacctgtgaccctagagctcctctcagaatagtgcctgccgaatcctag

SEQ ID NO: 133115 - DNA, 1263 bp, Artificial Sequence
  Description of Artificial Sequence: Synthetic coding sequence
atgtggtggagagatctgacccgcctgagattatggctgaaacgagaggcaatacccggagaaggacgaaaggccgcgaaagtcaacgctggggttggggagaagggcatctataccgcatccagtagggggggacctccttccgcccggagcaaagccgtgactgtcgtggcagaaggggctgcttctcggagctggcttagcatggacgcacccgagttagggcctgggctggttgagaggctggaacagctcgcaacctgccccctgtgtggtggctctttcgaggatcctgtcctgctcgcctgtgaacactcgttttgtagggcatgcctggcccggcgatgggggacgccacctgctacaggaactgaagcaagtccaaccgcgtgtccttgttgtgggctcccatgtcctaggaggagcctcaggtccaacgtgcggcttgccgtggaagttcgaatttcccgggaattacgggaaaagttggctgaacctggtgctagagccgggagaagacgcggcggaagaattcccaccatgggatgtcttgacttgcctggcgaagacatgcgtaaaacctggaggcgttttgaagtgcccacttccaagagctctaattccgaggatgaccttccagaagattaccccgtcgtgaagaagatgcttcatcggttgacggccgatcttaccctcgacccaggtaccgcccacaggcgtcttttaatctccgctgacagacggagcgtgcaattagcaccacccggaaccccagcaccccctgacggccccaagcgcttcgatcagttgccggcagttctaggggcccagggctttggggctggcaggcattgttgggaagtcgagaccgcagacgccgccagctgtagagattcatccggggaggacgctgatgatgaggaaagccattacgcagtaggggctgctggggagtcagtacagagaaaagggtgcgtaaggctttgcccggccggggccgtgtgggctgttgaaggtcggggtgggcgactgtgggccctgacagcgcccgaacctaccctgctaggaggcgtcgagccgccaccacgtaggattagggtggatctagactgggagaggggtcgagtggctttttacgacggccggtccttagatttactctacgccttccaggcacccggtcccttgggcgaacgcatctttcccctcttctgtacttgtgaccctagggcgcctctcaggatcgtgccagcagaaagctag

SEQ ID NO: 133116 - DNA, 1065 bp, Artificial Sequence
  Description of Artificial Sequence: Synthetic coding sequence
atgtggtggcgtgacttgaccagactccgtctgtggctgaagagggaagccatacctggcgaggggaggaaagccgcgaaggtcaatgccggggtgggagaaaaaggcatctacaccgcaagcagcaggggaggcccacccagcgcccggtccaaagctgtgaccgtagtcgcggagggtgctgctagcagatcttggttgagtatggatgcccccgagctcgggccaggactggttgaacgccttgagcagcttgcgacatgccccctgtgcggtggatcttttgaagaccccgtccttcttgcctgcgaacactccttttgtcgagcgtgcttggcaagaaggtgggggactcctcccgccactggcacagaagcatcccctaccgcctgcccatgctgcggcctgccctgccccaggagaagcttacggagcaatgtgcgcctagcggttgaagttaggatatctagagagctgcgcgaaaagctggctgagcccggagctagagctggacggcgcaggggaggcaggattcccacaatggggtgccttgatctgcctggagaggacatgcgcaagacctggcggcggtttgaagtcccaacttctaagagcagcaatagcgaggacgacttgcctgaggactaccccgtggtgaagaaaatgctgcataggctgacggctgatttgaccctggatcctggaaccgctcatcgcagactcttgatcagcgccgatcggcgatctgtgcagcttgctccgcctggtacacctgcgccccctgacggaccaaagaggtttgaccagctccccgccgtattaggtgctcagggctttggagcgggccggcactgttgggaggttgaaaccgccgacgcagcgagctgtagagacagctctggcgaagatgctgatgacgaagagagccattacgccgttggggccgcaggcgagtctgtgcagagaaaaggatgtgcccctggtcctctgggggagcgcatcttccctctgttttgtacgtgcgatcccagggccccgctgagaatcgtgccggctgaatcctag

SEQ ID NO: 133117 - DNA, 1263 bp, Artificial Sequence
  Description of Artificial Sequence: Synthetic coding sequence
atgtggtggagggatttgacccgactccgactttggttgaaacgggaagccatacctggcgagggccggaaggccgctaaagtgaatgctggcgtcggcgaaaaagggatttatacggcatcctcccgtggcggcccaccttccgcaaggtccaaagcagtcacggtcgtagccgagggcgctgcatcccggagttggctgagcatggacgcacccgagcttggccccggcctggtggaaaggctggagcagctcgccacctgcccgctgtgtggtggctcatttgaagatccggttctgctggcatgcgaacattccttctgcagggcatgcttggctaggagatgggggacccctcccgctaccggaaccgaagcctcacccaccgcctgtccctgttgcgggcttccctgccccagacgatctcttagatctaacgttaggctggctgtcgaagtgcggatttcccgggaattaagagagaagctcgcagaaccaggcgctcgggccggccgcagaaggggcggccgaatccccaccatgggatgcttggatctgccaggggaggacatgaggaaaacatggcggcgttttgaggtccccacttcaaagagttctaactcggaagatgacctgcccgaggactatcctgtggtcaagaagatgctgcaccgacttaccgccgacttaaccctggatcccggaactgcccatcgtaggctgctcatctcagctgatcgtcggtctgtccagttggccccccccgggacgcctgccccgcctgatggcccgaagcgcttcgatcagctcccggccgtgctcggtgcccaaggattcggggcggggcggcactgctgggaagtcgagactgccgatgcagctagctgccgggatagctctggtgaggatgcagatgacgaggaatctcactatgctgtaggagcagccggggaatccgttcagagaaagggctgtgttaggctgtgtcccgccggtgccgtatgggctgtagaggggcgcgggggacgtctttgggcactgactgcccccgaacccacattattgggcggtgttgagccccctcccaggcggattcgggttgaccttgactgggaacgcggtagagtggcattttacgacggacggagcctcgatctgctgtacgcgtttcaggccccaggccctcttggcgagagaatcttcccattattctgtacctgtgaccctcgagcccccctccgtattgttcctgctgaatcatag

SEQ ID NO: 133118 - DNA, 1065 bp, Artificial Sequence
  Description of Artificial Sequence: Synthetic coding sequence
atgtggtggcgagacttgacccgtctccgactttggctcaaacgtgaggccatccccggtgagggacgcaaggctgccaaagtgaacgccggggtaggagagaagggtatatacacagcatcctctagaggaggtcctccaagcgctcgaagcaaggccgtcacagtcgtagcagaaggagctgcaagcaggagttggttatcaatggatgcccccgaactcgggccaggcctcgtagagagactggagcagctggccacctgtccgctgtgtggcggaagcttcgaggatcccgtacttttagcgtgtgagcactccttctgtcgtgcctgtttagcacgcagatggggcacaccccccgcaacaggcacagaagcctcccccacagcctgcccctgttgcggtctcccctgtcctcgtagaagccttagatccaatgtccggctggctgtggaagttcgaatcagcagagagctgcgagaaaaattagccgagccgggcgctcgagccggaaggcgacgcggaggtcggattcccaccatgggatgtctggatctgcccggcgaggacatgcgaaaaacctggcggcgcttcgaagtgcctactagtaagtcctcaaattcggaagacgatcttccagaggactaccccgttgtcaagaaaatgctccaccgactgacagccgatctgacactggaccccggcaccgcccaccgacgcctcttgattagcgccgacagacgcagcgtccaacttgcccctccggggacgcctgcgccccctgacggtcccaaacggtttgaccagctgcccgctgtgctgggtgcccagggatttggcgccggccgccattgctgggaagtcgagacagccgatgccgcctcttgtcgtgattcttcaggcgaagatgccgacgacgaggaatcccactacgctgtgggggcagccggggagagtgtgcagcgcaaggggtgtgcccctggccctcttggtgagcgcatcttcccgctgttttgcacgtgcgatccaagggcccccctgcggatcgttccggcagagagctag

SEQ ID NO: 133119 - DNA, 756 bp, Artificial Sequence
  Description of Artificial Sequence: Synthetic coding sequence
atgtggtggagagatttaactcgtctaagactttggctcaagcgagaggcaatacctggggaaggacgcaaggcggccaaggtgaacgcaggagtcggtgaaaaaggtatttacacagcatcaagccgcggcgggcctccaagtgccagaagtaaggccgtgactgtggtggctgaaggggcagccagccgctcctggttgagcatggatgcaccagagcttggacctggtttggtagaacggttggagcagttggccacctgtcccctatgcgggggctcattcgaagaccccgtgcttctcgcctgcgaacactcattctgccgagcatgccttgcgagacggtggggcactccacctgctactggtacagaggccagtcctaccgcttgcccctgctgcggtctgccctgccccagacggtctctcaggagcaatgtccggctggctgttgaggttcgcatttctcgcgaattactttttggaggtggtattccccatagcttcctgggcactcattcacatgcgcactgtcgttctattaattccaatcctcatttcagacccaagatcatgcgtccacacctagtctctaccttccctagaccctgctctaagccaaacccttttttgccaagcggtagtcagaatctgttgagccccaccgccaccacagttctgccagattttagccactctaaccacagcagacccgcaatgggtaatagaccctctccctcggtcttagttaaatag

SEQ ID NO: 133120 - DNA, 756 bp, Artificial Sequence
  Description of Artificial Sequence: Synthetic coding sequence
atgtggtggagggacctcacaagactcagattgtggctcaaacgagaagctattccaggggaaggacgcaaggccgcaaaagtcaacgccggagtgggcgagaaaggcatctatacggctagctcccgtgggggccctccatccgcacgcagcaaggctgttacagtcgtcgctgagggcgcagcttcacgctcatggctgtccatggacgcgcccgagctcggtcctggccttgtagaacgtcttgagcagctggcaacatgtcccttgtgtggggggagcttcgaggatcccgtgctgcttgcctgtgagcattcgttttgtagagcatgtctggcccggagatggggtacgccccctgcaaccggcacggaggcatctcctactgcctgcccatgctgcggacttccttgccctcgtcggtcacttcgctctaatgtgcgcctggctgttgaagtcagaatctctagagagctgctctttggtggcggcatccctcactcttttcttgggacccattctcacgcgcattgcagaagtatcaactccaatccccattttcgtccaaaaatcatgcgaccccaccttgtcagcactttcccccgcccttgcagcaaacccaatcccttccttccgagtggcagccaaaacctcctgtcaccaacagcaaccaccgtcctgccagactttagccacagcaaccactcaagaccagccatgggaaatagaccttccccatctgtcctagttaagtag

SEQ ID NO: 133121 - DNA, 756 bp, Artificial Sequence
  Description of Artificial Sequence: Synthetic coding sequence
atgtggtggagagatctgacgcgactcaggctctggctgaagcgcgaggccatccccggagaaggcagaaaggctgctaaggtaaatgccggcgtcggggaaaaagggatctatactgcgagttctagaggaggcccaccctcggccaggtcgaaggctgtgacagtggtggccgagggagccgcaagccggtcatggctctctatggatgcccctgagcttggtcctgggctggtcgagcggctggaacagcttgcaacctgccccctgtgcggcggttcttttgaagatcctgtgctgcttgcttgtgaacacagcttttgtcgagcttgcttggcaaggcgctggggtaccccccctgctactggtaccgaagcgtctcccaccgcctgtccttgttgcggcctcccctgtcccagaagaagcctgcgatcgaatgtcagactagccgtggaggtgcgcatatctcgggagcttctgtttggcgggggaattccacattccttcctcggaactcactcacatgcccattgcagaagcatcaactctaatccccactttcgccctaagataatgcgaccacatctggtgtcaacgtttcctaggccatgtagtaaacctaatcccttcctcccgagcggatctcaaaatcttcttagtccgaccgccacaaccgtcctacccgatttttcgcactccaaccactccaggcctgccatgggtaacaggccaagtccctcagtgcttgtgaaatag

SEQ ID NO: 133122 - DNA, 756 bp, Artificial Sequence
  Description of Artificial Sequence: Synthetic coding sequence
atgtggtggagagatttgacacggcttagattgtggttgaaaagagaagcgatccctggagaggggcgaaaggccgcgaaggtgaatgcaggtgtgggggagaaggggatttacaccgcctccagcaggggcggtccaccatcagctagatctaaggcagtcactgttgtggcagagggggccgccagccgttcttggttgagcatggacgcacccgagctcggtccaggactggtcgagaggctcgagcagttggcgacatgccctctgtgtggaggaagcttcgaggatccggtcctgctcgcctgcgaacactctttttgtcgggcctgtcttgcaaggagatgggggactccccccgcaacagggaccgaggcctctccaactgcctgcccatgctgtggtctcccctgccccagacggagtctccggagtaacgtccggctggcagttgaagtgcggatttctcgcgaactactgttcgggggcgggataccgcacagctttctggggacccactctcacgcccattgtcgatctattaactctaacccgcattttcgcccaaagatcatgcgcccacatctcgtttctaccttcccaaggccctgtagcaagccaaatccgttcttgccatccggcagtcaaaacctactgtctcccacggccaccactgtactaccggatttttcacactcaaaccatagcaggccggcgatgggaaatcgacccagtccttcagtgctggtgaaatag

SEQ ID NO: 133123 - DNA, 756 bp, Artificial Sequence
  Description of Artificial Sequence: Synthetic coding sequence
atgtggtggcgggacctcactagattaagactctggctaaagagagaagccattcctggcgagggacggaaagccgccaaggtcaacgcgggcgtgggtgagaaaggaatctacacggcctcaagtcgaggtggtcctccaagcgcccgcagtaaggcagtaacggtagtagcagagggtgccgccagtcgctcttggctaagcatggacgcccctgaactagggccgggactggtggagaggttggaacagctcgccacctgtccgttgtgtggtggcagcttcgaggatcctgtcctcctcgcgtgtgagcactcattttgtcgtgcttgtctcgctaggagatggggcactcctccagctacgggaactgaagctagtccgacagcttgcccatgctgcggtctcccatgcccccgccgctccttgcgctccaatgtgagactggctgtggaggtgcgcatttctcgcgaactgctattcggaggcgggattccacactcgtttcttggtacgcatagccatgcccactgcagatccatcaacagtaacccccattttaggcctaagatcatgaggcctcacttggtctctaccttcccacggccttgcagtaagcctaacccctttctgccgagcggtagccagaatctactgtccccaaccgccaccacagtgctgccagacttctcccactccaatcactctcggccggctatgggtaatagacccagtccctctgttctcgttaagtag

SEQ ID NO: 133124 - DNA, 756 bp, Artificial Sequence
  Description of Artificial Sequence: Synthetic coding sequence
atgtggtggagagatctgacccgactgaggctttggctgaaaagggaggccatcccgggtgagggccgcaaggcggcaaaagtcaatgccggtgtcggcgagaaaggaatttatactgcctcaagtagaggtggccctccctctgcgcggtctaaagcagttaccgtggtggctgagggcgcggcctctcgatcctggctttcaatggatgcacctgagctgggacccggtctcgtcgaaaggttagaacagctcgccacctgtcctctgtgtggtggctcgttcgaggaccctgttttgctggcatgtgaacacagtttttgcagggcatgcctcgctagacgttgggggacgcccccagccaccggaacagaagctagtccaaccgcatgcccttgctgcggcttgccttgtcctcgcagaagtctgaggtcaaatgtgcggcttgctgttgaagtacggatttcacgcgaattactgtttggcggtggaatcccacattcttttctgggtactcactcccacgcacactgcaggtccatcaactccaatccccatttccgccccaagatcatgcgtccccaccttgtcagtacattcccgaggccttgcagcaaacccaatccctttctaccctctggttcccaaaatctgctctcacctaccgctgctacagtcctacctgacttcagccacagtaaccattctaggcccgccatgggtaatcggccttctccaagcgtcttggtaaagtag

SEQ ID NO: 133125 - DNA, 756 bp, Artificial Sequence
  Description of Artificial Sequence: Synthetic coding sequence
atgtggtggagagatctcacccggctgaggctctggctaaagcgcgaggcgattccaggtgagggacgcaaagccgccaaagttaacgcaggcgtaggtgagaagggaatctacactgcaagttctaggggtggcccgcccagtgcaagatctaaagcggtgacagtggtcgctgagggggcagcaagccgaagttggttatctatggatgcacccgagctagggcccggccttgtcgaaagactggagcaactggccacatgtcctttatgcggcggaagcttcgaggacccggtgctgcttgcctgcgagcattctttttgcagggcttgcttggccaggcggtggggaaccccccctgcaaccggcactgaagcgagcccgactgcctgtccatgttgcggattgccgtgtcctagaaggagtctccgcagcaacgtccgactagccgtggaagtccgcatctctcgggagcttctgtttggtaggggcatcccacactctttcctcggcacacactcacatgcacactgcaggtccatcaattctaacccacactttcgacctaagatcatgcggccccatcttgtgagcactttcccacacccatgcagcaaaccaaatccatttttgccgagcggcagtcaaaatcttctgagccctactgccacaaccgtattgcctgactttagtcactctaaccacagtagacccgccatgggcaaccgaccatctccatctgttctggttaaatag

SEQ ID NO: 133126 - DNA, 573 bp, Artificial Sequence
  Description of Artificial Sequence: Synthetic coding sequence
atgagcactagaaaaagacgagggggcgcaatcaactccaggcaagcccagaaaagaacccgtgaagcaacctcaactcccgagatcagcctggaggcagaaccaattgagctcgtagagaccgccggcgacgagatcgtcgacttgacctgcgagagcctcgagccagttgtcgtggacctgacacacaatgactccgtggttatcgttgacgagcggcggcgcccacgcaggaatgcaagaaggcttccacaggaccacgccgacagttgtgtggtgtcttctgacgatgaagaactatcaagagatcgagatgtttacgtgacaactcacactccccgcaacgcaagagacgagggcgccactggcttgcgacctagtggcacagtgtcttgccccatttgtatggatgggtactcagagatcgtccaaaacgggaggctgatagtttcaacagagtgtgggcacgtgttctgtagccagtgcctgcgggactccctgaagaatgctaacacctgtccaacatgtcgcaagaagatcaaccataagaggtaccatccaatatacatttag

SEQ ID NO: 133127 - DNA, 18 bp, Artificial Sequence
  Description of Artificial Sequence: Synthetic coding sequence
atgtctacgagaaaatag

SEQ ID NO: 133128 - DNA, 573 bp, Artificial Sequence
  Description of Artificial Sequence: Synthetic coding sequence
atgtcaacacgtaaacgaagaggcggagcaatcaatagccgacaagcacagaagcgcacccgggaagccactagtacacccgagatttctctggaagctgagcccattgaactcgtcgagactgctggggacgaaattgtcgacctgacgtgtgagtcacttgagcctgtcgttgtggacctgacccataatgacagcgttgtgattgtggacgagcgccgcagacccagacgcaacgcacgccgactccctcaagaccacgccgattcgtgtgtcgtgagctcggacgatgaagagctgtcaagagacagagatgtgtatgtcacgacgcatacacccagaaatgccagagacgagggcgctaccggactgagaccaagtggtactgtgagctgtcctatttgcatggatggctattcagagatagtgcaaaatggccgactgatcgtcagcacagaatgtggccacgtgttctgcagccagtgcctgcgagatagcctcaaaaatgccaacacatgcccgacgtgtcggaaaaaaatcaatcacaagaggtatcatcctatctacatctag

SEQ ID NO: 133129 - DNA, 573 bp, Artificial Sequence
  Description of Artificial Sequence: Synthetic coding sequence
atgtccacgcggaaaaggcgagggggagcaattaattccagacaagcccagaagcgcacgcgggaagccacaagcactcccgagatctccctcgaggcagagccaatcgaattagtggaaaccgctggcgatgagatcgtggacctgacttgtgaaagcctggagcctgtggtggtagacctgacccacaatgatagcgttgtcatcgttgacgaacgtagacgccctcgtcggaacgcccgtaggctcccccaggaccacgcggactcctgcgtcgtctctagtgatgacgaagagctgagccgggaccgggacgtttatgtgacgactcacactccccgcaatgctcgggatgagggagccacaggactccggccctccgggaccgtctcttgcccgatctgcatggatggctattcggagatcgtccaaaacggacggctgattgtgtcaactgagtgtggacatgtgttctgctctcagtgccttcgcgatagtttgaagaatgccaacacttgccccacatgtcgcaagaagattaatcacaagagatatcatccaatttatatctag

SEQ ID NO: 133130 - DNA, 165 bp, Artificial Sequence
  Description of Artificial Sequence: Synthetic coding sequence
atgtcaactaggaaaaggcgtggaggtgcgatcaacagtcggcaggcacagaaacgtactagagaagccacttccacgcccgagatttcactggaagctgagcctatcgaactggtcgagaccgctggtgatgaaatcgtcgatttaacctgcgaatctctgtag

SEQ ID NO: 133131 - DNA, 345 bp, Artificial Sequence
  Description of Artificial Sequence: Synthetic coding sequence
atgtctacccggaaaagacgggggggtgccataaactcacggcaggcccaaaaacgtacacgggaagctacatctaccccggaaatatccctcgaagcggaacctatcgagctcgtggaaacagcaggcgatgaaatcgtcgaccttacctgtgagtcactggagcccgttgtggtcgatctcactcacaatgattctgtcgttgtatccgtgggcgtcccacaggtgctgtccgtcgtcccgtcagcttggaccgacacccaaagatcatgccgtatggacgtttcatcttttccccaaaatgccgcaatgtctagtgtcgcttctgcaagcgtgatcccttag

SEQ ID NO: 133132 - DNA, 573 bp, Artificial Sequence
  Description of Artificial Sequence: Synthetic coding sequence
atgagtacacgaaaacgacgggggggagcgatcaattcaagacaggctcagaaaaggacaagggaagccacctctacacccgagatcagcttagaagcggagcctattgagcttgtggaaaccgctggcgacgagatcgtagatctgacatgtgaaagcctcgagcccgtggtggtggatctcacccataacgattctgttgtcgtgtctgacgaacggaggagaccacgccgcaacgctcgtagactaccacaggaccacgctgactcatgcgtggtatccagcgatgacgaggaactgagcagagatagagatgtgtacgttaccacccacactccacggaatgctcgggacgaaggtgcaaccgggctgcggccctcagggactgtcagttgtcctatctgcatggatggctactcagagatagtgcagaacgggagattgattgtatccactgagtgcggacatgtattttgttcccagtgcctgagagactcccttaaaaatgcgaatacgtgcccgacgtgccgcaagaaaattaaccacaaaaggtatcatccaatctacatttag

SEQ ID NO: 133133 - DNA, 342 bp, Artificial Sequence
  Description of Artificial Sequence: Synthetic coding sequence
atgtccacgcggaaacggcgggggggagctattaatagtagacaggctcagaaacggacacgtgaggctacgtctacaccggaaatctccttggaggctgaacctatagagctggtggagactgccggtgacgaaatcgtcgacttaacatgcgagtctctggagcctgtggtcgtggacctgacccataatgattcagtggttatcgtcgacggtccacaggttctctccgtggtcccatccgcttggacagatacccagaggtcttgtcgcatggacgtctccagcttcccccaaaatgctgctatgagtagcgtggcttcggcctccgtgataccatag

SEQ ID NO: 133134 - DNA, 2352 bp, Artificial Sequence
  Description of Artificial Sequence: Synthetic coding sequence
atgtcaggcggccatcagttgcagttggccgccctgtggccctggctgcttatggcaacgttgcaggccggctttggacgcaccggattggtacttgcagccgccgtcgaatctgagagaagtgccgaacaaaaagcgatcattagagtgatcccattaaagatggatcccactgggaaactgaacctgaccctggagggcgtcttcgcaggggtggcagaaataacacccgccgaggggaaactgatgcagtctcaccccctgtacctgtgcaacgcttctgacgatgataacctggagcctggattcattagcatcgtgaagctggagagcccacggagagcacctcggccttgtctgtcgctggcgtcaaaggctcggatggcaggcgagaggggcgcttccgccgttctgttcgacattactgaggatcgcgctgccgctgagcagctacagcagcctctgggactcacctggcctgttgtcctgatctgggggaacgatgcagagaaactcatggaattcgtgtataaaaaccagaaagcccacgtcaggatcgagttgaaggagcctcctgcgtggccagattatgacgtgtggattctgatgacagtcgtggggactatctttgtcattatcctggcgtctgtgcttaggatccgatgtcggcccaggcacagtagacccgacccccttcaacagcgcacagcctgggccatctcgcagctggcaactagacgataccaagcctcctgtcgccaggcgcggggtgagtggcctgactctggaagcagttgttcatcagcccccgtgtgtgccatctgcttggaggaatttagcgaagggcaggagctccgcgtgatttcatgtctgcacgaattccatcgtaactgcgtggacccttggttgcaccagcatcgaacctgtcccctatgcatgtttaatatcacggagggggattctttcagccagtctctcggacccagccggtcatatcaagagccaggacggagactgcacctgatacgccagcaccccggccatgcccattatcatttgcccgcagcctatctattgggaccgagtagatcagccgtagctcggccgccaagacctggtccatttctgccatctcaggaaccagggatgggccccaggcaccaccgattccctcgcgctgcgcacccaagagctccgggtgaacagcagcgcctggcaggcgctcagcatccctacgcccagggttggggtctgtcacatctacagtccacctcacagcatcccgccgcgtgtcccgtcccactgaggagggcgcgcccaccagactcttctgggagtggggagtcatactgtacagagcgcagcggttacttagctgacggacccgcaagtgattcaagcagtggtccatgccacggttcctccagtgactcagtggtcaactgcaccgacatttctcttcagggcgtgcacggttccagttctactttttgcagcagtttgagttctgattttgatcctttggtctattgctcccccaaaggggatcctcagcgggtggacatgcaaccatcagttacatcacggcccaggtccctggatagcgtggttcctactggagagactcaggtcagcagccacgtgcactaccatcggcacaggcaccatcactacaagaagcggttccagtggcatggtaggaagccgggcccagaaaccggggtgccccagagtagaccccctatcccacgtacacagcctcagcctgagcctccatctcccgatcagcaagtgaccagatccaattccgctgctcccagcgggcgtctgagcaatccccagtgccctagggcactccccgagccagcaccaggcccagttgatgccagcagtatatgtccttctacaagttctctgtttaatctgcagaagagctcactttcagccagacatcctcagaggaagcgtaggggcggaccctctgaacccactccaggctcaaggccacaggacgccacagttcatcccgcctgtcagatcttccctcattatactccaagcgtggcatacccctggagccccgaggctcatcctctcatttgcggcccacccggtcttgacaagaggctcctgcctgagacgccagggccatgctactccaacagccagccagtctggttgtgcctgaccccccgtcagcccttggagccacatcccccgggggaaggacccagcgagtggtcatcggacaccgctgaaggccgaccatgcccctaccctcactgtcaggtgctctcagcacagccaggcagtgaggaagaactagaggaactctgcgagcaggctgtttag

SEQ ID NO: 133135 - DNA, 2229 bp, Artificial Sequence
  Description of Artificial Sequence: Synthetic coding sequence
atgtcagggggccaccagctccagctagcggccctttggccatggttgctaatggctactcttcaggccggattcggtagaacgggtctcgtgctggctgccgcggtcgaaagcgagcgttcggctgagcagaaggccataattcgggtcatccctcttaaaatggatcccaccgggaagttgaatcttacactggagggggtctttgctggcgtggcagaaatcactcccgcagagggcaagctcatgcaggctcggatggcaggcgagcggggtgctagcgcggtgttattcgatataacagaagatagggccgccgccgaacagctgcaacagcctctggggttaacctggccagtagtcctgatatggggaaacgacgcagagaaattaatggagtttgtctataagaatcagaaggcccatgtgaggatcgagttgaaggaaccgccagcctggcccgactacgatgtgtggattctgatgactgtcgtgggaaccatcttcgtgataatactagcgtccgtgctacggattcggtgtaggcccaggcattccaggcccgacccattacagcagagaaccgcctgggcaatatctcagctggctactagacgctatcaggcaagttgccgtcaagcccggggtgaatggccagattccggcagcagctgttcaagcgccccagtatgcgctatctgcctggaggaatttagtgaaggtcaggagttgcgggtgatcagctgcctgcacgagttccaccgcaactgcgtggatccttggcttcaccagcatagaacatgcccactatgcatgttcaacatcaccgaaggggactccttcagtcagtcactggggccctctaggagctatcaggagcctggccgccgactccacttgatcaggcagcatcctggacacgctcactatcatcttccagccgcctacttgctaggtccaagcagaagcgccgtcgccaggcccccacggcccggacctttcctcccatcccaagaacctggaatgggaccgagacatcacagattccctcgggccgcgcatcccagggccccaggcgaacagcaaagattagctggcgctcaacacccctacgcccagggatggggattgtctcacctgcaaagtacctcgcaacatccagctgcctgcccagtgccgctacgccgggcaagaccccctgatagctcaggatcaggggagagttactgtaccgaacgctccgggtacttggcagacggccctgctagtgacagcagttcggggccgtgccacggctcttcttcagactctgtggtgaactgtacagatatcagcttgcagggtgtccatggctcctcttctacgttctgcagctctctcagttctgatttcgatccattagtatattgtagtcccaagggcgaccctcaacgagtcgatatgcagcctagtgttaccagcaggcctcggtctctcgatagcgtggtgcccacaggggagacccaggtttctagtcacgtccattatcaccggcatcgccaccatcattataagaagcggttccagtggcatggtcgtaagccaggccctgagactggtgtcccccagtcccgccctcctataccacggacccagccacaaccggagccgccaagccccgaccagcaggtgacacgatctaactccgctgctccatctggacggctgtcaaatccccagtgtccgagagccctgccagaaccagcacccggacccgtcgacgcatcctccatttgtcccagtacgtcttccttgttcaatctgcagaaatcaagcttgagtgctagacatccacagaggaagagacgcggaggacccagtgagcccacaccaggttcccgaccgcaggacgctactgtccaccccgcatgtcagatctttcctcactacaccccttcagtagcttatccatggagccccgaggcacatcccctcatttgcggccctcctggactggacaaacgcctgctgcctgaaactccagggccttgctattctaactcgcagcctgtatggctgtgtctgaccccaagacaacccctggagcctcatcctcccggggagggccctagcgagtggagctcagatactgccgaaggccgaccttgcccttaccctcattgtcaggtgctgtccgcccaaccaggcagtgaagaagagctggaagagctctgtgaacaggcagtctag

SEQ ID NO: 133136 - DNA, 543 bp, Artificial Sequence
  Description of Artificial Sequence: Synthetic coding sequence
atggccgctgctgaggaggaagacggggggcccgaggggccgaacagggagagggggggcgccggggccacatttgaatgcaatatctgcttggaaaccgctcgcgaggctgtagtctctgtttgcgggcacctgtactgctggccctgcctgcaccagtggctggaaactagacccgagcgtcaagagtgtcctgtttgtaaagccggaatcagtagagagaaggtggtgcccctatatggcagaggtagtcagaagccccaggacccacgactaaaaacccctccgagacctcagggacagcgcccggcacctgagtcccgcggcggatttcaaccgtttggagacaccggaggatttcatttctccttcggagtgggcgctttcccctttgggtttttcacaaccgtgtttaacgcccatgaacctttccgtcgcggcacaggggtcgatctgggccagggccatccagcctcatcttggcaggacagcctgttcctttttcttgcaatattctttttcttttggctcctgtctatctag

SEQ ID NO: 133137 - DNA, 543 bp, Artificial Sequence
  Description of Artificial Sequence: Synthetic coding sequence
atggccgccgctgaggaggaagatggcggtcccgaggggcctaacagggagcgagggggagcaggcgcaacgtttgaatgtaatatttgtttagaaacagctcgcgaggcagtggtctcggtgtgtggccatctctattgctggccctgtcttcatcagtggttagaaacccgccctgagcgccaggaatgtcccgtctgtaaagctggaattagtcgcgagaaagtcgttcccctctatggacgcggatctcagaagccccaagatccccgacttaagacccctcccaggccccagggtcagcggccagcccccgagagccgagggggattccagccctttggcgatacaggcggattccacttcagttttggggtgggggccttcccattcggctttttcaccaccgtgttcaatgctcacgagccctttagacggggaaccggcgtggaccttggccaagggcatcccgcaagttcatggcaggatagcctcttcctcttccttgctatatttttcttcttctggctattgagtatttag

SEQ ID NO: 133138 - DNA, 549 bp, Artificial Sequence
  Description of Artificial Sequence: Synthetic coding sequence
atggcagccgcagaggaagaagatggcgggccagaggggcccaaccgtgagaggggaggagcgggagccaccttcgagtgtaacatctgcctggaaacggcccgcgaggcggtcgttagtgtctgcggccacttgtattgttggccctgcttgcatcaatggctggagacgcgccccgaaagacaggaatgccctgtttgcaaggcagggatctctcgcgagaaagttgttcctctatatggtagaggtagccagaaaccccaggaccctcgactgaagacccccccacgaccacaaggtcagcgacctgcccctgaatcacgcggtgggttccagccatttggggatacagggggcttccacttctcgttcggtgtgggggcctttccattcggatttttcaccactgtgtttaatgcccacgaaccctttcggaggggcactgggccattctctacttccccagcatttttccactacctgatcggaaataccagcagggaatttcgcggtaggatctataacttctggttgccccgcaacctgtag

SEQ ID NO: 133139 - DNA, 543 bp, Artificial Sequence
  Description of Artificial Sequence: Synthetic coding sequence
atggcggccgccgaagaggaggacggtggccctgaaggacctaacagggagaggggaggtgcaggcgctacatttgagtgcaatatctgccttgagacggctcgggaggccgtcgtgtctgtgtgtggacatctgtattgctggccttgcctgcaccagtggctggagaccaggcccgagagacaggagtgtccagtctgtaaagccggtatcagccgcgaaaaggtcgtgcctctttacggaaggggcagccagaagccgcaggatccccgccttaagaccccaccaaggcctcaagggcagagacccgcaccggagagccgaggtgggtttcagccatttggggatacgggaggattccacttttctttcggggtcggggctttcccgtttgggtttttcacgaccgtgttcaacgctcatgagccctttcgacggggcacaggcgtcgacctgggccagggacatccagctagttcctggcaggacagtctttttttgtttcttgccattttcttttttttctggctcctctcaatctag

SEQ ID NO: 133140 - DNA, 543 bp, Artificial Sequence
  Description of Artificial Sequence: Synthetic coding sequence
atggcagctgccgaagaagaggatggaggtccagagggaccaaatagggaaaggggaggtgcaggtgccacatttgaatgcaacatctgtctcgaaacagccagggaggccgtggtcagcgtctgcggtcacctctattgctggccctgcttacaccagtggcttgaaacgaggcctgaaaggcaggaatgtcccgtatgcaaggccggcatttctcgggagaaggtggttccactgtacggtcggggcagccaaaagccacaggatcctagactgaagaccccccccagaccacagggtcagcgcccagcccccgaaagcaggggcggctttcaaccatttggggatacaggtggattccacttctctttcggcgtcggcgctttcccgtttggcttcttcaccacagtctttaacgcccatgaaccatttcggaggggcactggggtagatctgggacagggtcatcctgcaagttcatggcaagacagtttgtttctgttccttgcgattttcttcttcttttggttacttagcatctag

SEQ ID NO: 133141 - DNA, 543 bp, Artificial Sequence
  Description of Artificial Sequence: Synthetic coding sequence
atggccgcagccgaggaggaggatggggggccggagggccctaacagagagagggggggtgctggcgcaacttttgagtgcaacatctgtctagaaaccgctagggaggccgtagtgagcgtgtgtggccacctctattgctggccgtgccttcaccagtggctcgagacaagaccggagcggcaggagtgccctgtgtgtaaggccgggatatctcgcgagaaagtggtgccgctttatgggcgcggcagccagaagccgcaggacccacggctgaagacacctcctagaccacagggccagaggcccgcgcctgagtctcgcgggggatttcagcccttcggagacaccggaggcttccacttctcatttggagtgggcgcattcccctttggcttcttcacaaccgtttttaacgcacacgagcccttcagacgcggaacaggggtggacctcggccagggccatcccgcaagctcctggcaggactcactgtttttgtttctggcgatcttttttttcttctggctgctcagtatctag

SEQ ID NO: 133142 - DNA, 543 bp, Artificial Sequence
  Description of Artificial Sequence: Synthetic coding sequence
atggctgccgcagaggaggaggacgggggcccggaggggcccaacagagaacgcggcggggccggcgccaccttcgaatgcaacatatgcttagagactgcaagggaagccgtcgttagtgtttgtggacatctgtattgctggccctgtttacaccagtggctcgaaaccagacctgaacggcaggagtgccccgtgtgcaaggccggaatatcacgagaaaaggtcgttccactttatggtcgagggtcacaaaagcctcaggacccgagactgaaaaccccgccacggccgcagggtcagcggccagctccagagagccggggagggttccagcccttcggcgatacagggggcttccacttttcgttcggggtcggcgccttccccttcgggttttttacaactgtgtttaacgctcacgagcctttccgaaggggaaccggagtggacctgggccaaggacatcccgcgagtagctggcaggatagtttgtttcttttccttgctattttctttttcttctggttactgtctatctag

SEQ ID NO: 133143 - DNA, 543 bp, Artificial Sequence
  Description of Artificial Sequence: Synthetic coding sequence
atggcagctgccgaagaagaggacggaggccccgagggccccaatcgcgagcgcgggggcgctggcgccacatttgaatgtaatatctgcctggaaacagccagagaggcagtggtgtccgtctgcggtcatctttattgctggccctgcctgcatcagtggctggaaacaagacccgagaggcaggagtgtcccgtgtgcaaagccggcatttcccgcgagaaggtggtgcctctatacggacgtggatctcagaaacctcaggatcctaggctcaagacacctcccagacctcagggtcagagacccgctcctgagagtcggggtggcttccagcccttcggggacaccggcgggttccacttcagttttggcgtgggagcgttccctttcggattcttcaccacagttttcaacgcccatgagccgttccgtcggggcactggcgtagatctgggacaagggcaccctgcttcatcttggcaagacagcctgtttttgttcctggctatttttttcttcttttggctactgtctatttag

SEQ ID NO: 133144 - DNA, 549 bp, Artificial Sequence
  Description of Artificial Sequence: Synthetic coding sequence
atggccgcggccgaggaagaagatggtgggccagagggtcccaatcgggaaagaggcggggccggggccacattcgagtgcaacatctgtctggagaccgccagggaagctgtggtcagcgtgtgcgggcacctgtactgttggccctgccttcatcagtggctcgagacaaggccagagagacaggagtgtcctgtgtgtaaggccggaatctcgcgggagaaggttgtccccctgtatggtagaggaagtcagaagccccaggacccccgcctcaaaacccctcctaggcctcagggacagaggccggcccccgagtccagggggggtttccaacccttcggagacacagggggcttccactttagctttggagttggtgcttttccttttggattttttaccacggtgttcaatgcacatgagccctttcggagggggacagggcctttttcaacaagccccgctttcttccactatctgatcggcaatacatcccgagaattcagagggcgtatctacaacttttggctccctcgcaacctatag

SEQ ID NO: 133145 - DNA, 549 bp, Artificial Sequence
  Description of Artificial Sequence: Synthetic coding sequence
atggccgcagctgaggaggaggatggaggcccggagggcccaaatagagaaagaggtggggctggggcgacgtttgaatgtaatatatgcttagagactgccagggaggcagtggtgtccgtgtgcggccatttgtactgttggccatgtctccaccaatggctggaaacgaggcccgaacgccaagagtgtccagtgtgcaaggctggaatatcaagggagaaagtagtgccactgtacgggagaggctcccagaagcctcaggaccctaggttgaagacaccaccccgcccgcaggggcagaggcctgcccccgaatctaggggggggttccagcctttcggggacaccggggggttccattttagcttcggggtgggtgcatttccatttggattcttcacaaccgtattcaatgcacatgaaccctttagacgcggtaccggtccctttagtacctcccctgcctttttccattacttgatcggcaacacgagccgagagttccgcggcaggatctataatttctggctcccccgaaatctatag

SEQ ID NO: 133146 - DNA, 549 bp, Artificial Sequence
  Description of Artificial Sequence: Synthetic coding sequence
atggcggccgctgaagaggaagatggcgggccagagggcccaaatcgggaaagggggggggcaggtgctacttttgagtgcaatatttgtctcgaaacagcgcgggaggctgtcgtcagcgtctgcggtcatctgtattgttggccttgcctccaccagtggctggagacaaggccagaaagacaggaatgtccagtctgcaaagccggcatttcacgagaaaaggtggtccccctctacggacggggatcccagaaacctcaggatccccgtctgaaaactccgccacggccgcagggacagcgcccagcgccagagagcaggggcggtttccagccgtttggtgatactggcgggttccacttctcttttggagtgggtgctttccccttcggcttctttaccactgtttttaatgctcacgagccttttcggaggggaacaggcccgttcagtacgtccccagcattcttccactatctgataggtaacacttcccgagagttccgagggcgcatctataatttctggctccctcgtaacctttag

SEQ ID NO: 133147 - DNA, 549 bp, Artificial Sequence
  Description of Artificial Sequence: Synthetic coding sequence
atggccgcggcagaggaggaggacggcggacccgaggggcctaaccgcgagcgcggaggtgccggcgctacttttgagtgtaacatctgtttagaaacggcgcgagaggcagttgtctcagtgtgcggccacttgtactgttggccatgtctgcaccagtggcttgagactaggccggaaaggcaggagtgcccagtctgcaaagcaggcatttcaagggagaaagtggtcccactctatggcagaggcagccagaagccacaggacccgcggctcaaaactccccccagacctcagggacaacgaccagctccggaatctaggggcgggttccagcccttcggcgacaccggtgggtttcatttttcctttggcgtgggagccttcccatttgggttttttaccactgtcttcaacgcccatgaacccttcagacgcgggacaggcccattctccacctcaccagcattcttccactatctgatcggcaatacctcccgcgagttccgtggccggatctataacttttggcttcctcgaaacttatag

SEQ ID NO: 133148 - DNA, 549 bp, Artificial Sequence
  Description of Artificial Sequence: Synthetic coding sequence
atggccgccgctgaagaggaggatgggggacccgagggtccaaatagggagagagggggcgccggcgcaacattcgaatgcaacatatgtctcgaaacagcacgagaggctgtcgtgtccgtgtgcggacatctttactgctggccctgtcttcaccagtggttggagacccgccccgaaaggcaggagtgccctgtgtgcaaggctgggatctcccgggaaaaggtggtgcccttgtatggccggggatcccagaaaccccaagaccctcgtctgaagacgccacctcgcccacaaggtcagcggcccgctccggagtctagggggggctttcagccattcggcgacaccggcggattccatttcagtttcggcgtgggggcgttccccttcgggttcttcacaacggtgttcaatgcgcacgaaccctttcggcgcggaacagggcctttttccactagtccagccttttttcattatctgattggtaacacaagccgcgaattccgcgggaggatctataacttctggttaccgcgtaatctgtag

SEQ ID NO: 133149 - DNA, 549 bp, Artificial Sequence
  Description of Artificial Sequence: Synthetic coding sequence
atggcagctgccgaggaagaagacggtgggcctgagggccccaatcgagagcggggtggggctggtgctacctttgagtgcaacatctgtctggagacagcccgagaggcagtagtgtccgtatgcggccacctttactgttggccctgcctgcaccagtggctagaaactcgtcccgagcggcaggaatgtccggtctgtaaagctggtatctctcgtgagaaagtcgtgcctttgtatggtcgtggctcccagaaacctcaagatcctaggctgaagacaccacctagacctcaaggccagcgccccgcacctgagtcccgaggcggctttcagcctttcggcgacacaggagggttccacttctctttcggggtgggagcctttccctttgggttctttacaaccgtcttcaacgctcatgagccttttcgcagaggaaccggccctttctctactagccccgctttttttcactacctcatcggcaacaccagccgcgagtttcggggtagaatctacaacttttggttgcctaggaacctctag

SEQ ID NO: 133150 - DNA, 342 bp, Artificial Sequence
  Description of Artificial Sequence: Synthetic coding sequence
atggccgacgtagaggatggcgaggagacctgtgcacttgccagccactccgggagttctgggtccaaaagcggaggcgacaaaatgtttagtttaaaaaagtggaatgctgtggcaatgtggagctgggatgtcgaatgcgacacctgtgcgatctgccgggtacaggtcatggacgcttgcctgcgctgccaggcagagaacaaacaagaagactgcgtcgtggtctggggggagtgcaaccattctttccacaactgttgtatgagtctgtgggtcaaacaaaataatcgctgtccactctgccagcaggactgggtcgtgcagcgaatcggcaagtag

SEQ ID NO: 133151 - DNA, 273 bp, Artificial Sequence
  Description of Artificial Sequence: Synthetic coding sequence
atggctgatgtggaggacggcgaagaaacctgtgctctggcatcacactctggcagctccggcagtaagtcagggggcgacaagatgtttagcttgaaaaaatggaacgccgtggcaatgtggagctgggacgttgaatgtgatacgtgtgcaatctgtcgcgtgcagatgcctgttctcgacgtgaagcttaaaacaaataagcggaccgtgttgtggagcggggaaaatgtgatcattccaagtaccaccgccgcttgcccgtgcggttag

SEQ ID NO: 133152 - DNA, 294 bp, Artificial Sequence
  Description of Artificial Sequence: Synthetic coding sequence
atggctgacgtcgaggatggcgaggaaacctgtgccctggcgagccacagcgggagctcggggtcaaagagtgggggtgataagatgttttccctgaagaaatggaatgccgtagccatgtggtcgtgggacgtggaatgcgacacctgtgctatctgcagggtgcaggtcatggtggtctggggcgagtgtaatcatagctttcataactgttgcatgagcctctgggtcaaacagaacaatcgctgtcccctgtgtcaacaggactgggtggtccaacggatcggtaaatag

SEQ ID NO: 133153 - DNA, 1875 bp, Artificial Sequence
  Description of Artificial Sequence: Synthetic coding sequence
atggagaattcagactctaatgataagggttctggagatcagtccgcagcccagcgacgtagtcagatggatcgtctcgatcgagaagaggccttctatcagtttgtgaataatctttccgaggaagactatcggctgatgcgcgacaacaatctccttggcacgcccggggagtctacggaagaagaactgctccggcgcttacaacagatcaaagagggcccccctccccaaaactctgacgaaaaccgaggaggcgacagctctgacgacgtatccaacggcgattccataatagactggcttaatagtgttcgccagaccggaaataccacacgatctggccagcgcggaaaccagtcctggcgtgccgtgtcaagaacgaacccaaatagcggagacttccggttctccttggaaattaatgttaataggaataacgggagtcagaatagtgaaaatgagaatgagccaagtgcccgccgctcttctggggaaaacgtcgaaaacaatagccaacggcaggtcgagaacccccgctctgagagcacatctgcaaggccaagccgcagcgagcgcaattctacagaagcccttaccgaagtccctcctacccgtggccagaggcgggcaagatcacgatcccccgaccatcgccgtactagagccagagccgaaaggtccaggtcccccctgcatcccatgtccgaaatcccacgtcgcagtcatcatagcatttcttctcagaccttcgagcatcccctggtcaacgagaccgagggtagctccaggacgagacaccacgttacactccgacaacagatcagtgggcctgagctcctcagccgaggcctctttgccgcctccggtacacggaacgcttcccaaggggctggctcctctgatactgccgccagcggcgagtcaaccggcagtggacagcggcccccaacaatcgtcttggatttgcaggtgaggcgagtgcggcctggggagtaccggcagagagactctattgcatctaggacgcggagcagaagccagacacctaataataccgtcacttacgaatctgagagaggcggatttagaaggacattctcccgctccgaacgagcaggtgttcgtacctatgtgtctaccatcagaatccccatccgacggattctgaacacaggcctcagcgaaaccaccagcgtggccatccagactatgcttcgacagattatgaccggctttggtgaactgtcttactttatgtactctgactctgattccgaacccacaggtagcgtgagcaaccggaacatggagcgcgctgaaagcaggtcaggacggggcgggagcggtggagggtctagctctggcagtagcagtagctcttcatctagtagcagctcatcgagttcttccagttcttcaagttccccttcctcaagctcagggggcgagtcctctgaaactagcagtgacctgtttgaaggatctaatgaaggttctagctcctctggaagctcaggagctaggcgtgagggcagacaccgagcacccgtgacctttgacgagtccgggtcactacccttcttgagcctcgcccagttcttcttacttaatgaggacgacgatgaccagcctcgtggattgacaaaggaacagatagacaacttggcaatgcgtagcttcggggaaaatgacgctctgaagacctgttctgtctgtattaccgaatacacagaagggaataagctccgaaagctcccttgtagtcatgagtaccacgtccattgtattgatcgatggctgtctgagaattctacgtgccccatatgcagacgggccgtgctggcgagtggtaatcgggaaagcgttgtctag

SEQ ID NO: 133154 - DNA, 1875 bp, Artificial Sequence
  Description of Artificial Sequence: Synthetic coding sequence
atggaaaatagtgattccaacgataagggttccggagaccaatcagctgctcagcgccgtagccagatggatcgccttgatcgggaggaagcgttctaccaattcgtcaacaatttgtcggaagaggattatcgcctgatgagggacaataaccttttagggaccccaggcgagagtacagaggaggagctcttgagaagactgcagcagatcaaagagggcccccccccacagaattcagatgagaacaggggaggcgatagctccgacgatgtgagtaacggagatagtataattgattggttaaacagtgtgagacagactggaaatacaacaaggtccggacagagagggaaccagagctggagggctgtgagccgaaccaatccgaatagcggggactttcggtttagtctcgaaatcaacgtcaaccggaataacggctcacagaactcggagaacgagaacgagccaagcgccagaagatcaagcggtgagaatgtcgaaaataactctcaacgtcaggttgagaatcctagatctgagagtacatctgcacgcccctctaggtcggagagaaacagcacggaggctcttactgaagtgcctcctacccgtggccaacgcagggctagatcccgctctcccgaccaccggagaacaagagcccgtgcagaaagaagcagatcacccttacatccaatgtccgagatccccaggagatcccatcacagtattagttcccaaacattcgaacaccccttagtcaacgaaactgagggcagcagcaggaccaggcatcatgtgacgcttcgacagcaaatttcgggccctgagctgctcagtcgcggattgtttgctgcatcagggactaggaatgcgtcccagggggccggctcatccgacaccgccgccagcggggaaagtactggaagcggccagaggcccccaactattgtgctcgacctgcaggtgaggcgagttaggcctggggaatataggcaaagggattctatcgccagccggactagaagccgcagccagactcccaacaataccgtcacctatgagtcagaaagaggcggttttcgaaggacgttcagtcggtctgagagggccggtgtgaggacatatgtctcaacaataagaatcccaataaggcggattctgaataccgggctgagcgaaactacatcagtggcaatccaaacaatgcttcgccagattatgactggctttggagaattgtcatattttatgtatagcgattctgattccgagcctaccgggagtgtgagtaatcgaaacatggaacgtgccgaaagtcgatcagggaggggcggctcaggggggggcagttcttccggaagtagttcatctagttcctcctcctcaagcagttctagcagcagcagttcttcctctagccccagttcctccagcgggggagagagtagtgagacaagctccgacctgtttgaggggtccaatgagggctcctctagctctggctccagtggcgcaaggcgcgagggaaggcaccgagccccggttacctttgatgagagcggctctctccccttcctgtctctggcccagttcttcttgctgaacgaggatgatgacgatcagcctcggggactcacaaaagagcagattgataatctcgctatgaggagcttcggcgagaatgacgctctgaaaacttgtagcgtatgcatcaccgagtacacggaagggaataaactccgcaaactcccctgcagtcacgaatatcatgtccactgcattgataggtggctgagcgagaattcaacctgccctatttgccgccgggccgtcttagcttctggcaatcgggaaagcgtggtgtag

SEQ ID NO: 133155 - DNA, 954 bp, Artificial Sequence
  Description of Artificial Sequence: Synthetic coding sequence
tgactgcccgccccggccgcagctctacccggcgcgcccccgccaccccctggcgtgagaggttaccctgcgagagcgcgcgggctccagggagctagcggtggtgcacggttccctagtagccttagcctgcctgtccccggaaaaggaggctgggtggtctcaagggcgaagttccccgcgcttgatagctgcgagattactacagcccacccaaggttgtgctttgcagtgtctccccccttttcctgcagcctcccgctcccatcgcttttcccccacagccccctgcttggacggcccaaacgacaggccaagcccgcggccgacgagggattttgggactgcagtgtctgcacattccgcaattcagccgaggccttcaaatgcagtatctgcgacgtccgtaaagggacctccacgcggaagccaaggatcaactcccagctcgtggctcaacaagttgcccagcagtatgcaacccctcccccccccaagaaggagaaaaaagagaaggtggaaaaacaggacaaggaaaaaccagagaaggacaaagaaatctctccaagtgtaaccaagaaaaataccaacaagaagaccaagcccaaaagtgacatcctgaaagatccgccctctgaggcaaacagcattcagtcagctaatgcaactaccaagacatccgagaccaaccacacaagcagaccacgcttgaagaacgttgaccgctcaacggcccagcaactggcagttacagtgggcaacgtgaccgtgatcattaccgatttcaaggagaaaactagatcctcctcgaccagtagtagtaccgtgacaagtagcgcgggaagtgagcagcaaaaccagagctctagtggaagcgagtcaacagacaaaggctcgtctcggagctcgactccgaagggcgatatgtccgccgtgaacgatgaaagcttttag

SEQ ID NO: 133156 - DNA, 456 bp, Artificial Sequence
  Description of Artificial Sequence: Synthetic coding sequence
atggactcggctgcttgcgccgcggctgctacccctgttccggctctggccctggcactagcccctgacctggcccaagctccgctggcactgccaggcttgctgagtccctcctgtctcctcagctctgggcaggaggtgaatggatctgagcgggggacttgtctctggagaccatggctgtcgagcacaaatgacagcccccgtcagatgaggaagctagtcgatctggccgctgggggagcgactgctgccgaagtgactaaagcggaatccaaatttcaccacccagtccgacttttttggccaaagtctcgttccttcgattatctgtactctgctggagagatcctgctgcagaattttcccgtccaggcaactataaatctctacgaagactctgatagcgaggaggaggaggaagatgaagagcaggaagacgaggaagaaaaatag

SEQ ID NO: 133157 - DNA, 315 bp, Artificial Sequence
  Description of Artificial Sequence: Synthetic coding sequence
atggattccgccgcttgtgccgctgctgctacacccgttcctgccctggctttggctctcgcccctgaccttgcacaagctcccctcgccttacccggcctgctctctccaagttgcctgctgtcttcaggacaagaagtgaatgggagcgagaggctgttttggcctaaatcccgctcatttgattacctgtacagtgcaggagaaatccttcttcagaattttccagtgcaggcaaccatcaacctgtacgaagactctgatagtgaggaggaagaggaggacgaagaacaggaggatgaggaggagaagtag

SEQ ID NO: 133158 - DNA, 213 bp, Artificial Sequence
  Description of Artificial Sequence: Synthetic coding sequence
atgcctgatgggccaggcatgaccgcggccagcggaaagttgtaccaatttcgacacccagtgaggctgttctggccaaagagcaagtgctacgactacctctatcaggaggcagaggcacttctaaaaaactttcctatccaggcaactatatcattctacgaagattccgattctgaagatgaaatagaagacctgacttgcgaaaactag

SEQ ID NO: 133159 - DNA, 387 bp, Artificial Sequence
  Description of Artificial Sequence: Synthetic coding sequence
atggagaatgccggtggggccgaaggcaccgaaagtggtgctgccgcttgcgcggcaaccgacggccccacaagaagagcgggcgcggattctgggtatgcgggcttttggagaccctgggtcgatgccgggggcaaaaaggaagaggagacccccaatcacgccgccgaggcgatgccggatggccctggcatgaccgcagcttcagggaaactgtaccaattccggcacccggtcaggctcttttggcccaaatccaaatgttatgactatttgtatcaggaggccgaagcactgctcaaaaacttccccatccaggctacaatcagcttttacgaggactcggatagtgaggatgagatcgaggacctcacatgcgaaaattag

SEQ ID NO: 133160 - DNA, 444 bp, Artificial Sequence
  Description of Artificial Sequence: Synthetic coding sequence
atggctgcggccgccgactcgttctctgggggcccagcgggggtacggctgccccgctcccctcctctgaaggtgctggccgaacagctcagaagggatgcagagggcggccccggagcgtggcgactgtcacgggcggcggcaggtcgtggacccttggatttggcagctgtgtggatgcaagggcgagttgtgatggcagacaggggagaggcccgactcagggatccatctggcgatttttctgtgcgagggttggagagagtgcctcgaggaaggccttgtctagtgcctggtaagtacgttatggtgatgggcgtggtccaggcctgcagcccagaaccctgtctccaagccgtgaagatgaccgacctcagtgacaatcctatccatgaaagtatgtgggagctggaggtggaagacctccatcggaatattccctag

SEQ ID NO: 133161 - DNA, 255 bp, Artificial Sequence
  Description of Artificial Sequence: Synthetic coding sequence
atgaagcagacccaggtaggaagcctcttttcattgggcattagaaacccagagccgggacctgtgtccggcactgcagtccctaggcagctagcttggaaaagcggcaagtatgttatggtgatgggggtcgtccaagcttgttctccagagccttgtctccaagcagtgaaaatgacagatctttccgataatcctattcacgagtcaatgtgggagctcgaggtggaggatctacaccgtaacattccatag

SEQ ID NO: 133162 - DNA, 1431 bp, Artificial Sequence
  Description of Artificial Sequence: Synthetic coding sequence
atggcaaattccgcgaaggccgaagaatatgagaagatgagcctagaacaggccaaagccagcgtgaattctgagacagagagttcatttaatattaacgaaaataccactgcgagcggtacaggcctgtccgagaagaccagcgtgtgccgccaagtcgacatagccaggaagagaaaagaattcgaagatgacttggtgaaggagtcgagttcatgcgggaaggacactccttctaaaaaacgcaaacttgacccggaaatcgtacctgaggagaaggactgtggggacgcagagggtaatagtaaaaagcgcaaacgcgagacagaagatgtcccgaaggataaatcttccactggagacgggacccagaacaaacggaaaatcgcattagaggacgtccccgagaaacagaagaacctcgaagaggggcacagcagtacagtcgccgctcattataatgaacttcaagaagtcgggctcgagaagcgctctcagagtcgtatcttttacctcaggaatttcaataactggatgaagtccgtcctgatcggggagtttctggagaaagtgcgtcagaagaagaagagagatattacagtattggatcttgggtgcggaaaggggggcgacctacttaagtggaaaaaaggtagaatcaacaaactggtctgcactgacatcgccgatgtgtctgttaaacagtgccaacaaaggtacgaggacatgaagaatcggcgggactctgaatacattttttccgcagagtttattactgcagacagcagcaaagagctattgatagacaaatttcgggatccgcagatgtgtttcgatatttgttcctgtcaattcgtctgtcattattccttcgaaagctacgagcaggctgacatgatgctgagaaacgcctgtgaaagattgagtccaggtggctactttatagggaccactccgaactcctttgagctgatccgccgcctcgaggccagcgagactgaatcattcggcaacgaaatatatacggtcaagttccagaagaaaggagactacccactgtttggctgcaaatacgatttcaacctggaaggcgtggtggatgtgccagagttcctggtgtatttccccctcctgaacgaaatggctaagaagtacaacatgaaattggtgtacaaaaagaccttcctcgaattttatgaggagaaaattaagaataacgagaacaagatgttacttaaacgtatgcaggcgctggaaccctaccctgccaatgaaagctcaaaactcgtctccgaaaaagtggacgattatgaacatgccgcaaaatatatgaagaactcacaggtccgccttcccctcggcacgctgtccaagtccgagtgggaggctacttccatctatctggtgtttgccttcgaaaagcagcagtag

SEQ ID NO: 133163 - DNA, 1431 bp, Artificial Sequence
  Description of Artificial Sequence: Synthetic coding sequence
atggcaaacagcgccaaagctgaagagtacgagaagatgtcattggagcaagcaaaagctagtgtgaactccgaaacggaatcaagctttaatattaacgagaatacaactgcctctggaacaggcctgtccgaaaaaacctccgtgtgtaggcaggtggatatagcccgcaagcggaaagaatttgaggatgatttggttaaggaaagcagcagttgtggcaaagatacaccttctaagaaaagaaaactagacccagagatcgtccccgaagagaaagactgtggagacgccgaaggcaatagcaagaaacgaaaacgggaaactgaagacgtgcccaaagacaagtccagcacaggagatgggacccagaacaaaaggaaaattgccttggaggacgtaccagagaagcaaaagaaccttgaggaagggcacagcagcactgtggcagcacattataatgaactccaagaagttggactggaaaagaggtctcagtccagaattttctacctgcggaacttcaacaattggatgaagtccgtgttaatcggggaattcctggaaaaagtccgacaaaaaaagaaacgagacataacagtgctagacctgggctgcggcaaaggtggggacctcctgaaatggaaaaaggggcgaatcaacaaattggtctgtaccgatatcgcagatgtgagcgtgaagcagtgccagcagagatacgaggacatgaaaaacagacgggactccgagtacatcttctccgcagagtttattactgctgactcaagtaaagagttgctaattgataagtttagagatccacaaatgtgttttgatatctgctcctgccagttcgtctgtcactattcctttgaaagctacgagcaagctgacatgatgcttcgcaacgcctgtgagcggctgtcacccgggggttattttataggaactacccccaacagcttcgaacttattagacggctcgaagcaagcgagaccgagagtttcgggaacgaaatctacactgtaaaattccaaaagaagggcgattatccactcttcggatgtaagtatgattttaatctagagggcgtggtggacgtgccagagttcttagtttacttccctctactcaatgagatggccaagaagtataatatgaagctcgtgtataagaaaacctttctcgagttctatgaggagaagatcaaaaataatgagaataaaatgctactgaagaggatgcaggcgctggaaccctacccagctaatgagagcagtaaacttgtgagtgagaaggtggacgattacgagcacgccgccaagtatatgaagaacagtcaggtgcggctaccgttgggaacactgagcaagagtgagtgggaggccacaagcatctatctcgtattcgcttttgagaaacaacagtag

SEQ ID NO: 133164 - DNA, 705 bp, Artificial Sequence
  Description of Artificial Sequence: Synthetic coding sequence
atgaaaaaccgcagggacagcgaatacatcttcagtgcagaatttatcaccgccgacagttcgaaggagctgctgattgataaattcagggaccctcagatgtgcttcgatatttgctcatgtcaatttgtgtgccattatagcttcgaatcatatgagcaagccgatatgatgctcaggaacgcgtgtgagcggctctcaccaggcggttatttcatcggtacaaccccaaattcttttgagctgatcagacgcctggaggcgagtgaaaccgagtcctttggaaacgaaatctatactgttaaattccagaaaaagggcgattaccccctgttcggttgcaagtatgacttcaatcttgagggggttgtcgatgtgccagagtttcttgtttacttcccccttctcaacgagatggcaaaaaagtacaatatgaaacttgtatataagaagactttcttggagttttacgaagagaaaatcaagaataatgaaaacaagatgctgctcaaaaggatgcaggcacttgagccatatcctgctaacgaaagttcgaaacttgtctctgagaaagtcgacgactatgaacatgctgccaaatatatgaaaaactctcaggttaggctgcctctgggtacgctttcaaaatcagagtgggaagctactagcatatacctggtttttgcatttgagaagcagcagtag

SEQ ID NO: 133165 - DNA, 1431 bp, Artificial Sequence
  Description of Artificial Sequence: Synthetic coding sequence
atggcaaatagtgccaaggctgaagagtacgaaaaaatgagcctggagcaagccaaggcctctgtgaacagtgaaaccgagtcttcttttaatattaatgagaatacgacagcttcaggaaccggacttagtgaaaaaacatcggtatgtcgccaggtggatatcgccagaaagcggaaggagttcgaagacgacttggtaaaggagtcatccagctgcgggaaagacactccaagtaaaaagaggaagcttgatccggaaattgtacccgaagaaaaggactgtggcgacgctgaagggaactcaaaaaaaaggaagagggagacagaagacgttcccaaagataaaagctcaactggcgacgggacgcagaacaaacgaaagatcgctctagaggacgtgcccgagaaacaaaagaatttggaggagggccatagttctacggtagcagctcattataacgagctgcaggaggtgggcttagagaagagatcacaatcccggattttctatcttaggaactttaataattggatgaaatcagtgctaatcggcgaattcctggagaaagtacggcagaagaaaaaaagggacattacggtcttagatctgggctgcggtaaggggggtgatcttttgaaatggaaaaagggccgaatcaataaattagtttgcacagatatcgcggatgtgtccgtgaaacagtgccagcaaaggtatgaagatatgaagaacaggcgcgatagtgagtacatcttttccgcagagtttataacagctgatagctccaaggagttacttatcgacaaattcagggacccccagatgtgctttgacatatgctcctgtcagtttgtctgtcattactcttttgagtcttacgagcaagccgatatgatgctgcgcaacgcctgcgagagactgagcccaggcggttacttcattggaaccaccccgaacagcttcgagctcattcgacgactggaggcgagcgaaacggaaagctttggcaacgagatttatacagtcaaatttcagaaaaagggtgattaccccttgtttggctgtaaatatgactttaacctcgagggcgttgtggatgtgccagagttcctggtctacttcccattgctcaacgaaatggctaagaaatataacatgaagcttgtgtacaaaaagactttcctcgagttctatgaggaaaagataaagaataatgaaaacaaaatgctgttgaagagaatgcaggctcttgaaccatatcccgccaacgagagcagtaagcttgtgagcgaaaaagtcgatgattatgagcatgcagcgaaatacatgaaaaactcccaggttaggctgccgctgggaacgctgagtaagagcgaatgggaggccacatccatctatctagtattcgccttcgagaaacagcagtag

SEQ ID NO: 133166 - DNA, 390 bp, Artificial Sequence
  Description of Artificial Sequence: Synthetic coding sequence
atgaagtccgtgcttataggcgagttcctggaaaaggtaagacagaaaaagaaacgtgacattaccgtccttgacttaggatgcggtaaaggtggcgatctcttgaagtggaaaaaaggcaggattaacaagctcgtatgcacagatattgccgacgtttctgtcaagcagtgccaacaacgatacgaggacatgaagaaccgtagggatagcgagtatatttttagtgcagaatttatcactgcggattcttccaaggagcttttaattgataagtttcgtgaccctcagatgtgttttgacatttgcagttgtcagttcgtatgccattacagttttgaatcctatgagcaggccgacatgatgctgagaaatgcctgcggaacatag

SEQ ID NO: 133167 - DNA, 468 bp, Artificial Sequence
  Description of Artificial Sequence: Synthetic coding sequence
atggccccacgtacctggtgtccagcaggaatttttggactgttttgtcctttaacccttgcatgctcaagtctgacaatcgccctcactgactgccagccaattattttggtgtcccccacattgtccctgtggatggtcgtgagatctgtctggataatgcaagcttccttactcggggaaccagaagaggtcgcacttgggccaatgggcgtggttgcagccacactggaagtggtcggtacccgtgctatgggtgtggccggcataatgactgtggacctggaagggatggatatggatatggatgtccccgaaaccatcatggctgaaaccagggttgtcatgaccgccacccaggaggagatcacagaaacgatcatgacgaccgaaatgagacatgcgcacaacatcggcgaaacatggatatccgctctctctgaacccgtgtgccacactctgtcctag

SEQ ID NO: 133168 - DNA, 474 bp, Artificial Sequence
  Description of Artificial Sequence: Synthetic coding sequence
atgtcttccgaagagggaaaactgtttgtcggcggtcttaactttaatacagacgaacaagccttggaggaccacttttccagctttggacctattagcgaggtcgtggtggtgaaagatcgcgaaactcagcggagtcgcggctttggcttcataaccttcacaaaccccgagcacgcctcagtggccatgcgggctatgaatggggaaagtttggacggccgccagatccgggtggaccatgcagggaaatctgctcgtggaacaagaggcggcggattcggtgcccacggaagaggccgctcttattcacgcggaggtggagatcaagggtatggtagtggaaggtattacgacagccgaccagggggttacggctatggttatggacggagccgcgattataacggaagaaatcagggagggtatgacaggtattccggcgggaattacagggataattatgataattag

SEQ ID NO: 133169 - DNA, 474 bp, Artificial Sequence
  Description of Artificial Sequence: Synthetic coding sequence
atgagcagcgaggaaggaaaactgttcgttgggggcctgaacttcaacactgatgagcaggcccttgaagaccacttctcctctttcggacccatcagtgaggtcgttgtggtgaaggaccgcgagactcagcgcagcaggggattcggctttattactttcaccaatccagagcacgccagcgttgccatgagggccatgaacggtgagtctttggatggacggcaaattcgagtcgatcacgctgggaaatcggccaggggcaccagggggggcggatttggggcacatggacgagggcggtcttattcgcgcggtggcggagatcaagggtatgggtccggacgctattacgacagtaggcctgggggatacgggtacggctatggaaggtctcgtgactacaacggcaggaaccaagggggctacgatcgttactctggaggcaactatcgggataattatgataattag

SEQ ID NO: 133170 - DNA, 510 bp, Artificial Sequence
  Description of Artificial Sequence: Synthetic coding sequence
atggcccctaggacctggtgtcctgctggcatctttggcctcttttgtcccctgaccctagcctgctccagcctcacgatagccctcacagattgtcagcccatcattctggtgagtcccaccctgagtttgtggatggtagtcagaagcgtttggattatgcaagccagtctccttggcgaacccgaggaagtggctctgggtcctatgggcgtggtggccgcgaccctcgaggtcgtgggtacccgggctatgggggttgcgggaattatgaccgtcgatctcgagggaatggatatggacatggatgtgcctgaaacaataatggcagagacacgggtggtgatgacggctacccaggaggagatcactgaaaccatcatgacgacggaaatgcgacacgctcacaacattgacacccagggtatcatatcagaccccggcagttcatttcagatggctgtcttcataaaagtcttcggcgcagcgcctaaacaccttatcctgtag

SEQ ID NO: 133171 - DNA, 2559 bp, Artificial Sequence
  Description of Artificial Sequence: Synthetic coding sequence
atggagtatgagaggagagggggacggggtgaccggactggtcgctacggcgccacggatcgctcgcaagacgatggcggggaaaataggtcaagagatcacgactacagggatatggactacagatcctatccaagagaatacggctcacaagaggggaagcacgactacgacgatagttccgaagagcaaagtgccgagataagaggccagctccagtcccatggggtgcaggcacgtgaggtgagactcatgcggaacaagagtagcggacaatctagggggttcgcatttgtcgaattttctcacttgcaggacgcaacgaggtggatggaagctaaccagcacagtctaaacatcctcggccagaaagtgtctatgcattattccgatccaaagccaaaaatcaacgaagattggctgtgtaacaaatgcggtgtgcagaacttcaagaggcgtgaaaaatgtttcaagtgcggagtgccaaagtcagaagcagaacagaaactgccactggggacaagacttgatcagcagaccctgcctttaggagggcgcgagctgagccagggcttgctcccactacctcagccatatcaggctcagggcgtgctggcatctcaggcactgagccagggtagcgaaccttcctcagagaacgcaaacgacactattattctgagaaatctgaacccccacagcaccatggacagtattctgggcgccttagcaccctatgcagttctgagctcaagcaacgtacgcgttattaaggacaagcagactcagctgaatcgcggatttgctttcatccaactttctactattgaagcagcccaattactccagatactgcaggcattgcatccccctctcaccatcgatgggaagactatcaacgtcgaatttgcaaaaggatccaaacgggacatggccagcaacgaaggttcgcgaatttctgcggcctcagtcgcctcaacagcgatcgctgccgcccagtgggcaatctcgcaggcttcccagggtggagagggcacctgggccacaagcgaggagccccctgtcgattactcatactatcaacaggacgaggggtatggaaacagtcaggggacagagagctctctgtacgcccacggctacctcaagggaaccaaaggacccggtatcacaggtacaaagggcgaccctaccggagcgggccccgaggcctcacttgagcctggcgctgattcagtctccatgcaggcgttttctagggctcaaccgggcgcggctcccggaatctatcagcagtcagccgaagcgagttcgagccaagggacagccgcgaactcccaaagttatacaatcatgagccctgccgtgctcaaaagcgaactgcagtcccccacccacccctcatctgcactacccccagccacctcaccgacagctcaagagagctactctcagtatccggtgcccgatgtgagtacataccagtatgacgagaccagtggttattattatgaccctcagaccgggctctattatgaccccaattcccagtactactacaacgctcaatctcagcagtatttgtattgggacggagagcgcaggacctatgtcccagcactggaacagtccgcagacggacacaaggagacaggcgccccatccaaggaggggaaagagaaaaaggagaaacataaaaccaaaaccgcacaacagattgctaaagacatggagagatgggcacgctctttgaataagcagaaggagaacttcaagaactctttccagcctatttctagtctgcgggatgatgagcgtagagagagcgctacagcggacgcaggctacgcaattctagaaaaaaaaggggcccttgctgaaaggcaacacacctccatggatctgcctaaattagcttccgatgatcgcccgagtcctcctagaggtttggttgccgcgtacagtggtgagtctgattccgaggaggaacaagagagaggaggaccagagagggaagagaagctgaccgattggcagaaattagcctgcctgttgtgtcggagacagttcccaagcaaagaggctttgatcagacatcaacaattgtcaggtttgcacaagcaaaatcttgagatacacaggcgggctcatctttccgagaatgaattggaagctctggagaaaaacgacatggagcaaatgaaataccgagatcgagctgctgagagacgggaaaaatatggcataccagaaccccctgaacccaaaaggcgcaaatacggaggcatttcaacagcttccgtagatttcgaacaaccaactagggatgggttaggctcagacaacatcgggtctcgtatgttgcaggctatgggctggaaggagggcagcggcctagggaggaaaaagcaagggattgtcacacccattgaggcgcagactagagttagggggtccggtctgggggcacggggcagcagttatggtgtgacttccaccgagtcctacaaagaaactttgcataagaccatggtgactcgctttaacgaagcccagtag

SEQ ID NO: 133172 - DNA, 2562 bp, Artificial Sequence
  Description of Artificial Sequence: Synthetic coding sequence
atggaatacgaacgccgggggggtaggggggatagaaccggacgttatggggccactgacaggtcacaagatgatggaggcgaaaataggagcagggaccatgactaccgagacatggattacaggtcctacccaagggagtatggcagtcaggaaggtaagcatgactacgatgattcgtccgaggaacaaagcgccgagatcagggggcagctccagagtcatggggttcaggcccgggaggttcgccttatgcggaataagtcctccgggcagagccggggcttcgctttcgtggaattcagccatcttcaggacgctactcggtggatggaggctaaccagcattccctcaatattctgggccaaaaagttagcatgcattatagcgaccccaaacccaagattaacgaagattggttatgcaacaaatgtggcgtacagaacttcaaacgaagggagaaatgttttaagtgtggagttccaaaaagcgaggccgagcagaagctgccccttggcacaaggttagaccaacaaacgttacccctgggaggacgcgagcttagccagggactccttcctctgccacagccataccaggcccaaggagtgttggcctcccaggcactgtctcaaggatcagagccctcatccgagaatgccaacgataccatcattttaaggaatttgaatccacacagcaccatggatagtatcctgggagcgctcgccccttatgctgtgttgagtagcagcaatgtccgagtgatcaaggacaaacagacacagctcaaccggggatttgcattcattcagctgtccacaatcgtagaggcagctcagcttcttcaaattctgcaggctctccatccccctctgactattgacgggaaaactatcaacgtagaattcgcaaaaggatccaaacgggacatggcctcgaacgaaggctctagaattagtgctgcctcggtagcttcgactgcgattgccgccgcacagtgggctatatctcaggcttcacagggaggggagggcacctgggccacctccgaagagccccccgttgactacagttactatcagcaggatgagggctatggaaattctcagggcaccgagtctagcctgtatgcccacggataccttaagggaacaaaaggacctggcatcactggtaccaagggggatccaaccggggccggacccgaagcaagcctcgaacctggcgcggatagcgtcagtatgcaagctttctcccgggcgcagcccggggccgcccctggtatttaccagcagtcggcagaggccagtagctcgcaaggaacggctgccaactcccagtcctatacaattatgtcacccgccgtgctcaagtcagaactccaaagcccaacccatccctcatcagcactccctcccgctacctccccgacggcacaagagtcttactcccagtaccctgtgccggacgtgtcaacatatcaatacgacgagacaagcggctactactacgatccacaaactgggctctattacgacccgaactcccagtactactacaacgcacagtctcagcagtatctttactgggatggggagagaagaacctacgtccctgccctggaacaaagcgccgatggtcacaaggagacaggggcccccagtaaagaaggtaaagaaaagaaggagaaacataagaccaagaccgctcagcagattgccaaagatatggaaagatgggcccgctcgctgaacaaacagaaagagaatttcaagaattcctttcagcccatttctagtttacgagacgacgaacgcagagagtcggcaacggccgacgcgggctacgcaatactagagaaaaagggagccctggctgagagacagcatacaagcatggacctacctaagctcgccagcgacgatcggccctcaccacccagaggcctggtggctgcctattctggagagagcgatagcgaggaggagcaagaaaggggaggtccagagagagaagagaagttgactgactggcagaagcttgcttgtctcttatgcaggagacagttcccttctaaagaggccctcatcaggcaccagcaactgagcggactgcataagcaaaacctggagattcatagaagagcgcacctaagtgaaaacgaactggaagcactggagaagaacgatatggaacagatgaaatacagagaccgcgccgctgaaagacgggagaaatatggaatccctgaacctccagagcccaaaaggcgcaaatacggaggcatcagtacagcctccgtggatttcgagcaacctacacgggacggcctcgggagcgataatatagggtctcgcatgttgcaggccatggggtggaaggagggatccggattggggcgcaaaaaacaggggatcgtgaccccaattgaagcacagacccgcgttcgcggatcagggctgggggctcgggggtcgtcttacggcgtaacgtccacggagagctacaaagagactctgcataaaaccatggtgacacggttcaacgaagctcagtag

SEQ ID NO: 133173 - DNA, 2793 bp, Artificial Sequence
  Description of Artificial Sequence: Synthetic coding sequence
atggagtacgagagacgcggcggtagaggagacagaaccggacggtacggcgctaccgaccgctcccaggatgatgggggggagaaccgctctcgcgaccacgactaccgggacatggactatagatcataccctcgagagtacgggtcacaggagggtaaacatgactacgacgattcatctgaagagcagtcagccgaggattcctacgaggcatcacccgggagcgaaacccagcgcagacggcggcgacgccacagacacagtcccacgggccctccaggctttccaagagatggcgattatcgggatcaggattatagaacagaacagggggaggaggaagaagaggaggaagacgaggaggaggaggagaaggcctccaatattgtcatgctgagaatgcttcctcaagccgcaacagaggacgacatccgtggccagttgcagagccatggtgtgcaagcgcgcgaggtcagacttatgagaaataagagcagcggccagtcaaggggatttgctttcgtggaattcagccaccttcaggacgccacacgttggatggaagctaatcagcacagtttaaatatactgggtcagaaggtctctatgcactattcagaccccaagcccaagattaacgaggactggttgtgtaataagtgtggcgtccaaaactttaagaggcgagagaagtgcttcaaatgcggcgtgcctaagagcgaagcagaacagaagctgcccctcgggacacggctggaccagcaaacattgcccctgggcggccgcgaactgtctcagggactcctcccacttcctcagccctaccaggcccagggcgtgctggcctctcaggcactcagccagggctccgagcccagctcggaaaatgctaatgatactattatcctcaggaacctgaatccccattctaccatggactcaatcttgggggcactcgcaccctacgctgtgttgtcttcttccaacgtgagagtaatcaaggacaagcaaacccaattaaataggggcttcgccttcattcagctgagtacgatcgtagaggccgcgcagttgctgcaaatcctccaggctctgcaccctccattgacaattgatggtaagacgatcaacgtggaattcgccaaaggtagcaaacgcgacatggcttccaacgaaggctcccggatcagtgccgccagcgtcgccagcaccgctattgctgctgcccagtgggctatcagccaggcctcccagggaggggaggggacttgggcaaccagcgaagagccgcctgtggattactcctactatcaacaggacgagggttatggcaacagccagggcaccgaatcgagcctctatgcccatgggtacctaaagggcacgaaagggcctggcatcactgggaccaagggcgatcccactggagcaggcccagaggcctcactcgagcctggtgccgacagcgtgtcaatgcaggcatttagtcgggctcagccaggggccgctcctggaatctaccaacagtctgctgaagcctcttcttcccagggaaccgctgccaatagtcaaagctataccatcatgtctcccgccgtccttaagtcggaattgcagtctcccacacaccctagttcggcccttcctcccgccactagtccgactgcccaggaaagctactcccagtaccccgtgcctgacgttagtacctaccagtacgacgagacgagtggctactactatgacccgcaaaccggtttatactatgatccaaacagccagtactactataacgctcaatctcaacaatatctgtactgggatggcgaaagacggacatacgttcccgccttggagcaaagcgccgacggtcacaaagaaaccggcgcgcctagcaaagaagggaaggagaaaaaagagaaacacaagactaagaccgcccaacagatcgcaaaagatatggagcggtgggctcggtcactaaacaagcagaaggaaaacttcaaaaacagctttcagcccatcagctctttgagagatgatgagcggcgcgaatccgcgaccgcggacgctgggtacgctatcctcgaaaagaagggggccctcgccgaaagacagcatacatccatggacctgcctaagctggctagtgacgacaggccctcgccaccacgagggctggtcgccgcgtattccggagaatccgatagtgaagaagagcaagagcgaggcggccccgagcgtgaagagaaactgactgactggcaaaaacttgcctgcctcttatgtcggaggcagtttccttcaaaggaggcgttgatcaggcaccagcaactgagtggcctacacaaacagaacctcgagatacatcgacgagcccacctctccgagaacgaattggaggcactggagaagaatgacatggagcaaatgaagtatagggatagggcagctgagcgtcgtgaaaagtacggcatcccggaaccgcctgagcccaagcggcggaaatacggcggaatctccacggccagcgttgactttgagcagcctaccagagatggcctcggcagtgacaatatcggaagtcgaatgcttcaggcgatgggttggaaggaggggagcggacttggtaggaagaaacaaggtattgtgacgcctattgaagcccagacccgcgtccgaggcagcgggctgggagccaggggatcttcctatggagttacctctacagaatcctataaagagaccctccacaaaactatggtgactcgcttcaacgaagcacagtag

SEQ ID NO: 133174 - DNA, 2010 bp, Artificial Sequence
  Description of Artificial Sequence: Synthetic coding sequence
atgaaaattttcgttgggaacgtcgatggtgctgatacgacgcctgaagagctggctgcattgttcgccccctacgggaccgtgatgagttgcgccgttatgaaacagtttgccttcgtacacatgcgtgagaatgccggagcacttcgcgctatcgaagcgctgcatgggcacgaattgaggcccgggcgcgccctagtggtagagatgtcaagaccccgacccttgaacacatggaagatatttgtgggaaatgtgtcagccgcgtgtaccagccaagagctacggtcactcttcgagcggagaggacgcgtcattgaatgtgatgtggtgaaggactacgctttcgttcatatggaaaaagaggctgacgcaaaggctgctatcgcccagctcaacggtaaagaagtaaaaggcaaacgtattaacgtcgaattatcaacaaaaggacagaagaaaggtcctgggctagccgtacagagcggtgataagactaaaaagcccggggctggcgacactgcattccctgggactgggggcttctcagctacatttgactaccagcaggcgttcgggaattcaacaggtggatttgacggccaagccagacaacctaccccaccatttttcggccgagaccggagccctctgcgccggagtcctccccgggcctcttacgttgctcccctaaccgcccagcccgccacatatcgggcccaaccatctgtgtctcttggggcagcgtacagagcccagcctagcgcctcgttgggtgtggggtaccggacgcaaccaatgacagcacaggccgccagctaccgggcccagccttcagttagtctgggggccccatatcgcggacagctggcaagtccgagcagtcagagtgcggctgccagttcactgggaccctatggtggagcgcagccctcagcctccgctctaagttcttatggcggtcaggccgctgccgcgtcatctcttaattcctacggggcccaaggaagttcactggcctcatatggtaaccagccaagctcctatggggcccaggctgccagctcttatggcgtgagggcagccgcatcttcctacaacacccagggcgccgcttcatctctgggttcctacggagcccaagctgcaagctacggcgcccagagtgctgcaagcagtctggcctatggggcgcaagcggctagttacaacgctcaacctagtgcgtcatacaatgctcagtccgctccctatgcggcccagcaggccgcttcctacagttcccagccggctgcttatgtggctcaacctgccacagccgccgcatacgcctcccagcctgctgcctacgcggctcaggccaccacacccatggccggatcttatggtgctcagccagtcgtgcagactcagctgaatagctatggagcccaggcttctatgggactttcaggaagctatggggcacaatccgcagccgccgcgactggctcttatggtgccgccgccgcctatggggcgcaaccttccgccactctggcggcaccttatcggacacagtctagcgcctcgttagccgcttcctatgccgcccagcagcacccacaggccgcggcaagctataggggtcagcccggcaacgcatatgacggtgctggccagccttccgctgcatatttgagcatgagtcagggggccgtggccaacgccaacagcacgccacccccctacgaacgcactcgactgtcaccaccaagggcaagttatgacgatccctacaaaaaagccgttgcaatgagcaaaagatatggcagcgaccgtcgcctcgctgaattgagcgattacagaagactcagcgagtcccagctttcttttcgtcgcagccctaccaagtcttcactcgactacaggcgtctgcccgacgctcacagcgactacgcccgctactccggctcttataacgactacttaagggcagctcagatgcattccggataccagaggcgtatgtag

SEQ ID NO: 133175 - DNA, 471 bp, Artificial Sequence
  Description of Artificial Sequence: Synthetic coding sequence
atgaaaatctttgttggcaacgtagatggagccgacaccaccccagaggaactcgctgcattattcgcgccatacggcacggtgatgtcgtgtgccgtgatgaagcagttcgcgtttgtccacatgcgagagaacgccggagctcttcgtgccatagaagcactccacgggcacgagctgaggcccgggcgggccctggtcgttgagatgagccggccacgccccctcaacacctggaaaatattcgtcggcaacgttagcgcagcctgtacaagccaggaactccgcagcctgttcgagaggcggggcagggtgatcgagtgcgatgtcgtgaaggattatgcctttgtgcacatggagaaagaggctgacgccaaggctgccattgcacaactgaacggcaaagaggtgaaggggaagcgcatcaacgtagagctgagcactaagggcatggttcccacgggggtatag

SEQ ID NO: 133176 - DNA, 360 bp, Artificial Sequence
  Description of Artificial Sequence: Synthetic coding sequence
atgaaaatctttgtcggaaatgtggatggcgcagacacaacaccagaggaactggcggcattgttcgctccatacgggacagtcatgtcatgcgccgtaatgaagcaattcgccttcgtgcacatgcgcgagaacgccggggcactcagggccatcgaggcgcttcacgggcatgagcttcgccccggccgggccctggttgtggaaatgagccgccccagaccactgaacacatggaagatctttgtgggcaacgtgagtgcagcctgcacaagccaggaacttagaagcctgttcgagcgccgtggaagagttatcgagtgtgatgtcgtgaagggtatggtgcccacaggagtgtag

SEQ ID NO: 133177 - DNA, 2934 bp, Artificial Sequence
  Description of Artificial Sequence: Synthetic coding sequence
atgcggactgcaggaagggatcctgtcccacggaggtcaccaaggtggcgccgcgccgtgcccctctgcgaaacctcagcgggtcggcgcgtaacccaactgaggggagacgatctccgtcgccctgcaaccatgaagggcaaggaacgcagccctgttaaggcaaaacgaagtcgaggtggcgaggattccacctctcggggcgagcgctccaaaaaactcggtggcagtggaggaagtaatggctcaagcagtggcaagacagattccggcggcgggtcacgaaggtccctacatctggataagtcctccagtagaggcggctcacgcgagtacgataccgggggcggaagcagtagcagccgcctccatagctacagctccccgtctaccaaaaacagttccgggggaggggagtctaggtcaagcagtagagggggcggcggcgagagtcgtagctccggagctgctagctccgcgccagggggcggtgacggcgcagagtacaagactctaaaaatctcagagctagggtcacaactgtcggacgaggccgttgaagatggcctcttccacgaattcaagagattcggcgacgtgtccgttaaaatttcacacttgagtggatcaggatctggggacgaacgagttgctttcgtcaattttcggagacccgaagacgccagagcggccaagcatgcccgcggaaggctggtgctgtatgaccgccctctgaagatcgaggcggtatatgtttcgcgcaggaggagccggtctcctctggataaagatacatacccccccagtgccagcgtggtgggtgcctccgtggggggacaccgccaccctccgggcggtggtggcggccaaagaagccttagccctgggggagcagctctgggttaccgagactatcgcttgcagcagcttgccctcgggcgcctgcccccccctccaccaccccctctgcctcgcgatcttgaaagagaacgagattacccgttttatgagcgagtacggcccgcctacagtctcgagcctcgcgtgggcgctggcgctggggcagcaccttttcgtgaggtcgacgagatttctccggaggatgatcaacgggccaaccgcactctgttcctcggcaacctggacattactgtgacagagtccgatctgaggcgcgccttcgataggttcggcgtgattaccgaagtcgacattaaacgcccctctcgcggccaaacatccacctacgggttccttaagttcgaaaacctggacatgtcccaccgcgccaaattggcaatgagcggcaagatcattataaggaatccgataaagatcggctatggcaaggccacgcctaccacccggctgtgggtgggaggtctgggtccctgggtgcctctggccgcactcgctagggagttcgacagattcggaactattcgtaccatcgactatagaaaaggtgactcctgggcttacattcagtacgaatccctagatgcagctcacgcggcatggactcacatgcgcggctttccccttggcggaccagaccgccggctgagggtcgattttgcagatacggagcacaggtaccaacagcagtatcttcagcctctcccccttactcattatgagctcgtgaccgatgcatttggacaccgtgcccccgacccccttcgcggagcccgtgatcggaccccacctcttctgtatcgggatcgagatcgagatctataccctgactctgattgggtacctccaccccctccagtccgagaacgcagcacacggactgcagccacaagtgtaccagcttacgaacctctggactctctggatcgacggagagatggatggtcactggatcgggaccgaggagaccgagacctcccgagcagtagggaccagccgcggaaaagacgtctacctgaggaatccggggggcggcatcttgaccgatctccggaatctgataggccaaggaaaagacactgtgctcccagcccggatcggtctccagaactgtcaagctctagagatagatacaacagtgataatgatagaagctcgcgccttctgttagagcgcccttcccccattcgtgacagacgtgggagtctcgagaaatctcagggggacaaaagggacagaaaaaatagcgcctcggctgaaagggatcgaaaacaccggacgactgctcccacagagggtaagtctcccttgaagaaggaggaccgttccgacggaagtgcaccgtccaccagtactgcctcatcgaaactcaaatccccctcacagaaacaggatggaggtacagcccctgtcgcgtcagcctcaccgaaactgtgcttagcctggcagggcatgctgttgttgaagaacagcaatttcccttcaaatatgcacttgctgcaaggtgatttacaggtcgcatcatcactgttggtcgaaggaagcacaggcggaaaggtggcccagctgaaaataacacagagactgcgtctggatcagccaaaattagacgaagtcactcgccgcattaaagttgccgggcccaacggatacgcaatcctgctcgcggttcccgggtcgagcgacagccgaagcagcagtagtagcgcagctagtgatactgccacctctactcagcgccctttaaggaacctggtatcctatctgaagcaaaagcaggccgccggcgtgatctctctccctgtgggtgggaacaaagacaaggagaacaccggggtgctgcacgcattcccgccctgcgagttctcccagcagtttctcgacagcccggccaaagccttggccaaaagcgaggaggactacctagtcatgataatcgtcagaggtttcgggttccagatcggcgtccgctatgaaaacaagaagagagagaacctcgctctaacgctcttatag

SEQ ID NO: 133178 - DNA, 2673 bp, Artificial Sequence
  Description of Artificial Sequence: Synthetic coding sequence
atgaagcgacagtctgaacgtgattcatctccaagcggtagaggttcctcttcttcagccaagcggcccagagaaagagaacgggaggcagaggctggaggtagacgagctgcacacaaggccagtgggggtgcaaaacatccggtgcctgcccgtgcacgggataaaccaagagggtcggggtccggggggggaggtcatcgggatggtcgcgggacaggggacgccaaccaccgagcatctagtggtaggagcagcggaagcggcgctggcggaggcgggcggggggggaaagcaagtggcgaccctggcgcgtccggtatgtccccacgcgctagtcctcttcccccccccccgcccccaccaggcgcagagcccgcttgccctgggagttccgccgcagcgccagaatacaagacactcttgattagcagccttagcccggctctcccagcggaacatctggaggaccggcttttccaccagttcaagcgatttggagagattagcctcagactgtctcatacccctgagctgggaagagtggcctacgtgaatttcaggcacccacaggatgcccgcgaggcgcgtcagcatgccctggctcggcagctgctcctttacgaccgccctctcaaagtggaacctgtttatctcagaggaggcggcgggtcttcgaggcggtcaagcagtagctccgcagctgcctctaccccccctccaggacctccagcccccgcagacccattaggctacctgccgctccacggcgggtaccagtacaagcaacggtctctgtcacctgttgctgcccctcccctccgcgagcctcgggcccgacatgccgctgccgcgttcgcgttggacgctgcagccgcggccgccgtgggcctgagccgtgaaagagccctcgactactacggactgtatgacgatagaggtagaccctatggttatcccgccgtgtgcgaagaggatctgatgcctgaggacgatcaacgagctacacgcaacttatttatcggaaacttagatcattcggtttccgaagtcgaactgcggcgggcttttgaaaagtacggaatcatcgaggaagtggtcatcaagaggcctgctcggggacagggaggcgcctatgccttcctgaagtttcagaatttggatatggcccatagggccaaggtcgcaatgtcgggccgggtgattggcagaaaccctataaaaattgggtacggaaaggccaatcctaccacccgcctctgggtgggcggccttgggcctaacaccagcctggccgcgctcgcccgagaattcgaccggttcggtagtatccggactatcgatcacgtgaaaggggacagcttcgcctatatccagtacgaatctctggatgctgcccaagcagcctgcgccaaaatgaggggcttcccactgggaggacccgaccgaaggttaagggtggatttcgcaaaggcggaggaaactcgctacccacagcaataccagcccagcccacttcccgtccactatgaactcctgaccgatggctatacaaggcatcgtaatctcgacgccgacctggtcagagaccgaactcctccacatctcctttattctgatagagataggacatttctcgagggtgactggaccagcccaagtaaaagctccgacagaaggaattcacttgaggggtacagcaggagtgtgcgctctcgtagcggagaacgctggggcgcagacggcgatagagggttaccgaagccatgggaagagagaagaaagagaagatctctgtcttctgaccgggggagaacaactcatagtccctatgaagaaagatccagaactaaagggtccgggcagcagtccgaacgtggttctgacaggacaccagagcgcagtcggaaagagaaccatagctcggagggcacgaaagaatcttcaagcaatagcctgagcaactccagacacggagctgaggagaggggacatcaccatcatcatcacgaagccgctgactctagccatggaaagaaggcccgtgactctgagcggaaccacaggaccactgaggctgagccaaagcctctggaggaacctaaacatgaaaccaaaaagctgaagaatctgtctgaatatgcacagacactgcagctggggtggaatggtttgctcgtactgaagaattcctgctttcccaccagcatgcacatcttggagggggatcagggcgtgatctcttccctgctgaaggaccacacttcgggtagtaagttgacacagctcaaaatagctcagaggttaaggctggatcagcctaagctcgatgaggttacccgacgaatcaaacagggctctcccaacggatacgcagttctcctcgccactcaggctaccccatctggtctgggcacggaggggatgcctaccgtggaaccaggcttacagcgcagattgcttcgtaacctggtgtcttaccttaaacagaaacaagccgccggagtgatcagcttaccagtgggaggatctaaaggaagagatggcactggcatgttgtacgcatttcctccttgtgatttttcccagcaatatctgcagtctgccctgaggacccttgggaagctagaagaggaacacatggtaatcgtcatcgtgcgcgacacggcatag

SEQ ID NO: 133179 - DNA, 765 bp, Artificial Sequence
  Description of Artificial Sequence: Synthetic coding sequence
atggagactgtggtatgtcccccttgggaagagcgtcgaaagcggaggtccctgtcctccgatcgaggacggaccactcactcaccatatgaggagcggagccgtaccaaaggcagcgggcagcaatcagaaagaggctctgaccgcaccccagagagatcccgaaaagaaaatcacagctcagaagggaccaaagaatcctcctcgaatagtctaagtaactctaggcatggggctgaggagagaggacaccatcatcatcatcatgaggcagcagattcctcacacggaaaaaaggctagagattcagaacgcaaccatagaaccacggaggcagaacctaaaccactggaggagcctaagcatgaaactaagaaactaaagaacctttctgagtacgctcagaccctgcagctgggctggaacgggctgcttgtgctcaagaactcctgtttccccactagtatgcacatcctggagggggatcagggggtgatttcctccttactcaaagaccacacttctgggagtaaactgacacagttgaagattgctcaaagactccggttggatcaaccaaagctggacgaggttacccgccggattaagcaaggaagtcccaacggctatgccgtccttcttgcaactcaggcgactcccagcgggttgggcacggagggcatgcccacagtggaacccggtctccagcggcggctgcttcggaacctcgtgtcttacttgaaacagaaacaggctgcaggctag

SEQ ID NO: 133180 - DNA, 636 bp, Artificial Sequence
  Description of Artificial Sequence: Synthetic coding sequence
atgaaaagacagtccgagaggaatcacagaacaaccgaagctgaaccgaagccattggaggagccaaaacacgaaaccaaaaaacttaagaacttatcagagtatgcccagactctgcagctgggctggaatggtctcttggtcctgaagaacagctgcttccccacaagcatgcacatcttggagggcgaccagggcgtgatttcgagcctacttaaagaccacacgtcaggatcaaagctgactcaactgaagattgcccagcgcttgcgtctcgaccagcctaagttggatgaagtaactagacggatcaaacaaggaagcccaaatgggtacgctgttcttctggctactcaggccaccccgagtggcttaggcactgaaggcatgccaactgtagaacccggcctccagaggcgccttctgagaaacctcgtctcctatcttaagcagaaacaggccgcgggcgtgatttctctccccgtaggaggatccaagggcagggatgggactgggatgctgtatgccttcccaccttgtgacttcagccagcagtatttgcagtcagctctacggacgctcgggaagctagaggaggagcatatggttattgtgatcgtgcgcgacacagcttag

SEQ ID NO: 133181 - DNA, 1692 bp, Artificial Sequence
  Description of Artificial Sequence: Synthetic coding sequence
atgcccgaagacgaccagagggcgacaagaaatctgtttatcgggaatctggaccatagtgtgtccgaggtcgagttgcgacgggcgtttgagaaatacggtattattgaggaggttgtgatcaagaggccagcacgggggcagggcggtgcctacgcatttctcaagttccagaacctggacatggcacacagagcaaaagtggcaatgagtggcagggtgattggcaggaaccctattaagatcggctacgggaaagctaacccaaccacacgattatgggttgggggcctgggcccaaacacctcccttgctgctctggcccgcgagtttgatcgctttggcagcatcagaaccattgaccacgtcaaaggggacagcttcgcatacatccagtatgagtcccttgacgccgcacaagccgcctgcgccaagatgagggggtttcccctcggcgggcccgaccggcgcctgagggttgactttgcgaaggcagaggaaacacgatatccccagcagtaccagccaagtccgttgccagtgcactatgagctgctgactgatggatacacaagacaccgtaacttggacgctgaccttgtgagagataggacaccgcctcacctcttatactccgatcgggatcgtactttcttggaaggggactggacaagtccctctaagagctccgaccgcaggaacagcctagaaggatatagccggagtgtccggagccggagcggcgagagatggggagccgacggcgatagagggctccccaagccctgggaggaacgcagaaaacggagatcgttgtccagcgacagaggtagaaccacccatagtccctacgaggagaggtctagaaccaaggggtcggggcagcagtccgaacggggatcagaccggacacctgaacgctcacggaaggaaaaccatagtagcgagggtacgaaggagtcgagctctaacagcctctcaaattcccggcatggcgcagaggaaaggggccaccatcaccatcatcatgaagccgccgattcttctcacggaaaaaaggcccgcgactctgaacgaaaccatcgcaccactgaagccgagccgaagccattagaagagcccaagcacgaaactaagaaattaaaaaatctgagcgagtacgcacagacactccagctgggctggaacggcttgctggtgctaaagaactcctgcttcccgacctccatgcatatcctggagggcgatcagggcgtgatctcatctctgctaaaggatcacactagcggatctaagctgacacagttaaagatagcccagaggttacgcttggatcaacctaagctggatgaggtgaccagacggatcaagcagggatctccaaacggctacgcagttctcttagcgacacaagctaccccgtctggcctgggcaccgaggggatgcccaccgtggagccaggcctccagagaaggctgctacggaacctggtttcctacctgaagcagaaacaggcagctggcgtgatctctctccccgtgggcggaagcaagggaagggatggtacaggaatgctctacgcttttcccccgtgcgattttagccagcaataccttcagtctgctctgcgaaccctcggcaagctcgaggaggagcatatggtgatagtgatcgtccgtgacaccgcctag

SEQ ID NO: 133182 - DNA, 732 bp, Artificial Sequence
  Description of Artificial Sequence: Synthetic coding sequence
atgggcagagtgggtagagccggtagatcacagaggacaaagcagtccacagtgctggcccccgtcatcgacctgaaacgtggaggcagcagtgacgaccgccaaatcgtagatacacccccacacgtcgccgccggacttaaggaccctgtgccttctggattctccgccggcgaggtcctcataccacttgctgacgaatacgatccgatgttccctaacgattatgagaaagtcgttaaacggcagagagaggagaggcaaaggcagcgcgaactggaacgacaaaaggaaatcgaggagagggagaaacggagaaaagacaggcacgaagcgtctggtttcgctcgcaggcccgaccctgattcggacgaggatgaagactacgagcgggagcgcaggaagagatccatggggggtgcggcaatcgcccctcccacgagcctcgtcgagaaagataaggagctgcctcgtgattttccctacgaggaagattcacggcctaggagccagagcagtaaggccgccatcccaccgcctgtatatgaagaacaggatcgcccgagatcacccaccggcccctccaacagtttccttgcaaatatgggcggcaccgttgcacacaagatcatgcagaagtacggttttagggaaggacagggactgggcaaacacgagcaagggctgagtacagcgctcagtgtcgagaagacatctaaacggggagggtag

SEQ ID NO: 133183 - DNA, 1206 bp, Artificial Sequence
  Description of Artificial Sequence: Synthetic coding sequence
atgtcactctacgacgacttaggcgtggagacttcagattctaaaacggaaggttggagcaagaacttcaaattgcttcagtcacagcttcaagtgaagaaggccgccttaactcaggccaagtctcaaagaactaagcagagcacagtcctggctccggttattgacctgaagagaggcggctcttctgatgaccggcagattgtagacacgccccctcatgttgccgccggactgaaagacccggtccctagcggattcagcgccggcgaggtgctaatcccacttgccgacgaatacgacccaatgtttcctaatgactatgagaaggttgtcaaacgccagcgcgaagaaagacagagacagagggaattggagcggcagaaggagatcgaagaaagagagaagaggagaaaagatcgtcacgaagcatcgggatttgctcgtaggcctgacccagacagtgacgaagatgaggattatgaacgggagcgtagaaagaggtccatggggggagccgccattgcccctccaacaagcttggttgaaaaggataaagaactgcctcgagattttccatacgaggaagatagcagaccgcggtcacagtccagcaaggctgccattccaccccctgtctacgaggaacaggatcggccgaggagcccaaccgggccgtcaaactctttccttgctaatatgggcggcacagtggcacacaagataatgcagaaatacgggttcagagaagggcaggggttgggcaaacacgagcaaggcctaagtacagccctctccgtggaaaaaacgagcaaaagggggggaaaaattattgtgggtgatgcgactgaaaaggacgcatccaaaaaatccgattctaatcctctgaccgagattctcaagtgtcctaccaaagtagtgctacttcgtaacatggtcggcgcgggggaggtggatgaagacctggaggttgagactaaagaggaatgtgaaaagtatggcaaggtgggcaaatgtgtgattttcgaaattcccggagcccccgacgatgaggccgtgcgtatattccttgagttcgagcgagtcgaatccgccattaaagcagttgtggacctgaatggtcggtatttcggtggacgggttgtcaaggcctgtttctataacctggataagtttagggtgttggacctggccgagcaggtgtag

SEQ ID NO: 133184 - DNA, 639 bp, Artificial Sequence
  Description of Artificial Sequence: Synthetic coding sequence
atgagtctttatgatgatctgggcgtggaaacatcggattccaaaactgaaggttggagcaagaacttcaagctgcttcagtcccaactgcaggtaaagaaggccgccctgacgcaggccaaatcccagagaaccaagcagtcaaccgtgctagccccagtcattgatttaaagcggggcgggtcctccgatgatcggcagatcgttgatacacccccgcacgtggccgcgggcctcaaagacccagtgccttccggattcagtgccggcgaagtcttgatccctctggccgatgagtatgaccctatgtttcccaacgattacgagaaagtggtgaagcgccagcgcgaagaaaggcagcgacagagggaactcgaaagacaaaaagaaatagaagagcgggagaaaaggagaaaagacaggcacgaagcatcagggttcgcccgtcggccagaccctgactccgacgaagacgaagattatgagagggagaggcggaaacggagcatgggcggggctgcaattgccccacctactagcctagtggagaaagataaagagctgccaagagactttccttatgaggaggatagcagaccccggtcccagagttcaaaggcagcaatcccacctccttag

SEQ ID NO: 133185 - DNA, 666 bp, Artificial Sequence
  Description of Artificial Sequence: Synthetic coding sequence
atgagcctttacgatgacctcggagtggaaaccagcgactctaaaacagaaggatggagtaagaacttcaaactgttgcagtctcagctccaggtgaagaaggcagcattaacacaggcgaaatctcagaggactaagcagagcactgtccttgcgcccgtcatcgatctgaagaggggggggagctctgatgataggcagatagttgacaccccgccacatgtggccgctggcctgaaagacccagtgccatccgggttttcagctggagaggtgctcataccactcgccgatgaatatgatcccatgttccccaacgattacgagaaagtggtgaagcggcagcgggaggaaaggcagaggcagcgcgagctggaaaggcaaaaagagatcgaagaacgggagaagcgcaaggaccgccatgaggcatctgggtttgcccggcggccggatcctgattctgacgaggatgaagactacgagagggaacgcaggaaaaggtctatgggtggagccgccattgccccccctacgtctctcgtggagaaggataaggaattgcctcgtgactttccttacgaagaagatagcaggccaaggagccaatctagcaaagcggccatccccccacccgtatatgaagaacaggatcgcccccgctcttag

SEQ ID NO: 133186 - DNA, 732 bp, Artificial Sequence
  Description of Artificial Sequence: Synthetic coding sequence
atggggcgtgttggtagagctggccgcagtcaacgaacaaagcagtccacagttctggccccagtgatcgacttaaaacgcggaggatccagcgatgaccggcagattgtggatactccgccccacgtggctgccggtctcaaagatccagtccccagcgggttcagtgccggcgaggtcctgataccactagccgatgagtacgacccaatgttccctaatgactacgagaaagttgttaagcggcagagagaggagcggcaaagacagcgcgaactggagcgacagaaggagattgaagagcgagagaaaagacggaaagaccggcatgaagcttccgggttcgccaggaggcccgatccagattccgatgaggacgaggactatgaacgggagaggcgtaagagaagtatggggggtgccgcgatagcaccccctaccagcttggtggaaaaagataaggaactgccgcgcgatttcccgtatgaagaagattccaggcctaggagccagtccagcaaggccgccattccaccccccgtgtatgaggagcaagacagacctcgatcccccactgggccatccaactcttttcttgccaacatgggagggaccgtggctcacaagatcatgcagaagtacgggtttcgagagggacaaggtctgggtaaacatgagcaggggctgagtacagccctctctgtcgaaaaaacttccaagcggggaggctag

SEQ ID NO: 133187 - DNA, 1206 bp, Artificial Sequence
  Description of Artificial Sequence: Synthetic coding sequence
atgagcctgtacgatgaccttggcgtcgaaacgtcagacagcaaaacagagggctggtccaaaaattttaaactgctccagtcccaactgcaggttaaaaaggcagcactgactcaagcaaaatctcagcgaaccaagcagtctaccgtgcttgctccagtcattgaccttaaaagggggggcagctccgatgacagacagattgttgacactcctccgcacgtggcggctggcctgaaggaccctgtacctagtggatttagcgctggcgaggtcctgattccactcgccgacgagtatgaccccatgtttcccaatgactacgagaaggtggtaaagagacagagagaagagagacagagacagcgggagctggagagacagaaggagattgaggaaagagagaagcgccgaaaggacaggcacgaagcttccggcttcgctcgcaggccagacccagacagtgacgaggacgaggattacgagcgcgagagacgcaagcggagcatgggcggcgcggcaattgccccgcctactagtctggtggagaaggataaagaactacctcgggactttccatatgaagaagatagtagaccgcggagtcagagctccaaggccgctattcctcctccagtgtacgaagagcaggaccggccccggtcaccgaccggccccagcaacagctttctcgccaatatgggcggaacggtggctcataaaattatgcaaaaatatggattccgggaagggcagggactgggaaagcatgagcaggggctgtcaacggccctctccgttgaaaagacatccaaaagggggggaaagatcatcgttggagacgcgacagagaaggatgcatccaagaagagcgactccaacccactgaccgaaatcttaaagtgtcccactaaagttgtgctgctgcgcaacatggttggagccggtgaagtggacgaggacctggaagttgaaactaaagaagagtgtgaaaaatacggcaaggtgggcaagtgtgtgattttcgaaattccgggggctcctgatgatgaagcagtgcgcattttcctggagtttgagagagtggaatccgctattaaggctgtagtggatttaaacggccgctacttcggaggacgtgttgtcaaagcctgcttttacaacctcgataagtttagagtgctggatttggctgagcaggtatag

SEQ ID NO: 133188 - DNA, 678 bp, Artificial Sequence
  Description of Artificial Sequence: Synthetic coding sequence
taaccactggccgatgaatatgatcctatgtttccaaatgactatgaaaaggtggtgaagaggcagcgcgaggagcgtcaaagacagagagagctcgaaaggcagaaagagattgaagagcgcgagaagcgtcgaaaagataggcacgaagccagcggcttcgcccgcagaccagatcctgattcagacgaggatgaagactacgagcgggagcgtcggaagcgatctatgggcggggcagccatcgcaccccccacctctttggtggaaaaggacaaggaactgccccgtgattttccgtacgaggaagatagccgtcctaggagccagtctagtaaggcggccatacccccccctgtctatgaagaacaggatagaccacggagtccaacaggccctagtaattcttttttggccaacatggggggcaccgtggcccacaagataatgcaaaagtacggattccgcgaagggcaggggttaggaaaacacgagcagggtctgtcaacggccctcagtgttgaaaagacttcgaagcgcggcggaaagattatagtgggtgatgccaccgagaaaggcgtctcaccgggcaagcgtgtcacccgtggcaagggtctggcacccagcatcagcgatatggcttctcttgacccccacgtgtccgcaggcggacaatag

SEQ ID NO: 133189 - DNA, 3684 bp, Artificial Sequence
  Description of Artificial Sequence: Synthetic coding sequence
atggtgctagcggctgccatgtcgcaggacgcagatcctagcggacccgaacagcccgaccgcgtggcctgttccgtgcctggagccagggcatctcctgccccttccggaccgagaggtatgcagcagccaccacctcccccccagcctcccccacctccgcaggccgggttaccccagatcatccagaatgccgccaaactcttggataaaaacccctttagcgtttccaatcctaatcctctgttgccttctcccgcctcacttcagctggcccagttgcaagctcagctcacactgcatcggttgaagctggctcagactgccgtgacgaataacaccgccgctgcgaccgtgcttaaccaagtgttatcaaaggtggctatgtcgcagcctttgtttaatcagctgagacatcccagcgtgattacagggccccacggtcacgctggggtccctcagcacgccgcagccatcccatccacccgctttccctcaaatgctatcgcctttagtccaccctcacagaccaggggtccggggccttccatgaacttaccaaaccaaccgcctagtgctatggtcatgcaccccttcacaggtgtaatgccgcaaacacctgggcaaccagcagtgatactcgggattggcaaaacgggcccagctcccgctaccgcagggttctatgaatacggaaaggcctcatctggccaaacctacgggcctgaaactgatggccagcccggatttctgccttcttcggcgtctacctcaggcagtgtaacctatgaagggcactattcacacaccgggcaggatgggcaggccgccttttccaaagacttctatggccctaactcccagggatcacacgttgccagcggctttccagcagagcaggcaggaggactgaagagcgaagtgggtccactgctgcagggcacaaattcccagtgggagtccccacatgggttcagcggccagtccaaaccagatcttaccgcaggtccaatgtggccccccccccataatcagccatacgaactgtacgaccctgaagagccaacgtccgatcgtacacctcctagctttgggggccgacttaataactcaaaacagggttttatcggagcgggccgacgagctaaagaggaccaggccttgctgtctgttcggccccttcaggcccacgaactaaatgacttccatggcgtcgccccgctccaccttccacacatttgttccatttgcgacaaaaaggtgtttgacctgaaagattgggagctccacgtcaaaggcaaattacacgcacagaaatgtctagtcttcagtgagaacgctggcatacgatgcatcctagggtctgccgaggggacgctgtgcgccagcccaaatagtacagcagtctacaatcccgctggtaacgaagattatgcctccaatctcggtacgtcctacgtacccattcctgcacggtccttcacccagtccagtcctacattcccactggctagtgttgggaccaccttcgcccagaggaagggcgccggaagggtggttcatatttgcaatttgccagaaggatcgtgcacggagaacgatgtaatcaacttgggactccctttcgggaaggtaactaattacatccttatgaaaagtactaatcaggcctttttagaaatggcgtacaccgaggctgcccaggcaatggtacagtattatcaagagaagagtgctgttataaacggagagaagctgctgattcggatgtccaagcgttataaagagctgcaactgaaaaaacctgggaaggcagtagcggctatcatacaggatatccattctcagcgcgagagagacatgttcagagaagccgacagatatggcccagagaggccccggagtcgctcccctgttagcagatctttgtcaccgcggagtcatactccttccttcacatcctgttcttcctctcattccccacccggaccatctagggctgattggggcaatggaagagacagctgggaacattctccttacgctcgtagggaggaggaacgcgatcctgcaccttggagagataacggcgacgataaacgagataggatggacccttgggcccatgatagaaaacatcacccccgccagctcgacaaagcagagttggacgaacgccccgaggggggccgcccacacagggaaaagtacccccggtccggctcccctaatctccctcattcagtgtcatcctacaaatcccgcgaggacggctactacagaaaagagcctaaagcaaaatgggataagtacttgaagcagcagcaggatgcaccaggacgtagccgcaggaaggacgaggcacggctgagagaatctcgccacccccacccagatgactctggcaaggaggatggtctcggccccaaagtgactagagcgcctgaaggcgcgaaggccaagcagaatgaaaagaataagacaaaacgcaccgatcgcgatcaggaaggcgctgacgatcgaaaggaaaacaccatggctgagaatgaagccggcaaggaggagcaagagggaatggaagaatcccctcagagtgtggggcggcaggaaaaggaggccgagttctctgaccctgagaacacccgcaccaagaaggaacaggattgggagagcgaatctgaagccgagggcgaaagttggtatccaacaaatatggaggaactggtgaccgtcgacgaagtgggggaggaggaggattttatcgtcgagccagacatcccagagttagaagaaatcgtgcccatagatcagaaggataaaatctgtcctgagacctgtttgtgcgtgaccaccacactggatcttgacctcgcacaagacttccccaaagaaggtgttaaggccgttggaaacggagctgcagagatcagcctgaagagtcctagagaactcccttctgcctccacatcctgccctagcgatatggatgtggagatgcctggcctgaacctcgatgctgagcggaagcctgctgaaagcgaaacagggctgagcctcgaagattccgactgctatgagaaagaagctaagggcgtcgaaagctctgatgtgcatccggcaccaaccgtccagcagatgtcatccccaaaaccggctgaagaacgtgcccggcagccttcaccttttgttgacgattgcaaaacccgcgggacgcccgaagatggggcttgcgaaggtagcccgcttgaggagaaggcgagtcctcctatcgaaacggacctgcagaatcaggcgtgccaggaggtgctgacaccagagaattccaggtacgtagagatgaagagtttagaggtccgcagcccagaatatacggaggttgagttgaagcagcccctgtcccttccttcttgggagccggaggatgtgttttcggagctgagtatacccctcggggtcgagttcgtcgtaccgcggacgggtttctattgcaagttgtgtgggctgttttacaccagcgaggagacggcaaaaatgtcccactgccgatcagcagtgcactatcgtaatctgcaaaagtacctgagccagcttgcggaggaaggcctcaaagagaccgagggtgctgattcacccaggcctgaggacagcggtatcgtgcccaggttcgagagaaagaagctgtag

SEQ ID NO: 133190 - DNA, 3378 bp, Artificial Sequence
  Description of Artificial Sequence: Synthetic coding sequence
atggtcctagcagctgccatgagtcaagacgctgatcctagcgggccagagcaacctgaccgcgttgcctgcagtgttcccggcgctcgagctagtcctgcgccctccggccctaggggaatgcagcagccaccccctcccccccagcccccaccacctccccaagctgggctgcctcagattattcagaacgccgccaaactgctggacaaaaacccctttagcgtgtctaatccgaacccgttgctgccttcccccgcatctctccaacttgcccagcttcaggcccaactgaccctacacaggcttaaactcgctcagacagctgtcactaataacaccgccgccgccactgtgttgaaccaagttctttccaaagtggccatgtctcaacccctctttaaccaactcaggcatccgtccgtgattacaggtcctcacggccatgctggggtcccccagcatgcggccgccatcccttctactagatttcccagcaacgctatcgccttcagccctccctcacagaccagggggcctggcccgtctatgaatttaccaaaccagccaccttctgccatggtcatgcatcccttcacaggagttatgccacagacccctggccagccagccgtcatcctcggcatcggaaaaaccggcccagcgccggcgaccgcagggttctacgaatatggaaaagcatctagcgggcaaacctatggccccgagaccgacggccagcccgggtttctgccaagctctgccagcacaagtggctctgtgacctacgaggggcactattctcacaccggacaggatgggcaggccgcctttagcaaagatttctatgggccaaattctcaggggagtcatgtggcttctgggtttcctgctgagcaggccggcggactgaaatcggaggtggggcccctgttgcagggaacaaactcgcagtgggaaagtccccacggatttagtggtcagtccaaacccgaccttaccgccggacctatgtggccaccaccccataaccaaccctatgagctatatgaccctgaagaacctacctcagatcgtacacctccatcttttggcggtaggctgaacaactccaagcaaggctttataggtgctgggaggagagctaaagaagaccaggccctcctctctgtgagacctcttcaagctcacgagcttaatgattttcacggagtggccccgcttcatttaccacatatatgtagtatatgtgataagaaagtatttgatttgaaggactgggagctgcatgtcaagggcaagttacacgcacagaagtgcctcgtcttctccgagaacgccggaataagatgcatcctggggtctgcggagggaaccctgtgcgcatccccaaatagcacagccgtgtacaatcctgctggcaacgaggactatgccagcaacctggggacatcctacgtaccaattcccgctaggagcttcactcaatcgtcgcccaccttcccactagcgagtgtcgggacaacatttgcacagcgaaagggcgctggccgcgtcgtacacatttgcaacctgccagaaggctcctgtacagaaaatgatgtgattaacctgggactgccatttggtaaggttacaaattacatcctcatgaaatctactaatcaggcatttttggagatggcctatacagaggctgcccaggccatggtgcagtactatcaggagaagagtgccgtgattaatggcgagaaactgttgatcagaatgagtaagcggtacaaagaactgcagttaaaaaaacccggcaaggccgtggccgccatcattcaagacatacatagtcagcgagaaagggacatgttccgagaggccgatcgttatggtccggaacgaccccgctcgcggagtccggtcagcaggagcctctcccctaggagtcatactccttcctttaccagctgcagctcttcccatagccccccgggaccatcaagagctgattggggaaatggccgggactcctgggagcacagtccttacgccaggagggaggaggagagagacccggctccttggagagacaacggagatgataaacgggatcgaatggatccatgggctcacgatcgcaagcaccaccctcgccagttagacaaagccgaactagacgagaggcccgaagggggacggccacatagggaaaaataccctcgctcagggtcccctaacctccctcactccgtgagctcatataagagccgcgaggacggctactaccggaaagagccaaaggctaaatgggacaagtatctgaagcagcagcaagatgcgcccggaagaagtcgtaggaaggacgaggccagactgagggagtctagacacccccacccagacgattctggaaaagaagatggcctggggcctaaggtgacacgcgctccagaaggagcgaaggcaaagcagaatgagaagaataaaaccaagaggacagaccgcgatcaggaaggcgcagatgatcggaaagagaatacgatggctgaaaacgaagctggtaaagaggagcaggagggaatggaagagtcgccccagagcgtggggcgtcaagaaaaggaagccgaattcagcgacccggaaaacacacgaacaaaaaaagagcaggactgggaaagcgagagtgaggcagagggcgagtcatggtatcctaccaatatggaagagctggtgacagtggacgaagttggtgaggaggaggattttatagtagagccagacatcccggaattggaagaaatcgtccctattgaccagaaggataaaatttgtcctgagacttgcttatgcgtcactacaacactcgatttggatctggcccaggattttcctaaggagggagtcaaagccgtggggaacggagcagctgaaatcagcctgaaatcgccgcgggaacttccctctgcatctacttcatgccctagcgacatggacgttgaaatgcccggcctgaatctggatgcagaaaggaagccggccgaatctgaaaccggtctgagtttggaggatagcgactgttacgagaaagaagccaaaggcgtggaatcgagtgacgtccaccccgcccccacggtccaacagatgagcagccccaagccagccgaagaacgtgcgcgccagcctagccccttcgtggatgactgcaagacgcggggtacgccagaggatggcgcatgtgagggatcaccactggaggagaaggccagcccgcccatcgaaaccgatctccaaaatcaagcttgtcagggttccgacagtgatacccgcctggtgtccggctacagtctcaccccgctagaaaagacacccggcacttggaagtag

SEQ ID NO: 133191 - DNA, 1263 bp, Artificial Sequence
  Description of Artificial Sequence: Synthetic coding sequence
atggccacgtcactgggaagcaacacctacaaccggcagaactgggaagacgctgattttccaatcctctgccagacttgcttgggcgagaacccgtatattcgtatgaccaaggagaaatacggtaaggagtgcaagatatgtgcaagaccattcaccgtcttcagatggtgcccgggcgtgcgcatgcgttttaaaaaaactgaggtgtgccagacatgctcgaaacttaagaatgtgtgtcagacctgcttgcttgacctggaatacggactgccgattcaggttagggacgccggactttcattcaaggatgatatgcccaaatcagacgtcaataaggagtattacactcagaatatggagcgcgagattagcaactccgacggcacaagacctgtcggcatgctgggaaaggccacatctacttccgatatgcttctcaaactggcaagaacaacgccatactataaacgcaacaggccacacatctgctccttttgggtgaagggcgaatgtaaacgaggcgaggaatgcccctaccggcatgaaaagcctactgatcccgacgaccccctcgccgaccagaacatcaaggatcggtactatggaataaatgaccctgtggcagacaagctactgaaaagagcatccacaatgccaagactggacccccctgaggacaagactatcactaccttgtacgtgggcggactgggggacactatcactgagacagaccttaggaatcacttttatcagtttggcgagatacgcacaatcactgtggtccagaggcagcagtgcgcttttatccaattcgccactcgccaggccgccgaggtggctgccgaaaagtcctttaacaaactgattgtgaatggccggcgcctcaatgtcaaatggggaagaagccaggccgcccggggtaaggaaaaggagaaggatggaacaaccgacagcgggattaaactagagccagtgccgggcctgcccggcgctctgccccctcctccagccgctgaggaggaggcatctgctaattattttaaccttcccccctcggggcccccggcggtggtgaatatcgctctcccacccccgcccggaatcgcccctcccccccctccaggcttcgggcctcacatgtttcatccaatgggccctccgcctccttttatgagggcacccggcccgatacactatcccagtcaggatcctcagcggatgggagcccacgctggaaaacactcatctccctag

SEQ ID NO: 133192 - DNA, 1116 bp, Artificial Sequence
  Description of Artificial Sequence: Synthetic coding sequence
atggccacatctctggggtctaacacttataaccgccaaaactgggaggacgccgactttccaatcctttgccagacctgtctgggggagaatccatatatcagaatgactaaagagaagtacgggctccctatccaggtgcgagacgctggcctaagttttaaggacgatatgcccaagtccgatgtgaacaaagagtattatacacagaacatggaaagggagatttcaaacagcgatggaacacgacccgttgggatgcttggaaaggcaacctcaaccagcgatatgttactgaagctcgcacgcacaactccttactataaaagaaacagacctcacatctgtagtttttgggttaagggagaatgtaagaggggagaagaatgcccataccggcatgagaaacctaccgacccggatgaccccttagccgatcagaatataaaggataggtattacggcatcaacgatccagtggcggacaaactgctcaagcgtgcctctaccatgcctagattggatccccccgaggataagaccattaccaccttgtatgtgggcggcctgggggacaccataaccgagactgatctgcggaatcacttttaccaattcggcgagattagaactataacagtcgtacagagacagcagtgcgcctttatccagtttgccactaggcaggctgctgaggttgccgctgagaagagcttcaacaagttaatagtaaacggacgccggcttaatgtgaaatggggacgtagccaagctgcccggggaaaggagaaagagaaggatggaacaaccgactcagggattaaactggaaccagtaccaggactcccaggtgccctgccacctcctcctgctgccgaggaagaggcctccgctaactacttcaatctccctccttcagggccccctgcagtagtgaatattgcccttcccccccccccaggtatcgcccctccacccccccctggtttcgggccccacatgttccaccctatggggcccccgccccctttcatgcgtgctccagggcccattcactacccttcccaagaccctcagagaatgggggcccatgcaggcaagcactctagcccttag

SEQ ID NO: 133193 - DNA, 1116 bp, Artificial Sequence
  Description of Artificial Sequence: Synthetic coding sequence
atggcaacctcgctgggttcaaacacgtacaatcgccaaaactgggaagacgctgacttccctattttgtgccagacctgcctgggagagaacccttacatcagaatggaacgggaaaaatcgggccttccaattcaggtacgggacgccggactcagctttaaagatgatatgcccaaaagcgacgtaaataaggagtattacacacagaatatggagcgagagatctccaatagcgacgggacacgccccgttgggatgctaggtaaagccacttccacgtctgatatgctgctcaagctcgcacggacaacaccatattataagcgtaaccgcccacatatttgcagcttttgggtgaagggggaatgtaagaggggggaggagtgtccgtaccggcacgaaaagccaacagacccggacgatccccttgcagatcagaacattaaggatcgttactatgggattaacgaccctgtggctgataagctgcttaagagagcatccaccatgcctcgacttgaccccccggaggacaagactatcacaaccctgtatgtcggaggcttgggtgacaccattacggaaacagatctccggaaccatttctatcagttcggcgagatccgaaccattactgtagtacaaaggcagcagtgtgcctttatccaattcgccactcgccaggcggccgaggtggcagcagagaagagtttcaacaagctgattgttaacgggcgcagacttaatgtcaagtgggggcggtcacaggccgctcgcggcaaagaaaaagaaaaagatggcactactgatagcgggatcaagctcgagcctgtgccgggactgcctggcgccttacccccccccccagctgccgaggaggaggccagtgctaattattttaacctgcccccatcaggcccaccagcagtcgtgaacattgcgttgccacctccgcctggcatcgctccccccccaccacctgggtttggcccccatatgttccatccaatgggccccccaccccctttcatgagagctcccggtcccatccattatccctctcaggacccccaacggatgggagcccatgccggcaagcacagctcaccttag

SEQ ID NO: 133194 - DNA, 2532 bp, Artificial Sequence
  Description of Artificial Sequence: Synthetic coding sequence
atgtctttcccaccccacctgaatcgacccccaatgggaatccctgccctgcctccaggaatacccccccctcagtttcctggctttccccctcctgtcccacccgggactcccatgattcctgtgcctatgagcatcatggcgccagcaccgactgtgcttgtgccaactgtatccatggtgggtaaacacctcggcgctagaaaggaccatccagggctgaaggctaaggagaacgatgagaattgcggacccaccactaccgtgtttgtcggtaacatcagcgagaaggcttccgatatgcttatcaggcagctgctggcaaaatgtggactcgttttgagttggaagcgcgtgcagggagctagcgggaaactgcaggcattcggcttctgtgagtataaagaacctgagtctactcttagggccctgcgattgctgcatgacttgcagattggggagaaaaaacttctggtgaaggtggacgctaagaccaaggcccagctagatgaatggaaggccaaaaaaaaagcttctaacgggaacgcccggcccgagaccgttactaacgatgacgaggaagcgctggacgaggaaactaagaggagagaccagatgattaagggggcgatcgaagtcttaattagagagtatagctctgagttaaatgctccttcgcaggaaagtgactctcatcccagaaaaaaaaaaaaagagaagaaggaggacatctttcggcggttccccgtggccccactcataccttaccctctgattaccaaggaggacatcaacgcgatagagatggaagaagataagcgcgatctcatttcacgtgagatcagtaagtttagagatacccataagaagctggaggaggagaaggggaaaaaggagaaagaaagacaggagatcgagaaagaaaggcgcgagcgggagagggaacgagaacgggagagggagcggcgggaacgggaacgggagcgggagagggagcgcgagagagagaaggaaaaagaaagggagagggaacgtgagagggatagggatcgtgacagaaccaaggaacgtgatcgggatagggatagggagcgcgaccgggatagggacagggaacgcagcagcgacaggaacaaagataggtcccggagccgcgagaagagcagggacagggagagggagcgagagagagaacgcgagagagagcgagagcgggaaagagagagagaaagggagagggaaagggaaagggagagagaacgcgagagagagcgagaaaaggacaagaagcgtgacagggaggaggacgaggaagacgcctatgaacgccgcaaactggaacgaaaactccgagaaaaagaagccgcataccaagagcgactgaagaactgggagattcgggagcggaaaaaaacgagagagtatgaaaaagaggccgagagagaggaggaaagacgccgggagatggcgaaagaagcgaagagattgaaggagttcctagaggattatgatgacgatagagatgatcctaagtattacagagggagtgccctgcagaagagactccgcgatcgagaaaaggagatggaggccgatgaaagggaccggaaaagagagaaggaggagttagaggaaattcgacagcggttgcttgccgaagggcatccagaccctgatgccgaactgcaacgaatggagcaagaagctgagaggcgaaggcagcctcagattaaacaggaaccagagtccgaggaggaggaagaagaaaagcaagagaaggaagaaaagcgggaagaacccatggaagaagaagaggagcccgaacaaaagccctgtttgaagcccacgcttcgccctatatcatcagccccaagtgtctcctctgcaagcgggaatgccactccaaacacaccaggagatgagtctccatgcggcatcattataccacatgagaacagccccgatcagcagcagccagaagagcaccggccaaaaattggactttctttaaagctcggagcaagcaatagcccggggcagcctaactccgtgaagcggaaaaagctccccgttgactccgtattcaacaagtttgaagatgaggactccgacgacgtgcctcgcaagcgcaaactagtacctcttgattatggcgaggatgataagaacgccaccaagggcactgtgaacactgaagagaagcgaaagcacatcaagtcactcatcgaaaaaatccccacagctaaaccggagctcttcgcctaccctctcgattggagcattgttgactcgattctgatggaaaggcgaatcaggccatggatcaacaagaaaatcattgaatacattggcgaagaagaggccacactcgttgattttgtgtgttctaaggtaatggcccactcatcacctcaaagtatcttggacgacgtagcgatggtcctcgatgaagaggctgaagtcttcatcgtgaagatgtggcgactgctgatttacgaaacagaggctaaaaaaattgggctggttaaatag

SEQ ID NO: 133195 - DNA, 384 bp, Artificial Sequence
  Description of Artificial Sequence: Synthetic coding sequence
atgagctttcctcctcatctgaataggccacccatgggtatccccgcgttgccgcctgggatcccacccccacagttcccaggcttcccgccccccgtccccccgggcacccctatgattccagttcccatgtcaataatggcacctgcccctaccgtgctagtgcccaccgtctccatggtggggaaacacttaggcgcccggaaggatcatcctggactgaaggcaaaggagaatgatgaaaattgtggacctacaaccaccgtttttgtcggaaatataagcgagaaggccagcgacatgctgatccgacaactgctggccaaatgtggccttgtgctttcttggaagcgggttcagggcgcgagtggaaagctgcagtag

SEQ ID NO: 133196 - DNA, 903 bp, Artificial Sequence
  Description of Artificial Sequence: Synthetic coding sequence
atgtccttcccacctcacttgaaccgaccaccaatgggaatccccgctttgccgccaggaatccctcccccgcagtttccaggatttccaccgcccgtgccaccggggacaccaatgattccggtgccgatgagtatcatggcgcccgcccccactgtgctcgtgcccacagtctcaatggtaggaaagcatctgggagcgagaaaagatcaccctgggttgaaggcaaaggagaacgacgaaaattgtgggcccaccaccaccgtctttgtgggaaatatttccgaaaaggcctcagatatgcttattcgccagctccttgctaagtgtgggcttgtgctcagctggaagagagtgcagggagcttcggggaagcttcaggcatttggtttttgtgagtataaagaacccgaatcgacgctgcgggccctccgactcctgcacgaccttcaaataggcgaaaaaaagctgctggtcaaggtagacgctaagacaaaggcgcagctggatgagtggaaggctaaaaaaaaagcctccaacggtaatgccagaccagagactgtgacaaatgacgatgaagaggccttagatgaggaaactaaaagacgcgatcaaatgatcaagggcgcaattgaagtgctgattcgggagtatagcagcgaactgaatgccccttctcaagagagcgattctcacccgaggaaaaagaaaaaggagaaaaaagaggatatctttcggagattccccgtggcacccctgataccgtaccccctgatcaccaaggaggatattaacgccatcgagatggaggaggataagagagacctcattagccgggaaatctccaagtttagagacactcacaaggttgtgttcctctctttccacctgatccccatctag

SEQ ID NO: 133197 - DNA, 885 bp, Artificial Sequence
  Description of Artificial Sequence: Synthetic coding sequence
atgtcctttccacctcatcttaatagacctcctatggggatccctgctctccctccagggatcccccctcctcagtttcctgggttccctcctccagtgcccccgggcacccctatgatccccgttccaatgtccatcatggccccggcgcctacagtgctggttcccactgtgagcatggtcggaaagcacctgggtgcccgaaaagatcatcctgggttaaaggccaaagagaacgatgagaattgcggaccgacgacaactgtcttcgtcggaaacatttccgaaaaagcatctgacatgcttatacgccaactgctggccaaatgtgggcttgtgttgtcttggaaacgagtgcaaggggctagcgggaaactgcaggccttcggtttttgcgagtacaaagagccggagagcactctgcgcgcactccgactgctgcacgatcttcagataggtgagaaaaagctgcttgtgaaagtggacgccaaaaccaaggctcagctggacgagtggaaggcaaagaaaaaggccagcaacgggaatgccaggccagaaacagtgaccaatgatgatgaagaggcccttgacgaggagactaagcgaagggatcagatgatcaaaggtgccattgaggtcctgatcagggagtatagctccgagttgaatgcccccagtcaggagtcggactcccaccctcgtaagaagaaaaaagagaaaaaggaggacattttccgcagatttcctgtagcccctttgatcccttatcccctgattaccaaggaagacattaacgccatcgagatggaggaggataaacgtgatctaatctcccgagagatctccaaattcagagacacccacaaacgctcatatggcgattag

SEQ ID NO: 133198 - DNA, 2532 bp, Artificial Sequence
  Description of Artificial Sequence: Synthetic coding sequence
atgtctttcccccctcacttaaatagaccacccatgggaattcctgccctgccacccggcataccgcccccacagtttcccgggttcccaccacctgtacctccaggcacccccatgattcccgttccaatgagtattatggctccggcacccacagtgctcgtccccaccgtcagcatggtcggcaagcacttgggcgctagaaaggatcacccaggcctgaaggccaaagagaacgatgagaactgcggtcctacaactacggtctttgtgggcaatattagtgagaaggcctctgatatgctcatacgacagctgctcgcaaaatgcgggctggtcctgtcctggaaaagagtgcaaggagctagcggcaagctgcaggccttcggtttttgtgagtacaaggaacctgaatcaacgttacgagctctgcgccttttacacgacctgcaaatcggagagaaaaagctgctggtaaaggttgatgccaagactaaggcccagctcgacgaatggaaagcaaaaaaaaaagcctcaaatgggaatgctaggcctgaaaccgtcaccaatgacgacgaggaggcacttgacgaggagacaaagcgtcgagaccagatgattaaaggggccatagaggtgctgataagagaatattcttcagagctgaatgccccatcccaggaatctgattcccaccccagaaagaaaaagaaggaaaagaaagaagatatttttcgccggtttcctgtggccccactcataccatacccactgattacaaaggaggacattaacgccattgaaatggaggaagataaaagagacttaatttcccgcgagatatcaaagttcagggatacgcacaagaagctggaggaggaaaaagggaaaaaggaaaaagaacgccaggagatcgaaaaggaacgaagggagagggagcgagagcgggagcgtgaacgcgagagacgggaacgtgaaagggagcgggagcgtgagcgggaacgcgaaaaggaaaaggagcgcgagagagaaagagaacgagatagagaccgggatagaactaaagagcgggaccgagatagagatcgggagagggaccgagacagggatcgtgagcggagttcggaccgcaataaagatcgatccagatctcgcgagaaatctcgcgaccgggaaagggagcgagagcgtgagcgggagagagaaagggaacgggagagagaaagggagcgcgagcgcgaaagggagagggagcgagagcgggagcgcgagcgcgagaaggacaaaaagcgagatcgcgaggaggatgaggaggacgcatacgagcggaggaaactcgagaggaagctgagagagaaagaggccgcataccaggagagactgaagaattgggaaatcagggagcgcaaaaagacccgcgagtacgaaaaggaagcggagagggaagaagagagacgtagggagatggctaaggaggctaaacgtctgaaggagtttttagaagactatgatgacgacagagacgaccctaagtactatagaggcagtgctctgcaaaagagactccgtgatcgcgaaaaagagatggaggccgatgagcgagacagaaagcgggaaaaggaagagctggaagaaatcagacagcggcttcttgcagaaggccaccctgacccggacgcagaacttcagcgcatggagcaggaggcagaaagaagaaggcaaccgcaaatcaagcaggagcccgagtcagaagaggaggaggaggagaaacaagagaaagaggaaaaacgggaagaacccatggaggaagaagaggaacctgaacagaaaccctgcttgaagcccaccctgaggcctatctcgtcagccccgagtgttagctccgcatctgggaacgccacacctaatactccgggagacgaatccccctgtggtattattattccccacgagaatagcccggatcaacagcagcccgaggagcacaggcccaagatcggcctgtctctgaagctgggagctagtaacagccccgggcagcccaacagcgttaaaaggaagaagctgccggtggattcggtgttcaacaaatttgaagacgaagattctgatgacgtgccccgcaagcgtaagctagtaccactggattacggcgaggacgacaaaaacgccactaagggtactgtcaatacagaagaaaaacggaagcatataaagtccctgatcgaaaagatccctactgcaaagcccgaactgttcgcctaccccttggactggtctatcgtcgacagcattctgatggaacgacggattcgaccctggattaataagaaaattattgaatatataggcgaagaagaggccaccctggttgatttcgtgtgctctaaggtcatggcccactcgagcccccaatcaattctggatgacgtcgccatggtactggacgaagaggccgaggtgttcattgtgaaaatgtggagattgcttatatatgagaccgaggctaaaaagatcggcctggtgaagtag

SEQ ID NO: 133199 - DNA, 732 bp, Artificial Sequence
  Description of Artificial Sequence: Synthetic coding sequence
atgtccttccctcctcacctcaatcggcccccaatgggaatacccgcattgccacctggcattccaccaccccagttcccaggcttcccccctcctgtgcctccggggacacctatgatccctgtacccatgtccatcatggctcccgcaccaacagtgttggtccccactgtgtctatggtgggcaaacacctgggtgcacggaaggaccatcccggcctgaaagctaaggaaaacgacgagaactgcggcccaaccacaactgtctttgtgggtaatatatccgaaaaggctagcgatatgcttatccgccagttgctggccaaatgcggactagtactgtcatggaagcgcgtccagggagcctcaggaaaactgcaagccttcggattctgcgaatataaggagccagagagcactctacgcgcgctgcgtctgctacacgatctgcagatcggcgagaaaaagctcctggtgaaggtggatgctaaaacaaaagctcagctcgacgaatggaaggcgaagaaaaaagcaagtaatggcaatgcacggccagagaccgtcacaaatgacgacgaagaggcccttgacgaagagactaagcggcgggaccagatgattaagggtgctattgaagtgctgatccgtgagtattcatccgagttgaatgctcctagccaggaatctgactcccatccccgtaaaaaaaaaaaggaaaagaaagaagactag

SEQ ID NO: 133200 - DNA, 885 bp, Artificial Sequence
  Description of Artificial Sequence: Synthetic coding sequence
atgtccttcccccctcaccttaatagaccaccaatggggattcccgcacttcccccgggcatccccccgccgcaatttcctggctttccacctcccgtcccaccaggcactcccatgatcccagtgcccatgagtataatggcacctgcgccaaccgttttagtgcctaccgtatccatggtcggaaagcatcttggcgcaagaaaagatcatccaggtctgaaggcgaaagagaatgatgagaactgtggaccaacaaccacagtgtttgtgggcaacatttccgagaaggcaagtgacatgctcatccgccagctcttagccaagtgcggactcgtgcttagttggaaacgcgtgcaaggcgccagtggtaaactgcaggcattcggcttctgtgagtacaaggaaccagaaagcaccttgagggccctgagactgctccatgacctccagataggcgagaagaagctcttggtgaaggtcgacgccaaaacaaaggcccagctcgatgaatggaaggccaaaaagaaggcctctaacgggaacgcccgcccagagacggtgaccaatgacgatgaggaggctcttgatgaggagaccaagaggcgggatcagatgatcaagggcgcgattgaagtgctgatccgtgagtactcatcagagttgaatgctccatcccaagagtctgacagccatccccgaaaaaagaaaaaggaaaagaaagaagacatcttcagaagatttccagtggcacccttgatcccgtaccctctcatcacaaaggaagatatcaatgctatagagatggaagaggacaagcgggatctgatcagtagagaaatttcaaaatttagagatacccacaagcgctcctacggcgattag

SEQ ID NO: 133201 - DNA, 1350 bp, Artificial Sequence
  Description of Artificial Sequence: Synthetic coding sequence
atgctgcccgcagccactgcttccctattgggacctcttcttacagcatgcgcactgttaccattcgcccagggacagacacccaattacacccgccccgttttcctgtgcggcggggatgttaaaggggagagcggctatgttgcctccgagggctttccaaacctctacccgcctaataaagagtgcatttggacaatcaccgtcccagagggccaaactgtgagcttaagcttccgcgtgttcgatctggaattgcatcccgcttgcaggtacgacgccttagaagtgtttgcagggtccgggactagcggccaacggttaggccggttttgcggaacttttagaccggccccactagtggcacctggtaatcaggtgaccctaagaatgactacagatgaggggaccggcgggaggggatttttactgtggtactccgggagggccacaagtggcactgagcaccagttctgtggaggtcgtctcgagaaggctcagggcaccctcaccacccccaactggcctgagagtgattacccccccggtattagctgctcatggcacataattgcgccacccgatcaggttattgccttgactttcgagaagttcgatctggagcctgacacctactgtcgctacgactcagtttctgtgtttaacggggcagtctctgacgactctcggaggctggggaagttctgtggtgacgctgtgcccggctctatcagttccgaagggaatgaactcctcgtgcagttcgttagcgatctctccgtgacggccgatggcttttccgcatcttataagactctgcccagaggaacagctaaagagggccagggaccaggaccgaagagaggaacagaacctaaggttaaactgccacccaaaagccagccacctgaaaaaacggaggaaagcccaagtgccccggacgcgcccacctgtccaaagcagtgtcgtcgcacgggcaccctgcagtccaatttttgcgcttcgtcattggtcgtgacggccaccgtgaagagcatggtgagagaaccgggggagggactggcagtcacggtttccttgataggagcctacaagacaggaggcctggaccttccatctcctcccacgggcgcatccctgaaattttatgtaccatgtaagcagtgcccgcctatgaagaaaggtgtctcttatttacttatgggacaggtggaggagaacaggggcccagtgctgccacctgagagtttcgttgtgctgcaccgccccaatcaggaccagatcctgacaaacctaagtaagcgcaagtgtccctctcaacccgtgagggcagccgcctcacaggattag

SEQ ID NO: 133202 - DNA, 1857 bp, Artificial Sequence
  Description of Artificial Sequence: Synthetic coding sequence
atggcgggcctgacattgttcgttggtcgtctcccaccctctgcccgctccgagcagctcgaggaactgttttctcaggtcggccctgtcaaacagtgtttcgttgtgaccgaaaaaggccgaactgtggcggtggattgggccgtcgcaaaggacaaatacaaagacacccagagcgtgtcggctattggggaggagaagtcacacgagtccaagcaccaggagtccgtcaagaaaaaaggacgagaagaagaagacatggaagaggaagagaacgatgatgacgacgatgacgatgacgaggaggatggcgtgttcgatgatgaagatgaggaagaagaaaacatagaaagcaaggtgactaagcctgtgcagatccagaaaagagctgtcaagaggcctgccccagcaaaaagctccgaccattcggaagaggactccgacttagaagagtcagattcaatcgacgatggcgaagagctcgctcagtccgacacctctaccgaagagcaggaagacaaggctgtgcaggtctctaacaagaaaaaacggaagctccctagtgacgtaaacgagggaaagactgtctttatccggaatttgtctttcgactcagaagaggaagagctcggggagctgctgcagcagtttggtgagttaaagtatgtgaggatcgtgttacacccagatactgagcactcgaagggatgcgcttttgctcaattcatgacgcaggaggcagcccagaaatgtttactggcagcctcaccagagaacgaagcaggagggctgaaattagatggaaggcagttaaaggtcgatctggccgtgacgagggacgaggctgccaaactccagacaacgaaggtcaaaaaacctacgggcacccggaatctgtaccttgctagagagggccttatccgggcgggaacaaaggcggccgagggggtaagcgctgctgatatggctaagcgagagaggtttgagctactcaaacaccagaagttaaaggatcagaacatcttcgtatcgcgcacgcgactctgcttgcacaacttgcctaaagccgtcgatgataaacaacttcgtaagctcctccttagtgctacctctggggaaaaaggcgttaggatcaaggaatgcagagtgatgcgagacctcaaaggagttcatggaaatatgaagggccagtccctcggatatgcgttcgccgaattccaagaacacgagcatgctctgaaggcgcttcggctgattaacaataacccagaaatctttgggcctctgaagcgccctatagtggagttctccctggaggatcgacgtaagctgaagatgaaggagctccggattcagaggtcgctgcaaaagatgaggtccaagcccgctaccggagagcctcagaagggccagccagagccagccaaagaccaacagcaaaaagctgcacaacaccacaccgaggaacaaagtaaggtgccacccgaacagaagcgcaaggctggttctacgtcgtggaccggctttcagacaaaggccgaagtcgaacaagtggaactgcccgatggtaagaagcgtagaaaagtcctggctctgccctcccataggggccctaagatacggctgcgtgacaaaggtaaggtcaagccggtacaccctaaaaagcccaagcctcaaataaaccagtggaagcaggaaaagcaacagctctcatcagaacaagtttcaagaaaaaaagccaagggtaataaaaccgagactagatttaaccagcttgtggagcagtataagcagaaactgcttgggccgtccaaaggcgccccattggccaagcgttccaagtggtttgattcctag

SEQ ID NO: 133203 - DNA, 720 bp, Artificial Sequence
  Description of Artificial Sequence: Synthetic coding sequence
atgctgctgcaaccagctccctgtgccccttcagcgggtttccctaggcctctcgctgcccctggcgcaatgcacggaagtcagaaagatacaacctttaccaagatttttgtagggggcttgccctaccatactacggatgcgagcctgcggaaatatttcgagggattcggcgatatcgaggaggctgtggtaattaccgacagacagacaggaaagtcccggggctacggtttcgtgactatggctgacagagcggccgcggagcgagcatgcaaagacccaaatcccatcattgatggcaggaaagcaaacgtgaacctggcatatttgggcgctaagcctcgcagtttgcagaccggtttcgcaatcggtgtgcagcagctgcatccaaccctcatacagagaacttatggactgactccacactacatatatccccccgccatcgttcagccaagtgtggtcattcccgccgcacctgtcccaagcctgtcttctccctatatcgagtatacgcctgcctctcctgcttacgcccaataccctcccgcaacatacgaccagtacccttacgcagcgtcgcccgctacagcagcgtcattcgtcggatattcgtatccagcggccgttccacaagccctttccgcagcggctccagcaggtacaacgtttgtgcagtaccaagcaccacagctgcaaccagacaggatgcagtag

SEQ ID NO: 133204 - DNA, 477 bp, Artificial Sequence
  Description of Artificial Sequence: Synthetic coding sequence
atggccgatcgagccgcagcagagcgtgcctgcaaagacccaaaccccattatcgatgggcggaaagcaaacgttaacttggcctaccttggagctaaaccgcggagtttacagaccggcttcgccatcggagtccagcaactgcatcctaccctcatccagaggacctatggcctgacccctcactatatctacccgccagccattgtgcaaccgagcgtggtgatccctgccgctccggtgccctctctgagctccccctacattgagtacaccccggctagccccgcgtacgcccagtacccccctgctacctacgaccaatacccctacgctgcctcacccgcaactgctgcgtccttcgtgggctactcgtatccagcagcagtgccccaggctctaagcgccgcagccccagccgggactactttcgttcaataccaggcgccacagttacaacctgataggatgcagtag

SEQ ID NO: 133205 - DNA, 366 bp, Artificial Sequence
  Description of Artificial Sequence: Synthetic coding sequence
atgctgctacagcctgccccttgcgctcccagtgccggttttcctcgcccactcgcagcccctggcgccatgcacggctcccagaaggacacaacttttacaaagattttcgtgggcggactgccataccacaccaccgatgccagcctaaggaaatacttcgaaggcttcggtgacatcgaagaggcggtggtgattaccgataggcagacagggaagtcacgcggctatggcttcgtgaccatggcagatcgggcagcagctgagcgagcatgcaaggaccctaacccaatcatagacggaagaaaagcaaatgtcaatttagcctatctgggagctaagccccggtctctgcagacgggatag

SEQ ID NO: 133206 - DNA, 1095 bp, Artificial Sequence
  Description of Artificial Sequence: Synthetic coding sequence
atggtgaaactcttcatcggtaacttaccccgcgaagccacagaacaggagattcggtcactgttcgaacagtacggaaaggtgctagagtgcgatattattaagaattatggctttgttcacattgaagataagaccgcagcagaagacgcaatcagaaacctccatcactataagcttcatggcgtgaacatcaatgtcgaagccagcaagaacaagtccaagacaagcaccaaactccatgttggcaatatctcacccacatgtacaaacaaagagctcagggctaagtttgaagaatacgggcccgtgatcgagtgcgatatcgtaaaagactacgcttttgtgcacatggagcgcgcagaggacgcagtcgaggcaatccggggccttgataatacggaattccagggtaaaaggatgcatgtgcaattatcgacgagtcgtcttcgaacggcaccaggtatgggggaccagtcaggttgctatcgttgcggcaaagaaggtcattggtcgaaggaatgccctatcgataggtccggacgtgttgcagatctgacggaacagtacaatgagcagtacggtgctgtcagaacaccttataccatgtcgtatggggatagcctgtactacaacaacgcctacggggcgctggacgcctactacaagcgatgcagagccgctaggagttacgaggcggttgctgccgccgctgccagtgtatataattatgcagagcagacgctctcccagctacctcaagtccagaatacagctatggctagtcatctcaccagtacatcgctcgacccatatgatcgccacctgctgcctacctccggagcggccgctaccgccgccgccgcagccgctgctgctgctgccgtgacggcggccagcacctcctactacgggagagaccgcagtccactgcggagggcgaccgctccagttccaactgtcggagaagggtacgggtacggccacgagtcagagctttcccaagcaagtgcagctgcacgcaacagtctttatgatatggcgaggtatgagagggaacagtatgctgaccgcgcaaggtactcagccttctag

SEQ ID NO: 133207 - DNA, 1095 bp, Artificial Sequence
  Description of Artificial Sequence: Synthetic coding sequence
atggtcaagcttttcatcggcaacctacccagggaggcaaccgagcaggaaattaggtctctgttcgaacagtacggcaaggtactggaatgtgacatcatcaagaactacggtttcgtgcacatcgaggataagactgctgcggaagatgcaataagaaatttgcatcactataaactgcacggcgtgaatattaacgtggaagcttcaaaaaataagtctaagacctctacaaagctacacgtaggtaacatcagcccgacctgtacaaacaaggaactgagggccaagtttgaggagtacggcccagtgatcgagtgcgacattgttaaggattacgctttcgttcatatggagcgagcagaggacgccgttgaggcaatcaggggcctcgataacacagagtttcagggcaagagaatgcatgtgcaactgagtacaagccgactgcgcactgctccaggcatgggcgatcagagtgggtgttatcgatgcgggaaggaagggcattggtctaaggagtgccccattgacaggtctggtcgggtcgccgacctaactgagcaatataatgagcagtatggggctgtgagaaccccttacacaatgagctacggcgatagcttgtattataataatgcctacggcgcgctggacgcatactataaaaggtgcagggccgccagatcttatgaggctgtagccgccgcggcggcaagcgtgtacaactacgcagagcagacactgagtcaactaccccaggtgcagaacactgccatggcatctcacctgacttctacctctctggacccctatgatcggcatctcttgccaacaagcggggctgcggcaacagccgccgccgccgcggccgctgcagcagccgtgaccgctgcatctacctcatattacggccgagaccgaagtccgcttaggcgggctacagcccccgtcccaaccgtcggcgaaggatacgggtatggacatgaatcggaactgagccaggctagcgcggctgccagaaactctctgtacgatatggcccggtacgagagagagcaatatgctgatagggcacgatattccgctttctag

SEQ ID NO: 133208 - DNA, 1095 bp, Artificial Sequence
  Description of Artificial Sequence: Synthetic coding sequence
atggtaaaactcttcattggtaacctgccgcgcgaggccactgagcaggagattcgtagcttgttcgaacagtacgggaaggtgctcgagtgcgatataattaagaactacggctttgtgcatattgaagacaaaacagcagccgaggacgctatacggaacttacaccactataagctgcacggcgtgaatattaacgttgaagccagcaaaaataaaagtaagacctctaccaagctccatgtgggaaacatatcccccacttgtacaaacaaggaactgcgggccaagttcgaggagtatggaccggtgattgaatgtgatatagtgaaggattacgcctttgtgcatatggaacgagccgaagatgctgttgaagctatccgaggcttggataacacagaatttcaaggaaagcgcatgcacgttcaactgagcaccagtcggttgcgcaccgccccgggtatgggcgaccaaagcggctgctatcgatgcggcaaagagggccattggagcaaggagtgtccaatcgaccgttcagggcgcgtagccgatttgacggagcagtataatgagcagtacggcgccgtaaggaccccctatactatgtcttatggagactctctgtactataacaatgcttacggggccttagacgcatactacaaacgctgccgggccgcgcgtagctacgaggccgtcgcggcagctgcagcctcagtgtacaactatgctgaacagactctgtcccagcttccacaagtgcagaatacagctatggcatctcatctgacttctacgtccctggacccatacgatcgccatttactccccacctccggtgctgccgccaccgccgcagctgccgccgccgccgcagctgcggtaacagccgctagtacgtcctactacggcagggatagatctcctttgagacgggccactgctcctgtaccaactgtgggggagggctacgggtatggacacgaaagcgagctaagccaagcatcggccgccgcccggaacagtctgtatgacatggctcggtatgaacgagagcagtacgccgatcgtgcacgttactccgcgttctag

SEQ ID NO: 133209 - DNA, 534 bp, Artificial Sequence
  Description of Artificial Sequence: Synthetic coding sequence
atggtcaagctcttcattggtaatctgccccgtgaggctacagaacaggaaattcgctctcttttcgaacagtacggcaaagtactggagtgtgatatcattaagaattacggttttgtgcatattgaagataagacagccgccgaagacgccattaggaacttgcaccactacaagctccacggagtgaatatcaacgtggaggcaagcaagaataagtccaagactagcactaagctccacgtagggaacatatcacctacttgcacaaataaggagctacgcgcaaagttcgaggagtacgggcctgtgatcgagtgtgatattgtcaaggattacgccttcgtccatatggagagggctgaagatgctgtcgaggctattcgtggcctcgacaacaccgagttccagggagaaccaccaagcctgggacgaggacttaacacacgcctttgcgctgaaaatggatggatctccaagcggcgtggactggttaaaattacagcagtgggatggctcgtgatgaaaaagtag

SEQ ID NO: 133210 - DNA, 534 bp, Artificial Sequence
  Description of Artificial Sequence: Synthetic coding sequence
atggtcaaactgtttatcggcaatcttccccgggaggcgactgaacaggagataaggagcctcttcgaacagtacggcaaagttctggagtgcgacattatcaaaaactacggcttcgttcacatcgaggataaaaccgcagctgaagatgccatcaggaatttgcaccactataagctgcatggagttaatattaacgtggaggcctcaaaaaacaaatcgaagacatccacaaaactgcacgtgggcaatatcagccctacctgcaccaataaagagctgcgtgctaaatttgaggaatacggacccgtgatcgagtgtgacatcgtcaaggactatgcatttgtgcatatggagcgtgcagaagatgctgtggaggctattcgaggactagacaatactgaatttcaaggggagcccccgtcactgggccgagggctgaatactagactgtgtgccgaaaatggctggatatcaaagaggaggggattggtgaaaatcaccgctgtggggtggctggtcatgaaaaagtag

SEQ ID NO: 133211 - DNA, 522 bp, Artificial Sequence
  Description of Artificial Sequence: Synthetic coding sequence
atggtgaaactcttcatcggaaacttgccccgggaagctacagagcaagagattagaagcttgtttgagcaatacggaaaggtccttgagtgtgatataattaaaaattacggatttgtgcatatagaagataagacagcagccgaggacgcgatcaggaatctgcaccactacaagctccacggcgtcaatatcaatgtcgaagcaagcaagaacaagagcaagacctcgaccaagctccacgtgggaaacatcagcccaacatgtactaacaaagaactgcgggccaaattcgaagaatatggccctgtgatcgagtgtgatatagtaaaagactacgccttcgtccacatggaacgggctgaggacgccgtcgaagccatcaggggactggataatacagagtttcagggtaaaattaccccagtcaccgagggctattgctgttgcaataaaggtcacacctatatcttcaaaaattgcaaccttatcttagagagccggaagtccagacggtgctag

SEQ ID NO: 133212 - DNA, 432 bp, Artificial Sequence
  Description of Artificial Sequence: Synthetic coding sequence
atggtgaagctttttattgggaatcttccccgtgaagccacagagcaggaaatccggagtctctttgagcagtacggaaaagtgcttgagtgcgacatcattaagaattacgggttcgtgcatatcgaggacaaaactgcagccgaggatgcaattcggaacctgcaccattacaaactgcacggcgtaaatattaacgtggaggccagcaagaacaagtcaaaaacttccaccaagttacacgttggcaacattagtcctacctgcaccaataaggagctcagggcaaagttcgaggagtatgggccagtcatcgagtgcgatatcgtaaaggattacgcttttgtgcacatggaacgggccgaagacgctgtggaggctattaggggccttgacaacaccgaattccaaggcgggatgtgtgtcggctag

SEQ ID NO: 133213 - DNA, 1443 bp, Artificial Sequence
  Description of Artificial Sequence: Synthetic coding sequence
atggcaggcgccggaccagctccaggcctccctggggccggtgggcccgtggtgcctggcccgggcgcaggtattcctgggaaaagcggagaggaacggttaaaagaaatggaggctgagatggccctattcgagcaggaagtgctgggcgctccagttccaggtatacctaccgccgttcctgccgttcctaccgtgccaacagttcccacggtcgaggctatgcaggtccctgctgcgccggttatcaggccaatcattgcaacaaatacctaccagcaggtgcagcaaaccctggaagctagagcagctgctgctgcaaccgtggtgccaccaatggtcgggggcccacctttcgtcggtcccgtcggcttcgggcctggtgaccgctcccaccttgactctcctgaggcccgagaggctatgtttcttaggagggctgccgtggccccgcagagagccccaatcctccgcccggcattcgtcccgcatgttttgcagcgtgcagattctgctctgtctagcgcagctgccggaccccgccccatggcactaaggcctccacaccaggctctggtcgggccccctctcccaggccccccaggtccccccatgatgctaccccccatggcacgtgcgcccggcccacctctcggatcaatggcggccctgcgcccacccctggaggagccagcagcaccgagagaattgggtttggggctgggccttgggctgaaggagaaggaggaagccgtggtggcagccgctgcaggcttggaggaagcgagcgctgctgtggccgtgggcgccggcggcgcccctgctggaccagccgtcataggcccgtcattaccattggcgctggccatgcccctccctgagccggagccactgcctctccccctagaggtggtcagagggctcttaccgcctttaaggataccagagttgttatctctgcgacctagacctcgtccaccaagacccgaacccccaccaggcctgatggccttagaggtcccggaacccttgggagaggacaagaagaaaggaaaaccagagaagctcaagaggtgcatccggactgccgctgggagtagctgggaagatccatcgttgttggaatgggacgccgatgatttccgcatcttctgtggcgacctggggaacgaagtgaacgacgatattctggcccgcgcttttagccggttcccctctttcctgaaagcaaaggtcataagagataaacgcacgggcaaaaccaaggggtatggcttcgtgtcatttaaggatccatcagactatgtcagagctatgcgggaaatgaatggaaaatacgttggaagcaggcctataaagctgaggaagagcatgtggaaagatcgcaacctggacgtggtgagaaagaaacagaaggaaaaaaagaagctcggacttcggtag

SEQ ID NO: 133214 - DNA, 1356 bp, Artificial Sequence
  Description of Artificial Sequence: Synthetic coding sequence
atggccggtgccggaccagcccccggccttccaggagctgggggccccgtcgtccccgggcccggggccggaatccccggaaagagcggagaggagagactgaaggagatggaagccgaaatggccttgtttgagcaggaggtgctgggcgctcctgtgcccggaattccaactgccgttcctgctgtgcctacagtgcccaccgtgcctacagttgaggcgatgcaggtgccagcggccccagtcatccgaccaatcattgccacaaacacctaccagcaggtgcagcagacccttgaagcccgggccgcagctgctgccacagtcgttcctccaatggtggggggaccaccatttgtgggcccagtcggctttggcccgggggaccgtagccatctggactcccccgaggctcgtgaagcaatgttcctgcgccgggccgctgcaggcccaaggcccatggccctccggccacctcaccaagctctagtgggcccccccttgccgggaccccccggaccacccatgatgttacctccaatggcacgcgcacccggaccaccactgggctccatggccgcactccgcccgccactcgaagaacctgcagccccacgcgaattgggcttgggactgggattgggtctgaaggagaaagaggaggcggtggtggcggcggccgccggattggaggaagcatccgccgccgtggccgtgggtgcgggaggcgctccagcagggccagcggtcatcgggcctagtctgcccttagctttggccatgcccctgcctgaaccggagccactgccattacctttggaagtggtgcgcggcctgttacccccattgagaattcctgagctcctcagccttcggccacgtccccgacccccccggccagaacctcctccagggttgatggccctcgaggttcctgaaccactcggcgaggacaaaaaaaagggcaaaccggaaaagctgaagcgatgtatccggaccgcggcaggatccagctgggaggacccaagcctgttggagtgggacgcggatgatttccgcatcttttgtggggatctgggcaatgaagtaaacgatgatatactggctagggctttcagccggtttccctcattcttgaaggcaaaggtaataagagacaaacggacagggaaaaccaagggctacggatttgtgtcttttaaagacccatcagactacgtgcgggcgatgcgcgagatgaatggaaaatacgtaggctcccgccccataaagttacgcaaatcaatgtggaaggacaggaatttggatgttgtccgcaagaagcaaaaggaaaaaaaaaagctcggcctgcgttag

SEQ ID NO: 133215 - DNA, 801 bp, Artificial Sequence
  Description of Artificial Sequence: Synthetic coding sequence
atgggggccgctgccgctgaagccgacagaacgctgtttgtgggtaatttagagacaaaagttactgaagagctattgttcgaacttttccatcaggctggcccagtgataaaggtgaagataccaaaggataaagacggtaagcctaagcagttcgctttcgtcaatttcaaacacgaggtgagtgtcccgtacgcaatgaacctgcttaacggtatcaagttatacgggagacccattaagatccagttccgatctggttctagccatgcccctcaggacgttagtctgagctatccccagcatcatgtgggaaattcttctcctactagtactagcccaagtagatacgagaggaccatggacaacatgacctctagtgctcagataattcagcgaagcttcagctctccagaaaatttccagaggcaggcagtgatgaactccgctctgaggcaaatgagctatgggggaaagtttggctccagtcctctggaccagagtggcttttccccgtccgtgcagagccacagccatagctttaaccagtcttctagttcgcagtggcgccaagggacgcctagtagtcagagaaaagtcagaatgaatagctacccttacttagccgacagacactactcccgtgagcaaaggtataccgaccatggtagcgaccatcactatagagggaagcgggacgatttcttttacgaggaccggaaccatgatgattggtcccacgactacgacaatcgacgagactcaagcagagacgggaaatggagatcaagtagacactag

SEQ ID NO: 133216 - DNA, 525 bp, Artificial Sequence
  Description of Artificial Sequence: Synthetic coding sequence
atggcagacgtgctcgatctacatgaggccggaggggaggattttgctatggatgaagatggagacgagagcatccacaagctgaaggaaaaagctaagaaacggaagggacgcggttttgggtccgaggagggtagcagagcaaggatgagggaagattacgactctgtggagcaagatggtgatgaacccggaccccaacgtagcgtggagggatggatccttttcgttacaggggtccatgaggaggccaccgaggaggatattcatgataaattcgcagaatacggcgaaattaaaaacattcatctgaacctagaccgaagaacaggatacctgaagggatacacattggtggagtacgaaacttacaaggaggcccaggccgctatggagggactcaatggccaggatttgatgggacagccaataagtgtggattggtgcttcgtgcggggaccacccaaaggaaaaagaaggggggggcggcggcggtcccgtagccccgatagacggcgcagatag

SEQ ID NO: 133217 - DNA, 522 bp, Artificial Sequence
  Description of Artificial Sequence: Synthetic coding sequence
atggctgatgtactagatttgcatgaggctggcggcgaagacttcgctatggacgaagacggagatgagtccatccataaactcaaggaaaaagccaaaaaaagaaagggccgcggatttgggagcgaggggagccgcgcacgtatgcgcgaagattacgattcggttgaacaggacggcgacgaacctggcccccaacggtccgtggagggctggatactgtttgttaccggcgtgcatgaagaagcaaccgaggaggacatccacgacaaattcgccgaatacggcgagatcaaaaacatccacctcaacctggaccggaggaccggttacctgaagggctatacactcgtcgagtacgagacctacaaggaggctcaggctgcaatggagggattaaacggtcaggatctgatgggccagccaatcagcgtcgactggtgcttcgtccgtggacctccaaagggcaagaggaggggcggccgtcggcgttcaaggtccccagaccgcagaaggcgctag

SEQ ID NO: 133218 - DNA, 1179 bp, Artificial Sequence
  Description of Artificial Sequence: Synthetic coding sequence
atggttgaagccgacaggcccggaaagctgtttatcggcggccttaacctggagacggatgagaaagctctggaagccgaatttggcaagtacgggagaatcgttgaggttttgctgatgaaagatcgggagacgaacaagtcaaggggatttgccttcgtgacttttgaatcccccgcagatgcaaaagccgcagccagagacatgaacggcaagagtctcgatggcaaggcaattaaggtggctcaggcgaccaaacccgcattcgaaagttctcgacgaggccccccccccccacggtcacgcggaagacctagattcctgagaggaacccgcggtggtgggggcggccctcgacgctccccttctagggggggcccagatgacgatggtgggtatacagccgatttcgacctgcgcccttctcgtgcccctatgcccatgaagagagggcctcccccaagacgggttgggccgccacctaagagagccgcgccaagcggacctgctaggtcgtcagggggaggtatgcgaggacgggccttggccgtcagaggaagggacggatactccggcccccctagaagggagcctctgccacccaggagggatccatacttggggcctagagacgagggctattcctcacgtgatggatacagtagccgagattacagagaaccacggggctttgcccccagccctggcgagtacacccacagggattatggccattctagcgtgcgggatgactgtcccctgcgaggatattcagaccgggatggctatggagggcgagaccgcgattatggcgatcatctgagccgtggaagtcaccgtgagccgttcgaaagttacggggaactgcggggagcagctcccggtaggggcacaccaccaagctacggaggcgggggcagatacgaagagtacagagggtatagtcctgacgcatactcaggggggcgagactcatacagttcaagctatggaagatcagacagatactctaggggacggcaccgtgtgggtcggcctgaccggggcctgtccctgagcatggaaagaggctgtccacctcaacgggattcttattcgcgtagcgggtgtagggtgccgaggggcggtggacgactgggaggaagactcgagcgcggtggcggtagatccagatattag

SEQ ID NO: 133219 - DNA, 1491 bp, Artificial Sequence
  Description of Artificial Sequence: Synthetic coding sequence
atggtggaagcagatcaccccggtaagctgttcattggaggtcttaatagggaaactaacgagaaaatgttgaaggctgtgtttggcaaacacgggccgatcagcgaggtactgctcatcaaggataggaccagtaaatctcggggctttgcctttataaccttcgagaatccagcagacgccaagaatgcggccaaagacatgaacggaaaatcccttcatgggaaagctataaaagtcgagcaggcaaaaaaaccctcttttcagtccgggggccgacgacggccacccgcctcctcccgcaaccgatccccgtcaggatcacttcggtccgccagaggatcccggggcgggacgcgggggtggttgccgtctcacgaggggcaccttgacgacggcggatatactcctgatttaaagatgtcatactcccgggggctgatcccagtgaagaggggccctagcagcagatcaggtggcccaccaccgaaaaagtctgctccttcagcagtggctcgatctaattcttggatgggcagccagggaccaatgtcgcaacgcagggaaaactatggcgtacccccccgtcgagcgacaatctccagttggaggaacgatagaatgtccactcgacacgatggttatgccactaatgatggcaatcatcccagttgtcaagagacaagggactacgcaccaccgagtcgcggctatgcttatcgagacaacgggcatagtaaccgagatgagcatagcagcaggggttacagaaatcaccgctctagcagggaaacacgggattacgctccgccaagtcgagggcacgcctaccgcgattacggtcacagcagaagggacgagtcctattcgcgtggatatcgaaacagacgctcctctcgggagaccagggaatacgcccctcccagccgtggccatgggtaccgcgattacgggcactctagaaggcatgagagctactcgcgcggctatcgtaatcatccctcttcaagagaaacccgagactacgccccaccgcatagggattacgcctatcgggattacggccattcttcttgggacgaacatagcagcagaggttattcctatcacgacgggtacggggaggctctgggacgcgatcactctgagcacttaagtggctcctcctatagagatgccctgcagagatatgggacgtcacatggggcaccaccggctcgggggcctagaatgagctacggagggtccacgtgccatgcatatagtaacacacgagacagatatggacgatcttgggagagctattcctcatgtggtgatttccactattgcgaccgcgaacatgtctgcaggaaggaccagaggaacccaccttcactgggccgggttctgccagatccccgagaagcgtgtggtagctcctcgtatgtcgccagtatcgtcgatggcggggagtcccggtctgagaaaggggactcatcacggtattag

SEQ ID NO: 133220 - DNA, 1491 bp, Artificial Sequence
  Description of Artificial Sequence: Synthetic coding sequence
atggtggaagcagaccaccctggcaagctttttatcggcggccttaatagagagaccaatgaaaagatgctaaaagccgttttcggtaaacatggaccaatatcggaagtgttgctcattaaggatagaacttccaagtcaagggggttcgcttttattactttcgagaatccagcagacgcaaaaaacgcggccaaggatatgaacggtaaaagcctgcatggtaaagctatcaaagtcgaacaagctaaaaagccttcctttcagagcggagggcgccggcgcccccctgcgtcgagccgtaaccgctcaccctctggctccctcaggagcgcgcgcggcagtcgcggcgggaccagaggatggctgccttcacacgaaggacatttggatgacggtggttacaccccagacctgaagatgagctactcacgtggattaatacccgtgaagcgaggtcccagttcaaggtcaggagggccccccccgaagaaaagcgcaccatctgccgtagctaggagcaatagctggatgggctctcaggggccgatgtcgcaaaggcgggaaaactacggagttcctccacgacgggctacgattagctcatggaggaatgaccgtatgtccactagacatgacggctatgctaccaatgacggcaatcacccctcttgtcaagagactcgagactatgcgcctccttcccggggctacgcctacagagataacggccattctaatagagacgagcacagcagcagaggctatcggaaccatcgctccagcagggagacacgcgactatgccccccctagccgcggacacgcttacagggactacggtcactcccgtcgcgacgaaagctatagccgaggttaccggaatcggcgaagctccagggaaacccgcgagtacgccccacctagtagaggccacggataccgagattacggccattctagacgccacgagtcgtattctcgaggctatcgcaaccacccgtctagccgggagacccgagattacgcgcctccccaccgcgattatgcttacagagattacggacatagttcttgggacgaacatagcagtaggggttacagttaccacgacggctatggtgaagctcttggaagggaccatagcgagcacttgtcaggatctagctatcgcgacgcacttcagcgctatggaacttctcacggagctccgcccgctagaggtccccgaatgagttacgggggcagcacctgtcatgcctatagcaacaccagagaccgatatggccggtcgtgggaatcctatagttcttgtggcgacttccattattgtgacagggaacacgtctgccgcaaagaccagagaaaccccccctccctcggccgggtcctgcctgatcctagagaagcctgcggcagttcttcctatgttgcctctatcgtggacgggggtgagtcgcgcagtgagaagggggattcaagtaggtactag

SEQ ID NO: 133221 - DNA, 870 bp, Artificial Sequence
  Description of Artificial Sequence: Synthetic coding sequence
atgtcaacccgacacgacggatacgccactaatgacggaaatcacccaagttgtcaggagactcgtgactacgccccaccatcccgcggctatgcatatagagataacggccacagcaaccgagacgagcattccagcaggggatacagaaatcaccgatcaagccgagaaacccgggattatgcgccaccctcccgggggcacgcctacagggattatggccactcacgccgcgacgagtcttacagtcgcgggtacaggaacagacgtagcagtagggaaaccagggaatatgctccacctagtcggggccatgggtatcgagactacggccacagccgccggcacgaatcctattctcgaggatatagaaatcatcctagctcgcgggaaactcgggactatgcacctccacatcgtgactacgcatacagagactacggtcatagctcttgggatgagcactcttcacgtggctacagctaccacgatggatacggagaggccctgggccgagaccactcagagcatctgtcaggatcgagctaccgcgacgcccttcaacgttatggcaccagccatggagcaccacctgctaggggtcctcgtatgagctatggtggttctacttgccatgcctacagtaatacacgagataggtacggcaggtcctgggagtcctacagcagctgcggtgacttccattactgtgatagggagcacgtctgtcggaaggaccaacggaatcctcctagtctaggccgagtcctgccagatcctcgcgaggcctgtgggagcagctcctacgtggcaagcattgtggatggaggcgaatcgagatctgaaaaaggagatagctctagatactag

SEQ ID NO: 133222 - DNA, 1266 bp, Artificial Sequence
  Description of Artificial Sequence: Synthetic coding sequence
atgggcaagagactggaccagcctcagatgtacccgcagtatacctattactatccacattatcttcaaaccaaacagtcttacgcccccgccccacacccgatggctcctccgagtccaagcaccaatagtagcagtaacaactccagcaataatagctcaggggaacaacttagcaagacaaatctgtacatacgaggactgccaccaggtactactgatcaggatctgataaagctatgccagccatacgggaaaattgtatcaaccaaggccattctcgacaagaataccaaccagtgcaaaggatacggtttcgtcgattttgacagccctgccgcggcgcaaaaagccgtcgccagcctgaaggccaacggtgtgcaggcacaaatggccaagcagcaggaacaagacccaaccaatttatatatttctaatctgccaatctcaatggatgagcaagaacttgagaacatgctgaaaccttttggacacgtgatatctaccaggattcttcgcgatgcaaatggtgtaagccgtggggttggcttcgcccgcatggaatccaccgaaaagtgcgaggtagtcatccagcattttaacgggaagtatctgaagactcctccagggatccctgcgccctccgagccactcctctgcaagttcgcggatgggggccaaaaaaagcggcagaatcaatccaaatatactcagaacgggagaccatggccacgggagggggaggccggaatggcactcacctacgatccaactgccgccatccaaaacgggttctacagttccccttactctatcgccaccaatcgcatgatcccgcagacatccatcactcccttcatagcggcctctcccgtttccacttatcaggtgcagagcaccagctggatgccgcacccaccatacgttatgcagcccaccggagccgtgattacacctacaatggaccacccgatgagcatgcaaccagcaaacatgatgggacccctgacacaacagatgaaccatctgtcactgggaacaacaggcacgtatatgaccgcagccgctccaatgcagggaacgtacataccacagtataccccagtgccacctactgcggtgtccattgaaggcgtggtcgccgacactagcccgcagaccgtggctccctctagtcaagacacaagcggtcaacagcagcaaattgccgtcgacacctcaaacgaacacgctcccgcatactcttatcagcagagcaagccctag

SEQ ID NO: 133223 - DNA, 1263 bp, Artificial Sequence
  Description of Artificial Sequence: Synthetic coding sequence
atgggaaagcgattggaccagcctcaaatgtaccctcaatacacctactactatcctcactacctccaaacaaagcagagttacgctcctgcccctcaccctatggccccaccaagtccttctactaattcttcatcgaataatagttctaataactccagcggggagcaattaagcaagacgaatttgtacattagggggttaccccccggcactactgaccaagacttaatcaagctttgccaaccctacggtaaaatcgtatcaaccaaggcaattctggataaaaataccaatcagtgtaaggggtacggttttgttgactttgatagccccgcagccgcccagaaagccgtggcctcgctgaaggctaacggggtccaggcccagatggcgaagcagcaagagcaagatccaacaaatctctacatttcaaacctgcctatttccatggacgagcaagagctggaaaacatgcttaagccgttcgggcacgtgatctccacccggattctgagagatgcaaatggcgttagtagaggggtcggcttcgcacggatggagagcaccgaaaaatgtgaggtcgtaatacaacatttcaacggtaagtatctgaagacccccccaggcatcccagccccaagtgagccgttgctctgcaagttcgccgacggcggccaaaagaagagacagaatcagagcaaatatacccagaatggccggccgtggcctagagaaggcgaagctggaatggcccttacgtacgaccccacagctgctatccaaaacggattctactcgtcgccatactcgatcgccaccaatcgtatgattccacagacctccatcacgccattcattgcagcttctcctgttagcacataccaggttcaaagcacaagctggatgcctcaccccccatatgtgatgcagcccaccggcgcagtcataacacccacgatggaccacccaatgtcaatgcagcccgctaatatgatgggccctctaacacagcaaatgaaccatctttcactcgggacgacaggaacctacatgacagccgccgccccaatgcagggtacctacatcccgcagtatacacctgtccccccaaccgcggtgagcattgagggagtggtggcagacacaagcccacagactgtcgctccctctagtcaagatacatcgggccagcaacagcagatagccgtcgacacttcaaatgaacacgctccggcctactcctatcagcaaagcaagtag

SEQ ID NO: 133224 - DNA, 1260 bp, Artificial Sequence
  Description of Artificial Sequence: Synthetic coding sequence
atgggcaaaagactcgaccagccacagatgtatccccagtatacatattattaccctcactatcttcagacaaaatcctacgcacccgctccccaccccatggcccctccctcaccctccacaaactcgtcttcaaacaactcctctaataatagctccggggaacaattgtccaagacaaatctgtacatccgcggtctcccacctggaaccactgaccaggacctgatcaaactttgccagccttatggcaaaatcgtcagtacaaaggcgatcttagataagaacaccaatcaatgcaaaggctatggatttgtagattttgattcacctgccgctgcccagaaggcagttgcaagcctgaaggccaatggcgtgcaggcccagatggctaaacagcaggagcaggatcccacaaatctctatattagtaatctcccaatatcaatggatgaacaggaactcgagaatatgcttaagcctttcgggcacgtgatctccactcgcattctgagggacgccaacggcgttagccggggagtgggtttcgctcgtatggaatctacagagaaatgtgaggtagtgatccaacattttaacggtaagtacttgaagacgcccccaggaatcccagctccttctgagccccttttgtgtaaatttgctgatggcggccagaagaagagacaaaatcagagtaagtatactcagaatggtagaccatggccaagagaaggagaggcaggcatggcactcacctacgatcccacggcagctatccagaatggtttctattctagcccttactctatcgcaactaatcgcatgattccacagacatcaattacacctttcatagctgcctccccagtttcaacctaccagggtgcggtcatcacgcccacgatggaccatcctatgagtatgcaacccgcgaacatgatgggacctttgacccagcagatgaaccacctctccctgggcaccacaggaaccattcagtcccaggaccggatcatgatcctccaccagctgctgtgccagtatatgactgctgccgccccgatgcaaggcacgtatattccccagtacacccccgtcccaccaaccgcagtgtctatcgagggggttgtggcagacacatccccacaaactgtagccccgtcctctcaggatacttccggccagcaacagcagatcgctgtcgatacttccaatgagcacgctcccgcctactcttatcagcagagcaaaccttag

SEQ ID NO: 133225 - DNA, 1314 bp, Artificial Sequence
  Description of Artificial Sequence: Synthetic coding sequence
atggggaagaggctggatcagccccaaatgtatcctcagtacacctactactatcctcattacctccaaactaaacaatcatatgcaccggcacctcaccccatggcaccaccgagtcccagtactaactccagtagtaataacagctccaacaattcaagcggcgagcagttgagcaagacaaatctgtacattcggggactgccacctgggactaccgatcaggacctcataaaactctgccagccatacggtaagattgtctcaacgaaggccatcctggacaagaacacaaatcagtgcaagggctacggttttgttgactttgactcacccgccgccgctcagaaggctgtcgctagcctaaaggcaaacggagtgcaagcccagatggccaagcagcaggaacaggaccccacaaacctgtatatctctaacctgcctatcagtatggatgagcaagagcttgagaacatgctcaagcccttcgggcacgtgatctcaacccgtattttgcgtgatgctaacggcgtatcacggggagtcgggttcgcaagaatggaatcaactgaaaaatgcgaggtagtaatccagcactttaacggcaagtatctaaagacacccccaggaatacctgcaccaagcgagcctctgctgtgcaaatttgctgacggggggcaaaagaagcgccagaatcagtcaaagtatacacagaatggccggccttggcccagggaaggggaagctgggatggcccttacgtacgatccgaccgccgccatccagaacgggttttactcgagtccttactctatcgcaaccaatcgaatgattccacaaacctcaattaccccctttatcgccgcatcaccagtgtcaacttaccaggtccagtcaacatcatggatgccccatcccccttacgtcatgcagccaacaggggccgtgatcacgcccaccatggaccacccgatgagtatgcaacccgctaacatgatgggtcctctcacacaacaaatgaaccacctgagcctgggcaccacggggactatccaatcccaggacagaattatgatactgcaccagcttttatgccagtacatgaccgcggctgccccaatgcaggggacgtatatcccccagtacaccccggtgccgcctaccgcagtctcaattgaaggcgtggtcgcggacacatctccacagaccgtcgcacccagttctcaagacaccagcgggcagcagcaacaaatcgccgttgacaccagcaacgaacacgccccagcgtattcttaccagcaatccaaaccttag

SEQ ID NO: 133226 - DNA, 1305 bp, Artificial Sequence
  Description of Artificial Sequence: Synthetic coding sequence
atgggcaaacggttagatcagccgcagatgtacccacagtatacttattattacccgcattatcttcaaaccaaacagagttacgcccctgcgccacacccaatggctcctcccagcccaagcacgaatagtagctccaacaactcctctaataacagcagcggcgaacaattgtctaagaccaacctgtatattcggggcctccctccaggcacaaccgatcaagacctgataaaactgtgccagccttacgggaaaatagtgagcacaaaagcaatcttggacaaaaacaccaatcaatgcaaaggctacggatttgtcgattttgacagtccagcggcagctcaaaaggccgtggcgtcgctgaaggctaacggggtgcaagcacagatggcgaaacagcaggaacaagacccgacaaatctttacatcagcaacctccccatatccatggacgaacaggagctggaaaatatgctgaagcctttcggacatgttatctccacgcgcattctgcgggatgctaacggagtttcccggggcgttggcttcgctcgtatggagtctacagaaaagtgtgaagtggtgattcagcattttaacggaaagtatcttaagaccccacccggaatacctgctcctagtgaacccctgctgtgcaaattcgccgatggaggacagaagaagcggcaaaatcagtccaagtatacccagaacggccgcccctggccccgagaaggcgaagtactcagggggcggactgttcctcggcaaaatcgcgaggccggcatggctctgacatacgatcctactgctgcgatccaaaacggcttttactcttctccctactctatcgctacgaacaggatgatcccccagacttccattaccccttttatagcagcgtcccctgtttcaacatatcaggtgcagagtacctcatggatgccccacccaccctacgtcatgcagcctaccggggccgtgattacgcccacaatggatcatccaatgtctatgcagcccgccaacatgatgggcccactcacccagcagatgaatcacctgtctctgggtactacaggcacctacatgaccgctgccgcaccaatgcaaggcacctatatacctcagtataccccagtgcctccgactgcggtttcaattgagggcgtggtcgcagacacaagtccccagactgtggccccaagcagtcaggatacttccggccaacagcaacagatagctgtggatacttctaatgaacacgcgccggcttattcataccagcaaagcaagccttag

SEQ ID NO: 133227 - DNA, 1311 bp, Artificial Sequence
  Description of Artificial Sequence: Synthetic coding sequence
atgggcaaaagattagaccagcctcagatgtaccctcagtacacctattattatccccactacttacagaccaaatcttatgcacccgctccccaccccatggcacctccatcgccctccacaaactcgtcctcaaacaacagttccaataactcttcaggcgagcagctgtccaaaacaaatctttatattcgaggactgccaccgggcaccacagatcaggacctgatcaagttgtgccagccttacggaaagatagtgtccacaaaggctatcctggacaagaacacaaatcaatgcaagggctacggctttgtcgactttgattctcctgcagcagctcagaaggctgtggcatccctgaaggcaaacggggtacaggcccagatggccaaacagcaagaacaggaccctaccaacctgtacataagcaatctgcctatcagtatggacgagcaagaattagagaatatgttgaaaccatttgggcatgtcatttctacgcggattctcagggatgctaacggcgtgtccagaggcgtcggctttgcacgcatggaaagcaccgagaaatgtgaggtagtcatccagcacttcaacgggaagtacttaaaaacgccccctggcatccctgcccctagcgaaccactgttgtgcaaatttgctgatggcggacaaaaaaagcgccagaaccagagtaagtatacccagaatggccgaccctggccgcgggaaggcgaggcaggcatggcactcacgtatgaccctaccgctgccatccagaatgggttctactccagcccttacagcatcgccactaacagaatgatcccccagactagcatcacaccattcatcgcagcatcaccagtctccacctaccaggtgcaatcgacgtcttggatgccccaccctccctacgtgatgcagcccaccggggccgttattacgccaacaatggaccaccctatgagtatgcagcctgctaacatgatgggaccactcactcagcaaatgaatcatttgtctttgggaaccacagggacaattcagagccaggaccggatcatgattctccaccagctcctatgccagtacatgaccgccgcagccccaatgcagggtacatacattccccagtacacaccggtgcccccgaccgccgtgtccattgaaggagtggtagcagacacatccccacaaaccgttgcccccagttcacaggacactagtggccagcagcagcagatagccgtggacacttccaatgaacacgcccccgcgtactcataccagcagtctaagccatag

SEQ ID NO: 133228 - DNA, 1302 bp, Artificial Sequence
  Description of Artificial Sequence: Synthetic coding sequence
atgggcaaaagactggaccagccccagatgtacccccagtatacgtattactacccacactacctccagaccaagcagtcctacgcccccgcacctcaccctatggcaccaccatcccccagcacaaacagctcatcgaataacagctccaacaattctagcggagaacagctctctaagaccaatctgtacatccgcggactcccgcctggcaccaccgaccaggacctcataaagctgtgccagccatatgggaaaattgttagcacaaaggcaatccttgataagaatacaaatcagtgtaaaggatacggatttgtggacttcgacagcccggctgccgcgcagaaggccgtagcctcactcaaagcaaacggagtacaggctcaaatggctaaacagcaggagcaggacccaactaacctttacattagtaaccttccaattagcatggatgagcaagaattagaaaacatgctcaaaccctttggacatgtgatatctacccggatactccgtgatgcgaacggcgtgtctagaggggtgggatttgctcgaatggaatctacagaaaaatgtgaggtcgttatccagcacttcaacgggaagtatcttaaaacgcctccagggatccccgcgcccagtgagccccttctctgtaaattcgcagacggcggtcaaaaaaaaaggcagaaccagagcaagtacacccagaacggaagaccctggccaagggaaggcgaagtacttcgggggagaacagtcccccggcagaacagggaggccgggatggcactgacgtacgaccctacggcggctatacagaatggcttttactcctcgccgtattcgattgctaccaaccggatgattcctcagacctctattactccctttattgcagcctcgccagtgtcgacctaccaggtccagagtacctcttggatgccccatcctccatacgtaatgcagcctactggcgctgtcatcactccaacgatggaccaccccatgtctatgcagccagctaatatgatgggccccttaacgcagcaaatgaaccatctttccctaggcaccaccgggacgtacatgaccgccgccgctcccatgcaggggacctacattccacagtatacacctgttcccccaacagcagtttctatcgagggggtggtagccgacacctccccacagactgtggctccaagttcccaggacaccagtggacagcaacaacagatcgcggtggacacaagcaatgaacacgcgcccgcgtatagctaccagcagtccaagtag

SEQ ID NO: 133229 - DNA, 615 bp, Artificial Sequence
  Description of Artificial Sequence: Synthetic coding sequence
atgaacaatggtggaaaggccgagaaggaaaacacgccgagcgaagcaaatcttcaggaagaggaagttcggacactgttcgtttctggactgccattggatatcaagccgcgggaactgtatttactgttccggccatttaagggctatgagggctcactgattaagttgacatccaaacagcccgtcggcttcgtgtcattcgactcgcgatcagaggccgaggccgcgaaaaatgcccttaatggaatccgcttcgatccagagattcctcagactctcagactggagttcgccaaagctaacaccaagatggccaaaaacaagctggttggtacacccaatccttctacgcccttacctaacactgtgcctcagtttatagctagagaaccgtacgaactcaccgttccagccttgtatccttcctctccggaagtatgggctccttaccccttgtaccccgccgagttagccccagctttgcccccgcctgcctttacctaccctgcctctttgcacgcgcagctctgtgagggacagacggtacgcaggagccatcctctgtctgcacccagtcccgattccgccagcttggcatggtttcccgtgtag

SEQ ID NO: 133230 - DNA, 591 bp, Artificial Sequence
  Description of Artificial Sequence: Synthetic coding sequence
atgaacaacggagggaaagccgagaaagagaacacaccatccgaagctaatctgcaggaggaggaggtgagaactttgttcgtcagcggtctgccactggacattaaaccacgagagctctatctgctgtttagaccgtttaaaggctatgaaggaagtttgataaaattgacctctaaacagcccgtcggtttcgtgtccttcgacagtcgaagcgaggccgaggccgcaaaaaatgcactcaacggaatccgctttgacccagagattcctcagacacttcgccttgagtttgcaaaggccaacactaagatggcaaagaacaaactggtggggacacctaatccttccacacctcttcctaacacagtgccccagtttatcgcccgagagccctatgagctgactgtgcctgccctttacccatctagcccagaggtttgggccccttaccctctttatcctgccgaactcgccccagccttaccaccaccagcctttacctatcccgcttccctgcacgcgcagatgcgatggctgccaccaagtgaggccactagtcaaggttggaagagtaggcaattttgttag

SEQ ID NO: 133231 - DNA, 660 bp, Artificial Sequence
  Description of Artificial Sequence: Synthetic coding sequence
atgaacaatggcggaaaggctgagaaagagaataccccatcagaagctaacctccaggaagaagaggtccgcactctgttcgtgtccggcctgcccctggacattaaacctcgtgaactgtatctgttgtttcgaccctttaaagggtatgagggatctttgattaagctgacatctaagcagcctgtgggattcgtgtcatttgacagtaggagcgaagcagaggccgcgaaaaatgccttaaacggcatcaggtttgaccctgagatccctcagactcttaggttagagtttgccaaagcaaatacaaagatggcaaaaaataaactggtagggactccgaatccctctacgcctttacccaatacagtgccacagttcatagcgcgcgagccttatgaactgaccgtgccagccctctatccctctagtccagaagtttgggctccgtatccactgtaccccgctgagcttgctcccgccttacctcctcccgctttcacgtaccccgcatcactccatgctcagtgtttcagtcctgaggcaaagcccaatacgccagtgttctgtccccttctgcaacaaatcagattcgtgagtggcaacgtcttcgttacatatcagccaactgctgaccagcagagagaactgccctgctag

SEQ ID NO: 133232 - DNA, 591 bp, Artificial Sequence
  Description of Artificial Sequence: Synthetic coding sequence
atgaataacggcggcaaggcagaaaaagagaatacaccgagcgaggccaatctgcaggaagaggaggtaagaaccctgtttgtctccggcctcccacttgatattaagcccagggagctgtacctcttgtttcgacccttcaaaggttacgagggatcgctcattaagttgacgtcgaagcagcccgtggggttcgtgtcgttcgactctagaagcgaagccgaggctgccaagaatgcactgaatggaatacgcttcgatcccgaaattccccagacattaagactggagttcgccaaggctaacaccaagatggccaaaaacaagctcgtggggactcctaatcctagcactccattgcctaacaccgttccacagtttatcgcacgagagccatacgagctgacagtccccgccctgtacccctcctctccagaggtatgggccccgtacccgctctatcctgctgaacttgcacccgccctgcctccaccagcatttacctatccagcaagcttacatgcgcagatgagatggctccctccctcagaggctacgtctcaggggtggaagtcccgacaattttgctag

SEQ ID NO: 133233 - DNA, 462 bp, Artificial Sequence
  Description of Artificial Sequence: Synthetic coding sequence
atgaacaatggcggcaaggctgaaaaggaaaacacccccagtgaagctaacttgcaggaagaggaggtgaggacgctgtttgtatctggactgcctctcgatatcaagccccgggagctttatttactgtttaggccattcaagggctatgaaggatccttgatcaaactcacaagtaaacagcctgtcggtttcgtttcattcgactcacggtccgaggcggaagcagccaagaatgctttgaacgggattagattcgatccagagattcctcagacactacgcctcgagtttgctaaggccaacaccaaaatggcaaaaaataagttagtgggcacccctaatccatctactcctctcccaaataccgtgccccaattcatcgccagagaacccctgatgcgatggctacccccctcagaagctacctcccagggatggaagtcccggcagttttgctag

SEQ ID NO: 133234 - DNA, 1257 bp, Artificial Sequence
  Description of Artificial Sequence: Synthetic coding sequence
atgttggcatctcaaggcgttttattgcatccatatggcgttccaatgatcgtgcctgccgctccttatttgccaggcttgatccagggaaatcaagaggcggccgccgcccccgataccatggcccaaccttacgcctcagctcaattcgcccccccgcagaacggtatacctgctgaatataccgccccccacccacaccctgcgccagagtataccgggcaaaccacggttccagagcatacactgaatctgtacccacccgctcagacacactctgaacagtcacctgctgacacatcagcgcaaacggtcagcggaacagctacccaaaccgacgatgcagcgccaaccgatggccagcctcagacacaaccctccgagaataccgaaaacaagagtcagcccaaaaggcttcacgtgtccaacataccatttcgctttcgggatcccgacttgagacagatgttcggtcagtttggtaagatcctcgatgtggaaatcatattcaacgaaaggggcagcaaaggcttcggcttcgtgacctttgaaaactctgctgacgccgatagagcaagggagaagttgcacggcaccgtcgttgaaggaagaaaaatcgaggttaacaatgcgacggctagggtgatgacaaataagaaaaccgtgaatccttatacaaatggctggaagctcaaccccgttgtgggggccgtgtattcccccgagttttacgctgggaccgtcttactgtgccaggctaaccaggaaggctctagtatgtatagcgcccccagttcccttgtctacacatccgcgatgccagggtttccttaccccgccgcgaccgccgccgccgcctatcgcggagcccaccttaggggccgcggccgcaccgtgtataatacatttagagcggccgcacccccacccccaattcccgcctacggcggtgttgtttaccaggagccggtctacgggaacaagctgctgcagggaggttacgccgcctacagatacgcacagccaactccggccacagccgccgcctactccgatagctacgggagagtgtacgctgcagacccttatcatcatgccctggccccagccccaacatatggtgtgggcgctatgaacgcctttgcacccttgaccgatgcgaaaactcgctcacacgctgatgacgttgggcttgttctctcaagtctgcaggcctccatttaccggggaggctataaccgatttgctccctattag

SEQ ID NO: 133235 - DNA, 1209 bp, Artificial Sequence
  Description of Artificial Sequence: Synthetic coding sequence
atgatcgtgcccgctgctccttatctaccaggtctcatccagggtaaccaggaggctgccgctgcaccagatactatggcacaaccatacgcatctgcccaatttgcaccaccccagaatgggatcccggctgaatatactgccccacacccgcacccagctccggagtataccggacagactaccgtgccagagcacacgctgaatctgtacccccctgcccagacacactccgaacagtcccccgctgacaccagcgctcagactgtttccggaacggccacccaaacggacgatgccgcacctacagatggccagccccagacccagccctctgagaacaccgagaataagagtcagcccaagcgtctgcacgtgtcgaacatcccatttagatttagagaccccgatttgaggcagatgttcggccagttcggcaagattctggacgttgaaataatcttcaatgagcggggaagcaaaggtttcggcttcgttacctttgagaactcagctgacgccgatagagctagagagaagctccatggtaccgtcgtagagggacgcaagattgaagtcaacaacgctacagctcgggttatgactaataaaaaaacggtcaacccgtacaccaacggctggaaactgaaccctgtggttggagccgtgtactcgccagaattttacgcaggcacagtccttttgtgtcaggctaaccaggagggcagctcaatgtattcagccccctcttccctggtctataccagcgctatgccgggattcccatatcctgccgccactgccgccgcagcatatcggggcgcccatctgcgtggacgtggacgcaccgtgtacaatacgtttagagcagccgcaccaccacccccaattcccgcatacggaggagtggtttaccaggacgggttttacggcgcagatatttacgggggctacgcggcctatagatacgcacagccaacgcccgccaccgcagcggcctactcagatagttatggaagagtgtatgctgctgacccgtaccaccacgcgctggctcccgcccccacttatggggttggtgccatgaacgcgtttgccccactgactgatgctaagactagaagtcacgctgacgacgtggggctggtactcagctctctgcaggcatccatctacaggggcggttataatagattcgcaccgtattag

SEQ ID NO: 133236 - DNA, 1176 bp, Artificial Sequence
  Description of Artificial Sequence: Synthetic coding sequence
atgctggccagccagggcgttctgctgcacccctatggcgtgcccatgatcgttcctgccgccccatatcttcccggcctgattcagggtaaccaggaggctgctgctgcaccagatacaatggctcaaccctacgcctcggcccaattcgccccgccacaaaatgggattccagccgagtacaccgccccccatccgcacccggcccctgagtacacaggccagacgaccgtaccagaacacactctgaacctgtatcctccagctcagacccacagtgagcagtcacctgctgacacatccgcacagaccgtgtctggcacggcaactcagaccgatgacgccgctcctaccgatggccagccccaaacccagcccagcgaaaacacggaaaacaagtctcagccaaagcgcctccatgtgtccaacatccccttcagatttcgggatccagaccttcgtcagatgtttggccagtttggcaaaatactggacgtcgaaattattttcaatgaaagaggaagcaaaggtttcggatttgtcaccttcgagaatagcgccgatgccgatcgagccagagagaaactgcacggcactgtcgtcgagggccggaagattgaagtgaacaacgccaccgctcgggtgatgaccaataagaagaccgtgaacccttacaccaatggatggaagcttaaccccgtcgtcggcgcagtttacagtccagagttttatgcagtcccaggttttccctatcctgcggcaacagcagctgccgcataccggggcgcgcatctccgaggacgaggacgcacagtgtataatacctttagggccgctgcccccccacctccgatccctgcttacggaggagtcgtgtaccaagagccagtgtacggcaacaagttgctgcaggggggctatgccgcctaccggtacgctcagcccacccccgccactgccgcagcgtatagtgacagttacgggcgagtatacgcagccgacccataccaccatgcgctggcacccgctccgacatatggggttggcgccatgaacgcctttgcacctttgaccgatgccaagactcgctctcacgcagatgatgtcggccttgtgctgtcatcgctccaagcatccatttaccgaggcggctacaatcgctttgctccctattag

SEQ ID NO: 133237 - DNA, 1188 bp, Artificial Sequence
  Description of Artificial Sequence: Synthetic coding sequence
atgctggctagccagggagttctattgcacccctatggcgttccgatgatcgtccccgccgcaccatatctgcccggtctaatccagggtaatcaggaagctgcagcagccccggataccatggcccaaccttatgcctcagcccagttcgcaccaccgcagaatggtatccctgccgaatacaccgcaccacacccgcacccagccccagagtacactggacaaacaacagtgccagagcacactttgaacctataccctcctgcacagacgcactccgagcagagccccgccgacaccagtgctcagaccgtgtcggggacggcaacacagacagacgatgctgctccaaccgatggacagcctcaaacccagccatcggagaataccgagaataaatcgcagccaaaaagactgcacgtgtctaacatccctttcagattcagagacccagacttaaggcagatgttcggccaattcgggaagatccttgatgtagagatcattttcaatgagagaggatctaaaggtttcggattcgtgacctttgaaaattcggctgacgccgatagggctagggagaagctgcacggaactgtcgtggagggccgcaaaatcgaagtgaataatgccacggccagagtcatgaccaacaaaaaaacggtcaatccatatacgaatggctggaagctgaatcctgtcgtgggggctgtctactcaccagaattttatgccggcactgtattgctgtgtcaggccaatcaggagggatcttctatgtactctgctccatcttctttagtctacaccagcgccatgcctgggtttccctaccccgcggctaccgctgccgctgcttatagaggcgcccacctgaggggccggggaaggactgtgtacaatacatttagagcagctgcccccccacccccgattcccgcctacggcggtgtggtttatcaggaaccagtctacggaaacaagttgctccaaggaggctacgccgcctataggtacgcacagccaaccccagccacggccgccgcatatagcgaccgcaaccaattcgtctttgtggccgctgatgaaataagttgcaatacttccgccgtgaccgacgaattcatgttgccgacccccacaaccacccacctcttgcagccaccccctacagccttggtgccttag

SEQ ID NO: 133238 - DNA, 1179 bp, Artificial Sequence
  Description of Artificial Sequence: Synthetic coding sequence
atgcttgcctcacagggggtgctactccacccgtacggcgtgccgatgatagtgccagcagccccttatctacctggcctgattcaaggcaaccaagaggccgcagcagctcctgacaccatggcgcagccatatgccagcgcccagtttgctccaccccaaaacggaatccccgccgaatacactgccccccaccctcaccctgccccggagtacactggtcagaccaccgtgcctgagcacacacttaatctttaccctcccgctcaaacacatagcgaacagagcccggccgatacctctgcccagacggtctctgggactgctactcaaaccgatgatgcagcccccaccgatggacagcctcagactcaaccttccgagaataccgagaataaatcacagccgaagcggttacacgttagcaatatccctttccgctttagagacccagacctgcggcagatgttcggtcagttcggaaaaatcctggacgtcgagatcatatttaatgaacggggaagtaagggctttgggtttgtaacatttgagaactcagccgatgccgaccgggctcgcgaaaaactgcacgggaccgtggtagaggggcggaaaattgaggtcaacaacgcaaccgctagggtgatgacaaataaaaagactgttaacccgtacaccaacggatggaaactcaatcctgtggtgggagccgtgtacagcccagagttctatgccggtactgttctgctctgccaggccaaccaagagggcagtagtatgtatagtgcaccttcttcactcgtatatacctctgccatgccaggtttcccttaccctgctgccaccgccgccgcggcatataggggtgcccacttaaggggtagggggcgcaccgtttacaacacctttagggcagcagccccgccgcctccaatcccagcttatggcggagtcgtttatcaagagcccgtgtatggcaacaaactgctacagggcggatatgctgcctatcgatacgcgcagcccacacccgctactgctgcggcctactctgattcttatgggcgggtctatgctgctgacccctaccaccatgcgctcgcccccgctcccacgtatggggtcggtgccatggcttctatctaccgggggggctataatcgattcgccccatactag

SEQ ID NO: 133239 - DNA, 1194 bp, Artificial Sequence
  Description of Artificial Sequence: Synthetic coding sequence
atgaattgcgagcgcgaacaactgcggggcaaccaggaggccgcagctgccccagatacgatggcacagccatatgcaagtgcacagtttgccccacctcagaatgggatcccagctgaatacactgccccgcacccccatccagcaccggagtacacaggacaaactactgtgcctgagcatactctgaatctctaccctccggctcagacccactcagagcagagtccagcagacacttccgcacaaaccgtttcaggtaccgcaactcagactgatgatgccgctcccaccgacggtcagcctcaaacgcaaccgagtgagaacactgagaacaagagtcagccaaagcggttgcacgtctctaatattcctttccgatttagagatccagacttgcggcaaatgtttgggcagtttggaaaaatcctggacgtggaaatcatattcaacgagcgcggaagcaaaggtttcggcttcgtaacttttgaaaactcagcagacgcagacagggcccgcgagaaactccatggtactgttgtcgaaggtcggaaaattgaagtgaataatgccaccgcaagagtaatgaccaataaaaagactgtcaacccttacacaaacgggtggaaactaaaccccgtggttggtgccgtctactcaccagagttttatgctggcactgtgctactttgccaagctaaccaggaagggagttctatgtacagtgcaccctccagcctggtgtacacaagcgcaatgcccggatttccctatcctgccgccaccgccgctgccgcctacaggggggcacatctcagaggcaggggcagaaccgtatacaacacttttagggccgccgctccaccccctccgatccccgcctatgggggggtcgtttaccaggacggcttttacggggcagatatctacggaggatacgctgcatacagatacgctcagccgacaccagcgaccgccgctgcctacagcgatagctatggcagggtgtacgcagccgacccgtaccaccatgccttggctcctgctcccacatatggagtgggtgccatgaacgctttcgctccactcaccgacgcaaaaacacgcagccatgcagatgatgttggtctcgttctcagctcactacaggctagtatttataggggtgggtacaacaggttcgctccatactag

SEQ ID NO: 133240 - DNA, 1401 bp, Artificial Sequence
  Description of Artificial Sequence: Synthetic coding sequence
atggagacagggcaaaggacgcacgccagcggaacctatagttttctcgatcgcacgcagcattcagatataaaagctgattgcaatacctgtgtggagatcgaggataggaaagtgtcccggcagcagatgaattgcgagcgtgaacagctgagaggcaaccaagaggctgcagccgctccagatactatggcccagccgtatgctagcgcccagttcgcccccccacagaatgggatcccagccgagtacactgcgcctcatccgcatcccgcaccagagtacaccgggcagacaacagtgccagaacacactttgaacctctacccaccagcccagacacatagcgagcagtccccagccgacacatccgcccagacggtgtctggcacggcaacacagacagacgacgctgccccaactgatggacagcctcagacccaacctagtgagaacaccgaaaacaagtcccagcctaagaggctgcacgtgtctaatatcccatttcgttttagagaccccgacctaagacagatgtttggacagtttggaaaaatcctcgatgtagagattattttcaacgagcggggcagcaagggatttggattcgtcacattcgaaaactccgcagatgccgacagagcccgcgagaaactacatggcacagtggtggaagggcggaagattgaggtcaataacgctacggcacgggtgatgactaacaagaagacggtgaatccctacacaaatggctggaaacttaaccctgtagtgggggcagtatactcacccgaattctacgccgggactgtgctgctgtgccaggctaatcaggaaggatcaagcatgtattcggcgcccagcagcctggtgtacacttcggctatgcccggttttccctaccctgctgccaccgccgccgcagcttaccggggagctcatctccgggggcggggtcgcactgtgtacaatactttccgcgcagctgctcccccacctcccattcccgcctatggcggagtggtctaccaggacggcttctatggggcagacatttatggaggctacgcagcctatcgctacgcacaaccaacccctgctacagctgcagcatattccgataggaatcagtttgtgttcgtggctgccgacgaaatctcctgcaacaccagcgctgtgactgacgaatttatgctgcccacccctacgactactcacctactgcaaccaccaccaactgccctggtcccatgcccgaaagtgccagcacctgctcaaacgagtgaagaactgagctgcaccctgcctggactttgctgtcaggcagccgaaaacctgactgcttccccacccctgctgcagttcatgtttaaagtgattgtggctcaagaaaggaaatag

SEQ ID NO: 133241 - DNA, 1194 bp, Artificial Sequence
  Description of Artificial Sequence: Synthetic coding sequence
atgaactgcgagcgggagcagctgcggggcaaccaggaggcagcggctgctcccgatactatggcacaaccgtacgcttcagcccaattcgcccctcctcagaacggcataccagcagaatacaccgccccgcacccacaccctgctcctgaatacaccggacagacaaccgtacccgagcacactctcaatctgtatccccccgctcagacacatagtgagcagtcacccgctgatacaagcgcccagacagtctccggaacggcaacacagaccgacgatgcagcccccaccgatggacagccacagacacagcccagcgagaacacagaaaacaagtcccagcctaaacgccttcatgttagcaacatacctttcaggttccgggacccagatttacggcaaatgttcggccagtttggtaaaatcctcgacgtcgagataattttcaacgagagaggatcaaagggctttggattcgttacatttgagaatagcgctgacgccgaccgggcccgggaaaaactgcatggaactgtggtagaggggcggaaaatagaagtcaataacgccacagcccgggtcatgaccaataaaaagactgtcaacccgtataccaacgggtggaagttgaatcccgtagtgggggctgtttactcacccgagttttatgctggaacggtgctcttatgtcaggcgaatcaagagggctcttccatgtattctgctccaagcagtttggtgtatacatcagccatgccggggtttccatatccagctgctacagccgccgccgcataccggggagcacacctccgcggcagaggcaggactgtctacaacaccttccgcgctgcggccccacccccccctattccagcgtatgggggggtggtctaccaggacggattttatggagcagacatttacggagggtatgctgcttacagatacgcccagcctacacctgcaaccgccgctgcctattctgactcctacggccgggtctacgcagccgacccatatcaccacgcgctcgctccagcccccacctatggcgtgggcgcaatgaacgctttcgcacctctgaccgacgcaaaaacgcgtagccacgccgatgatgtggggttagtgttaagctccttacaggccagtatatacagagggggatacaaccgcttcgcaccctattag

SEQ ID NO: 133242 - DNA, 792 bp, Artificial Sequence
  Description of Artificial Sequence: Synthetic coding sequence
atgaactgcgaaagagagcagttacgtgggaatcaggaggccgctgctgctcccgacactatggcccagccatatgcctctgcacaattcgcaccccctcagaacggaatacccgccgaatacaccgcgccacatccacatcccgcacctgagtacaccggccagaccactgtccccgagcacactttaaatctctatcccccagcgcaaacacactccgagcagtcacctgccgataccagcgctcagaccgtgtcaggaacagccacccagacagacgatgccgcacccaccgatgggcagccccaaacccagccctctgaaaatacggagaacaaaagtcaacccaagcgcctccacgtaagtaatatccccttccgcttcagggatccagatttgcgtcagatgtttggacagtttgggaaaatcctcgatgttgagattattttcaacgaaagaggaagcaaaggctttgggttcgttacattcgagaattccgccgacgccgaccgagctcgggagaagttgcatggaacagtggtcgaaggtagaaagatcgaggtgaataatgcgacagcacgcgttatgaccaataagaaaactgtgaacccctataccaatggctggaaactcaaccccgtggtcggcgccgtgtactcccccgagttctacgccggaaccgtactattatgtcaggccaatcaagagggttcatccatgtattccgccccctctagtctggtctacacaagcgcaatgccaggtttcccttacccagccgcaacagcctag

SEQ ID NO: 133243 - DNA, 1113 bp, Artificial Sequence
  Description of Artificial Sequence: Synthetic coding sequence
atgaattgtgagagggagcagttgcggggtaatcaggaggctgcagccgctccggacacgatggctcaaccttacgcctccgcgcagttcgcacctccacagaacggaatcccagccgagtacaccgctccacaccctcatcctgctcccgaatacacaggccagacaacagtgccagaacacacattaaacttgtatccgcccgctcagacccactcagaacagagccctgcggatacaagcgcccaaacagtgagcggcacagcaacccagacagatgacgctgcccccaccgatgggcaacctcaaacccagccgtcagaaaacactgagaataagtctcaacccaagcgactccatgtctcaaacattcccttcagattcagagaccccgacttacgccagatgtttgggcagttcggtaagatcctagacgtggaaattatctttaacgaacgggggtctaagggctttggattcgtcacctttgagaattccgcagacgccgaccgtgccagggagaagctgcacgggactgtggtggaagggaggaaaatcgaggtaaataatgcaaccgctagagtgatgacaaataagaaaactgtgaatccctacaccaacggttggaaactgaacccagttgttggagctgtgtacagtcccgaattctacgccgtccccggattcccgtatccagccgcaacagctgctgctgcctacaggggcgcccatttgagaggccggggtaggacagtctacaacacgtttcgtgcagcagctcctcctccccctatccccgcttacgggggcgtggtttatcaggacggattttatggcgccgacatctacggcggctatgcagcttataggtacgcccagccaacccccgccactgctgccgcttatagtgatagctatggcagggtgtacgccgctgatccgtaccaccatgcacttgcccctgctccgacctatggcgtgggagcgatgaatgcattcgcacccctgaccgatgccaaaacccggtcacacgctgatgacgttggtttggtgctctctagcctacaggcgagcatctaccgcggtggatacaacagattcgctccatactag

SEQ ID NO: 133244 - DNA, 1725 bp, Artificial Sequence
  Description of Artificial Sequence: Synthetic coding sequence
atggcccacaacaaaatacccccgaggtggttaaactgtccacgtcgcggccagcctgtggctggtcgatttcttccccttaaaaccatgctcggcccacggtacgatagccaagtggctgaagagaatcgctttcaccccagcatgttatcgaactatctgaaaagcttgaaagtaaagatgggcctgctggtggatctgaccaacacatctcgcttctatgaccgcaatgacattgagaaggaaggtatcaagtatatcaaactacaatgtaagggacatggcgagtgccccaccaccgaaaacactgaaaccttcattcggctgtgtgaaaggttcaacgagagaaacccgccagaactgattggtgttcactgcactcacgggttcaatcggacagggtttctcatctgtgcgttcctggtggaaaagatggactggtctatcgaagcagcagttgccaccttcgctcaggcccgtcctcccggaatatataaaggagactatctgaaagagctgttccgaagatacggtgacatcgaagaggctccaccccctcccctgttgcccgactggtgcttcgaagatgacgaagatgaagacgaggatgaggatgggaaaaaggaatccgagcctggaagttcagctagctttggcaaaagacggaaggagagactgaaactcggtgctatatttctggagggggttaccgtgaaaggagtgacccaagtgacgactcaaccgaaactgggcgaagtccagcagaagtgtcatcagttttgcgggtgggagggctcgggattcccgggcgctcagcccgtttccatggacaagcagaacattaagttgctggatctgaaaccatataaagtcagttggaaagccgatgggaccaggtacatgatgctgatcgacgggacaaacgaggtgttcatgattgatcgcgacaacagtgtttttcacgtatccaacttggaattcccatttagaaaagacttaaggatgcatttgtctaacactctgctagacggggaaatgatcatagatcgcgtcaacggccaagcggtccctagatatctgatctatgatataataaaattcaactcgcagcctgttggggattgtgactttaacgttagacttcagtgcatcgagcgtgagatcatcagcccccgacacgaaaagatgaagacaggtttgattgataagactcaggagcctttttccgtccggaacaaaccttttttcgatatttgtacaagccggaagaagtataagcccggacggtgtgatgatatactcaaatggaaaccgccctctttgaattctgttgactttcggctcaagatcacacggatggggggggaagggctgttgccacagaacgttggacttctttatgtcggaggatacgagagaccattcgcccagatcaaagtgactaaggaactcaaacagtacgacaacaaaatcatcgaatgtaagttcgagaataattcctgggtgttcatgcgccagagaaccgacaagagctttcctaatgcatataacaccgctatggctgtgtgcaactctattagcaacccagtaacaaaagaaatgctctttgaatttattgatagatgcaccgctgcatctcagggccagaagagaaaacatcacttagatccagacacggagttgatgcccccaccgcctccaaaaagacctaggccattgacctag

SEQ ID NO: 133245 - DNA, 1626 bp, Artificial Sequence
  Description of Artificial Sequence: Synthetic coding sequence
atggcccataataaaatccccccccgttggctgaactgtccccgccggggccaacccgtcgcaggccgctttctccccctgaagacgatgctgggcccccgctacgacagtcaggtcgccgaggagaatcgctttcacccttctatgttgtcaaactatctaaaatcactgaaagtaaaaatgggacttctggtggacttaacaaacaccagcaggttctacgataggaatgatatcgagaaagagggaatcaagtacatcaagctgcaatgcaaaggccacggggaatgcccgactactgagaacacagaaacattcatacggctctgcgagagattcaatgagcgtaacccaccagaattaatcggcgtacattgtacccacggttttaacagaaccggcttcctgatctgtgcctttttggtggaaaagatggactggtctatcgaagccgcagttgcaaccttcgcacaggccagaccaccaggaatctataagggcgactatttaaaagaactgttcaggcgttatggcgatatagaagaggcccctccaccacctttactccctgactggtgttttgaagacgacgaagatgaggacgaagatgaggacggaaagaaggagagtgagccaggcagctccgcgtcatttggtaagcgccgcaaggaacggttgaagctaggagctatctttctggagggagttaccgtgaagggcgtgactcaagttaccacccagccaaagctgggtgaggtccagcagaagtgccatcagttctgcggctgggaggggtcaggattcccaggcgcccagcccgtgtctatggataagcagaacatcaagctgcttgacctaaagccttataaagtctcttggaaggccgacgggacaaggtatatgatgttgatagatgggacgaatgaagtcttcatgattgatagagacaatagtgtgtttcacgtcagcaatctcgagttccctttcaggaaagatttgcggatgcacctgtcgaatacactcctcgatggcgagatgattatagaccgcgtaaacggccaagccgtgccacgctacctaatctatgatatcatcaagtttaatagccagccggtcggtgattgcgatttcaacgtgcgtctgcagtgcatagagcgtgagatcatcagtccaaggcatgaaaagatgaagacaggactcattgataagacccaggagccgttttccgttaggaacaagcccttttttgatatctgcactagtagaaagttgctggaggggaacttcgccaaggaggtgagtcatgagatggatgggcttatattccagccaacaggaaagtacaaaccaggtaggtgcgacgacatcctaaaatggaaaccaccatctttgaattctgtggactttcgccttaaaattactcggatggggggtgagggactactgccgcagaatgtcggtctcctatacgttggtgggtatgaacgcccatttgctcagattaaggtgtgcctcttcatcttcagtgtgttgtttttggacgttctgctgtctagaatacaccaaaacctggctaataacaatcagcatatcaagatatcttgcagctcgaccctgggcggttag

SEQ ID NO: 133246 - DNA, 1794 bp, Artificial Sequence
  Description of Artificial Sequence: Synthetic coding sequence
atggcacataacaaaattcctcccaggtggctgaattgcccccgccgcggccagcccgtagcaggtaggttcttgccattgaagaccatgcttggcccccgttatgatagtcaggtggctgaggagaaccgcttccaccccagcatgcttagcaattatctgaaatctttgaaagtgaaaatggggttacttgtggacctgactaatacctccaggttctacgaccgcaacgacatcgagaaggagggcattaaatacatcaaactccagtgtaagggccatggagaatgtcccactacagaaaatacggagacattcattcgcctatgtgagcggtttaacgagagaaatccccccgaactaataggggtgcattgcacacatgggttcaatcggaccggattcctcatatgcgccttcctggtagagaaaatggactggtctattgaggccgcggtggctacctttgctcaagcacgaccgccagggatctataagggggattacttgaaggaactattccggagatacggagacatcgaagaagctcccccacctcccctactgcccgattggtgctttgaagatgacgaggacgaagacgaagatgaggatggcaagaaagaaagcgagcctggctcctctgcgtcttttggaaagcggaggaaggagcgcctgaaacttggagccatttttttggaaggagtcacagtgaaaggggttacacaagttacaacgcagccaaagctcggcgaggtacagcagaagtgccatcagttctgtggttgggaggggtccggatttcctggagcacagcctgtgtcaatggacaagcagaacatcaagctcctggatctgaagccttacaaggttagttggaaggctgatggtacccgatacatgatgcttatagacggaacaaatgaagttttcatgattgatagggacaacagcgttttccacgtgtccaatctggaatttcctttccgcaaagacctgcgcatgcacctgtctaacactcttctggacggtgagatgatcatcgaccgagtcaatggccaggccgtccccaggtaccttatttatgacatcattaagttcaacagccaacccgttggcgattgtgatttcaatgttcgactccagtgcattgagcgggagatcatcagcccaaggcacgagaaaatgaagaccgggctaatcgataagactcaggaacccttttccgtgagaaataagcccttcttcgatatttgtacgagtcggaaacttttagagggcaatttcgcaaaggaggtgtcacatgaaatggatggtctgatcttccaaccaactgggaagtacaagccaggaagatgcgacgacatcttaaaatggaagccgccatctctcaattcggtggatttccggctgaaaatcacaagaatggggggagaggggttgctgccacagaatgttggactcctgtacgtgggtgggtatgagcggccctttgcccagatcaaagtcacaaaggagctgaaacaatacgataataagatcatagagtgcaaattcgagaacaacagctgggtcttcatgcggcagagaacagacaaatcttttcccaacgcatacaataccgcaatggctgtgtgcaactcgatctctaatcccgtcacaaaagagatgctttttgaatttatagataggtgtacagcagccagccagggacagaagcggaaacaccatcttgatcctgatacagagctcatgccacccccaccccccaagcgaccacgccctcttacatag

SEQ ID NO: 133247 - DNA, 1707 bp, Artificial Sequence
  Description of Artificial Sequence: Synthetic coding sequence
atgctgggccctagatacgacagccaggtcgctgaagaaaaccggtttcacccttcaatgttgagcaattatctaaagtccctcaaggtaaaaatggggcttctggtcgacctcactaatacaagccggttctatgatagaaacgatattgaaaaagaaggtatcaagtatattaagctgcagtgtaagggccacggcgagtgccctacaactgaaaacactgagacttttatccggctttgtgaacggtttaatgaaaggaatcccccagaactgataggcgtgcactgcacacacggcttcaatcgcaccggtttcctcatttgcgctttcctggtagaaaaaatggattggtctatcgaggcggcggttgccactttcgcgcaggcccgacctcctggaatctacaagggggattacctcaaggaactattcagacgctacggcgacatcgaagaagccccccccccacctctgttgcccgattggtgcttcgaggacgacgaggacgaagacgaggatgaggacggaaaaaaggagtccgagccgggctctagcgcttccttcggtaagcgccgcaaggaacggctgaagctgggagcaattttccttgagggtgtcactgttaaaggggtcactcaggttacaacccaacctaagctgggcgaagtgcagcagaaatgtcaccaattctgtggatgggagggctcaggcttccctggagcccagccagtgtcgatggacaagcaaaatatcaagctcctggatctaaagccttacaaggtgtcttggaaggctgatggaacccgatatatgatgctgatagatgggactaacgaggtgtttatgattgaccgcgacaattcagtgtttcacgtatctaatttagagttcccattccggaaggatctgagaatgcacctgagcaacacacttctggacggagaaatgataatcgatcgggtgaatggacaggctgtgccaaggtacctcatatacgacatcattaaattcaattctcagcccgtgggagattgtgacttcaacgtgcggctccaatgcattgaacgagaaatcataagccctcgccacgaaaagatgaaaactggcctgatcgacaaaacacaagagcctttctcagttcgcaataagcccttctttgacatttgtacctctagaaagctgcttgaaggcaattttgcaaaggaggtgagtcacgagatggacggcttgatttttcagcctaccggcaaatataaacctggacgttgtgatgatatcttgaagtggaagccccccagtctgaactcagtggattttcgactaaaaatcactcgcatgggtggagagggactcttaccccagaacgtgggacttctctatgtgggcggctatgaacgcccctttgcacagataaaagtgacaaaggaactgaaacagtacgacaacaagatcattgagtgcaagttcgagaacaattcatgggttttcatgcgccaaagaaccgataaaagctttcctaatgcctacaacaccgccatggccgtctgtaattccattagcaatcctgtgactaaagaaatgttgttcgagttcatagataggtgcacagccgccagtcaggggcagaagcgtaagcatcacttagaccccgatactgaactcatgccaccgcctcctccgaagagaccccggccactgacatag

SEQ ID NO: 133248 - DNA, 1545 bp, Artificial Sequence
  Description of Artificial Sequence: Synthetic coding sequence
atgggactgcttgtggacctgaccaacacgtcacgcttctatgaccgcaacgacatagagaaagagggcattaagtacatcaaattgcagtgtaaggggcacggggagtgtccgactaccgagaacacggaaacctttatacgtttatgtgagcgcttcaacgagcgaaacccaccagagctgattggagtccactgtacacatggttttaaccggactgggttccttatttgcgctttcttggtggagaaaatggactggtccattgaggctgccgttgcgacatttgcccaggccagaccaccaggtatttataaaggagactatttgaaggaactcttcagacggtatggggacattgaagaggccccaccgcctccgctgttgccggactggtgctttgaagacgacgaggacgaagacgaagatgaggacggaaagaaggaaagcgagccaggatcaagcgcatcctttggcaaacgcagaaaggagcggttaaagctaggcgccatctttttggagggtgtcactgtgaaaggggttacccaggtcacaactcagccaaaacttggcgaggtgcagcagaaatgccatcagttctgtggttgggagggtagcggctttcctggagcccagcccgtttccatggacaagcaaaatatcaagctgcttgacctgaagccatacaaggtttcctggaaggccgacggcactcgttacatgatgcttattgacggcaccaacgaggtttttatgatcgacagagacaactccgtctttcatgtgtcgaacttagagttcccattcaggaaagaccttaggatgcatctgtctaatacactgcttgatggtgaaatgattattgatcgcgtgaacggccaggctgtacccaggtaccttatatacgacattatcaagtttaattcccaacccgtcggagattgcgacttcaacgtccggctccagtgtattgaacgtgagattatcagtccccgccacgaaaagatgaaaaccggcctcatagataaaacacaggagcctttttccgtacgaaacaaaccgttttttgatatttgtactagtaggaagaagtacaaaccagggcggtgcgatgatatcctgaagtggaagcctcctagtctgaactccgtggacttcagactaaaaattacgcgaatgggaggggagggtcttctcccccagaacgttgggctcttgtacgtgggcggttacgaacggcctttcgcgcagatcaaagttacaaaagagctcaagcagtacgataataaaattattgagtgcaagtttgaaaacaacagctgggtgttcatgcgccaaagaaccgacaaaagtttccccaacgcgtataatactgctatggccgtgtgcaactccatcagcaacccagtgaccaaggagatgcttttcgagttcatcgaccggtgtactgccgcatcgcaggggcaaaaacgcaagcaccacttagatcctgacacagagctcatgcctccacctccccccaaacggccaaggcctctgacctag

SEQ ID NO: 133249 - DNA, 1263 bp, Artificial Sequence
  Description of Artificial Sequence: Synthetic coding sequence
atggctgcccttgtccgccccgctaggtttgtggtgaggccactccttcaggttgtccaagcctgggatcttgacgctcgccgctgggttcgggccttgaggaggagccctgtgaaagtcgtgttccctagcggcgaggtagtggaacaaaagcgtgcgcctgggaaacaaccaaggaaggctccttcagaagcctcagctcaggagcaacgtgagaaacagcccctcgaagaatcagcgagtagagctccctccacttgggaggaaagtggcctccgatatgataaagcataccctggggataggcgcctgtcgtcggtcatgactattgtcaagagccgaccattcagggaaaagcaggggaaaattctcctggaggggagaagactgataagtgatgccctaaaggctggggccgtcccaaagatgttcttcttcagcaggctggagtacttgaaggagctccccgtggacaaactgaaaggcgtgtccctcattaaagtgaaattcgaggacatcaaagactggtctgatctcgtgacgccccagggaatcatgggaatcttcgccaaaccagaccacgtaaagatgacttacccaaagactcagcttcaacacagcctccctctcctgttgatttgtgacaatttgcgcgaccccgggaacctgggtacgattctccgaagtgctgcaggcgcggggtgctcaaaagttcttctgaccaaaggctgtgttgacgcctgggagcccaaagtcttacgcgccggcatgggggcccactttcgcatgccaattattaataacctggaatgggagaccgtgcctaattatcttcctccagacaccagagtgtacgtcgccgataattgcggcctttatgctcaggccgagatgtcgaataaggcatcggaccacggctgggtgtgtgatcagcgcgtgatgaaatttcataagtatgaggaggaagaggacgtcgagacaggggcctcgcaggactggctaccgcatgtagaggtgcagagctacgacagcgactggactgaggcgcccgcagctgtggtgataggtggagaaacctatggagtctctcttgaatctctgcagttggctgaatctacaggagggaagagattactgataccagtggtgccaggggttgactctctgaattcggcaatggctgccagtattctactgttcgagggcaaacgacagctacggggtagagccgaagatctcagccgcgatagatcttaccattag

SEQ ID NO: 133250 - DNA, 4182 bp, Artificial Sequence
  Description of Artificial Sequence: Synthetic coding sequence
atgctgtcccgacccaagccgggggaaagcgaagtcgacttgctgcatttccagagccagtttttggccgccggcgctgcccccgccgtccaactggtcaaaaagggcaacagaggcgggggggacgccaactccgatagacctcctctccaggaccaccgggatgtagtgatgctcgataacctccccgatctgccccctgctctggtgcccagcccacccaagcgcgcacggccgtctccgggccattgcctgcccgaagacgaggatccggaagaaaggctgaggagacacgaccagcatatcactgctgtgttaaccaaaatcatagagagagatacgagctccgtcgccgttaacctgcctgtcccaagcggtgtcgcctttcccgccgtgttcctgagatctcgtgacactcaaggcaagagcgccacttcagggaagagatctattttcgcccaggagatcgctgccagacggattgcagaagccaaaggacctagcgtgggcgaggttgtgcccaacgtggggcctcccgagggcgccgtgacgtgtgaaactcctaccccaaggaaccaggggtgtcagctccccggctcgagtcattcttttcaaggaccaaacctggtgaccgggaagggactgcgggaccaggaagccgagcaggaagcacagacaattcacgaggagaatattgcacgcctgcaggctatggcccccgaggagattttacaggagcagcagcgacttttagctcagttggatccaagtttggtggccttcctccgcagccactctcatacacaggaacaaaccggcgaaacagcatccgaagagcagaggccaggcggaccaagcgccaatgtcaccaaagaggagccgctgatgtccgctttcgcgagcgagcctcgcaagagggacaaactggaacctgaggctcccgccctagccctgcctgtgacacctcagaaggagtggctgcacatggacactgttgagctggagaaattgcactggacacaggatttgcccccagtccgtcgacagcaaacacaagagcggatgcaggcacgcttttccctgcagggggaactgctggccccggatgtggatctaccaacacaccttggactgcatcatcatggggaagaagctgagcgggctgggtattccttacaggagttgtttcaccttacccggtcccaggtcagccagcagagagctctggcgctgcatgtgctcgcccaggtgatttcccgtgctcaggcgggcgaattcggagaccggctcgcaggaagcgtgctgtccctcctcctggatgcgggcttcctgtttcttctgcgtttttctctcgacgatagggtggatggggtgattgcgactgctattagggccctgcgcgccctcctcgttgcccccggagatgaggagctcctggactctaccttctcctggtaccatggagcactcacattccccctcatgccctctcaggaggacaaggaggatgaggacgaagatgaagagtgccctgcgggaaaggccaaacgcaaatctccagaagaagagagccgcccgcctcctgatctggcgaggcacgacgtgattaagggcctgttagccacctctttgcttcccaggctacgctacgtgctggaggtcacctatcctggacccgcagtggtgctggacatattagccgtgctgattagactcgcccgccattctctggagtctgctacacgggtattagagtgtcccagactcatcgaaacgattgttagagagtttctgcccacatcctggagtccggtgggagccggacctacaccatcactttacaaggtgccatgcgctactgcgatgaagttactgagagtgcttgccagtgccggaaggaacattgccgcgcgcctgttgagctcatttgatttacgaagccgcttgtgccgcataattgccgaggcaccacaggaacttgctttgcccccggaggaggcagaaatgttaagcacggaggctctgaggctgtgggcggtagccgcttcctatggccagggtgggtacctatatagagaactatatccagtcctaatgagagcactgcaggttgtccccagagagctgtccactcacccgcctcagccactctccatgcagagaattgcttctctgctcacactgctgacacaacttacgttggccgccggcagcaccccagctgagactatttccgacagcgctgaggcgtctctctcagcaacacctagcctggtaacctggacacaagtcagtgggctccagccattggttgaaccatgcctgaggcaaacattaaaactgttgtctaggcccgagatgtggcgagcagtgggaccggtgccagtagcatgtctcctgttcttaggggcgtactatcaggcttggagccaacagccttcgagctgccccgaggactggttacaagatatgcaacgcctgagtgaggaactgctgctccctctgctcagccagcctacactgggttcactctgggattcactacggcactgtagcttattgtgtaatcctttgagctgtgtccccgcactggaggccccacctagtctagtaagcctgggctgtagcggcgggtgtcctagactgtctctggccggttccgcctctccattcccttttttgacagcacttctctcactcctcaatacattggcccagatccataaaggactgtgtggacaacttgcagcaatcctggcggcccctggcctgcagaattatttccttcagtgtgttgcaccaggcgcggctccacacctgacccctttctctgcctgggccttgagacatgagtatcatctccagtacctcgctctggctctggctcagaaggctgctgctctgcaacccctgcccgcgactcacgcggcactctaccacggaatggcattggctctactgagtcgcctgctgcctggcagcgaatacctaacccatgaactgctccttagttgcgtttttaggctggaatttctgcccgagaggacatccggcggcccagaagccgccgattttagtgaccagctgagcttgggaagttcccgggtccccagatgcggtcagggcacacttcttgcccaggcgtgccaggacctaccatctattagaaattgttacctgactcactgtagcccagctagagcgtccttactagcgtctcaagccctccatagaggggagttgcagagggtgcctactttgcttctgcccatgccgaccgagccactactgcccacagactggcccttcttgcctctgatccgcctttaccacagggctagcgatactccgagtggcctgtcaccaacggatacgatgggcactgcaatgagagtcttgcagtgggtactcgtactggagtcatggcgtcctcaggccctgtgggccgtgccccctgcggccaggctggcccgcttgatgtgcgtgttcctggtggactccgagctgttcagggagtctcccgtccaacaccttgtcgccgctcttctggcccagctgtgccagccacaagtgcttccgaacttgaacctcgactgccgccttcctgggctgaccagcttccccgatctctacgctaacttcctcgaccacttcgaggccgtttctttcggcgaccacctgtttggggccctggtgcttctgccattgcagagacggttcagcgtcacactgcgcctcgctttattcggagagcacgttggggctctgcgcgccttgagcctaccgttgactcagctgccggtctccttggagtgctacactgtcccccctgaagataatctggcattattgcagctatacttcaggacgctggtgacgggcgccctgcgaccgcgttggtgtcctgtgctttatgcggtggccgtggcgcacgtcaactccttcattttctcgcaagacccacaatcatcagatgaagtaaaggctgccaggcgttccatgctccagaaaacttggctcctcgccgatgagggcttacggcagcacctgcttcactacaagctgccgaactccaccctgccggagggcttcgaactctatagccaactgccgcccctgcggcagcattatctgcagaggctcaccagtacagtgctgcaaaacggggtatccgagacgtag

SEQ ID NO: 133251 - DNA, 1839 bp, Artificial Sequence
  Description of Artificial Sequence: Synthetic coding sequence
atggctgatttcgccggaccttcctctgccggtcggaaggccggagcacccagatgttccagaaaggcagccggaactaagcagacatcaaccctcaagcaggaggacgcttctaagcgcaaggccgaactggaagcagcagtgaggaagaaaattgaattcgaaagaaaagcactccatatcgtggagcaactcctggaagaaaacataaccgaagaatttctgatggagtgcggacggtttatcacaccagcacactactcagacgttgtcgacgagcgctccatcgttaaactgtgtgggtacccattgtgccagaagaaattgggcattgtcccaaagcagaagtacaaaatctccaccaaaaccaacaaagtgtatgatatcactgagaggaagtctttttgcagcaacttctgttaccaagccagcaagttctttgaggcccagatcccaaaaacccccgtatgggtccgcgaagaggagcggcacccagatttccaactgttaaaggaagaacagagcggccattcaggagaagaggtgcagctgtgtagcaaagcgataaaaactagcgacatcgacaatccttcccatttcgaaaaacaatatgagagcagttcctcaagcacccactccgatagctccagtgacaatgagcaggatttcgtgagctctatattgccaggcaataggcccaacagcactaacattaggccccagctgcatcagaaatctatcatgaagaaaaaagctggtcacaaagccaacagtaagcataaggacaaggaacagaccgtggtggacgtcaccgagcaattaggggattgtaagctcgatagccaggagaaggacgccacctgtgaactgcccctgcaaaaggtgaacacccagagttcctccaattctaccttgcctgaacggctcaaggcctctgaaaattctgagtctgaatattcccgcagcgagattacactggtgggaattagtaaaaagtccgctgaacattttaagcgcaagtttgccaagtctaaccaagtgagtagaagcgtgtcatccagcgtgcaggtgtgcccagaggtgggtaagaggaacctgcttaaggtcctcaaagaaacgctgatcgaatggaaaacagaggagactctcagattcctgtacggtcaaaattatgcctctgtgtgccttaaaccagaggcttcattagtaaaggaggagctggacgaggacgatattattagtgatcctgatagccacttccctgcctggagggaaagccagaatagcttggacgaatcgctgccattccgaggatccggcacagccattaagcccctcccttcctacgagaatctaaaaaaagagacagagaaactcaacctgagaattagagagttctatcgtgggcggtatgtcctgggcgaggagactactaaaagccaggactccgaggagcatgacagcacattccctctgatcgactcatcaagtcagaaccaaatccggaagaggatcgttctggagaagctatcgaaggtgttgccgggcttactcgttccattgcaaatcacgctgggtgacatctatacccaattgaagaacctggtcagaacatttcgcttgacgaaccgaaatatcatccataaacctgcggagtggactctgatagccatggtgctgctgtctctgctcactcccatccttggcattcagaagcactcacaggaaggcatggtgtttactaggtttctggacacattacttgaggaactccacctgaagaacgaggacttagagtccttgaccattatcttccggacttcctgcctgccagagtag

SEQ ID NO: 133252 - DNA, 1755 bp, Artificial Sequence
  Description of Artificial Sequence: Synthetic coding sequence
atggcagattttgctggaccctcatcggctggcagaaaggccggagctccaagatgcagtcgcaaggctgcaggtacaaagcaaacatctactctcaagcaggaggacgcatctaagagaaaggccgagttagaggcggcggtgcgaaaaaaaatcgaattcgaaagaaaagccctgcatatcgtggaacaactgctcgaagagaatatcacggaagagttcctaatggagtgtggacgcttcataacccctgctcactattcagacgtcgtggatgaaagatccatcgtcaagctctgtggttatccactttgtcaaaaaaaactgggaattgtaccaaaacaaaagtataaaatcagcacgaaaacgaacaaggtgtacgacatcacagaaagaaagagtttctgttctaacttctgctatcaggccagcaaattcttcgaggcccagattcccaaaaccccagtgtgggtacgggaagaggaacgtcatcccgattttcagctcctcaaggaagagcagtcaggacactccggggaagaagtccaactgtgttcaaaagcaattaaaactagtgacatagacaatccttcccacttcgagaaacagtatgaaagcagcagtagcagcacacattcagacagcagcagcgataatgaacaggattttgtgtcttccatcctcccgggaaacagacctaactccaccaatataaggccacagctgcaccagaagtccatcatgaagaagaaggctggacataaggctaacagcaaacacaaagacaaggagcagactgttgtagacgtcacggagcaattgggagattgcaagctggacagtcaagagaaggacgctacgtgcgaattgcccctccaaaaagtaaatactcagtcttcttcaaacagcaccctgcccgaaaggctgaaagcctcagagaactcggagtccgagtattctcggtctgagattacactggtaggcattagcaagaaaagtgctgaacactttaagaggaaattcgccaaatccaatcaggtgagtaggagcgtatcctcttccgttcaggtctgccccgaggtaggcaagcggaacctcctaaaggttttgaaggagacgctgatagaatggaaaactgaagaaacattgcggttcctctatggacaaaactatgcaagtgtgtgcctgaagcctgaagcctccctggtaaaagaagaacttgacgaggatgatatcatttccgatccagactctcactttccagcctggcgagaatctcagaactctctggacgagagcctgcccttccgcgggtccgggacagctataaaaccactgcccagttatgaaaatctgaaaaaggagaccgagaagctaaacctgcggatccgggagttttacagagggcgctacgtactaggagaagagactactaagtcacaggattctgaggagcatgatagcacttttccactcattgatagtagcagccagaatcaaatcagaaagcgcatagtgcttgagaaactttcgaaagtgctacccggactgcttgtgccattgcagatcaccctgggtgatatatacacacaactgaagaatttggtacggacattccgactgacgaataggaacataattcacaaacctgccgaatggacactcatcgcgatggtccttttgtccttcctgctgaacgtgaagacacggattaagacattcatgatgatttacttccacctgatgaactcttag

SEQ ID NO: 133253 - DNA, 1998 bp, Artificial Sequence
  Description of Artificial Sequence: Synthetic coding sequence
atgactagtgcgaataaagctatagagctccagcttcaggtcaaacagaacgccgaagagctgcaggacttcatgcgcgacctagagaactgggaaaaggacattaaacaaaaggatatggagctcaggaggcagaacggcgtcccagaagagaatctccctcccatacggaacggcaattttaggaaaaaaaaaaagggaaaggcaaaggagtcttccaaaaaaaccagagaggagaataccaaaaaccggatcaaatcatatgactatgaagcttgggcaaaactagatgtagaccggatcctcgatgagctagataaggatgacagtacccacgagtctctgtcacaagaatctgaatcagaggaagatggaattcacgtggatagccagaaggccctggtgttgaaggagaagggaaataaatactttaaacaggggaagtatgatgaggccatcgattgctacaccaaagggatggacgccgacccatataatccggttttgcccacgaatagagcaagcgcatatttcaggctcaagaagtttgcagttgctgagtcggattgcaatctggcagtagcactgaaccggtcttacaccaaagcatactctcggcgtggggctgcacgcttcgctctccagaagcttgaagaggccaagaaagattatgaaagggttttggagcttgagcccaacaatttcgaggctactaacgagctgcgcaagatatctcaggcactcgccagcaaagagaactcttatccaaaggaggccgacatcgtcatcaagtctactgagggagaaaggaagcagattgaggctcaacagaataaacagcaagcgattagcgaaaaggaccgaggcaacggtttttttaaggagggaaaatatgaaagagcaattgagtgttatacacggggtatcgctgctgatggggccaatgctctgttacccgcaaaccgtgcaatggcttacttgaaaattcagaagtacgaagaggcagagaaagattgtactcaggcgatcctcctcgatggctcttatagtaaagcatttgctcgtaggggcacggccagaaccttcctgggaaaactgaatgaggccaaacaagatttcgagacagtgctgctgcttgaacctggcaataagcaggcagtgaccgagctctcaaaaatcaaaaaagaacttatcgagaaaggacactgggatgacgtattcctggacagcacccagaggcagaacgttgtcaagcctatcgacaaccccccccatcccggcagtactaagcccttaaagaaagtgattatagaggagacaggcaatctgatccagaccatcgacgtaccagactccaccacggccgccgcccccgagaataaccccattaacctggcgaacgtgatcgcagccaccggcaccacaagcaagaaaaatagttctcaggatgacttgttcccaacaagcgacacgcctcgggccaaggtcctaaaaattgaagaggtgtccgacactagctcgctgcagccccaggcgagcctgaagcaggatgtttgtcagagctattctgagaaaatgccaattgagattgagcagaaacccgcacagtttgcaaccacagtcctgccacccattccagcaaactctttccaattggaatccgatttccggcagctgaaaagctccccagacatgctgtatcagtatcttaagcagattgagccatcactgtatcctaagttgttccaaaaaaatcttgatcctgatgtgtttaaccaaatcgttaaaattctccacgacttttatattgagaaggagaagcctcttctgatcttcgaaatcttgcagcgcctgtcagagttaaaacgatttgatatggcagtaatgttcatgtcggagactgagaagaagatcgcacgggcactgtttaaccacattgacaaatcgggtctgaaggacagctctgtggaggagctcaaaaagcgttatggcggctag

SEQ ID NO: 133254 - DNA, 1896 bp, Artificial Sequence
  Description of Artificial Sequence: Synthetic coding sequence
atgacttcagctaataaggccatagaactgcaacttcaggtaaagcagaacgctgaagagctgcaggattttatgagggacctggagaactgggagaaagatataaagcagaaagatatggagttaaggcgccagaatggagtacccgaggagaacctccctccgattcggaacggcaatttcaggaagaagaagaagggtaaagccaaagaaagtagcaaaaagacacgtgaggagaataccaaaaatcgtattaagtcttacgattatgaggcttgggcaaaactcgatgtggatcgcattctggatgaacttgacaaagacgacagcacccatgaatccctgagccaggaaagcgagagcgaagaagacgggatccacgttgattcacagaaagccctagttctgaaagaaaaaggtaacaaatattttaaacagggcaagtatgacgaggctatcgactgctatacaaaagggatggacgccgatccttacaaccccgttctgccaacaaatcgggcctccgcgtatttcaggttaaagaaatttgctgtcgcagagagtgactgtaacctcgcggttgctttgaatcgcagttacaccaaggcgtatagtcgcaggggggcagctcgtttcgccctccagaagctcgaggaggcaaaaaaagactacgagcgggtgctggagctcgaacccaacaattttgaggctaccaacgaactgcggaagatcagccaggcgctagctagcaaggagaactcatatcctaaagaggccgatatagtgatcaaatctactgaaggcgaacggaaacagattgaggcccagcagaacaagcagcaggccatcagtgaaaaagaccggggcaatggattttttaaggaggggaaatatgagagagcaatcgaatgctataccagaggcatcgctgcagatggcgcaaatgcattgttacccgctaaccgcgcgatggcctatctcaagatccagaagtatgaggaggccgagaaggattgcactcaagcgatccttctggacgggtcctactctaaggctttcgcccggagaggcaccgcccgcactttcctcggcaagctgaacgaagccaagcaagattttgagaccgtccttcttctggaacccggtaacaagcaggccgtgacggaactgagcaagatcaagaagaaacccctcaaaaaggtaatcatagaagagacagggaacctgatccagaccattgacgtgcccgatagtactaccgccgcggcccctgaaaacaaccctataaacctggccaacgtgatcgcagcgacaggtactacaagtaagaaaaactcctctcaggacgacctgttccccacgtccgacacccctagggccaaggttttaaagattgaggaagtgagcgacaccagtagtctgcaacctcaagcgagcctcaagcaagacgtgtgccaatcctacagcgagaagatgcctattgagatcgagcagaaaccagctcagttcgctacaaccgttctgccccccatccccgcaaattcttttcagctcgaatctgactttcgccaattaaagagtagccctgatatgctgtatcagtacctcaaacagatcgagccatcgttgtaccctaaactgttccaaaagaatctggaccctgacgttttcaaccagattgtgaaaattctgcatgacttctacatcgagaaagaaaaacccctcctgatctttgagattttacagagattatcagagttaaagaggtttgacatggccgtgatgttcatgtcagaaacagagaagaagatcgcgcgtgcactttttaatcatatcgacaagtccggtctcaaagattcgagcgtggaggaactgaaaaagaggtatgggggttag

SEQ ID NO: 133255 - DNA, 1521 bp, Artificial Sequence
  Description of Artificial Sequence: Synthetic coding sequence
atggacgcagacccttacaatcctgtgctccccaccaatcgggcctccgcttactttcgtctgaaaaagttcgcggttgccgagagcgattgtaacctggctgtagccctgaaccggtcctacaccaaggcatacagcaggcggggggcagcgcggttcgcacttcagaaactggaggaggctaaaaaggattacgaaagggtgcttgagcttgagcctaataactttgaggctaccaatgagctcaggaagatctctcaggccttagccagcaaggaaaacagttatccaaaagaagccgacattgtgattaagtccactgagggggagaggaagcagattgaagcgcagcagaataagcagcaagccattagcgagaaggatcgagggaatggcttttttaaagagggaaagtacgaacgggccatagagtgttatactcgagggatagctgccgacggcgccaacgccctgctgccagccaaccgggccatggcatacttaaagatccaaaaatatgaagaagctgaaaaagactgcactcaagcaatccttttggacggtagctattctaaggctttcgccagacgcgggaccgctaggaccttcctcgggaagttgaatgaagcaaaacaagacttcgagaccgtgttactactcgagccaggtaacaaacaagccgtcactgagctctcaaaaattaagaaagagctcattgaaaagggtcattgggacgatgtgttcctggactccacgcagcggcagaacgtcgtcaaacctatagacaaccccccacacccagggagcacaaagcctttgaagaaggtcattatcgaggagacaggaaatttaatccaaacaatagatgtacccgactcgactacagccgcggcgccagaaaataatccaattaatttggcaaatgtaatcgctgctacaggaacaacctcaaaaaagaactcttctcaggatgatctgtttcctacctcagacaccccccgagcaaaagtgttgaagatcgaagaggtttccgacacctctagtctgcagccacaagcgagcctcaagcaagacgtttgtcagtcatattctgaaaagatgcctatcgaaattgagcaaaaaccagcccagtttgctacgactgtgttaccgcccataccggcaaacagctttcagctagagagtgatttccggcaattaaaaagtagcccagatatgctctaccaatatctgaagcagatcgaaccaagcttgtatccaaagctgttccaaaagaatctagatccggacgttttcaaccagatcgtgaagatcctgcatgatttctacatcgagaaagaaaaacctctacttattttcgagatcctgcagagactttctgagctaaaaagatttgatatggccgtgatgttcatgtcagaaacagagaaaaaaattgctagggccctcttcaatcacattgacaagtccggactgaaagactcgagcgtggaggagttgaaaaaacggtatggggggtag

SEQ ID NO: 133256 - DNA, 4821 bp, Artificial Sequence
  Description of Artificial Sequence: Synthetic coding sequence
atgatcgccgagccagcccatttttatctttttggtctgatctgtctctgttcaggctctcgtctccggcaggaggacttccccccacgaatcgtggagcatcccagtgaccttatcgtatcgaaaggtgagcccgctacactcaattgtaaggcagaaggaaggccaacgccaaccatcgagtggtataagggtggggagagagttgagactgataaggatgatccaagaagccaccggatgctgctcccatctggttcactgttttttcttaggattgttcacggtcgaaaatctaggcccgatgaaggagtgtatgtgtgtgttgcacgcaactacctcggagaggccgtaagtcataatgcatctcttgaggttgccatcctccgagacgactttaggcagaatccctcagacgttatggtggctgttggcgagcctgccgtgatggaatgccagccccctcgggggcaccctgagcctaccatttcttggaaaaaggacggaagcccactcgatgacaaggatgagcgaataaccattaggggcggcaagctcatgataacctacacgcggaagagtgacgccggaaaatacgtgtgtgtcgggaccaacatggttggcgaacgcgagagcgaggtggcggaactcaccgtcctggagagaccttcattcgtcaaacgcccgagcaacctggcagtaacagtggacgactcagcggaatttaaatgtgaagccagaggagaccctgttccaactgtaaggtggcgaaaagacgatggggaactccctaaaagtcggtacgaaatcagagacgatcatactcttaagatccgtaaggttaccgccggggacatgggctcctacacttgcgtggccgagaatatggttggcaaagctgaagcgagcgctacacttacagttcaggcgccatccgagccaccgcactttgtcgtaaaaccaagggatcaggtagtggccctggggagaacagtgacattccagtgcgaggccacagggaacccacaaccagctatattctggaggagggagggctcgcaaaacctcctcttctcctaccaaccccctcagtcctcctcccggttctccgtttcacagaccggagatctgacgatcaccaacgttcaacgctctgacgttggatactacatctgccagactctgaatgtggctggttccatcatcaccaaggcctacttagaggttacggatgtcatagccgaccgccccccaccagtgatacggcagggaccagtaaaccaaaccgttgcagttgatgggaccttcgtgctgtcgtgtgtggccacggggagccctgtccctacaatactctggcggaaggacggcgtcctcgtctccacacaggattccagaataaaacagctcgagaacggggtgctgcagataagatacgccaaattgggcgacactggtcggtacacatgcatcgcctccacaccctctggcgaggcgacttggtctgcatatatcgaggtgcaagaatttggagtgcccgtacaaccaccacgcccaactgaccctaacttgataccatccgccccctctaaacccgaggtgaccgacgtgtcccgcaacactgtgactttatcctggcagcctaacctgaactcaggcgcgacccccacatcctacatcatcgaggcattcagccatgcatccggctcctcctggcaaactgtagccgagaacgttaagacagaaacctcagcaatcaagggactgaaacccaatgccatttatctatttttagtccgcgctgcaaatgcctatggcatcagtgatccatctcagattagcgatcccgttaagacccaggacgtcctgccgacatctcaaggggttgaccacaagcaggtgcagcgtgagcttggcaacgcagtgttgcacctccacaaccctaccgttttgtcatcttcttccattgaggttcactggactgtagaccagcaatctcagtacattcagggctacaagatcctgtatcgaccatccggtgccaatcacggagaatctgactggttggtgtttgaagttcgaaccccggccaaaaattcggtcgtgatccctgacttaagaaagggcgtgaattacgagatcaaagctcggccattcttcaacgagtttcagggagccgactctgaaattaaattcgcgaagacattggaagaggccccttctgcccctccccagggcgtgacagtaagtaagaatgatgggaacggtacagcgattcttgtgtcctggcaaccacctcccgaggatacccaaaatgggatggttcaggagtacaaggtgtggtgcctgggaaatgagactagatatcacatcaacaaaaccgtagatggttcaaccttctcagttgtgatcccgttcctggtgccagggatacgctactctgtagaggtcgccgcttcaactggcgcgggaagcggagtgaaatcagaacctcagtttattcagttggacgcccacggcaaccctgtctctcccgaggaccaggtgtcactggcacagcaaattagcgatgtggtgaaacagccagcatttattgcagggattggtgccgcttgttggattatacttatggtgttctccatttggttgtacagacatcggaagaaaaggaatggactaacgtccacttacgctgggattaggaaagtaacatatcagagaggaggcgaagctgtgtcctcaggaggccgccccggccttttgaatattagcgaaccagccgcgcagccctggcttgcggatacatggcccaacaccgggaacaaccacaacgattgcagcatttcatgctgcacagctggcaacggaaactccgacagcaaccttaccacatatagcaggccggctgattgcatcgctaactataacaatcagttagacaataaacaaaccaacctaatgttgccagagtccactgtgtatggcgacgtggatctgagtaacaaaattaacgaaatgaagacctttaactccccaaacttaaaagacggcagattcgtgaatcctagcgggcagccaactccatatgccaccacacaactgatccagagtaatctaagcaataacatgaataacggctccggagactccggagaaaaacattggaaaccattgggccagcagaaacaggaagtggctcctgtccagtacaacatcgtggagcagaataagctgaacaaggattatcgagctaacgatacagtcccacctactattccttacaatcaaagctacgaccagaatactggcgggtcctacaatagtagcgacagaggctcttctaccagtggtagccagggccacaagaaaggagccagaacgcctaaagtgcccaagcagggcggcatgaactgggccgacctcctcccgccaccccccgctcacccaccgcctcactcgaacagcgaagagtacaacatcagcgtggacgagagctatgatcaggaaatgccttgtcctgtgccgccggctagaatgtatctccagcaggatgaactggaggaggaggaggatgaacggggcccaacaccccctgtccgcggagcggcaagctccccagccgctgtgtcctactctcatcagtcaactgcgactctgactccttcacctcaagaagagcttcaacccatgctccaggattgtcctgaggaaactggccacatgcagcatcaacccgatcgtcgcagacagccagtaagtcccccgcctcctcctagaccaataagcccacctcatacctacgggtacataagcgggcctttagtgtccgatatggataccgacgcccctgaggaagaagaagatgaagctgatatggaggttgccaagatgcagactagacgtctcttgctcaggggattggagcagacacccgctagtagtgttggcgatctagaatctagtgtcactggcagcatgattaatgggtggggatcggcaagtgaagaagataatatatcgtccggtcgttctagcgtctcttccagtgatggctcctttttcactgacgccgacttcgcacaagcggtggccgctgccgcggagtatgcggggctcaaggtggccaggcgtcagatgcaagatgctgcgggccgccggcatttccatgcctctcaatgcccccggccaacttcacctgttagcacagactccaatatgtctgcggctgtgatgcaaaagacgcggcctgccaagaagctcaagcaccagccaggccacctcagaagggagacctacactgatgacctgccaccccctcctgtgcctccaccggccatcaagagccccaccgcacaatctaagacacaattagaagtccggcctgtcgtggtgcctaaactgcctagcatggacgcaaggactgacaggagttcagatagaaagggtagcagctataaaggacgggaggtgctggacggcaggcaagtggtagacatgaggaccaatcctggtgacccacgcgaagcccaggaacagcagaacgatgggaaagggcgtggcaacaaggccgcaaaaagggatcttccgccggctaaaactcatctaattcaggaggacatattgccctactgtcgccctacctttccaacatccaacaacccacgcgatccgtcctcgtcatcaagtatgagctcccgcgggtctgggtcacgccagcgggagcaagctaacgtcgggcggagaaacattgcggaaatgcaggtgctagggggctatgaacggggagaggataacaacgaagagctggaagagacagaaagttag

SEQ ID NO: 133257 - DNA, 4968 bp, Artificial Sequence
  Description of Artificial Sequence: Synthetic coding sequence
atgaagtggaaacacgtgccgttcttggtaatgatctccctgctaagtctgtccccaaatcacctttttctggcacagctaattcctgaccccgaggacgtagaacggggcaatgaccatggtacacctatacccacaagcgataacgatgacaactcacttggttatactggaagtcgcctccgccaggaagactttcctccacgcattgtagaacacccttcagacctgatcgtgagcaagggcgaaccagctacgttaaattgtaaagccgaggggaggcctaccccaacaatcgagtggtataaaggaggtgagagggtcgaaaccgacaaagacgacccacgttcacacaggatgctgctccccagcggatcactgttctttctgaggattgttcacggcagaaaatccagacctgacgagggggtctatgtgtgcgtggcccgaaactatttgggagaggcagtgagtcataatgcttcattagaagtagccatattacgcgatgattttcgccagaacccatccgacgtaatggtggccgtcggagagccagctgtaatggaatgccagccccctagggggcaccccgaacctactatttcctggaagaaggacggatcgcccctcgatgataaggatgaacggattaccatacgcgggggcaagctcatgataacctacacgcgcaagtcagacgcaggcaaatacgtctgcgtggggaccaacatggtgggggagcgagagtcagaagtggctgaactgaccgtgctcgagagaccctctttcgtgaaaaggccaagcaacctggccgtcaccgtggacgattcagctgaattcaaatgtgaggcacgcggagaccccgttccaaccgtccgatggcgaaaggacgacggcgagctgccgaagagcagatacgaaataagggacgaccataccctgaagatcaggaaagtaactgctggagatatgggatcctacacttgcgtagccgaaaacatggttgggaaagcggaagccagtgcaactcttaccgtgcaagagcctccccacttcgttgtgaagccacgagaccaggtggtggcgctcggcagaaccgtgacattccaatgcgaagccacagggaacccacaaccggccatcttctggagacgcgagggctctcagaatctcctattcagctaccaaccaccccaatccagcagtagattcagcgtgtcccagacaggcgacctgacaatcacgaatgtgcagaggtctgacgtgggatactacatctgccaaacattgaacgtggcaggttctatcattaccaaagcgtacctcgaagtgactgacgtgatagcagatcgccccccacccgtcatccgacagggtcctgtcaatcagacagtggccgtcgacggcacattcgtcttgtcctgtgtagccacaggcagcccagtgccgactatcctgtggaggaaggatggagtgttggttagcactcaggactccagaatcaagcagcttgaaaatggagttcttcagatacgctacgctaagttaggcgacactggcaggtacacatgcatcgcctcaacacctagcggtgaggccacctggagcgcttatattgaagtgcagggaaaggtgaacgaatttggtgtccccgtacagccaccgagacccaccgacccaaatctcatcccatccgcgccctccaagcccgaagtgacagacgtgtcccgcaacactgtaactctgtcatggcagcccaacctgaactcgggcgcaacgcccacttcctatattatcgaggccttcagtcacgcatctggctccagttggcagaccgtcgcagaaaacgtgaagacagagacctcagctatcaaggggctaaaaccaaatgcaatctacctgttcttagtgagggctgccaatgcctatgggatatctgatccatcgcagattagcgatccagtcaaaactcaggatgtgctgccaacctctcagggagtcgaccataagcaggtccagagggagttaggtaacgctgtcctccacttgcacaaccctacggtgctttccagctccagtatcgaagttcattggactgtggatcaacagagtcaatatatccagggatacaaaattctttacaggcctagcggcgctaatcatggagagtcggattggctggtctttgaggtcaggacccccgcgaaaaacagtgtggtcatccctgacttgcgcaagggagtcaactacgagatcaaagctaggcccttttttaacgaatttcaaggcgccgactcagagattaagttcgcaaaaactcttgaggaagccccctccgctccaccccagggagtgacagtaagtaagaatgatggcaacgggacagccatcctggtgtcttggcagccacctccagaggatactcaaaacggcatggtgcaggaatacaaagtctggtgcctcggcaacgaaactcgttaccacattaataaaacggtggatgggagtacattttcagttgtgatccccttccttgtccccggtattaggtattcggtggaagtggcggcatcaactggggcggggagcggcgtgaagagtgagccccaatttatccagctggatgcacatggcaaccccgtgtcgcctgaagaccaggtgtcactggcccagcagatctctgatgtggtgaaacagccagccttcattgcaggcatcggtgccgcttgctggatcatcttgatggtctttagtatctggctatacaggcaccggaagaagaggaatgggctgaccagcacttacgcagggatcaggaaggtgccatccttcacttttacacctactgtcacgtaccagagaggaggggaggcggtgtcatctggggggagaccgggccttctgaacattagtgaacccgccgcccagccctggctcgcagatacttggcccaacactgggaacaaccataacgattgttctatatcctgttgtactgccgggaacggaaattctgacagcaatctgacgacctattcaagacccgctgattgtatcgctaattacaataatcagctggataataagcagacgaatttgatgctgccggaatcgactgtttatggggacgttgacttgagtaacaaaatcaatgaaatgaaaactttcaactctccaaaccttaaagatggtagattcgttaacccctctggccagcccactccatatgccacgacccagctgatccaatcgaacttatccaataacatgaacaatggatctggagacagtggggagaaacactggaaaccgcttggccagcaaaagcaggaggtcgccccagtccaatataacatcgtagagcagaacaaactcaacaaagattacagggcaaatgacactgtgcctcctacaatcccctacaaccagtcctatgatcagaacactggtgggtcatacaactcctccgatcgcggatcatctacctcaggttcacagggacataaaaagggcgcacgaaccccaaaagtaccaaagcagggaggaatgaattgggccgatttgctgccccctccccccgctcaccctccgccacactcaaactcggaagaatacaacatttcagtggacgaaagttacgatcaagagatgccatgtcccgtgccacctgctcgaatgtatttgcagcaggacgagctcgaggaggaagaagacgaaagaggacccactcctcccgtgcgcggtgccgcctccagcccggcagctgtgtcttatagtcaccaatctaccgcgacactaactccctctcctcaggaggagctccagccaatgctccaggactgcccagaggagactggacatatgcaacatcagcccgacaggcggagacagcctgtctctcctccgccgccgccacgacccatcagtccaccccatacttatggctatatctctggccccctagtgtcggatatggatacagatgctccggaggaagaagaggatgaggctgatatggaagtggctaaaatgcaaacacggcggctgctgctcagagggttagagcaaactcccgcaagctctgtgggcgacctcgagagctctgtgaccgggtctatgatcaatgggtgggggagtgcgagtgaggaggataacatctctagcgggcggagttccgtgtcttcatccgatggctcattttttacagatgctgatttcgcacaggctgttgcagcagctgcggagtatgccggcttgaaggtcgcacgaagacaaatgcaagatgcagcagggcggagacacttccatgctagccagtgccccaggcccacctctcccgtctcaactgactccaacatgtctgccgccgtaatgcaaaagacacgacctgcgaaaaaactgaagcaccagccgggccacctccgcagggagacttacactgatgaccttccacctccacccgtgcctcctcctgccatcaagtcacctaccgcgcagagcaaaacgcaactggaagttcgaccggtggttgtgcctaaattacctagcatggatgctcggactgacagaagctccgaccgaaagggcagctcctacaaaggtagggaagtgcttgacggtagacaagtggttgatatgagaacaaaccccggggatcctcgagaggcccaggagcaacagaatgatgggaaaggcagggggaataaggcagctaagcgcgatctccccccagcaaaaacgcacctaattcaggaagacatactcccgtattgcagaccaactttccccacatcaaacaacccccgtgacccaagcagctctagctcaatgagcagtcgaggatctggtagcaggcaacgtgaacaagctaacgtcggccgaagaaatatagctgaaatgcaagtgctcggaggttacgaacggggagaggacaataatgaggaattggaagagccctcctcgtag

SEQ ID NO: 133258 - DNA, 4839 bp, Artificial Sequence
  Description of Artificial Sequence: Synthetic coding sequence
atgattgccgaacccgcgcacttttatctgtttggtctaatttgtttgtgtagcggctcccgactgagacaggaagactttccccctcggattgttgagcatccctcggatcttatagtctcaaagggcgagcccgctacacttaattgtaaagccgaaggacggcccacaccaaccattgagtggtacaagggcggggagagggtcgagaccgataaagatgaccctagatcccatcggatgcttcttccgagtggcagcctcttttttctgaggattgtgcatggtcgaaaatccagacccgacgagggggtgtatgtgtgtgtggcaaggaactatttgggtgaggcggttagccataacgctagcttggaagtggccattcttcgagacgactttagacagaaccctagtgatgtgatggtcgccgtgggagaaccagcagtgatggagtgccagccacctagaggtcaccctgaacctacaatctcatggaaaaaagatggaagcccacttgatgacaaggacgagcggatcaccatcagggggggaaagctgatgattacgtacactcgcaaatccgatgcaggcaaatacgtatgtgttggcacaaatatggttggcgagcgcgagagcgaggtcgcggagctgaccgtcctggagaggcctagttttgtcaaaagacccagcaatctcgcagtaacggtggatgacagcgctgaatttaaatgcgaagctcgtggtgacccagtccccaccgtgcgctggaggaaagatgatggcgaattgcccaagtctcgctacgagatcagggacgatcacaccctgaagattcgcaaggtgacggctggagacatggggtcctatacatgcgtcgccgagaacatggtagggaaggctgaggcgtcagccactctgacagtgcaagagcccccacactttgtcgtaaagccacgggaccaggttgtggcactgggtagaactgtgactttccaatgtgaggcaacgggcaacccacagcctgcgattttttggcgcagagaaggctcccagaacctgctgttcagctatcagcccccacagagttcttccagatttagcgtgtctcagactggcgacctcaccattaccaatgtccagaggagcgatgtagggtattacatctgtcagacactcaatgtggcaggctctatcattacaaaagcttatctggaggttaccgatgtgatcgcagaccgccccccacctgtgattagacagggacctgttaaccagaccgttgccgtggacgggacttttgtgctgtcctgtgtggccaccggatcccccgtaccaacaatcctgtggaggaaagatggggtcctggtgtcgacgcaggatagccgcattaagcagttggagaatggggtgttgcagattcgttatgcaaaacttggagatacaggtagatacacctgtattgccagcacaccaagtggcgaggcaacatggtctgcctacatcgaggtgcaggaatttggcgtgcccgtgcagccaccaaggcccactgatccaaatctgataccgtcagcaccctccaagcccgaggtgacagatgtttctcgtaacaccgtgacactctcctggcagcccaatttaaattccggagcgacacctacctcttacataatcgaagccttctcccacgctagcggttccagctggcagacagtggctgagaacgtcaagaccgagacttctgctatcaagggcttgaagcctaacgccatctatctgtttctggtcagagctgcaaacgcttacgggatcagtgacccttcccagatcagtgacccagtgaaaacccaggacgtgcttcccacgtcccagggagtggatcataagcaggtgcagcgagagctcggcaatgccgtgttacatctgcacaacccgaccgttctgtcatcctcatccatagaggtgcactggaccgtggaccagcaatcacagtatatccagggatataaaatcctgtatagaccctcaggtgccaaccacggggaaagtgattggctcgtatttgaagtacggacacctgcgaaaaacagcgtcgtgatccctgatctgaggaaaggggtaaactacgagattaaggctcgcccattcttcaacgaattccaaggagccgattcagagatcaaattcgccaagacactggaagaggctcctagcgcacccccccagggcgtgactgtttcaaaaaacgatggaaatggcacagcgatcttggttagctggcagcctcctcccgaggacacacagaacgggatggtgcaggagtataaggtctggtgtctgggcaacgaaaccagataccacattaataagactgtggatggtagcacattttcagtggtgattcctttcctggtgcctggtataaggtactccgttgaagtggccgcatcgactggcgcaggttcaggagttaagagcgaaccacaattcatccagctggatgcacacgggaatcccgtgtcccctgaggaccaggttagcctcgcacagcagatatcagacgttgtcaagcagcccgcctttattgcaggaataggagccgcatgctggattatcctcatggtattttcgatttggttgtacaggcaccgaaaaaaacgcaacggcctcaccagtacatatgccgggattaggaaggtgccttccttcacttttactcctaccgttacctatcagagaggcggtgaggccgtctctagcggggggcgacctggccttcttaacatcagcgagcctgctgcacagccttggctggccgacacttggcccaatacaggcaataaccacaacgactgcagcatctcatgttgtaccgcaggcaacggaaactcagatagcaacctgactacatacagcaggcccgctgactgcattgcaaattataataaccaactggataacaagcagaccaacctcatgctgcccgagtccactgtttatggcgacgtggatctctctaataagataaacgaaatgaaaacatttaatagtcccaacctgaaagacgggcgttttgtcaaccccagcggccaaccgaccccttatgcgaccactcaactcatccagtctaatctgagcaacaacatgaataacggatctggagatagtggagaaaagcactggaaaccactgggacagcagaaacaggaagtggctcctgtacagtacaatatcgttgagcaaaataagttaaataaggattacagagccaatgatacagtcccaccaacaatcccctacaatcagtcgtacgaccagaatactggcggatcgtataatagtagcgaccgcggctctagcaccagcggatcgcagggacacaagaagggcgcccggacaccgaaagtgcccaagcaaggcggaatgaactgggcggacctcctccctccaccaccagctcacccgccacctcactctaattccgaggaatacaatattagtgttgacgaatcgtacgaccaggagatgccatgccctgtgccccctgcgcgcatgtacctacagcaagatgagctcgaggaggaagaggatgaacgcggcccaacgcctccagttcggggagccgcaagctcgccagccgccgtatcctattcacatcagagcactgccacccttacgccgtccccacaagaggaactgcagcccatgctccaggactgcccggaagagaccggacatatgcagcatcagcccgacagaaggcgccagcccgttagcccccctccacccccacgacccatttcgcctccccatacctatggttacatcagcgggccccttgtgagcgatatggatactgatgccccagaagaggaggaggacgaggctgacatggaggtagccaaaatgcagacacggcgactgctgctgagaggcttagagcaaactcccgcttcatctgttggtgacctggaatccagtgtgacaggttccatgataaacggctgggggtccgccagcgaggaagataatatctcatcgggacggagctcagtaagtagttccgacggctcttttttcaccgatgctgacttcgcccaagccgtcgctgcggccgcggagtatgccggtttaaaggtggcacggaggcagatgcaggacgctgcaggcagacgccactttcacgcgagtcaatgtccgcgtcctacctctccagtgagcacggactccaacatgtctgctgcagtcatgcagaagacgcgaccagcaaaaaagctcaaacaccagccgggccatctccgtcgggagacatatacggacgaccttccgcctcctcccgttccgccccccgcaatcaagtcgcccaccgcacagagcaagacccagttggaggtccgacccgttgtggtgccaaagctccctagcatggatgcgcgcaccgatcgcagctccgatcggaagggttcttcatataaagggagggaagtgctggatgggaggcaggtggttgacatgcggactaaccctggagatcccagagaagctcaggaacagcagaacgacggtaagggccgggggaacaaagccgcgaagagggaccttcctcccgcaaaaacccatttaatccaagaggatatcctgccttattgtagaccaacctttccaaccagtaacaacccccgggaccctagctcctcgtcctccatgagctcccggggttccggatctcgccagagggaacaagccaacgttgggcgcagaaatattgccgagatgcaggtcctcggcggatatgaacgtggtgaggataataatgaagagctggaagagacggagtcgtag

SEQ ID NO: 133259 - DNA, 4956 bp, Artificial Sequence
  Description of Artificial Sequence: Synthetic coding sequence
atgaaatggaagcacgtgcctttcctcgtgatgatctcacttctgagcctatcacccaaccatctcttcttagcacagctaattcccgatcctgaggacgttgagagaggaaatgatcacggtacgcctataccaacctcagataatgacgacaattccctgggctacaccggaagtcgcttgagacaggaagacttccctccaaggatcgttgagcacccgtccgatttgattgtttccaagggagagcccgcgaccttgaattgcaaggctgagggccgcccgacccccactatcgagtggtacaagggtggggagcgcgtggagacagataaggacgatccaaggagccataggatgctgttgccatccgggtccctgtttttcctgagaatcgtccatgggcgcaagtcacggccggatgagggcgtatacgtgtgtgttgcacggaattatctgggcgaggcagtgagtcacaatgcctctcttgaagttgccatcttgagggacgatttccgacagaatccttctgatgttatggtggccgttggagagccggcagtcatggagtgccagccacctcgcggacaccccgagccaacgatctcatggaagaaagacggcagcccgctggatgataaggatgagagaattacaattcgggggggcaagttgatgatcacatacacccggaagtcagacgccggaaagtacgtttgcgttgggaccaatatggtcggggagcgagagagtgaggtcgctgagttgacagtgcttgagaggccgagtttcgtcaagcgcccaagcaatctggcagttaccgttgatgactctgctgaatttaagtgcgaggcacggggggacccggtcccaactgtgcggtggcgaaaagatgatggagaacttcccaagtctcgctacgaaatccgagatgatcatacccttaaaatccggaaagtgaccgctggtgacatggggtcatacacgtgtgtggctgagaatatggtgggtaaagcagaagcaagtgcaaccctgactgtacaagaaccaccacacttcgtagttaagccgcgcgaccaggttgtggccctgggacggaccgtgacttttcaatgcgaggccaccggaaaccctcagcccgccattttctggcgcagggagggcagccagaatcttctgttctcttaccagcctcctcaatcttcttcaaggttctcggtgtcccagacgggggatctaaccatcaccaacgtgcagagaagtgacgttggctactatatatgccaaacactcaacgttgccggcagcataataactaaggcctacctggaggtgaccgacgttattgcggaccgcccgcctcccgtgattcgacagggcccagtgaaccaaactgtagccgtggacgggaccttcgtgctaagctgtgtcgcaaccgggagtccggtaccaaccattctgtggcgaaaagacggtgtgctcgtgtctacccaggactccagaatcaagcagctcgaaaatggcgtactgcagatccggtacgcaaaattaggcgatacaggtaggtatacatgcatagcgagcacaccaagtggggaggccacatggtccgcctatattgaagtccaagagttcggggtccctgtgcagccgccaaggcccaccgaccccaatttaataccttccgccccaagtaagccggaggttacggacgtgtctagaaataccgtgactctatcctggcagcccaacttgaattcaggcgctacgccaacttcgtacatcatcgaagcattctcacatgcttctggaagctcttggcaaaccgttgcagaaaacgtgaaaactgagactagtgccatcaaaggcctgaagccaaacgctatctacttgttcttagtccgagccgcaaacgcctacggtatttccgacccctcccagatttccgaccctgtgaaaactcaggatgttctaccaacatcccagggggtagatcataaacaagtgcagagggaattaggaaacgctgtgcttcacctgcataaccccacagtgctgagtagctcttccatcgaggtgcactggactgttgaccagcagagccagtacattcagggctacaaaattctgtatagaccttcgggcgccaaccacggggagagtgactggctggtatttgaggtgcgcactcccgctaagaacagcgtcgtgataccagacctgcggaaaggagttaattatgagattaaggcgcggccttttttcaacgaatttcagggcgccgatagtgagatcaagtttgccaaaacattagaggaggcaccctcggccccacctcagggcgtcaccgtgtccaagaacgatggcaatggcacagctatccttgtgagctggcagcctccgcccgaggacacacagaacggaatggtgcaggagtacaaagtgtggtgtcttgggaacgaaaccagataccacattaataagacagtagacgggtccacattttccgtggtgatccctttccttgtgccaggcattagatacagtgtggaggttgctgcatcaactggagccggctccggtgtgaaatccgaaccgcagttcatccagctggatgcgcatgggaaccctgtgtcccctgaggaccaggtctccttggcccagcagatttcagatgtcgtgaagcaaccagcctttattgccgggattggtgccgcttgctggatcattcttatggtatttagtatctggctgtatcgtcatcggaagaaacgcaacggtctgacatctacgtatgccggtattaggaaagttccctcgttcactttcactccaaccgtgacctaccagagaggaggagaggcggttagcagtggtgggcgtcccggccttctgaacattagtgagcccgccgctcagccatggctcgctgatacatggccaaatacaggaaacaatcacaatgactgttcaatctcttgttgcacagctgggaatggtaacagtgattcaaacctgacaacctattctaggccggccgattgcatagcaaattacaataatcagttggataataaacaaactaacctgatgctccctgaatcaacggtctacggcgatgtggatttgtctaacaagattaatgaaatgaagacgtttaacagcccaaatctgaaggacgggaggtttgtgaatccgtcagggcagccaacaccctatgcaactacacaacttatacagagtaatttgtcgaacaatatgaataatgggagcggcgactccggcgagaaacactggaaaccactgggccagcagaagcaggaagtcgcccctgtccagtacaacattgttgagcagaataagctgaacaaagattatagagcgaatgacactgtccctcccactataccatataaccagagctatgatcaaaataccggcggctcatacaactcttcagatagagggtcatctacgtctggatcccagggacataagaagggtgctcgcacgcctaaagttcccaagcagggtgggatgaattgggccgatcttttaccaccacctccggcacacccccccccccattccaacagcgaggaatataacatcagcgttgatgagtcttacgaccaggagatgccatgccctgtgcccccagctaggatgtacttacaacaagacgaattggaagaggaggaggatgagcggggaccaacccccccagtgcgtggggccgcttcctccccggccgccgtcagctattcccatcaaagcaccgccaccctgactccaagtccgcaggaagagctgcagccaatgctgcaggactgcccagaagaaacagggcatatgcaacaccagccggaccgcagacgccagcccgtgtccccacctccccctccacggccaatctctcctccccacacctacggatacatatccggacctctcgtttccgatatggacaccgacgcccccgaagaagaagaggatgaggctgatatggaagtggccaagatgcagacacgacggttgttactgcgtggtctcgagcaaacccccgcttctagcgtgggagacttagagtcctccgtgacaggctccatgatcaatgggtggggctctgcttccgaggaggataatattagttccggccgctcttccgtgtcaagctccgatggaagcttttttactgatgcggattttgcgcaggctgttgctgccgcggccgaatatgccggccttaaggtggccagaaggcagatgcaggatgctgcaggcagacggcatttccatgccagccagtgtccacggcctacaagccccgtttccactgattcgaacatgtctgctgccgttatgcagaaaaccaggcccgccaagaagttgaagcatcagcctgggcacctgaggagggaaacctacaccgacgatctgcctcccccacccgtaccaccgcccgccataaaaagccccaccgcccaaagcaaaacacaacttgaggtgaggcccgttgtagtgcctaagctgccctctatggatgccaggacggaccgctcttcagaccgcaaaggttcctcttataagggtcgggaagttctcgatgggcggcaggtggtggacatgcggactaaccccggtgaccctagagaagcccaagagcagcaaaatgacgggaagggccgcggaaataaggccgccaaacgggatctccctccagctaaaactcatctgattcaggaggacattctcccctattgccgccctacatttcctaccagcaacaatccgcgcgacccctcaagcagcagcagtatgagttcgcggggcagtggaagccggcagagagagcaggctaatgttgggcgtcgtaatattgctgaaatgcaggtcctaggcggctatgagcggggcgaggacaataacgaggaactggaagaaaccgagtcctag

SEQ ID NO: 133260 - DNA, 4656 bp, Artificial Sequence
  Description of Artificial Sequence: Synthetic coding sequence
atgattgccgaaccggctcacttctatttgttcggtctgatctgtttgtgttcagggtccaggctgcggcaggaggactttcctccgcgcatcgtggagcatccatccgacctaatagtaagcaagggggaaccggccaccctcaattgcaaggcagaaggcagacccactccaacaatcgagtggtacaaagggggagaaagggtggagacggataaggacgatcctagatctcatagaatgctgctgccatcagggtcccttttcttcctgcgtatcgtacatggtagaaagtctcggcccgatgaaggcgtatacgtgtgtgtggcccgaaactacctcggcgaggcagtctcccacaatgcctctttggaggttgctatcttacgtgacgattttcggcaaaacccgagcgatgttatggtggccgtaggggagccagccgtgatggagtgccagccacctcggggacatcctgagccaacaattagctggaagaaggacggctcccctctggatgacaaagacgagaggatcacaataagaggggggaagctcatgattacctacacaagaaagagcgacgccgggaaatatgtgtgtgtcgggacaaatatggtgggggaaagggaatctgaggttgcagaactgacagttcttgaacgtccatccttcgtcaagcggcccagcaatctcgcggtgacggtggatgactctgccgaattcaaatgcgaggcaaggggtgatccagtgcctacagtgaggtggaggaaggatgatggcgagcttccaaagagccgctatgagattcgtgatgatcacaccctgaaaattcggaaagttacagctggagatatgggaagctacacttgtgttgctgaaaacatggtgggaaaggcagaagcctccgcaacgctgaccgtgcaggttggctcagaacccccacattttgttgtcaagccccgggaccaggtggtggcacttggaaggaccgtgaccttccagtgtgaggcgaccggcaatcctcagcccgcaatcttctggagaagggaaggttctcagaatctccttttctcttatcagcctcctcaaagttcttctagattctctgtctcacagacgggagacctcaccattactaatgtccaaagaagtgacgtaggctactatatttgccagaccctaaatgttgccggcagcatcattacgaaggcttacctggaagttactgacgtgattgctgacagacctcctcctgtgattaggcagggaccggtcaaccagacggtcgccgtggacggtacttttgttctgtcttgcgtcgccactggaagtccagtccccaccattctgtggcgaaaggacggcgttttagtgtcaacacaggattcgcggatcaagcagctggaaaatggcgtgctacagatccgatatgcgaaattgggagataccggccgatatacatgtatcgcttcaacaccatctggagaagcgacctggagcgcctacatagaagttcaggaattcggagtgcccgtccagccaccacggcccacggatccgaacctgatcccttcggcccctagcaagcctgaagtgaccgatgtgagccggaatactgttaccctatcctggcagcccaacttgaacagtggcgcgacacccacatcgtacatcattgaagcgttctcccacgcatcaggatcctcatggcagacagttgctgaaaatgtgaaaacagagactagcgcgataaaagggcttaagccaaacgccatctacctgtttctcgttcgagctgctaatgcctacggcatttcggacccttcccagattagcgaccctgtcaagactcaggacgtgctgcctacctcccagggtgtggatcacaagcaggtccagcgtgagttgggtaacgccgttctgcatttacacaatccgacagtcctgagttcctcatccattgaagttcattggaccgtggaccagcagtctcagtatatccagggctataagattctctaccggccctcaggcgccaatcacggagagagcgactggcttgtctttgaagtgcgcactcccgctaagaattccgttgtgatccccgatcttcgcaagggtgtaaattacgagatcaaagcacgaccgttcttcaacgagtttcagggagctgatagcgagatcaagtttgccaaaaccctggaagaagctcctagtgctccgccacagggtgtcacagttagcaagaatgacggtaacggaacagctattctagtgtcttggcaacccccacccgaagatacccaaaacggaatggtccaggagtacaaggtatggtgtctcggcaatgagacccgatatcatattaacaaaacagtagacggctccacctttagcgtggtgattccatttctggtccccgggatcagatacagcgtggaggtggcggcaagcactggtgccgggtcaggtgtcaaaagtgagcctcagttcatccagctggatgctcacgggaatccagtgtctccagaggatcaggtgagcctggcccaacagatctccgacgtggtaaaacagcccgcattcatagctggaattggagcggcttgctggattattctgatggtgttttccatctggctgtaccggcatcgaaagaaaagaaatgggttgaccagcacgtacgcaggaatacggaaagtgacctatcaacgcggcggagaggcagttagttccggaggacggccagggctgcttaacatttccgaaccagcagctcagccttggctggcagacacatggcctaataccgggaacaaccataatgattgctccattagctgttgcacggccggtaatggaaattctgactcaaacttgaccacctattctcggcctggccagcccaccccttacgccaccacgcagttgatccagtctaatctctcaaataacatgaacaatgggtccggcgatagcggggagaagcattggaaaccgctgggtcagcagaagcaggaggtcgcccctgtgcagtacaacatcgttgaacaaaataagcttaacaaggactaccgcgcgaacgataccgtcccacctaccataccttataaccagtcatacgaccagaatacaggcgggtcttacaacagttccgaccgaggctccagcacgagcggctcacaaggccacaagaagggagccagaacacccaaagtgccgaaacagggcgggatgaactgggcagacttgttaccccctccccccgcccacccccccccccacagcaactcggaagagtataacatctcagtagacgaatcgtatgaccaggagatgccctgtccagtccctccggctaggatgtacttacaacaggacgaactcgaggaagaggaagatgagcgcggacctactccacccgtgaggggagctgctagtagtcccgccgccgtgagctactcccatcagtccacagcaacactcacgccaagtcctcaggaggagctgcagcctatgctgcaggattgtcccgaggagactggccatatgcagcatcagcctgataggcggcgacagcccgttagccctccacccccaccccgtcctatttccccaccacacacatacggatacatttctggcccactagtcagtgacatggataccgatgcccccgaggaggaggaagacgaggccgatatggaagtggcaaaaatgcagacccgccgcttactactcagaggcctcgagcagacacccgcctcttcagtgggggatcttgagtccagcgtgacaggctccatgattaatggatggggaagcgcatccgaagaggataatatttcgtcgggtaggtcctctgtgtcgtcatccgacggaagctttttcacagatgctgacttcgcccaggctgtagctgctgccgccgaatacgcgggattgaaggtggcccggaggcaaatgcaggatgccgcgggacgacggcattttcatgcatctcagtgcccccggcctacctctcccgtctcgactgatagcaatatgagtgccgccgtgatgcaaaaaacccggccggcaaagaaactgaaacaccaaccaggccacctgagacgggagacttataccgacgatcttcctccgcctcccgtgcccccccccgccataaaatctcctacagctcaaagcaaaactcagttggaagtcaggccagttgtggtgccaaagcttccgagtatggatgcccgcaccgacaggtccagtgataggaagggctcttcttataaggggcgcgaagttctggacggccgtcaggtcgtggacatgagaacaaatcccggcgaccccagagaagctcaggaacagcaaaacgacggcaagggtcggggcaacaaagcagccaagagggacctccctccagctaagacccatctgattcaggaggacatcctgccctactgcagaccaacattccccactagcaacaacccccgggatcccagctcgagcagcagtatgtcatcccgcggatctggttcaaggcagagagagcaggcaaacgtagggcgtaggaacatagctgagatgcaagtactaggcggctatgaaaggggggaggataacaatgaggagcttgaagagacagagtcctag

SEQ ID NO: 133261 - DNA, 4821 bp, Artificial Sequence
  Description of Artificial Sequence: Synthetic coding sequence
atgatcgccgaacccgcccatttttatctcttcgggttgatctgcctctgttcgggcagtcggctgagacaagaggactttccgcctcgaatcgtggagcacccgagcgacctcattgtgtctaagggggaaccagcaactttgaattgcaaggccgagggtcgtcctacacctactattgagtggtataagggaggcgaaagagtggaaaccgacaaggacgatccacggagccacagaatgcttcttcccagcgggtccctcttctttctgagaatcgtgcacggccgcaaatccagacctgacgagggcgtctatgtatgcgtcgcacgcaactatctgggagaggctgtatcccataatgccagtttggaagtcgctatactacgggatgattttagacaaaaccccagtgatgtgatggtggccgtcggagagccagctgtgatggaatgtcagccacctcgcggtcaccccgaaccgacaatatcctggaagaaagacggctctcctctggatgacaaggacgagagaataacaattcggggcggcaaactcatgatcacttacacccggaaatcagatgcaggcaagtatgtttgcgtggggacaaacatggtgggagagagagagtccgaagttgcggagttaactgtgctggaaagaccatcattcgtgaagaggcccagtaacctcgctgtcaccgtagacgactctgccgagttcaagtgcgaagctaggggcgatcccgtgcctactgtgcgttggcgcaaggatgacggggagctcccgaaatcccgctacgagatccgggatgaccacaccttgaagatcagaaaggtaacagctggtgatatgggatcctacacctgtgtggcggaaaatatggtcggcaaggctgaggctagcgcaacactgactgtacaggtcggatcagaacctccccatttcgttgtcaagcctagggatcaagtggtggcccttggacgtactgtaactttccaatgcgaagcaaccgggaatccccagcccgcaatcttttggagaagagaggggagccagaacctgctgttctcctaccagccccctcaaagtagttctcggttttctgtctcgcagacaggcgacctaactataaccaacgtccagcgcagcgacgtggggtactatatttgtcaaacactgaatgtggccggcagcataataactaaggcctatctggaggtaaccgacgtgatcgccgatcggccgccacccgtcatcaggcaggggcccgtcaaccagacggtggcagtggatggaaccttcgtactgagttgcgtggccactggaagccccgtgccgacgatcctgtggagaaaggacggcgtcctggtttctacccaggactcgcggatcaaacagctcgagaatggtgttctgcagattcgctacgcaaagctgggcgacaccggccgctatacctgtattgcaagcactccaagcggggaggccacatggagcgcatacattgaagttcaggagtttggagtacctgtgcagcccccccgcccaaccgaccccaaccttattccttccgcgccaagcaagcctgaggtcacagacgtgagtcgcaatacggtgactctgagctggcagcccaacttgaattctggcgctacccccacatcttacataatcgaagccttttcccacgcttccggtagtagctggcagactgtggctgagaatgttaagactgagacatctgccatcaagggactgaagcctaacgcaatatatctgtttttggtgagagctgccaatgcatatgggatctcagatccttcacagatcagcgacccagttaaaactcaggacgtcctgcctacctctcagggagttgaccacaagcaggtccagcgtgaactgggcaacgccgtcttacacctccacaatccgactgtgttgagctcaagctctattgaggtccattggactgttgaccagcaaagccagtacattcaggggtacaagatactttaccggcctagcggagctaaccacggagagtcggactggcttgtctttgaggtcaggaccccagccaagaactcagtcgtgatccctgaccttagaaagggagtgaattatgagatcaaagctcgcccattctttaatgaattccagggcgctgatagtgaaattaaattcgccaaaactttggaggaagccccgtccgcccctcctcagggtgtcaccgtgagtaaaaatgatggcaatgggaccgctatcttggtgagttggcagccacctccggaggatacccagaacggcatggtccaagaatataaggtctggtgcctcgggaacgagacacggtaccacattaataagaccgtggacggtagcacattttcggtggtaattccatttttagtgcccgggatcaggtactcagtcgaagtggctgcgtccacaggcgcaggctcgggtgtcaaatcagaaccgcagtttatccaattggacgcccacgggaacccggtgagccctgaagaccaggtttccctcgcacagcagatcagcgatgtcgtgaagcaacctgcctttatcgccggaatcggcgcagcctgctggatcatcctgatggtcttcagcatctggctatacaggcaccgtaaaaaacgcaacggacttacaagcacctatgccggaatccggaaggtgacctatcagcgcggaggcgaggccgtgtcctccggagggaggccaggcctactgaacatatctgaaccggctgcccagccctggctggccgacacatggccgaataccgggaacaaccataatgactgttccatctcgtgttgcactgccggaaatggcaactccgatagcaatctgaccacttatagccgacctgctgactgtatcgctaactacaataatcagttagacaataaacaaactaatctcatgttgccagaatcgaccgtctacggggatgtggacctctccaacaagataaatgagatgaagaccttcaattccccgaatctgaaggacggacgctttgtgaaccctagcggacagcctacaccatacgctaccacacagctgattcagtccaatttatccaataatatgaataatgggtccggcgacagtggggagaagcattggaagccgctcggacagcagaagcaggaagttgctcccgttcaatacaacatcgttgaacaaaacaaactgaacaaagactacagagcaaatgacacggtgccaccaaccatcccatataatcagtcctatgatcaaaacactggcggatcatataatagctccgacagaggttctagtacttctggatcccagggacataagaaaggagctcggacacccaaagtgccgaagcagggcgggatgaactgggcagacctgttgcctcctccacccgctcaccctcctccacatagtaatagtgaagagtacaatatctcggtcgacgaatcctacgatcaagagatgccgtgcccagtcccaccggccaggatgtatctgcaacaggacgagcttgaagaggaggaagatgagcgcgggcctaccccaccagtaaggggcgctgcaagcagccctgccgctgtgtcctatagtcaccagagcacggctactctcactccctccccgcaggaggaattacaaccgatgctgcaggattgcccggaagaaacaggccacatgcagcaccagccggacaggcggcgccaacccgtctctccccctcctccccctaggcccatttcacccccccatacgtacggatacatctctggcccactggttagtgacatggataccgatgcccccgaggaggaagaagacgaggcagatatggaggtagcgaagatgcagactcgtaggctcttgctgcggggactggagcagacaccagccagcagtgtcggagaccttgagtccagcgtaactggtagcatgatcaacggctggggctctgcgtccgaggaagacaacatctccagcgggcgcagttccgtgtccagtagcgatggatccttcttcacggacgcagatttcgctcaggccgttgccgcagctgctgaatatgcgggcctgaaagtggcgcgtaggcagatgcaggatgcagccgggcgcaggcacttccacgcttcacagtgtccaagacccacctcacccgtcagcactgatagcaacatgagcgcggctgtgatgcagaagactaggcctgccaagaagctaaaacaccagccaggtcacttgcgcagagagacttataccgatgacttgcctccacccccagttccgccaccggctataaagtctcccacggctcaatcaaaaacccaactcgaggtgcggccagttgtggtacctaagctgccctctatggacgccagaaccgaccgctcaagcgatcgcaagggcagttcctataaaggtagggaggttctcgacggaagacaggtggtggacatgcggacaaaccccggcgaccccagggaggcacaagaacagcagaatgacgggaaaggaagggggaacaaagcagcaaagcgcgacttgccgcccgctaagactcatttgattcaagaggatatcttgccctactgtcgccccacgtttccaaccagcaacaacccacgagatccttcatccagctccagcatgtcttcgcggggttctggatctaggcagcgagagcaagctaatgtaggaaggagaaacatcgcagaaatgcaggtgctcggaggctacgagcggggggaggataataatgaggagctcgaagagaccgagtcctag

SEQ ID NO: 133262 - DNA, 3213 bp, Artificial Sequence
  Description of Artificial Sequence: Synthetic coding sequence
atggcccgaagacatgagagggtgacccgacggatgtggacatgggcaccagggcttctgatgatgactgtcgtgttttggggccatcaaggtaatggccaggggcaagggtccaggctacgtcaggaggactttccacctagaattgtggaacacccctctgatgtgattgtgtcgaagggcgaaccgacaacactaaattgtaaagcagaggggcgcccgaccccaacaattgagtggtacaaggacggcgagagggtggagactgataaagatgaccccaggtctcaccggatgctgctgccgagcggatcccttttcttcctgcggatagtacatggcagacgtagcaaacccgatgaaggcagctatgtgtgtgtggcgcgaaactatctgggagaggcggtctctaggaatgcttcattggaggtcgctttactgagagacgacttccggcagaaccctaccgatgttgtggtggccgccggagaacctgccatcctagaatgtcagcccccgagaggccatcctgaacccacgatatattggaagaaggacaaggtgaggatagacgacaaagaggagcgtatatccattagaggaggcaaactgatgatcagcaacacccggaagagtgacgccggcatgtacacctgcgtgggtacaaacatggtcggggaacgagatagtgatccagccgagctgaccgtgtttgaaaggcctacctttcttcgccggccaataaatcaggtggtactcgaggaagaagcagtggaattcagatgccaggtgcagggagatccgcaacccaccgtccgctggaagaaggacgacgctgatcttcctagaggcagatatgacattaaggacgattacactttgcgcattaaaaagacgatgtcaacggatgaaggaacgtatatgtgcatcgctgagaacagggtgggcaagatggaagcatccgccactctgactgtccgcggtggcgtcattgctccacctcagttcgttgtgaggccccgcgatcagattgttgcccaaggccgtactgtgaccttcccttgcgaaaccaaaggaaacccacaaccagctgttttctggcagaaagagggatcacagaacctgctgtttcctaaccaacctcagcagcccaacagtcgatgttcagtctcccccacaggagacctcaccataacaaatattcagaggagtgacgccggctactatatttgccaggctctgacggttgctgggagcatactggccaaggctcagctcgaagtcaccgacgtcttgacagatagacctccacctattatactacagggccctgctaaccagaccttagccgtggatggcaccgcccttctaaagtgcaaagctaccggggatccactcccagtgatctcctggttgaaggagggtttcactttccctggcagggatccaagagctacaatccaggaacagggcacactgcaaattaagaatctccggatctccgacaccggcacttacacgtgtgttgccaccagtagcagcggcgaaacctcatggtcggccgtccttgatgtgacagagagtggggccactatatccaagaattatgatctatccgatttacccggaccaccgagcaaacctcaggtgacagatgtgaccaagaacagcgtgacactctcctggcagccagggacaccgggcactttgcctgcgagtgcatacatcatagaagccttttctcaatccgtatcaaactcttggcagacggtggcaaaccatgtgaaaacaactctatacacagtcagagggctacggccgaatacgatttacttgttcatggtgcgcgctatcaatccacagggcctgagcgacccatcccctatgtcagacccggtccgcactcaggacatttcacctcccgcccagggtgttgatcatcggcaggtgcagaaagagttgggggatgtgttggtccgcctccacaacccggtggtcctcactcctactacagttcaggttacatggactgtggaccgccagcctcagttcattcagggctatagggtgatgtataggcagaccagtgggcttcaagcaacatcctcctggcagaatctcgacgccaaagtaccaacagaaagatccgcagtgctggtgaatttgaagaagggagtgacctacgagatcaaagtgcgtccatattttaacgagttccaggggatggactccgaaagcaagaccgtgaggaccacagaggaggctccttccgcgcctcctcagtctgtcaccgtgctaacagtagggagttacaattcaacatcaatctccgtgtcttgggaccccccccctccagaccaccagaatggtatcatccaggaatacaaaatttggtgtttgggtaacgaaactcgattccatatcaacaaaaccgttgatgcagccatcagaagtgttattatcggaggactgttccccgggatacagtatagggtagaggtggccgcgtctacgagcgctggcgtgggtgtgaaatctgagccccaaccaattataattggacgacgaaatgaagtggttattaccgagaataacaactctatcacagagcagattactgacgtagtgaagcagccagcattcattgcagggattggtggggcctgctgggtaatccttatgggattttccatttggctgtactggcggcggaaaaaacgcaaaggactgagtaattacgctgtgactttccaaaggggggacgggggactcatgagtaatggctcaagaccggggctcttaaacgcgggtgaccctagttacccctggctggcggatagttggcccgcaacgagtcttcccgtgaataacagcaatagcggccctaacgagattggaaattttggaagaggcgacgtcctaccacctgtgccagggcagggtgacaagacagcaacaatgctttcagatggcgcgatctattcaagtatcgattttactactaagacctcctataattcctccagccagattacccaagctaccccttacgctacgacgcagatcttacatagtaactcaatccacgaattggctgtggacctgccggacccccaatggaagagctcaatccaacagaagacggatttgatggggtttggttacagcttacccgatcagaacaaggggaataatggagagtccgggagctag

SEQ ID NO: 133263 - DNA, 1713 bp, Artificial Sequence
  Description of Artificial Sequence: Synthetic coding sequence
atgagtacagacgagggcacgtacatgtgcattgccgaaaaccgtgtgggaaaaatggaggcatcagctactttgactgtccgcggcggcgttatagccccacctcagtttgtggtccgtcctcgggatcaaatcgtagcacagggcagaaccgtcacctttccgtgcgaaaccaaggggaatccccagcctgccgttttctggcagaaagagggatctcagaacctgttattccccaaccagccccaacaaccaaattctagatgtagtgtgtctcccactggggacttgacgattaccaacattcaaagatccgacgcagggtattacatatgtcaggccctgaccgtcgcaggcagcatccttgctaaagcacagttagaagttacagacgttttgacagaccgaccgccaccgataattctacaggggcctgccaatcagactctggctgtggatggcaccgcattactgaaatgtaaggccacaggcgaccctttgcctgtgatatcttggctcaaagaggggttcacttttcccggccgcgatccgcgggccaccatccaagaacagggaaccctgcagatcaagaatctcaggatctcagacacaggcacatacacctgcgtggccacctcctcgtcaggggagacatcctggagcgcagtcctggatgttaccgaatcgggagctaccatcagtaaaaactacgacctgtctgatctaccaggtcctcctagtaagccccaggtgactgatgtaactaagaactctgtgaccctgtcctggcagccaggcacgccagggaccctccctgctagcgcctatatcattgaggccttttcgcagagcgtttcgaactcttggcaaacagtggccaaccacgttaagactaccctgtatacagtcagaggcttgcggccaaacactatctacctctttatggtgagagcgataaatccccagggacttagtgatccttcacccatgagtgacccagtgcgaacacaggacatctcgccaccggcacagggagtcgatcatcggcaggtgcagaaggaacttggcgatgtcttggtgagacttcataatcccgtggtactcacccctaccaccgttcaggtgacatggacggtagatcgacagccccagttcatccagggctacagagttatgtatagacagacttcaggcctgcaggctactagttcctggcagaatctggatgctaaggttcccacagagcggagcgctgtactggtaaacttaaagaagggggtcacctatgaaattaaagttagaccatacttcaacgaatttcaggggatggatagtgaatctaagacagtcagaacaactgaggaggcgccatcagccccaccccagagtgtaactgtgctcaccgttggaagctataacagcacctctatttcagtgtcctgggatccgcctccccctgaccaccagaacgggataatacaggagtacaagatctggtgtctgggaaatgagacgagatttcacattaataaaacggtggacgcggcaattcggagtgtcatcatcgggggcctgtttcccggcatccagtaccgggttgaagtggcagctagcaccagcgccggagtgggtgttaagagcgaaccacagccaaacaataccggctaccccatatgccacgacactgaccttgcattccagcagcacacctag

SEQ ID NO: 133264 - DNA, 4185 bp, Artificial Sequence
  Description of Artificial Sequence: Synthetic coding sequence
atggccaggcgtcacgaacgggttacgcggcgtatgtggacatgggctcccggactcctgatgatgaccgtggtgttttggggacaccaaggaaacgggcaaggacaaggcagcagactcagacaggaagacttcccacctcgcatcgtcgaacacccatcggatgtaatcgtctctaagggcgaacctactactctaaactgcaaagctgagggcaggccgacccccaccattgaatggtacaaggacggagaacgagtggaaacagataaagacgacccgcgatcccaccggatgttgttaccaagcgggtcactgttttttcttagaattgttcatggacggaggtcaaaacccgatgagggtagctacgtctgtgtggctcgcaattaccttggcgaagctgtaagtaggaacgcctcattggaggttgctctgctccgcgacgatttcaggcagaatcctactgacgtggtagtggccgccggcgagccagctatcctagagtgccagcctccccgcggccaccctgaacccacaatctactggaaaaaagataaggtacggatcgacgacaaagaagagcgaatttccatccgcggtggtaagctgatgatctccaatacccgcaagagtgacgctggaatgtatacatgcgtcggcacgaacatggtgggtgaaagggatagcgatcccgcagagctaaccgtgtttgagaggcccacatttctgaggaggccaattaaccaggtcgtcctcgaagaagaggcggtggagttcagatgccaagttcagggcgacccacaaccgactgtgcgttggaagaaggacgacgctgacctaccccgggggcgatatgacataaaagatgattataccctgcgaatcaagaagacaatgtctacagatgaagggacttacatgtgtatcgctgagaatcgggtaggcaaaatggaggcctccgctacactcacggtgcgcgctccccctcagtttgtagttcggcctagggaccagattgtcgcccaaggccggactgtcacttttccgtgtgagacgaagggaaacccgcaacccgcagtgttctggcagaaggaggggagtcagaaccttctctttcccaaccaaccccagcagcccaattcccgatgttccgtatcacccacaggagacctaaccatcaccaacatccaacgcagtgatgcgggttactacatttgtcaagcactgactgtggccggctccattctggctaaggcacagttagaggtgacggacgttctaacagaccgtcctcctccaattatcctccagggacccgccaatcagactctcgccgtggacggcaccgccctgctgaaatgtaaggctactggcgatccattgccagtaataagctggctgaaggagggcttcactttccctggacgagatccacgtgcgactatccaggaacaaggtaccctgcaaatcaagaatctacggatatctgataccggtacctacacctgcgtggccacctcgagctcaggtgagaccagctggagtgcggtgttggacgtaactgagagtggagcaaccataagcaagaactacgacttgagcgatttacccggcccacctagcaaacctcaggtcacggacgtgacaaaaaatagtgtgacactctcctggcagcctgggaccccagggacactaccggcatctgcctatattatcgaggcattttctcaaagcgtgtcaaattcttggcagaccgtcgccaaccacgtgaagacaactctgtacacagtgcgaggcttacgcccaaatactatctacctgtttatggttagggccatcaacccccagggcctgtccgacccctccccaatgtctgatccagtccgaacgcaagacatctctccccccgcacaaggagtggatcatcggcaggtgcaaaaggagctgggcgacgtcctggtgcgcctccacaatccggtggtgcttacccctactacggtgcaggttacttggacagtggatcgacaacctcagttcatccagggctatcgtgtaatgtacagacagacctcaggtctgcaagccacaagcagttggcagaacctcgacgccaaggtgcccaccgaaagatctgctgtgctggtcaatcttaagaaaggtgtaacatacgaaataaaagtacgcccgtactttaacgaattccaaggcatggattcggagtctaaaactgtacgaacaaccgaggaggctccctcagctcctcctcaaagtgttacagtgctcacagtcggaagctataacagtactagtatcagcgtgtcttgggacccacctcctcccgatcaccagaatgggattatacaggagtacaaaatctggtgcctgggcaatgagacacgattccatatcaataagacagtggatgccgccattcgatctgttatcattggaggcctgttcccaggcattcagtacagagtagaagtcgcggcctccacctctgctggagtcggagttaagtctgagccccaacctatcatcattggcagacgcaacgaggtggttattactgagaacaacaactctattacggagcagatcacagatgtggttaagcagccagccttcattgccgggattggcggtgcttgttgggtgatattaatggggtttagcatctggctgtattggcggagaaaaaagaggaagggtctgtctaattacgctgttaccttccagagaggcgacggaggactgatgtccaatggatctcgcccaggactgctgaacgcgggggatccaagctatccttggttggccgattcatggccggctacctcactccccgttaacaactctaattcaggtcctaatgaaattgggaatttcggacgaggcgacgtgctgcccccggtcccgggacagggagacaaaacggctaccatgctgtcagacggagctatctactccagcatcgacttcacaaccaaaacgtcatataactcatcctcacagatcacacaggctactccctacgccacaacccagatcctgcactctaactccatccacgagcttgctgtcgacctgccggaccctcagtggaaaagcagcattcaacaaaagaccgatctgatgggcttcggctactccctgccagatcagaacaaaggcaataacggaggaaagggcggtaagaagaaaaagaacaagaactcatctaagcctcaaaaaaacaatggctccacatgggccaatgtgcctctgcccccccctccagttcaacccctgcccgggaccgagctcgagcactatgctgttgaacagcaggaaaacggttatgactcggatagctggtgtcctccgctccccgtgcagacctatttacaccaaggtctggaagatgaactggaggaggatgacgacagggtgcccacccctcctgtgagaggcgttgcatcatctcccgcgataagtttcggacagcagtcgaccgccacgcttacacctagtcccagggaagaaatgcagccgatgttgcaagcacacctcgacgagctaaccagggcgtatcagttcgatatagccaagcagacttggcacatccaaagcaacaatcagccaccacaaccaccggtacctcctctcggctatgtttcaggtgcccttattagcgacttggagaccgacgtggcggacgatgatgctgatgatgaggaagaagccttagaaatcccgagacctctcagggctcttgaccagactccaggctccagcatggacaacctagactcatctgttacaggaaaagccttcacttcctcgcaacggccccggcccacctcaccctttagcaccgacagcaacacaagcgccgcactgtcgcagtcccagagaccacgcccaaccaaaaaacacaaagggggaagaatggatcagcagcccgctttgccgcatcgacgggaaggcatgactgatgaagaggccttagtgccctattcaaagcctagttttccctctcctggaggccattcttctagcggcacggctagctctaaaggctctaccggaccacgcaagacagaggtgctgagagcaggacaccagaggaacgcctcggatctcctggacataggttacatgggcagcaactctcagggccagttcactggagaactgtag

SEQ ID NO: 133265 - DNA, 4137 bp, Artificial Sequence
  Description of Artificial Sequence: Synthetic coding sequence
atgtccctgctgatgttcacgcagctgctgctgtgcggattcctttacgtcagggtggatgggtccagactgagacaggaggattttcccccccggattgttgagcacccctccgacgtcatcgtgtccaaaggggagcccactactttgaactgcaaggctgaaggcaggcccacgccaactattgagtggtataaggatggggaacgagtggaaaccgataaggatgatcccaggtcccatcgaatgttactgcctagcggctccttgttcttcctgcggattgtgcatggaagacggtctaagccggatgagggatcatatgtgtgtgttgcccgcaactacctgggcgaagcagtctcccggaacgcctctttggaggtagctctgcttagggacgatttccgccagaatcctacagacgttgtagtggctgcaggcgagccagccattcttgagtgccaacctcctaggggtcatcccgaaccaactatctactggaagaaagataaagtccgcattgacgataaagaagagcgcattagcattagaggtgggaagctgatgatctccaatactaggaaatccgatgcagggatgtatacttgcgtgggtactaacatggtgggggagagagactctgaccccgctgaactcaccgttttcgaaaggcccacgtttctgcggcgcccgattaaccaggtggttcttgaagaagaagccgtggaattccgctgccaggtccagggcgatccccagccgactgtgagatggaagaaagatgatgccgatttaccccggggacgatacgatatcaaggacgattacacgctgagaattaaaaagacgatgtcaactgacgagggtacttacatgtgtatcgcagagaatagagtggggaagatggaagcatccgctacattaacagttcgcgctcctcctcaatttgtcgtgcgaccaagagaccagatcgtcgcacaaggacgtacagtcactttcccctgtgaaactaagggcaatcctcaacctgcagtgttttggcaaaaggaggggagtcagaatttgctgttcccaaaccagcctcaacagcctaacagtcgttgtagcgtcagtcccacaggtgatctgacaattaccaacatccagaggtctgacgctggctactatatctgccaggctttaacagtggcaggctccatcttggccaaagcccagcttgaagtgaccgacgtgctgactgaccgaccccctccaataatcctacaaggacctgccaaccagactctcgcagtcgatggcaccgccctgctgaagtgcaaggctacaggggatccgctgcctgtgatttcctggcttaaagagggtttcacttttcctgggcgagacccaagggccactattcaggagcaagggactctacagataaagaacttgcgaattagtgacaccggtacctacacttgcgtagcaaccagtagctccggcgagacaagctggtctgctgtgcttgacgtgactgagtctggtgcgaccatcagcaaaaactacgatttatcggatctgccagggcccccatcaaagccacaggtcactgatgttaccaagaactccgtcactctcagttggcagccaggcacaccgggaacgctgcctgccagtgcatatatcatcgaagctttctcccaaagcgtgagcaattcttggcaaacggttgccaaccacgtgaagaccaccctgtatactgtgcggggtctgaggcctaatactatttatctcttcatggtgagggccatcaatccccagggattgtccgacccctctccaatgtcggatcctgtgcggacacaagatatatctccacctgcacaaggcgtggaccaccggcaagtccaaaaggaactaggcgacgttttggtgcgcctgcacaaccctgtggtccttaccccaacgacagtgcaggtgacttggaccgtggaccgccaaccccagtttatacaagggtatcgagtgatgtatcggcagacctcagggcttcaggcaacttcctcttggcagaacctcgacgcaaaggttcctacagagcggagtgcggtgctcgtgaatcttaaaaagggggtgacttacgaaattaaggtacgaccttatttcaacgaattccaaggaatggattcggagtccaaaactgtcagaaccaccgaagaggccccttcagctccaccacagtctgtgacagtgcttactgtgggctcttacaacagcacttcgatttcggtatcctgggatccgcctccccctgatcaccagaatgggataatacaggaatataagatatggtgtctgggcaacgagacaagattccatatcaacaaaacagtggatgcagccatccggagtgttataattggcggccttttccctggcatccagtatcgggtcgaggtcgctgccagtaccagcgctggggtcggggtaaagtccgagcctcagcctatcataataggccgtcgaaatgaggtggtcatcaccgagaacaacaactctatcacagagcagatcaccgacgtagtaaaacagcccgcattcattgccggcattggaggggcctgttgggtgattctgatgggcttcagcatttggctgtattggagacgcaaaaagcgaaaggggctatccaactatgcagtgaccttccagcggggggatggaggcctcatgtctaacggaagccgaccaggtctgcttaatgctggggacccgtcctacccctggcttgccgacagctggccagccacatcccttcctgtgaacaactcaaattcaggccctaacgagatagggaacttcggaagaggtgacgttttaccccccgttcccggccaaggcgacaagaccgcaactatgctatcggacggcgccatctattcatccattgactttaccacaaagacatcctacaactccagctcgcagattacccaggcaactccttacgccactacacagatactccacagcaattctattcatgaattggcagtggacttgcccgatcctcaatggaagtctagtatccagcaaaagacagacctgatggggttcggctacagtctccctgatcagaacaagggaaacaatggcggcaagggcgggaaaaaaaagaagaataagaattccagcaaacctcagaaaaacaacggcagtacttgggcaaatgtgccgctgccacctcctccggtgcagcccttaccaggaaccgagctcgagcattacgccgtggaacagcaggagaatggctacgacagcgactcctggtgtcctccattacccgtgcagacatatttgcatcagggacttgaggacgaacttgaggaagacgatgacagggttcctacccccccagtgcgtggggtggcgtcttccccagctatctctttcggacaacagtccaccgccacactgacaccatctcccagagaggagatgcagccaatgctgcaagcccatctcgacgaactgacaagagcctaccagttcgatatagctaaacaaacatggcacattcagtctaataaccagccacctcagccgcccgttccacccttagggtatgtcagtggggccctaatatcagacctggaaacggatgttgccgacgacgatgccgacgatgaagaagaagccctggagatccctagacctttaagggcccttgatcagacgccaggtagctcgatggacaatctggactcttccgtcactggcaaagcctttacatcaagtcagaggccgaggcctacctcccccttcagcaccgacagcaatacttccgccgctctgtctcagtctcaaagacctaggccgacaaagaagcacaaaggaggcaggatggaccaacagcccgctctgccacatcggcgcgaggggatgaccgatgaagaggctcttgtgccctactcaaaacctagcttcccctcccccggaggtcattcgtcttcgggcacggcttcctcaaaagggagcacgggaccacgcaaaactgaggttttgcgtgccggacatcaacggaacgcgtcagatctgctagatattggttatatggggtcaaattcacaggggcagttcacaggagaactgtag

SEQ ID NO: 133266 - DNA, 4185 bp, Artificial Sequence
  Description of Artificial Sequence: Synthetic coding sequence
atggccagaaggcatgagagggtcactcggcggatgtggacctgggcccctggccttctcatgatgactgtcgtgttttggggccatcaggggaatgggcaggggcaggggagtagactgagacaggaggattttccaccacgaattgtagagcatccctcagacgtaatcgtaagcaagggagagccaactactctgaattgtaaggccgagggccggcctacccccacgatcgagtggtataaagatggggaaagggtggagaccgacaaagacgacccgcggtcccaccgaatgcttctgccttctggctccttattcttcctgaggatcgtccacgggcgccgctcgaaacctgacgagggatcttacgtgtgtgtagccaggaattatttgggtgaggcggtttcgcggaacgcaagtctggaggtagcacttctgcgagatgattttaggcagaaccctacagacgtggttgtggctgctggtgaacccgccatattagaatgtcagccacccagaggacacccggagcctacaatctattggaagaaggataaagtcagaatcgacgataaggaggaaagaattagcataagaggtggcaaactgatgatcagtaatacaaggaagagtgacgccggcatgtatacatgcgtgggaacaaatatggtcggggagagagattctgatccagccgagctgactgtcttcgaacggccaacattcctcaggagacccattaatcaggttgtgctggaggaagaggctgttgagtttcggtgtcaggtccaaggagaccctcaaccgacagtgagatggaagaaagacgacgcagacctgccccgcggccgatatgatatcaaagacgactacaccctgcgcattaagaaaaccatgtcaacagatgagggcacgtatatgtgtattgctgagaaccgggttggcaagatggaggcttcagctaccctgactgtccgcgccccaccccaatttgtggtcagaccgcgcgaccaaatcgtcgcccagggacgcacagttaccttcccctgtgaaacaaaagggaacccacagccagcagtgttttggcaaaaagagggctctcagaacctgctctttccgaaccagccgcagcagcccaatagccgctgctccgtgtcccccacgggtgacctgacaattacaaatatccagcggtcggacgccggttattatatttgccaggctctcactgtggctggcagtattttagcaaaagcacagctggaagtcactgatgtgctgaccgatagaccccctcctattatcctgcagggccccgccaatcaaacattggccgtggacgggactgccttgttaaagtgcaaagctacgggagacccacttcctgtgatttcttggctcaaggaggggttcaccttcccgggcagggatcctcgggcaacaattcaggaacaggggactcttcagataaaaaatctccggatctctgacacgggaacatacacctgcgttgccaccagctcctctggggagaccagctggtcagctgtacttgacgtgacagaatctggagccaccatcagcaaaaattatgacctatcggacctccccggtccgccttcaaagccccaggtgaccgatgtgaccaaaaactccgtgactctgagctggcagccaggcacccccggtacactccctgctagcgcttatataatcgaggcattcagccagtcagtcagcaattcttggcaaactgttgccaaccatgttaaaactacactctatacggtgagagggctccggcccaacaccatttacttgttcatggtcagggccattaacccccaggggctcagcgatccttctcctatgagtgaccctgtacgaacccaggatatctcaccgccagcccagggcgtggaccaccggcaagtgcagaaggagctcggagacgtcctcgtacggctgcataatcctgtagtattgactccaacgaccgtgcaggtgacctggactgtggatcgtcaaccacagttcatccagggatatagggttatgtaccgccagacaagtggacttcaggccacaagctcttggcagaacttggatgctaaggttccaaccgagcgctcagctgtcctggtgaatttgaaaaagggcgtgacctacgaaatcaaagtgcggccctattttaacgagttccagggcatggacagtgagtccaagaccgtgcgcaccacagaggaggcaccaagcgcccctcctcagtctgtgacagtgttaacggtaggttcctataacagcacctccatctctgtgtcatgggatccacctcctccagatcatcagaatgggattattcaggaatataaaatttggtgcctcgggaacgaaacccgctttcacatcaacaaaacagtggatgctgccataagatctgtgataatcggtgggctgttccctggcatccagtatagggtagaggtggcggcctccactagtgctggggttggcgtaaaaagtgaacctcagccaattattattggccggcggaacgaagtggtgattactgaaaacaataatagcatcactgagcaaatcacggatgtcgtgaagcagcccgcgttcattgctggtatcggcggagcatgctgggtgattctgatgggcttctctatatggctgtattggcgtagaaaaaagaggaaagggttgagcaattacgcagtgaccttccagcgtggggatgggggactgatgtctaatggctcacggccaggactgctgaatgctggagatccttcatacccctggttggcagactcgtggcctgccactagcctgcccgtaaacaactcaaacagtggaccaaacgaaatcggcaattttggcaggggagacgtccttccaccagtgccaggccagggggacaagacagcaaccatgctcagcgatggcgccatatacagctccatcgatttcacgacaaaaacgagctacaattcaagttcccagataactcaggccactccttacgccactacacagattctccatagcaatagcattcacgagcttgccgtagacctgccggaccctcagtggaaaagctccattcaacagaagacggacctcatgggcttcggatattctctccccgatcagaataaaggaaataatggtggcaagggaggcaagaagaaaaaaaacaagaattcttctaagcctcagaagaataacggcagcacctgggctaacgttcccctccctcctccccctgtgcaaccactgcctggaacagaactggagcactatgctgtggagcagcaggagaatggctatgattcagacagttggtgtccccccctgccggttcagacgtatcttcatcagggcctcgaggatgaacttgaggaagacgacgaccgggtcccaacacccccagtacgaggcgtggccagcagcccagcaattagctttggccaacagagcactgccacacttactccaagcccccgggaggaaatgcaacctatgctgcaggcccaccttgacgagctaacccgagcgtatcaatttgacatcgcgaagcagacctggcacattcagtcgaataatcagccacctcagcctcccgtacctcctctaggatatgtcagcggagctttgatcagtgatctcgagacagacgtggcggacgatgatgccgacgatgaggaagaagcgctggagatccctcgacccctgcgggcacttgatcagacaccgggatcaagcatggacaatcttgactcctcagtgaccggcaaggcatttaccagtagccaacgccccagacccacctcaccattttctactgattcaaatacgtctgcggccctcagtcagtcccagcgccctaggcctacaaagaaacacaaggggggtagaatggatcagcagccagccctcccgcacaggagagaagggatgaccgacgaagaggcacttgtcccctacagcaaaccttcctttccaagcccaggtggccattccagcagcggtaccgccagttctaaagggagcactggcccaaggaagacagaagtgctgcgggcagggcatcagcggaacgcctcagacttgctggacatcggatacatgggatcaaattcccaaggccagtttacaggtgaattatag

SEQ ID NO: 133267 - DNA, 4161 bp, Artificial Sequence
  Description of Artificial Sequence: Synthetic coding sequence
atgttacgctacttgctcaaaacactgctgcagatgaatttgttcgccgacagcctcgccggagatatttccaattctagcgaacttctgcttggtttcaacagtagcctggcggctcttaaccacactctgctgccacccggagaccctagcctcaatgggagccgggtcggccccgaagatgcaatgccccgaatagttgagcagcccccagatctgctggtgtctcgcggggaacccgcaacactgccatgcagggctgagggccgcccaagacccaacattgaatggtataagaatggagcccgcgtagcgactgttagagaggatcctagggctcacagactgcttctgccaagcggtgctctgtttttccctaggatcgtacacggccggcgcgctagaccggatgaaggagtgtatacatgcgtggcgaggaactacctcggagctgccgcctccaggaatgctagtttggaggttgccgtattgagggatgacttcagacagagcccaggcaatgttgtggtggccgtgggcgagccggccgtcctggagtgtgtgcccccccgcggacaccccgagccttccgtgtcatggaggaaggacggggccagactgaaggaggaggaaggtcgcattactatacgtggaggaaagttaatgatgtcgcataccctgaagtcagatgccggcatgtatgtgtgtgtcgcctctaacatggccggcgaaagagaaagcgccgccgcggaagttatggtacttgaaaggccatcattcctgcgtcgacccgttaatcaagttgtcctggccgacgcccccgtgactttcctgtgtgaagtaaagggagatccgccacctcggttgaggtggaggaaggaagatggcgaacttcctactggccggtacgagatcaggtcagatcactccctttggatcgggcacgtatcagctgaggatgagggaacgtatacgtgcgttgctgagaattcagttggtcgagccgaggcctcgggctctctgtccgttcatgtccccccccaattggttacacagccccaagatcagatggcagccccgggcgagagcgtggctttccagtgcgagacaaaaggtaaccccccacccgcgattttctggcagaaggaaggttctcaagtcctcttgttcccatcccagagtcttcaacctacaggcagattttctgtgagccctcggggtcagctgaacatcacagccgtgcagcgcggcgacgccgggtattatgtttgtcaggccgtgtccgtagcaggatctatcctcgccaaagctcttctggaaattaagggagcttcactcgacgggctgccgcccgtcattctccagggtccagctaatcagacactggtgctgggctcaagcgtttggttaccatgcagagtgacagggaatccccagccctcggtgagatggaaaaaagatggccagtggttacaaggagatgacctccaatttaagacgatggccaatgggaccctgtacatcgctaatgtgcaggaaatggacatgggattctactcctgtgttgcaaagtcctcaaccggagaggcgacatggtctggctggctcaagatgcgggaggactggggagtttctccagatccccctactgagccgtccagcccacccggagcccccagccaacctgtcgtgacagagataaccaagaatagcatcaccctgacttggaagcccaatccccagacgggggccgccgtgacatcatatgtgatcgaggccttttcgccagctgcagggaacacctggcgcactgtcgccgacggcgtccagctcgaaacccacaccgtttccggcctgcagcccaatacaatttacctctttctggtgcgggcagtcggtgcatggggtctgtcagagccttcacccgtctccgagcctgtgagaactcaagacagctccccatctaggccagtagaggatccctggcgcggccagcagggccttgcagaggtggctgtgcgactccaggagcctatcgtccttggccccaggacgttgcaggtctcttggacagtggatggaccggtccagctggtccagggattccgggtctcctggcgcgtcgccgggcctgagggcggatcctggacaatgctggatctgcagagtcctagccaacagagtaccgtcctacgaggtctccccccagggacacagatacagatcaaggtgcaggctcaggggcaggaagggctaggagctgagtcgctatcagtcacccgatccattcccgaggaagcacccagcggaccgccccagggcgtcgcagtggcgttggggggcgacggcaacagcagcattaccgttagctgggagccccctctgccttctcagcagaacggcgttatcacagaatatcaaatatggtgtttaggtaacgagagtcggttccatctgaatcggagcgcagctggatgggcgcgaagtgcaatgctgcgaggtttagtgcccggcctcctgtacaggactctggtggcggctgccacatcagccggggtaggtgttccatccgcccccgtgcttgtccagcttcctagcccgcccgacctggagccggggctcgaggtgggggcaggcctggccgtgaggttggcgagggtactgagagaaccagcctttttggccggatccggtgcagcatgtggggccttgctcctgggcctgtgcgctgccctgtattggaggagaaaacaaagaaaagaactgtcccattacactgctagctttgcatatactccggctgtgagctttccccattctgaaggcctgagtggtgccagttctcggccacctatggggctgggacccgcaccctactcctggctcgcggatagctggccccacccaagccgatccccatcggcccaggagcccagggggtcttgttgcccgtctaatccggacccggatgacagatattacaacgaagcggggattagtctttacctggcacagacagctagaggtacagccgctcccggtgagggacctgtgtattctactatcgatcccgcaggggaagagcttcaaaccttccatgggggttttccccaacaccctagcggagatcttggaccttggtctcagtatgctccccctgagtggtcccagggggattctggcgcaaaggggggaaaggttaaattgcttggtaagcccgtccagatgccttctctcaactggcccgaggcgcttccgccccctcccccttcatgcgagctgagttgtctcgaggggcccgaagaggagttagagggtagttccgagcccgaggaatggtgcccccctatgccggagcgatctcatttgaccgaaccaagttcctccggaggctgtctggtcacccccagccgccgtgaaaccccatcccctactccttcttatgggcagcagagcactgcgacactgacgccgtcgccccccgacccaccacaaccacccacagatatgcctcatctccaccaaatgcccagaagagttccactgggcccatcttcaccccttagcgtgtcacaacccatgttaggtatccgggaagctaggcccgcagggttgggcgcaggtcccgcggcgtcaccacacctgagcccctcccctgcccccagtactgcctcctcagcgcccggacggacgtggcaggggaatggggagatgaccccaccccttcagggccctcgagccaggtttcggaaaaaacctaaagcgctgccgtaccggagagaaaactcccctggcgatctgccccctcctccactcccacctccagaagaggaggcgagctgggctctggaactcagggcggcaggctctatgtcatcactcgagcgcgagcggagcggcgagcgcaaggccgttcaggcagtgccattggctgcgcaaagagtgctgcacccagatgaagaagcctggctgccttactctcgcccaagctttctgtcacgtggccagggaacatctacctgttccaccgctggttccaattctagtagaggatcttcgagttccagggggtctaggggccccgggagaagtcgtagccggagccagtcacgatcacagagccaaagacccggacagaagagacgtgaggagccccgatag

SEQ ID NO: 133268 - DNA, 4095 bp, Artificial Sequence
  Description of Artificial Sequence: Synthetic coding sequence
atggaaagacctgaggacagtctgtctttatggtcactgaatctttctccacagtttccttgtctcaatgcattgcggcacccactgagtcccggcagtagggtcggacctgaagatgctatgcccagaatcgtggagcaaccgcccgacttgctggtgtcacgcggggagccagcaacgcttccctgtcgggccgaggggcgaccccgccccaatattgaatggtataaaaatggagctcgtgtcgccactgtgcgggaggaccctcgggcacatagacttctcctgcccagcggcgcacttttctttccccggatagtgcatggcagaagagcacgaccagatgagggagtgtatacgtgcgtggcccgaaattatctgggagctgctgcttctcggaatgcctcactcgaggtggccgtgctcagggacgactttaggcagagtcctggcaacgttgtggtggcagtgggggaacccgccgtgctcgagtgcgttccaccccgcggccatcctgaaccaagcgtgagttggagaaaagacggtgcaagattgaaggaggaagagggtaggataaccataagggggggcaagctcatgatgtctcataccctgaagagcgatgccgggatgtacgtttgcgtggctagcaatatggctggcgagagggaatccgcagcagccgaggtgatggtcctcgagagaccttctttcctcaggcggccggtgaatcaggtcgtactggccgacgcccctgtgacctttctgtgcgaagttaaaggtgatcccccacccaggctgcgctggcggaaagaggatggcgaactcccaactgggcgctacgagatacgcagcgatcatagtttatggatcggtcatgtgagtgccgaggatgagggaacctatacttgcgttgctgaaaactccgtagggagagcagaggccagtggttcgcttagcgtccatgtgccaccgcagctggtgacacaaccacaggatcaaatggcggcgcccggcgaatcagtagcgttccagtgcgagaccaagggaaatccccctcccgccatcttttggcagaaggaagggtcacaagtgctcctgtttccaagccagtcactgcaaccaactggaagattttctgtttcacctcgtggacagttgaatatcaccgccgtgcagagaggagatgccggctattacgtatgccaggctgttagcgtggcagggtccatcctggccaaggccctattggagatcaaaggcgcctctttggacgggctgccacctgtgattttacagggccctgctaaccagacactggtacttggctccagcgtttggctcccttgtagggtgaccggtaatccccagccctctgtgaggtggaagaaggacggacagtggctgcaaggagacgatctgcagtttaagacaatggccaacggcactctatacatcgccaacgtccaagaaatggacatggggttctattcctgtgttgccaaatccagtactggagaggctacttggtccggctggctgaagatgagagaggactggggagtttctcctgatccacctaccgagcccagctctcctcctggggcaccctcccagcccgtcgttaccgagatcacgaagaattccatcactctgacttggaaacccaacccacagacaggggcggcggtgacgtcctacgtgattgaggccttcagccctgctgctggaaacacttggaggaccgtcgccgatggggtccaacttgagacacacactgtttcaggcctccaaccaaatacaatctacctatttttagtgcgagcagtgggcgcctggggcttgagtgagccctccccggtctcggagccagtcagaacccaagattcttcccccagccgaccagttgaggacccttggcggggacagcagggcctcgccgaggttgccgtcaggctccaggaacctattgttctgggaccacggaccctgcaggtctcctggaccgtggatgggccagtccagttggtccaaggattccgagtctcctggcgtgtcgcaggacccgaaggtggaagttggaccatgctcgacctccagtccccttcccaacaatcgacagtactgaggggtcttccgcccggcacacagattcagattaaggtccaagcccaagggcaggaaggtctcggggccgagtccctttctgtcacccgcagtattcccgaagaagccccttcagggcccccacagggggttgctgtcgcccttggaggggatggcaattccagcattacggtgtcatgggaaccacctctcccctcccagcaaaacggagtaattaccgagtatcagatctggtgcctggggaatgaaagccgtttccacctgaaccgtagtgccgcaggatgggcacggtcagctatgcttagagggctggttccaggcctcctataccggaccctcgtcgctgccgcgactagcgcgggcgttggcgtgcctagcgcacccgttctcgtccagttaccgtctccacctgacttggagccgggcctggaagttggcgccggtctggccgtgcggctggccagagtgctgcgggaacctgcttttcttgccgggagcggtgccgcatgcggtgccctgcttctcgggctgtgcgctgctctgtactggcggaggaaacagaggaaagagctgtcccattatacagcttcctttgcttatacccccgctgtgagctttcctcacagtgaaggcctaagcggggcaagtagtcggcccccaatgggactgggtcctgctccttatagttggctggctgattcttggccccacccttcaaggagcccctcagcccaagaacccagaggctcatgctgcccatcaaatccagaccccgacgataggtattataatgaggcgggaatctccctgtacctggcccagactgcccggggcacagctgcccccggagagggtcctgtgtactctacgatcgatccagcaggagaagagctgcagacattccacggggggtttcctcaacatccctcaggtgacttaggaccttggagccaatacgccccccctgagtggagccagggcgattcaggcgctaagggggggaaggtaaagctgctcggcaaacccgttcagatgccatcacttaactggccagaggccttgcctccgccacctccgtcctgtgagctgagttgtctcgagggcccggaggaagagctggaagggagctcagagcccgaggagtggtgcccacccatgcccgaacggtcacatctgaccgagccctcctcatctgggggatgcctcgtgaccccaagcaggcgcgagacaccttcacctaccccttcttatggccagcagagcacagccactctaactccgtcgcctcctgatcccccacaaccgccaacagatatgccccatctgcaccagatgcctagacgggtgccactcgggccctctagtccactgagtgtttctcaaccgatgctgggcattagagaagccaggccagctggtctgggcgctggcccggccgcttctccgcatctgtctccgtcgcccgctccctccactgcctcttccgccccaggccgtacctggcaggggaatggagaaatgaccccacctctgcagggaccccgcgctcgatttcgtaagaaacccaaggccctgccctatcgccgggaaaatagccctggtgacctgccccctccaccactgccacccccggaagaagaggcttcctgggccctcgagctccgggctgcgggctccatgagtagtttggagagggaaaggagcggcgagaggaaagctgttcaagcggtccctctcgcagcccagcgggtcttgcaccccgatgaggaggcctggttgccttattctcgaccgtcatttctatcccgcggtcagggaacaagcacttgtagtacagctgggtcgaatagctctagaggctcttcatccagccgtggttctagggggcccggacgttctcgtagccggagccagtcccgatcgcaatcccaacggcccggccagaagcgcagagaggagccccggtag

SEQ ID NO: 133269 - DNA, 450 bp, Artificial Sequence
  Description of Artificial Sequence: Synthetic coding sequence
atgactccaccattgcaaggtcctagagcgcgcttccgaaaaaaacccaaagcactgccataccgcagagaaaacagcccaggcgatcttcccccaccacccttgccacccccggaggaggaagctagttgggcgttagaacttcgggccgcaggcagcatgagttctttagagagggaacggagcggggagaggaaggctgtccaagctgtgcctcttgcagcacagagggtgcttcaccccgatgaggaggcctggctcccctactcaaggccatcatttttgtcgcgcggccaagggaccagtacctgtagtacggcagggtctaactccagccgcgggagtagctcgtcccgcggctcccggggtcctggacggagccgcagcagatcgcagtcacgcagccagtcacagcgcccgggacagaagcgccgcgaggaaccccggtag

SEQ ID NO: 133270 - DNA, 3024 bp, Artificial Sequence
  Description of Artificial Sequence: Synthetic coding sequence
atgggcagtgggggcgactccctcttgggaggaagggggtctctgcctctgttactgctgctgattatgggaggcatggcccaggacagccccccacagatcctggtgcaccctcaggatcagctgttccaggggcctggtcccgcccggatgtcatgtcaggcttcaggtcagccacccccaaccatcagatggttattgaacggccaaccactgagtatggtgccacctgaccctcatcacctcctgcctgacgggaccctcttactgcttcagccgccggcaagggggcacgcacatgacggccaggccctaagcacagatctaggagtatatacctgcgaggcctctaatcgactaggcaccgccgtcagtaggggggcccgccttagcgtcgccgtcttgcgagaggacttccaaattcagccccgggatatggtggctgtggttggcgaacaatttacgctggaatgtggacctccatggggccatcccgagccaaccgtgtcttggtggaaggacggcaaacctctggctttacaacccggacgccataccgtgagcggtggctcactgctgatggcccgggcggagaagtccgacgaaggcacatatatgtgcgtggccacaaacagcgccggacatcgcgagtctcgggccgcacgcgtgtccatacaggaaccacaggactatactgagcccgtggaattgctggcggtgcggatccagctggaaaacgttactttgttgaacccagatcccgctgaaggtcccaaacctcggccagcagtctggctgagctggaaggtgagcggaccggctgctccagcccagtcatacacagccttgttccgcacccagacagcgcccggaggacagggggctccctgggctgaggaactgctcgctggttggcagtccgctgagctgggcggtctgcactgggggcaggattacgaattcaaggtgcgtccatcaagcgggcgcgcgagaggtcctgattctaacgtgttgctgctgcgcctgcctgaaaaggttcctagcgcaccgccacaggaggtgacgcttaagcctggtaacgggacagttttcgtatcatgggtgcctcctcccgccgagaatcataatggcatcatccgcgggtatcaggtctggtctctcggtaacacctcccttccccctgccaattggactgtggtaggggagcagacccagctggagatcgcaacgcatatgccgggttcctattgcgtccaggttgcagctgttacaggcgctggagccggggagccatccagacccgtgtgtctcctattggagcaggccatggagcgtgccacgcaggaaccctcagagcacggcccgtggaccctcgagcagctcagggccacactgaagagacctgaagttattgccacttgtggcgtggctttgtggcttctcctgctgggcactgcagtatgcattcatcggagacggcgcgcccgcgtccacctcggccccggcctttaccgctacacaagcgaggacgctatattgaaacaccgcatggaccactctgattctcagtggttggcagatacctggagatccactagcgggagcagggatctgtctagcagcagtagtctgagcagtcgcctgggggcagatgctcgggacccactagattgccggcggagtctcctctcgtgggattctagatcgccaggagtccccctgctgccagataccagtacgttttacggcagcctcatcgcggagctccctagcagcacgcctgcacgcccatccccacaggttcctgccgtcaggcgtctcccaccgcagctggcccaactaagctccccatgtagctcatctgattccctttgttctcgccgcggactctctagtccgcgcttgtcgctcgcacccgctgaagcctggaaggccaagaagaagcaggagttgcaacatgcgaatagttcacctctgctgagaggatcacactctctggagctgcgagcctgcgagttaggtaacagagggtcaaagaacctttcccagtcccccggggctgtcccacaggccctcgttgcatggcgagccctcggcccgaagcttctgtcatcgtccaatgagctggtgacgcgccacctgcctccagctcctctcttcccgcacgagaccccacccacacagtctcaacaaactcagccacccgtggcgccacaggccccctcaagcattctcctgcctgcagctcctatcccaatcctgagtccttgctcaccgcctagcccgcaagctagcagcttgtctggtccctctccagcttcaagccgactatcaagtagctctcttagtagccttggcgaggaccaagacagcgtactgactcccgaggaagtcgccctatgcttggagctctctgaaggcgaggaaactcctcgaaattcggtttccccaatgccgagagctcccagccctccaactacctacggctatatcagcgtgcccaccgcgtccgaattcaccgatatgggtcgaaccggaggaggcgtaggcccaaaggggggtgttcttctgtgtccacccagaccttgcctgacgcctactccatcagaagggtctctggccaatggatggggctccgcctccgaggacaatgctgcaagtgcccgcgccagcctggtttctagcagtgacggcagctttctggccgacgcccatttcgcccgcgccttggccgtggctgttgattcgttcggtttcggccttgaacctcgcgaggcggactgtgtctttatagacgcttcatcaccaccaagcccacgagatgaaatttttctcactccaaacctcagcctacccctgtgggagtggcggcctgattggttggaggatatggaggtcagtcacacccagcgtctgggccgcggcatgcccccatggcccccagactcccaaataagtagtcagaggagccaactgcattgtaggatgcccaaagcaggtgcatcaccggttgattacagctag

SEQ ID NO: 133271 - DNA, 2106 bp, Artificial Sequence
  Description of Artificial Sequence: Synthetic coding sequence
atgggttccggaggcgacagcctcttgggcggcaggggcagcctccccctgctcctgctgctgatcatggtattaagagaggattttcaaatccaacccagggacatggtggcggtggtgggcgagcagtttactctcgaatgcgggcctccatggggtcaccccgagccaacagtctcttggtggaaggacggcaagcccctggccttgcagcctggaaggcacacggtatctggtgggagcctgctcatggctagggccgagaaaagcgacgagggaacgtacatgtgcgttgccacgaatagcgcggggcacagagagtcccgtgctgcccgggttagtatccaggagcctcaggactatacagagcccgtggagctgttggccgtcaggattcagctggaaaatgtcacgctcctgaacccggatcctgctgagggaccaaagccgagacctgccgtctggttaagctggaaggttagtggccccgccgcgccagcccagagttatacagcattgttccgcacgcagaccgcacctggggggcaaggcgccccatgggctgaggagttgctcgcagggtggcagtcagcggaactcggcggccttcattggggtcaggactatgagttcaaggtgagacctagcagcggcagggcgcgggggccagacagtaatgtgctgttgttacggttacctgagaaggttccatccgccccgcctcaggaagttactctgaaacccggcaacggtaccgtctttgtatcttgggtgcccccccctgccgaaaaccacaacggaatcattagggggtatcaggtgtggagccttgggaataccagcctaccacccgcaaattggacagttgtgggcgagcagacacagctggaaatcgccacgcacatgcccggttcttattgcgtacaggtggcggccgtcacaggtgccggtgcgggagagccctcccggcctgtctgcctcttgctggagcaagcaatggagcgcgctacacaagaaccaagcgagcatgggccctggaccctggagcaacttagagcaacacttaaacggcccgaggtgattgctacctgtggcgtggccttatggttgttactgcttggcaccgctgtctgcattcacaggcggaggagagcaagagtgcacctgggccccggcctgtatcgttacactagtgaagacgccattttaaagcatcgcatggatcattccgatagccagtggcttgccgacacgtggagaagtacctcgggctctagggacttgtcttcgagtagctcgctttcctctagacttggagcagatgctagagacccgcttgactgcagacggagtttactctcatgggactcgaggtcaccaggcgtgccgctgctcccggatacttctaccttttacggaagcctgatagctgagctgccctcatccacaccagctcgtccaagcccgcaggtgccagcagtcagacggctcccgccgcagctggcccagttgtcatccccatgcagcagctcagactctctgtgctccaggaggggtctgagcagtccaaggctgtctttggcccctgcggaagcttggaaggctaaaaagaaacaggagctgcagcatgcgaactccagtccactcctgcggggctctcactctttggaactaagagcatgcgaactgggcaacagaggtagcaagaatttgagccaaagtccaggcgcagttccacaggcattagtcgcgtggcgtgcccttgggcctaagcttctcagttcttccaacgagctcgttaccagacatctaccacctgctcccctctttcctcacgaaacccctccgacccagtctcagcagacgcagcctcctgtggcaccacaggcaccaagcagcatcctgctgcctgcagctcccattccgatcttaagtccgtgttctccaccatcaccacaggcctcatctctgagtgggcccagccccgcctccagcagactctcatcttcctctctcagcagtctcggcgaagatcaggattccgtgctcactccagaggaggtcgctctatgccttgaattgtcagagggagaagagaccccctag

SEQ ID NO: 133272 - DNA, 2589 bp, Artificial Sequence
  Description of Artificial Sequence: Synthetic coding sequence
atggttgccgttgttggcgaacagtttactctggagtgcggccccccttggggacaccctgagccgacagtcagttggtggaaagatggcaaacccctggcactccaacccgggcggcatactgtgagcggtggaagcctgctcatggctagggcagagaaatcggacgaaggaacatatatgtgcgtcgcgaccaacagcgctggccatcgcgaaagtagagccgctcgggtttcgatccaggaacctcaggactatacagagcccgtggagctgctggcggtcagaatccagctcgagaatgttaccctgctgaacccagatccagccgaaggtcccaaacctcgccctgcagtgtggctgtcttggaaagtgtccggacctgccgcgcctgcccagagttataccgccctgttcagaacgcaaacagctcccggaggtcaaggtgcaccgtgggccgaagaactgctcgcgggatggcagagtgctgagttagggggcctgcactggggccaagactacgagtttaaagtgcgcccctcctccggtcgggcaagaggccccgacagcaacgtgcttctcctgcgtctccctgagaaggtacccagcgcccctccccaagaggtcactttgaaacccggaaatggtactgtttttgtgagctgggtaccaccccctgccgaaaaccacaatgggattattcgcggttatcaggtatggtccctcggaaacacctctctgccccctgcgaactggaccgtagtaggcgagcaaacacagctcgagattgccactcatatgcctggtagttactgcgtccaggttgcagcagtcaccggtgcaggggcaggtgagccatcccgtcccgtgtgtctgttgttagaacaggctatggagcgcgccacacaggagccttccgagcatggcccatggacactcgagcagctgagggccacactgaagaggcccgaggtgatagcaacttgtggtgtggccctttggttactgctgctcggcactgcggtgtgtattcatcgcagaaggagggctagagtgcatcttggacccggactctaccgctataccagcgaggatgctattctgaagcatagaatggaccacagcgactcacaatggctcgccgacacatggcggtccacttctggcagccgggacctctcttctagctcgagcctgtctagccgacttggggcagacgcccgtgaccccctcgactgtcgcaggtcgttattgtcgtgggactcccgttccccaggggtaccccttttgcctgatacctccacgttctacggttcactcatcgcagaactgccctcttccacgcctgccagaccttccccacaggttcctgccgtgaggaggctccctcctcagctggcacagctgagctctccttgctcctcctccgactccctttgctcaagacgtggccttagttccccaagactgtcgctggccccagctgaggcatggaaagccaagaaaaaacaggagctgcagcacgccaactctagtcccctgctgaggggctcacactcgctggaactcagggcttgcgaattgggcaataggggctcaaagaatctttcccagagccccggagcggtgccacaggcccttgtagcatggagggccctgggcccgaagttgcttagtagtagcaacgaacttgtaacccgccatcttccgcccgccccgttatttccacatgaaactcctccaacacagagtcagcagacacagcccccagtggctccgcaggccccctcaagcatccttctgcccgcggctccgatcccgatcctctcgccttgcagccctcctagcccgcaagctagcagtctttcggggcccagtcccgccagctcccggctcagtagttcatcattatcgtcactcggtgaggatcaggacagtgtgctgaccccagaggaagtggccctctgtttagaattatccgaaggcgaagaaacacccagaaattccgtgtctccaatgccaagggccccttccccccccacaacttacggctacatctcagtgcccacagcaagcgagtttaccgatatggggaggacaggaggcggtgtcggccctaaaggaggtgttctcttgtgtcccccccggccatgtctcacgccaacacctagcgagggcagcctcgcaaacggctggggctccgcctccgaagacaatgcagcatccgcccgggcttcactagtctcttctagtgacggaagcttcctggccgacgcccattttgccagggcactcgcagtggccgtagactcttttggattcggtcttgagccgagagaggcagactgtgtgtttatcgacgcgagttctcctccctcgcctagagatgagattttcctcacccccaacctctcattaccgctgtgggaatggaggccagattggctggaggacatggaagtgtcccacacccagaggctgggacgcggtatgcccccatggccaccagactcccagatcagtagccagcggagccagcttcattgtcgcatgccgaaagcgggagcttcccctgtggactacagttag

SEQ ID NO: 133273 - DNA, 3708 bp, Artificial Sequence
  Description of Artificial Sequence: Synthetic coding sequence
atgtctgggccaactgacgagactgccggagatctgccagtgaaggacaccggactaaatttgtttggcatggggggattacaggaaacctctaccacacggacaatgaaatctcggcaggcagtatcccgggtctcgcgcgaggaactcgaagatagattcctgagactgcacgatgaaaatatcctccttaagcagcatgcccgtaaacaggaagacaagatcaagcgaatggcaacaaagctgattcgtcttgtgaatgacaagaagcgctacgaaagagtaggaggaggtccgaagcgtctggggagagatgtggaaatggaggagatgattgagcaacttcaagagaaggtccatgagctggaaaagcagaatgagacactgaagaaccgcctcatctcggctaaacagcagctgcagactcaagggtaccgccagactccttacaataacgtgcagtctagaattaatacaggtcggaggaaggctaacgaaaatgctggtcttcaagagtgcccacggaaagggattaaattccaagacgctgatgtggccgaaactcctcaccccatgttcacaaaatacgggaacagtctcctggaggaggcaagaggcgaaatccgcaacctggagaacgtgatccaatctcagagaggtcaaatcgaagaattggagcatcttgccgaaatactcaagacccagttgcggaggaaggaaaatgaaatagaactgtccctgctacagctaagggaacagcaggcaactgatcaaagatccaacatcagagacaacgtggaaatgatcaaactgcacaagcagctggttgagaagagcaatgcactctccgccatggaggggaagttcatccagctgcaggagaagcaacgaaccttacgaatcagccatgacgcactgatggccaacggtgacgaactcaacatgcagctgaaggagcagaggttgaagtgttgtagtctcgagaagcagctgcactccatgaaatttagcgagcgacgcattgaagaactacaggaccgcatcaacgatctcgagaaggagcgcgagttactcaaagagaactacgacaagttatacgatagcgcgttttcggcagctcacgaggagcagtggaaactgaaggagcagcaacttaaagtgcagatcgcccagctagaaactgccctaaagtctgatctgaccgacaaaacagagattttagatcgcctaaaaaccgagcgcgatcagaatgagaagcttgtccaggagaaccgcgagctgcagctccagtacctggagcagaaacagcagctcgatgagttgaagaaacgtatcaagctgtacaaccaggaaaatgatataaatgcggacgagctcagtgaagccctgctcctgatcaaagcccaaaaggaacagaaaaatggcgacctttctttcttggtgaaagtggattctgaaataaacaaggatcttgaacgatccatgcgagagctacaagcgacacatgccgagacagtccaggaacttgagaaaacccgcaacatgctgatcatgcagcataaaatcaacaaggattaccagatggaagtcgaagctgtaacccgaaagatggaaaacttgcagcaggactatgagttaaaggtagaacagtatgtgcatcttctggatattcgcgcggctcggatccacaagctggaagcccaattgaaggacattgcttacggaaccaagcagtataagttcaagcctgagataatgcctgacgactccgtggacgagtttgacgagactatccatctagagcgcggcgagaacctgttcgaaatccacatcaacaaggtcactttctctagcgaggtgcttcaggcatcaggagacaaggagcccgtgaccttctgcacctacgccttttacgactttgagctgcaaacgactcctgtcgtccggggattgcatccagagtataattttacgtcccagtacctagtgcacgttaatgacttgttcctccagtacattcaaaagaatacaataactctggaggtgcatcaggcttatagtaccgagtacgagactattgccgcttgccaactcaagttccacgagatcttggagaaaagcggccgcattttttgcacagcgtctctaattggcacaaaaggtgatatcccgaatttcgggacggtagagtactggtttcggctgcgggtgcctatggaccaagcaatacgattgtacagagaaagggcaaaggcgctcggatacattacatccaatttcaaaggacccgagcacatgcagtctctgtcccaacaggcccccaagaccgcacagctcagcagtaccgattctaccgatggcaacctgaacgaacttcatatcacaataagatgctgcaatcacttacaatcccgcgcctcacatttgcagccccacccttatgtcgtttataagttctttgatttcgcagatcacgataccgctattataccctccagcaacgatccccagttcgatgaccacatgtacttccctgtccctatgaacatggacttagatagataccttaagagcgagtccctcagcttctacgtgttcgatgactctgacacccaggagaatatatacatcggaaaagtgaatgttcccctgatcagcctggcccacgacaggtgcatttccggaatcttcgagctgaccgatcatcaaaaacacccagctggcacaattcacgtcattctgaagtggaaatttgcctacctcccaccatcaggcagcatcactacagaggacctggggaacttcatcaggtcggaggagcccgaggtggtacaaaggctgcctcctgcgtcatccgtctctactttagtactggccccgaggcccaagccacggcagagactgacccccgttgacaaaaaggtttcttttgttgatatcatgccccaccagagcgatgtatctcaagaggggagcgttgatgaagtgaaagaaaatacggagaagatgcaacaaggaaaggacgatgtgagcctactgtccgaaggacagttggcagagcagagcctggcctcgagtgaggacgaaacagaaataaccgaagacttagagccagaagtggaggaggatatgagtgccagtgattctgacgattgcataatccctgggccgatctcaaagaacattaaacagccttctgaaaaaatcaggatagaaatcattgccctgagcctgaatgactcccaggtaacgatggacgatacaatacaaaggctatttgtggaatgccggttttactctttgcctgccgaagagacacccgtaagtttgcctaagccaaagtcagggcaatgggtgtattataattattccaatgtgatttatgtggataaagagaacaacaaggcaaagcgtgatattctaaaggccatcctgcagaaacaggaaatgcccaacagatctcttcgtttcacggtcgtgagtgacccaccagaggacgagcaggatttggaatgtgaggacatcggagtggcacacgtcgatctcgccgatatgttccaggaaggcagggatctgattgagcaaaacattgatgtgtttgacgcacgcgccgatggtgaagggatcggcaaactgagagttaccgtagaggcactccatgcgctgcagtcagtgtataagcaatatcgggatgatctcgaggcctag

SEQ ID NO: 133274 - DNA, 3948 bp, Artificial Sequence
  Description of Artificial Sequence: Synthetic coding sequence
atgtctggcccaacagatgagactgcgggggatctgccagttaaagacaccggtctgaatctttttggaatgggaggtcttcaggaaacttcaaccactagaacgatgaagagccgccaggcggtgagtcgcgtgagccgagaagagttggaggataggttcctgcggctgcacgatgaaaatattttacttaagcagcacgcacggaagcaggaagacaaaatcaagaggatggcaaccaagctgatccggctggtgaatgacaaaaaacggtatgagagggtgggcggcgggcctaagcgcctgggcagggatgtggaaatggaggagatgattgaacagctgcaggagaaggtgcacgaattagaaaaacaaaacgagaccctgaagaaccgactcatctctgcaaagcagcagcttcaaacacaaggttacagacagaccccctacaataatgtgcaatcacggattaacactggacgcagaaaggctaacgagaatgcaggactgcaagaatgtcccaggaagggcattaagtttcaggacgctgatgtggctgaaaccccccaccccatgttcacaaaatacggtaattcattgcttgaagaagctaggggagaaattcgcaacctggaaaatgtgatccagagtcagcgcggacagatagaagagcttgagcacttggcagagatcttaaagacccagttgcggcgtaaggagaatgagatagaactgagcctcttgcaactcagggagcaacaggccaccgaccagcgttctaacattcgggataacgttgagatgataaagcttcacaaacagctggtagagaaatccaatgccttgtcagcaatggagggaaagtttattcagctgcaggaaaagcagagaacgcttaggatatcacacgatgctctgatggctaatggagacgaactcaatatgcagcttaaagaacagcgactcaagtgttgcagtctcgagaaacagctgcattctatgaagttttccgaaagacgaattgaggagctgcaggatcgaataaacgatctggaaaaagagcgggagctcctcaaagaaaattacgacaaactctacgatagtgcattcagtgccgctcatgaagagcagtggaagctcaaggagcagcaacttaaagtacagatcgcccagctcgaaaccgctttgaagagcgatctgaccgacaagacagagattctagaccggctgaaaactgaaagggatcagaacgaaaagcttgtccaggagaacagagaactccagttacagtacctggaacagaagcaacagcttgacgagctgaaaaagaggattaaactttataatcaggaaaacgatattaacgcagacgaactgagtgaggccctcctactaataaaagctcaaaaagagcagaaaaacggcgacctgtccttcttggtcaaggtcgattccgaaatcaacaaggatctggaacggagtatgcgcgaactccaggcaacacatgctgaaacggtgcaagagctggagaagacaaggaatatgttaattatgcagcacaagatcaacaaggattaccaaatggaggttgaagccgtgacccgcaagatggagaacctgcagcaggattatgagttgaaagtggagcaatacgtgcacttgttggatatcagagctgctcgcatacataaactggaggcacagcttaaggatatcgcatatggtactaaacagtacaaattcaaaccagagattatgcctgacgatagtgtggacgaatttgatgagactatccaccttgaaagaggggagaatctgtttgagatacacatcaataaagtgaccttcagctccgaggtactgcaggctagtggagacaaagagccagtaaccttttgtacatacgctttttacgatttcgagctccagacaactcccgtggtgaggggcctacatcccgagtacaacttcacatcgcagtacttagttcacgtgaacgacctctttctgcaatacatccaaaaaaatactataaccctggaggtccatcaggcctatagcactgagtacgaaaccatcgcagcttgccaactgaaatttcatgagattttagaaaaatccggacggattttttgtactgcctcgctgatcggcacaaaaggcgacatcccaaacttcggcaccgttgaatattggttccggctgcgggtccctatggatcaagccattcggttatatagggagcgagcaaaagctctcggctatattaccagcaactttaagggccccgagcacatgcaatcactatctcaacaggcacccaagacagcccagctgtcatcaaccgactccactgacggtaacttgaacgaactgcacattacaatccgctgctgtaatcaccttcagagccgagcaagtcatcttcagccacatccttacgtcgtgtacaagttcttcgattttgccgaccatgataccgcaattatcccctcatctaacgacccccagtttgatgaccacatgtactttcccgtgccgatgaacatggacctcgatcgttatctcaaatctgagtcactgtcgttttacgtttttgatgattctgatacccaggagaatatttatattggaaaggtcaacgtgccattgatctccttggcacatgataggtgtataagcggcatatttgaactcacagaccaccagaagcatcccgcagggacaatccatgttatcctgaagtggaagttcgcctatctgcctccatccgggtcgataactactgaagatctgggaaatttcattagaagcgaggagcccgaggtggtacagcggctcccccccgcgtcaagcgtaagcacactggtcttagctcctaggccaaagcctagacagagactgacgccggtcgacaagaaggtatcatttgtggatattatgccacatcaatcagacgaaacttccccaccccccgaggatagaaaggagataagtcccgaggttgagcacatccctgaaattgagattaacatgctgactgtaccacatgtgcctaaggtcagccaggagggcagcgtggacgaggttaaagagaatacggaaaaaatgcagcaaggtaaggatgacgtgtcccttctctcagaaggtcagctcgcggaacaatctctggcctctagcgaggacgaaaccgagatcacagaggatctggagccagaagttgaagaggacatgtccgcttctgacagtgacgattgtataatccccggcccaatttccaaaaatatcaagcaaagcttggccctctctccggggttgggctgctctagtgctatctctgcacattgtaacttcagactccccgggtcatcagacttccccgcaagtgcgagtcaggttgatgggatcaccggcgcctgccaccatacacagccatctgaaaaaattcggatcgagatcatcgcgctatccctcaacgactctcaagtgaccatggatgatacaatccagagattattcgtagaatgtcgattttattctctgcctgcggaagagaccccggtcagcctgccgaagccgaaatccggacaatgggtgtactataactattcgaacgtcatttatgttgacaaggaaaataataaggctaagcgagatatcctaaaagccattttgcaaaagcaggagatgcctaaccggagtttgcgctttacggtcgttagtgacccgcccgaggacgaacaggatttggagtgtgaggacataggcgtggctcatgttgatctggccgacatgtttcaagaaggaagggatttgatagagcagaacatagatgtgtttgacgcccgcgctgacggagaaggcatcggcaagctgcgggtgaccgttgaagcccttcatgcccttcaaagtgtgtataaacaatatcgcgatgatctggaagcatag

SEQ ID NO: 133275 - DNA, 1956 bp, Artificial Sequence
  Description of Artificial Sequence: Synthetic coding sequence
atggcagcccctctcctacatacacgactgcctggcgacgccgccgcgagctcttcagctgtaaaaaaacttggggcctctcgcaccggtatttcaaacatgagggccctagagaacgatttttttaattctccccccaggaagaccgtgcggttcggcggaaccgtaacagaagtgctgctcaagtacaagaagggcgaaactaacgattttgaactattgaagaaccaacttttagatccagatataaaggatgatcagattatcaactggcttctcgagtttagatcctcgattatgtatctgactaaagattttgagcagctcatatcaatcatcttgagattaccatggcttaaccggtcccaaacagtggttgaggaatatctcgctttcctgggcaatttggtgtcagctcagacagtattcctgcgcccctgtctgagtatgatcgcaagccactttgtgcccccgagagtgataattaaggagggggacgttgacgtgagcgactccgacgatgaggacgataaccttccagcaaacttcgacacctgtcatcgagcgctacaaatcatcgcacggtatgtgccctcaacaccctggttcctgatgcctatattagtagagaagtttcctttcgtgcgaaaatccgagagaacccttgagtgctacgttcacaatcttctcaggatatcagtttatttcccgacactacgtcatgagatattggagctaattatcgagaaactgctgaagttggacgttaacgcaagcagacagggtatcgaagacgccgaagaaactgcaactcaaacgtgcggtggcacagactcgaccgagggattattcaatatggatgaagacgaggaaacagagcacgagacaaaggcaggacccgaaaggctggaccagatggtgcacccagttgcggagcgccttgacattttaatgtcccttgtgttatcttacatgaaagatgtctgctatgtcgacgggaaagtcgataacggcaagaccaaggatttgtatcgcgaccttatcaatatctttgacaaactcctgctgccgactcatgctagctgccacgttcagttcttcatgttttatctatgttcgttcaaactagggtttgcagaagcttttcttgagcacctgtggaaaaaactgcaagatccctcaaaccccgcgatcatcaggcaggccgccggaaattatataggctcattcctggccagggcaaaattcattcctctgatcacggtaaagagctgcctggatctgttggtgaactggctgcacatctacctgaacaatcaggactctgggacgaaggcattttgcgacgtagccctccatggtcccttctattctgcttgtcaagccgtgttctacacattcgtgtttcgccacaaacaactgctatctggtaacctgaaagaaggcctccagtacctgcagagcttaaactttgagcgtatagtcatgagccaactgaacccactgaaaatttgcctcccatccgtggtgaacttttttgccgctataacaaataagtaccagctcgtgttctgctacaccattattgagaggaataacagacagatgcttccagttatcagaagcacagctggaggtgattctgtgcagatatgcacaaaccccctggatacctttttcccttttgatccatgcgtgcttaagagatccaagaagtttatcgatccaatataccaggtctgggaagacatgtctgccgaagagctgcaggagttcaaaaagcccatgaagaaggacatcgtggaggacgaggatgatgatttcctgaaaggcgaagtgcctcaaaacgacaccgtgattgggataaccccgagctcgttcgatactcactttcgctccccatcctccagcgtggggtcacctccagttctatatatgcagccctctcccctatag

SEQ ID NO: 133276 - DNA, 1857 bp, Artificial Sequence
  Description of Artificial Sequence: Synthetic coding sequence
atgagagccctggaaaacgatttcttcaactcccctccaagaaagaccgtgcgctttggcggtacagtgactgaggtcctgctgaaatataagaagggcgaaactaacgatttcgaactgctgaaaaatcagttactcgaccctgacattaaagatgatcagattatcaattggcttctcgaatttagaagcagcattatgtaccttacaaaggacttcgaacaactgattagtatcattctacgacttccttggctaaaccggtctcagacagtggttgaggagtacctggcgttccttggcaatctggtctccgcccagacagtgtttttaaggccttgtctgtctatgatagcttcacattttgtgcccccacgagtaataatcaaagaaggggacgtggatgttagtgacagtgacgacgaggatgataatcttcccgcaaatttcgatacgtgccacagagcactgcagattatcgcacgctatgtccctagcactccctggtttctgatgccgattctggtggaaaaatttccttttgtgcggaagtctgagcggacactggagtgctatgtgcataatctactgcgaatttccgtctattttcctactctgcgacacgagatcctggagctcatcatcgaaaagttgctcaaactagatgtaaatgcttcccggcagggaattgaggacgccgaggaaaccgccacccagacctgcggcggaaccgactcaaccgaagggctgttcaatatggatgaggacgaagaaacagagcatgaaactaaggctggtcctgaacgcttggatcagatggtgcacccggtggcggagagactcgatatactcatgagtttggtgctgagctacatgaaagacgtttgctacgtggacggaaaggtggataatggcaagactaaggatctgtatcgcgacctgattaatatctttgacaaacttctgctacctacgcatgcgtcttgtcacgttcagttctttatgttttatctctgcagcttcaagctcggcttcgctgaggcgtttcttgagcacctgtggaaaaagctgcaggaccctagtaatccagcaatcatccgacaggctgccggaaattacatcggctctttcttggctagggcaaaatttatccccctgataaccgttaaatcgtgtcttgatttgctcgtgaactggctacatatatacttaaacaatcaagacagcgggactaaggccttctgtgacgtggccctgcatggcccattttactcagcctgccaggcagttttttacacttttgtctttcgtcataaacagctgctctctggtaacttgaaggaaggtcttcagtatttgcagagtcttaactttgaaaggatagtgatgtctcagcttaatcctctgaagatatgcttgcctagcgtggtgaatttctttgctgcgattacaaataagtaccagctggtgttctgctacaccatcatcgaaaggaataaccgccagatgctgcctgtaataaggtccaccgcagggggggattccgtgcagatctgcactaacccactggacactttttttccattcgacccctgcgttctaaaaaggtcgaagaaatttatcgaccccatctaccaggtgtgggaagacatgtctgccgaggaactccaggagttcaaaaagccgatgaaaaaagatatcgttgaggatgaggatgatgactttttgaaaggagaagtcccccagaacgacaccgtaataggcatcacgccatcttcttttgacacccactttaggagcccttcttcttcagtgggctcaccgccagttctttatatgcagccctcccctctttag

SEQ ID NO: 133277 - DNA, 1866 bp, Artificial Sequence
  Description of Artificial Sequence: Synthetic coding sequence
atggcggcaccactgctacacactcggctccccggcgacgccgcggctagctcttccgccgtcaagaagctgggagcatctaggaccggcataagtaatatgagagctctagaaaacgattttttcaatagccccccccgtaaaaccgtgaggtttggaggaaccgtcaccgaagtcctccttaagtacaagaaaggcgaaactaatgatttcgaactccttaaaaaccagctcttggaccctgatattaaacgactcccatggctcaataggagtcagaccgtagtcgaggagtaccttgcctttctggggaacctcgtgagtgcgcagaccgtgtttctgcgcccgtgtctgagcatgattgcctcccactttgtcccacccagagtgataattaaagaaggtgatgtggatgtgtctgacagtgacgacgaggatgacaatctgccagccaatttcgatacctgtcaccgcgccctgcagatcatcgccagatatgtcccttctactccatggttcctgatgccaatcttagtcgagaagtttccttttgtacggaaatcagagcgcactctggagtgctacgtgcataatctactacgtatcagcgtgtattttccaacgctccgacacgaaatattggaacttatcatagaaaaactgctcaagttggatgtgaacgcctcccggcaggggattgaggatgctgaagaaacggccacccagacatgtggaggcacagactctacagaggggctgtttaatatggacgaggatgaagagaccgagcacgaaaccaaggcaggccccgaaaggctcgatcaaatggtccatccagttgccgaacggctagacattcttatgagtctcgtgctgtcctacatgaaggatgtctgttacgtggacgggaaggtggataatggtaagacaaaagacttatatagagacctcataaacatctttgacaaacttttattacctacacatgcgagttgtcacgtgcagttcttcatgttttatctttgttctttcaaattaggcttcgccgaggcattcctcgagcacctgtggaaaaagctccaagaccctagtaatcctgcaatcattcgccaggcagctggcaactacatagggtcctttctggctagagccaaattcattccactgataaccgttaaaagctgcctcgatttgctggtgaattggctgcatatttatctgaataaccaagactctggcacaaaagctttctgtgacgtggctttacacggacccttctattccgcctgccaagctgtcttttacaccttcgtgtttcgccataagcagctgctatcagggaatctgaaggagggcctgcagtacttacagtctctgaattttgagagaatcgtgatgagtcagctgaatcctctcaaaatatgcttaccctccgtggtgaactttttcgccgcgatcaccaacaagtatcagctggtgttttgctatacgatcattgaacgcaataatcgccagatgttgccggttatcaggtctacagccggcggggattcagtgcagatttgcacaaaccctctagatacatttttcccttttgatccttgtgtactcaagcggagcaaaaagtttatcgatccgatctatcaggtttgggaagacatgagtgctgaagagctgcaggaatttaaaaaacctatgaaaaaggacatagttgaggacgaggatgacgattttctgaagggagaggtgccccagaacgacactgttattggcattaccccatcatcgttcgatacgcacttcaggagcccctcctcctcagttggttcacccccagtgctgtacatgcagcccagccctttgtag

SEQ ID NO: 133278 - DNA, 1410 bp, Artificial Sequence
  Description of Artificial Sequence: Synthetic coding sequence
atgattgcatctcatttcgttccccctcgagtgatcatcaaggagggcgacgtggatgttagtgactccgatgatgaggacgacaacctcccagccaatttcgacacctgtcacagagcattacagatcattgccaggtacgttccttccaccccatggttcttgatgccaattttagtggagaaatttccttttgtgagaaagagcgagaggacccttgtgaatgcttctcggcagggcattgaggatgctgaggaaaccgcaacgcaaacgtgcggcggcaccgattctaccgaggggctgtttaatatggatgaggatgaggagaccgagcacgagactaaggccggtccggaaaggctcgatcaaatggtccatcccgtagctgagaggctcgacatactcatgagtctggtattgtcctacatgaaggatgtgtgctatgttgatggcaaagtcgataatgggaagaccaaggatctgtaccgcgacttgattaatatcttcgataagcttttattaccaactcatgcctcctgtcatgtacaattctttatgttttatctgtgcagcttcaagctcggctttgccgaggcctttttggagcacttatggaaaaagttacaggatccatccaatcccgccattattcgccaggcggccggcaactacattgggtctttccttgcaagagccaagtttattccactcatcacagtgaagtcatgtctggacctactagtcaactggctgcacatatatcttaacaaccaggattccggaacaaaggctttttgcgatgtggccttgcatggccccttttattctgcatgccaggctgtgttttacacttttgtctttcgccataaacagctcctgtctgggaatctgaaagaggggctgcagtatctgcagtcccttaattttgaacgcatcgtcatgtctcagttaaatccactcaaaatctgcctgcccagcgtagtgaactttttcgccgccataacaaacaagtaccagctggtgttttgttacactatcatagaacgaaataacaggcaaatgcttcccgtcattcgcagcaccgcaggcggcgactccgtacagatatgcaccaatcctctcgacacatttttcccatttgatccatgtgtgctcaagagatccaagaagtttatcgatcctatttatcaagtgtgggaggacatgtctgccgaagaactgcaggagtttaaaaagccgatgaagaaagacattgtggaagatgaagatgacgacttcctgaaaggcgaggtaccccaaaacgacaccgtgatcggaattaccccctcctccttcgatactcatttcagatccccttcaagttccgtgggaagccctcccgtgctttacatgcagccctcccccctgtag

SEQ ID NO: 133279 - DNA, 792 bp, Artificial Sequence
  Description of Artificial Sequence: Synthetic coding sequence
atgcggctgggcctctgcgtcgtggcactggtcctcagctggacccatctgaccatttcctcacgcggcattaaggggaaaaggcagcgcagaatatccgcagagggatctcaggcctgtgccaaggggtgcgagctgtgttccgaggtgaatggatgccttaagtgtagccctaagctgtttatcctcctcgaaagaaacgatattagacaggtgggggtgtgcctgcccagctgcccacccggctatttcgacgctagaaatcccgatatgaataaatgcatcaagtgtaaaatcgagcactgtgaagcctgcttttcacacaacttttgcactaagtgtaaggaaggcttgtatttacacaaaggccggtgttacccggcctgcccggagggcagctcagccgccaatggcactatggaatgttcaagcccagcccagtgtgaaatgtccgaatggtcaccttggggtccatgctccaaaaagcaacagctctgtggatttaggcgaggatccgaggagcgaacacgtcgcgttcttcacgcacctgttggggaccatgctgcatgtagcgatacgaaggaaacccgaagatgtaccgtgcgccgcgtaccctgcccagagggtcaaaaaagaagaaaaggtggacagggtcgacgtgagaatgcaaataggaatctggcccgcaaggaatcgaaggaagcaggcgccggctctagacgccgaaaaggacagcagcagcagcagcagcagggtaccgtggggccactcacatccgccggacctgcttag

SEQ ID NO: 133280 - DNA, 792 bp, Artificial Sequence
  Description of Artificial Sequence: Synthetic coding sequence
atgcgactgggtctatgcgtggtagcgctggttctcagctggacacatctcacaatatctagccgcggcattaaagggaagcgccagagacggatcagtgcagaaggcagtcaggcctgcgccaaaggctgcgagctctgttcagaggtgaacggctgcctgaaatgcagccccaagctgtttatcctgctggagcggaacgatatccggcaggtcggggtttgtctgccttcctgtcctcctggatactttgatgcaaggaatccagacatgaacaaatgcatcaagtgtaaaatcgaacactgcgaagcctgtttttcccacaacttttgtaccaaatgtaaagagggactgtacctccacaagggcagatgctatccagcctgccccgaggggagcagcgccgcaaacggcaccatggagtgcagctcaccagcgcagtgcgaaatgtctgagtggtcaccctggggtccgtgctccaagaaacaacagctctgcggatttaggcggggttccgaagagcggacaaggcgcgtattacatgcccccgtcggcgaccacgccgcctgtagcgacacaaaggaaacccggaggtgtaccgtacgcagagtgccgtgtcctgaggggcagaaacggaggaagggtggtcaggggagacgtgagaatgctaatcgaaatctcgctagaaaggaaagcaaagaagccggtgcaggcagtcgacgcaggaaaggtcagcagcagcaacagcaacagggcactgttgggcccctgacctcagcagggcctgcctag

SEQ ID NO: 133281 - DNA, 792 bp, Artificial Sequence
  Description of Artificial Sequence: Synthetic coding sequence
atgaggctgggcctctgtgtcgtcgcactcgtgctcagttggactcacctgacgattagtagtcgagggatcaaaggaaaacgccagcgccgcattagtgctgaaggttcccaagcgtgcgccaaaggatgtgagttatgcagtgaggttaatggatgtttgaagtgttcccctaagctgttcatcctgctggagcgtaacgatatccgccaagtgggtgtttgcctgccaagttgtccccctggctattttgatgcccggaacccggatatgaacaagtgtattaaatgcaagattgagcactgcgaagcctgctttagccacaacttctgtaccaagtgtaaggaaggattatacctgcataagggccgctgttacccagcatgccccgaaggctccagtgccgcaaatgggacaatggagtgctcatcccctgcacaatgtgagatgagcgagtggtccccctggggcccttgctctaagaagcagcaactttgcgggttccggagggggagtgaggaacggacacggcgcgtcctgcacgccccagtaggggaccacgctgcatgctccgacacgaaggagactaggagatgtactgtgagaagagtaccctgtcctgaaggacaaaaaagaagaaaaggtggccaaggcagacgtgaaaacgcaaatcgcaacctggctcggaaggaatcaaaggaagcaggcgccgggtctcgacgccggaaggggcagcagcaacagcagcagcagggcacagtcggacctctgacctccgccggcccagcctag

SEQ ID NO: 133282 - DNA, 603 bp, Artificial Sequence
  Description of Artificial Sequence: Synthetic coding sequence
atgaggctcggcctctgtgtagtggcattggtcctttcttggacccacctgactatctcctctagaggcattaagggtaaacgtcagaggaggatctctgctgaggggtcccaggcatgtgcaaagggatgcgagttgtgctcagaagtaaatggatgtctgaagtgttcgccgaagctgttcattctgctggaaaggaacgacattcggcaggtcggagtctgcctaccgagctgtcctcccggttacttcgatgcccgcaacccagacatgaacaaatgcatcaagtgtaagatcgaacactgcgaagcatgtttcagccacaacttttgcactaagtgcaaagaaggtctctacttacacaaaggtcgctgctatccagcctgcccagaagggtcctccgctgctaacggaaccatggagtgctctagccccggacagaaacggaggaaagggggccagggacgacgggaaaatgccaacaggaaccttgctcggaaagagtcgaaggaagccggcgccgggtctaggcgacgtaagggccagcaacagcagcaacagcagggtactgtcgggcccctcacctctgccggccctgcttag

SEQ ID NO: 133283 - DNA, 711 bp, Artificial Sequence
  Description of Artificial Sequence: Synthetic coding sequence
atgatcttcagggtgtctgctgaggggagccaagcctgcgccaagggctgcgaactgtgctcagaggttaacgggtgcctgaagtgcagtcccaagctgttcatcctgctcgagagaaacgatataagacaggtgggggtgtgtctccctagttgcccgcccgggtactttgacgcacgtaatccagacatgaataaatgcatcaagtgcaaaatagagcactgtgaggcttgctttagtcataatttttgtacaaagtgcaaggaagggctctacttacataaagggagatgctacccagcctgccctgaaggatccagcgcggccaatggaacaatggaatgcagtagtccggctcaatgcgaaatgtctgagtggtctccatggggcccctgctctaaaaaacagcaactgtgtgggttcagaaggggatccgaggaaagaacgagacgcgtgctgcacgcccctgtgggtgaccatgctgcttgcagcgacaccaaggagactagaaggtgcaccgtgcgccgcgtgccttgccctgagggacaaaagaggagaaagggtggacaaggtcggcgggagaacgccaataggaatttggccagaaaggagtccaaagaggctggagccgggtctcgcagaagaaagggtcaacagcaacagcaacaacagggcactgtaggtcccctgacctctgcgggccctgcatag

SEQ ID NO: 133284 - DNA, 732 bp, Artificial Sequence
  Description of Artificial Sequence: Synthetic coding sequence
atgcagttccggctcttttcttttgctttaattattctaaactgcatggattactcgcactgccagggcaacagatggagacggtccaagagagcctcttacgttagcaacccaatatgtaagggatgtttgagttgttctaaggacaacgggtgctcaaggtgccaacagaagctatttttctttttgcgtagagaggggatgcgacagtacggtgaatgtctgcacagctgcccaagtgggtactacggccaccgcgcaccagacatgaatcgctgcgctaggtgtagaatcgagaattgtgatagctgcttcagtaaagacttttgcacaaagtgtaaagtgggcttctacctacacagaggacggtgttttgatgaatgtcccgacggcttcgccccgctggaagagaccatggagtgcgtggagggctgtgaggtggggcattggagtgagtggggcacatgctctcggaacaacagaacatgtggattcaaatggggactagaaacccggaccagacagattgtgaaaaaaccagttaaagataccattctgtgcccaacgattgctgaaagccgacgttgcaagatgaccatgcgccactgccccggcggaaagcggacaccaaaggccaaggaaaagagaaataaaaaaaagaagcgcaaacttatcgaacgggcccaagagcagcatagcgtgtttctagcgactgatagggctaatcagtag

SEQ ID NO: 133285 - DNA, 540 bp, Artificial Sequence
  Description of Artificial Sequence: Synthetic coding sequence
atgcagtttcgtctgttttcatttgccctgataatcctcaactgtatggactacagccattgtcaggggaacagatggcgccggagtaaaagggggtgccggatagagaactgcgatagctgttttagcaaggatttttgcactaaatgcaaagtaggattttatctgcacagaggaagatgtttcgatgaatgcccggatggctttgcccctctggaggaaaccatggaatgtgtggggtgcgaagttggacactggtctgagtggggcacatgcagcagaaacaaccgcacctgtggctttaagtggggcctcgaaacaagaacaagacagatcgtgaaaaaacccgtgaaggataccatcttatgccccacgatcgcagaatctcgtagatgtaaaatgaccatgcgccattgtcccggcggaaagcggacacccaaagcgaaggagaagcgaaacaaaaaaaagaaacggaagttaattgagcgggcccaggagcaacactccgtgttcctggctacagatagggcaaaccagtag

SEQ ID NO: 133286 - DNA, 540 bp, Artificial Sequence
  Description of Artificial Sequence: Synthetic coding sequence
atgcagttccggttgttcagcttcgccttaatcatcctgaattgcatggattattctcactgccagggcaatcgctggcgtcggagtaagcgcggttgcaggatagagaactgcgacagctgcttttcaaaagacttttgtacaaagtgcaaagttgggttctatctccatagaggcaggtgctttgatgaatgcccagatggcttcgcacccttagaagaaacaatggaatgtgtggggtgtgaagtcgggcattggtccgagtgggggacttgttcgaggaataaccgcacctgcgggttcaaatggggtctggaaacccgaactagacaaatcgtcaagaagccggtcaaagatacaatcctgtgccccacaattgctgagtcccgaagatgcaaaatgacaatgaggcattgtcccggcggtaagagaacgcccaaggccaaggaaaaacgaaacaaaaagaagaagagaaagcttattgaacgagcccaggagcaacacagcgtgtttttagccaccgatcgagccaatcagtag

SEQ ID NO: 133287 - DNA, 531 bp, Artificial Sequence
  Description of Artificial Sequence: Synthetic coding sequence
atgagacagtatggcgaatgtttacattcttgtccttccggatattatggacacagagcgcccgatatgaatcgatgtgcaagatgtcggatcgagaactgcgattcctgtttcagcaaagacttctgcacaaaatgcaaggtcggcttctatttgcaccgggggaggtgtttcgatgagtgtcctgatggttttgctcccctggaggagacaatggaatgtgtcgagggatgtgaagtcggtcactggagcgagtgggggacatgtagcaggaacaatagaacctgtggcttcaagtgggggttggagaccaggacccgtcagattgtgaagaagcctgtgaaggataccattctctgtccgaccatagcagaatctagacgatgcaagatgaccatgcgacactgcccagggggcaaacgaacccccaaagctaaggaaaaacgaaacaaaaaaaagaagaggaagctgatagagcgcgctcaggagcaacactctgtatttctggctaccgaccgggctaatcaatag

SEQ ID NO: 133288 - DNA, 507 bp, Artificial Sequence
  Description of Artificial Sequence: Synthetic coding sequence
atgcgccagtacggggaatgtcttcatagttgcccatccgggtattatggccatagagccccagatatgaacaggtgtgctcggtgccgaatcgaaaattgtgattcgtgtttctctaaggacttttgcacaaagtgcaaggtgggattctacctgcacagaggcaggtgcttcgacgagtgccctgacggctttgcacccctagaagaaaccatggaatgcgtcgaaggctgtgaggtgggccactggtctgaatggggcacatgcagtaggaacaataggacatgtgggtttaagtgggggctcgagactaggacccgccagatcgtgaaaaaacctgtgaaggacaccattctctgccccactattgctgagtccagacgctgcaagatgacgatgcggcactgccccgggggcaagagaacacccaaagccaaggaaaagcgcaataagaagaaaaaaaggaaacttatcgaaagggcccaggaacagcattcagtattttag

SEQ ID NO: 133289 - DNA, 270 bp, Artificial Sequence
  Description of Artificial Sequence: Synthetic coding sequence
atgaggcagtacggcgagtgcctccactcatgtccgtccggctactatggtcaccgcgcacctgacatgaataggtgtgctaggtgccggatcgaaaattgtgacagctgcttcagcaaggacttctgtacaaaatgcaaggtagggttctacctgcacaggggcagatgttttgacgaatgtccagacgggttcgcccctttggaggagacgatggaatgtgtggagggatgtgaggtgggtcattggtcagagtgggggacgtgttag

SEQ ID NO: 133290 - DNA, 366 bp, Artificial Sequence
  Description of Artificial Sequence: Synthetic coding sequence
atgcaattcaggttgttctcattcgccctgatcatactcaattgcatggattactctcactgccagggtaatcgctggcggcgttcaaaaagggcgtcatacgtaagcaaccctatctgcaagggttgtctgtcgtgttctaaggacaacggttgctctcgctgtcagcagaagctttttttctttcttaggagggaaggcatgcgtcagtacggggagtgcctccactcatgtccttcagggtactatggacaccgggcccctgacatgaaccgatgcgctcgttgccgaattgagaattgtgactcttgcttctccaaggatttttgtacaaagtgcaaagtcggattttacctgcaccggtag

SEQ ID NO: 133291 - DNA, 234 bp, Artificial Sequence
  Description of Artificial Sequence: Synthetic coding sequence
atgcaatttcgccttttttcgtttgcccttattattcttaattgtatggactattcccattgtcagggtaaccgctggagaaggagcaagagagcttcatacgtgagcaaccccatctgtaaaggatgtcttagctgtagtaaggataatggttgctcacgctgtcagcagaaattatttttttttctaaggcgcgaagggatgaggcagtacggtgagtgtctgcatagctag

SEQ ID NO: 133292 - DNA, 1410 bp, Artificial Sequence
  Description of Artificial Sequence: Synthetic coding sequence
atggcctttcttatgcatctgctggtgtgtgtcttcgggatgggctcttgggtcacaattaacggcttgtgggtcgagctccccctgctggtaatggaactgcccgagggttggtatctcccctcatatctgaccgtggtgatccagttagcgaacatcgggccattattggtcacgctgctgcatcactttcgtccgtcctgtttgtccgaggttccaatcatttttacactgctcggagtgggcacagtcacatgtattattttcgcgttcctgtggaatatgacatcttgggtactggacggtcaccattccattgcctttttagtcttgaccttcttcctagccttagtggattgcacgagcagtgttaccttcctcccctttatgagccgtcttcctacttattacctcacgacattctttgtcggagaaggcctttccggcttgctgcctgctctcgtagctctggcgcagggttccggcctcaccacttgtgtgaatgtcaccgaaataagcgactccgtgccttcgcccgttcctacaagagagacggatattgctcagggtgtccccagagccctcgtttctgctctgcctggaatggaggcaccgctatcacatttagaatccagatatttgcctgcacactttagtccacttgtgttttttttactgttgagcataatgatggcctgttgcctggtcgcgttcttcgtgctgcagaggcagccccggtgttgggaggcctcagtggaagatctgctcaacgatcaggttacgttacactccatacgaccacgtgaggaaaatgatttaggacccgctggcactgtggatagtagtcaagggcaggggtacctcgaagaaaaggccgccccttgctgtcctgctcacctggcattcatttataccctggtggcctttgtcaatgccctcacaaacggtatgctgccaagcgttcagacctactcttgcctgagttacggccccgtggcttatcatctggccgccacactgtccatcgtcgctaatcctttggcttctctcgtcagtatgtttctccccaaccggtccttactgttcctgggggtactgagcgtcttaggcacctgtttcgggggctataacatggccatggcagtaatgtcaccttgtccactcctccagggccactggggcggcgaagtcctcatcgtggcatcttgggtgctgttttccgggtgtctgtcctacgtgaaagtcatgctgggggtggtcctccgcgacctgtctcgctcagccctgctatggtgtggggcagccgtgcagctgggctcgctgctgggggccctgctcatgtttccactcgtgaacgtgctgagactcttcagtagcgccgacttttgtaaccttcactgccccgcctag

SEQ ID NO: 133293 - DNA, 519 bp, Artificial Sequence
  Description of Artificial Sequence: Synthetic coding sequence
atgcgagcccctctatgtctgttattattggtggcccacgccgtggacatgttggcccttaatagacgaaagaagcaggtggggacagggctgggcggaaactgtactggatgtatcatctgcagcgaggaaaatggctgttcgacatgccaacagcggctgttcttgttcatcaggagagaagggatacggcagtatggcaagtgcctgcacgactgtccccccgggtatttcggtattaggggccaggaagtgaatcgctgcaagaaatgtggcgccacttgtgaatcctgcttttctcaagatttctgtatcagatgtaagcggcagttttacctgtataagggcaagtgcctaccaacgtgccccccaggcaccttagcccaccagaacacacgggaatgccaggaacgtagtcccggtcagaagaagggcagaaaagacagacgcccacggaaagatcgcaaactggatagaagattagacgtcaggcctcgccaacctggcctccaaccttag

SEQ ID NO: 133294 - DNA, 2133 bp, Artificial Sequence
  Description of Artificial Sequence: Synthetic coding sequence
atgaggggacgcttatgcgtgggcagggccgccgctgcggcagctgctgtagccgtgcccctcgccggcgggcaggagggcagtcccgggggcgggagaaggggctctagaggaaccaccatggtcaaaaaaaggaagggacgtgtggttatagacagcgatacagaggactctggtagcgacgaaaatctagaccaagagttgctgagcctggcaaagcgtaagcgttccgatagtgaggagaaggagcctcctgtatcccagcccgctgcttcttctgatagtgaaacctccgactccgacgacgagtggacctttggaagcaataagaacaaaaagaagggcaaagcccgaaaaatcgagaagaaaggcacaatgaaaaaacaggccaacaaaaccgcctcctccgggagttctgataaagacagtagtgccgaaagctccgctcccgaagagggtgaggtgtctgattcagactccaacagtagcagtagcagctccgatagcgattcatccagcgaagatgaagagttccatgatgggtatggagaagatttgatgggggacgaggaggatagagcacgattagaacagatgactgaaaaagaacgagagcaggagctattcaatagaatagaaaagcgggaggttctgaagcgcagattcgagattaagaaaaaacttaaaaccgccaagaagaaggaaaagaaggagaaaaaaaagaaacaggaggaagagcaggaaaaaaagaagctcacccagatccaggaaagccaagtaactagccataataaagagaggcgctcaaagcgggatgaaaagcttgataagaagtcacaggccatggaggaattaaaagctgagcgcgagaagagaaagaaccgaacagctgaactgctggctaaaaagcaacctcttaaaacaagtgaggtatactctgatgatgaggaagaggaggaggatgacaagtcttccgagaaatctgacaggagctctaggaccagctcctctgatgaagaggaggaaaaggaggaaattccccctaagagtcagcccgtcagtttgcccgaggaactaaaccgggtaaggctgtctaggcacaaactcgaaaggtggtgccacatgcccttctttgctaaaactgtcaccggctgtttcgtgaggatcggcataggcaaccacaactccaagccagtgtacagggtagctgagattaccggagtggttgagacagcgaaggtgtaccagctgggcggtacgagaaccaacaagggcttgcagttgcgccacggcaacgaccaacgggttttcaggctcgagtttgtctccaaccaggaattcaccgagtctgagtttatgaaatggaaagaggcaatgttcagcgcaggcatgcaattgccaacactggacgaaattaacaagaaggaactctccattaaggaggcactgaattacaaattcaacgatcaagatatcgaggagatcgtgaaggagaaagagcgttttaggaaagcacccccaaactacgcgatgaagaaaacacaacttctcaaggaaaaagccatggccgaggatcttggagatcaggataaagctaaacagatccaagaccagctgaacgagctcgaggagagagctgaagctttagataggcagcgaacaaagaatatctcagctatttcttacattaatcagaggaatagagaatggaatattgtagagagtgaaaaggctctggtagccgaatcccataatatgaagaaccaacaaatggatccattcacaaggcgtcagtgtaaaccaactatcgtttctaactctcgcgaccccgctgtgcaggctgccattctcgcccagcttaacgcaaaatacgggtctggagtgcttccagacgcaccaaaagagatgtctaaggggcagggtaaggacaaagatctcaacagcaagtccgccagcgatctctcagaggacctgtttaaggtgcatgattttgatgtgaagatcgacctacaagtgccaagttccgagtccaaagcactggcaatcacttcgaaagctcctccagctaaggacggcgccccccggcggtctctcaacttagaggattataaaaagcgtcgggggcttatttag

SEQ ID NO: 133295 - DNA, 4551 bp, Artificial Sequence
  Description of Artificial Sequence: Synthetic coding sequence
atggatagtccccctaagctcacaggagagacactcatcgttcaccacatcccactagtgcattgccaggttcccgacagacagtgctgtggcggcgccggcgggggaggagggtcaaccagacctaatccgttctgcccaccagagctgggtattactcagcccgaccaggatctcggccaggcagattctctgctcttttcaagcctccacagtacccctggcgggactgctcggagtatcgattcaaccaagtccaggtccagagatggaaggggccccggggcgcccaaaagacacaaccctttcctcttgcaagagggagtgggggaacccgggctgggggacttgtacgatgactcgattggagatagcgccactcagcagtcattccatctgcacggcaccggtcagcccaacttccatctatccagctttcagttgcctccatccggcccccgggtggggagaccttggggcactacccgatccagggccggcgttgtcgaaggccaggagcaggaacccgtgatgacactggatactcaacagtgtggcactagtcattgctgtcgacccgagctagaagccgaaactatggaactggatgagtgcggcggcccgggaggtagcggatctggtggtggtgcttctgacactagtggcttctctttcgatcaggaatggaagctgtccagcgatgagtccccaagaaatccaggctgctctggatctggggaccaacactgccggtgtagtagcacctcgagccagtccgaagcggcagaccagagtatggggtatgttagtgattcaagttgcaacagcagcgatggcgtgttagttacattctctactctatacaacaaaatgcatggtacaccccgagccaatctgaactcggcaccacagtcttgctcagactccagtttctgtagtcactcggaccctggggccttctatctagatctgcagcctagcccatttgagagcaaaatgtcctatgagtcccatcaccctgagtccggtgggagggaaggcggctacggctgcccgcacgctagctcgcctgagctggacgccaattgtaacagctacaggccacactgtgagccgtgtcctgccgtagcggacctaaccgcgtgttttcagtcacaggctaggttagtggtagctacccagaattattataagcttgtgacatgcgacttgagttcccaaagttctccatcacctgcagggtcctcaattacctcatgcagtgaggaacacaccaagatttcaccccctcctgggcccggtcccgatccagggccttcacagccttctgagtactacttgtttcagaagcctgaagtacagcctgaagagcaggaagccgtatcgtcctcaacacaagctgcagcagcagtcggtcccaccgtgcttgagggacaggtgtatacaaacacaagtcccccaaatctgtctaccggtagacagagatcccgctcatacgatcggagcttacagcgtagcccacctgttcgcctcgggagcttagaacgtatgctgtcctgtcctgtgaggctgtcagagggcccagcagcgatggctggacccggatcccctccccgtcgggtaacctcgttcgcagagctggccaaaggacggaagaagactggcggctctggctctccacccctgcgggtttctgtgggcgactcttctcaggaattctctccaatccaggaagctcagcaggatagaggcgcgcccctggatgaggggacgtgttgttcccactctctgcctccgatgcccttgggtcccggtatggacttgctcggccctgatccctctccaccctggagcacccaggtatgtcaggggccccactcaagtgagatgccccctgccggtcttagagccacaggtcaggggcctctggcacagctgatggaccctgggcccgcgctgcccggatccccagccaatagtcatacccagcgggacgctagagcaagagccgatggaggtgggacagaatcccgccccgtgctccggtactctaaagaacaaaggcccacgactctgcctattcaaccatttgtgttccaacaccatttccctaaacaactggccaaagccagagcattgcactctctgagccagctgtatagcctgtctggctgttccagaacccagcagcccgccccactcgcagcccccgccgcacaagtctccgtcccggctcctagtggcgagcctcaggcatctaccccccgggccacagggaggggggccagaaaagctggctctgagcctgagaccagccgacccagtcccctcggctcttacagccccatcaggagcgttggacctttcgggccaagcactgacagcagcgcgtccacgtcgtgctcccccccacccgagcaacctactgctaccgagagcctccccccatggtcccattcctgcccatctgccgtgcggccagctacatcccagcagccccagaaggaggatcagaagatccttacgctcaccgaataccgcctgcatggaaccgggtccctgccccccctgggatcctggcgcagcgggctgtctagggccgaaagcttggctcggggtggaggcgaggggtccatggcaacaaggcccagtaatgcaaatcatctcagtccacaggcacttaaatggcgggagtaccgccggaagaatcccctgggtccccctggcctgagcgggagtctggatcggcggtcccaggaggcacggctggcccgtaggaatcccattttcgagtttcctggctctttgagtgctgcttcccatctcaactgtaggctcaatggtcaagcagttaagccgctgcctctcacctgtcccgattttcaggatccctttagtcttaccgaaaagcctccagcggagttttgccttagcccagacggtagtagcgaggccatcagcatcgatcttctgcagaaaaagggtctggtgaaagcagtcaacatagccgtagaccttattgtggcacattttggtaccagccgggatccaggtgttaaggccaagctcgggaatagctctgtgagcccgaatgtggggcaccttgtgctcaagtacctctgtccggctgtgcgggccgtcttggaggatggtcttaaggctttcgtacttgatgtgattatcggacaaagaaaaaacatgccctggtcagtggttgaagcttctacgcagctgggtccttctaccaaggtactccacggactgtataataaagtgtctcaattccctgagctgacctcgcatacaatgcgatttaacgccttcatccttggactgctgaacattcgtagtctcgagttttggtttaaccacctttacaatcatgaagacatcatccagacacactatcagccatggggcttcctatcagctgcgcatacagtctgcccgggcctgttcgaagaactcctcctgctgcttcagccgcttgcattattgcccttctccctcgacttattatttcaacaccgcctgctccagtctggacagcagcagagacaacataaagagctcctgcgggtgtcgcaagacctgctgctgagcgctcactccacactgcagctagccagggcaaggggacaagagggccctggggacgtggatagggccgcgcagggagagcgggttaagggggtgggagcttccgagggaggtgaagaggaggaggaagaagaagagacggaggaggtggcggaagccgcgggggggtccgggagggcccggtgggccagggggggccaggccgggtggtggtatcagctgatgcagagttctcaggtgtatattgacggcagcattgaggggtcacggttcccccgagggtcctctaacagcagctccgaaaagaaaaaaggtgcagggggtggtggtccaccccaagctccccctcctagggaaggggtggtagagggcgcggaagcctgccccgcgtcggaagaggctctgggcagggagaggggctggccattctggatgggctctcccccggactcagtactggccgagctgagacgtagcagggagagagagggcccagctgcgtcccctgctgagaatgaggagggggccagtgaacccagccctggtgggattaagtggggccacctcttcggatcccgcaaggcgcagcgcgaggcgcgaccgaccaatcgccttcctagcgattggttatcactggacaaatcaatgttccagctcgtggcccagacagtgggaagtcgcagggaaccagaaccgaaagagtctttgcaagaaccacactcccctgccttgcccagtagcccaccctgtgaggtccaggcgctatgtcaccacctcgccacgggacctggtcaacttagttttcacaaaggagatatcctacgtgtgctaggaagggctggcggtgattggctgcgctgctcgcgaggccccgacagtggcctggtgcccctggcttacgtcacgctgacaccgacaccatctccaaccccaggttcatctcagaattag

SEQ ID NO: 133296 - DNA, 4551 bp, Artificial Sequence
  Description of Artificial Sequence: Synthetic coding sequence
atggattccccaccaaagctaaccggggagacccttatcgtccaccacatacccctagtccattgtcaggtgcccgatcgtcagtgttgtggaggagctggtgggggagggggaagtacccgccccaaccccttttgtcctcccgaattggggattactcaacccgaccaggacctgggacaagccgattccctgctgttttcatccttacactccacaccaggaggtacagcacgctctatcgatagtacgaagtcccgatctagggacggccgggggcctggagccccaaagagacataatcctttcctgctgcaagagggcgtgggtgagcctggcctcggggacctctacgacgacagcataggagactctgccacccagcagtcctttcacctacacggtacgggacagcccaacttccatctttcctcttttcaactgcccccttccggaccaagggtgggcagaccatgggggaccacccgtagccgagctggggtggtagaggggcaggagcaagaaccagtgatgactctcgacacgcagcaatgcgggaccagccattgctgtaggcccgaactggaggctgagaccatggaattggacgaatgcggggggccaggaggctcgggtagtgggggcggcgctagcgacacttccgggttttcctttgatcaagaatggaaactgtcttcagatgaatcgcctagaaacccgggttgttcaggatctggagaccagcactgtcggtgttcatctacatcaagccaatctgaagctgctgaccagtccatgggatacgtcagcgatagttcgtgcaacagcagcgatggcgttctggtgactttttccaccttgtacaacaagatgcatggcacgccgcgcgctaacctaaatagcgctccccagtcctgctctgactccagtttctgctctcactccgaccctggtgctttctacctggacctgcagcctagcccatttgaaagcaagatgtcttatgagtctcaccaccctgaatcgggcggtcgcgaaggcggttatggctgccctcacgcctcctcccctgaactcgatgcgaactgtaactcttacaggccgcactgcgaaccttgcccagccgtggcggaccttacagcctgcttccagagtcaggcccgcttggtagtcgctacccagaattattacaaactggtcacttgcgatttatctagtcaatctagtcctagcccagctggcagttctataacttcatgttccgaagagcatactaaaatctctcctcccccaggccctggcccggaccctggcccaagccagcctagcgagtactatttgttccagaagcccgaggtgcagccagaagaacaggaagcagtgtcaagttctacacaagcagccgcagcagttggcccaaccgtcctggaagggcaggtatatacgaataccagtccgcccaatctgagtacaggacggcagaggtctaggtcatacgaccgcagcctgcagcgaagtcctcctgtaaggttgggctctctggagaggatgctgtcctgccccgtgaggctgagtgaagggccggccgctatggcagggcccgggtctccccctaggagagtgacaagtttcgcggagctagctaagggccgcaaaaaaacgggggggagcggcagcccacctctgagggtgtctgtcggggactctagccaggagttctcgccgatccaggaggctcaacaggaccgcggcgcccctcttgatgaaggcacgtgctgcagccacagcctcccacctatgccccttggtcccggcatggatcttcttggtccagacccgtcgcccccctggtctacacaggtctgccaaggcccacattcatcagagatgcctcctgctggtctacgcgcgacgggacagggcccactcgcccaacttatggacccagggcccgcgctgccagggtccccagccaacagccacacacagagggacgctagggcccgcgccgacggcggcggcaccgagtcaagaccagtgttgcgatactcgaaagagcagcgaccgaccactctgccaattcagcctttcgtttttcagcaccacttccccaaacaactcgccaaggctcgggcgctccacagcctgagccaactctattctctgagtggctgctcccgtacgcagcagcccgcgcctctggcagcccctgctgctcaggtttcagttcctgcaccatcaggtgaaccccaggcaagcacaccgagggccacaggacgaggcgcgcggaaagccgggtccgagccagaaacatcccggcctagccctcttggttcttattcccctattcggtctgtcggaccctttggcccttctacagacagctccgcaagcaccagctgttccccgccccctgagcaacctactgccacggagtcgctgccaccctggtcccactcctgccctagcgccgtcagacccgccacctctcagcagccccagaaggaggatcagaagatcctgactttgaccgaatacagactccatggcacaggctcactcccacccctaggctcttggcgctctggtcttagccgtgccgagagcctagcaagaggaggcggtgaggggtcgatggccacacgccctagcaacgccaatcacctgagtcctcaggccttaaagtggagggagtatcgaagaaagaatccactaggaccccctgggctgagcggatccctggatcgcaggtcgcaagaggccaggctggcccgccgcaaccccatttttgaattccccggcagtctgtcagcagctagccatctgaactgtaggttaaacgggcaggccgtgaaaccattacctctgacctgtccggatttccaagatcccttcagcctaaccgaaaagccaccagccgagttttgcctctctccagacggatctagcgaagctatatccatcgatctgctccagaagaaaggcctcgtaaaggcagtgaacattgcggtcgacttgatcgtggctcatttcggcacaagtcgcgacccgggcgttaaagcaaaactcggcaacagctccgtatcaccaaacgtggggcacctggtgctgaagtatctgtgtccagcggttagagccgttttggaggacgggctgaaggcctttgttctggacgtcattatcggccagaggaaaaacatgccttggtctgttgtggaggccagcacccaacttggcccaagcaccaaggtgttgcacggcctctataacaaagtctctcaattccccgaactgacttcccataccatgagattcaacgcgtttatcctgggactcctcaacatcagatctttagaattctggttcaaccacctgtacaatcatgaagacattattcaaacgcactaccagccttggggctttcttagtgcagcccacaccgtatgcccggggttgtttgaggagcttctgctgctattgcaaccgcttgcgttactcccattctccctggacctgctttttcagcacagactccttcaatctggtcagcaacaacgccagcacaaggagttgttgagggtgtctcaggatctgctcctcagtgcacactctacgcttcagctggcccgagcacggggacaagaaggaccaggcgatgtcgatcgggcggcccagggagagagagtgaaaggggtgggagcctctgaggggggcgaagaggaggaagaagaggaagaaactgaggaagtggcggaggccgctggaggctccggcagagcacgatgggctagaggcggccaagctggttggtggtaccagctgatgcagagtagccaagtgtatatcgacggttcaatcgaaggcagcagattcccccgtgggtcttccaactctagtagcgagaagaagaaaggagctggcgggggggggccaccacaggctccaccgcctcgtgagggagtagtggaaggggccgaggcctgccccgccagcgaagaggcactaggtcgcgaaaggggctggcccttctggatgggttcccccccagactccgttctcgccgaactacggagatctcgggagcgtgagggacctgcagcctcaccagccgaaaatgaagaaggcgcttccgagcccagccccggaggaatcaaatgggggcatctctttggaagtagaaaggcacagcgcgaagctagacccacaaatcggctgccctcagactggctctctctggataaaagcatgttccagctagtagcccagacggtgggatctaggcgggagccagaacctaaagaaagcttacaggagccgcactctcctgctttgccttcgtctcccccatgtgaggtgcaagccctctgccaccacctcgccacagggccgggacaactgagtttccacaagggtgatatcctgcgcgttttagggcgggccggaggcgactggctcaggtgttcccgcggccctgattcaggccttgtccctttggcctacgtcacgctcaccccaaccccatcacccacgcctgggtcgagccaaaattag

SEQ ID NO: 133297 - DNA, 2775 bp, Artificial Sequence
  Description of Artificial Sequence: Synthetic coding sequence
atggatagtcccccaaaattgacaggtgaaactttgatcgttcatcatataccactcgtgcattgccaggtacctgataggcagtgctgtggcggcgccgggggcggagggggtagtaccagacccaacccattctgcccgccagaacttggcattacccagccagatcaagatctgggtcaggccgatagcctcttgttctcttcattacacagcacccctggtggaaccgctcgatctatagacagtacgaaatcccggtctcgagacggcagagggcccggagcacccaaaagacataaccctttcttgctgcaggagggggtcggtgaacccggactaggggatctgtacgacgattcaataggcgatagcgcaacccagcaaagttttcatctgcacggcacaggtcagcccaactttcatctttcctctttccagttgcccccaagtgggccccgggtcgggaggccctgggggacgacccggtctagagctggagtggtggaggggcaggagcaggagcccgttatgacccttgacacgcagcagtgcgggacttcacactgctgtcgtcctgagctcgaggccgaaaccatggagctggacgaatgtgggggccctggggggagcgggagcggggggggggctagcgatacttcaggcttctcctttgaccaggaatggaagctctcgtctgatgaatcccccagaaatcctggctgtagcggtagcggcgaccagcactgccgctgttccagtacctcatcacagagcgaagccgccgaccagagcatgggttacgtcagcgattctagttgcaactcctccgacggtgtgctagtgacattctctacattgtacaacaagatgcacggaactccgcgcgcaaacctgaattccgcaccacaatcctgttctgactcatccttctgttcacactcagacccaggagccttttacctggatttacagccaagcccgtttgagagcaaaatgtcctatgagtcacaccaccccgagtccgggggtcgggagggcggctacgggtgtcctcatgcaagctcacccgagttggatgctaattgcaactcctacaggccacactgcgaaccttgccccgccgtggccgatcttaccgcgtgtttccagagccaggccaggttggtggttgcaacccagaactattacaaacttgtgacatgcgatctcagcagccagtctagccccagccccgccggctctagtatcacatcctgctcagaggagcacacaaagatctctccccccccgggacccggccccgacccagggccctctcagcctagtgagtactatttgtttcagaagccagaagtgcaaccagaggagcaagaagccgtcagctctagcacacaggcagccgcggccgtaggtcccaccgtgctggagggtcaagtgtatactaacacaagcccccctaatctatctaccggaagacagaggtcacgtagttacgaccgcagcctccaacggtcgccccccgtgaggttaggtagtcttgaacgcatgttgtcctgccctgttcggctaagcgagggccccgccgccatggccgggcccggttcccctccccggcgagtcacctcttttgcagagttggcaaagggacgtaagaagaccgggggttctggaagtccacccctcagggtttcagtgggagacagtagtcaggagttctcccccattcaggaagcccagcaagataggggggcaccgctcgatgagggaacttgctgttcccactccttacctccgatgccgttgggccctggcatggacctgctgggaccagatccgagccccccatggtcaactcaggtgtgtcaagggccccatagcagtgaaatgccgcctgccgggctcagggctactgggcagggccccctcgctcaattgatggaccctgggcccgccttacccggtagcccagctaatagtcacacccagcgggacgcgagggcaagggcggacggcggaggtactgaatcaagacccgtcctcagatacagcaaagagcagaggcctaccaccctgcctatccagcccttcgtgttccagcatcatttcccaaagcagctggccaaagcaagggcgctgcacagcctttctcagctgtattcactctcgggctgctcacggacacagcagccagctcctttagcagctcctgccgcccaggtcagtgtgccggcccctagtggcgaaccccaggctagcacaccccgcgcaactggcagaggggccaggaaggctggatcagagccagagacctcccggcccagcccgctcgggagttatagcccgatacggagcgtcgggccattcggccccagcacagattcctccgcatccacgagctgctctcccccgcccgaacagccaacggccacagagtctttacccccctggagtcacagctgtccttcggccgtgaggccggctacatcgcagcagccacaaaaagaagaccaaaaaatcctaactctgactgagtatcggctacatgggactgggtcactaccaccgttggggtcctggagaagtggcctatctcgggccgaatctctcgcacgcggcgggggagagggatccatggcaactaggccatccaacgccaatcatctttcaccccaggcgctcaaatggagagagtatcgtagaaagaatcctttgggacctccaggtctcagcggttcactggataggcgatcccaagaggctcgcactgggtag

SEQ ID NO: 133298 - DNA, 591 bp, Artificial Sequence
  Description of Artificial Sequence: Synthetic coding sequence
atgtccatgctcaggttgcaaaaacgcctggcttctagcgtgcttaggtgcggcaagaaaaaggtttggctcgatcctaacgaaacaaatgaaattgcaaacgcaaattcccgccagcagattcgcaagcttatcaaagatgggctcataattcggaagcctgtgactgtgcacagtcgcgctcgctgcaggaaaaatacactggcacgtaggaagggaaggcacatgggaataggtaagagaaagggtactgccaatgcccgaatgcctgagaaagtcacttggatgcgtagaatgcgcattctgagacggcttctgcgtagatacagggagtcaaagaaaatcgaccgccacatgtaccattctctgtatttgaaagtgaaagggaacgtttttaaaaacaaacgcatcctcatggagcatatacacaagcttaaagctgacaaagctcgaaaaaaactcttggcagaccaagctgaggctagacggtccaagacaaaggaggctcgcaaaaggagagaggagcggctgcaagctaaaaaggaagagatcataaaaaccctgagcaaggaggaggaaactaagaaatag

SEQ ID NO: 133299 - DNA, 1341 bp, Artificial Sequence
  Description of Artificial Sequence: Synthetic coding sequence
atggaggccagcttcgtgcagactaccatggctctcggcctgtcctcaaaaaaggccagcagtaggaacgtggccgtggagaggaagaacctaattacagtgtgtaggttctcagtcaagacgctgctggaaaagtataccgcggaaccgatcgacgactcttcagaggagttcgttaattttgccgcgattcttgaacaaattcttagtcacagatttaaggcatgtgctcccgcaggccctgtgagctggtttagttcagatggacagcggggcttttgggattacatcagactcgcttgctcaaaagtaccaaacaattgtgtgtcttccatcgaaaatatggagaacatttcaactgcccgcgcaaaggggcgcgcctggatccgggtggctctgatggagaagaggatgagcgaatatatcaccactgccctgagggacacacgaaccacacggagattttatgactctggcgccattatgttgagggatgaggcgaccattctgacaggaatgttaatcggactcagcgccatcgacttttcattttgtttgaagggcgaggttctggatggaaagacacccgtggtgatcgactacaccccttatcttaaattcacccaatcttatgactacctgaccgacgaggaagaacgacactcagcagaatccagcacttcagaggataacagccccgaacacccatacctcccccttgtgaccgacgaggactcatggtacagcaagtggcataagatggagcagaaatttaggatcgtgtacgcccaaaaaggatacctggaggagttagtgcggctcagagagagccaactgaaagaccttgaggccgaaaatagaaggctacagctgcaactggaagaagcggcagctcaaaatcaaagggagaaacgagagcttgaaggagtgattctggaattacaggagcagctgaccggactgatcccatcggatcacgcacccctggcccagggctctaaggaactgaccaccccccttgttaatcagtggcctagcctgggcacactgaacggtgccgagggcgcaagcaatagtaagctttacaggagacattcatttatgtccacagaaccattgagcgccgaggcctcattgtctagcgattctcaaaggctgggggagggtacacgagacgaagagccttggggtccaattggtaaggatcctacgcccagcatgcttgggttgtgcggttcgctggccagcattccatcatgcaagtccctggcttcttttaaatcgaacgagtgcctcgtctctgacagccctgagggcagccctgctctttcccccagttag

SEQ ID NO: 133300 - DNA, 1371 bp, Artificial Sequence
  Description of Artificial Sequence: Synthetic coding sequence
atgaaaatcgaggaagtgaagtcaacaacaaagacacaacggattgcttcccattcgcacgtcaagggcctgggattggacgaaagtggtcttgccaagcaggcagctagcggacttgtgggccaggagaatgcccgtgaagcttgcggggtgatcgtcgagctcatcaagtccaagaaaatggcaggcagggccgtactgttggccgggccccccggcactggtaagacagcactggcgctcgccattgcccaagagctgggaagcaaggtccccttttgccctatggtgggaagtgaggtgtactccacagagatcaaaaagacagaggtcctgatggagaacttcagaagagctatcggtctgcgcatcaaggaaacgaaagaggtgtacgagggagaagtgaccgagctgactccctgtgaaactgagaacccaatgggcggttacggaaaaaccatctcacatgtgatcatcgggcttaaaactgccaaagggaccaagcagctcaaattagatccgtctatcttcgagtccctgcagaaggagcgggttgaggctggcgacgtaatctatatcgaggctaacagtggtgcggtgaaaagacaaggccggtgcgatacctatgctaccgaatttgacctggaagcagaagagtacgttccactgccgaagggcgacgttcataagaaaaaagagatcatccaggatgtgaccttacatgaccttgacgtggctaacgccaggccgcagggtgggcaggacattctctcaatgatggggcagttgatgaaacccaagaagaccgaaataactgacaagctgcgtggcgaaatcaataaggtcgttaataagtacatcgaccagggcatcgcggagctcgttcccggtgtcctcttcgttgatgaggtccacatgttagatatcgaatgctttacttaccttcacagggcactggaatcatccatcgcgcctattgtgatcttcgcaagcaatcgagggaattgtgtgatccgaggcaccgaggatatcacctccccccatggcatccctctggatctgctcgacagagtgatgattatacgaaccatgttgtataccccgcaagagatgaagcaaattataaaaatccgagctcagaccgaagggattaacatttccgaggaagcgctcaaccacctgggggagattgggactaagaccaccctgagatattcagtgcaactactgactcctgccaacttgctggccaagatcaacgggaaggacagcatcgaaaaggagcatgttgaggagataagcgagctgttttatgacgcaaaatcctccgctaagattttagccgaccaacaagacaaatatatgaagtag

SEQ ID NO: 133301 - DNA, 1161 bp, Artificial Sequence
  Description of Artificial Sequence: Synthetic coding sequence
atgaaaatcgaagaggtcaaatctactactaagacccaacggatcgcatcacactctcacgtcaaaggcctgggactggacgaatccggtctggccaagcaagctgccagcggtctagtgggacaggagaatgcgagagaagcatgtggagtcattgtggagctcatcaagtccaaaaagatggctggtagagcagtcctgctggccggcccccccggaaccgggaagacagctctcgcacttgcaatcgctcaggaactgggctctaaggtgcccttctgccccatggtcggaagcgaggtgtatagcacggaaatcaaaaagaccgaggtgctgatggagaattttagaagggctattgggctgcggataaaagagaccaaagaggtatatgagggggaagtgacggagctaacaccttgtgagacggagaaccccatggggggctacggcaagacaatctcccacgtcatcatcggtttgaagacagccaaaggcacgaaacagcttaagttagatccctcaatcttcgaatccctgcagaaggagagagtggaggccggcgatgtgatatacattgaggccaacagtggggccgtgaaacgacaggggaggtgcgacacatatgcaacggaattcgatttggaggccgaggaatatgtgccattgccaaaaggggacgtgcacaaaaaaaaggaaatcatccaggatgtcacattgcatgacctcgatgtcgcgaacgcacgccctcagggaggacaagacatccttagcatgatgggtcagctgatgaagccgaaaaaaacagaaatcaccgacaagctccggggtgagataaacaaggttgtgaataagtatattgaccagggtattgcagaactggtgcccggagtactcttcgtcgatgaagtacatatgctcgacatcgagtgtttcacctacttgcaccgcgcccttgagagcagcatcgctcctattgtgatctttgccagcaaccgagggaattgtgttatcagggggaccgaggacatcactagccctcacggtataccattggatttactggaccgggtcatgattatcaggaccatgctatatacaccacaagagatgaaacaagtcctctctgccgcggcggacccaggacagctagcttgttag

SEQ ID NO: 133302 - DNA, 2502 bp, Artificial Sequence
  Description of Artificial Sequence: Synthetic coding sequence
atggacgttgtagatcctgacatttttaatagagacccgcgagaccattacgaccttttgcagagactgggcggaggcacttacggagaggtctttaaagccagagacaaggtgtcaggagatctggtggctctcaagatggtgaaaatggagcccgatgatgatgtgtcgacactgcagaaggagattctaattttaaagacctgccggcacgcaaacatcgtcgcttatcatggctcttatctttggctgcagaagctttggatctgcatggagttttgcggagccggaagcctgcaagacatctatcaggttacgggatccttaagtgagttgcagatctcctatgtctgccgggaggtgctgcaaggtctggcgtatctgcattctcagaagaagatccaccgggatatcaaaggcgctaacattttaattaatgacgctggtgaggtgaggctggccgactttggaatcagtgctcagataggggccacccttgcacgccgcctgtcctttatcgggacaccatattggatggccccagaggtggcggctgttgcccttaagggtgggtacaatgaactgtgcgatatatggagtttgggcatcactgccatagagctggcggaactccaaccccctctgtttgatgtgcatcctctccgggtgctgtttcttatgactaaaagcggctaccaacctcctcgacttaaagaaaagggtaagtggagcgccgctttccataactttattaaagtaactttgaccaaatctccaaaaaagagaccgtctgctacgaaaatgcttagtcatcagctggtgtcacagcccggcctcaatcgcgggttgattttggaccttctggacaaactgaaaaatccgggcaaaggaccttcaattggcgatatagaggatgaggaaccggagctgccccctgctatacccagaaggattaggagcactcaccggtccagtagcctaggaataccagacgctgactgctgcaggaggcacatggaatttaggaaattgcgcggcatggagaccaggcctcctgctaataccgctcgcctgcaacctcctagagatctgcgaagctcatccccacgtaaacaattatctgaatcctcggatgacgactacgatgacgtggatatccctacccccgcggaagacacaccaccacctctgcctcctaagcccaaattccgatctcctagcgatgagggtcccggaagcatgggggatgacggccaacttagccccggggtgcttgtgagatgtgccagtggtcccccacctaattctccacgccctgggcctcctcccagtacctcctccccccatctgactgcacatagcgagccttccctgtggaacccaccaagtcgggagctcgataaaccacccctgttgccgcctaaaaaggagaagatgaagcgcaaaggctgcgccctcttggtgaaattgttcaacggatgtccactcagaatccattccacagcagcgtggacccatccaagcactaaggaccagcatctgcttttgggggcagaagaggggatcttcattctgaatcgaaatgaccaagaagcaacccttgaaatgttatttccctcaagaaccacctgggtctattctattaataacgtcctgatgagtctgtcagggaagaccccccacctgtacagtcacagcattttgggcctgctggaacgcaaggaaacaagagcaggaaaccctatcgcacacattagcccccatcgcctcctggccaggaagaacatggtaagcaccaaaattcaagatacgaaaggatgtagggcttgctgtgttgcggagggcgcttcctctggcggccctttcttatgtggggctttagaaacatcggtcgtgttgctgcagtggtaccagcctatgaacaagttcctattagttcgtcaggtcctcttcccacttccgacacctctgagtgtgttcgccttgctaactgggcccggaagcgaactgcccgctgtgtgtatcggcgtgtcacctggtcgtccaggcaaatccgtgctgttccacacagtgaggttcggggccctttcttgctggctgggcgagatgtcaacggaacaccgcggacccgtgcaggtgactcaggttgaggaagatatggttatggtcctgatggatggttctgttaagctcgttacccccgagggctccccagtgcgcggactgcggacacccgaaatccccatgaccgaggccgtggaagccgtcgccatggtgggaggacaactacaggccttctggaaacacggcgttcaggtgtgggccctagggagcgaccagctgttacaggagctacgagaccccacgctgacgtttcggctcttaggatcgccaaggctcgagtgctctgggacgatcagccctcattgcaatcttctgctccctgggtcttctaattctcctgcctcagcaagccgggtagccgggatcaccggcctgtag

SEQ ID NO: 133303 - DNA, 1257 bp, Artificial Sequence
  Description of Artificial Sequence: Synthetic coding sequence
atggtagggcagttggcagcacggcgggctgccggcgttgtgctggagatgataagagaagggaaaatagcaggccgagccgtactgattgccggtcaacccggcacagggaaaaccgcgattgccatgggcatggcccaggccctaggcccagacacccctttcacggcgattgccggttccgagatcttttccctggagatgagcaagacagaagctctgactcaggcattcaggcggagcattggcgtgaggataaaagaagagaccgaaattattgaaggtgaggtcgtggaaatccaaattgacaggcctgccacggggactggctcaaaggtcgggaagctgactctgaaaaccaccgaaatggaaacaatttacgatctgggaactaagatgattgagagtttgaccaaggataaagtgcaagcgggcgatgttatcaccattgataaggcgactggcaaaattagtaaactggggagaagcttcactcgagctcgggattatgatgctatgggctcccagacaaagtttgtgcagtgccccgatggcgaactgcaaaagcgcaaggaagttgtgcacactgtgagcctccatgagattgatgtgattaacagccggacacaggggtttttagccttattttctggagatacaggagaaataaagagcgaagtgagagaacagatcaacgccaaggttgctgagtggcgtgaggagggaaaagctgaaatcatacccggcgttttgtttattgacgaggtgcacatgctcgacatagagagtttttcattcctgaatagggccttagaatccgacatggcccctgtgctgatcatggccaccaaccgagggattactcggatcagaggcacatcataccagtcaccgcatggcatcccaatagatttgctggatcggctgctgatagtcagcacgactccatactcagagaaagataccaagcagattctccgtattcgttgcgaagaggaggacgtcgagatgtccgaggacgcatacaccgttcttacccgtataggcttagaaacaagcttgaggtatgcgattcagcttatcaccgccgcctcactcgtctgcaggaagagaaaaggtacagaggtccaggttgatgatatcaagagggtgtattccctgttcctcgatgagtcacgttccacccaatatatgaaagaatatcaggatgctttcctcttcaacgaattaaaaggagaaactatggatacgtcgtag

SEQ ID NO: 133304 - DNA, 1392 bp, Artificial Sequence
  Description of Artificial Sequence: Synthetic coding sequence
atggctacggtcacggccacaaccaaagtccctgaaattagggatgtaacgcggatcgagcgtatcggcgcccattcgcatataaggggcctcgggcttgacgacgcgctggaaccacggcaagcttcgcagggcatggtcgggcagcttgcagcccgtcgggcggcaggagttgttctggagatgatccgtgaaggtaagatcgctgggagagccgttctaattgcaggtcagcccggcacaggcaagaccgccattgctatgggaatggcccaggcactgggacccgatacgcccttcaccgctatagcggggagcgagatattcagtctggagatgtcaaagacagaggccctcactcaggcatttcggaggagcatcggggtgcgtatcaaggaagaaaccgaaatcatcgaaggcgaggtggttgagatccagatcgatagacctgccaccgggacggggtcgaaggttggcaaacttactctgaaaactactgaaatggaaacaatctacgatctgggtactaaaatgattgagagcctgacgaaggataaggttcaagcaggagatgtgattaccatcgataaagccaccggcaagatttctaagctgggtcggtcattcacaagggcaagggactatgatgccatgggatctcaaaccaaattcgtccagtgccctgacggagagttacagaaacgaaaagaggttgtgcacactgttagcttgcacgaaattgacgtgattaatagtcgtacgcaaggcttcctagcccttttctctggagacacaggggaaattaaatccgaggtgagagaacaaatcaacgccaaagtggccgaatggcgtgaagaggggaaagctgaaatcattccgggggttctgttcatagacgaagtgcacatgcttgatatcgaatccttttcttttctgaaccgagccctcgaaagcgatatggcacctgtcctgatcatggctactaaccggggcatcactcgaatccggggcaccagctaccagagtccccacgggatccctattgatctccttgaccggttgctgattgtaagtaccactccctattctgagaaggataccaagcagattctgcgcatccgctgcgaggaggaagacgtcgaaatgagcgaagacgcctacactgttctcacccgtattgggcttgagacgtcactcagatatgcaattcagctgataaccgcagcctcattggtctgcagaaaaaggaaggggaccgaggttcaggttgatgacatcaagagagtctattcactgttcctggatgagtctaggtccacccaatacatgaaagaataccaggacgctttcttgttcaacgagctgaagggagagaccatggatacaagctag

SEQ ID NO: 133305 - DNA, 15102 bp, Artificial Sequence
  Description of Artificial Sequence: Synthetic coding sequence
atgggagatgctgagggagaagatgaggtccagtttctgcgaaccgatgatgaggttgtgctacagtgctcagccacagtgctaaaggagcagctaaagctctgcttggcagcagaggggtttggcaatcgcttgtgttttctggagccaacaagcaatgcccagaacgtgcccccggacctcgctatctgctgcttcgttcttgagcagtcattgtccgtcagggcattgcaggaaatgctggccaatactgtggaagcaggggtggaaagttcccagggcggagggcataggactctgttgtacgggcatgctatcctgctgaggcatgctcactcccggatgtatcttagttgcctcactacatcccgaagcatgactgataaactggcttttgacgttgggttgcaggaggacgccactggagaggcatgttggtggactatgcatccggcatctaagcaacgcagcgagggagagaaggtgagggtgggggacgacattattttggtcagtgtatcatccgagcggtatcttcacctgagcacagcatccggcgaacttcaggtggacgcatcattcatgcaaaccttgtggaacatgaatcccatttgctcccggtgcgaagagggcttcgtcaccggcggccacgtgttgcgactttttcatggacatatggacgaatgtctcacaatttccccagccgactccgacgaccaaaggcgtctggtatattatgaggggggagctgtgtgcactcacgcccgaagtctgtggagactggagcccctcaggatcagctggagtggaagccaccttcgatgggggcagcctctgcgagttcgccacgtgactacaggtcagtacctggccctgacggaggaccagggcctggttgtggtagacgcgtcaaaggcacataccaaagccaccagcttctgcttccggatttctaaggaaaagctcgatgtagccccaaagcgggatgtggagggcatgggacctccagaaattaagtacggcgagagcctatgtttcgtacagcacgttgcgtctggcctgtggctgacatatgctgcccccgaccctaaggcattaaggctgggcgtgcttaagaaaaaagcgatgttacaccaggaagggcatatggatgatgccctgagtctaacacggtgtcagcaagaagagtcacaagctgcccgtatgattcattctacaaatggactgtacaatcagttcataaagtctctcgattctttctccggtaaacctagggggtctggaccacctgccggtactgccctccctatcgaaggtgtcatcctatctctccaggatcttatcatttactttgagcccccttctgaagacctacaacatgaggagaagcagtccaaacttagatctcttagaaatcggcaatcgttgtttcaagaggaggggatgctttccatggtcctgaattgcatagacaggcttaatgtgtacaccaccgccgctcattttgcagagtttgctggagaggaagctgcggaatcttggaaagaaattgtgaatctgctgtacgaactccttgctagtctgattcgagggaaccgcagcaactgcgcgttattctctactaacctcgactggctggtctccaagctggaccgcctggaggcttcaagcggcatcctggaggttctgtactgcgtgctgattgaatctccggaggtcctgaacattatccaagaaaatcatattaagagtataattagccttctcgacaaacacgggagaaatcacaaagtcttggacgtcctgtgctccctctgcgtgtgtaatggagtcgccgtcaggtcaaaccaagacttaattaccgagaaccttttacctggccgcgaacttttgctccaaaccaacttgatcaattacgtcactagcattcgcccaaatatctttgtagggagggccgaaggcacgactcaatattcgaaatggtacttcgaggttatggtagacgaggtcacaccatttttgactgcacaggcgacccatctgagggtcggatgggcccttacagagggctacacaccttaccctggcgccggtgaaggctggggaggaaacggcgttggcgacgatctgtacagctatggtttcgacggcctccatttatggactggacatgtcgccaggcccgtaactagcccaggacagcacctgctggcgccagaagacgtgatctcatgttgtctcgatctttccgtgccttctatttccttcagaatcaacggatgcccagtgcagggtgtttttgaatctttcaatctggatggtctcttctttcctgtagtgtcgttcagcgctggcgtcaaagtacggttcctactgggagggcggcatggtgaattcaaatttctacctcctccagggtatgcgccttgccacgaggctgttttgccccgcgagagactgcacttggagcctatcaaggagtacaggagggaaggccctcggggaccacacctggtcgggccatctcgctgtttgtctcacaccgatttcgtgccgtgccctgttgatacggtgcagattgtactgccgccacatctcgaacgtattagagagaagctggcggaaaatattcacgagctgtgggccctcaccaggatagagcaggggtggacctacgggccagtgcgggacgacaacaaacggctgcacccctgtctggtagatttccattccctaccagaacccgaaaggaattacaacctgcaaatgagtggagaaactcttaagacactcttagcactaggttgtcacgtgggcatggctgatgagaaggcagaggacaacctgaagaaaactaaactgccaaagacctatatgatgtccaatggctataaaccagcaccgctggacttgtcccatgttcgtcttaccccagcacaaactaccttggtggaccgccttgctgaaaatggacacaatgtatgggcgagagatcgagtgggccagggttggtcctatagtgcggttcaggatattcccgccaggcggaatcctaggcttgtaccctatcgccttctggacgaggcaacgaagagatccaatagggatagcctctgccaagccgttcgaactctgctggggtacggctataacatcgaaccccccgaccaggaaccttcccaggtggaaaatcaatcccgttgcgaccgtgtgcgtatcttccgagctgagaaatcatatacagttcagagcggcagatggtatttcgagttcgaagccgtgacgacgggggagatgagagttggatgggccaggcccgagctgcggccagatgtggagctgggggctgatgagctggcttatgtctttaatgggcaccggggccaacgttggcatctgggctccgagccttttggacggccatggcagccgggggacgtggtgggttgcatgattgacctgacagagaatactattatattcacattaaacggagaagtactcatgtctgactccgggtccgagaccgcatttcgggaaatcgagataggtgatgggttcctgcccgtgtgttcactgggacctggccaggtaggccatctgaacctgggccaggatgtgtcttctttgcggtttttcgccatatgcggactgcaagagggtttcgagccatttgcaattaatatgcagcggccggttaccacatggttttccaagggtctgcctcagtttgagcccgtcccgctagaacatcctcactatgaagtctcccgtgtggatggaacagtggacacacccccttgtttgaggctgactcacagaacctgggggagccagaattcccttgtggaaatgctgtttctcagactgagtctccctgtgcagttccatcagcactttcgctgcacagccggagcaacccccctggcgccacccggattgcagccgcccgccgaagacgaagcccgggcagccgagcccgaccccgactacgaaaatctgagaagatctgccgggggctggagcgaagccgagaatgggaaagagggcaccgccaaggagggcgccccaggcgggaccccgcaggccgggggagaagctcagcctgcccgcgcagagaacgagaaggacgccaccactgaaaagaacaaaaaaagagggttccttttcaaggccaagaaggtcgcaatgatgacacagcctcctgcaaccccgaccttgccacgacttccacatgacgtggtgcctgccgataatagagacgatccagagattattctaaacacgaccacatattattactctgtaagagtgttcgcagggcaggagcctagctgtgtttgggctgggtgggttacgcctgattaccatcagcacgatatgtcttttgacctctcgaaagttcgcgtcgtcacagtaaccatgggtgatgagcaaggaaacgtgcattctagcctgaaatgtagcaactgctacatggtttgggggggtgactttgtcagcccaggtcagcaaggtcggatctcccacaccgatctagttatcggatgccttgtggacctggccactgggctgatgacctttactgccaatgggaaagagtctaatacattctttcaggtcgagcctaacacgaaactgttccctgctgttttcgttctgccaactcatcagaacgttattcaatttgagctgggtaagcaaaaaaatatcatgcccctaagcgccgccatgttccagagtgagcgcaagaatcccgcaccacagtgcccgccccggctagagatgcaaatgctcatgcccgtgagctggtctcgtatgccgaatcattttctgcaggtggaaactagacgagccggcgagcgactggggtgggccgtgcaatgtcaggaacctttgactatgatggctctccatatccctgaggagaacagatgtatggatattctggagcttagcgagcggctggatttacagcgattccactctcataccctccgtctttacagagccgtgtgtgctctcggtaacaatcgtgtcgcgcacgcactgtgttctcacgtggaccaggcccagttgttgcacgccttggaggatgcccacctccctgggcctctacgggcaggctactatgatctgctcatcagtattcaccttgagagcgcatgcaggtctcgacggagtatgcttagtgagtatatagtgccattgacaccggagacaagggctatcacgctctttccccccggaagatccaccgaaaacgggcacccccgacacgggctcccaggagttggtgtgacgaccagtctgaggcccccccaccattttagccccccctgctttgtcgcagccctgcccgcagcgggagcggccgaagcaccggcaagactcagccctgccatcccgctggaagctttgagagacaaggccttgcgcatgctgggcgaggcagtcagggatggaggacagcatgcccgagacccagtgggggggagcgtggaatttcagtttgtaccggtgctgaaactggtcagcaccctactggtaatgggtatctttggagacgaggacgtgaagcagatcttgaagatgattgagccagaagttttcaccgaggaggaggaggaggaggacgaggaagaagagggagaagaggaagacgaggaggagaaggaggaagatgaagaggaaaccgcccaggagaaggaggatgaggagaaggaagaggaggaagcagcggagggcgagaaggaggaggggctggaggagggcctgctccagatgaagttacctgaaagcgtcaaactgcagatgtgccacctcctggaatacttttgcgaccaggagttacagcatagggtggagagcttagctgccttcgccgagagatatgtcgataagctgcaggctaaccaaaggtccaggtatggtctgttgatcaaggcgttctcgatgaccgccgcggagaccgcccgccggacgagagagttcagaagccctcctcaggaacagatcaatatgctcttacagttcaaagacggcactgatgaagaggattgtcctctgcccgaggaaatccgccaggacctgttagactttcaccaggatctcctggcccactgcggcattcaacttgatggcgaagaggaggaacccgaagaggagacaaccttgggctcacgccttatgagtctcctggaaaaggtgcggctggtgaaaaagaaggaggaaaagcccgaggaagaaagaagtgccgaggaaagcaaaccccggtccctgcaagagttagtgtctcacatggtagtgagatgggcccaggaagatttcgtgcagagccctgaactcgtacgcgccatgtttagtttgctgcaccgccagtatgacggcctgggggaactgctgagggccctcccccgcgcctatacaatctccccttcttccgtggaggataccatgtccctgttggaatgcttgggacaaattcgctcattactgatcgtccagatggggcctcaggaggaaaatctcatgatacaatctatcggcaacattatgaacaacaaagtgttttaccaacatccaaacctgatgcgcgccctgggaatgcacgagactgttatggaggtgatggtgaacgtcctcggcggcggggaaagcaaggaaatcagattcccaaagatggttacttcttgttgtaggttcctctgctacttctgccggatcagtcgccaaaaccagagatctatgttcgatcacctgtcttacttactggagaatagcggcatcggactgggcatgcagggatccaccccactggatgtggcagcggccagcgtgattgacaataacgaattggccctggcacttcaggagcaggacctggagaaagttgtgagttacctggccgggtgtgggctgcagtcctgcccaatgctggtcgcaaagggatatccagacataggttggaacccatgcggaggagaacgctatttggattttctccggtttgcggtctttgtgaacggagagtccgtagaagagaacgctaatgtggtggtaaggctactcatccgcaagcccgagtgtttcgggcccgcgctccgcggggaggggggaagcggcctgctggctgctatcgaagaggctatcagaatttccgaagatccagcacgtgatggtccgggtattcgtagggacaggagaagggagcactttggagaagagcctcccgaggaaaacagagttcacctaggccacgcaatcatgagcttctacgctgctctgattgatctgttaggtcgctgtgcccctgaaatgcacctgattcaggctggcaagggtgaagcccttcgaatcagggcaatcctcaggagtctggttccactggaagacctggtgggaatcatctcactgcctctgcaaatccccacgctgggaaaagacggcgctctagtccagccgaagatgagcgcgtcatttgtccccgatcataaggcctccatggtcctgttcctggatcgcgtgtatggcattgagaaccaggacttccttctgcacgttctggatgtcgggtttctaccggacatgcgcgcggctgcttctctagacacagcgacattcagcacgaccgagatggcgctggccctcaaccggtatctatgcctggcggtactaccactcatcaccaaatgtgcccccttgttcgcaggaaccgaacaccgggcaatcatggtggatagtatgctccacactgtgtaccgcctatctcggggtagatccctgacaaaagctcagcgggacgtgattgaggactgtttgatgagtctgtgtagatatattcggcctagcatgcttcagcacctacttcgcagactggtgttcgatgtgccaatcctcaacgagtttgcaaagatgccacttaaactactcactaatcactacgagagatgctggaagtattattgtctaccaacaggctgggccaactttggtgtgacatctgaggaggaactccatttgacccgtaaactcttttggggtattttcgatagcctggctcacaaaaaatatgacccagaattgtatagaatggccatgccttgcctgtgcgcaatagctggcgcactgcccccagattacgtcgacgcttcctattccagcaaggccgagaagaaagcaacagtcgacgctgaaggaaatttcgaccctcgcccagtggagaccctgaatgttataattcccgagaagctggattcattcattaacaagtttgctgaatacactcacgagaaatgggctttcgataaaatccagaataactggagttatggtgagaatatcgacgaggaacttaaaactcatcctatgttgcgaccttacaagaccttttccgaaaaggacaaggagatctatcggtggcctattaaagagtctctgaaggcaatgattgcttgggaatggacgattgagaaagcaagggaaggcgaagaagaaaagacagagaagaaaaagacccggaagatttcccagtctgctcagacatatgacccaagggaggggtataaccctcaaccaccggatctgagcgccgtgactctcagccgcgagctgcaagccatggcggaacagctggccgaaaattaccacaacacctggggacggaaaaagaagcaggaattagaggcaaagggaggtgggacacatccactgctcgtcccctacgatacgctgaccgccaaagaaaaggcgcgcgaccgagaaaaagcgcaagaactcttaaaattcctacaaatgaacgggtatgcagtgacccggggccttaaagatatggagctcgactcctcaagcatcgaaaagcgctttgccttcggattcttgcagcagctcctgcgatggatggacataagccaggagttcatcgcacacctcgaagctgtcgtgtcttctggccgcgtcgagaagtctccgcacgagcaagaaatcaaattctttgcaaagatactgctaccactcattaaccagtatttcacaaaccactgcctttactttctttcaaccccggcgaaggtacttgggagcggggggcatgctagtaacaaagagaaggagatgatcaccagcctgttctgtaagttagcggctctggtaaggcatcgggtgtcccttttcgggacagatgcccctgcagttgtgaactgtctgcatattctggcaaggtcactggatgccagaactgttatgaaaagcgggccagaaattgttaaagccggactacgcagcttcttcgaatccgccagtgaagatatcgagaagatggtggagaaccttagactcggcaaagtcagccaggcccggacccaggttaaaggcgtgggacagaacttgacatacaccaccgttgcgctcctaccggtcctcaccactcttttccagcacatcgctcagcaccagtttggtgatgatgttattctggatgacgtccaggtgtcctgttatagaacactttgttctatctacagtctgggtaccaccaaaaatacttacgtggagaagctgaggcccgctctcggggagtgtctcgcacgcctggcagcggctatgccagtggctttcttggagcctcagctaaacgaatacaatgcatgttccgtttacactacaaagtcaccccgcgagagggctatcctcggcttgcctaacagcgtggaggagatgtgccccgacattcccgtgttggaaaggctgatggctgatattgggggactcgccgagtccggcgcccgctataccgagatgcctcatgtaattgaaataaccctccctatgctctgttcctatctgccaaggtggtgggaaagagggccggaggcgccgcccagcgcacttccggctggtgctccaccaccctgtaccgcagtcacgagtgatcatctcaactccttgctcggcaacatcttgaggattattgtcaacaatctaggcattgacgaagctagctggatgaagcggttggctgtgttcgcccagccaattgtttcacgggccaggccagaacttttgcagagccatttcatccctactatcggccggctcaggaaacgcgctggtaaagttgtgtccgaggaggagcagttgcggttggaggccaaagccgaggcgcaggaaggggagctgctggtgcgcgatgaatttagcgtcttgtgccgagatctgtatgctctgtaccccctcctcatacgttatgtagataacaatagagctcagtggctcactgagccgaatccctccgcagaagaactcttcaggatggtcggtgagattttcatctattggtcaaagagtcataacttcaaaagagaggagcaaaacttcgtcgtgcagaatgagattaacaatatgtcctttttgaccgccgacaataaatctaaaatggctaaatccggcggcagtgaccaggagcggacaaaaaagaaaagacggggcgaccggtactccgtgcagacatccctaatagttgccacactgaaaaagatgttgcccatagggctgaatatgtgcgctcctaccgatcaagaccttattaccctggcaaagacacgatacgccctgaaagacacggatgaagaggtccgagagtttctgcataataatctgcacctccagggaaaagtggaaggctcaccgtcgctccgatggcaaatggctctgtataggggtgttccaggccgcgaggaagacgcggatgatcccgagaaaattgtgagaagggtgcaggaagtttcggcagtgctgtattatctggaccaaacggaacatccgtacaaaagtaaaaaagctgtgtggcataagttgctttctaaacaacgaagaagagctgtggttgcctgtttccggatgacacctctgtacaatctgcctactcaccgggcctgtaatatgtttcttgagtcttataaggccgcttggatattgactgaagaccactcgtttgaagatcgcatgattgatgacctaagtaaggccggcgagcaagaagaggaggaggaagaggtcgaagagaaaaagcccgacccgctgcatcagttagtgcttcatttcagtcggacggccttgacagagaagtctaagttggacgaggactatctctacatggcctatgccgatatcatggccaaaagctgccacctcgaggagggcggcgaaaacggagaagccgaggaagaggtggaagtctccttcgaggaaaagcagatggagaagcagaggttgctctaccagcaggccagactgcacacaaggggtgcagcagaaatggtgcttcagatgatcagcgcttgcaaaggtgagaccggagcaatggtatcgagcacactaaaactcggcatatctattttgaacgggggtaatgccgaagtccagcagaaaatgctggattatttgaaagataagaaagaggtaggcttcttccaaagcatccaggccctcatgcagacgtgttcagtcttggatctgaacgcctttgaacggcaaaataaggccgagggtctaggaatggttaacgaggatggcaccgtgatcaacagacaaaatggggagaaagtgatggctgacgacgaatttacccaggatctgttcagattcctgcagctgctatgtgaaggtcacaataacgacttccagaattacctgcgaacccaaactggaaacactactactatcaatattatcatctgcaccgttgattatctactcagattacaggagtcaatatccgatttttattggtattatagcggcaaagacgtaatagaagagcaagggaaaagaaattttagcaaagcaatgagtgtggccaagcaggtgttcaactcgctgactgaatatatccaggggccctgcactggcaaccagcagagccttgcacacagccggctctgggacgctgtggtgggttttttgcatgtgtttgctcacatgatgatgaaactggctcaggatagctctcaaatcgagctcctgaaggagctgttagatctccaaaaggatatggtcgttatgctcctttccttgctagagggtaacgtcgtcaacggtatgatagcccgccaaatggtggacatgctggtcgaatcttcttccaacgtagaaatgattttgaaattttttgatatgtttctgaaattaaaagacatcgtaggcagcgaggcttttcaagactatgttaccgatcctaggggactcatctcaaagaaagacttccagaaggccatggactcacagaagcagttcagtggtccagaaattcagttcttgctgtcatgttccgaagctgatgagaacgaaatgattaattgcgaggagttcgctaatcgctttcaagagcccgcaagagacattggttttaatgttgcagtgttattgactaacctgtcagagcatgtcccccatgatccacggttacacaatttcctcgagctcgctgagagtatactggagtactttagaccgtacctgggacgaatagaaatcatgggggcaagccggagaatcgagcgaatctacttcgagatttcagagacaaacagggctcagtgggagatgccccaggttaaggagagtaagagacagttcatctttgatgtggtgaatgaaggtggagaggccgagaagatggaactgtttgtttcgttttgcgaagataccatcttcgaaatgcagatcgctgctcagatcagcgagcccgaaggggagccagaaactgatgaggacgagggggcgggggcagcggaagctggagccgagggggcggaggagggagctgcagggctcgagggaactgccgctacagctgccgcaggtgcgacggcccgggtagtggccgcggccgggagagctctgagagggttaagttacagatctcttcgcaggagagtccgccggctccgccgtctgactgcacgggaggccgcaacggctgtcgctgccctgctctgggctgctgtcactagggctggcgctgcgggcgccggcgcagcagccggcgctcttggtctgttgtgggggagcttattcggtgggggtctggtggagggcgccaagaaggtgacggtaacagagctgctggcagggatgccggaccccacatcagacgaggttcacggtgagcagcctgccggacctggcggagacgctgatggcgagggagcaagtgaaggagccggggatgcagcagagggcgccggagatgaggaagaagcagtccacgaagctggcccagggggcgccgatggagctgtggcagttaccgatggcggacccttccggccagaaggcgctggaggcctgggcgacatgggggataccactccagccgagccacccaccccagagggctccccaatcctgaaaagaaagctgggagtcgatggcgtcgaagaggagcttcccccagaaccagagcctgagccagagcccgaattagaacctgaaaaagcagacgcagagaacggcgaaaaggaggaagtcccggaacccacccctgaaccacctaaaaagcaggcacctcctagccccccacctaaaaaggaggaagctggcggcgaattctggggcgagcttgaggtgcagagggtgaagtttctgaactatctgagcaggaacttttacactctgcggtttctagcactcttcctggcattcgccattaacttcatattgctgttctacaaagtcagcgactctccccctggcgaggacgacatggagggatcggctgctggagatgtcagtggcgccggtagcggaggcagttctggatggggactgggggctggagaagaggctgagggcgacgaggacgagaacatggtctattattttctggaggagtccacaggttatatggagccagctctgcggtgtctaagcctactccatacactggtggccttcttgtgcatcattggttataactgccttaaagtcccccttgtgatcttcaagcgagaaaaagagctggctcggaaattggagtttgatggactgtacatcaccgaacaacccgaagacgatgacgtgaaagggcaatgggatcggctggtcctgaacactccatccttcccaagcaactactgggacaaatttgtaaagcgcaaggttctggacaaacacggcgacatttacggccgcgagcggatcgccgagctgctggggatggatctcgccacgcttgaaatcacggcccacaacgagcggaaacccaatcctccgcctggtctgctcacttggctgatgagtatcgatgtgaagtaccaaatctggaagttcggagtaatatttactgacaactcatttctttatctaggctggtatatggttatgagcctgcttggccactacaacaatttcttcttcgcagcacaccttctggatattgcgatgggagtaaagactctgaggacgattttatcctccgtgacacacaacggtaaacagctggtaatgacagtcggcctcctggccgtcgttgtatacctgtatacagtggtcgcttttaacttttttcgcaagttctataataagagcgaagatgaggacgaacctgacatgaaatgtgatgatatgatgacgtgttacctattccatatgtatgtcggggtacgtgccggaggtgggatcggcgacgagattgaggatccggcaggagatgagtacgaactttatcgcgtggtctttgacattacatttttttttttcgtcatagttatattgctggccatcatacaaggtcttatcatcgacgctttcggggagttgcgagatcaacaggagcaggtcaaggaggatatggagacgaaatgcttcatttgtggtatcgggtctgactacttcgataccacgcctcatggttttgagacccacacgctcgaagagcacaacttagcaaactatatgttttttttgatgtatctgattaacaaagatgagaccgagcatacaggacaggaaagctatgtatggaagatgtaccaggagaggtgttgggacttctttcctgccggggattgttttaggaaacagtatgaggatcagctgagctag

SEQ ID NO: 133306 - DNA, 15117 bp, Artificial Sequence
  Description of Artificial Sequence: Synthetic coding sequence
atgggtgacgctgaaggcgaggacgaagtgcaatttctgagaactgacgacgaggtggtccttcaatgcagcgctacagtgttaaaagaacagcttaaactgtgcctcgctgccgaaggtttcggaaatagactgtgcttcttggagcctacaagcaacgctcagaatgtcccacctgatctcgctatatgttgcttcgtgttagaacagagtttgagcgtgcgggccctccaggagatgttagcaaatactgtagaggctggggttgaatcctcacagggaggcgggcatagaacgttgttgtacgggcacgccatccttctgcggcatgcacatagccgcatgtacttgagttgtctgacaacaagtagatctatgaccgacaagctcgccttcgatgtcggattacaggaagacgcaacaggtgaagcttgctggtggacaatgcatcctgcgtctaagcagaggtctgagggtgaaaaagtacgggtgggcgacgacatcattctcgtgagcgtgagttccgagagatacctgcacctttccaccgcttccggggagttacaggtggatgcgtctttcatgcagacgctgtggaatatgaaccccatctgttcacgatgtgaggagggcttcgtgacaggcggccatgtgcttaggctattccacggccatatggacgaatgcctgacgataagtcctgctgactcagatgaccagcgccgacttgtctactatgagggcggcgcggtttgtacccacgcccgaagtctctggcgtcttgagcctctgcggatatcttggtccggctcgcatctgagatggggacagccgctacgggttaggcacgtgacaactggacagtacctcgctctgaccgaagaccagggactggttgtcgtggacgcttccaaagcccacacaaaagccacatcattctgcttccggatatccaaggagaaactcgatgtggctcccaagcgtgacgttgaggggatgggaccccccgagatcaaatacggggagtccctttgtttcgtccagcacgtagcaagcgggctctggctgacatatgccgccccggaccctaaagccttgaggctcggggttctcaagaagaaggcaatgttacaccaggagggacacatggatgacgctctcagtcttacgaggtgtcagcaagaggagtcccaggctgcaaggatgatccacagcactaacggcctgtataatcagttcattaaaagtctggatagctttagtggaaagccccgaggaagcggtccaccagcgggtaccgctttgccaatcgagggcgtgattctatccctccaggacctcattatatatttcgagccaccttccgaagatctgcagcacgaagagaagcagtcaaagcttaggtctctgcgaaacaggcagtcactgttccaggaggagggtatgctctcaatggtgctgaactgcatcgaccggctcaatgtgtacacaacagccgcacactttgctgaattcgccggagaagaagccgccgaatcctggaaagaaattgttaacctcctgtatgaactgctggcctccctcatcagaggcaataggagtaattgcgccctgttcagcactaatctggattggctcgtttctaagctcgatcgtttagaagcaagctcaggcatcctagaggtcctgtattgtgtcctgatcgagtctccagaggttctcaacatcatacaggaaaatcatatcaaatccatcatcagcctattggataagcacggacgcaaccacaaagttctcgacgtgttatgctcactgtgcgtatgtaatggcgtcgcagttcgctccaaccaggatctgatcacagagaatctgttacccgggagagagctgctgctgcaaaccaatttgataaactatgtgacatccatccgcccgaacatcttcgtcggcagggcagagggtacaactcagtattccaaatggtatttcgaggtgatggtggatgaagtaactccattcctaacagctcaggcaacccatctgagagtgggatgggcccttacggaagggtatactccatatcccggagctggagagggatggggtggcaatggggtgggggatgacctgtattcctacggatttgacgggctgcacctgtggacagggcacgtggctagacccgtgacgagtccaggacagcatctcctggcgcctgaggatgtgatttcatgctgcctcgacctgtccgtaccttcgataagtttcaggatcaacggatgtcctgtgcagggggtgtttgagtcctttaacctcgatgggctgttcttccccgtggtcagcttcagtgctggagttaaggtaaggtttctcctcggcggtcgacacggagaattcaagttccttccaccgccagggtacgccccatgccacgaggccgtgctgccccgagaacggctccacctggaacctatcaaggagtatcgtagggaaggcccccgcgggccacacttagttggtccatccaggtgtttgtctcacacagacttcgtcccctgccctgttgatacagtacaaatcgtgcttccaccacatctggagcggatccgggaaaagctggccgagaatatccacgagctgtgggccctgacgaggattgaacagggatggacctacggccccgtgagagatgataataagcgattacatccatgtcttgtggacttccactccctgccagaacccgaacgaaattacaacctgcagatgagcggagagaccctgaaaacactgttggccttgggctgccatgtcggcatggctgatgagaaggctgaggacaatctgaaaaagaccaaactccctaagacctacatgatgtcaaacggatacaaaccagccccccttgatttatctcatgttcgactgacaccagcccaaactaccctggtagatcgactggctgagaatggacacaacgtatgggcccgggacagggtgggccagggttggtcatactctgcagtgcaagacattccggcccggcgtaacccacgcctggttccatatcgactcctcgacgaagccacaaagagaagcaaccgtgacagcttgtgtcaggctgtccgaactcttctggggtacggttataatatcgaacccccagaccaggagccaagtcaggtcgagaatcaatcccggtgtgacagggtgcgcatattccgcgccgagaaaagttataccgtgcaatccggtaggtggtactttgagttcgaagccgtgacaacaggcgagatgcgggtggggtgggcacggcctgagctgcggcctgacgtggagctgggggccgatgaactggcctacgtgttcaacggccaccgcggccagcgctggcacctggggagcgaaccttttggaagaccttggcagcccggcgatgtggtagggtgcatgattgacctgactgagaataccattatatttaccctgaacggcgaagttcttatgagtgacagcgggagcgaaaccgccttcagggaaatcgaaatcggggatgggtttctgccagtgtgcagcctgggtccaggccaggttggccatctcaacctggggcaagacgtgagctctctgaggttttttgcaatctgcggcctccaggaggggttcgaaccattcgccatcaacatgcaaagacccgtcaccacctggttcagcaagggcttgcctcagttcgaacctgtgccgctggagcaccctcactacgaagtaagccgagtggatggcacagtggacactcccccatgtctccgcctcacccatcggacatggggctcacagaactctctggtagaaatgcttttcctaagactatccctgcccgtgcagtttcaccagcacttccggtgcaccgcaggagcaactccgcttgctccccccggactccagcctccggctgaggacgaggccagggccgccgaaccagaccccgattatgaaaacttaaggaggtccgctggtggttggagcgaggctgagaacggcaaagaggggactgctaaagaaggcgctccggggggcacacctcaggccgggggagaagcacaacccgccagggcggagaatgaaaaagatgcaactaccgagaagaataagaagcgcggattcctgttcaaagcaaaaaaggtggcaatgatgactcaaccccccgctactcctaccctgccccgcctgccgcacgacgtcgtgcctgccgacaatcgggatgaccccgagataattctaaacactacgacctactattacagcgtgagagtttttgccggacaggagcctagctgcgtctgggctgggtgggttactccagattatcaccaacacgacatgtcttttgatctgagcaaagttagagtggtgacagttactatgggagacgagcagggcaatgttcactcatccctgaaatgctcaaattgctatatggtctggggtggcgattttgtctcaccgggacagcaggggagaatctcccacacagacctggttatagggtgtctcgtggacctggctacaggcctcatgaccttcacagcgaatgggaaagagagcaatacgttttttcaggtcgaacccaacaccaagctgtttcctgctgtgtttgtactgcctacacatcagaatgttatacagttcgagctgggaaagcagaaaaacattatgcctctgtctgccgcaatgttccagtcagagcggaaaaaccccgcaccccagtgtccccccagacttgaaatgcagatgttaatgccggtgagttggtcccggatgccaaaccatttcttgcaggtggagaccagacgagccggcgagcggcttggatgggccgtgcagtgtcaagaaccacttaccatgatggccctgcacatccccgaggaaaaccgctgcatggatattctggagcttagcgagagattggaccttcagcgcttccacagtcacaccctgcgcctctaccgagctgtttgcgctctcgggaataacagggtggcccacgccctgtgttctcacgtggatcaggcccagctgctgcatgccctcgaagacgcccacttgccagggccattgagagccggatattatgaccttctgatttcaattcaccttgaatctgcctgtagatcacggaggagcatgctctcagagtatatcgttcccttaaccccagagactagggccattacgctgttccccccaggaagatccaccgaaaacggacatcccaggcacgggctcccaggggtcggcgtaacaacctcccttcgccctccccatcatttttccccgccctgttttgtggctgcccttcccgctgctggtgccgctgaggcccctgcgcgtctctctccggctatccccctcgaggcactgagagataaagcattgcggatgctaggggaggccgtgcgggacggagggcaacacgctcgagacccagtgggtggatccgtggagttccagttcgtccctgttctgaaactggtttccacactgctggtcatggggattttcggcgatgaagatgtgaaacaaatcctgaaaatgattgagcctgaggtgttcacagaggaagaggaggaggaagacgaagaagaagagggcgaagaggaggacgaggaagagaaggaagaagacgaagaggagacagcacaggagaaggaggatgaagaaaaggaggaggaggaagctgccgagggtgagaaggaagagggcctagaagaaggcctgttacagatgaagttgcccgaaagcgtaaaactgcagatgtgccacctgctggaatatttttgcgaccaggagctgcagcaccgcgtagaaagtctggctgcctttgccgaaaggtatgtcgacaagctgcaggccaatcagcgcagtcggtacggcctcctgatcaaagcattcagtatgacagccgcagaaaccgcacggaggacacgtgagttccgaagccctccccaggaacagatcaacatgctgttgcagtttaaagatggtacggatgaggaagattgcccgcttcccgaggagattcgccaggatctgttggattttcaccaggacctgctcgcccattgcggtatacaacttgacggcgaggaggaggagcccgaggaggaaacgacattgggttctcgtctgatgagtctcttggagaaggttagactcgtcaaaaagaaggaggaaaaacctgaggaagagcggagcgcggaggagagtaagcctagaagcctccaggaactcgtatcccacatggtcgtacggtgggcccaagaagactttgtccagagtcctgaattggtgcgcgccatgttttctctcctgcaccggcagtacgacgggctgggcgaactcctgcgggcgttaccccgagcgtatactatcagcccctcctcagtcgaagatacaatgagtctgctggagtgcctgggacagattagaagtctactcatcgttcagatgggaccacaggaagagaacctgatgattcagtcaatcggaaacatcatgaacaataaggtattttaccagcatccgaacctcatgcgagccctggggatgcatgagacagtgatggaggtgatggtgaatgtattgggcgggggggagtctaaagagatacggttcccaaaaatggttacatcctgctgtcgatttttgtgttatttctgcaggatctcacggcagaaccagcggtcaatgttcgaccatctgagttacctgttagaaaactccggcataggcttggggatgcaagggtctacccctctcgacgtagcagccgcttccgtcatagataataacgagctcgcactcgctctgcaggaacaggacctagaaaaggtcgtctcttacctggcaggctgcgggcttcagtcttgtccaatgctggtggccaaaggataccctgacatcggctggaatccctgcggcggagagaggtatctggactttctgcggtttgccgttttcgttaacggggagtctgttgaggaaaacgctaacgtggtcgtgcgactgctgatccgtaagcccgaatgtttcggacctgccctgaggggagaaggcgggtcaggactgctggctgcaattgaagaggctatccgcatcagtgaggaccccgccagggatggccctggtattcggcgagacagacgaagagagcattttggggaggagcctcccgaagagaaccgagttcacctgggacatgctatcatgtcattttacgctgccctgatcgacctgctcggccggtgcgcccctgagatgcatttgatacaggccggcaaaggcgaagccctcaggattcgcgcgatcctgcgtagtcttgtcccactagaggacctagtgggcatcatttctcttcccctgcagataccgactctggggaaggatggagccctagtgcagcctaagatgagtgcttcctttgtcccagaccacaaagccagcatggtgttgttcctcgatcgcgtctatgggattgaaaatcaggattttctcctgcacgtgctggacgttggatttcttcccgacatgagagcagcggccagcctggatactgccaccttcagtactaccgagatggctcttgccctgaatcggtatctctgtcttgccgtcctgcctctgatcaccaaatgtgccccactattcgcaggcaccgaacatagggcaatcatggttgactcaatgcttcatacagtgtaccgtttatctcggggcaggagcctcaccaaagctcaacgagatgtgatcgaagattgcctgatgtctttgtgtcgatacatccgaccatctatgcttcaacacctgcttcggaggttagttttcgacgtacctatacttaacgaatttgcaaagatgcccctgaaattactcacaaaccattacgagaggtgctggaaatactactgtcttcccaccggttgggctaatttcggcgtcacctctgaggaggagctgcacctcacccgaaaactgttttgggggatatttgactccttagctcataagaagtacgatcccgagctttacagaatggctatgccctgcctgtgtgcgatcgccggggcactgccgccagactacgtggacgcttcatacagttcgaaagccgaaaagaaagcaaccgtggatgctgaagggaacttcgatccaaggcctgtggagaccctcaacgtgatcataccagagaagctggatagctttatcaacaagttcgctgagtacacccatgagaagtgggccttcgacaaaatacagaataactggtcttacggtgagaatattgacgaggagttgaaaacccatccaatgctcaggccctacaaaacattttccgagaaggacaaagaaatctataggtggcccattaaggagtctttaaaagcgatgatagcttgggaatggacaatcgagaaggctcgcgaaggcgaagaggaaaagacggagaagaagaaaacgaggaaaataagtcagtctgcacaaacttatgatccccgcgaggggtataacccccagccccccgacctcagcgcagtgacactgtcccgggagctacaggcaatggcggagcagctggccgagaactaccacaatacctggggtcggaaaaagaagcaggaactagaggccaaaggcggaggcacccatccattactcgtcccatatgatactctgaccgcaaaagagaaggcaagagaccgagaaaaggcgcaagagttactgaagttcttacaaatgaacggctacgccgtgacaaggggattgaaggacatggagctggattcatccagtattgaaaaacgttttgctttcgggtttctgcagcagctcctaaggtggatggatataagccaggagttcatcgctcacctcgaagccgtagtgtcgagtgggcgggtcgaaaaatctcctcacgagcaggagatcaagtttttcgctaagatcctgcttcctttgatcaatcagtattttaccaaccattgcctgtactttctttctactcctgctaaggtcctcgggtccggaggacatgcttccaacaaagagaaggagatgattactagccttttctgtaagctagccgctctggtgaggcatcgggtgagcttattcgggacggacgctcccgctgtagttaattgtctgcatatccttgcgcgcagtctcgatgcacggacagtgatgaagagcggccccgagatagttaaagccggactacggagcttttttgaatctgcctctgaagacatagaaaaaatggtggaaaacctacgactcgggaaagtgtcccaggcacgaacccaggtaaaaggcgtgggacagaatctcacttacaccactgtggcgctgctacctgtgctaacaacgctgttccagcacatcgcccagcaccaattcggcgacgatgtaatcctggatgatgtccaggtgagctgctatcgtaccctgtgctctatctactctttgggcaccactaagaacacgtacgtggagaaactgagacccgccctgggcgaatgcctcgcccggctcgcggccgcaatgccagtggccttcctggaacctcaacttaatgaatataacgcatgttcagtgtacaccacgaagagtcccagggaacgtgccattctgggtttacctaattccgttgaggaaatgtgtccagatattcccgtgctcgagaggcttatggcagacattgggggtctcgccgagtcgggagcgcgttacaccgaaatgccccatgtcattgagatcactctccctatgctgtgtagctatctcccgaggtggtgggagagagggccggaagcccccccgtccgccctgcctgcaggcgccccccccccctgcacagcagtgacatccgatcacctaaacagcctgcttggcaacatacttagaattattgtgaacaacttgggtatcgatgaagcgagctggatgaagcgcctagctgtctttgcccagccgatcgtgagccgcgccagacccgagctgttgcagtcacattttatcccaacaataggacggctccgcaaaagagcaggaaaggtcgtgtctgaagaggaacagctcagactcgaagcaaaagccgaagctcaagaaggagagcttcttgttcgggatgagttttctgttttgtgtcgtgacctgtacgcactgtatcctctgcttataagatacgtggacaataacagagctcaatggctcaccgaacccaaccctagcgctgaggagttatttcgaatggtcggcgaaatattcatttattggtccaagagccacaatttcaaaagggaggagcaaaactttgtagttcagaacgagatcaataacatgtcttttttgaccgccgacaataagtcaaagatggcaaaagctggcgatatacagagcggtggaagcgatcaagaacgcacgaaaaaaaagcggcggggagacagatactctgtacagacaagtttaattgtcgccaccttgaagaaaatgttgcccatcggattgaacatgtgcgcaccaaccgatcaagacctgattaccctggcgaaaacaagatatgcgctgaaagataccgacgaagaggttcgagagtttctgcacaacaacttgcacctgcagggaaaggttgaagggtcacccagcttgcgttggcagatggctctatatcggggggttccaggacgtgaggaggatgctgatgatcccgaaaaaatcgtaaggcgggtgcaggaagtgagcgccgttctctattacctcgatcagaccgagcacccctacaagtccaaaaaagcagtttggcacaagctgttaagcaaacaacgaaggagggccgtggtggcatgttttcgtatgacccctctatacaacctgcctacccacagggcctgcaacatgtttctggaatcttataaggccgcctggatactaacagaagaccactccttcgaggaccgtatgatcgacgatctctcaaaagccggcgagcaggaggaagaagaagaagaggtggaggagaaaaagcccgatcctttgcatcagttggtacttcacttttccagaacagctctcacggagaaatcaaagctggatgaggattatctgtatatggcttacgctgacatcatggccaaaagttgccatctagaggaggggggcgaaaatggtgaggcggaggaggaggtcgaggtaagcttcgaggagaagcagatggaaaaacaacggctgctataccagcaggctcggctccatacaaggggagcagccgagatggtgctgcaaatgatctctgcatgcaaaggggaaactggggccatggtgtcctctaccctgaaactcggcatctctattctcaatggcggaaacgccgaggttcagcagaagatgctagactatctaaaggataagaaagaagtggggtttttccagagcatacaagccctcatgcaaacctgttcagtgttggacctgaacgcttttgagagacagaacaaggccgagggacttggcatggttaatgaggatggaactgttatcaacagacagaacggtgagaaggtgatggccgacgacgagttcacacaggacttgttccgatttctccaacttttgtgtgaagggcataacaacgactttcagaactatctccgtacccagactggaaatacaactacaattaacattataatctgtacagtggattacctgttgaggctccaggaaagtatttcagatttctattggtattactctgggaaggacgtgattgaggagcagggaaaacggaatttttcaaaggcaatgtctgtggcaaagcaagtcttcaactcactgacagagtatatacaaggtccctgtaccggcaaccagcagtccttagcacactcgagactttgggacgcagtggtcggatttctgcacgtcttcgcccatatgatgatgaaactcgcccaggattcctctcagatcgagctgctcaaagagttattggatctgcagaaggacatggtcgtcatgctgctgtcattactggagggcaatgttgtgaacggcatgatagctcgacagatggtcgatatgcttgtggaatcatcgtccaacgtggagatgatactcaagttcttcgacatgttcctaaaattgaaagacatagtagggtctgaagcattccaagactacgtgaccgaccccagagggcttatttctaagaaagacttccaaaaggcaatggactcccagaaacaattctccgggcctgagattcagttcttgctctcatgtagcgaggctgatgagaatgagatgattaactgtgaggaattcgctaatcgctttcaggagcctgcaagggatatcggtttcaatgtggccgtgctgctgactaacctctcggaacacgtgccacatgacccccgcctgcacaacttccttgaattggccgaatccatcctggaatactttaggccttatctcggtcggatcgagataatgggcgcctctaggagaatagagaggatatactttgagataagtgagaccaatagagcccagtgggaaatgcctcaagtgaaggaatctaagcggcagttcatcttcgacgtcgtgaatgaaggaggtgaggcagagaaaatggagcttttcgtttcattctgtgaagatacaattttcgagatgcagattgcagcacagatttccgagcctgaaggggagccagaaaccgatgaggacgagggcgcgggcgctgctgaggctggagcagaaggggcagaagagggagcggctggattagagggcactgccgctacagcagctgcaggagcgactgctagagtggtggccgccgccggccgagcactcagaggtctctcctaccgcagtctgagaaggagagtcagacgcttgcgtaggctaacggccagggaggcagcaacagccgttgctgcactgctgtgggccgctgtgactagagcaggggccgccggagccggagcagccgccggggccctgggacttctgtggggtagcttgttcgggggtggcctggttgagggggccaaaaaggtgaccgtgacagagttgctggctggcatgccagaccccacttctgatgaggttcatggcgaacagccggctgggcctggcggcgacgcagatggtgagggagcctcagagggggcgggcgatgccgctgaaggagccggtgatgaagaagaggctgtccacgaggcggggcccggcggagccgacggggcagttgccgtgacagacggtggcccttttagacctgagggcgcgggtggactgggcgacatgggcgataccactccagccgaacctcctaccccggagggatccccaattttaaagaggaaactgggcgtcgatggagtcgaagaagagttgccgccagaacctgaacccgaacccgaacccgagctcgagcccgagaaagctgatgcagagaacggcgaaaaggaggaggtgcctgagcctacaccagagccgccgaagaagcaagccccaccaagccctcccccaaagaaggaggaggcagggggcgagttctggggagagctcgaggtgcagagggtgaaatttctgaactatctgtcacgtaacttctacactctgcggtttttggccctcttcctggctttcgcaattaattttatcctgctgttctataaggtttctgacagcccccccggtgaggacgacatggaaggctctgctgctggtgacgtaagcggggcaggttcagggggatcttcaggctggggactgggcgctggggaggaagccgaaggtgacgaagacgagaacatggtgtactactttctggaagaaagtaccggatacatggaacccgccctgcgatgtcttagtctgctgcataccttagtagcattcttgtgcatcattggatacaattgccttaaagtgccactggttatttttaaacgtgagaaagagctcgctcgaaagctagaattcgacggtctgtacatcactgagcagcccgaggacgatgatgtcaaaggccagtgggaccggctggtgctgaacactccaagctttccaagcaattactgggacaagtttgtgaaaaggaaagtgttagacaagcacggtgacatttacggccgtgaacgtatcgcagagctgttgggcatggatctcgcaaccttggagatcaccgctcacaacgaacggaagcctaaccctccaccaggccttttgacctggttaatgtccatcgacgtcaagtaccaaatttggaagttcggggtaattttcactgataatagtttcctgtatctgggctggtatatggtgatgagcctgttaggtcactacaacaatttcttctttgcggctcacctgctggatatcgccatgggcgtcaagaccctccgcacaatactgagtagcgtgactcataatgggaagcagttggtgatgacagtggggctccttgcggtagtcgtgtatctctacacagtggttgcttttaatttcttccgcaaattctataataagtcagaggatgaggacgagcctgatatgaagtgcgacgatatgatgacgtgttatcttttccacatgtatgtgggggtgagggctgggggcgggattggagatgagatagaggaccccgctggagatgaatacgagctttatagggtggtcttcgatatcaccttttttttcttcgtgatcgtgatcttactcgcaatcattcagggcctcatcatcgatgcttttggggaactgagggaccaacaggaacaggtgaaggaagatatggagactaagtgtttcatatgtggaatcgggtctgactactttgacaccacaccacacggcttcgaaacgcacactctcgaggaacacaatctcgcaaactatatgtttttcctaatgtacctgattaacaaagacgagaccgaacacactggccaagagtcttacgtgtggaaaatgtatcaagagagatgctgggacttctttcccgccggcgactgctttcgcaagcagtacgaggaccagctgagctag

SEQ ID NO: 133307 - DNA, 15102 bp, Artificial Sequence
  Description of Artificial Sequence: Synthetic coding sequence
atgggggacgccgagggagaggatgaggtgcagttcctgcgcacagatgacgaggtagtgctgcagtgttcggctactgtgctgaaggagcagctcaaactctgtcttgctgccgaaggtttcgggaaccggctgtgtttccttgaaccaactagcaatgcccagaatgtccctcccgatctagcaatctgctgttttgtcctggaacagagcctttcggttcgagccctgcaggaaatgctcgccaacaccgtagaagccggggtcgaatctagtcagggcggagggcaccggacactcttgtacgggcacgccatcctcctgcggcacgcccattcgagaatgtatcttagttgtctgacgacctcgaggagcatgacagacaagctggcctttgatgtgggattgcaggaagatgccacaggtgaggcctgctggtggactatgcatccggccagcaaacagcggagcgagggagagaaggtcagagtaggagatgacataatcttagtgtctgtgagctccgagcgctacctgcacctgtccaccgcctccggcgaactgcaagtggacgcctcattcatgcagaccctctggaatatgaaccctatctgcagccgctgcgaggaggggttcgtgacaggaggccatgtcctacggcttttccacggccatatggatgagtgcttgaccatttctcccgccgatagcgatgaccagcggcggttggtgtattacgaaggtggcgccgtctgcactcatgctcgatccttatggcgtctggaaccattgaggatctcatggagtggaagtcatctccgatggggacaaccgcttagggtcaggcacgtgaccactggccagtatctcgcccttacagaggaccagggactggtggtagtcgacgccagcaaagcacacacgaaggcgacctctttctgcttcagaattagcaaggagaaactggacgtggctccaaagcgtgacgttgaaggtatgggacctcccgagatcaaatacggggagagtctgtgtttcgtgcagcatgtcgcatctggattgtggctgacctatgctgctcccgatccgaaggccctgagactgggggtgttaaaaaaaaaggcgatgctgcaccaggaggggcacatggatgatgctctgtctttgactcgttgccaacaggaagaatctcaggcagcacgcatgatccactccacgaacggactgtataatcaattcatcaagagcctcgactcgttttccggtaagcctcgaggaagtgggcccccagcgggaacagccttgcctattgagggagtaatcctcagcttgcaggaccttattatctactttgaacccccaagcgaagatttacaacacgaggagaaacagtcgaaactgcgatcactgcgtaaccgtcagagtctgttccaggaagagggcatgctgtccatggtgctcaattgtattgaccgcctgaatgtctacactacggcagcacacttcgccgaattcgcaggcgaagaggcagctgagtcctggaaagagatcgtcaatctgctatatgaactcttagcctcactcattagagggaatcggtccaactgtgccctgtttagtacaaacctggactggctggtgagcaaactagaccgtctggaagcatcatccgggattctggaggtactttactgcgtgctgatagagtcccctgaggtgttgaatatcatccaagaaaatcatataaaaagtatcatctccctgctggacaagcatggccggaaccataaggtattggacgtgctgtgcagcctctgcgtttgtaacggtgttgccgtgagatccaatcaggacctgattaccgaaaacctgttacccggacgggagctattactccagaccaacttgatcaattacgttacatctattcgacccaatatatttgtcggacgagccgagggtaccactcagtattcgaagtggtacttcgaagtgatggtggacgaagtgacaccctttctgaccgcccaagcaactcacctgcgtgtgggatgggccctgactgaggggtacacaccttatcctggggccggggagggatggggcggcaacggagtgggagatgatctttattcttatggctttgacgggctccacttatggacaggacatgtggcccgcccagtgacttctcctggtcagcacctgctggcaccagaggatgtaataagctgctgcctggatctcagcgttccctcaatcagttttaggattaatggttgccccgttcagggcgtgttcgagtccttcaacttggatggtctgttctttccagtggtaagctttagcgcgggcgtcaaagtccgctttctgcttggagggaggcacggcgagtttaagtttctgccccctcctggctacgccccatgccacgaggccgtgctcccgagggagaggctgcacctcgaacctattaaagagtatcgcagagaggggccccgcggcccccaccttgtgggcccctccaggtgtctgagtcacacggattttgttccctgcccagtggataccgttcagatcgtgctgcccccccatctggaacgtatccgcgagaaattagccgagaacattcatgaactgtgggcgctgactaggattgagcaggggtggacatacgggcccgtgagggacgataataaacgcctgcacccttgtcttgtggacttccacagtttgcctgagccggagcggaattacaacttgcagatgtctggcgaaacactcaagacattactagcactaggatgtcacgtgggaatggcggacgaaaaggcggaagacaatctgaaaaagacaaaattgcctaagacttatatgatgagcaacggctacaagcccgcaccactggatttatctcacgtaaggctgacacctgcccagaccactctcgtggatcggctcgccgagaacggacacaatgtgtgggcaagggatcgagttggtcagggctggtcatacagcgccgtgcaggatattcctgctaggaggaatccgcggctcgttccgtatcgccttctggatgaggcaacgaagaggtccaaccgggactccttatgccaggcggtgagaacactgctgggctatggctacaatattgagccaccagaccaagagccttctcaggtagaaaatcagtctcgctgtgatcgcgtcaggatatttcgtgctgagaagtcgtataccgtgcagtctggcaggtggtatttcgagtttgaagccgtgactacaggagaaatgcgcgtcggctgggctcgccctgaactgcgccctgatgtcgagctaggcgccgatgagttggcatatgtgtttaatgggcatcgtggccagaggtggcatctgggatcagaaccttttgggaggccttggcagcccggggacgtggtggggtgtatgatcgacttaaccgagaatactattattttcacactgaacggcgaggtgctcatgagcgacagcgggtctgagaccgccttcagggaaattgaaataggagacggatttctgcctgtgtgctccctgggccctggccaggtcgggcatctgaatctggggcaggatgtcagctctctgagattttttgcaatatgcggcttgcaggaaggcttcgagccgtttgccatcaacatgcagcggcctgtcacaacatggttctcaaaagggctcccgcagttcgagcctgtccctttagaacacccccactacgaagttagcagagttgacggaaccgtagataccccgccctgcctacgattgacccatagaacctggggatcacagaactctctggtcgagatgctgttcctgaggctctcactgcccgtccaattccatcagcacttccggtgcaccgcgggagctacacccttggctccaccgggactgcaaccccctgccgaagacgaggccagagccgcagaacctgatccagactatgagaacctgcggagaagtgctggcggatggtcagaagctgaaaacggcaaagaagggacagctaaggaaggggcacccggggggaccccccaggcgggaggtgaagcccagcccgctagagccgaaaatgaaaaagacgctaccacggagaagaataagaagcgtggcttcttgtttaaggctaagaaggtggcaatgatgacacaaccacctgcaaccccgactctgccccgactaccgcacgatgtagtccccgcagataaccgggacgatcccgaaatcattttgaatacaacaacctattactactcagtgagagtgttcgctggccaagaacctagctgcgtgtgggctggctgggttaccccagactatcatcagcatgatatgtcttttgatctcagcaaagtccgggtcgttacggtaactatgggcgacgaacagggaaatgtgcactccagcctgaagtgtagcaactgttacatggtttggggcggagacttcgtttcaccagggcagcaggggcgtatctcacataccgaccttgtaatcggatgcctggtggatcttgcaactggtctgatgacattcaccgctaatggaaaggagagtaatacattcttccaggttgagcccaacactaagctctttccggcggtttttgtgctcccgacacatcaaaacgtgattcagttcgagttaggcaagcagaagaatattatgcccttgtctgcagccatgttccagtccgaacgcaaaaatccagcgccccagtgccctcctaggctggagatgcagatgctgatgcctgttagctggtctaggatgcctaaccattttctgcaggtagagactcggagggccggggaacggctcggatgggccgtgcagtgccaagaaccactaacgatgatggccctgcatatcccagaggaaaataggtgcatggacatcctggagctcagtgaacggcttgatctgcagagatttcactcacacacccttcgcctgtatcgggctgtttgcgccctcggaaataacagagtggcccacgccttatgctcccacgtcgaccaggctcaactgttgcatgctctggaagatgctcatctccctgggccactgagagccggttactatgatctgttaatcagcatccacctcgagtccgcttgtcggtcccgccgcagcatgctatcagagtacatcgtcccactcacacccgagacgcgggccataacactgtttccacccggtcgctcaaccgaaaacggccaccctcgccacggactgcccggtgtgggagttaccacgtccctccgaccccctcatcatttttctcctccctgcttcgtggccgccctcccagccgccggcgcggctgaagcaccggcgcggttgagccctgcaattcctctggaggcgttaagagacaaagcacttcgcatgctgggggaggccgtacgagacggcggacaacacgctcgagaccctgtgggtggctccgtcgagtttcagttcgtgccggtgttaaaacttgtgtcaactcttttggtgatggggatatttggcgacgaagacgtgaagcagattctcaagatgattgagcctgaggtgttcacagaagaggaagaagaagaagacgaagaggaggagggggaagaggaggatgaagaggagaaggaagaagatgaagaggagactgctcaagaaaaggaagatgaagagaaagaggaggaggaggcggctgagggggagaaggaggaaggtctcgaggagggcctcctgcagatgaagttgcccgaatcagtcaagctgcagatgtgccatcttctggagtacttttgtgatcaagaactgcagcaccgggtggagtccctggccgcttttgctgagcgatacgtagataagctgcaggcaaaccagaggagccggtatggcttgttgataaaagccttctcaatgaccgcagccgagacggctagacggactagagagttcagaagtccccctcaggaacagattaacatgttgctccagttcaaggatgggacagacgaagaggactgcccgctgccagaggaaatccggcaggatctgctcgatttccaccaggacttgctggctcactgcggaatccagttggacggggaagaggaggaacctgaggaagagacgaccctggggagcaggctcatgtccctgctcgagaaggtccgccttgtcaaaaaaaaagaagagaaacctgaagaagaaagatccgcagaagaatcaaaaccacggagtttgcaggagttagtttctcacatggtggtaaggtgggcacaggaggactttgtgcagtctccagagctcgtgcgggcaatgttctcactgctgcataggcagtacgacggtctcggtgagctgcttcgggccctgccccgggcctatacgatcagtcccagcagtgtagaggacacaatgagcctgctagagtgccttggtcaaatacgatcacttctgattgttcagatgggtcctcaggaagaaaatctcatgattcagtctatcggaaatattatgaataacaaggtgttctaccaacaccccaatctgatgcgggctttaggcatgcatgaaactgtgatggaggttatggttaatgtgcttgggggcggcgagtcaaaagaaattcggttcccaaagatggtaacctcttgctgtcgcttcctttgctatttctgtcgcatcagccggcagaatcagagatcaatgttcgaccacctttcatatctgctggaaaactccgggatcggactcggtatgcagggttcaacacccctggacgtggcggccgcctctgtgatcgacaacaatgagctggcgctggctttgcaggagcaggacttagaaaaagtggtgtcctatctggcaggctgcggattgcaatcatgtcctatgctggttgccaaaggctatcctgatatcggatggaatccttgtggcggggaacggtatttagatttcctccgcttcgcagtgttcgtgaatggggagtcagttgaagaaaacgcaaatgtggtcgtgagactgctcatacgaaagcctgagtgcttcggtccagccctgaggggggaaggagggtcgggcctcctcgccgccatcgaggaagcgatcaggatctcggaggaccctgctcgggatggcccaggcattcgtagggaccggaggagggagcatttcggagaagaaccgccagaagagaacagggtgcatctcggccatgccattatgtccttttatgctgccttgattgacctgttaggcaggtgtgcgccagagatgcaccttattcaagcagggaaaggagaggcattaaggatacgtgctattctccgttcactggtccccctggaagacctagtgggtatcatttcgcttcctctgcaaataccaactctcggcaaggatggggctctcgtgcagcctaaaatgtccgcttcttttgtgcctgaccataaggcatctatggttctcttcctggacagggtgtatggcatcgaaaaccaggatttcctgcttcacgttctggatgttggatttctccccgacatgcgagcagccgccagccttgacacggccaccttttcaactaccgaaatggcactagctctgaatcgatatctgtgcctggctgtgttaccgctgatcacgaaatgtgcccccctcttcgccggcaccgagcaccgtgccatcatggtggactccatgcttcatactgtctacagactgtcacgcggtcgtagcctgacaaaggctcaacgggacgtgatagaagattgcctcatgtcgttgtgtcggtacatacggccttctatgctgcagcatctcttgcggcgtctggtttttgacgtacccattcttaacgaattcgctaagatgccactcaaactcttaactaatcattatgaaagatgctggaaatattactgcctccctactggctgggctaacttcggcgtgactagtgaagaggagctccacctgacaagaaagctgttctgggggattttcgacagcctggcccataaaaagtatgaccccgagctgtaccgaatggccatgccttgtctgtgcgccattgccggagccctgcctcctgactatgtggacgctagctattcctctaaggcagagaaaaaggccacagtcgacgcagaaggcaactttgacccaagacccgttgagacccttaatgtgataattcctgaaaagctggacagtttcataaataagtttgcagagtatactcacgagaagtgggcatttgataagattcagaataattggtcgtatggcgaaaatatagacgaggagttgaagacccaccctatgctgaggccttacaaaacttttagcgagaaggataaggaaatttaccgatggcctattaaagaaagcctcaaagctatgatcgcctgggagtggactattgaaaaagcacgcgaaggagaagaggagaagaccgaaaaaaagaagactaggaagatctcccagagcgcccagacatacgacccaagagagggatacaatccacaaccccccgacctttccgccgtaacactctccagggagctgcaggctatggcagagcagctcgccgagaattaccataacacgtgggggcgcaagaaaaagcaggagctggaagccaaaggaggtggaactcatcctctgctcgttccttacgatacactcactgcaaaagaaaaagctagagacagagagaaagcccaggaactgttgaaattcctgcaaatgaatgggtatgcggtaacccggggactgaaggacatggagcttgacagcagcagtatagagaaaaggttcgccttcggtttcctccaacagcttttaagatggatggatatcagtcaagaatttatcgctcacttagaggccgtcgtcagttcagggcgcgtggagaagagtccacatgagcaggaaatcaagttcttcgctaaaatactgctgcctctgatcaatcagtactttactaaccactgcctatactttctgtccacccctgctaaagtcctcggctccggcgggcacgcctcgaacaaagagaaggagatgataacgagcctgttttgcaagttagccgccctggtccgtcaccgtgtgagtttatttgggaccgacgcaccagctgtcgtaaattgcctccatatactggccagaagtttggatgcccgaaccgtgatgaagtccgggccagagatcgtgaaggccgggctacgctcattctttgaaagcgccagcgaagatattgaaaaaatggttgagaacctgaggttaggtaaggtgtcccaagcaagaacacaagtgaagggagtgggacaaaacctcacttacaccacggtcgctctccttcctgtcctgactacactgttccagcatattgcccaacaccagtttggcgatgatgtaattctggacgacgtccaggtgagttgttatagaacactgtgtagtatttattcactcggaacaacaaaaaatacgtatgtagaaaaattgcgtcctgcgctgggggaatgtctcgcaaggctcgcagccgccatgccagttgcttttcttgaaccacagctgaatgaatataatgcttgctcggtgtataccactaagtccccaagggagcgagcaatcctggggttgcctaattccgttgaggagatgtgccccgatatccctgtgctggagcgcctcatggcagatattggcggcctggctgaaagtggcgcccggtacacagagatgccacatgtgatcgagattactctgcccatgttgtgctcctatctgccaaggtggtgggaaaggggaccggaggctcctccctctgctctgcccgccggcgcacccccgccctgtacagcggtgacatcagaccacctgaactccttacttggtaacattctgcggattatcgtgaataatcttggcatcgacgaggcgagctggatgaagcggcttgctgtctttgcccagcctatcgtgagcagggcccggcccgaattgctgcagtcccactttatacctaccattggccgcctgcggaagcgcgcagggaaggtggtgagcgaggaagaacagctccgtctcgaagccaaagcagaagctcaggaaggagagctgctggttagggacgaattctcagttctgtgtagggacttatacgccctgtacccactattgatacgctacgtggacaataatcgggctcagtggctgaccgagcccaatccttccgctgaggaactcttccgaatggtgggcgagatcttcatctactggagcaagtcacacaatttcaagcgcgaggaacaaaatttcgtcgtgcagaatgagattaataatatgtctttcctgaccgctgataacaaatccaaaatggctaaagccggggacatccagtccggcggatctgatcaggagaggacgaagaagaagaggagaggggatagatactcagtgcagaccagcctgattgtggccacccttaagaaaatgctgcccattgggcttaatatgtgcgccccaactgaccaggacctgattacattagccaaaacaagatacgccctgaaggataccgacgaagaggtacgggagtttctccacaataacctgcatttgcaaggcaaagtcgaggggtctccatcgcttagatggcaaatggcattgtaccgaggcgtgcccggtcgcgaggaggacgcggatgatcctgagaagattgtaagaagggtgcaggaggtgtccgccgttctgtactatctggatcagaccgagcacccatacaagtccaagaaagctgtgtggcacaagctgctatctaaacagaggcgccgggccgttgtcgcatgtttcagaatgacgcccttatacaacctgcccacacatcgcgcttgtaacatgttccttgagtcatataaagccgcttggatcctgactgaggatcactcttttgaggacaggatgattgatgacctgtccaaggcaggagagcaagaggaggaagaagaagaggtcgaggaaaaaaagccagaccccttgcatcaactggttctgcatttttcaagaactgccctgacagaaaaatctaaactggacgaagactatctgtacatggcctatgcggatattatggcgaagagttgtcatctggaagagggtggcgaaaatggcgaggctgaggaggaggtagaggtgtcctttgaggagaagcagatggaaaaacaacggctgctatatcagcaggcccgcctccacacacgcggtgccgctgaaatggtcctgcagatgattagtgcctgcaaaggcgaaacaggagccatggtatcttccaccttaaaattgggtataagtattctcaatggtggaaacgctgaagtgcaacaaaagatgctagattatcttaaggataagaaggaggtaggattctttcagagtatccaggccttgatgcagacttgcagcgtattagacttaaacgctttcgagcgccagaataaagctgaagggctgggaatggtcaatgaggatggcaccgtgggcgagaaagtgatggcggacgatgagttcacccaggacctgttccggtttctccagctgctatgcgagggccataacaacgactttcagaactacctgcgcacccaaaccgggaatacaacaaccatcaacatcattatctgcaccgtcgattatctcctcaggctgcaagagtcaatttcagatttctactggtactattcaggtaaggacgtcatcgaagagcagggcaaaaggaacttcagtaaagcgatgagtgtcgctaagcaagtttttaactctttaaccgagtatattcaaggcccgtgtacagggaaccagcagtccctggcacactcgcgactctgggatgccgtggtgggtttcctgcacgtgtttgctcacatgatgatgaagctcgcccaagactcttcacagatcgagttgttgaaagagttgttggacctccagaaggacatggtggtgatgctcctgtccttgttagaaggtaatgttgtcaatggcatgattgcacgccagatggttgatatgctggtggaaagtagtagtaacgtggagatgattctgaagttcttcgatatgtttcttaaacttaaagacattgtagggagtgaggcgtttcaggactacgtgactgatccgcgggggctcatcagtaaaaaggacttccagaaagccatggatagccaaaaacagttttcggggcccgaaattcagttcttgctgtcctgctcagaagccgacgagaatgagatgattaattgtgaagaattcgccaacagattccaggagccggcgcgggatataggctttaacgtcgcggtactactgacaaacctgagtgagcatgtacctcatgatcccagacttcacaactttctagagctcgccgaaagcatccttgaatacttccgcccttatttgggacggatcgaaatcatgggggcatctcgacggattgaaagaatttactttgagatttccgagaccaaccgggcccagtgggaaatgcctcaggtaaaagaatccaagcggcagtttatcttcgacgtggttaatgagggcggggaggccgaaaaaatggaactcttcgtcagtttttgcgaggacaccatattcgagatgcagatcgctgcgcagatatctgagcctgaaggagaacccgagaccgacgaggacgagggtgccggcgctgctgaggccggagctgaaggtgcagaggaaggagccgcaggcctggaggggacagccgccacagctgccgcaggagccacagcccgcgtggtcgctgctgccgggcgcgctctgcgggggctctcataccggagcctgaggcggcgggtccgcagactgcgcaggcttaccgccagagaggctgccaccgctgttgctgccttgctttgggctgctgtcacccgcgcaggagctgctggtgccggtgcagcggccggcgctttgggattactgtgggggtcactcttcggaggaggactggtagaaggtgccaaaaaggttaccgtcaccgagctgctcgccggcatgcccgatcccactagcgatgaagtgcatggcgaacagcccgcaggacccggtggggacgccgacggggaaggagcctctgagggagctggggatgctgctgagggagctggcgacgaagaggaggccgtgcatgaggcagggcctggcggggccgatggggcggtcgccgttaccgacggaggcccatttcggccagaaggagctggcgggctcggcgatatgggcgatactacgcctgccgagccgcctacaccagaaggcagtcccattcttaagcgtaaacttggcgtagacggggtggaagaggagcttcccccggagccagagccagagccagaacccgagctggagccagaaaaggcggacgctgagaacggcgagaaagaggaagttcccgagccaacacctgaacctcccaagaagcaagccccgcccagtccccctccaaagaaggaggaagctggaggtgagttttggggcgaacttgaggtgcagagggttaagtttctgaattatttgtcaagaaacttttacacacttcgatttctggccctatttctggccttcgccatcaacttcatcttgctattttacaaagtgagcgactcaccacccggcgaggacgacatggagggctccgccgcaggcgacgtgagtggtgcaggatcaggtggatcatcagggtgggggttgggcgccggcgaggaggctgagggggacgaggacgaaaacatggtttattattttctggaggagtcaactggttacatggaacctgcactgagatgcctgtccctgctccatactttggttgcttttctctgcataataggctataactgtctcaaggtgcctctcgtgattttcaagcgcgaaaaagagttggctagaaaactggagttcgatggactgtacatcaccgagcaacccgaggacgatgatgtgaagggccagtgggatcgactggtgcttaacaccccttctttcccgagcaactactgggacaagttcgtgaagaggaaggtgcttgataagcatggagacatttatggacgcgagcgcattgctgaattattgggcatggacctcgctacgctggagattaccgcacacaacgagcggaaacccaaccccccacctggcctgctcacctggctgatgtccatcgatgtcaaataccagatctggaagttcggcgtaattttcacagataactcatttctgtatctcggctggtacatggtgatgtccctgttgggacactataataattttttcttcgccgcacatctgttggatatcgcgatgggcgtcaagacactgcgcacaatccttagctctgtgacccataacggcaagcagctggttatgacggtggggctgcttgcagtggtggtgtacctttataccgtggtggctttcaacttctttagaaaattttacaataaaagtgaggatgaggatgagcccgacatgaaatgtgacgatatgatgacctgctacctgtttcacatgtatgttggggttcgcgccggcggtgggattggtgatgagattgaggatcccgccggagatgaatacgagctgtatagagtcgtatttgacatcacattctttttcttcgtcatcgtgatcctgctcgccatcatccaggggctcattatagatgcatttggggagctgagagatcagcaggaacaggtgaaagaggatatggagaccaagtgtttcatctgtggcatcgggtctgactatttcgatactactccccacggattcgaaacccatacactggaggaacacaacctggctaactacatgttcttcctaatgtacctgattaacaaagatgaaaccgaacatactggccaagaatcttacgtatggaagatgtaccaggaacgttgctgggacttttttcccgcaggggattgcttcagaaaacaatacgaagatcagctgtcttag

SEQ ID NO: 133308 - DNA, 2031 bp, Artificial Sequence
  Description of Artificial Sequence: Synthetic coding sequence
atgaaatcaggcccggagattgtaaaggccggccttaggtctttctttgagagtgcatccgaggacatcgagaagatggtcgagaacctgcgcttgggaaaggtctcccaggcccggacccaggttaaaggagtgggtcaaaatctgacgtatactacagtcgcacttttgccggtcctcaccacactcttccagcacattgcgcagcatcagttcggtgacgacgtaatcttggacgacgtgcaagtgagctgctacaggacactgtgttctatatacagtctgggaaccaccaagaacacctatgtggagaagctgagaccagcgctcggagagtgcctcgcccgcctggcagccgccatgcctgtagccttcctggagccccagctgaacgagtacaacgcctgttcagtttatacgacaaagagtcctagggaaagggccatactggggcttcccaactctgttgaggagatgtgcccagacattcctgttctcgagagactaatggccgatatagggggactggctgagtccggcgctaggtacaccgaaatgccccatgtgatcgagataaccctgcctatgctgtgtagttacctgcctagatggtgggagcgcgggccagaggcacctccctccgccctgcccgccggtgcgccccctccatgtacggctgtgacgagcgatcatctgaatagtttactcggaaacattctgaggattattgtcaataacttgggtatcgacgaagcgtcatggatgaagcggctggccgtgttcgcccagccgatcgtgtcgcgtgcccggcctgaattgctccagtctcacttcattcccactatcggaaggttgaggaagcgagcaggtaaggttgtgtcagaagaagagcaactgagactcgaggctaaggccgaggctcaggaaggcgagttgctggtgcgcgacgagtttagcgtgctgtgccgagacctatatgccttgtatcctcttctgatccgctatgtcgataataaccgcgctcagtggttgacagagccaaatccgagtgccgaagaactgttccgcatggtcggcgagattttcatttattggtctaaatctcataattttaaacgggaagagcagaatttcgtggtacaaaatgaaatcaataatatgtcctttctcacggctgacaataagtctaagatggccaaagcaggcgacatacagagcggagggtccgaccaagaacgaactaaaaaaaagaggcgcggtgatagatacagtgtccagacttcattgattgtcgccacgcttaagaaaatgttacccattgggttgaacatgtgtgccccaacggaccaagacttgatcacattagcaaaaacccgttacgcactgaaggacactgatgaggaggtgcgggagttcctgcataacaacctgcacctgcagggcaaagttgagggcagtccttctttacgctggcaaatggccctgtacagaggggtgcccggaagagaagaggacgcagatgatccagaaaaaatcgttcggcgggtgcaggaggtgtccgcagtcctatactacctcgaccagaccgaacatccgtacaagtctaagaaggccgtctggcataagctattatcgaaacagaggagacgggccgtggtggcctgcttccgtatgacgcctctgtacaatctccccactcaccgggcatgtaatatgtttctggaaagctataaggcggcatggattctgactgaagaccatagttttgaggacagaatgatagacgatctaagtaaagctggagagcaagaggaagaagaagaggaagtggaagagaaaaagcccgatcctctgcatcaacttgtgttgcacttctccaggactgccctgacagagaaatccaaactggacgaggactacttatacatggcgtatgccgacatcatggccaagtcatgccacctggaggagggtggggagaacggggaagcagaagaggaagtcgaggtgagttttgaggaaaagcaatag

SEQ ID NO: 133309 - DNA, 14922 bp, Artificial Sequence
  Description of Artificial Sequence: Synthetic coding sequence
ctgggcccaagaagcagtagcaataagctgtcaaataagaaaatgatgaaatggttctgctcagctccccagccttcgactaaaaataaccgatcttatgcctggcaacagaaggacctcgctaccgactttgtgtcatggtctcctctacctattccaaggatgtgtcctcagacaagcccatcagcaccgttatgttggtcctcgccgtctctgtcaggaagatgtcgtaggtgttggctgacgccatggcggaatcagaagggccagttggatatcattaagtggagttttggactaaagaccgctcagggcggtgggcatcgcactctcctctacgggcatgccattctcctacggcatagctactcgggaatgtacctgtgctgtctttccacaagcaggtcttctaccgacaagctcgcattcgacgtggggttgcaggaagacacaaccggcgaagcatgctggtggacaatccacccggctagcaagcaaagatcagagggtgagaaggtgagggtgggagacgatctcattttagtgagtgtatccagcgagagatacctgcatctgtcttatggaaacggttccctccacgttgacgccgcattccaacaaacactctggagcgtggccccaattagttcaggctcggaggcagcccagggctacttaatcggtggagatgtgctgcgactgctgcacggacatatggacgaatgcttgaccgtgccatcaggagagcacggcgaggagcagcgtcgaacggttcactacgaggggggggcagtgtcagttcacgctcggtctctctggcggctggagactcttcgcgtagcgtggtctggtagtcacataaggtgggggcaacccttccgacttcggcacgtgacaactgggaagtacctaagtctgatggaagataaaaaccttttgttgatggacaaggaaaaggctgatgtcaaatctacagcttttacgtttaggagttctaaggagaaattggacgtcggtgttcggaaggaagtggacggaatggggacaagtgaaattaagtatggagacagcgtttgctacatacagcatgttgacaccggactttggctgacctatcagtccgtcgatgtgaaatccgtgcgaatgggcagcattcagcgcaaggctatcatgcaccacgaaggccacatggatgatggcatttcactgtctagaagtcaacacgaggagtcccggaccgccagggtcattaggagcactgtattccttttcaatagattcatcaggggcttggatgctctgtccaagaaggctaaggcctcaacagttgatctccccattgagtcagtgtcgttgtcgctacaggatctgataggctatttccaccctccggacgagcatctggagcatgaggacaagcagaatcggctccgcgcccttaaaaacaggcagaacctattccaggaagagggaatgataaatttggtcctggaatgcatcgatcgtctgcacgtctactccagcgccgctcattttgctgatgttgccggccgcgaggccggcgaatcatggaaaagcattctcaatagcttatatgagcttctggcagctttaattcgtggtaatcgcaagaattgtgcccaatttagcggatctcttgattggctgattagtagactagagaggctggaagcatctagtggtattctcgaagtgctccattgcgtgctggtggagtcacctgaagcacttaatatcatcaaagaaggccacattaaatctattattagccttttggacaagcacggtcgaaaccataaggttcttgacgtcctttgttctctgtgcgtctgccatggagttgccgtgcggagtaatcaacaccttatctgcgataatttattaccaggtcgggatctgctactgcagactagactagttaaccacgtgtcgagcatgagaccgaacatttttctgggtgtgagtgaaggctccgcacagtacaaaaaatggtattatgagcttatggttgaccatacggagcccttcgtaaccgccgaggccactcatcttcgtgtcggctgggcgagcactgaggggtatagcccctaccctggagggggagaggaatggggcgggaatggcgtaggagatgacctgttttcatacggcttcgacggattgcacctctggtccggctgcatcgcccgtacagtctcgagtcctaatcagcatctccttaggactgacgacgtcatttcttgttgcttggatcttagtgcaccaagcattagtttccgaatcaatggccagcctgtccagggtatgttcgagaatttcaacattgatggtctttttttcccagtggtgtccttctctgctgggattaaggtgaggtttttgctggggggccgacacggcgaattcaaatttctcccccccccgggttacgcaccctgctatgaagccgtcctccccaaggagaaactcaaagtggaacacagccgcgaatacaagcaggagagaacatacactagagatctgttgggccccactgttagtttaacccaggccgccttcactccaatcccagtggacacatcacagatcgtgttgcctccacacctggaacgaatccgggaaaagttggccgagaacattcatgaactgtgggtgatgaacaagatcgaactgggatggcagtatggccccgtacgggacgacaacaaaagacagcacccctgtctggtggaattctccaagcttcccgaacaggaaagaaactataatcttcaaatgtcattggagactctgaagacactgctggccctcggttgtcacgttgggatctccgacgagcacgcagaggacaaggtgaaaaaaatgaaactcccaaaaaattatcagcttacgagcgggtacaaacccgccccaatggacctgtctttcatcaagttgacacctagccaggaggccatggttgataagcttgccgaaaatgcccacaatgtctgggcccgagacagaataaggcagggatggacttacggaatccagcaagatgtaaagaatcgaaggaatccaaggttggtcccctatacactgctcgacgacagaaccaagaagtcaaacaaagattccttgcgggaggccgtgcgcacactgctgggatacgggtataatcttgaggcccctgatcaggaccacgctgctagagcggaggtgtgttcaggtacaggagagcggtttcggattttccgtgctgaaaagacctatgcagtcaaggccggccgatggtactttgagttcgaaacagttacggctggcgacatgcgcgtgggctggtctcgtcctggatgccaacctgaccaggagcttggttctgatgagcgcgcattcgccttcgacggctttaaggctcaacgctggcatcaggggaatgagcactatgggcgaagttggcaagctggagacgtggtggggtgcatggtggacatgaacgaacataccatgatgttcacgttgaacggagaaattctccttgatgacagcggttccgagctggcctttaaggattttgatgtaggcgatggtttcatccctgtatgtagcctgggggtcgctcaggtgggacgaatgaattttggaaaggacgtgtccacattgaaatatttcacaatctgtggattgcaagagggttacgagccatttgccgttaacactaacagagacatcacaatgtggctctctaagaggctgccccaatttctgcaagttccctctaaccacgagcatatagaggtgaccaggatcgacggaactattgactctagtccctgcctcaaagtaacccagaaatcattcggcagtcagaacagcaataccgatattatgttttatcggctctcaatgcctatcgagtgcgctgaggtgttcagcaaaacggtggccggaggactgccgggcgcaggcttgttcggccccaaaaatgacctggaagactatgatgctgactcagatttcgaagttctgatgaaaaccgcacacggacatttggttcccgaccgagtggacaaagacaaagaagcaaccaaaccagaattcaacaaccacaaggactatgcccaagagaagccatctagactaaaacaacgatttctcctgagaagaactaagcctgactacagcacgtcacattccgccagactaacggaggacgtgctcgctgacgacagggatgattacgatttccttatgcagacatccacgtactactatagcgtgcggatctttcctggccaggaacccgccaacgtttgggtgggttggatcacttcggatttccaccagtatgatactggatttgatctcgacagggtccgcacggttaccgtcacactaggagacgaaaaaggcaaggtgcacgagagcataaagcgatcaaattgttacatggtttgtgcgggagaaagcatgtccccaggtcaaggcaggaacaacaatgggctagaaattggatgtgtcgtggacgccgccagcgggctgctaacctttatcgccaatggaaaggaactgtccacatattatcaagtggagccgtcaaccaagctgttcccagccgtgttcgcccaagctacatcacccaacgtgttccagttcgaattaggcagaatcaaaaatgtgatgcctctctccgccggcctgttcaaaagcgaacacaaaaaccccgtgccgcagtgtcccccccgcctccacgtccagttcctgagccatgtgctttggtcacgaatgcccaaccagtttctcaaagttgacgtgtctcgcatctccgaacgccaggggtggctggttcaatgccttgaccccctgcagttcatgtcattacatatccccgaggagaatcgaagcgtggacattctggagctcactgaacaggaggaactcctgaaattccattaccatacgcttaggctttactccgcagtgtgtgcactaggtaatcaccgggttgcacacgccttgtgcagccacgtggatgaaccccagttgctgtatgcgattgaaaataaatatatgcctggcctgctgcgggctggctattatgacttacttattgacatacatctgtctagctatgccactgctagacttatgatgaacaatgagtatatcgtccccatgacagaggagacaaagtccattactctttttcctgacgaaaacaagaagcacgggctccccggaattggtttgtctacctctcttcgacctcgcatgcaatttagcagcccttccttcgtctcaattagtaacgagtgctaccaatattctcctgagtttcccctggacatcttaaaatccaaaactatccagatgttgaccgaggcagtgaaagaaggcagcctgcacgcacgtgaccccgttggcggaacaacagagttcctattcgtgcccctgatcaagctgttctatactctgttgatcatggggatcttccataacgaagacttaaaacacattttgcaactcatagagccttccgtgtttaaagaagccgctactcctgaggaggagtctgacacattggaaaaggaactgtctgtggatgacgccaaactacaaggcgctggcgaagaggaagctaagggagggaagagacctaaggaggggctgctccaaatgaagctgcccgaacctgtgaagctgcagatgtgcctgctactgcagtatctttgtgactgccaagttaggcatcggattgaggctatagtcgctttttccgacgacttcgtggcgaagctccaggataatcagaggtttaggtacaacgaagttatgcaggccttaaatatgtctgctgctctcactgcaaggaagactaaagaattcagatctcccccccaggagcagatcaacatgctgctgaacttcaaagatgacaagagtgaatgtccatgcccggaagagatccgggaccagctattggatttccacgaggatctcatgacacattgtggaattgagctggatgaggacggaagcctggatgggaactcagatctcactattagggggaggcttctgtctttggtggagaaggtgacctatctcaagaagaagcaggcagaaaagccggtggaatcagacagcaaaaagtcatccaccttgcaacagctgattagcgagacaatggtcaggtgggcacaagaaagtgtgattgaggaccccgaactcgttcgtgcaatgtttgtgctgttacacaggcagtatgatgggataggcggcctggtgcgcgctttaccaaaaacttatactatcaatggggtttctgtggaggataccataaaccttctggccagtctggggcagataagaagcctgctgtcagtgagaatgggaaaggaggaggaaaagttgatgataaggggactgggcgacataatgaataacaaggtgttctatcaacatcccaatcttatgcgagcgctgggtatgcatgaaactgtgatggaggtgatggtcaatgtgttggggggaggagagtctaaggagattaccttcccaaagatggtagcaaattgctgtcgttttctgtgctacttttgtagaatctctcgacagaatcagaaagcgatgttcgatcacctgtcctatctgctggaaaatagttccgtgggcctggctagtccagcgatgcgcggctcaaccccactggacgttgccgccgcgagcgtgatggataacaatgagctggccctggcgctgagggaacccgaccttgagaaggtggtgcgatatctcgccggctgcgggcttcagagctgtcaaatgctggtgagtaaaggttaccccgatattgggtggaacccagttgaaggagagcgatatctagatttcttgcgcttcgccgtgttctgtaacggggagagcgtggaagagaacgctaacgtcgtagtgagactgctgattcgaagaccagagtgtttcggccctgcattaagaggtgaggggggaaacggtctgctcgcagccatggaagaagcaattaagatagcagaggacccgagcagagatggaccctctcctaactcagggagcagcaagactttagataccgaggaggaagaggatgacacaatacacatgggtaacgccattatgactttttactctgctttaattgacctgcttggccgatgcgcacccgagatgcatctcattcatgctggcaagggggaggctataaggatcaggagtatcctgcgctcactgattccactgggagatctcgtgggtgtcatctcgatagcctttcagatgcccacaattgccaaggacggcaacgtggtcgaacccgatatgtccgccggcttctgcccagaccacaaggcagccatggtgctattcctggacagagtgtatggaattgaggttcaggacttcttactgcacttgctcgaagtggggttcttgcccgatttgcgcgccgccgctagcttagataccgccgcactgtctgcaactgacatggcactagcccttaataggtacctctgtaccgcagtgctgcccctccttacacggtgtgcccctctattcgccggtacagaacaccatgcatcactcatcgacagcttgctccatacagtctaccgcctaagcaagggctgcagcctcactaaagcccaaagagactccattgaagtctgtctgctgtcaatttgcggtcagttgaggccatcaatgatgcagcacttgttaagaaggctcgtctttgatgtgcctcttctaaacgagcacgccaagatgcctctgaaactgcttactaaccactacgagagatgttggaaatactactgtctcccaggcgggtggggcaacttcggagccgcatccgaggaagagctgcacttgtcgaggaaacttttttgggggattttcgatgcgctcagccagaagaaatatgagcaagaactgtttaagctagctcttccatgtttgtccgcagtagccggtgccctgccccctgactatatggagagcaactacgtctccatgatggagaaacagtctagtatggatagcgaaggcaactttaatcctcagcccgtggatactagtaatatcacaatccccgaaaaactggaatactttataaataagtatgccgagcactcccacgataagtggtccatggataagctggccaacggttggatttacggcgagatctattccgactcctcaaaggtccagcctctcatgaagccctataagctgttgtcagagaaggagaaggaaatctataggtggccaattaaggaatccttaaagaccatgctggcatggggatggcgaatcgagcgtacgagggagggggactccatggctctgtataataggactcgtcgcatctcccagacctctcaggtgtcagtggatgccgctcacggctacagtcccagggcaatcgatatgtcgaacgtcaccctatcacgggacctccacgctatggcggaaatgatggcggaaaattaccataacatatgggctaagaaaaaaaaaatggagctggaaagtaaggggggtggtaatcaccccctcctggtcccatacgataccttgactgccaaggaaaaggctaaggatagagagaaagcacaggatatactaaagttcctgcagattaatggttacgctgtgtcccggggctttaaagacttggagcttgacacgccttctattgaaaagcgctttgcctattcgttcctacaacagctgatcagatacgttgacgaggcccaccagtatatacttgagttcgacggagggtccagagggaagggagaacattttccctacgaacaggaaatcaagttcttcgccaaggtcgtacttccactcatcgaccaatacttcaagaatcatcgcctgtattttctgtctgcggccagcagacccctgtgttccggcggtcacgccagcaacaaggaaaaagaaatggttacctcattgttttgcaaattaggcgtgctagtgaggcacagaatctccttgttcggcaacgatgccacctccatcgtgaattgcttacatatcttaggacagaccctggacgcgaggactgtgatgaagacaggtcttgaaagtgttaaatccgccctgcgcgcgtttctggacaatgcagccgaggatctcgagaaaaccatggagaatctgaaacagggacagttcacgcacactaggaatcagccgaagggagtaactcaaatcattaattacaccactgttgccctgttgcctatgctctccagtttgttcgagcacattgggcagcaccagtttggcgaggacttaatattggaagatgtgcaggtcagttgttacagaattttaacctcactttacgcattgggcactagcaaatctatatacgtggaaaggcagagatcggccctaggagagtgcctggcagcattcgcaggcgcttttccagtggcctttctggagactcacctggacaagcacaacatctattccatttacaataccaagtcaagtagagagcgggcagcgctctccctccccaccaatgtcgaggatgtgtgtccaaatattcccagcttggaaaagctcatggaggaaattgtggagctggccgagtcaggcattcggtacacccagatgcctcatgtgatggaagtcatcctgccaatgctttgtagctacatgtcccggtggtgggaacacggaccggagaacaatccagagagagctgaaatgtgttgtaccgccctgaatagcgagcacatgaacacattgttagggaacattctcaagataatttataataatctgggcatcgacgagggggcctggatgaagagacttgctgtgttctcccagcccataattaacaaggtcaagccacagttgcttaaaactcactttttgcccctcatggagaagcttaagaagaaggcagccacggtcgtttctgaggaggaccacttgaaagccgaggcgcgcggagatatgagcgaagctgagctgttgatcctcgacgagttcacaacccttgctagagacttgtatgcgttctacccattgctgattcgtttcgtcgactataaccgcgccaaatggcttaaggagccaaaccccgaagctgaggagctattcagaatggtggccgaggtatttatttactggtctaagtcacacaactttaagagagaagagcagaattttgtggtccagaatgagatcaataatatgtcatttcttataactgacactaagtcaaagatgtccaaggccgctgtgtccgatcaagaaagaaaaaaaatgaagcggaaaggcgaccggtacagcatgcagacctccctgatcgtggctgcactgaaacggttgcttcctatcgggcttaacatttgcgcccccggcgaccaggagttaatcgctttggctaagaacaggttttccctgaaagacactgaggacgaggtcagagatatcattcgctctaacatccacctgcaggggaagctcgaagacccggctatcagatggcagatggcgctgtataaagatttgcctaacagaaccgacgatacatccgatcccgagaagactgtggaaagagtcctggacatcgccaacgtcctgtttcacttagagcagaagtcgaagcgggtggggaggcgccattattgcctcgtcgaacacccacagcgatcgaagaaggcggtgtggcataagttactatcgaagcagcgcaagagagcagtggttgcctgttttcgcatggcacccctgtataacctcccaagacacagggcagtaaatctgtttctccaggggtatgagaagtcttggatcgagacagaagagcactacttcgaagataagctcatcgaagaccttgccaagccaggcgccgagccaccagaggaagatgagggaacgaaacgtgtcgaccccctgcatcagttgattctgttattttcacgcacagcattgacggagaagtgcaagctggaagaggacttcctgtacatggcatatgccgacatcatggctaagtcatgccatgatgaagaggacgacgacggcgaggaggaagtgaagagctttgaagtcacaggctctcagcggagcaaggaaaaggaaatggagaagcagaaactgctgtaccagcaggcaagactgcacgaccgaggggcagccgagatggtgctgcaaaccatctctgcctccaaaggggagaccggccctatggttgccgccacattaaagctgggaatcgctatacttaatggaggaaactctacagtacagcagaagatgctggactatctcaaggagaaaaaggacgtcggattcttccagagcctggccggtctaatgcagtcatgttcggtgctcgacttgaatgcatttgagcgacagaataaggctgaaggactgggcatggtcacggaggagggaagcggggaaaaagtgttgcaagatgacgagtttacatgcgatctgtttagatttctgcagcttctctgcgaagggcacaactcggactttcagaactaccttcgcactcagaccgggaataacacaacggtcaacatcattatctcaaccgtcgactacttattaagggtgcaggagtcgataagtgacttttattggtactattccggtaaagatgtgatcgacgaacagggccaacgcaacttttcaaaagcaatccaggttgctaaacaggtgttcaacactttaactgaatacattcagggaccatgcacaggtaaccagcaaagcctggcacattcaaggctatgggacgcggtggtaggattcttgcatgtgttcgcccacatgcagatgaaactctcccaagactcttcccagatcgaactcttaaaagaactgatggacctgcagaaggacatggtggtaatgctcttgtccatgctcgagggtaatgtagtcaacgggacaatcggcaagcagatggtcgatatgctggtggagtcatccaacaacgtggaaatgattcttaagttttttgacatgttcttgaagctcaaggatctgacatcctctgacacctttaaggaatacgatcccgacggtaaaggagtcatcagtaagcgtgattttcataaggccatggaatctcacaaacattacacccagagcgagacagaatttctcctgtcctgtgcagaaacggacgaaaacgagacactggactacgaggagttcgtgaagcgcttccacgagccggcgaaggatatcggatttaacgtggccgtgttactcaccaacttgagcgaacatatgcccaatgatacgcggttacagactttcctggagcttgctgagagcgtgctgaattacttccagccattcctggggaggattgaaattatgggctctgcaaagagaatcgagcgggtatatttcgaaataagtgagtcctcacgcacacagtgggagaagcctcaggttaaggaatctaaacgacagtttatcttcgacgtggtcaacgaagggggagaaaaggagaagatggaactgttcgtgaacttttgtgaagacacgatttttgagatgcaactggcagcccagattagcgagtctgatttgaatgaaagatctgccaacaaagaagagtcagagaaggaaagaccagaagagcagggaccgcgtatggccttcttcagtattctaaccgtcaggtctgccctgtttgcgctgagatacaacatccttacactgatgaggatgctgtctctgaagtccctcaaaaagcaaatgaagaaggtgaagaagatgacggtaaaagatatggtgactgctttcttctcatcttattggtccatcttcatgacacttctccacttcgtcgcttctgtgtttaggggctttttccgcatcatttgctctctgttgttaggaggctctctggtggagggtgcaaagaaaataaaggtggcggaactccttgccaacatgcccgatccaacacaggacgaggtgagaggcgatggggaagagggagaaagaaagcctcttgaggccgctctaccttcagaagacttgacggatctgaaagaactgactgaggagagtgacttgcttagcgacatcttcggactcgacttgaaacgggagggggggcaatataagttaatcccccataatccaaacgccgggctctctgacctcatgtctaatcccgtgccaatgcctgaagtgcaggagaaattccaggaacagaaggccaaggaggaggagaaggaggaaaaagaggaaacgaaatccgagcctgagaaagcagagggcgaggacggcgagaaggaagaaaaggccaaagaagacaagggcaaacagaagttgcgccagcttcacacccatcggtacggggaacctgaggtccccgagtccgcattctggaaaaagattatcgcataccaacagaagctgctgaattacttcgcccgtaacttctacaacatgcgtatgttagctctgttcgtggcgttcgcaatcaacttcatcttgctattttacaaggtctcaacaagttcagtagttgaaggtaaggaactccctaccagaagctcctctgagaacgccaaagtaacaagcctagattccagcagccatagaatcattgccgttcactatgtgctggaggaaagctcgggctatatggagccaacactaaggattctggccattttacacactgtgatatcttttttctgcatcattggctattactgccttaaggtcccactagtcatcttcaagcgggagaaagaggtggcgcgcaagctcgagtttgatggactgtacataaccgagcaacccagtgaagacgacattaagggacaatgggacaggttggtgatcaacacacagagtttccccaataattattgggacaaattcgttaagcgcaaggtgatggacaagtacggggaattctacggccgagaccgcatatccgaattactaggaatggataaggcagcactcgacttttctgacgcccgcgaaaaaaaaaaacccaagaaggactctagcttgtcagcagtactgaactcgattgacgtaaagtatcaaatgtggaaactcggagttgtgttcacggataactcgttcctgtatctggcatggtatatgaccatgtctgtgctgggccattacaacaactttttttttgccgctcatctgctagatattgcgatgggctttaaaaccctgcgcaccatactaagttcagtgacccacaacggcaagcagctggttctgacggttggcttgctcgccgtcgttgtgtacctctatacagtggtggcctttaatttctttcggaagttctacaacaaatcggaagatggagacaccccagacatgaagtgtgacgacatgcttacgtgttacatgttccatatgtacgtgggagtgcgcgccggcggtggcatcggcgacgaaattgaagacccagccggagacgaatacgagatctacagaatcatcttcgatataacatttttcttcttcgtgatcgttattctgctggccatcatccaaggtctgataatcgacgcattcggagaacttcgggaccaacaggagcaggttaaagaggacatggagacaaaatgctttatctgcgggattgggaatgactacttcgatactgtccctcacggatttgaaacccacaccctgcaagaacacaatctggcaaattacctctttttcttaatgtatctgatcaataaagacgaaacagaacatactggacaggagtcctatgtgtggaagatgtatcaagaacgctgttgggagttctttccggctggcgattgcttccgcaagcaatacgaggaccaactgaattag

SEQ ID NO: 133310 - DNA, 14904 bp, Artificial Sequence
  Description of Artificial Sequence: Synthetic coding sequence
atggccgatggaggggagggcgaggacgagattcaatttttgagaacagatgacgaagtggtgttgcagtgcacagccactattcataaagagcagcagaagctatgcctagccgccgaaggcttcggcaatcggctgtgttttctagagtctacttcaaacagcaaaaatgtgccgcccgatctgtccatatgtactttcgtgctcgagcaatctctctccgttcgggctttgcaggaaatgttggcaaatactgtagaaaaatctgaaggacaggttgatgtagaaaaatggaaatttatgatgaaaacagcacaaggcggaggacatagaacactgttatatggacacgcaatcttgctgcgacattcctactctggcatgtatctttgctgcttatccaccagccggtcttctactgacaaactggcctttgacgttgggctacaggaggataccaccggggaggcatgctggtggacgatacatcccgcttccaagcagagatctgaaggcgaaaaagtgcgagtaggtgatgacctcattttggtcagtgtgagtagtgagcggtatctccacctctcgtacggtaatggatccctccacgtcgacgccgccttccagcagacactctggagtgtggcaccaatcagcagtggttctgaagcagctcagggctatctgatcggcggagacgtcctccggctgcttcacggacacatggatgagtgcctcactgtgccctccggcgaacacggggaggagcagcgccggacagtgcactatgaggggggcgctgtgtcagtgcacgcaagatcactttggcgcctagagactctcagggtggcatggtcaggatcgcatattaggtgggggcagccgttcagacttcgccatgtcacgacaggaaaatacctctccctgatggaggataaaaacttattgttaatggataaagaaaaagccgacgtcaagtcgacggcttttacctttcggtctagtaaagagaagctggacgtgggtgtgcgaaaggaagttgacggtatggggacctctgagattaagtacggggattcagtgtgttacatccagcatgttgatacgggtctctggctgacctaccagtccgttgacgttaagtccgtgcgaatgggctcaattcagcgaaaggcaatcatgcaccatgaaggccacatggacgacggcatctcactgagcagatcacaacacgaggagagcaggacagctcgcgtgatcaggagcactgtctttctctttaatagattcattcgcggtctagatgcactgagcaagaaagctaaggcaagcaccgtggaccttccaatcgagtctgtgagcctcagcttgcaagacctgattggatacttccatcctccagacgaacacttggaacacgaagacaagcagaatcgccttagagcccttaaaaaccgacagaacctctttcaggaggagggcatgataaaccttgtattggaatgtatagatcgcctgcatgtctacagctccgcagcacatttcgcagatgttgccggccgagaagctggcgagtcttggaaaagcatattgaattcgctgtacgaactcctggctgccctgattcgggggaaccgtaaaaactgtgcacagttcagcggatcccttgattggcttataagccgcctcgagcgcctggaggcttcatcagggattctggaagttctgcattgcgtgctcgtcgaatcccccgaagccttaaacatcatcaaggaaggacatatcaagtctataatttcactgctagataagcacggaaggaatcacaaggtcctcgatgttctttgtagcttgtgcgtgtgtcacggtgtggctgttcgctcaaaccagcatctgatatgcgataatctccttcctggcagggacctcctattgcagactagactcgttaaccacgtgtctagcatgcgtcccaacatttttctcggcgtgtccgaagggtcggcccaatacaagaagtggtattacgaacttatggtagaccacaccgaaccgtttgtaacagcagaggctactcatctcagagtgggctgggcaagcactgaggggtacagtccttatccaggcgggggagaggagtggggaggaaatggagttggcgacgacctgtttagctatggctttgatggcctccatttatggagcggctgtattgcccgcactgtgtcttctccaaaccagcaccttctgcggacagatgatgtgataagctgttgcctggatctcagtgcaccaagtatctcctttaggataaacgggcagcccgtccagggaatgtttgaaaacttcaatattgatggcctgttctttcccgtggtaagcttcagcgccggtatcaaagttcggtttcttctcgggggtagacacggggaatttaaattcttaccaccacctgggtacgctccctgctacgaagctgtccttccaaaggagaagctgaaggtggaacactcccgtgagtacaagcaggaacgcacgtacactagggatcttctggggccaacagtgagcttaacccaggcagccttcacacctatacctgtagatacgagtcagattgttctaccaccccacctcgagaggattcgcgagaaacttgccgagaacattcacgaactgtgggtcatgaataagatagagctggggtggcagtacggacccgtgcgggatgataataaacgacagcatccatgtctggtggagttcagtaaattgcccgaacaagaaaggaactataatttgcagatgtctctggaaaccctgaagacgctgttggccttggggtgccatgtgggcattagcgatgagcacgctgaagacaaagtaaagaagatgaagctgcctaagaattatcaattgacaagcggttataagccggccccaatggatctgagctttattaaactcacgccgagtcaggaggccatggtggacaaactcgcggagaatgcccacaatgtttgggcccgggaccggatccgccagggttggacttacggtatccagcaagacgtgaaaaaccggcgaaatccccgtctggttccttacacactactggatgatcgaacgaaaaaaagcaataaggattctctgcgtgaagccgttcgcactctcctgggttacggatacaacctcgaggctccagatcaagatcatgctgctcgtgcggaagtgtgttccgggaccggcgaacggttcaggatcttcagagctgagaaaacttacgccgttaaggccggcagatggtacttcgagttcgaaactgtcactgccggcgatatgcgcgtgggctggtcccgacccggctgccagcccgaccaggaactggggagcgatgaaagagcatttgcatttgacggctttaaagcccagcggtggcatcagggcaacgagcactatggcaggtcatggcaggctggcgatgtagtaggatgcatggtggacatgaacgagcatactatgatgttcacactgaatggtgagatcctgctggatgacagtgggtctgagttagcgtttaaggattttgatgtgggcgatggattcatccccgtatgctcccttggggtggcccaggtcggcagaatgaactttggaaaggatgtcagcactctgaagtactttaccatctgtgggctccaggaggggtatgagccttttgctgtgaataccaatcgcgacatcactatgtggctgtccaaacggttgccccagtttttgcaagttccaagtaatcatgaacatatagaggtgacgcgcatcgatggaactatcgattcctccccgtgtttgaaggtgacccagaagagctttggctcgcagaactcgaatacggatataatgttttacaggctgtctatgcccattgagtgtgcggaggtgttctctaaaacagtcgctgggggcctgcctggggctggattgttcggccctaaaaacgacctggaagattatgacgcggacagcgacttcgaagttttgatgaaaacggcccacggccatctagtgcccgatagggtagataaggacaaggaagctactaaacctgaattcaacaaccacaaggattatgcacaggaaaagccctctcgtctgaagcagcgtttccttctgagacggacaaaacccgattattcaacaagccactcggcacgcttgaccgaggacgttctggctgatgaccgagacgattacgatttcctgatgcagacctcaacttactattacagtgtcagaatatttcccgggcaagaaccagctaacgtgtgggtggggtggattacctctgacttccaccagtacgataccggttttgatttggatcgtgtgcggacagtgaccgtgaccctcggagatgagaaaggcaaagtgcatgaatccattaaacggtccaattgctacatggtgtgtgcaggcgagagtatgtccccaggtcagggcagaaataacaatgggttggagatcgggtgtgtggtcgacgcagcatccgggctgttaacgttcatcgcgaatgggaaggaattaagcacctattatcaggtggaacctagcaccaagctttttcccgctgtgtttgcacaagctacctctccaaacgtgttccagtttgagcttggaagaatcaagaacgttatgcctctctcggcgggactcttcaagagcgaacacaaaaatcctgtcccgcaatgccctccacgactacacgtacagtttttgagccacgtcctgtggagccgcatgcctaaccagtttttgaaagtggatgtaagtagaatttcggagaggcaaggatggctggtgcagtgtctcgatccattgcaattcatgtccctccacattccagaggagaaccggtctgtggacatcctcgaattgacggagcaggaggagctgcttaagttccactaccatacgcttaggttgtactccgccgtgtgtgctctaggaaaccacagggttgctcacgccctgtgtagtcacgttgacgagcctcagctactctatgcaattgagaacaaatatatgcccggactcctacgagccggctattacgatctcctgattgatattcacctctcctcttacgcaacagcacggctaatgatgaataacgagtatattgttccaatgaccgaggaaaccaagtccattactttattccctgatgagaataagaaacatggcctcccaggcatcggcctgtcaacttccctgcgtccaaggatgcagttctcttccccttcttttgtgagtatatcaaatgaatgctaccaatatagccccgagtttccattagacatcctcaagtcgaaaacaattcagatgctgacagaggcagtgaaggagggtagcctgcacgcgcgcgatcctgtaggaggaacaacagagtttttattcgtgccccttattaagctcttctacaccctgctcatcatgggcattttccataacgaggatctgaaacacatccttcagttgattgagccttctgtgttcaaagaagctgctacccctgaggaagaatctgatacattggagaaggaactgtctgtggatgacgcaaaattacaaggagccggagaagaggaggctaagggaggcaagcgcccaaaggaagggttgctccaaatgaagctgccagaacctgtgaagctgcaaatgtgcctgctcttgcagtacctgtgcgactgtcaggtgaggcaccgcatcgaggccatcgtggctttcagtgacgatttcgttgctaagctccaggacaaccagagattccgctacaacgaggtgatgcaagctctcaatatgtcagctgcgttgactgcccgtaagacaaaggaattcagaagcccaccccaggaacagataaatatgcttctgaattttaaggacgataagtcggagtgtccttgcccagaagaaatcagagaccagctcttggactttcacgaagacctgatgacgcactgcgggatcgaactcgacgaggacggatctctggacgggaattcagacctgaccattcgcggaagactcctgagcttagtggagaaggtcacgtatctcaaaaagaagcaagccgagaagcccgtggagagcgattcaaagaaaagctccacgctacaacagctcatatcggagacaatggtccgatgggcacaggaaagcgtcatcgaggacccagagcttgtgcgggctatgttcgtcttgctacacaggcagtatgacggcattgggggcttggtccgtgccctcccgaaaacgtataccatcaacggtgtatcagttgaggatactatcaatctcttggcctccctgggacagatcaggtcgctgctgtccgtgcgcatgggaaaggaagaagagaagctaatgatcagaggcctgggagacattatgaataataaagtgttctatcaacacccaaaccttatgagggctctcggcatgcatgaaaccgtgatggaggtaatggtgaatgtgttgggcggaggggagtccaaagaaatcacttttcccaagatggtggcaaattgttgcagattcctgtgttatttttgcaggatttctaggcagaaccagaaggcaatgttcgaccatctgtcatacctattggaaaatagctctgtgggcctcgccagccctgcaatgcgaggctctacccctcttgatgtcgccgctgcttctgtgatggacaacaatgagctcgctctggcactgcgcgagcccgacctggaaaaggtggtccgctatcttgcaggttgtgggttacagagctgtcagatgctggtatcaaaggggtatcccgacatcggctggaaccccgtagaaggggaacgttacctggattttttgcgttttgctgtcttctgcaatggagagtcagtcgaggagaatgcaaatgtggtcgtgcgcttactaatcagacgtcctgagtgctttgggcccgcgttgaggggcgaaggggggaacgggctcctggctgccatggaggaagccatcaagattgcggaggatccttcccgggacgggccaagtcccaacagcggctccagcaagactttagacacagaggaggaagaagacgacacaattcacatgggcaacgccattatgacattctacagcgccttaattgacctgctcgggaggtgcgctcctgagatgcacctgattcatgctggcaagggagaagccatccgaatccgaagcatcctcagaagcctcatccccctgggtgatttggtcggtgtgatatccatcgcttttcagatgcccactatcgccaaagatggaaacgtggttgagcctgacatgtctgcaggcttctgtcctgatcataaggccgctatggttctgtttttggaccgggtatatggtattgaggttcaggatttcctgctgcatctcctcgaggtagggttcctgcctgatctgcgagcagcagcctctctcgacacagccgcactatccgcaactgatatggcgttggccctcaatagatacctttgtactgccgtgctgccccttttgactaggtgcgcaccactgtttgctgggaccgaacaccatgcctccctaattgattccctcctgcacactgtgtacagattgtcgaagggctgttctctcaccaaggcacagagggattcaatcgaagtgtgtttattgtctatctgcggacagttgagaccaagtatgatgcagcacctgcttcgtcgtctcgtattcgatgttccgcttctgaacgaacacgcgaagatgcccctgaagctgctgacgaaccattatgagaggtgctggaagtactactgcctgcccggcggctggggcaacttcggggctgcctccgaagaagagctacacctcagtcgcaagctgttttgggggatctttgatgcactgagtcagaagaaatacgaacaggagctttttaaactcgctctgccatgcctttccgcagttgccggagccctgccccctgactatatggaatcaaactacgtgagcatgatggagaagcagagcagcatggactctgaagggaattttaatccccagcccgttgatacatcaaacatcaccattccagagaagttagaatactttatcaacaaatatgccgagcactctcacgataagtggtccatggacaaactggctaacgggtggatctacggcgaaatctactctgacagcagcaaggtgcagccactcatgaagccttacaaactgttgtcagagaaagaaaaggagatctatcgatggcccatcaaggagagcctgaagactatgctggcctggggttggaggattgagcgaaccagggaaggtgatagtatggcactgtataaccgaacacgtagaatcagtcagacttcccaggtgagtgtggacgcagcgcatggatatagtcctcgagcaatcgatatgtccaatgtcacgctctctcgagacctccatgccatggccgagatgatggccgagaactatcacaacatctgggcaaaaaagaaaaagatggaacttgagtccaaggggggcggtaatcaccccttgcttgtgccttacgacacgctgactgccaaggaaaaggccaaagacagggagaaggctcaggatattctcaagttcctgcagataaatggctacgccgtttccagaggcttcaaagaccttgaactcgatacgccgtctattgagaagcgctttgcttactccttccttcagcaattgattcggtacgtcgacgaagcacaccaatacattctggagtttgacggtggcagccgagggaagggtgaacactttccgtacgagcaagagatcaagttctttgcaaaggtggtgcttccacttatcgatcagtacttcaagaatcaccgactgtatttcctcagtgccgccagtaggccactctgcagcggcgggcatgcatccaataaagagaaggagatggtaacctccctcttttgtaagctcggagtcctggtgaggcatcgtatctccctgttcggcaacgatgctacaagcatcgttaactgtttgcatatcctaggccagacccttgacgcaagaaccgttatgaagaccggcttagagagcgttaagagtgcacttagagcatttctcgacaatgcagccgaggatctcgaaaagacaatggagaatctgaagcaggggcagttcacccatacgaggaaccaacccaagggcgtgactcaaatcatcaattatactactgtggcactgctccccatgctgagtagcctgttcgagcacattgggcaacatcagttcggcgaggaccttattctggaggacgttcaggtcagttgctacaggatattgacctccctctacgccctagggaccagtaagtccatctatgtggaacgtcagcgttcagctctgggtgagtgcctggcggcttttgcaggagcctttccggtcgcattcctggagacacatctcgacaagcacaacatttactcaatctataacacgaagtcaagcagggagcgcgctgctttatcactacccaccaacgtcgaggacgtatgccctaatatcccatcactggagaaattaatggaagagattgtagagttagctgagtcaggcattaggtacactcaaatgccccatgtcatggaggtgattctgcccatgctgtgttcatacatgagccgctggtgggagcatggccctgagaataatccagaaagagcggaaatgtgttgcaccgcattaaattctgaacacatgaataccctgctggggaacattctgaagattatctataacaatctggggattgatgagggggcgtggatgaagagactggctgtgttttcccaaccaattatcaacaaggtgaagccacagctcctaaaaacacacttcctcccccttatggaaaaactgaagaagaaagcggccactgttgtatccgaagaagaccatctaaaggctgaggcaaggggggacatgagcgaagctgagctgctgattctcgacgagtttacaaccctcgctagggatttgtacgcattctatcccctgctgatcaggtttgtggactacaatcgcgctaagtggctgaaagaacccaaccccgaggcagaagagctgtttagaatggtggccgaagtgttcatttactggagcaagagtcataacttcaagagggaagaacagaacttcgtggtgcagaacgagatcaacaatatgagcttcctgatcactgataccaagtcaaagatgtccaaagccgcagtatcggaccaagaacggaagaaaatgaaacggaagggtgaccgctattctatgcaaacatctttgattgttgccgccctgaagaggctcctgcctatcggactaaatatttgtgctcctggggaccaggagcttatagctttagcaaagaataggttttcactcaaggacacagaggatgaggttagggatatcattagatcaaatatccatctgcaggggaagctcgaggatccggctattagatggcagatggctctgtataaggacctgcctaacagaacagacgatacttctgaccccgaaaaaaccgtggaaagagtcttggatatcgcaaacgtgctgttccaccttgagcagaaaagtaagcgggtgggtcgacgccactactgcctcgtggaacatccacaacgtagcaagaaggcggtgtggcacaaactgctctccaagcaaaggaaacgggctgtcgtcgcttgttttcgaatggcaccgttatacaatttacccagacatcgggccgtgaacttattcctgcagggctatgagaagtcctggatcgagacagaggagcactacttcgaagacaagctaattgaggatctggccaaacctggggccgaaccaccagaggaggatgagggtacaaagcgcgtggaccctctgcaccaactcatactgctgttttctcgcactgccctgacagaaaaatgtaagcttgaggaagactttctgtatatggcctacgccgatattatggccaagtcatgccacgatgaagaagatgatgatggcgaagaggaggtgaaaagtttcgaggaaaaagaaatggaaaagcaaaaactgttataccagcaggcacgcctgcacgatcgcggcgcagccgagatggtgttgcagacgattagcgccagtaagggcgagacgggccctatggtagccgccacactaaagttggggatcgcaatactaaatggcggtaattcaactgtgcaacaaaagatgctggattacttgaaggagaagaaagacgtaggtttttttcagtccctcgccgggcttatgcagtcttgctccgtgctagacctcaatgcattcgagaggcaaaacaaggccgaaggcctgggcatggtcacagaggaaggctccggcgagaaagttttgcaggacgacgagtttacttgcgacctgtttcggttcctgcagttgctttgcgaaggccataactccgatttccagaactaccttcggacccagacaggcaataataccactgttaacattattatttcaacagtggattatctcctacgcgttcaggaatccatttcagatttttactggtattattccggtaaagatgtaatagacgaacaggggcagcgtaatttcagtaaggctatccaagtggcaaagcaggtgtttaatacactgacagagtatatccaagggccatgcactggtaatcagcaatcgcttgctcactcaagactgtgggacgccgttgtcggtttccttcacgtgttcgcacacatgcagatgaaactgtctcaggactcgtcgcagatagaactgctgaaagaattaatggatctgcagaaagatatggtggtgatgttgctgagtatgctcgagggaaatgtggtgaatggaacaatcggcaaacagatggtagatatgcttgttgagtccagcaacaatgttgagatgattttgaaattcttcgatatgttcctcaaactgaaggatttgacaagcagtgacactttcaaggagtatgatccagatggcaagggagtcattagcaagagagattttcacaaggccatggagtcccacaaacactatacccaatccgagaccgaattcctcctctcgtgcgctgaaacggatgaaaatgagacattggactatgaagaatttgtgaaacgattccacgagccggccaaggatatcggttttaatgtggccgtactgttaaccaacctttctgaacacatgccaaatgatacacgcctgcagaccttcctcgagttggctgaaagtgtactgaactacttccagccttttctgggccggattgagatcatgggcagcgctaagcggattgagcgcgtatacttcgaaatttccgaaagcagcagaacgcaatgggaaaagccccaagtcaaggagtctaagaggcaatttatattcgatgttgtcaatgaggggggggagaaggagaaaatggaacttttcgttaatttttgtgaagatacaatcttcgaaatgcagcttgccgctcagatatcagagtcggacttgaatgagagaagcgccaataaggaggagtctgaaaaggaacgccccgaggagcaaggaccacgtatggccttcttctctatactcacagtgaggtcagcactcttcgccttgaggtacaacattcttacactcatgaggatgctgtctctgaaatctttgaaaaagcagatgaagaaagttaagaagatgaccgtcaaggacatggtaacagcctttttttccagctattggtccattttcatgactcttctacactttgtggccagtgtattccgaggatttttcaggatcatctgctcactgctgctgggtggctccctcgtcgagggcgccaaaaaaatcaaggttgccgagctgctggcaaacatgcccgatcccacccaggatgaggtccggggcgacggcgaggagggagagcgaaaaccactggaggcggcactcccttctgaggatcttaccgatctcaaggagttaacagaggaatctgacttactttccgacatatttggcctggacctgaagcgagagggcgggcagtacaagctgataccacacaacccgaatgccggcctgagcgacctcatgtctaatcctgttcccatgccggaagtacaggagaagtttcaggagcagaaggctaaagaggaagagaaagaagaaaaagaagagaccaagagtgaacccgagaaggcggaaggtgaggacggcgagaaggaggagaaagctaaagaggataaagggaaacagaaactgagacagctgcatactcatcgctacggagaaccggaagttcccgaatccgccttctggaagaagattatcgcgtaccaacaaaagctcctgaactactttgctcgcaatttctacaacatgagaatgttggctctctttgttgccttcgccattaacttcattctattattctacaaagtgagcacctcaagtgtggtcgagggcaaagaactgccaactcgtagttctagcgaaaacgcaaaggtcactagtcttgattccagtagccatcggatcattgccgttcattatgtgctggaagagagttcaggctatatggagccaacccttcgcattctcgcaatcctgcacaccgtcatttccttcttttgcatcataggatactattgcctaaaagtccccctggtgatctttaagcgggagaaagaggtcgcgcgtaaactagaattcgatgggctgtacatcacagaacaaccctctgaagatgatattaagggacagtgggataggctggtcattaacacccagagttttccaaataactactgggataagtttgtcaaaaggaaggttatggacaagtacggtgaattttacggccgcgataggatttcagaactgctgggcatggataaagccgcgctggacttttctgacgccagggagaaaaaaaagccaaaaaaggattctagcctgagcgccgtgctcaatagcattgacgtgaagtaccaaatgtggaagctgggagtggttttcactgataattcgttcctctatttggcctggtacatgaccatgtcagtgcttgggcattacaataacttcttctttgccgcccacctccttgacattgccatgggctttaagactctgaggacgattttaagctctgtgacccataacggcaagcagctggtgctcacagtgggacttctcgcagtggtggtgtacttgtacacagtcgtggcttttaatttcttccgtaagttttacaacaagtccgaggatggtgacactcctgatatgaaatgtgatgacatgttaacgtgctatatgttccacatgtacgtgggcgtgagagccggcgggggcattggagatgagatcgaagacccagcgggggatgaatacgagatttaccgcattattttcgacatcacattttttttcttcgtgatcgtgattctactagcaattatccaagggctaattattgatgcctttggggagttgagggatcagcaggagcaagtcaaggaagatatggaaaccaagtgtttcatatgcggaattggcaatgactatttcgataccgtgccacatggatttgagacccataccctgcaagaacataacctggcaaactacctatttttcttaatgtacttgattaataaggacgaaacagagcatacagggcaggagtcttacgtttggaagatgtatcaagaaagatgttgggagttttttcccgcaggcgactgtttcaggaaacaatatgaagaccagttgaactag

SEQ ID NO: 133311 - DNA, 987 bp, Artificial Sequence
  Description of Artificial Sequence: Synthetic coding sequence
atggaacccacactgcggattctggcaatattacacaccgtgatttctttcttttgcataatcggatactattgcctcaaggttcctcttgtgattttcaaacgggagaaagaggtggcaaggaagctcgaatttgacggactgtacatcaccgagcagccctccgaggatgatataaaagggcagtgggacaggctggtcatcaatactcaatcgttccccaataactattgggacaagttcgttaagcgtaaggtaatggataagtacggcgaattttacggccgggacagaatctcagagctcctgggtatggataaggccgcactggatttctctgacgcccgtgagaagaaaaaacctaagaaggactccagcctgtctgcagtgcttaatagtatcgatgtgaagtatcagatgtggaagttgggagtcgtttttaccgacaattcattcttgtacctagcctggtatatgacaatgagcgtgttgggtcattacaacaactttttctttgctgctcacctcttggacatagccatgggctttaaaacactcaggacaatcctaagttcagtgacccacaatggcaaacagctggtgctgaccgtgggactgttggccgtagtcgtttacctgtacacagtggttgcctttaacttttttaggaaattctacaacaaatccgaagacggtgacactccggacatgaagtgcgatgatatgcttacctgttacatgtttcacatgtatgtgggcgtcagggcggggggcggcatcggagatgagatcgaggaccctgctggcgatgaatacgagatctataggataatcttcgatatcacatttttcttctttgtgatcgtcatactgctcgccataattcaggggctgattatcgatgcttttggggaattgcgggatcaacaggagcaggtgaaggaggacatggaggtgttttctgatgtgtcatataagcagaggtag

SEQ ID NO: 133312 - DNA, 645 bp, Artificial Sequence
  Description of Artificial Sequence: Synthetic coding sequence
agtctgttttgtaagctgggggttctcgttcgtcacagaatttccctgtttggaaacgacgcgacatccatcgtcaattgtctgcacattctcgggcaaactctggatgctaggaccgtgatgaagaccggcctggagagtgtcaaatcagcactgagggcgtttctcgataatgctgccgaggatctggaaaagacgatggaaaacctgaaacaaggccagttcacccacacaaggaaccaacccaaaggtgtgacccagatcatcaattatacgaccgttgcccttctgcccatgctgagctctttgtttgaacacatcggacagcaccagtttggagaggatctgatccttgaggatgtgcaagtgtcgtgttataggattctgacatctctgtacgctctgggaactagtaagtctatctacgtggaaaggcagaggtccgccctcggcgaatgcctggccgccttcgcaggggccttcccggtggctttcctcgagacccaccttgacaagcacaacatctactccatttacaatacgaagtctagccgggagcgagccgccctaagcctgcccaccaacgtcgaggatgtttgtcccaacatccctagtctcgaaaagttgatggaggaaatagtgtag

SEQ ID NO: 133313 - DNA, 4266 bp, Artificial Sequence
  Description of Artificial Sequence: Synthetic coding sequence
atgaagaccgggctggaatccgtgaaaagtgctctgcgggcctttctggataacgctgccgaagatctagagaagaccatggaaaacctgaagcaggggcagttcacacatacccgtaaccagcctaaaggagtaacgcagatcatcaattacacgacagtggccctcctcccaatgttaagtagtctctttgagcatatcgggcagcatcaattcggagaagacctcatccttgaggacgtacaggtgtcttgctatagaatcctcacaagcctctacgctctaggcacgtctaagtccatctatgtcgagagacagcggagtgcacttggggaatgtcttgcagcctttgccggagcctttcccgttgctttcttggagacacacctcgacaagcataacatctattccatctataatacaaagagtagcagggagagggcagctcttagcctgcccaccaatgtggaagacgtgtgcccaaacattccctcactggagaagctgatggaagagattgtggagttggccgaaagcgggataagatatacccagatgccacacgtcatggaagtgatattgccaatgctttgcagttatatgagcaggtggtgggagcatggacctgagaacaaccctgagagggcggaaatgtgctgtaccgccctgaacagcgagcatatgaacacattactcgggaatatcctcaaaatcatctacaataacctcggcatcgatgagggcgcctggatgaaaagattagcagtgtttagtcaacctattatcaataaggtaaagccgcagctcctgaagacccatttcctcccactgatggaaaagctgaagaaaaaggctgcaaccgtcgtgagtgaggaggatcaccttaaggctgaggccagaggtgacatgtccgaggctgagctgctgatcctggacgagttcaccaccctcgctagagatttatacgctttctatcctctgctgataaggttcgtggactataaccgcgccaagtggttaaaagagcccaaccccgaagccgaagagttattcagaatggtggcggaggtctttatatattggagtaagagccacaacttcaaaagagaagagcagaattttgtggtacagaatgaaatcaataacatgtcattcctcattacagatacgaaaagtaaaatgagcaaggccgccgtgtcagatcaggagcggaaaaaaatgaaacgaaaaggcgatcgatattcaatgcagacctccttgattgtggccgctctgaaacggctcctgccaataggcctgaatatctgtgcccccggagatcaagagctgattgccctggccaagaacaggttctcgttgaaagataccgaggatgaggtccgggacatcatccgcagcaacatccacttgcaggggaagctggaggatcctgcaattcgctggcagatggcgctctataaagatctgccgaatcggaccgacgatacaagtgaccccgaaaagaccgtggagcgagttctggacattgctaatgttttgttccatctggaacaaaaaagtaaaagagtaggtaggagacactactgcctcgtggaacacccccagaggtcgaaaaaggccgtctggcataagctgctgtctaagcagaggaagcgggctgtggtcgcttgtttccggatggcccccttgtacaacttgccacgccaccgtgccgtgaacctgttcctccagggctatgagaagtcttggatcgaaaccgaggagcactactttgaggataaattgattgaggacctcgccaagcccggtgccgagcctccagaagaagatgaaggcaccaagagagtggatcccctccatcaactcattctgctcttcagccggacagccctgactgagaagtgcaaactagaagaggactttctttatatggcctacgcagatatcatggccaaatcctgtcatgatgaggaggatgatgatggggaggaggaagtgaagtccttcgagcatgatatcatcaaggatctcaggaacaaattcgcatctctgggggaaaattcactggagaaggagatggagaaacagaagctattgtaccaacaggcccgcctgcacgatagaggcgcggctgagatggtgctgcagacaatctcagcatccaaaggggaaacaggacccatggtggctgcgaccctgaaactagggatcgccatccttaacggaggcaactcaaccgtgcagcaaaaaatgttggactacttaaaggaaaagaaggacgtgggatttttccagtctctcgcgggcctgatgcaatcatgcagcgtactcgatctgaatgcttttgaacgtcagaacaaagcagagggactgggaatggttaccgaggaaggctcaggcgagaaggttttacaggacgacgagtttacctgtgatctcttcaggttcctgcagctactctgtgaaggacataacagtgactttcaaaattacctgaggacccagacagggaacaataccacggtaaacatcatcatctcaactgtagattacttacttcgagttcaggaatctataagcgatttttactggtactatagcggcaaagatgtcatcgatgaacaggggcagagaaactttagtaaagctattcaggtggccaagcaggtgttcaacacccttactgagtacattcagggaccatgtacaggcaaccagcagtcactggcccacagcaggctgtgggatgctgtcgttggcttcctgcatgttttcgctcacatgcagatgaagctgagccaggacagctcacaaattgaactgcttaaggaattgatggacttgcaaaaggacatggtggtgatgcttttgtcgatgctggaaggcaacgttgttaatggcactattggaaaacaaatggtggacatgttagttgaatcatcaaataacgtggagatgatactcaagttcttcgacatgtttttgaaactgaaggatctgacaagctcagacacattcaaggaatacgaccccgatggtaagggagtgattagcaagagagattttcacaaagctatggaatctcataagcactacacacaatcggagaccgagttcttgttgagttgcgctgagactgatgagaatgagaccctggattatgaggaatttgtcaagaggtttcacgagcctgccaaggacattggattcaatgtggctgtgctgttgacgaacttgtctgaacatatgcccaacgatactcgcctacaaactttcctcgagttagctgagagcgtcttgaactacttccaaccatttctaggccgaatcgagatcatggggtccgctaaaagaatcgaaagggtgtattttgaaatctcagaaagctccaggacgcaatgggagaagccccaggtgaaggagagtaaacggcagttcatctttgatgtggtgaacgaaggaggcgagaaggaaaaaatggagctgttcgtgaacttttgtgaggataccatttttgaaatgcagctggccgcacagattagcgagagcgacctgaacgaaaggtctgccaataaggaagagtcagagaaggagcgaccagaggagcaggggccaaggatggcctttttctccatcctcacagtgagaagtgcacttttcgctctgaggtacaatatcctgacactcatgcggatgctcagtctgaagagtctcaagaagcagatgaaaaaggtgaagaagatgacagtgaaagacatggttaccgcttttttttcttcgtactggtcaatttttatgactttactccattttgtagccagtgtttttaggggcttcttccgaatcatttgctcgctcctgctggggggttccctggtggagggagctaagaaaattaaggtagccgaattgttagccaacatgcccgaccccacccaggacgaagtccggggagatggagaagagggtgaaagaaagcctctcgaggctgctcttcccagcgaagatttgactgacttgaaggagttaaccgaagagtccgatttgcttagcgatatttttggactcgacctgaaaagagagggcggtcaatacaaactcattccacacaaccccaatgctgggctgtccgatctgatgagtaacccagtgccaatgcccgaggtacaggaaaagtttcaggaacagaaggctaaagaggaagaaaaggaagagaaagaagaaactaaatcagaacccgagaaggcagagggtgaggatggatag

SEQ ID NO: 133314 - DNA, 14856 bp, Artificial Sequence
  Description of Artificial Sequence: Synthetic coding sequence
gacgatgaggtagtgttgcagtgcactgcaacgatccacaaagagcaacagaagctgtgtctggccgctgagggcttcggaaatcggctctgtttcctcgagtccacctccaatagcaaaaatgtaccgccagacttaagtatttgcacattcgtactggaacaatcgctgtccgttcgagccctacaggagatgttagcaaatactgtcgagaaaagtgaggggcaggtggacgtggagaagtggaagtttatgatgaaaacggcccagggaggtggccaccgtaccctcttatacggacacgccatactgctgaggcatagctattcaggcatgtacctgtgttgtctcagcacaagccgttcctcgacagacaagctggcttttgacgttgggctgcaagaagacacaactggggaggcttgttggtggacaatacatcccgcatccaagcagagatctgagggggaaaaggttcgcgtgggagatgacttaattctcgtctctgtgtcttccgagagatacctccatctgtcatatgggaacggctctctccatgtggatgcggcatttcaacagactttatggtccgttgcccctatctctagcggttccgaggcagcgcaaggctacctgattggaggagacgttctgagactgctgcatggccacatggacgaatgccttaccgtgccatccggcgaacacggggaagaacaaagaaggaccgttcactacgaggggggtgcggttagcgttcatgcgcgttcactatggcgtctggagactcttcgcgtcgcttggagtgggagtcacatcaggtggggacaaccttttagactacggcatgtgacaaccggcaagtatctctccttaatggaagataaaaacctcctcctgatggataaggagaaggctgatgtgaagtccaccgcctttaccttccgctctagcaaagagaagcttgacgtgggagtcaggaaagaggttgacggcatgggaacctccgaaatcaagtacggagatagtgtttgttatatacagcacgtcgatacgggattatggctcacttaccagtcggtggacgtgaaaagcgtacgtatgggcagcatccagagaaaagctattatgcatcacgaaggacatatggacgatggaattagcctgtccagatcccagcacgaagaatccagaactgccagggttatccgctctactgtgtttctgtttaatcgattcatccgaggactcgatgccctgtccaaaaaggccaaggcatccacagtcgatctccctatcgaatctgtttcacttagcctgcaggacttgattgggtacttccacccccccgatgagcacctcgaacacgaagacaagcagaaccggctgcgcgccttaaagaaccgacagaacctgttccaggaggaaggtatgattaacctggtcctcgagtgcattgatcgacttcacgtgtatagctccgccgcccatttcgccgacgtggcgggcagggaagcaggcgaatcctggaagagcatcttgaactccctgtatgaattactggcggctctcatcagaggaaacagaaagaattgtgcccagttttcaggttccctcgactggctgatttcccggctggaaagattggaggcctcttcggggatcctcgaagtgctccactgcgtcctcgttgagagtcccgaagcccttaatatcataaaagaagggcacatcaaaagcatcatttccctgcttgataagcatgggagaaaccataaagtattggatgtgctgtgttctctctgtgtctgccatggcgttgctgtgagatccaatcagcatctgatttgcgacaacttgctgcctgggcgcgacctgttgctgcagacaagattggtgaatcacgtatcgtccatgcgccccaatatctttctcggagtatcagagggaagtgctcagtataaaaaatggtactacgagctcatggtcgatcatacagaaccctttgtaacagccgaagcaacccatctgcgcgtgggctgggccagtacagaaggatatagtccctatccaggaggcggggaggagtggggagggaacggcgttggagacgacctgttctcctatgggttcgatggacttcacctctggagtggctgcatcgcacgcacggtcagttcgcctaaccagcacttgctccgcactgatgacgtaatcagctgttgtttggatctgagcgcccccagcatctccttccggattaacggacagcctgtgcagggcatgtttgagaatttcaatatcgatggtctattcttcccggtcgtcagcttcagcgcagggatcaaagtccggtttttacttgggggccggcacggcgagttcaagttcctcccccctcctggctacgccccctgctatgaagcggtactgcccaaggaaaaactgaaggtcgagcatagcagagagtacaagcaagaacgaacctatacccgagacctgctaggtcctaccgtttctcttacacaggcggcattcacacctattccagtggatacgtctcaaatcgtcctaccgcctcatctcgaacggattagagaaaagttagctgagaacattcacgaactgtgggtaatgaacaagattgaactcggttggcaatatgggccggtgcgcgacgataataaacgacagcatccatgtttagtagaattcagcaaactgcctgagcaagaaagaaattataacctacagatgtctctggaaaccttgaaaaccctgctggctctgggctgtcatgttggcatatcggatgagcatgcagaagataaggtgaaaaaaatgaaactgcccaagaattaccagctgacaagcggctacaaacccgctcctatggacctttccttcataaaattgaccccatctcaggaggcaatggttgataagctcgctgagaatgcacacaatgtatgggcccgggatcgaatccgccaaggctggacttacgggattcagcaagatgtgaagaaccgtcgcaacccccggctcgtgccctacaccttattggacgaccgcaccaaaaaatctaacaaggactctctccgggaggcagttcgcacgctgctgggttacgggtacaatctggaagcgcccgaccaagatcacgccgcccgggccgaggtttgcagcggaacaggagagcgcttccgcatttttagagccgaaaagacatatgcagtgaaagctgggagatggtacttcgaatttgaaacagtcaccgctggcgatatgcgtgtcggatggtccagacccgggtgtcagccggatcaggaattgggttccgatgagcgggccttcgcttttgacggatttaaagcccaacgctggcatcaaggtaacgagcattacggacgtagctggcaggccggtgacgtggtaggttgcatggtcgatatgaacgagcacactatgatgttcaccctgaacggcgaaattctgttagatgacagtggaagtgaactggccttcaaagacttcgatgtcggcgatggctttatcccggtgtgctcattgggggttgcccaggtgggcaggatgaacttcgggaaggacgttagtactctgaagtattttaccatatgcggactgcaagaaggctacgagccgttcgccgtcaacaccaatcgggacataacaatgtggctgagcaaaaggctcccgcaattcttgcaggtgccaagcaaccatgagcacatcgaagttactaggatcgatgggaccattgatagctctccctgcctgaaggtgactcagaaatccttcggatcgcaaaacagcaataccgacattatgttttacagactctccatgcccatagagtgtgcagaagttttctccaaaactgtggccggaggactccccggcgccggcttgttcggccctaagaatgatctggaggactatgacgctgacagcgacttcgaagtcctgatgaagaccgcacacggccaccttgtgcccgatcgggtcgataaagataaagaagcaaccaagccagaatttaataaccataaagattacgcccaggagaagcctagccggctcaaacagagatttctcttgcggcggacaaaaccagattacagcacttcacatagtgcccgtctgactgaggacgtgttggccgatgatcgtgacgactatgacttcctgatgcagacctctacatactattactctgtgcggatcttccctggccaggaacctgctaatgtgtgggtgggttggatcacgagcgacttccaccagtacgatactgggttcgacctggaccgtgtgagaaccgtgaccgtgacgctgggcgatgaaaaggggaaagtgcacgagtccattaagaggagtaactgctacatggtgtgcgctggcgagtccatgtctcccggccagggacgcaacaataacggactggaaattggctgcgtagtggatgcagcctctggactgttaacctttatagcaaacggtaaggaactgtcaacctactatcaggtagagccttccactaagctgttccccgccgtcttcgcgcaggcaacatcccccaacgtgtttcaatttgagctgggacggattaagaatgttatgcccctgagcgccggactgtttaaaagtgagcataagaatcccgtaccgcagtgtcctcccaggctgcatgtgcagttcctctcccatgtactgtggtctaggatgccaaaccagttcctcaaggtggacgtcagtagaatctcagaacgccagggatggctggtgcaatgtttggatccgcttcagtttatgtccctccatatccccgaggagaacagatcagtggatattctggagctcaccgagcaggaggagctactcaagtttcactatcataccctgcgcctttatagcgccgtctgtgcactgggaaaccaccgcgtggcccacgctctgtgttctcatgtcgacgagcctcaactgttgtatgctatcgagaacaagtacatgcctggtctcctcagagccggctactacgatctcttaattgatatacacctgtcctcctatgccacagctcgtctgatgatgaacaatgaatatattgtcccgatgaccgaagaaaccaaaagtatcacactgtttcctgacgagaataagaaacatggtttgcctgggatcgggctgtccactagcctgcggccccgtatgcagttctcatcacctagcttcgtgagcatcagcaatgaatgctaccagtactccccagaattccctctcgatattctgaaatcaaagaccatccagatgctgaccgaagcagtgaaggagggctccctgcacgccagggatcctgttggagggaccacagagttcctgttcgtccccttgatcaaactgttctacacgctgctgatcatgggaatctttcacaatgaggatctcaaacatattctacagctcattgagccctctgtgtttaaggaggccgccaccccagaagaggagagcgataccttggaaaaggagctcagcgtcgacgacgccaagttgcagggcgccggagaggaggaggccaaggggggtaagagacccaaggaggggctgttgcaaatgaagctgcccgaaccagtcaaactccaaatgtgcctcctgctgcagtacctctgcgattgccaggtgcggcatcgaatcgaagctatcgttgctttctctgacgactttgtcgcaaagttgcaggacaatcagcggttccggtataatgaggttatgcaagccctgaatatgtccgccgcactgaccgcccgcaaaacaaaggagttcaggagcccacctcaggaacagatcaatatgctattgaattttaaagatgataagagcgagtgcccctgtcccgaagagattcgggaccagcttctggatttccatgaggatctgatgacacactgcggaatagaactggatgaagacgggagcctggacgggaactcagatcttacaattcggggtcgcctattgagtctggtggagaaagtaacgtatttaaaaaaaaagcaggccgaaaagcccgtagagtcagattctaaaaagagctccactttgcagcagttgatcagcgagacaatggtgcgctgggcccaggaatctgtgatagaagaccctgaactggttcgcgcaatgttcgtgctactccataggcagtatgacgggattgggggcctggtacgtgctctgccgaagacatacacaataaacggtgtttcggtggaagacacgatcaatttgctggccagcctgggtcagattagatccctgctgtccgtgcggatggggaaagaagaggagaagctgatgatacggggactcggagacattatgaataacaaggtgttttatcagcatccaaaccttatgagagcccttggtatgcacgaaactgtgatggaggtgatggtgaatgtacttgggggcggagagtccaaagagattacatttccaaagatggtggctaattgttgtcggttcctgtgttatttctgccgaataagcaggcagaatcagaaagccatgtttgaccacctgagctatctcctcgagaatagtagtgtgggtctcgcatctccagccatgcgaggttcaacaccacttgatgttgctgcagcatccgttatggacaacaatgagcttgccctggcacttagggagcctgatctcgaaaaggtggtgcgctatctggctggatgcggacttcaaagttgccagatgctggtttcaaagggataccctgacataggatggaacccagttgagggggagcgttacctggacttcttgcgcttcgctgtgttctgtaacggagaatcggtggaagagaatgcaaatgtggtcgtccgacttctgatcaggcgccccgaatgtttcgggccggcactgaggggcgagggcggcaacggtctgcttgcagccatggaggaagcaattaaaatcgcagaggatccgagcagggatggaccatcacccaactctgggagctctaaaaccctagacactgaagaagaagaagacgacaccattcacatgggcaatgctattatgactttctatagcgccctaatcgacctcctggggcgatgcgctcccgaaatgcacctgatacacgccgggaaaggggaggcaatcagaattcggagcatactgagaagcctaatcccacttggcgacctagtgggggtcatcagcatcgcctttcaaatgcctacgatagcgaaagacggcaacgtagttgaacccgatatgagtgcgggattctgcccggatcacaaagcagccatggtgttgttcctcgatcgggtctacggcatcgaggtgcaggactttctactgcacctgctcgaagtcggatttttacctgatcttagagcagcggccagcctggacacagccgctttgtctgcgaccgacatggcccttgcattgaacaggtacctgtgcaccgccgtgttgcccttactaacacgctgtgccccgctgtttgctggtacagagcaccacgcttcactgatcgactctctgctccataccgtctatagactttctaagggctgctctctgacaaaagcccagagagacagcatagaggtctgcctcctatcaatttgtggccagctgaggcctagtatgatgcagcatctgctccgccgtttagtgttcgatgtgcccctgcttaacgagcacgctaaaatgccactcaagctactgacgaaccattacgagagatgttggaagtattactgcctccccggcggatgggggaactttggagctgccagtgaggaagagctgcacctgtcacgtaagctattctggggcatattcgatgctttaagccagaaaaagtatgagcaggagctgtttaaactggcattaccatgtctgtccgcagtcgccggggccctgcccccagattacatggagtcaaattatgttagtatgatggagaagcagagtagtatggatagtgaaggaaacttcaaccctcagccagtggatacctccaacattaccatccccgagaagctagagtatttcattaataaatatgcagaacatagccatgacaagtggagtatggacaaattggccaatgggtggatctatggagagatctactcggattcctccaaagttcaacccctgatgaagccttacaaactcctgagcgaaaaggagaaggaaatctatcgttggccaatcaaagagagcctcaaaactatgctggcctggggatggaggattgaaaggacacgggaaggagacagtatggcgctgtacaacagaacacgcaggatttctcagacctcccaggtatcggtagacgccgcacacgggtattcacccagggcaatcgacatgtccaacgtaacattgtctagggacctccacgcaatggcagaaatgatggcggagaattaccacaacatttgggccaagaagaagaagatggaattggagtcaaaaggggggggtaaccacccactcctcgtcccatatgacactttaacagccaaagagaaggcgaaggatagggaaaaggctcaagacatcctaaagttcctgcagattaacggctatgctgtaagtagggggtttaaggacttggagctggacacaccaagcatcgagaaacgattcgcctattcttttttgcagcagctgatcagatacgtcgatgaagcccaccagtacatcctggagtttgacggggggagccgtgggaagggcgagcattttccatacgaacaagaaataaagttttttgctaaggtcgtgctgcccctaatcgaccaatacttcaagaatcacaggctctatttcctgtctgcggcctccaggcccctgtgttccggcggacatgcaagcaataaagagaaggaaatggtcacatctctgttctgcaaactgggagtgctcgtccgccaccgcataagcctattcgggaacgacgcaactagcattgtcaactgcctgcacatcctcggccagacattggatgcgcgcacggtcatgaaaacgggcttggagtccgtgaaatccgcgttgcgcgcctttctggacaatgcggcggaggacctggagaagaccatggagaacctgaaacaggggcagtttacacatactaggaatcaaccaaagggcgtgacccagatcattaattataccacggtcgcactcctgcctatgctgagtagtctgtttgagcatattggacagcaccagttcggagaggatctgattttggaggacgtccaggtaagctgttatagaattctaacatcactctacgccctaggcacatctaaatctatttacgtcgagaggcaacggagtgccctgggcgagtgcctcgcggcattcgccggcgctttcccagtcgcattcttggaaacacacttggataagcacaacatctatagcatttacaacaccaaaagctcccgagagcgagctgctctgtccctgcctaccaacgtggaggacgtctgccctaacatccctagcttggaaaagttaatggaggaaatcgtcgagttggcagagtcaggcattcggtacacccagatgccccacgtgatggaggtcatcttgcctatgctgtgtagctacatgagccgctggtgggagcacggcccagaaaataaccccgagcgcgccgagatgtgttgcactgctctaaacagcgagcatatgaatactctgcttgggaacattctcaaaatcatctataacaacctgggtattgacgaaggagcttggatgaagagactggcagtctttagccagcccatcattaataaagtgaagccacaactgctgaagacacattttctgcccctcatggagaaactgaaaaaaaaggctgccacggttgtgtccgaggaggaccacctcaaggccgaagcccgcggcgatatgtctgaggcagagttgctcatcctggacgaatttacgacactggctcgtgacctctatgccttctatcctctgctgatcagatttgtggattacaatagggcaaaatggctcaaagagcctaatcctgaagccgaagagctcttccgcatggttgctgaggtattcatatactggtcaaagagccataatttcaaacgcgaggagcaaaacttcgtggtgcagaatgagatcaacaacatgtcctttcttatcacggataccaagtctaagatgagcaaggccgctgtatcagaccaagagcgaaagaaaatgaagcgaaagggcgacaggtattcaatgcaaacttcactgatcgttgctgcccttaaaagactgctccctatcggactaaacatctgcgctcccggggatcaggagttgatcgctctagccaaaaatagattctcgcttaaggataccgaggatgaggtccgagacattattaggagcaacattcacctgcagggaaaactggaggaccccgctattagatggcaaatggcgttgtataaggacctcccgaaccggacagacgatacttctgatcccgagaaaaccgtagagcgcgtgctggacattgccaatgtactgttccatctggaacagaaatcaaagcgcgtgggcagaaggcattactgcctggtggagcatccacagcgctcgaaaaaggccgtatggcataaacttctctccaagcagaggaagagagcagtcgttgcctgcttcaggatggctccactgtataacctgccacgccatagagctgtgaatctgtttctgcagggttacgagaaaagctggatagagacggaagagcattatttcgaggataagctgattgaagatctcgccaaacccggagccgaaccaccagaagaggacgaaggtacaaaacgggtcgaccccctgcaccagctgatcttgctattttccagaactgcactcactgaaaaatgcaaactcgaggaagacttcttgtacatggcttatgccgatattatggccaagtcttgtcatgacgaggaggatgacgatggggaagaagaggtgaaatcctttgaagagaaagagatggagaagcagaaacttctgtaccagcaggcccgtttgcatgacagaggcgccgccgagatggtgttacagacgatcagcgcctctaagggcgagactgggccaatggtggctgccactctgaagttagggattgccatcctgaacggcggcaattcaaccgtgcagcagaaaatgctggattatctgaaagagaagaaggacgtgggcttctttcagagtctggcaggcctgatgcagagttgttctgttttggatctcaacgcatttgagcgtcaaaacaaggccgaaggcctgggaatggttaccgaagagggctccggcgagaaggttctgcaagacgatgagttcacatgcgatctgtttcggtttctgcagctgctgtgcgaagggcataactccgacttccaaaactatttaaggacacaaaccggaaacaacacaaccgtgaacattataattagcaccgtggattatcttttgcgcgtgcaggaatccataagcgacttctactggtactacagcggcaaggacgtcatcgacgagcaggggcaacgcaacttcagcaaggctattcaggtagccaaacaggtattcaatacccttactgagtatatccaggggccgtgtacaggcaaccagcagtctctggctcatagcaggctttgggatgccgtggtcgggtttttacatgttttcgcacacatgcaaatgaaactaagccaggattcttcccaaatcgaacttctcaaggagctcatggatctgcagaaggacatggtggtcatgttgctgtcaatgctcgagggcaacgtcgtgaatggaaccataggcaagcaaatggtcgacatgctggtggagtcctccaacaatgtcgagatgattctgaagttcttcgatatgtttttgaaactcaaagacctgacctcctctgacacatttaaggaatacgatcctgacggaaagggcgtgatctctaaacgcgatttccataaggcaatggaaagccataagcattacacacaaagtgaaacagaattcctcctcagctgtgccgagactgatgaaaatgaaaccctggactacgaagagtttgtgaagcggttccacgaacctgctaaggacatcggcttcaatgtagcggttttgcttaccaacctaagcgagcatatgccaaacgataccagattacagacctttcttgaacttgctgaaagtgtgctgaactactttcagccatttctgggcagaattgaaataatgggaagcgcaaagcggatagagagggtgtatttcgaaatatccgagtccagtcgtacccagtgggaaaaaccacaggttaaggaatccaagcgacagtttatcttcgacgtggtgaatgagggcggcgaaaaagaaaaaatggagctgttcgtgaacttttgtgaggataccatcttcgagatgcagctggccgcacaaatctcagaaagcgacctgaatgagaggagtgcaaataaagaagagtcggaaaaggaacgcccggaggagcaaggccctaggatggctttcttctccattctgaccgtgcggtccgccctttttgctctgcggtataacattctgactttgatgcgcatgctgagcctgaagtcattgaaaaaacaaatgaaaaaagttaaaaagatgaccgtgaaagatatggtcacggctttctttagcagctactggtccatcttcatgaccctgcttcatttcgtagcttccgtgtttaggggcttctttagaataatctgtagcctcctactggggggatccctcgttgaaggtgccaagaagattaaagttgcagaactcctcgctaatatgcccgacccaactcaggatgaagtgaggggagatggcgaagagggcgagcgcaagcccctcgaggccgccttgcccagcgaagatctcacagaccttaaagaacttaccgaagagtcagacctgttgtccgatatttttggtctggatctgaaaagggagggcggtcagtacaagttaattccccacaatcctaacgcaggtctgtctgatctgatgagtaatccggttccgatgccagaggtccaggagaagtttcaggaacagaaagctaaagaagaagagaaggaagagaaggaagaaacaaaaagtgagccagagaaggcggagggcgaagacggcgaaaaggaggaaaaagctaaagaagacaaaggtaaacaaaagctacgccagctccatacccaccgctacggcgagccagaggtgccagaatcagcattctggaagaagattatcgcctatcagcaaaaactgcttaattacttcgccaggaatttttacaatatgcggatgctagcccttttcgtagcctttgccattaactttatattattgttttacaaggtgtccacaagctccgtggtggaggggaaagagctacccacaaggagctcttccgaaaacgccaaggtcacttccttggactctagctctcacaggattattgcggtgcattacgtcctagaagagtcttctggctacatggagcctactctgcgaatcctggcaattttacacaccgtgatctcttttttttgcatcatcggctactattgccttaaggttcctctggttatcttcaagcgggaaaaagaagtcgctcgcaagttagagtttgatggattgtatattactgagcagccaagtgaagatgatattaaggggcaatgggatcggctggtgatcaatacccagtcctttccgaataattactgggataagtttgtcaagcgtaaggtaatggataaatacggggagttctacggtagggaccgcatcagtgaactgctgggcatggacaaggcggctctggatttttcggacgctcgggaaaagaaaaagcccaaaaaagatagctccctgtctgccgttttgaacagcattgatgtgaaatatcagatgtggaaactgggagttgtattcaccgataatagcttcctgtacctagcttggtatatgaccatgagcgttctgggtcattataacaactttttttttgctgcccatctacttgatatcgcgatgggtttcaagacgctgcgtacaatcctgagcagcgtgacacacaatggcaaacagctggtcctgaccgttggcctgctggcagtggtggtttacctgtataccgtggtggctttcaactttttccgtaaattctataataagtctgaggacggggatacacctgacatgaagtgcgatgacatgctgacctgttatatgttccacatgtatgtcggagtacgcgccggcgggggcatcggggatgagatcgaggatccagccggagacgagtacgaaatctacagaattatatttgatattacattcttcttttttgtgattgttatcctcctggcgattatccagggcctaataatcgacgcatttggcgagcttcgggaccagcaagagcaggttaaggaggatatggaaaccaagtgctttatatgtggaattggcaatgactactttgataccgtccctcatggcttcgaaacccatactctacaagagcacaacttggcaaactacctcttcttcctgatgtacctgatcaataaagacgagactgaacatactggccaagagtcttacgtatggaaaatgtatcaggagcggtgctgggagttttttcctgcgggcgactgctttagaaagcagtatgaagaccaacttaactag

SEQ ID NO: 133315 - DNA, 14601 bp, Artificial Sequence
  Description of Artificial Sequence: Synthetic coding sequence
atggctgagctcggggggggtggggaggaagacgctagatggtatcgcaaggaagacgaagttgttcttcagtgtatcgctaccattcacaaggaacaaaggaagttctgcctggccgccgaaggattaggcaataggttatgctttctcgagcccacttccgaggccaagtacatcccacccgatttgtgcgtgtgcaacttcgtactggaacagtctctctctgtgcgcgccctgcaggaaatgctggcaaatactggggagaatggaggagagggcgctgctcagggaggcggccatagaactctgctttatgggcatgccgtgctcctgaggcactccttctccggaatgtacttaacctgtctcaccacctcacggtcccagacagataaattggcctttgacgtcggattgagggagcacgcaactggcgaagcctgttggtggacaatccaccccgcgagcaaacagagatccgaaggcgagaaagtccggattggagacgacctgatcttagtatcggtgtctagcgagaggtatctgcacctgagtgtctccaatggaaacatccaagttgacgcctcttttatgcagactttgtggaatgtccaccccacatgttctgggagtagcatagaggaaggatatctgctcggaggccacgtggtgcgccttttccatgggcacgatgagtgcttgactatcccaagcaccgatcaaaacgactctcagcatcgtcgtatattttatgaggccggcggagctggaactcgagcgagaagtctctggagggtagagcccctgcggatttcctggagcggttccaatatacggtggggacaggctttccgcctgaggcatctgaccaccggccactaccttgccctcacagaggatcagggtctgatccttcaggatcgtgctaagtcagacaccaaatccaccgccttctcttttcgtgcctccaaagagttaaaggaaaagctcgactcatcccataagcgggacatcgagggcatgggggtcccggagatcaaatacggtgacagtgtctgtttcgttcagcatatcgcctccggtttgtgggtaacctacaaggctcaagacgccaaaacatcgaggctggggcctctgaaacggaaggtgatcttgcaccaggaagggcacatggatgatggactgacactgcagagatgccaacgcgaggaaagccaggcggcacgcattatcaggaacactaccgctttattcagtcaatttgtgagcggaaacaaccgcacagccgcccccataactctgccaatcgaggaggtgttacagactcttcaggacctgatcgcctactttcaacctccggaggaggagatgcgtcatgaggacaaacagaacaagttgagaagccttaagaataggcaaaatttatttaaggaagaggggatgctagccctagtgttgaattgcatcgaccgattgaacgtgtataattcagtcgcccatttcgcaggtatcgcccgggaagaatcgggcatggcttggaaggaaattctgaacctcctgtacaaactgttggccgcccttatacggggaaatcgtaataactgtgcacagttctccaacaacctggactggcttatcagcaagctggacaggctggagagctcctctgggattctcgaggtgcttcattgcattctcactgagagccctgaagcactgaaccttattgccgagggccatatcaaatcaatcatttcgctactcgacaagcacggccgcaaccataaggtgcttgatatactgtgtagcttgtgtctgtgcaatggtgtggcagtcagggccaatcaaaatctcatctgtgataacctcctcccacggcgcaaccttctgctgcagactagactaattaatgatgtgacatccataagacctaacattttcctgggggtcgcagagggctccgcacagtataagaaatggtacttcgagttgattattgaccaggtggacccatttctcacagctgagcccacccatctgcgggtcggctgggcgtccagctccggttatgctccgtatcccggaggcggcgagggctggggcggcaacggagttggcgatgatctttattcttacggattcgacggcttgcacctgtggagcggcaggatcccaagggccgtcgcgtctattaatcaacacttgctgcggtccgatgacgtcgtgagctgttgtctcgatcttggggtgccaagcatcagctttcggatcaacggacagccagtgcagggaatgtttgaaaacttcaacacagacgggctgttctttcctgtgatgagcttctccgccggagtcaaggtgcgctttctgatgggtggaagacacggggaatttaagttcctgccaccatccggctacgcgccttgttacgaagccctgttacctaaagaaaagatgcgcctggagccggttaaggagtacaagcgtgacgctgatgggatcagggacctcctggggaccacccagtttctctcacaggcctcctttatcccctgccccgtagacacaagccaggtcatcctgccgccccacctcgagaaaattcgcgataggctcgcggaaaacatccatgaactttggggcatgaacaaaattgagctgggttggacatttggcaagattcgtgatgataataagagacagcacccatgcctcgttgagtttagtaaattgcctgagacggaaaaaaattacaatctccagatgtctactgaaacattgaaaacactcctcgcactgggatgtcacatcgcccacgtcaatcccgcggccgaagaggatctgaagaaagtaaagctgcctaagaactatatgatgtccaatgggtataagcccgcaccactggacctgtctgatgtgaaactgctgccccctcaggagatcttggtggacaaactggccgagaacgcccataatgtatgggccaaagataggatcaagcagggctggacatacgggatccagcaggatcttaaaaacaagcgcaacccaagactggtgccctatgcactactggatgagagaactaagaagagtaatcgtgacagtctgcgagaagccgtccgcacgttcgttggatatggctataacatcgaaccaagcgatcaggagttagctgactctgctgttgagaaagtttccatcgataaaatcagattctttagggtggagcgttcctacgcagtacgcagcggaaaatggtactttgaatttgaggtggtcactggaggagacatgcgagtgggctgggcccgccctggctgcagacccgatgtcgaactgggtgccgacgaccaggcatttgtatttgagggcaaccgcgggcagaggtggcatcagggatcaggctattttggaaggacgtggcaaccgggcgacgttgtgggatgcatgatcaacctggatgacgcatctatgatattcactttaaatggtgaactcctcattaccaacaagggatccgaactggcgtttgcggattacgagattgagaatggtttcgttcccatctgttgtctcggactctcccagattgggcggatgaacctcggaacagatgcatcaacctttaagttctacacgatgtgcggcttgcaagaaggcttcgaacccttcgccgtgaatatgaatcgagatgttgctatgtggttcagtaaaagactgcccacctttgttaatgtgcctaaggaccaccctcacatagaggtaatgaggatagatggcacaatggacagccctccatgtcttaaggtgacccacaaaactttcgggacacagaactcaaatgcagacatgatctattgccgtctgtctatgcccgtcgaatgccacagcagcttttctcacagtccctgccttgatagcgaagccttccagaagaggaaacagatgcaggagatcctgagccacacaacaacacagtgctattacgcgatcaggatctttgcaggccaggatccctcctgcgtttgggtggggtgggtgactccagattaccacctctatagtgagaagttcgatcttaacaaaaactgcaccgtcacggttacactcggggatgagcgggggcgcgtgcatgagtcagtgaaacgaagtaactgctatatggtatggggaggggatatcgtagctagctcccagagaagcaatagaagcaacgtggacctagaaatcggctgcctggtggatttggcgatgggcatgctctctttttcagcaaacgggaaagagctcggaacatgttaccaggtcgaacctaatacaaaggtgttcccggcagtctttctacagccaacctcgacttctttatttcagttcgaactgggaaaattgaaaaatgccatgccactctccgctgctatatttaggtcagaagaaaagaacccagttccacagtgtcccccaaggctggacgtgcagacaatccagccagtgctttggtcaaggatgcccaactcctttctgaaggtggaaaccgagagggtctctgaacggcacggatgggtggttcagtgcctggagccacttcagatgatggccctgcatatccctgaggagaatcggtgcgtggacatcctcgaattgtgcgagcaggaggacttaatgcggtttcactatcacactctgaggctttattcagccgtgtgcgcgttaggcaacagtagagtggcctacgctttgtgctcacatgtggatttgtcacaactgttttacgccatcgataataaatacctgccaggactgcttcgctctggattttacgaccttcttatctcaattcatctcgcatcagccaaggagagaaaattaatgatgaagaacgaatatattattcctatcacatctaccactagaaacatacggctgttccccgacgagagcaaacgacatgggttacctggagtcggtctgagaacatgtctaaaacctggcttcagattctctacgccttgtttcgtggtgacaggggaagaccatcagaaacagtcccctgagatacctctcgagtccttacgcactaaggcgcttagcatgctgactgaagccgttcagtgttcgggcgcgcacattagggatcctgtgggaggaagtgtggagtttcaattcgtccctgtcttgaaactgatcgggacactgttggtgatgggcgtgttcgacgacgatgatgtgaggcagatcctactcctcatagaccccagtgtattcggggagcacagtgctgggaccgaggagggggcagagaaggaggaagtgacgcaagtcgaggaaaaggctgtggaagcaggagagaaggcagggaaggaagctcctgtgaaaggtctcttgcagactcgcttgcctgagtctgttaagcttcaaatgtgtgagctactgtcctatctgtgcgattgtgaattgcagcatcgggttgaagcaattgtcgccttcggtgacatctacgttagcaaactgcaggctaatcagaaattccggtataacgagctgatgcaggccctgaatatgtcagccgccctgacagcaaggaagacgaaggagtttagaagccctcctcaagaacaaattaatatgctgttgaactttcagctgggggagaactgtccttgccccgaagaaatccgagaggaattatatgatttccacgaggacctgcttttacattgcggcgtgccgctcgaggaggaggaggaggaggaagaagatactagttggacaggaaagctgtgcgcactcgtgtacaaaatcaagggaccacccaaaccagagaaagaacagccgaccgaggaggaggaacgttgtccaactacacttaaagaattgatttctcagacaatgatctgctgggctcaggaagaccaaatacaggatagcgagcttgtacggatgatgtttaatctgctgagaaggcaatatgattcaattggggagctgttgcaggctctgaggaagacctatacaatcagccacacctccgtgtccgatacaattaatctattagcggctcttggtcaaattagaagcttgctctccgtcagaatgggtaaggaggaagaacttctaatgatcaacggactgggtgacatcatgaataacaaagtcttttaccaacaccccaacctaatgagagttttagggatgcatgagaccgttatggaagtgatggtgaatgtcctaggaacggagaagtctcaaatcgcatttcccaagatggttgccagctgttgccgatttctgtgctacttctgtcggatttctcgacagaaccagaaggccatgtttgagcatctatcttatcttctcgaaaactctagcgttggactggctagtccttcaatgaggggaagcacccccctcgacgtggcagcaagctcagttatggacaacaatgagctggcacttagcctggaagagcctgacctggagaaggtagtcacttacctcgccggatgcggccttcagtcctgtcctatgttgttggcgaagggatacccggatgtcggatggaatcctatcgagggcgagcgatacttaagcttccttcggtttgcagtcttcgtcaactcggaaagcgtcgaagagaatgcgagcgttgtagtgaagctgctgattcgccggccggagtgcttcgggcccgctctccgcggggaggggggtaacggcctcctggccgccatgcagggtgcaattaagatcagtgagaatccagccctagaccttcccagtcagggctacaagcgggaagtgagcacaggagatgatgaggaggaagaggagattgtgcacatgggtaatgccatcatgtctttttattctgccttgatcgacctgttgggcagatgcgcgcccgaaatgcatcttatccagaccgggaaaggagaagcgatcaggataagaagcatacttaggagtttggtacctacagaagacttggtcggcatcatttccataccactgaagctcccctcgctgaacaaggatgggagcgtatccgagccagatatggccgccaacttttgccctgaccataaagccccaatggtgctctttctcgatcgagtgtatggaatcaaagaccagacattcctgcttcacctgcttgaagtaggctttctgcccgacctgcgagcctcagcctccctggatacggttagtctgtccaccacagaggccgccttagccctgaatagatacatatgtagcgcggtgttgccattgctgacacgatgtgcaccgttgtttgctggcactgaacactgcacttctctgattgacagtactctgcagaccatctaccgcctgagcaaagggcgatcacttactaaagctcagagggacactatcgaagagtgcctgctggcaatttgcaaccacctgaggccttcaatgctgcagcagctcctgagaagactggtgtttgatgtgcctcagctgaatgaatactgcaagatgcctcttaagctgctcacaaatcactacgaacagtgctggaagtattattgtctgccaagcgggtggggaagttacggtctcgccgtggaagaagagctccacctcaccgagaagcttttctggggcatctttgactcgttgtcacacaaaaagtatgatcctgatttgttccggatggctctgccctgcctgagcgccattgcaggggctcttcctccagattacctggatacgaggattaccgcaactctggaaaagcagatcagcgtggacgcagatggcaacttcgatccaaaacctataaatacaatgaacttcagtttgccagagaagctcgagtacatcgtgaccaagtatgctgagcatagtcacgacaaatgggcatgcgacaagtcacagtctggatggaaatatggcattagccttgacgagaacgtcaagacgcatcctctgataagaccttttaagacactgactgagaaggagaaggagatttacagatggccagcccgggaaagtctcaagacaatgttagctgtgggatggacagtcgagcgcaccaaagaaggagaggctctagtgcagcagcgcgagaatgagaagttacggagtgtcagccaagctaaccaggggaattcctatagccctgccccccttgacctcagcaatgtggttctctccagagagctccaggggatggtggaagtcgtcgccgagaattaccacaacatttgggcaaagaagaagaaacttgagcttgaatctaagggagggggctcccatcctctgctcgtcccatatgacacattgacagctaaggaaaagtttaaggacagagagaaggcacaggacctattcaagtttcttcaggtgaatgggattatcgtcagccggggcatgaaggacatggagctcgacgcgtccagcatggagaaacggttcgcctataagtttctgaagaagattttgaagtacgtggacagcgctcaagagttcattgcacatctggaggctattgttagttctgggaaaacggagaaatctccacgtgaccaggagataaagtttttcgctaaggtgcttcttccactcgtcgatcagtattttacttcccattgtctgtacttcttgtctagcccactgaaacctctttcttccagcggctacgcgagtcataaagaaaaagagatggtggccggactcttctgtaagttggcagctctcgttagacaccggatcagcctattcggttccgatagcactaccatggtcagctgtctgcatatcctcgcccaaaccctggacacacgcacagtaatgaaaagcggctcggaactggtgaaagccggtctgagggccttttttgagaatgctgccgaggatttggagaaaacgtccgaaaatctcaagctggggaagttcacacactcacgcactcagattaagggggtcagccagaatataaattatactactgtcgcccttctgccgattctaacgagtatcttcgagcacgtcacacaacatcagttcgggatggatctgctgttaggagatgtacaaatcagttgctaccacatattgtgttccctgtactccctgggcaccgggaaaaacatctacgtggaacggcagagacccgccctcggtgagtgtctagcttctctcgccgctgccattccagtggcgttcctggaacccaccttgaaccgctataatccactgtctgtcttcaatacaaaaacaccccgagagaggtctatcttggggatgcctgacaccgtcgaagatatgtgccctgatatcccacagttggaaggcctgatgaaggaaatcaatgacctggcagaaagcggggctagatacacggagatgccacatgttattgaagtgatacttccaatgctgtgtaactacctttcatactggtgggagcgggggccagagaatctgccaccctcaaccgggccctgttgtaccaaggtgacctctgagcacctgagcctaatcctaggaaacattctgaagattatcaacaataacctggggatcgacgaagctagctggatgaagcggatagcagtgtatgctcaaccgattatctccaaggctcggcctgacctgttacgaagtcacttcataccaactctcgaaaaactcaaaaagaaagcggtgaagactgtccaggaagaagagcaattaaaagccgacggcaagggcgacacccaggaggctgagttgctgatcctggacgagtttgcagtcttatgccgggatctctatgccttctatcctatgctgatccggtacgtcgataataacaggagtaattggctcaagtctcctgacgcggacagtgatcaactctttcgaatggtcgccgaggtctttatactgtggtgtaagtcacataattttaagagagaagaacaaaactttgtaatccagaacgagattaataacttagcatttctgacaggcgactccaagtccaagatgagcaaaagcggtggccaggatcaggagcgcaagaaaacgaagaggaggggagatttgtatagtatacaaacttctctcatcgtcgcagcactcaaaaagatgctgccaatagggcttaacatgtgcacacctggggaccaagagctaatctctctagccaagagccggtactcccaccgtgacaccgatgaagaggttagagaacacctgagaaataaccttcacttgcaggagaaaagcgacgacccggcagtgaaatggcagttaaatctgtacaaagacgtgctgaagtctgaagagcccttcaaccctgaaaagaccgtcgagcgggtgcagcgaattagcgctgctgtctttcaccttgagcaggtggagcagcctctaaggtccaagaaggcagtttggcacaagcttttgtcaaaacagcgaaagagggcagttgtagcttgttttcgcatggcccctctgtataacctgccacgccatcgctcaattaacctcttcttgcatgggtatcagcgcttctggatcgagacagaagagtactcgtttgaggaaaagcttgtccaggatcttgcaaaatcccccaaggttgaggaagaagaggaagaagaaacagaaaagcagcccgaccctctccaccagattatcctgtatttcagccgcaatgcactcactgaaaggtcaaaactggaagacgacccactctatacaagctattcctctatgatggctaagtcatgccaaagtggcgaggatgaagaggaagatgaggacaaggagaaaacctttgaggaaaaggagatggaaaagcaaaaaaccctgtaccagcaggcacggctgcatgagaggggtgccgccgagatggtactccagatgatttccgcctccaaaggcgaaatgagtcctatggttgtcgagaccctaaagctgggcatagccatactcaatggaggcaacgctggcgtgcagcagaaaatgctcgactatctcaaggagaagaaggacgcaggattcttccagagcttgtctggactgatgcagtcctgtcggagtgtgcttgacctaaatgctttcgaacggcagaacaaggccgaggggctggggatggttacagaagaaggaaccctgatcgtgcgggaacgcggagagaaggtgctacagaatgatgagttcactcgggacctttttagattccttcagctgctgtgcgagggccataactccgatttccagaacttcctgcgcacccagatggggaatactacgacagtgaacgtgattatcagcactgtcgactatctcctgcgattgcaagagtctatatcggatttctactggtactatagtgggaaagacattattgacgaatctggccaacacaattttagtaaggcactggcagtgaccaagcagatcttcaatagcctgacggagtatatccagggcccatgcattggcaaccagcagtcactggctcatagccgcctctgggacgcggtcgtcggtttcctccatgttttcgctaatatgcaaatgaaactgagtcaagactccagtcagatcgagctgctgaaagaactgttagatctactccaggacatggtggtaatgttactaagccttctggagggtaacgtggtgaatggaacaattggcaagcagatggtagacaccctggtggagtccagcaccaacgtggaaatgatcctcaaattctttgacatgttccttaagttaaaggaccttacgtcatccgatacctttaaggagtacgatcctgatggtaagggaatcatatccaagaaagagttccagaaagccatggagggccagaagcagtacacccagagcgagattgactttttgcttagttgtgctgaagctgacgaaaacgatatgtttaactacgttgactttgttgacaggttccacgaaccagcgaaagatatcgggtttaatgtcgcagtgttgctcaccaacctttcagaacacatgccgaatgacagtcgcctgaaatgccttcttgatcctgccgagtccgtccttaattactttgagccttacctcggccgaatagagatcatgggaggagccaagaaaatcgaacgggtgtactttgagatttctgaaagctcacgaacccagtgggaaaagccgcaggtcaaggagtcaaaacgccagttcatttttgatgtggtgaacgaaggtggtgagcaggaaaagatggaactatttgtcaacttttgtgaggacactatcttcgaaatgcaactagcttcccaaatttctgagtccgattcagcggatagaccagaggaagaggaagaagacgaagatagttcgtacgtcctggaaattgccggagaagaggaagaagatggatcgttggagccggcatcagctttcgccatggcctgcgctagtgtgaaaaggaacgtgaccgattttctgaaacgcgctactcttaagaatctccggaaacagtatcgtaatgttaaaaagatgaccgctaaagagctggtgaaggttctgttctcgttcttctggatgctgttcgtcggtttattccagttgctatttactattttgggcggtatcttccagatcttatggtctacagtgttcggtgggggtttggtggagggcgcaaaaaacattagagtcacaaaaatattaggtgacatgcccgaccccacgcagtttggcatccatgacgataccatggaggccgagcgtgcagaggtgatggaacccggtataaccacagaactggtccatttcattaaaggagagaagggcgacacggatattatgtcagaccttttcggtctgcaccccaaaaaagaaggcagtcttaagcacggacctgaggtgggcctaggcgatctctcagagatcatcggcaaggacgaacccccaacgcttgaaagcacagtacagaaaaagcgaaaggcccaggctgccgaaatgaaggcggccaacgaagcggagggaaaggtcgagtcagagaaagcagacatggaagatggcgagaaagaggataaagataaggaagaggagcaggcagagtacctgtggactgaagtgactaagaaaaaaaagcgaaggtgcggacaaaaagtcgagaaacctgaggccttcaccgccaactttttcaaaggtctcgagatctatcaaacaaaactacttcattatcttgcaaggaatttttataatctgcgatttttggcgctattcgtggctttcgcaattaattttatattactgttttataaagtgactgaggaacccctcgaagaagaaaccgaggatgttgccaatctgtggaattcctttaatgacgaggaggaggaggaagccatggtttttttcgtgttgcaagagtctacaggctacatggcccctactctccgggccctcgccattatccacacgataatctctctcgtttgtgtcgtggggtattattgtctgaaggtccctctcgtggtcttcaagagagaaaaagaaatcgcacgcaagctggagtttgacgggctgtatattacagagcagccatccgaagacgacatcaagggccagtgggatagactggtgataaacaccccttcatttcctaacaactactgggacaagtttgtgaagcgcaaagtgatcaacaaatacggcgacctctacggcgccgaacggattgcagaactgttaggcttggataaaaatgcgcttgatttctcccctgtggaggaaactaaggccgaagcggcgtcattagtatcatggctgtcttcgattgacatgaaatatcatatctggaagctcggcgttgtgttcacagacaactcttttttgtacctggcctggtacaccacaatgtctgttctggggcattataataatttcttcttcgccgcccatctgctggatatagccatgggattcaagacattgcgcacaatcctgagctctgtgactcataatgggaaacagctggtcctgaccgtcgggctcctggcagtggtcgtgtatctgtacaccgttgtcgcattcaacttcttccgcaagttttataataagtcagaagatgatgatgagcccgatatgaaatgcgatgacatgatgacctgctatcttttccatatgtacgtcggcgttagagcgggtggcggcataggagatgaaattgaggacccagcgggcgacccttatgaaatgtacagaatcgtgttcgatatcacattcttcttttttgtgatcgtcatcctcctcgccatcatccagggacttatcatcgatgccttcggcgagctaagggatcagcaggagcaggtgagggaagatatggaaaccaaatgcttcatctgtggaataggtaatgattactttgatacgaccccccacggcttcgaaacgcatacgctgcaggagcacaacctcgctaactacctgtttttcttaatgtatctgatcaacaaagatgaaacagaacacaccgggcaagaaagctacgtgtggaaaatgtaccaagaaagatgctgggatttttttcccgctggagattgctttcgaaaacagtacgaagatcaactcggatag

SEQ ID NO: 133316 - DNA, 14613 bp, Artificial Sequence
  Description of Artificial Sequence: Synthetic coding sequence
atggccgaaggaggggaagggggggaggacgagatacaattcttaaggacagaagatgaagtggttttgcagtgtatagcgactatccacaaggaacagaggaagttttgtctcgcggcagagggtttgggtaatcgcttgtgctttcttgaacctactagcgaggctaagtacataccccctgatttatgcgtgtgtaatttcgtcctcgagcagtcactgtcggttagagctctacaggagatgttggcaaatacaggcgaaaatgggggcgagggtgcagcccagggtggagggcaccgcactctgctgtacggacatgccgttctgctgcgacactcatttagtggaatgtatttgacgtgcctgaccacatcccggtcccagacggacaagcttgccttcgatgtggggttacgggaacacgccaccggggaggcttgctggtggaccattcatcccgcatcaaaacagcgatcagaaggcgagaaagttcgcataggagacgatctgattctggtgtcagtgtcttctgagagatatcttcacttaagcgtgtccaacggaaatatccaggtggacgcctcatttatgcagactttatggaacgtgcaccccacgtgtagcggctcctctatcgaggagggctacctgttagggggacacgtggtcaggctcttccatggccatgacgagtgtttgaccatcccgtccacagatcagaacgactctcagcataggaggattttttatgaagcgggaggagcaggcacccgggctcgcagtctgtggagggtcgagcctcttcggatctcctggtccgggtcgaacattcgctggggccaggcgttccgcctgagacatctgaccactggtcactacttggcccttacagaggaccagggtttaatcctgcaggaccgggcaaagtccgacacaaaaagtaccgcgttcagcttcagggcttctaaagaattgaaagagaaacttgacagcagccataaacgggatatcgaaggaatgggcgtacctgagatcaaatatggggattcggtatgcttcgttcagcacattgcctcagggctgtgggtgacgtacaaggcgcaggacgctaagacgagccgcctgggacccctgaaacgcaaggtcatcttgcatcaggagggacatatggacgatgggctcacattgcagcgatgccagcgagaagaatcacaggccgcccgaatcatcaggaataccactgcactttttagccagtttgtgagcggtaacaaccgaacagccgctccaattaccctgcccattgaagaggtgctgcagaccctacaggatttgattgcctacttccagccacccgaagaggaaatgcgtcacgaggataaacaaaacaaactccgtagtctgaagaacagacagaacctgtttaaggaagagggaatgctggccctggtacttaattgcatagatcggctgaatgtgtataattcagtggcccactttgccgggatagcccgggaagagagcggtatggcgtggaaggagattcttaacctactgtacaaactgctggcggcactgatacggggaaatagaaataattgtgcccaattctccaataacctggattggcttattagcaagttggaccgactggaaagctccagcggaatcctggaagtgctccattgtatcctcacagagagcccggaggctttgaacttaattgctgagggacacataaagtcaatcatctccctattagacaaacacggaaggaaccataaggtgttggatattctgtgctctttgtgcctttgcaatggcgttgcagtcagggctaaccagaatctgatctgtgataatctgctgcccaggagaaatctgctgctccaaacgaggcttattaacgacgtgacaagtattcgccctaatatttttctcggcgtggcagaagggtcagcacaatacaagaagtggtacttcgaactgattatagaccaagtggaccccttcctgactgctgaacccactcatctgagggttggttgggcgtcgtcctctggctacgccccatacccgggcggaggagaagggtggggggggaacggcgtgggcgatgatctttattcatatggctttgacggactgcacctttggagtggacggattccacgcgccgttgcctctatcaatcagcacctgttgagatccgatgatgttgtgtcctgctgcctggacctgggggttccatccatcagctttcgaatcaacggacaaccggtacagggaatgtttgagaacttcaataccgacggcttatttttccccgtcatgagcttcagcgctggcgtgaaggtgcgctttcttatggggggccgacatggtgagtttaagtttctgcctccctccggctacgctccatgctatgaagcactgttaccaaaagagaagatgcgactcgagccagtcaaggagtataagcgggatgctgatggcatccgcgatctgctcggaaccacccagttcctgagtcaggcttcttttatcccctgtcctgtggatacctcccaggttattttacccccacatttggagaagattcgggaccgcctggccgagaacattcacgaattatggggaatgaataagatagaactcggatggacttttggcaagattcgggatgacaacaagcggcaacatccctgcctggttgaattttcgaagctgccagagacagagaaaaactataacctacagatgtctacagaaactcttaaaacactactcgccctcggttgccacatcgctcacgttaaccctgccgccgaggaggaccttaaaaaggtgaagctgcctaaaaactacatgatgtcgaatggatacaaacccgcgccactggatctgagcgatgtgaagctgctgccccctcaggaaatcctagtcgataagctagctgagaacgcccacaacgtctgggccaaggaccgcatcaagcaggggtggacatacggcatccaacaggacttaaaaaacaagagaaaccctaggctggtgccttacgctcttctggatgagcgtaccaagaaatcaaacagggattccctgcgtgaagccgtcagaacttttgtggggtacggatataacattgaaccgtctgatcaggagttagccgacagtgccgtggagaaagttagcatcgacaagattcggttctttagggtggaacgatcctacgcagtgcggtctggaaaatggtactttgagttcgaagttgttacggggggagatatgcgcgtaggctgggcacggccaggctgtagacctgatgtcgaattgggggctgacgatcaggcgtttgtcttcgaaggcaatcgcggacagcgctggcatcagggctcaggatatttcggcagaacttggcagcccggcgacgtggttggctgcatgattaacctcgatgacgcgtcaatgatcttcaccctcaatggggagctgcttattaccaacaagggctccgagttagcctttgccgactacgagatcgagaacgggtttgttccaatttgctgccttggtttaagtcagatcggaaggatgaacctgggcactgacgcctctacatttaagttctacacaatgtgtgggctgcaggagggtttcgagccatttgccgtcaacatgaatcgggatgtggccatgtggtttagcaaacgcctgccgacttttgttaatgttcccaaagaccacccccacattgaggtgatgcggatcgacggtactatggattccccaccctgccttaaggtcacccacaaaacgtttggcacacagaacagcaacgctgacatgatctactgcagactctccatgcccgtcgagtgtcattcaagtttctctcacagtccttgtttggacagcgaagcctttcagaaaagaaagcagatgcaggagatcctgtcgcataccacgacacagtgttactatgctataaggatcttcgcaggccaggatccctcgtgtgtctgggtcgggtgggtcacgcccgactaccacctgtatagcgagaagtttgaccttaacaaaaactgtacggtaaccgtgacattgggcgatgaacgcgggagggtgcacgagagcgtgaagcgctctaattgctacatggtatggggcggcgatatcgttgcctcaagccaaaggagcaacaggtctaacgtcgatctcgagatagggtgtctcgtagatttggccatgggcatgctgtcgttttcagccaacggaaaagaactggggacctgctatcaggtggagccgaataccaaagtgtttccggccgtgtttctgcaacctaccagtacttctctgtttcagttcgaactgggcaagctgaaaaatgctatgcccctttcggctgctattttccgctccgaagagaagaatccagttccacagtgtccgccaaggcttgatgtccagactatacagccagtgctgtggagccgaatgccaaactccttcttgaaggtggaaacagagagggtgagtgaaaggcatgggtgggttgtgcagtgtctggagccgctacagatgatggcactgcacattcctgaggaaaacagatgtgtcgatatcctcgagctgtgcgaacaggaggacctgatgagattccactatcacaccctgaggctatactctgccgtctgtgctctcggtaattcaagggtggcttatgccctgtgttctcacgttgacctctcccagctgttttacgctatagacaacaaatatctccccggtttactcagaagcggcttctatgacctgttgatatctatccatttagctagcgcgaaagagagaaaactgatgatgaagaacgagtatataattcctatcacttccactacgcggaacatcaggctgtttcctgacgagtccaagcggcacggacttcctggtgtggggttgaggacttgtctgaaacccggatttcggttcagcactccttgctttgtggtcacaggtgaagatcaccagaagcagtcacccgagatccctcttgaatctctcaggacaaaagccctttccatgctcacagaagcggtccagtgtagcggagcccacatccgcgaccctgtcggcggcagcgtagaatttcagttcgttcccgtgcttaagttaatcggcaccctcttggtgatgggtgtttttgacgacgatgatgttcggcaaatcctgctgctgatcgacccaagcgtgtttggtgagcatagcgccggcacggaggagggggcagaaaaagaggaggtcacacaggtggaagagaaagctgtggaggcaggcgaaaaagccggaaaggaagcccctgtgaaagggctgctccagactaggctaccagaatctgtcaagctccagatgtgtgaactgctgagttatctgtgtgactgcgagttgcagcaccgggtagaagccatcgtcgcattcggagacatctacgtcagcaagctgcaagccaatcagaagtttagatacaatgagctgatgcaagcactcaacatgagcgccgctcttaccgcaagaaaaaccaaggagttccggagtcctccccaagaacaaattaatatgctcttgaattttcagctgggtgaaaactgtccctgccctgaagagattcgggaggaactgtatgacttccacgaggacctgctgctgcactgcggagtgccgcttgaggaagaggaggaagaggaagaagatacttcttggactgggaaactgtgtgcactggtgtacaaaatcaaggggccgcctaaacctgagaaggagcagcccaccgaagaggaagaaagatgtccaacgacactgaaggagttaatttcgcagacaatgatctgctgggcccaggaggatcagatccaggacagcgagctggtgaggatgatgtttaacctattgcgccgacagtatgattccattggtgaactgctacaagccctacggaaaacctacaccatttcccacacgtccgtttctgacacaatcaacctcctagcggcactgggacagatccgctctctgctgtcagtgaggatggggaaggaggaagaattactcatgattaatgggctgggggacatcatgaacaacaaggtgttctatcagcaccctaaccttatgcgagtcctggggatgcacgagaccgtgatggaggtgatggtcaacgtactggggactgaaaaatctcagatagccttcccgaagatggtagcttcctgctgcaggttcctgtgctacttctgcaggatatccaggcagaaccagaaggcaatgttcgagcatctgtcgtatctccttgaaaacagttccgtaggtttagcctcaccatctatgcgaggatcaacacccctggacgtggcagcctcgagcgtgatggataacaatgagctggctctttctctcgaggagccagatcttgaaaaggtagtgacctacttagctggatgcgggctccagagttgtcccatgctgctggccaaaggctatcctgacgttggctggaatccaattgagggggagcgttacctcagctttctgcggtttgccgtgttcgtgaactcggagtcagtggaagaaaacgccagcgtggtggtcaaacttctgattcggcggccagaatgtttcggcccagccctgagaggcgaagggggaaacggactgctggccgccatgcagggtgccattaagatttctgaaaatccagcactggatctcccatcacagggctataaacgcgaggtctcaaccggggatgacgaggaagaagaggaaatcgtgcacatgggaaacgccattatgtcattctacagcgctcttatagatctcttgggccgatgtgccccagaaatgcacctgattcaaaccggcaaaggtgaggccatcagaataaggtccatactgcgatccctcgttcctactgaggatctagtcggcatcatcagcattcctttgaaactgccttcactgaataaagatggaagcgtgagtgaaccagacatggctgctaacttctgtcccgatcacaaggccccgatggtgctgtttcttgaccgcgtgtatggcattaaagaccagacatttctcctgcatctcctggaggtgggcttcctgcccgacctgagagctagcgccagtttggacacagtctcattatcaaccacagaggccgctcttgccctcaatcggtacatctgctccgctgtgctgccgttgttaaccaggtgtgctccccttttcgcaggcactgagcactgtacatctctgatcgactcaacccttcagactatctacagattaagcaagggaagatctctgacaaaggctcagcgcgatactattgaagagtgcttgcttgccatctgtaatcacctcagaccttctatgctgcagcaactgctgagacgtttagttttcgatgtccctcagctgaatgaatactgtaaaatgccactgaagctcctcacaaatcactacgaacagtgttggaagtattactgtttgcccagcggctggggtagctacggcctggcagtggaagaggaactccaccttactgagaaactcttctggggcatctttgactccctgtctcataagaagtacgaccccgacttattcagaatggctttgccttgcctgtctgccatcgcaggtgcgcttccgcccgactatttagatactcgcatcaccgccactctcgagaaacaaatctccgtagacgcagacggaaacttcgatccaaagcctattaacaccatgaacttttccctaccagagaagcttgagtacatagtgaccaagtacgctgaacacagtcacgataagtgggcttgcgataaaagtcagagcgggtggaagtacggcatatctctggacgagaatgtgaaaacacatcccttgattaggcccttcaaaacacttacggaaaaggaaaaagaaatctatcgctggcctgcccgcgaatccctcaagaccatgctggctgtgggctggactgtcgagcggacaaaagaaggtgaggctctggttcagcagcgcgagaatgagaagctgcggtcagtgagccaagctaatcagggaaactcctactcccctgcccctctggacttatccaacgtcgtgctctctagggagttacaggggatggtggaagttgtggccgagaattatcacaatatttgggcaaagaagaagaaactggaattagagtccaagggtgggggcagtcacccacttcttgtaccgtatgacacactgacggccaaggagaaatttaaggatagagagaaggcccaagacctgtttaaattcctgcaagtgaacggcattatcgtaagcagggggatgaaggacatggaactcgacgcgagctcaatggagaagagatttgcttacaaattcctcaaaaaaattctgaagtacgttgattctgctcaagaatttattgctcacctggaggcaatcgtttctagtggaaagactgaaaaaagtcctcgggaccaggagataaaattttttgccaaagttttgctccccctggtggaccagtattttacttcccactgtctgtatttcctgtcatccccccttaaaccgttgtccagcagcggctacgccagccacaaggaaaaggagatggtggccggcttattttgtaaactggccgctttagtcagacacaggatatccctttttggaagcgacagcacaacaatggtatcctgcttacacatcctggcccaaaccctcgataccaggacagtcatgaaatcaggctctgaattggtcaaggctggcctcagagcatttttcgaaaatgctgcagaggatctggagaagacctccgagaatctgaagctcgggaaatttacacactcgcggactcagattaagggagtaagccagaacataaactacactacggtggcactgttgcctattttaacctcgattttcgagcacgtgacacagcatcagtttggaatggacctcctcttgggtgacgtccagatttcatgctaccacatcctttgttctctgtacagtttagggaccggtaagaatatctatgttgaacgtcagagaccagctctgggagaatgcttggccagtctagcagcagccattcccgtggccttccttgagcccacactcaaccggtataaccctctgtctgtatttaatacaaagaccccccgcgagcgaagtatcctcgggatgcctgacaccgttgaagacatgtgtcccgacattccacagttagaaggtctcatgaaggagatcaatgacctggccgaatccggtgcccgctataccgagatgcctcacgtcatcgaggtcatcctgcctatgttatgcaactacttatcatactggtgggagcgcgggccggaaaatctgcctccgagcacgggaccttgttgtaccaaggtcaccagtgagcacctctccctaatcctgggtaacatcctgaagattatcaataacaacctaggcattgatgaggcatcctggatgaaaagaattgccgtctacgcccagccaatcattagtaaggctcgtcccgacctcttgagaagtcactttattcccaccctggaaaaactgaaaaagaaggcagtgaaaaccgtgcaagaggaggaacaactgaaggccgacggcaagggcgacacccaggaagctgaactgctgatcctggatgagttcgccgtactgtgcagagacttgtatgctttctatccaatgctcatcagatacgtggacaacaaccgctcaaattggctgaaaagcccggacgccgatagtgatcagctgttcagaatggttgcagaagtgtttattctgtggtgcaagtcacataatttcaaacgcgaggaacagaatttcgttatccagaacgagatcaacaatctcgctttcctgacaggcgattcgaaatcaaagatgagcaaggctatgcaggttaaatccggcggccaggatcaggaaagaaaaaagacaaaaaggagaggggacctgtattccattcagacctctctgatcgtggccgctttgaagaaaatgcttccaattggcctgaacatgtgtacacccggtgaccaagagctgatctccttggcaaaatctaggtattcccatcgggatactgatgaggaggttagagaacatcttcgcaacaacctccacctgcaagaaaagtccgacgatcctgcggtgaaatggcagttgaatttatacaaggatgttctgaagtcagaggagccatttaatccagagaagacggtggagcgggtgcagcggatatcagccgctgtgttccacctcgagcaggtggagcagcccttgagaagtaagaaagccgtgtggcataaactgctctccaaacagcgcaagcgagccgtggtcgcatgctttcgcatggcgcctctatataatctgcctcgtcaccgttctattaatctttttctgcatggctaccagagattttggatcgaaactgaggagtatagttttgaagagaagctggtgcaggatctcgccaagagtcctaaagtggaggaagaagaggaggaggagaccgaaaagcaacccgatcctttgcaccagatcattctttactttagtcgaaatgccctgacagaaagatcaaagttagaggatgaccctctgtatacatcatattctagcatgatggcaaaatcatgccagagcggagaggatgaagaggaggacgaagacaaagagaagacgttcgaagaaaaagagatggagaaacagaagacactctaccaacaggcacgactccacgagaggggagcagctgagatggtgctgcagatgatctctgctagtaagggcgagatgagtccaatggttgtggaaaccttgaagctgggcatcgcaattctaaatggtggaaacgctggcgtacagcagaagatgttggactacctgaaggagaagaaagatgctggtttcttccaatccttatcaggactgatgcagagttgctctgtcctggacttgaatgcttttgagcgtcagaataaggccgaaggacttggtatggtgacagaggaagggactttgatcgtgcgcgagcgcggagagaaggtgttacagaacgatgagttcaccagggacctgtttcggttcctgcagctactgtgcgaaggacacaactctgatttccaaaattttttaagaacacagatggggaatactacaactgtcaacgtaattatctccactgtggattatttgctgcggctgcaggagagcatcagcgacttttattggtattattccgggaaagatatcatcgatgagtcgggccagcataacttttccaaggcactggcggtgaccaagcagatcttcaactcacttaccgaatacatccaggggccttgcattggaaaccagcagtcactcgctcactcaagactgtgggatgcagtggtaggcttcctgcatgtctttgctaacatgcagatgaaactgagtcaggattccagtcagatcgagttgctgaaggagcttcttgacctgctgcaggacatggtagttatgctcttgtcactgttagagggcaacgtggtcaatggtacaattggcaagcaaatggttgatactctagtcgagagctcaaccaacgtggagatgatcctcaagtttttcgatatgtttcttaagcttaaggatctcactagctcggatacttttaaagaatacgacccagatggtaaaggaatcattagcaagaaggagttccagaaggctatggagggacagaagcaatatacacagagcgagatagacttcctgctgagctgcgctgaggctgacgagaatgatatgtttaactatgtggactttgtcgatcgatttcatgagcctgctaaagatatcggatttaatgttgctgtgctgctgactaatctgtcagaacacatgccgaatgattcccggttgaaatgtcttctggatcctgcagaaagtgtactgaattactttgaaccctatttaggcaggatcgagatcatgggcggcgcaaagaagattgaacgagtgtactttgaaataagtgagagttccagaacacagtgggagaaaccccaggttaaagaaagcaaacgccagttcatattcgacgtcgttaatgagggaggtgagcaagaaaaaatggagttgttcgtaaacttttgtgaagacaccatattcgaaatgcagttagccagccagatctccgagagtgattccgcagaccgaccggaggaagaagaagaagatgaggactcctcgtatgtgttggaaattgccggcgaggaggaggaagacggcagcctagagcccgccagcgcctttgctatggcctgcgcttcagtaaaaagaaatgtgaccgattttttaaagagagccactctaaaaaatctcaggaagcaatacagaaatgtcaaaaaaatgaccgccaaggagttggtgaaggtcctgttttcattcttttggatgctgttcgtcggcctgttccaactcctgtttactattcttgggggaattttccagattctctggtcgactgtctttggcggtggcctcgtagagggagccaagaacatccgagttacaaaaatccttggagacatgcctgatccgacccagtttggaatccatgacgacacaatggaagcagagcgtgccgaggtcatggagccgggcatcactactgaacttgtacactttatcaaaggagagaagggggacacagatatcatgagcgacctgttcggattgcaccccaagaaggagggctctttaaagcacggcccggaggtaggtctaggcgacttgtctgaaattatcgggaaagacgaacctccaactcttgagagcacagttcagaagaaaagaaaagctcaggccgccgagatgaaagctgcgaatgaggccgaaggtaaggtcgagagcgaaaaagccgacatggaggatggggagaaagaagacaaagacaaagaggaggagcaggctgaatatttgtggaccgaggtgaccaagaaaaaaaagagaagatgtggacagaaagtcgaaaagccagaagcctttaccgctaacttcttcaaaggtctggaaatctaccagactaaattactgcattatcttgctcggaatttctacaatttacgtttcttggcattattcgtcgctttcgccataaattttatccttttgttctacaaagtgacagaggagcctctggaagaggaaacagaagacgtggccaacctgtggaactcatttaatgacgaagaagaggaggaggcaatggtgttcttcgtgctgcaggagtccacgggatatatggctccaactcttcgggcgttggctattatacacaccatcatctccctggtatgtgttgttgggtactactgcttgaaagttcccctagtggtgtttaagcgggaaaaggagattgctcgcaagttagagttcgacggactgtacatcaccgagcaaccaagcgaggacgatatcaagggccagtgggatagactggttattaacacaccctcatttcccaacaattactgggataagttcgtcaagagaaaggtgattaacaagtacggggacctgtacggcgctgagcgaattgcagaactcctgggcctggacaagaacgcgctggatttcagccctgtggaagaaaccaaggccgaagcagcctccttggtcagctggctttcctctattgatatgaaataccacatctggaagctaggtgtggtgttcacagataacagttttctttatctggcatggtataccaccatgtcagttttgggacattataataatttcttcttcgccgcgcacctattagacatcgcaatgggtttcaagaccttgaggacaattctcagttctgtaactcataatggaaaacagcttgtgctcaccgttggactgttagccgtcgtcgtttacctctacacagtagtcgccttcaactttttcaggaagttctataataagagtgaagacgatgacgaacccgatatgaagtgtgatgacatgatgacgtgctatctgttccacatgtatgtgggagtaagggctggaggcggcataggagacgaaatcgaagaccccgcgggagacccttatgaaatgtaccggatagtgttcgatattactttctttttctttgtgatcgtgatcctgctggctattattcaaggccttattatcgatgcattcggggaactgcgcgaccagcaggaacaggtgagggaggatatggaaaccaagtgctttatttgcggaattggtaatgactacttcgataccaccccacatggctttgagactcacaccttgcaagagcacaacctggcaaattacctcttctttctgatgtacctgattaataaagatgaaaccgagcacacgggccaggagtcctacgtgtggaaaatgtaccaagaacgctgctgggattttttcccagccggagactgctttcgcaagcaatacgaggatcaactggggtag

SEQ ID NO: 133317 - DNA, 14598 bp, Artificial Sequence
  Description of Artificial Sequence: Synthetic coding sequence
atggccgaaggaggggaggggggtgaagacgaaatacagtttctgaggaccgaggacgaagtcgtactgcaatgtattgccacgatccataaagagcaaaggaaattctgtttggccgccgagggccttggcaaccgactatgcttcctcgaaccaaccagcgaagcaaaatatatcccaccagacctgtgcgtatgcaactttgtgctggaacagagcctttccgtaagagctctccaggaaatgctcgcaaacaccggtgagaacggtggcgagggtgcagcccaggggggaggacaccggacactgctgtacgggcacgccgtcctcctgaggcattcttttagtggaatgtatctgacctgcttgactacatcacgatctcagactgacaagctggcatttgacgtcggactcagggagcacgccactggcgaagcttgctggtggaccatacatcccgcctcaaaacaacgatccgaaggtgagaaagttaggatcggggacgatcttatcttggtatccgtctcttccgaaaggtatctccatctgtctgttagcaacggcaacattcaagttgatgcttctttcatgcagacgctgtggaacgtgcatcccacctgcagcggcagtagcatcgaggaaggatacctgctgggtggccacgtagtcaggctgttccacggccatgacgagtgtctgaccattcctagtactgaccaaaatgacagtcagcatcgccgcatcttctatgaggcaggtggggcaggcactcgtgcccgctccctatggagagttgaaccattgcggatctcttggtctggctctaatatccggtgggggcaggcctttcgcttacgccatctgaccactggacattacctggcactcacagaagaccagggcctaatcctgcaggacagggccaaatctgatacaaagagtaccgcttttagttttcgggcctcgaaagagctgaaggagaaactcgactcgagccacaagagagatatcgaggggatgggagtgccggaaataaaatatggcgattcagtgtgcttcgtccaacacattgcgagtggactgtgggtgacttataaggctcaggacgctaagacttcacgcttaggaccactcaaacggaaggtcatcctgcaccaagaaggtcatatggatgacggtctcactctgcaacggtgccagcgtgaggaaagtcaggcggctagaataatccggaacacaactgctcttttcagtcagttcgtttccgggaataacaggaccgcggccccaatcacactaccaatagaggaagtgcttcagactctccaggatctgatcgcctattttcagccaccggaggaggaaatgaggcatgaggataagcagaacaagctgagatctctgaaaaatcgccagaatctcttcaaggaggaaggcatgcttgcgttggttcttaactgcattgaccgtctgaacgtgtataacagcgtcgcgcattttgctggcatcgccagagaggaatctggtatggcctggaaggagattctgaatctgctgtataagcttttagccgccctgattcgtgggaatcggaataactgtgctcagttctcgaacaatctcgactggcttattagcaagcttgatagattggaaagctctagtggaatcctcgaggtcttacactgcattctcacagaaagcccagaggctctcaatctcatcgctgagggccatatcaagagtatcatttccctgctcgacaaacacggtcgcaaccacaaggttctggatattttgtgcagcctgtgtctttgtaatggggttgccgtgcgtgcaaatcagaacttgatatgcgacaacctgctgcccaggcggaatcttctgttgcagacccgtttgatcaacgatgtcacaagtatcaggccaaacattttcctaggcgtggccgaggggtccgctcagtacaagaagtggtacttcgagttgattattgaccaggtagacccgttcctgaccgcggagccaacacacttacgggtggggtgggccagcagttctggatacgccccatatccaggaggaggggaggggtggggtggaaacggagtgggggacgatctgtactcttacgggtttgatggactgcacctatggtcaggacgaatcccaagagccgtggccagtatcaaccagcacctgctccggagtgatgacgtcgtgagctgttgtctagacctgggcgtgcctagtatcagcttccgaatcaatgggcagcctgttcagggcatgttcgaaaatttcaacacagacggcttgttttttcctgtgatgtcgtttagtgccggggtcaaggtcagattcctgatgggaggccgccacggggagttcaagttcctccctccatccggatatgccccctgttatgaggccctgcttccaaaagaaaaaatgcgcctcgagcccgtgaaagagtacaaaagggacgcagatggcattcgagatctactggggacgacacagtttttgagtcaggccagctttatcccttgccccgttgataccagtcaggtgattttaccaccacacttagagaaaattcgagaccggcttgccgaaaatattcacgagctctggggaatgaacaaaatcgagcttgggtggacctttggtaaaattcgggatgataataaaagacagcatccatgtctggtcgaattttctaagctgcccgaaaccgaaaagaactacaatttgcagatgagcactgaaacactgaagactctcctggctctgggatgccacattgcccacgttaatccggcagccgaagaggacctcaagaaagttaaactaccaaaaaattatatgatgtctaatggttacaagccagctcctctcgaccttagcgacgtcaagttgctcccaccacaagagattctagtggacaagctcgctgaaaatgcccataacgtatgggccaaggaccgaatcaagcaaggctggacctatggaatacagcaggatctcaagaacaaaagaaatccaagactcgttccatacgctctccttgacgagcggactaaaaaatccaatagggactccctgagggaagccgttcgcacttttgtcggatacgggtacaacatcgagccctcagatcaggagctggcagatagcgcagttgaaaaagtttctatcgataaaatccgatttttccgagtggaacgatcatacgctgtccggagcggaaagtggtactttgagttcgaggtagtaacgggcggggatatgagagttggatgggcccgccctggatgtaggccagacgtggagctcggtgcggacgaccaagcgttcgtttttgagggaaataggggccagcgatggcatcagggcagtgggtacttcggacgcacatggcagccaggtgacgtcgtcggatgtatgattaatttagacgatgcctcaatgatcttcactttgaatggggaactcctgatcactaacaaggggtccgagctggcatttgccgattacgagattgagaatggttttgtccctatctgttgcttaggactctctcagatcggtcgaatgaatctgggtacggatgccagcacctttaaattctacactatgtgtgggctgcaggaaggcttcgagccattcgccgttaatatgaatcgagacgtggcaatgtggttctccaagaggttgccgacgtttgtgaatgtgcccaaggaccaccctcatattgaggttatgcggattgacgggaccatggactcacccccctgtctgaaagtcacccacaagacatttggcactcagaattcaaacgctgatatgatctactgtaggttgagcatgcccgtagaatgtcacagcagtttcagccattccccctgtctcgattccgaagccttccaaaagcggaaacagatgcaggagatactgtcccacacaacaacacagtgctactatgcaatcaggatttttgccgggcaggacccaagctgcgtgtgggtcgggtgggtgacgccagactaccatctttacagcgaaaagttcgatctgaacaaaaactgcaccgtgactgtgaccctgggcgatgagaggggacgcgtacacgagagcgtcaagaggtccaactgttacatggtatggggcggagatatagtagcttcttcacaacgctctaatcgctctaatgtggacctggagataggatgcctagtggatctcgccatgggaatgttgtcattctccgctaatggcaaagaactgggtacgtgctaccaggtcgaaccgaacactaaggtatttcctgcggtgttcctgcagcccacaagcacctctctgtttcagttcgaactgggaaagctgaagaatgcgatgccactaagcgccgcaatctttagatctgaggaaaagaatccagtaccccagtgtccgcctcgcttggatgtgcaaaccattcagcccgtactttggtcacgcatgcctaactcattcctcaaggtggaaacggagagagtctccgagaggcacgggtgggtagtccagtgccttgaacctctgcagatgatggcccttcacattcccgaagagaaccggtgtgttgatatccttgaactatgtgagcaagaggacctcatgaggtttcactatcacactctgcgtctgtacagtgccgtatgtgcactggggaatagcagggttgcatacgctctgtgctcccacgtagacttgtcccagctgttctatgcgattgataataagtaccttcctggactgctaaggagtggcttttatgatttgctgattagtattcacctggcgtctgctaaggagcgcaaactgatgatgaagaatgagtatattataccaatcacgtcaacaactagaaacatcaggctcttccctgacgagtctaagcgtcacggcctgccaggcgtgggtctgcggacatgcctaaaacctgggtttaggttttcaaccccttgtttcgtggtcaccggagaagatcaccagaagcaaagtcctgaaatacccttagagtcccttcgcaccaaagccttgagcatgcttacggaagcggtccaatgctcaggggcacacatccgcgatcccgttggtggaagcgttgagttccagtttgtgcctgtcctgaaactgattggaaccctgcttgtaatgggagtgttcgatgacgacgacgtcaggcagattctccttctcatcgatcccagcgtgtttggtgagcatagtgccgggactgaggaaggtgccgagaaggaggaagtaacacaggtcgaagagaaagctgtggaggcaggagaaaaggccgggaaagaagcgcctgttaaaggcttgctccagacgcgattgcccgaatcagtgaagctccagatgtgtgaactgcttagctacctctgtgactgtgagttgcagcatagggtagaagccatcgtagcgtttggcgatatatacgtgagcaaattacaggccaatcagaagttccggtacaacgagttgatgcaggcactgaatatgtccgctgccctgacagccagaaaaaccaaagaattccggagtccaccgcaagagcagattaacatgctactgaactttcaactcggagagaactgtccatgtcccgaagaaattagggaggaactttatgactttcacgaggatctccttcttcattgcggagtgccattagaggaagaggaggaggaagaggaagacactagttggacggggaagctgtgtgccctggtctacaagatcaagggccctcctaaaccagaaaaggagcagccgacagaggaggaggaaaggtgccctaccaccctaaaagagctcatatcccaaacgatgatctgttgggcccaggaagaccaaattcaagactctgagttagtcagaatgatgtttaatcttttgcggcggcagtatgacagcatcggcgaactcttgcaggcactccggaagacatatactattagtcacaccagcgtgtcagacacaattaatctgctggctgccttaggtcagatcagatccctcctatcagtgcgcatgggcaaggaagaggaactgctgatgattaatggtctgggcgatatcatgaataacaaggtgttctaccagcacccaaatctcatgagggtccttggcatgcatgagactgtgatggaggtcatggtcaatgtgctgggcactgaaaagagtcagattgctttcccaaaaatggtagcgtcgtgctgccgcttcctttgttatttctgcaggatctccaggcagaatcagaaagcaatgtttgagcatttgtcttacctactggaaaattcttctgtcggtctggcctctcctagtatgcgaggctcaaccccactagacgttgcggcgagtagtgtgatggacaataacgagctggccctctcactcgaggagcccgatcttgagaaagtggtcacttacctggcgggctgtggactgcagagctgtcccatgttgctcgctaaaggctatccagacgtgggatggaatcccatagagggggagagatacctctcatttcttaggtttgcagtctttgtgaattccgagagtgtcgaagaaaatgcttcggttgttgttaagcttcttattagaaggccagagtgtttcggtcctgctttaagaggtgagggaggtaatggactgttagctgcaatgcagggcgcaatcaagatttctgagaatcccgccctcgatctgcccagccagggatacaagagagaagtttccacaggggatgacgaggaggaggaggagattgtgcatatggggaacgcaattatgagcttctactccgccctcatcgatttactaggtcgctgcgcccccgaaatgcacctcatccagacagggaagggtgaggcgatcagaatacggtccatactgagaagtctagtacctactgaggatctggtgggcatcatttcaatcccccttaagctgccgagcctgaataaagacgggtccgtaagcgagccggatatggctgccaacttttgtcccgaccataaggccccaatggtgctgtttctcgatcgggtttatgggattaaggatcaaacatttctgctgcacctcctggaggtgggcttcctgccggatctgagagcttctgcctctctcgacaccgtgagcctcagcaccaccgaggctgcacttgccttaaaccgatacatatgctctgcagtgctccctttactgacgcgttgtgcccccctgtttgcagggactgagcactgtacaagcttgattgattcaacgctccaaaccatttaccgcctaagcaaaggccgctcacttacaaaagctcagcgggatacgattgaggagtgtttgttggcaatctgcaatcatctgcggccgagcatgttgcagcaacttctgagacggttggtgttcgacgtgccgcagctcaacgaatactgcaagatgcctcttaaactgttaaccaaccactacgagcaatgttggaaatactattgtctcccctccgggtggggctcatacggacttgccgtagaggaagagttgcatctgaccgagaagctcttctgggggattttcgacagtttatctcacaagaagtacgatccagatctgtttagaatggctctaccttgcctgtcagccattgctggggcccttcctcctgactatctggacaccaggatcacagcaaccctggagaaacagatctccgtggatgccgatggaaacttcgatcccaagccaatcaacaccatgaatttctctttgcccgagaaacttgaatatatagtcaccaagtatgcggaacattcccacgacaaatgggcttgtgacaagtcacagagcgggtggaagtacggcattagtctggatgaaaatgtgaagacccaccctctcatcaggcccttcaaaacactgacagagaaggaaaaagagatctaccggtggcccgctagggagtccctgaagactatgttagccgtgggctggaccgttgagcgcacgaaggaaggtgaagcgttggtccagcagcgcgaaaatgagaaactccgttctgtctcacaggccaaccagggaaattcatactcgcccgcccctttagatctgtctaatgttgtactctcacgcgaactgcagggcatggtggaggtggtagctgagaattatcacaatatatgggcaaagaaaaaaaaactggaactcgagtccaaaggggggggctctcatccgctgctcgtgccatacgataccttgacagccaaggaaaagttcaaggaccgcgaaaaagcacaagatctcttcaaatttctccaagtcaatgggatcatcgtgagccgcgggatgaaagacatggaattggacgcttcaagcatggagaagcgtttcgcctacaagttccttaagaagatcctgaagtatgtcgactcagcgcaggaatttattgctcaccttgaagcaatagtttctagtggaaagactgagaaatctcccagggaccaggaaattaagtttttcgcgaaagtgctgttgcctcttgtggaccagtacttcacctcccactgcttatacttcctgtcatcgcctctcaaaccgttgagtagcagtgggtacgcatcacacaaggaaaaggagatggtggcgggactgttttgtaaactggcagccctggtccgccaccggattagcctgtttggcagcgattccactaccatggtgtcttgcttgcacatcctggcgcagaccctcgatacacggactgtgatgaaatcgggctctgaactggtgaaagccggcctcagagccttctttgaaaatgcagcggaagacctggaaaagacttccgaaaacctcaaactgggcaagttcacccatagccgcacccagataaagggagtttcccagaacataaactacaccaccgtcgctctcctgccgattctcacatctattttcgagcatgtgactcagcatcaatttggcatggatcttctgttaggtgacgttcagatcagttgctatcatattctctgtagcctgtattcactaggcactggaaaaaatatctacgtggaacgtcagaggcccgccctgggcgagtgcctcgctagcttggctgccgcgattccagttgcgttcctggagccaacattgaatcggtataatcccttaagcgtgtttaacaccaagactccaagagaacgctcaatccttggcatgccagacactgtggaggatatgtgccctgacataccgcagttggagggactgatgaaggaaattaacgatctcgccgaaagcggagcgagatacacggagatgcctcacgtaatcgaggtgatcctgcccatgctttgcaactatttgtcctattggtgggaacgaggtccagagaatctgcctccctctaccggtccatgctgtactaaagttacgagcgaacatctgagtctaatcctgggaaatatccttaaaattatcaacaataatctcggcatcgatgaggcctcttggatgaagcgcattgcggtgtatgcccagcccattatatcgaaagccaggccagatctgcttagatcccacttcataccaacactagagaagctgaagaaaaaggcagtgaagacagttcaggaagaggagcagcttaaggcggacggcaagggggatacacaggaggccgagctgctgatccttgatgagtttgctgttctttgtcgggatttatatgccttttaccccatgcttatccgctatgttgacaataaccgtagcaactggctgaagtcaccagacgcggattctgatcagctctttagaatggtcgccgaggtattcattttatggtgcaagtctcacaattttaagagggaggagcagaacttcgttatacaaaatgagatcaacaacttggccttccttactggtgactctaaatccaagatgtcaaaatcagggggccaggaccaggaacgcaagaagaccaagcgccgcggcgacctctattccatacagacaagcctgattgtggccgctctcaagaagatgttacccatcggccttaacatgtgcacccctggagatcaagagcttatttctctcgcaaagtcccgatattcccaccgagatactgatgaggaggtgagagaacacttacgcaataatctgcacttgcaggagaaatccgatgatcctgccgtcaaatggcagctcaatctctataaggatgtgctaaaatcagaagaacctttcaacccagagaagacagtggagcgggtgcagagaatcagcgcggcggtgtttcacctggaacaggtggagcaacctttaaggtcaaagaaggccgtgtggcataagcttttgtccaagcagcgaaaaagggccgtcgttgcttgttttcgaatggcacctctgtacaatctgccgcgtcacagatcaattaacttattcctgcacggttatcaacgcttttggatagaaactgaagaatattcttttgaagaaaagcttgttcaggatttagcaaagagtccaaaagtggaggaggaagaggaagaggaaaccgaaaaacagccagatcccctgcaccagataattctctatttctcgcgcaatgctttgaccgagcgctcgaaattggaggacgacccactgtacaccagctattcctcaatgatggccaagagctgccaaagcggcgaggacgaggaagaagacgaggataaagaaaagacttttgaggagaaggaaatggaaaagcaaaagactctgtaccaacaggcccgtctccatgagagaggtgccgctgagatggtgctccagatgatttctgcttccaaaggtgagatgtcccccatggtggtggaaaccctgaagctgggtatcgcgattctgaacggggggaatgcaggcgtgcaacaaaagatgctggactacctcaaagagaaaaaggacgccgggttcttccagtccttgtcaggcctaatgcagtcttgctcagttttggacctaaacgcatttgagagacagaacaaggccgagggcctagggatggtcaccgaagaagggacactcatcgtaagagagcgtggggaaaaagtgctacagaatgatgagttcacaagggatctgttcagattcctgcagttattgtgcgagggccacaatagtgacttccagaacttccttcggactcagatgggaaatacgactactgtgaatgttattatcagtacagtggattacctacttcggctgcaggagtccatctccgatttctattggtactacagcggcaaagacataatagatgagagtgggcagcataattttagcaaagccttagccgtaactaaacaaatctttaatagcttgaccgagtacatacaggggccatgtatcggtaaccagcagtcgctggcacacagcagactctgggacgcggtcgtgggatttctgcatgtcttcgccaatatgcaaatgaagctctcccaggattcatctcaaatcgaactgctcaaagagcttctagatctacttcaggatatggtggtaatgcttttgagccttctagaggggaatgtggtcaatggtacaatcggaaaacaaatggtcgacactctcgtcgaaagcagcaccaacgtggagatgattctaaagtttttcgacatgtttctgaagctgaaagatcttacgtccagcgacaccttcaaagaatatgaccccgatggcaaaggcatcatttcaaaaaaggagttccaaaaggccatggagggccagaaacaatatacacagtcggaaattgatttcctcctctcatgtgcagaagctgatgagaatgatatgttcaattacgtcgacttcgttgatcgatttcatgaaccagcgaaggatattgggttcaacgtggctgttctcctgactaaccttagtgagcacatgccaaatgattcaaggctcaaatgcctgctggacccggctgagtcggtgttgaactactttgagccatatcttggtcggattgaaatcatgggcggtgctaagaagatcgagcgagtttatttcgaaatctccgagtcgtcccgcacacaatgggagaaacctcaggttaaagaaagtaagcggcagttcatcttcgatgtggtaaacgaaggtggggagcaagaaaagatggaactgttcgttaacttttgcgaggacaccatcttcgaaatgcagctggcgtcacaaatctccgagtccgacagtgccgaccgtcccgaggaggaagaagaggacgaggactccagctatgtgctggagattgccggcgaggaggaggaggatgggagcctggaaccagcgtctgcattcgctatggcgtgcgcttctgtaaagcgcaatgtgactgatttcctaaaacgtgcaacgctcaaaaacctgcgaaagcaatatcgcaacgtcaagaaaatgacagccaaagagttggtcaaagtactgttctcttttttctggatgctatttgtgggcctattccagctactcttcacgatccttggtggcatctttcaaatcctgtggtccaccgtgtttggcgggggattagtggagggcgcgaagaatatccgggtcaccaagatcctgggagatatgcccgaccctactcaattcgggatccatgacgatacgatggaagccgagcgcgccgaagtaatggaacccggcatcactaccgagctagtgcatttcattaagggggaaaagggggacacagatatcatgtcagatctcttcggccttcaccccaaaaaagagggaagtcttaagcatgggccagaagtgggcctcggcgatctctccgaaattattgggaaagatgaacctcccaccctcgagtctacggtacaaaaaaagcgaaaagctcaggcggcagaaatgaaagcagccaacgaggcagaggggaaagtggagagtgagaaagctgatatggaggacggcgagaaagaagacaaagacaaggaagaggagcaggccgagtacctttggactgaggtcaccaagaaaaagaaaaggaggtgcggacagaaagtggaaaaaccagaggctttcaccgcgaacttttttaaggggctcgagatttaccagactaagttgttgcattacttggccagaaatttttataaccttcgatttctagcactcttcgtagcatttgccatcaactttatcttactgttctataaggtaacagaggagcctctggaggaggagactgaagacgtagccaacctgtggaattcttttaatgacgaggaagaagaagaagcgatggtgttcttcgtgctgcaagagtccacggggtacatggcaccaactctgcgggccctggctatcattcacaccatcatctcgctggtttgcgtggtgggatactattgtctgaaggttccattagttgtcttcaaacgggagaaggaaattgcacgcaaactggaattcgacggcctttacattaccgagcagccctccgaggatgacattaagggccaatgggaccgtttggtgattaacacaccaagctttccgaataactactgggacaagtttgttaagaggaaagtgatcaacaaatatggcgatctgtatggtgctgaaaggatcgcagaattactcggcttagacaaaaatgcactcgatttctcaccagtcgaggagaccaaggctgaagctgcgtccctcgttagttggttgtcatccatcgacatgaagtaccatatctggaagctgggcgtagtgtttaccgacaactcctttctgtaccttgcctggtacaccaccatgtccgtcttgggccactacaataatttcttctttgctgcccacctgctcgacatcgccatggggttcaagacccttcgaacaattttatcaagtgtgacccacaatgggaagcagctggtgctcacagtgggcctgcttgcggtagtggtctacctgtatacagtggtcgcctttaattttttccggaagttctacaataaatctgaagacgatgatgagcctgacatgaagtgcgatgatatgatgacatgttacctttttcatatgtacgtgggtgttcgagccggggggggcatcggagacgagattgaggatccagcaggcgatccttatgagatgtatagaatagtgttcgacataacctttttcttttttgtcatagtgatacttctggcaatcatacaagggctgattatcgacgcatttggggagctgagagatcaacaggagcaggtcagagaggacatggaaacgaagtgctttatatgcggtattggtaatgattatttcgatacgacaccccatggcttcgagacacatactctccaggaacacaacctggcaaattacttattcttcctgatgtacctaattaacaaagatgaaaccgaacacaccggacaggagtcctacgtgtggaagatgtaccaggagcggtgttgggattttttcccggctggcgactgtttcagaaagcaatacgaggatcagctgggatag

SEQ ID NO: 133318 - DNA, 285 bp, Artificial Sequence
  Description of Artificial Sequence: Synthetic coding sequence
atggggtctgaactggagactgctatggagaccctgattaacgtatttcacgcgcattccggaaaagagggcgataagtacaaactctcaaagaaggagctcaaggaactgttgcaaaccgagctctcgggatttttggatgctcaaaaggacgtggatgcagtcgacaaggtcatgaaagagcttgatgagaacggggatggcgaagtcgacttccaggaatatgtagttttggtggctgcccttactgttgcgtgcaataactttttttgggaaaatagttag

SEQ ID NO: 133319 - DNA, 162 bp, Artificial Sequence
  Description of Artificial Sequence: Synthetic coding sequence
atgggctcggaactggaaacggcgatggaaacccttatcaatgtttttcatgctcacagcggaaaggagggggacaaatacaaactgagcaagaaagagctaaaagagctgctgcagactgagttgagtggcttcctggatgttaaggaattaatgctgtag

SEQ ID NO: 133320 - DNA, 444 bp, Artificial Sequence
  Description of Artificial Sequence: Synthetic coding sequence
atggaagaaccccagacaaagaccccaagcgcagagttcccaccctacagagctcaacctgctcagccagccacagcccctgctgctacattcgctaccctggctatttgccctgaaccggcgccaacaagtgggcccgggcaaccctgcacagccgccatggggtccgagttagagaccgctatggaaaccctgattaacgtgtttcacgcccactcgggcaaagagggggataaatataaactgtctaagaaggaactgaaagaattgctgcaaaccgaactgtccgggtttctggacgctcaaaaggacgtggatgctgtcgacaaggtaatgaaagagctggacgagaatggggatggcgaagttgattttcaggagtacgttgtcttggtggcagcgctcactgtggcttgtaacaattttttctgggaaaattcctag

SEQ ID NO: 133321 - DNA, 105 bp, Artificial Sequence
  Description of Artificial Sequence: Synthetic coding sequence
atgggaagtgaactcgagactgctatggaaacactgataaatgtattccacgctcacagcggcaaggagggagataaatataagctctccaagaaagagctgtag

SEQ ID NO: 133322 - DNA, 294 bp, Artificial Sequence
  Description of Artificial Sequence: Synthetic coding sequence
atgcctagccagatggaacatgccatggagacaatgatgttcacattccacaagtttgccggtgacaaaggatatttgacaaaggaagacctgcgagtgttaatggagaaggagttcccaggtttcctcgagaaccagaaggacccattggcagtggacaagattatgaaagacctagaccaatgtagagatggcaaggtcggattccaatccttctttagtttaatcgccgggttgacaatcgcctgcaatgattacttcgtcgtgcatatgaagcagaaaggaaaaaagtag

SEQ ID NO: 133323 - DNA, 294 bp, Artificial Sequence
  Description of Artificial Sequence: Synthetic coding sequence
atgccctctcagatggagcacgcaatggagacaatgatgttcacgttccataaatttgctggtgacaagggatacttgacaaaagaagacctgcgagtattaatggagaaggagttcccaggatttctggaaaatcagaaagatcctcttgccgtggacaaaattatgaaagatctcgaccaatgtagagatggaaaggtaggcttccagagttttttctcacttatcgccggtttgacaatcgcctgtaacgattacttcgtggtccacatgaaacagaaaggcaaaaaatag

SEQ ID NO: 133324 - DNA, 318 bp, Artificial Sequence
  Description of Artificial Sequence: Synthetic coding sequence
atggctaaaatcagtagcccgacagaaactgagcgttgtattgaatcgctcattgctgtcttccagaaatacgcggggaaggatggatacaattataccctcagtaagacagagtttctttcctttatgaatacagaacttgcggctttcactaagaaccagaaagaccccggcgttctggaccgtatgatgaagaaactagatactaactctgatggccagttggacttctccgagtttctcaacttgataggcggactagccatggcctgccatgactccttcctgaaggccgtcccttctcagaagagaacttag

SEQ ID NO: 133325 - DNA, 252 bp, Artificial Sequence
  Description of Artificial Sequence: Synthetic coding sequence
gctggcaaaatgacgaaactggaagagcatctcgaagggatcgtcaacatttttcatcagtattccgttcggaaaggccactttgacactctctcgaagggtgagttaaaacagttacttaccaaggagttggccaataccatcaaaagaccgaagaagggtagttctgtgattgatgaaatcttccagggtttggacgccaaccaggacgaacaggtggattttcaggagtttatcagtctggtcgcttag

SEQ ID NO: 133326 - DNA, 279 bp, Artificial Sequence
  Description of Artificial Sequence: Synthetic coding sequence
atgaccaagctcgaagagcatctggagggaattgtgaacatttttcaccagtacagcgtgagaaaaggacattttgacaccctgtctaagggtgagttgaaacagttgctgaccaaggagctggcgaatacgataaaaaacattaaagataaagcagttatcgacgaaatttttcagggcttagatgctaatcaagacgagcaggtggacttccaggaatttatcagcctcgtagctattgccctgaaagctgcccactaccacacccataaagaatag

SEQ ID NO: 133327 - DNA, 297 bp, Artificial Sequence
  Description of Artificial Sequence: Synthetic coding sequence
atggccgcagaacccctcacggagttagaagagtcaatcgaaacagtggtaaccacgttttttactttcgcacggcaagagggacgtaaggatagtctgtccgtgaacgaattcaaagaactggttactcaacaactgccgcacctgctgaaggatgtggggtcactggatgaaaagatgaaatcactggacgtcaatcaggattctgagctcaagtttaatgagtattggcggttgatcggagaactggcaaaggagatcagaaagaagaaagacctgaagatcaggaaaaaatag

SEQ ID NO: 133328 - DNA, 297 bp, Artificial Sequence
  Description of Artificial Sequence: Synthetic coding sequence
atggccgctgaaccacttacggagctggaagagtccattgagactgtagttaccaccttttttactttcgccagacaggagggacggaaagattctttatctgtgaacgagtttaaggaactggtcacccagcagctcccccacttgcttaaggacgtgggctcattggatgaaaaaatgaagagtctggatgtaaaccaggatagcgagttgaagttcaacgagtattggagactgatcggcgagctggctaaagagatccggaagaagaaggacttgaaaattcgaaagaaatag

SEQ ID NO: 133329 - DNA, 297 bp, Artificial Sequence
  Description of Artificial Sequence: Synthetic coding sequence
atggctgcagagcccctgactgagttggaggaaagtatagagacagtcgttaccacatttttcaccttcgcccgccaggaagggaggaaagactcattgtcggtcaatgaatttaaagaattagtgacacaacagctgccacatctgttgaaggacgtagggtctttagatgagaaaatgaaaagcctggatgtcaaccaggattccgaacttaagttcaatgaatattggagactcatcggcgaactcgctaaggagatccggaaaaaaaaggatctgaagatacggaagaagtag

SEQ ID NO: 133330 - DNA, 297 bp, Artificial Sequence
  Description of Artificial Sequence: Synthetic coding sequence
atggctgccgagcctctgaccgaactggaggagtccatagaaaccgtcgtaactacattcttcacatttgccagacaggagggccgaaaggatagcctatccgtgaatgagtttaaagaacttgttacccagcagctcccccatctgctgaaagacgttggctcactggacgaaaagatgaaatctctggatgttaaccaggattcagagttgaaatttaacgaatattggcgtttaatcggcgaactggccaaggaaatcaggaagaaaaaggatctcaaaatccgcaagaaatag

SEQ ID NO: 133331 - DNA, 297 bp, Artificial Sequence
  Description of Artificial Sequence: Synthetic coding sequence
atggccgccgagccactaacagaacttgaggagagcatcgagaccgtggtgaccacattcttcacattcgcccgccaggagggcagaaaagattccctcagcgtgaacgagtttaaagagctggtcacacagcagctgccacaccttttgaaagatgttggatcacttgatgagaaaatgaaatctcttgatgttaatcaagactctgagttaaagttcaatgagtactggagattgataggggaactcgcaaaggagatccggaagaagaaggatctgaagatcaggaaaaaatag

SEQ ID NO: 133332 - DNA, 315 bp, Artificial Sequence
  Description of Artificial Sequence: Synthetic coding sequence
atgggtcaatgcagatccgctaacgcagaagatgcccaggaattcagcgacgtggagcgggccattgagacacttatcaagaatttccaccagtacagcgtagagggcggaaaggaaaccttgaccccaagcgagttaagggatctcgtgactcagcagctccctcatcttatgccatcaaattgtggcctcgaagagaaaattgcaaacctgggcagctgtaatgattccaagttagaattcagatcattttgggaattgattggcgaagctgctaaaagcgttaagctcgaacgtcctgtgcgtggacattag

SEQ ID NO: 133333 - DNA, 315 bp, Artificial Sequence
  Description of Artificial Sequence: Synthetic coding sequence
atgggacagtgtagaagcgctaacgccgaggacgctcaggagttcagcgacgtggagcgggcaattgaaactcttatcaagaattttcaccaatactcggtggagggcggaaaggagacactaacaccgtccgagctcagggacctagtgacccagcagctgccacacctgatgccgagtaactgcggattggaggagaagatcgccaatctcggtagttgcaacgattccaaactagaatttcgtagtttctgggagttgattggcgaggcagccaaatcggtgaagttggaacggcctgttcgcgggcactag

SEQ ID NO: 133334 - DNA, 315 bp, Artificial Sequence
  Description of Artificial Sequence: Synthetic coding sequence
atggggcagtgtagatctgctaacgcagaagatgctcaggagttttctgacgtggaaagggctattgagactttgattaagaactttcaccagtattccgttgagggaggtaaggaaaccctgacaccaagcgaactgcgcgacctggtcacccagcagcttccccacttgatgccttcaaattgtgggctggaggagaaaattgccaatttgggaagctgcaacgacagtaagctagagtttcgatccttttgggagttaatcggagaggcagcgaaaagcgtgaagctggaacgccctgtgagaggacattag

SEQ ID NO: 133335 - DNA, 315 bp, Artificial Sequence
  Description of Artificial Sequence: Synthetic coding sequence
atgggtcagtgtagaagcgcaaacgctgaggacgcacaagaattcagcgatgtcgagcgggccattgagacgctcatcaagaatttccaccaatattctgtggagggcggaaaagaaactctgaccccaagtgagctcagggatctggtaactcagcagctgccccacctgatgccttctaactgcggtcttgaagagaagattgctaatttgggctcttgtaatgactccaaacttgagttcaggtccttctgggagttgatcggggaggctgccaaatcagtgaaacttgagcgccctgtgcgcgggcactag

SEQ ID NO: 133336 - DNA, 417 bp, Artificial Sequence
  Description of Artificial Sequence: Synthetic coding sequence
atgtgcagttctcttgagcaggctctggctgtactggtgacgacgttccacaagtattcatgtcaggaaggggacaaatttaagttatcaaaaggcgaaatgaaggagttactacataaggagcttccatcttttgtgggacatagcagagaaccatgcgctgtgagagcattccgcgtgcacctgttcaaccccgtgattggggatctcaggaaccagagtccagagggcaagtcggactgccctaaaattacacagcattgggagaaggtggacgaagagggtcttaaaaagttgatggggtctttagacgagaattccgaccagcaagtcgacttccaggagtacgcagtctttcttgcattaatcacagtgatgtgcaatgacttctttcagggctgccctgatcggccctag

SEQ ID NO: 133337 - DNA, 294 bp, Artificial Sequence
  Description of Artificial Sequence: Synthetic coding sequence
atgtgctctagcctggaacaggcacttgcggttctggtaactaccttccataaatacagttgccaggagggcgacaaatttaagctctccaaaggggagatgaaagagctcctgcacaaagagctcccgagttttgttggagagaaggtggacgaagaaggtctcaaaaaattgatggggtccctggacgaaaactctgatcagcaggtggacttccaggaatatgcagtattcctcgccctgattacagttatgtgcaatgatttctttcaaggatgcccagaccgaccttag

SEQ ID NO: 133338 - DNA, 294 bp, Artificial Sequence
  Description of Artificial Sequence: Synthetic coding sequence
atgtgctcctctctcgaacaggccctcgccgtcctcgtgacaacatttcacaaatacagttgccaggagggcgataaattcaaactatcaaagggagagatgaaggagttactgcataaggagttacccagttttgtgggagagaaggtagatgaggagggcctgaagaaactgatgggcagtcttgacgagaacagcgaccagcaagtagactttcaggaatatgctgtgttcttggccctcatcaccgtgatgtgcaatgacttctttcaggggtgccccgataggccgtag

SEQ ID NO: 133339 - DNA, 294 bp, Artificial Sequence
  Description of Artificial Sequence: Synthetic coding sequence
atgtgttccagtctcgagcaagccctggctgtgctggtaacaacattccataaatacagttgccaagagggggacaagtttaagctatctaaaggagagatgaaagagttgttgcataaagagctaccctcattcgtcggagagaaagtggacgaggaaggtcttaagaagttgatgggctccctagatgagaacagcgatcagcaggtggacttccaagaatacgccgtgtttctcgctctgattactgtaatgtgcaatgatttcttccaagggtgccctgaccggccctag

SEQ ID NO: 133340 - DNA, 306 bp, Artificial Sequence
  Description of Artificial Sequence: Synthetic coding sequence
atggctcggccactagagcaggccgtagccgccatcgtgtgcaccttccaagagtacgcgggacgttgcggggacaagtacaagttgtgccaagccgagctaaaagagctccttcagaaggagctcgccacatggacccccacagagttcagggaatgcgattataacaagtttatgagtgtgctcgacacgaacaaggactgtgaagttgactttgtggagtacgttcgctccctcgcctgtctgtgtctctactgccatgagtactttaaggactgcccaagcgaacccccctgttctcagtag

SEQ ID NO: 133341 - DNA, 306 bp, Artificial Sequence
  Description of Artificial Sequence: Synthetic coding sequence
atggctcgccccctggaacaggcggttgctgctatcgtctgtacattccaagaatacgctggccggtgtggtgacaaatacaaactatgccaagccgagctgaaggagctcctgcagaaggagctcgccacatggaccccaacggaattccgagagtgtgattacaataagtttatgtccgttctggatactaacaaggactgcgaagtcgactttgtggagtacgtgagatccctcgcttgtttgtgcctgtattgtcacgagtattttaaagactgtccttccgaacccccttgcagtcaatag

SEQ ID NO: 133342 - DNA, 306 bp, Artificial Sequence
  Description of Artificial Sequence: Synthetic coding sequence
atggcatgccctttagagaaagctctcgatgtgatggtttctacctttcacaagtactccgggaaagagggagacaagttcaagctgaacaagagcgagcttaaggagcttctcacgcgcgagcttccgagtttcttaggtaagaggacagacgaagcagcctttcagaaactgatgagcaatttggatagcaaccgagacaatgaagtcgattttcaggagtactgtgtctttctcagctgtatcgccatgatgtgtaacgaatttttcgaaggatttccggataagcagcccagaaaaaaatag

SEQ ID NO: 133343 - DNA, 306 bp, Artificial Sequence
  Description of Artificial Sequence: Synthetic coding sequence
atggcctgccctcttgaaaaagccctggatgtcatggttagtacctttcacaagtacagcggaaaagagggcgacaagtttaagttgaacaagagcgagttaaaggagctgctcaccagggaactcccttcgtttctgggaaaaagaactgatgaagcagcttttcagaagctgatgtcaaacttggatagcaatcgagacaacgaggtggacttccaagagtactgtgtcttcttaagttgcatcgccatgatgtgtaatgagttctttgagggttttcccgacaaacagccacgcaagaagtag

SEQ ID NO: 133344 - DNA, 306 bp, Artificial Sequence
  Description of Artificial Sequence: Synthetic coding sequence
atggcgtgccccctggagaaggccttggatgtaatggtgtcgacctttcataagtactccggaaaagaaggcgataaattcaaactgaataaatctgaattgaaggaattactcacgagagagctgccgtctttcctcggaaagaggacggacgaggctgctttccagaagcttatgagtaaccttgattccaatcgggataacgaagtagattttcaagaatactgcgtgttccttagttgtatcgcaatgatgtgtaacgagtttttcgaaggatttcccgacaaacagccccggaagaaatag

SEQ ID NO: 133345 - DNA, 306 bp, Artificial Sequence
  Description of Artificial Sequence: Synthetic coding sequence
atggcttgtcccttagagaaggcgctggacgtaatggtgtctacttttcataagtatagcgggaaagagggagataagtttaagctaaacaaatccgagctgaaagagctgctgaccagagagcttccctcattcttgggcaaacgaactgacgaggctgcgttccagaaactgatgtcaaatcttgactcaaaccgggataacgaggttgacttccaggagtattgcgtgtttttgagctgcatagctatgatgtgcaatgaattctttgaagggtttcctgacaagcagcctaggaagaagtag

SEQ ID NO: 133346 - DNA, 273 bp, Artificial Sequence
  Description of Artificial Sequence: Synthetic coding sequence
atggtgtccacattccacaaatactctgggaaagagggagacaaatttaaactgaacaaaagcgagttaaaagagttgcttactcgggaattgccatcttttctcggaaagagaacagacgaagccgcgtttcagaagctcatgtccaaccttgatagtaatcgcgataacgaggttgacttccaggagtactgtgtgttcctgtcctgtattgcaatgatgtgcaatgagttttttgaaggttttcccgataaacagccgcggaaaaagtag

SEQ ID NO: 133347 - DNA, 333 bp, Artificial Sequence
  Description of Artificial Sequence: Synthetic coding sequence
atgcccgccgcctggatattatgggcacattcccattctgagttgcacaccgtcatggagacacctctggagaaggctcttaccaccatggtcaccacttttcacaaatactctggtcgcgagggcagcaaactgactcttagtcggaaggagctcaaggaactgattaagaaagagctgtgcctgggggaaatgaaagaaagctccattgatgacctcatgaaaagtcttgacaagaactcagatcaagagatcgatttcaaagaatacagcgtgtttctgaccatgctttgcatggcttataatgattttttcctagaagacaacaaatag

SEQ ID NO: 133348 - DNA, 279 bp, Artificial Sequence
  Description of Artificial Sequence: Synthetic coding sequence
atggagacaccgctcgaaaaggccctcacaaccatggtgactacctttcataagtactccggacgagagggctccaaattgaccctgagtagaaaggaactcaaagagttgatcaagaaggagctttgcctgggggagatgaaggagtcgagcattgatgatctcatgaaatccttagataagaatagcgaccaggaaatcgattttaaagagtactcagtgttcctcacaatgctttgtatggcgtacaacgatttcttcttggaagacaataaatag

SEQ ID NO: 133349 - DNA, 279 bp, Artificial Sequence
  Description of Artificial Sequence: Synthetic coding sequence
atggaaacccctctggaaaaagcccttacaaccatggttaccacattccacaaatatagtgggagggagggaagcaaattgacactcagtcgaaaagagctcaaagaactgattaagaaggaattatgtctgggcgaaatgaaagaatccagcatcgacgatttgatgaaatctctggacaaaaactctgatcaggagatcgactttaaagaatattccgtgtttctgaccatgctctgcatggcttacaacgacttttttctggaagataacaagtag

SEQ ID NO: 133350 - DNA, 273 bp, Artificial Sequence
  Description of Artificial Sequence: Synthetic coding sequence
atggcgtgccctttagaccaggccatcggcttactggttgcgatattccacaagtacagcggaagggaaggcgataaacatactctgtctaagaaagagcttaaggaattaatacaaaaggagctgacaattggctcgaagttgcaggacgcggagattgccagactcatggaggacctcgatcgcaacaaggatcaggaggtcaacttccaggagtacgttacgtttttgggcgctttagctctcatatataacgaggctctgaaaggatag

SEQ ID NO: 133351 - DNA, 273 bp, Artificial Sequence
  Description of Artificial Sequence: Synthetic coding sequence
atggcctgcccacttgatcaggcgattgggctccttgttgccatctttcataagtattctggacgggaaggtgacaaacacactttatctaaaaaagaattaaaagagctcatccaaaaggagctcacaatcggcagtaagcttcaggatgccgagatcgctcgtctaatggaggatctcgataggaacaaagatcaggaagtcaacttccaagagtacgttacctttctgggcgccctggccctgatctacaatgaagccctcaaaggctag

SEQ ID NO: 133352 - DNA, 306 bp, Artificial Sequence
  Description of Artificial Sequence: Synthetic coding sequence
atgtctaatacgcaggccgaacggtccataatcggaatgatcgacatgttccataagtatactcgaagggatgataagattgagaagcccagccttctgactatgatgaaagaaaactttcctaactttctgtctgcatgcgacaagaaagggaccaattatttggcagacgttttcgaaaagaaggacaagaatgaggataaaaagatcgatttttcagagttcctgtctctgctgggagatattgctactgattaccataaacagtcccatggagcggccccctgtagcgggggtagccagtag

SEQ ID NO: 133353 - DNA, 306 bp, Artificial Sequence
  Description of Artificial Sequence: Synthetic coding sequence
atgtccaacactcaagctgagaggtccatcattgggatgatcgacatgtttcacaagtatacacgtagggatgacaaaatagaaaaacctagtctgctcacaatgatgaaagaaaacttcccaaacttcctgtcagcctgcgacaagaagggtacaaattatcttgctgatgtgttcgagaagaaagataagaacgaagacaagaagattgacttctctgagtttcttagtctgctcggtgatattgctaccgactatcacaagcaatcacacggggctgctccttgcagtggaggcagccagtag

SEQ ID NO: 133354 - DNA, 282 bp, Artificial Sequence
  Description of Artificial Sequence: Synthetic coding sequence
atgctgacagaattagaaaaggcccttaatagcattatcgacgtgtatcataaatactccttgatcaaaggaaacttccatgccgtctaccgagacgatttgaaaaaactccttgaaacggagtgcccgcagtacattagaaagaaaggagcagatgtgtggttcaaagagctcgacatcaatacggacggggcggtgaacttccaggaattcctgattctggtcattaagatgggagtggctgctcataaaaaaagccatgaggagagtcataaggagtag

SEQ ID NO: 133355 - DNA, 282 bp, Artificial Sequence
  Description of Artificial Sequence: Synthetic coding sequence
atgctcactgagctggaaaaagccctcaactcaatcatagacgtgtaccataagtacagtctgatcaagggcaattttcatgcagtctacagggacgatttaaagaagctgctggaaacagaatgtcctcagtacatccggaagaagggagccgacgtatggttcaaagagcttgacatcaacacagatggggcagtcaactttcaggagttcctgatactcgtcattaaaatgggtgtcgccgcacataagaaatcccatgaagaaagtcataaagagtag

SEQ ID NO: 133356 - DNA, 345 bp, Artificial Sequence
  Description of Artificial Sequence: Synthetic coding sequence
atgacatgtaaaatgagccagcttgagcggaatatcgaaacaattattaacaccttccaccagtacagcgtcaagttaggtcacccggacactctgaaccagggagaattcaaagaactggtcagaaaagacctgcagaatttcctcaagaaggaaaataagaatgagaaggtcatcgagcacattatggaagacctggatacgaatgcagataagcagttgagctttgaggaatttatcatgctaatggcccgattaacttgggcttcacatgagaaaatgcacgagggagacgaggggcctggccaccaccacaagcctggcctgggggagggaacaccatag

SEQ ID NO: 133357 - DNA, 279 bp, Artificial Sequence
  Description of Artificial Sequence: Synthetic coding sequence
atgagcgagctcgagaaggctatggttgcattgattgatgtgtttcatcagtattctggtcgagagggagataaacacaagttgaaaaaaagcgagctcaaggagctgattaacaatgaactgagccactttctggaggagataaaagagcaggaggtggtagacaaggttatggagaccctggacaatgatggagacggcgagtgcgactttcaggagtttatggctttcgtcgctatggtcacgactgcctgtcatgaattctttgaacacgagtag

SEQ ID NO: 133358 - DNA, 279 bp, Artificial Sequence
  Description of Artificial Sequence: Synthetic coding sequence
atgtccgaactcgagaaagccatggtcgccctaatcgatgtgtttcaccagtactcgggacgcgaaggggacaagcacaaactaaagaagtccgaactgaaggaactgatcaacaatgagctatctcactttctcgaggagatcaaagaacaagaggttgtggataaggtgatggagaccctggataatgacggtgatggcgagtgtgactttcaagaatttatggcctttgtcgcaatggtaaccactgcatgccatgaattcttcgagcacgagtag

SEQ ID NO: 133359 - DNA, 288 bp, Artificial Sequence
  Description of Artificial Sequence: Synthetic coding sequence
atgacagaattggagaccgcgatgggaatgattatcgatgtgttcagccgctactcaggctcagagggatcgacacagacccttaccaagggggaacttaaagtgctgatggagaaggaactgcctggcttcctacagagcggcaaggacaaggacgcagtcgacaaactgctcaaggacctggacgcaaatggtgacgcacaggttgatttttctgaatttatcgtgttcgtcgccgccataacctctgcctgccacaaatacttcgagaaggctggactgaagtag

SEQ ID NO: 133360 - DNA, 300 bp, Artificial Sequence
  Description of Artificial Sequence: Synthetic coding sequence
atgccaacacagttagaaatggccatggataccatgatccggattttccatagatattctggcaaagaacgcaaaagatttaagctcagcaagggcgaactcaaactgctcctccagcgagagctgacagagtttctttcctgccaaaaggagactcaactggttgataagatcgtccaagacctcgatgccaacaaagacaacgaggttgactttaatgagttcgtcgtcatggtggcagccctgacagtagcttgcaacgactatttcgtggagcagttaaaaaagaagggcaaatag

SEQ ID NO: 133361 - DNA, 300 bp, Artificial Sequence
  Description of Artificial Sequence: Synthetic coding sequence
atgcctacccaattagagatggcgatggacacaatgatcagaatctttcaccgctactcgggcaaggaaaggaagagatttaaactgagcaaaggagagcttaagctcttattgcagcgggaattgaccgagtttctttcctgccagaaggagactcagctcgtcgataaaatcgtacaggacctggacgcgaacaaagataatgaggtggatttcaacgagtttgtggttatggtggctgctttaacggttgcctgcaacgactactttgtggaacagcttaagaagaagggaaagtag

SEQ ID NO: 133362 - DNA, 1029 bp, Artificial Sequence
  Description of Artificial Sequence: Synthetic coding sequence
atgatgtgctctcgcgtcccttccgagcagagcagtggtacctccttgttgcctaaggatggggcgcctttctcatgggacagcctcgatgaggacggcctggatgattcactgctcgagctgtcggagggcgaggaagacgacggggacgttaactacactgaggaggaaattgatgcactgctcaaagaagatgaccctagttacgagcaatccagcggggaggatgacgggggccacgtcgagaaaggagagcgcggatcccagattcttcttgacacgccaagagagaagaacagttcatacagccttggccccgtggctgagaccccggacctgtttaagttgcctcagctctccactagcagcggccacggccctgcccacaccaaaccccttaacaggcggtcggtgctagagaagaacctgattaaagtgacagtggctccgtttaatcccacagtgtgtgatgcacttttagacaaggacgagacagattccagtaaagacacggagaagctgagttctctgggcgaagagatgcgcgaggatggcctcagtccaaacgagagcaagttatgcaccgagagcgagggcataagccctaataattctgcctggaatggccctcaactttcaagcagcaataataactttcagcaaacagtgagtgataaaaatatgcccgacagcgagaaccctaccagtgtgttctcacgcatttccgatcattctgagacacccaatatggaactcagttgtaggaatggcgggagtcacaagagctcatgtgaaatgaggagtctggtcgtatccaccagctctaacaaacaggatgtgctaaacaaagactctggcaaaatgaagggacatgagcggcggctgggtaaggttatacctgtgcttcagactaagactcggaccaacgtgccaactttttctcagtcaaatctggaacaacaaaagcagctgtatttaaggagcgtcatcgcacacatcgaggaccctgaagacactaaccagggatag

SEQ ID NO: 133363 - DNA, 1227 bp, Artificial Sequence
  Description of Artificial Sequence: Synthetic coding sequence
atgatgtgcagccgggtgccctctgaacaatcatccggaactagcctgctccccaaagacggtgcccccttctcctgggactctttggacgaggacggcctggatgacagcctcctggagctgtctgagggcgaggaggacgacggggacgtgaactacaccgaagaggagatcgatgccctactcaaagaagatgaccccagttacgagcagtcaagtggtgaggacgacggcggacacgtagagaaaggcgagagggggagtcagatcctgctcgataccccacgggagaaaaacagtagttattcactgggacccgttgcagaaacccctgatctcttcaaactgccacaactgtccactagcagtggccatggccctgcgcatactaaaccgctcaacagacggtccgttttggagaaaaaccttattaaagtgaccgtggcccccttcaatccaacagtgtgcgacgccctgctggacaaggacgagaccgatagctcgaaggataccgaaaaactgtccagccttggcgaggagatgcgcgaggatgggttgtctcctaacgagtctaaactctgcaccgaatctgagggcattagtccaaacaactccgcctggaatggcccccagctgtcgtccagcaataacaacttccagcaaactgtgtcggataaaaatatgcctgactctgagaacccaacatctgtattctcacgaatctctgaccatagtgaaactcccaatatggaactcagctgtaggaacgggggctctcataagtcaagctgtgaaatgagaagcctcgttgtgagcacctcaagcaacaagcaagacgtgctgaacaaggactccggtaaaatgaagggacacgagcgtagactgggcaaagtgatcccagtgctgcagaccaaaacacggaccaacgtgcctactttcagccagagcaatctcgaacagcagaagcaactgtatttgcgctccgtgattgcccatatagaagaccctgaggatactaatcaagggatcagtggcgagctgtgtgccctcatggaccaggtccatcacatgcagcacagtaagtggcagcacccctcggatctgacaacacgtaactatgcccggcgtcagaagcacctgcagcgctactccctgacacagtgggtggatcgaaatatgcgctctcaccatcgatttcagagattgcccgacttcagttattcctag

SEQ ID NO: 133364 - DNA, 1227 bp, Artificial Sequence
  Description of Artificial Sequence: Synthetic coding sequence
atgatgtgctcaagggtgccctcagagcagtcatccggaacttctttgttgccaaaggatggcgcacccttctcctgggactctttggacgaggacggtctggatgactcactgcttgagctgtcggagggagaagaagacgacggagatgtgaactataccgaagaggagatcgacgctttgcttaaagaggacgacccttcatacgagcagtctagtggcgaagacgatgggggccacgtggagaagggcgaaaggggctcgcaaattctgctggatacgccccgtgagaaaaattcaagctattctctagggccggttgccgaaacacctgatctgtttaagcttcctcaactgtcaacatctagcggccatggaccagctcacacgaagccactcaaccgtcggagtgtgctggagaagaacctaatcaaagttactgtcgcaccctttaatcccaccgtctgcgacgctctgctggataaggatgagacagactcaagcaaggacaccgagaagctctcttccttaggcgaggaaatgagagaagatgggctgagccctaatgagtcaaaactgtgcacggaatctgagggcatcagtcccaacaattctgcctggaacggaccgcagctgagctctagcaacaacaacttccagcagactgtgtctgacaagaatatgcctgattccgagaaccctacatcggtgttcagtcgaatttcagaccactctgagaccccgaacatggagctaagctgccgcaatggagggagtcataagagctcatgcgagatgcggagcctggtggtatctacaagctcgaacaaacaggacgttctcaacaaagacagtggcaagatgaagggacatgaaaggaggcttggcaaagtgatccccgtgttacagaccaagacccgaaccaatgtgccaactttcagtcagagtaacctggaacaacagaaacaactttaccttcgctctgtcattgctcatatcgaagatcctgaggacactaaccaaggaatttctggagaactctgtgcccttatggaccaagttcatcatatgcagcatagcaaatggcaacatccttccgacctgaccacccgcaattacgcacggagacagaagcacctccaacggtattcgcttacacagtgggtcgacaggaacatgcggtcccatcatagatttcaacggctgcccgactttagttacagctag

SEQ ID NO: 133365 - DNA, 1026 bp, Artificial Sequence
  Description of Artificial Sequence: Synthetic coding sequence
atgatgtgctccagggtgcccagtgagcagtctagtggcacctccctcctccctaaggacggcgctccattctcatgggactctttagatgaagatggcttggacgatagcttgttagagctgtcagagggagaagaggatgatggcgacgtaaattacaccgaagaagaaatcgatgctctgctcaaagaggatgatcctagctacgagcagagcagtggagaagacgacggtggacacgtggagaaaggagaacgcggatctcagatccttctcgatacccctcgggagaagaatagttcctacagtttgggaccggtggccgagacccctgacctattcaagctgccccagctatctaccagtagcggccatggacccgcccacacaaagcctctgaacagaaggtcagtgcttgagaaaaatttgattaaggtcacagtggccccttttaaccctaccgtttgtgacgcactgctcgataaagatgagaccgatagcagcaaggatacggaaaaattatcctccctcggtgaggagatgcgggaagatggactgagcccaaacgagtcaaaactctgtaccgaatcggagggcataagccctaataatagcgcctggaacggtcctcagcttagctcctccaacaacaattttcagcagacagtgtccgataaaaatatgccggactctgagaacccgaccagcgttttttctagaattagcgatcactctgagaccccaaatatggaactcagttgcaggaacggcggaagccacaaatctagttgcgagatgcgctcactggttgtgagcaccagtagcaacaaagacgtgcttaacaaggatagcggcaaaatgaaaggccacgagaggcgcttgggaaaagtgattccagtcctgcagacaaagaccaggacaaatgtcccaaccttctcacagagcaatctggagcaacagaagcaactgtacctgaggagcgtgattgcccacattgaggacccggaggataccaatcagggatag

SEQ ID NO: 133366 - DNA, 441 bp, Artificial Sequence
  Description of Artificial Sequence: Synthetic coding sequence
atgatgtgcagtcgagtgccaagtgagcagtcttccggcacatcactactaccaaaggacggcgcaccgttttcctgggactctttagacgaggatggcctggatgattccctgctcgaactcagcgaaggtgaggaggatgatggcgatgtcaattacacagaggaagaaattgatgccctgctgaaagaagacgacccgtcctatgaacaatcttctggggaggacgatggaggccacgtggaaaaaggggaacgggggtcccagatcctccttgacaccccgagagaaaaaaactccagctattctctcggtccagtggctgagactcccgatctgtttaaactgccacagctcagcacttccagtggccacggaccggcccatactaagccactaaacagacgatcagtgctcgagaagaatcttatcaaggtctag

SEQ ID NO: 133367 - DNA, 363 bp, Artificial Sequence
  Description of Artificial Sequence: Synthetic coding sequence
atgatgtgttctcgcgttccatctgaacagagcagtggcacctcactgctcccaaaagacggcgcccctttttcatgggattcactggacgaagacggcctcgacgactccctgctggagctatctgagggagaggaagatgacggagacgttaactatacggaggaagaaattgatgctttgttgaaggaggacgatccaagctacgaacaaagcagtggtgaggatgacggaggccacgtggagaaaggagaacgcggctcgcagatcctgctcgataccccccgggagaagaactctagctactcactgggcccagtagcagaaacgccagatctgtttaagttgcctcagctttcatag

SEQ ID NO: 133368 - DNA, 126 bp, Artificial Sequence
  Description of Artificial Sequence: Synthetic coding sequence
atgatgtgcagccgggtcccatcggagcagtcctcagggaccagtctgctgcccaaagatggcgcacccttctcctgggacagccttgatgaggatggactggacgactccctgctggaactctag

SEQ ID NO: 133369 - DNA, 18 bp, Artificial Sequence
  Description of Artificial Sequence: Synthetic coding sequence
atgatgtgttcacggtag

SEQ ID NO: 133370 - DNA, 393 bp, Artificial Sequence
  Description of Artificial Sequence: Synthetic coding sequence
atgatgtgtagccgggtcccgtctgaacagtccagtgggacttccctgctgcccaaagacggcgctcccttctcatgggacagcctagatgaagacgggctggacgacagcctcttggaactgtctgagggggaggaggatgatggggacgtgaactatacagaggaggaaatagacgcccttcttaaagaagatgacccatcatatgaacagagctcaggagaggatgacggaggtcacgtggagaagggagagcgcggctcacagattctcttggatacaccgagagagaagaacagtagctacagtctggggcctgtcgcagaaacacctgatttgtttaaattgccacagctcagtaccagctcaggccatggtcccgctcacacttag

SEQ ID NO: 133371 - DNA, 1026 bp, Artificial Sequence
  Description of Artificial Sequence: Synthetic coding sequence
atgatgtgctcaagagttccttccgagcagagctccggtaccagcctgttgcccaaggacggggctcctttctcatgggatagcttggacgaggatgggctcgacgacagcctgctcgagctaagcgagggcgaagaggacgatggagacgttaattacactgaagaagagatcgatgcgcttctgaaagaggacgacccatcatatgagcagtctagcggggaggatgacgggggacacgtggagaagggcgagcgaggctcgcagattctccttgatacaccgcgggagaaaaattcttcctatagcctcggtccagtcgccgaaaccccagatctcttcaaactgcctcaactgtccacatcctccggccacgggcctgcccatacaaagcccttaaacagaaggagcgtcctcgaaaaaaacctgatcaaagtgacagtcgcaccattcaacccaacagtctgtgatgcacttctggacaaagacgagactgacagctcgaaggacactgaaaagttgtcttcactgggggaggaaatgagggaagatgggctgtcaccaaacgagagtaagctgtgtactgagtccgaagggatctctcccaacaactccgcctggaacggccctcagctttcctccagtaacaataactttcagcagaccgttagcgacaagaatatgcctgactcagaaaaccctacgagcgttttttcgcgtattagtgatcactctgagacacctaacatggagctgagttgccggaatggcggctcccataagagctcatgtgaaatgcgcagcttggtggtgtcgacctcatccaacaaggatgtgctgaataaggactccggaaagatgaagggtcacgaaagacgtcttggcaaagtgattccggttctgcagactaagacgcgcactaacgtgccgaccttctctcagtccaacctggaacagcagaagcaactctacctgagatcagtcatcgctcatattgaggaccccgaagacaccaaccagggttag

SEQ ID NO: 133372 - DNA, 516 bp, Artificial Sequence
  Description of Artificial Sequence: Synthetic coding sequence
atgatgtgcagccgggtcccctccgagcagagctctggtaccagcttgctgccgaaggatggagcgccattcagctgggattccctcgacgaggatggcctggatgatagtctattggaactctctgaaggggaggaagacgacggggacgtaaattacaccgaggaggaaattgacgccctgctgaaagaagatgacccaagttacgagcaatcaagcggggaggatgacgggggtcatgtggaaaagggggaacgtgggtctcagatcctgcttgatacgcctcgcgaaaagaatagttcttacagcttgggaccggttgcggagacacctgacctgtttaaactcccacagctgtctacctccagcgggcacggcccagcccacaccaagcctctgaacaggcggtctgtgcttgaaaagaacctcatcaaggtgactgtcgcaccgtttaacccgaccgtgtgtgacgcacttctggacaaagacgagaccgactcatcaaaagatacatag

SEQ ID NO: 133373 - DNA, 1764 bp, Artificial Sequence
  Description of Artificial Sequence: Synthetic coding sequence
atggccacagctgcatacgaacaactcaaattacatatcacaccagaaaagttctacgtagaagcctgcgacgatggtgcggatgacgtgctgactatcgacagggtgagcaccgaggtgaccctggcagtcaagaaggacgtgcctccttctgccgtgacgcgacctatattcggaatcctgggcactatacatctcgtggccggaaactacttgatcgttataactaagaagatcaaggttggagagttcttcagtcacgtggtttggaaggccaccgattttgacgtgctgtcatacaagaaaacaatgctacacctcacggacattcagcttcaggacaacaagacttttctcgctatgctgaatcacgtgctgaatgtggatgggttctacttctctaccacatacgacttaacccacaccttgcagagattatcaaacaccagtcctgaattccaggagatgagtctgcttgaaagagccgatcagagatttgtttggaacggccacctgttgcgggagctgtctgctcaacccgaagtgcaccggtttgcactccctgtactgcacggatttatcactatgcactcctgttctatcaatggcaaatacttcgattggattctaatatctcgcagatcatgtttcagggcgggcgtgagatactacgtgcgtggcatagactccgaaggtcacgcggctaactttgtagagaccgagcagattgttcactacaacgggtccaaggcctcctttgtccagacaaggggttccattcctgtgttttggtcacagcgccctaacctcaagtacaaacccctgccccagatctccaaggtggctaatcacatggacggcttccaaaggcactttgacagccaggttatcatctacgggaaacaagttatcattaatctgataaatcaaaagggttccgagaagcctttagagcagacgttcgctacgatggtctctagcctaggatccggtatgatgagatacattgcgtttgattttcataaagaatgtaagaatatgcggtgggaccgcctgtccatcctgttggatcaagttgccgagatgcaggacgagctttcctacttccttgtggactcagcagggcaggtggtcgcaaaccaggagggcgtttttaggtcgaactgcatggattgtctcgatcggaccaatgtgattcagtctctgctcgcaaggaggagtctacaggcccagctgcagagactgggcgtgctccacgttggtcagaaactagaagagcaggatgagttcgaaaagatctacaagaatgcttgggccgacaatgccaacgcgtgcgccaaacagtacgctggcaccggggccctcaaaacggatttcactaggacaggcaaaagaacccatctgggcttgattatggacggctggaactccatgattcgctattacaagaataattttagtgacggtttccggcaggattccattgatctgtttttaggtaattacagtgtggacgaactggagtcccattctcccctctcagtaccacgcgattggaagttccttgccctgccaattatcatggtcgttgccttcagcatgtgcattatctgtctgctgatggccggcgacacatggaccgaaacattagcatacgtcttattctggggagtagcctcaatcggaacattcttcatcattctctataatggtaaagacttcgtggacgcgccccgactcgtccagaaggaaaaaatcgattag

SEQ ID NO: 133374 - DNA, 1581 bp, Artificial Sequence
  Description of Artificial Sequence: Synthetic coding sequence
atgtggaaactggtgatgatggagcaaatgacctatctcccactgaccgtttgcccgcagcgcctaccccttcagagccgcaaaatgttcctcctgcagctgagccaggatcaatatctggtatactgggcacagagtatttggtggcagcttcaagacaataaaacgttcctcgccatgctgaaccatgtactcaacgtggacggcttttatttcagtaccacgtacgacttgacacatacactccaacggctgtcaaatacgtcgcctgagttccaggagatgtcgctgctcgaaagagcagaccagcgcttcgtctggaacggacatctgctgagggagctgtccgcccagcctgaggtgcaccggttcgctctgccagtgcttcacggattcatcacgatgcatagctgttcgattaacggaaaatattttgattggatactcattagccgccgcagttgcttcagagcaggggtaaggtattacgttcgcgggattgattccgagggtcacgccgccaatttcgtcgaaacagagcagatcgtgcactataacgggtccaaagcctccttcgttcagaccagaggatcaatcccagtgttctggagtcagcgaccaaacctcaagtataagcccctgccccagattagcaaggtagctaatcatatggacggcttccaacgccactttgactcacaagtgattatatacgggaagcaggtgattatcaacctgatcaatcagaagggatcagagaaaccgttggagcagacattcgccaccatggtgtcctccctggggtccggcatgatgcggtacatcgccttcgattttcacaaagaatgcaagaacatgcggtgggataggcttagcatcctcttagatcaggtagccgagatgcaggatgagctgtcttactttctggtcgactctgctggacaggtggtggctaaccaggagggggtttttcgtagtaattgcatggattgtctggatcggacaaacgttatccagtcattgttggctcgccgctctttgcaagcccagcttcaaaggctgggcgtgcttcatgttggtcagaagctggaggagcaggatgaattcgaaaagatttacaaaaatgcctgggctgacaacgctaacgcttgcgcgaagcaatacgccggcacaggcgccttaaaaaccgattttacgagaactggcaaacggactcacctcgggttaatcatggatggatggaactcaatgattagatactataaaaataatttcagcgatgggtttcggcaagactctatagatctttttctaggcaactactctgtggacgagctggagagccacagtccgctctcggtgccacgggattggaaattccttgccttgccaatcattatggttgttgccttttcaatgtgtattatctgtctgctcatggcaggggacacgtggactgaaactctcgcctatgtgctcttttggggtgttgccagtatagggaccttttttatcatcttgtataacggtaaggacttcgtcgatgccccgcggttggtacagaaagagaaaattgactag

SEQ ID NO: 133375 - DNA, 2901 bp, Artificial Sequence
  Description of Artificial Sequence: Synthetic coding sequence
atgttctggaagtttgatctgaatactacctcgcacgtggacaagctgctcgacaaggagcatgtgacactgcaagagcttatggacgaggatgatattttgcaagagtgcaaggcgcagaaccaaaaactgcttgatttcctctgccggcagcagtgtatggaggagttggtatcactgatcacgcaagacccacccctggatatggaggagaaggtcagattcaaataccccaacaccgcttgtgaattgttgacatgcgacgtgcctcagatctccgaccgcctcgggggagatgaatctctgctgagcctgctgtacgatttcttggaccatgaaccaccactgaacccactgcttgccagctttttttctaaaacaattggcaatctgatagcccgaaaaacagagcaggtcatcactttcctgaagaaaaaagataagttcatctccctagtactcaagcacatcgggactagtgctctgatggatttgctgttgagattggtcagctgtgtcgagccagctggactacgacaggacgtcctgcactggctcaacgaagagaaggtgatacagagattagtggagttgattcatccttctcaggacgaagacagacagtccaacgcaagccaaactctgtgcgatattgtgcgcctcgggagagatcagggcagccagttgcaagaggctcttgagccagatcctctgctgaccgcactggagtcccaggattgcgtggagcagcttcttaagaacatgttcgacggggaccggacagaaagctgtcttgtatctggaacgcaggtcttgctgactctcctggagaccagacgagtggggacagagggtctggtggattcattttcccaggggctggagaggagctacgcagtgagcagctcagtgttgcacggcatcgaacccaggcttaaagactttcaccagctgctgcttaatccccctaaaaagaaggccattttaacaaccataggagtccttgaagagccactgggtaatgcccgccttcacggcgcaagactgatggccgctttactccatacaaatacgccctccataaatcaggagctctgccggctcaatactatggacctgctgctcgatctcttcttcaagtacacctggaacaacttcctgcacttccaggtagagttatgtatagcagctatacttagccatgctgctagagaagaaagaaccgaagcctctggcagcgagtcccgcgtggagccaccacacgagaacggcaacaggtcattggaaaccccccagcctgctgcttcactacccgacaataccatggtcacacacctctttcagaagtgttgcctggtgcagagaatcttggaggcctgggaagcaaacgaccatacacaggctgctggggggatgcggcggggaaatatgggccatctaactagaatagcaaacgctgttgtgcagaacttggagagaggaccagttcagacacatatctctgaagtgatcagaggacttccagccgattgccgaggcagatgggaatccttcgtcgaagaaacactcactgaaacaaatagacggaacacagttgacctcgtgtccacccatcacctgcactcaagttccgaggatgaggatatagagggcgccttccccaacgagctctcattacaacaagcgttttcagactatcagatccaacaaatgacagctaacttcgtcgatcagtttggattcaacgacgaggagtttgctgaccaagatgataacataaacgctccgttcgacaggatcgcggagattaatttcaacattgacgcagacgaggatagtcctagcgccgcgctgttcgaagcctgttgcagcgatcgcatccaacccttcgacgacgacgaggacgaggatatctgggaggatagcgatacccgctgtgcggccagggtgatggctagaccaaggttcggcgcaccacatgccagcgaaagttgcagtaagaatggcccggagcgcggaggtcaggatggcaaagcttccttggaggcgcaccgagacgctccgggcgctggagcaccccccgcgcctgggaagaaagaagcaccgcctgtggagggtgatagcgagggcgccatgtggactgccgtcttcgatgaacctgctaattccacaccaactgcacctggcgtggtgagggatgttggctcatcagtgtgggcagctggcacatcagccccggaggaaaaagggtgggctaagtttaccgatttccaacccttttgctgctcggaatcaggtccgaggtgctcgagccccgtcgacaccgagtgctcccacgcggagggcagtagatcccagggccccgaaaaggcctcacaggcaagctacttcgcagtgtcacccgccagtccctgtgcctggaatgtatgtgttacaaggaaggcccccctgctggcttccgacagtagctctagcggcggctcacattcagaggatggagatcagaaggccgcctcagccatggacgcagtgtccagaggacccggccgcgaggccccacccctgcctacagtcgctcgtacagaagaagcagtggggcgggtggggtgcgccgacagtagactgctgagtcctgcatgtccagcacctaaggaggtgacggccgcccctgcagtcgcagtccctcctgaggccacagtggcgatcactacagctctgtccaaggctggtcctgcaattcccactccagctgtcagtagtgcattagccgtcgccgtgcctcttggacccattatggctgtgactgccgccccagctatggtggccacactgggaacggtcaccaaggacgggaagaccgacgctcctcccgaaggagccgccctgaacgggcctgtgtag

SEQ ID NO: 133376 - DNA, 2217 bp, Artificial Sequence
  Description of Artificial Sequence: Synthetic coding sequence
atgagcaggcgctcacagcgcctgacccggtattcccagggcgatgacgacgggtccagcagcagtggcggttcaagcgtcgccggatcccagtccaccctcttcaaggatagtccactgcgcacgctaaagcgcaagagcagcaatatgaagagattaagtccagccccccagctgggacctagctctgatgcccacaccagttactattccgaatctctggttcacgaaagttggttccctccaagatccagcctagaggagctacacggtgacgccaattggggtgaagatctgagggttcggcgccgaaggggaaccgggggcagcgaaagcagccgggcctcaggtctggttgggcggaaggctaccgaggactttctcgggtccagctccggatactcctctgaagacgattacgttgaggactctgaagggcgcggttctaaggttactgagaccgagcccgtaagtagctttccagccggatactcagacgttgatcaacagtcttcctccagtagactgcggtctgcagtaagcagagccggttcgctgctgtggatggtggccaccagcccaggccggctgttcagactcctttattggtgggccggcactacctggtaccgtttaacaacagccgcttccttactggatgtgttcgtgctcacacggcgattctcaagtctgaaaacatttttatggttcctactacccttacttctgctgacttgcctcacatacggtgcatggtatttttacccttacggccttcagaccttccaccctgctcttgtgtcttggtgggctgcgaaggattctcggagacctgacgaaggatgggaggctcgagattcgtccccacacttccaagccgaacagagggtcatgtcacgagtgcactccttagagcggagattggaagctctcgcggccgagttttcatccaattggcagaaggaggctatgagacttgagagactagagctgcgtcaaggcgcccctggccagggtggaggtggagggctttcccacgaagacaccttggcccttctggagggacttgtttccaggcgcgaagcagctctgaaggaggatttcagacgggagaccgccgcgaggatccaagaggagctgtccgctctcagggctgagcaccagcaagattccgaagacctttttaaaaaaatcgtcagggcttcacaggagtctgaggcaaggattcaacagctgaaaagtgagtggcagtctatgacccaggagtccttccaggagagtagtgtgaaagaactacgcagattagaggatcaactagccgggctccagcaagaattggctgcgttggccctgaaacagagctccgtggcggaggaggtgggcttactgccacagcagatacaagccgtacgggacgatgttgaaagtcagtttccagcctggattagccagttcctggctcggggcgggggcgggcgcgtcggcctgctccagagggaggagatgcaagcccagctgcgcgagctggaaagtaagatcctgacacacgtcgcggagatgcagggaaaaagcgctagagaagcagcggcctcgctgagcctcactctgcagaaagagggagtaatcggcgtcaccgaggagcaggtccatcacattgttaagcaggctctgcaaaggtactccgaggataggattggacttgccgattacgccctggagtctggtggcgcgtcagtgattagcacgcgctgctccgagacatacgagaccaagacagcccttctatctctcttcggaatccccctgtggtatcattcacagagtccccgggtcattctgcagcccgacgtccatccggggaactgctgggcctttcaaggcccacagggtttcgctgtggtccggctatccgcccgaattcgccctacggctgtgacccttgagcacgtcccaaaggcgctctctccaaactctacaattagctcggctcctaaagatttcgccattttcggctttgacgaagatcttcagcaggaagggactctactcgggaaattcacttacgatcaggatggtgaacccattcagacctttcacttccaggctccaactatggctacctatcaagtggttgagctgcgaattttaaccaactggggccacccggaatacacctgtatttacaggtttcgagtccatggagagccagctcactag

SEQ ID NO: 133377 - DNA, 2154 bp, Artificial Sequence
  Description of Artificial Sequence: Synthetic coding sequence
atgagcagacgctcccaaagacttactcgctattctcagggcgatgacgacggatcatccagtagcggaggcagctccgtagccggatctcagtccacgttgtttaaggatagccctttacgaacactaaaacgcaaaagctccaacatgaaacggctgtctcccgcacctcagctcggaccctcatcagacgcccacacatcttactatagcgaaagcctagtccacgagagctggttcccaccacgctctagcctcgaggaactccatggcgatgccaactggggcgaggatcttagagttaggagacggcgcgggaccggcgggtctgaatcatctcgagcctcaggtcttgttgggagaaaagcaacagaggattttttaggtagcagttccggctacagcagcgaagatgactacgttggctactcagacgtggaccagcagagctctagcagcagattacgaagtgccgtctctagagctggaagcctcctatggatggtagcgacgagcccagggcggctctttagacttttatactggtgggctggaaccacatggtatcggctcaccaccgcagcttccttgcttgacgtgtttgtcctcacgcggagattcagcagtctgaagacgttcctgtggtttttgctgccgcttctcttactgacctgcctcacctacggcgcttggtatttctacccctatggactgcaaacgtttcaccctgcactggtgagttggtgggctgcaaaggacagcaggagaccagacgaagggtgggaggcccgggacagttcaccacactttcaggccgaacagcgtgtgatgtccagagtgcactccctcgagcgacggttagaagctctggcagccgagttttcttcgaactggcaaaaagaagcgatgcgcctggagagactcgagctgcggcagggcgctcccggccaaggaggcggtggcggattaagccatgaggatacactggccctgctggaggggctcgtcagtagaagggaggcagctctgaaggaagatttccgtcgcgagacagcggcccgaattcaggaggagttgtccgcactgcgggccgaacaccagcaggactccgaggacttgttcaaaaagatagtcagggcatcacaggaatcagaagcacggattcagcagttgaagtctgagtggcaatccatgacacaggagtcgtttcaagagagcagcgtgaaggaattgagaagactggaggatcagttagcagggttgcagcaagagctcgctgcccttgccctgaaacagtcatctgtcgcagaggaggttggcctgctgccacagcagatccaagccgtgcgggatgacgttgagagccagtttcccgcttggattagccaattcctggcgcggggtggcgggggcagagtgggccttctgcagcgagaagagatgcaggcccagttgcgggagctggaatctaagatcttaacccacgtggccgagatgcaagggaagagtgccagagaggcagctgcttcactgagcctgacattacagaaggagggagtgatcggcgtgactgaagaacaggtacaccacatcgtgaagcaagccctacaaagatactccgaagacaggatcggcctggccgactacgcattggaatcgggcggcgctagcgtgattagtacacggtgtagtgagacttatgagacaaagactgccctgctgtcactttttgggatacctctatggtaccacagccaatcaccacgcgtaatactgcagccggacgttcaccccggtaattgctgggccttccaagggcctcagggctttgccgttgtgcgtctgtctgctagaattcgtcccacagccgtgacgctggagcacgtgccaaaggcgctctcccctaacagtaccatcagctcagcacccaaggactttgcaatttttgggttcgatgaggacctccagcaagaaggaactttactgggcaaatttacttacgatcaggacggcgagcccatccagacattccacttccaagcgcccactatggccacctatcaggttgtcgaactccggattctgaccaattggggccatccggagtacacctgcatttacaggttcagggtccacggagaaccagcacactag

SEQ ID NO: 133378 - DNA, 2154 bp, Artificial Sequence
  Description of Artificial Sequence: Synthetic coding sequence
atgtccaggcgctcccagagactcacgaggtactcccagggtgacgatgacggatcctctagctccggcggaagcagcgtggccggatctcagtctaccctatttaaggatagccctttgaggacccttaagcgtaaatcctctaacatgaagaggctgtctccagctccacaactggggccttctagcgacgcacatacatcgtattatagtgagtccctcgtccatgagtcctggtttcctcccaggtcgagtctggaggaactccatggagacgcgaattggggggaagatctccgggtgaggcgaagaagagggactggtggctcagaaagctcccgggcctcgggactggtagggcggaaagcaaccgaggacttcctcgggagtagcagcggctatagcagcgaggacgattacgttgggtatagcgatgtggatcagcagtcgtctagcagccgtctgagatcggccgtatcccgggcgggctcacttctgtggatggtggcaacgtccccgggccggctgttcaggctgctttactggtgggcaggcacgacctggtaccgcctcaccaccgctgcatccttgctagacgtgttcgtcctgaccagaaggttctcctccctgaagacctttctgtggtttctactgccactcctgctactgacctgcctgacctatggcgcctggtatttctacccttatggtctgcagacctttcatcctgctctggtgtcctggtgggccgcgaaggactcccggcgccctgacgagggttgggaggcccgtgattcaagtcctcactttcaagctgagcagcgggttatgagtcgcgtgcactccttagagcgaagactggaggctctggccgcggagtttagcagcaactggcaaaaggaagccatgagactggagcgcctggagctcaggcagggagcacccggtcagggcggagggggcgggctttctcacgaagacactcttgcgttattggaggggctggtgtcccgccgagaagctgccctcaaagaggacttccgacgtgagaccgcagcgcgaatccaggaagaattatcagcattgcgcgctgagcaccagcaagactctgaagatttgtttaaaaagatcgtgcgagctagtcaggaatctgaggctcgtatccagcagctcaaaagtgaatggcagtcaatgacacaggagtcctttcaggagtcttcagtcaaagaactacggaggttagaagaccagcttgccggattgcagcaggagcttgccgctcttgccctgaagcagtcatcagtcgctgaagaagttgggttgttgcctcagcagattcaggcagtgagggacgatgtggagtcccagttccccgcttggatcagccagttccttgctcgcggaggaggcggccgtgtgggtttgctgcagcgtgaggagatgcaggctcaactgagagaattggaaagcaaaattctgactcatgttgccgaaatgcaggggaaatccgcgcgggaagcagcggctagcctcagccttacgctccaaaaggagggcgtgattggggtgacggaagagcaggtccatcacattgtgaagcaggccttgcagcgctacagtgaggaccgtatcggcctggccgattacgcactggagtcaggtggagcttccgtgatttcaacgagatgttcggagacatatgagaccaagacagcactcctgtctctctttggtattcccttatggtaccacagccagagccctagagtcatattacaaccggatgttcaccctggaaactgctgggcattccagggtccccaggggtttgcagttgtccggctgtctgcccgaattcgacctaccgctgtgaccctagaacacgtgcctaaagcactcagtcccaattctacaatatctagcgctccaaaagactttgcgatatttgggttcgatgaggatctgcagcaagaagggacgctccttggtaagttcacatatgatcaggacggggaacccatacagaccttccatttccaagctcctacgatggcgacgtatcaggttgtggaactcagaatcctgaccaattgggggcatcctgaatatacttgcatctatagatttcgagtccacggggaacctgcccattag

SEQ ID NO: 133379 - DNA, 2121 bp, Artificial Sequence
  Description of Artificial Sequence: Synthetic coding sequence
atggtgtcaccaccctccgccggacagcggttaaggggagtaccagtgtgggctgccggcgcgtttcggttctcgagtggagaggagtccacaagtcatcttatcatgagccgaaggagtcagagactgacccggtattcccaaggagacgacgatggatcaagctcatctggcggatccagcgtggccggctctcagtctaccttgttcaaagacagcccccttcgcaccctgaaacgtaaatcaagcaacatgaagcgcctatcccccgccccccaattaggaccatcgtccgatgcccacaccagctattatagcgaatccctggtgcacgagtcatggtttccacccagatcaagcttggaggagcttcacggagacgccaattggggttatagtgatgtggaccaacagtcctcttcttcacggctgagaagcgccgtgtccagagcaggcagcctgctttggatggtggcgacgtcacctgggagactgtttagactgctctactggtgggccgggacaacttggtaccggctcaccactgcagcatccctgctggacgtctttgtgctgacccgaaggttcagctcactgaagacatttctgtggtttcttttgccgctgctgctattaacttgtctgacttacggcgcatggtatttctacccctatggactacaaacgttccacccggcgcttgtttcctggtgggcagccaaggattctaggcggccggacgaagggtgggaagcacgggactcttcccctcatttccaggccgaacaacgagtcatgtcgcgagtgcacagcctcgaaagacgactggaggccttggccgccgaattctccagcaattggcagaaggaagctatgcggctggaaagactggaacttcgtcagggtgccccaggccagggcggtggggggggcctttcccatgaagatacacttgccttgctcgagggcctggtgtcacggcgggaggcagcgctgaaggaggatttccggcgagaaaccgctgcgcgcatccaagaggagctgtctgccctgcgggccgaacaccagcaggattctgaagacttgtttaaaaaaattgtgagggcaagtcaggagagcgaggcccggatccagcagctaaaatctgagtggcagtccatgacccaagagtctttccaggaaagctctgttaaagaactgcggagactggaggaccagttagctggacttcagcaggagttggccgctcttgcactaaaacagagttctgtcgctgaagaagttggcctgctgccacaacaaatccaggctgtgcgggacgatgtggagtcgcagttccccgcctggatctctcaattcctcgcaagaggtgggggtggaagggtaggattactgcaaagagaggagatgcaagcacagctgagggagctggagagcaaaattcttacgcatgttgcagagatgcagggtaagagtgctcgagaagctgctgctagcctctcattgacactacagaaggaaggtgtaatcggtgtgactgaagaacaggtacaccatattgttaaacaggctctgcaaaggtactccgaggaccgcatcggcctggcagactatgccctggagtccggaggagcgtcagttatatcaactaggtgcagcgagacctatgaaaccaaaacggcccttctctccctgtttggcattcccctttggtatcactcccaatcgccccgtgtgattctccagcctgatgtgcaccctggcaactgctgggcttttcagggaccacaaggcttcgccgtcgtgcggctgagcgcgcgcatccgcccaactgcggtgactctggaacacgtgccaaaagccctgagtcctaattcaacaatctctagcgctccgaaggacttcgctattttcggattcgatgaagatctccaacaggagggtactctgctgggaaaattcacttatgaccaggacggggagccgattcagaccttccatttccaggcaccaacgatggccacatatcaagtggtggagttgcgaatcctgaccaactggggacacccagaatacacctgcatttatagattccgggtgcacggagagccagcccattag

SEQ ID NO: 133380 - DNA, 375 bp, Artificial Sequence
  Description of Artificial Sequence: Synthetic coding sequence
atgtctagaagatcccagcggctcacaaggtattctcagggtgacgatgatgggagttcttcaagtggggggtcttcagtagctgggtcccaatcaactttatttaaggacagtcctcttcgaacgttaaaaaggaagtcttccaacatgaaacgtctgtccccagctccccagctgggtccgtcaagcgacgctcatacgtcctactacagcgaatctttagtgcacgagtcctggttccctcccagaagtagccttgaggagttgcatggagatgcgaattgggaccccacgttccagaaacttctcgaggcgcagaagtccccttggttcttcccggcccaggtgaggacctgcggatgcgggggtggctag

SEQ ID NO: 133381 - DNA, 384 bp, Artificial Sequence
  Description of Artificial Sequence: Synthetic coding sequence
atgtcacgccgctcccagcggcttactagatacagtcagggggacgatgacggttcctcctcctcgggtgggtcttcggtagctgggtcccagagtacacttttcaaagacagccccctgagaaccctgaagagaaagtccagcaatatgaagaggctgtcccccgcaccccaactaggcccatcatctgacgcgcataccagttattattcagagtccctggttcacgaatcatggtttcccccgcgcagttctctggaggagcttcatggagatgctaattgggggtactctgacgtggaccaacagagcagttcctcccgtctgcgaagcgcggtctccagggctggatctttgctgtggatggttgccacctctccctag

SEQ ID NO: 133382 - DNA, 333 bp, Artificial Sequence
  Description of Artificial Sequence: Synthetic coding sequence
atgagccggcgttcccagcgcttaacacggtacagccaaggagatgatgatggttctagcagcagtggcgggtctagcgtggccggcagtcagtcaactctttttaaggattctccacttcgtaccctgaagagaaagtcctccaacatgaagaggctgtctcctgcccctcagctgggaccctcaagcgacgcacatacaagttattattctgaatctttagtacatgaaagctggtttcccccccgaagcagtctggaagagctacacggagatgcaaactggggggaggacctgagggtcagacggcggaggggaacagggggatcatag

SEQ ID NO: 133383 - DNA, 675 bp, Artificial Sequence
  Description of Artificial Sequence: Synthetic coding sequence
atgagcagacgatcccagcggctcacgcgttactcccagggggatgacgacggctcgtctagctccggtggaagtagcgttgcgggatcccaatccacactattcaaggatagtcctctgagaactcttaaaaggaaaagcagtaatatgaaaaggctgagtcccgccccccagctgggaccctcttcagacgctcatacgtcctattactcagaatcactggtgcacgagtcttggttccctcctcgatccagcttagaggagctacatggggatgcaaactggggttacagtgatgtggaccagcagtccagcagcagccggttgcggtctgctgtgagtagggcaggatccctcctgtggatggtagccacttctcctggacggctatttcggttactttactggtgggctggcactacctggtatcgcttgaccaccgctgcgtccctgcttgacgtgttcgtgctcacccggcgttttagttctctcaagaccttcctctggtttttactgcctcttctgctgttaacctgtctcacatatggcgcatggtacttctacccttacgggttgcagacttttcatcccgcccttgtctcttggtgggctgctaaagattcacggcgacctgatgaaggatgggaggcccgagatagttcaccccacttttag

SEQ ID NO: 133384 - DNA, 306 bp, Artificial Sequence
  Description of Artificial Sequence: Synthetic coding sequence
atgagccggcgatcacagcgcctgacgcggtatagccagggggatgatgacggttcctcttcctctggcggcagttctgtcgccggcagccagagtaccctgtttaaggactccccgcttcggacacttaaaagaaagtcaagtaatatgaaaaggttgagtccggcccctcagctcggccctagctccgacgcccataccagttattattccgaaagtcttgtgcacgagtcatggtttccccctcggtcctctctggaagagctgcacggagacgccaattggggggaagacctgagagtctag

SEQ ID NO: 133385 - DNA, 435 bp, Artificial Sequence
  Description of Artificial Sequence: Synthetic coding sequence
atgtcaagacggagtcagaggctgacacggtattcacagggagacgacgacggatcgtcctcaagcggaggatctagtgttgctggaagccagtcaaccttgtttaaggactcccctttgcggacccttaagcgaaagtctagcaacatgaagaggctgagccccgcgccacaattaggcccgtcgtcagacgcccatacgtcctattattcagagagcctggtgcacgaatcctggttcccaccacgatcatcccttgaagagctccacggtgatgccaattggggggaagacctccgagtccgaagaaggcggggtactggaggatctgaatcatctagggctagcggtctcgtgggccgtaaagctactgaggacttcttgggctcttcttctggttactcgtcggaggatgattacgtaggccggagatag

SEQ ID NO: 133386 - DNA, 618 bp, Artificial Sequence
  Description of Artificial Sequence: Synthetic coding sequence
atgagtcgacgttcacagcgcttgacccggtatagtcaaggagatgacgatggctcttcatccagcggaggctctagtgtggctggttctcagagcactctgtttaaagattcacccctgcggacccttaaaaggaagagttctaatatgaagcggctttctccggctcctcagttgggcccatctagtgatgctcatactagctattactctgaaagcctcgttcacgaaagctggttccccccccgttcttccctggaagagctgcatggggacgctaactggggggaggacctcagggtccgacgccggcgggggacgggcggatcagagtcatctcgggctagcggtctcgtagggcgtaaagccactgaggacttcctaggatccagctccggatactccagtgaggatgactacgtcggctactcagacgttgatcaacagagttctagcagcaggctgaggagcgctgtgtccagggccggctctctgctgtggatggtggcgacgtctcctggacggctctttcgactgctgtactggtgggcgggtacaacgtggtatcgtcttacgaccgcagcttcactgttggatgtcttcgtgctcacccggtag

SEQ ID NO: 133387 - DNA, 1140 bp, Artificial Sequence
  Description of Artificial Sequence: Synthetic coding sequence
atgcctagaagctctcggagccccggcgatcccggggctcttctcgaggacgttgcccataacccacgtccacgccgaatcgctcaacgtggccgaaacacaagccggatggccgaagatacgagccccaacatgaacgacaacattctgctgccagttcgaaataacgatcaggccctgggactcacacagtgcatgttgggatgcgtgtcttggttcacttgctttgcatgcagtttgaggacacaggcacaacaggtgctttttaatacatgccggtgtaaactgctctgtcagaagctaatggagaaaaccgggatcttgcttctgtgtgccttcggattctggatgttctccattcacctgccatccaagatgaaggtgtggcaggacgacagtataaatgggcccctccagagtctgcggctgtaccaggaaaaagtgcgccaccactctggagagattcaggacctgcgtgggagcatgaatcagctgatcgcgaaactccaggagatggaggcaatgtccgatgaacagaagatggcccagaagatcatgaagatgatccatggagactacattgaaaagccagactttgcactgaaatcaattggagcgtctatcgactttgagcacacttcggtgacgtataaccacgaaaaggcacatagttattggaactggattcagctgtggaattatgcacagcccccagatgtgatcctagaacccaatgtaacgcctgggaactgctgggctttcgaaggggaccggggtcaggtgaccatacagctggcccagaaggtgtacctgtctaatctaacacttcaacatatcccaaaaaccatatcactgagcgggagtttggacactgcccccaaggattttgtcatctatggaatggaagggagtcccaaggaagaggtatttttgggcgcatttcaatttcaacctgagaacattattcagatgttcccccttcagaaccagcccgctagggcgtttagcgcggtcaaagtaaagatctcaagtaactggggaaaccctggttttacttgcctctatagggtcagagttcacggctcagtggcccccccacgggaacagccacaccagaatccatatcctaaacgcgactag

SEQ ID NO: 133388 - DNA, 369 bp, Artificial Sequence
  Description of Artificial Sequence: Synthetic coding sequence
atgcccaggtcttctcgctctcctggcgacccaggcgcattactggaggacgtggcacacaacccgcgccccagaagaatagcccagcgcggtagaaatactagtaggatggctgaagacacatcgcctaatatgaatgacaacatacttctcccagtacgcaataacgaccaggctctgggcttaacacagtgcatgcttggatgcgtgtacgcctcctgctgcgcgcggagctcatggcgcaggcaagccttctgttcttcagtcctgagtgtgtgccctcgggctcttccttctcctagatggaggtatccctgggctttagctctgatcattggccactgggcgcggcattgtactgcaacctag

SEQ ID NO: 133389 - DNA, 1065 bp, Artificial Sequence
  Description of Artificial Sequence: Synthetic coding sequence
atgcctcgctctagccggtcaccaggagaccctggagctctccttgaagacgtggctcataatcctagaccacgacgcattgcacaacgcggtaggaacacgagcaggatggccgaagatacgtcacctaatatgacatggttcacatgctttgcatgttcattaagaacgcaggcccaacaggtgctttttaacacttgtcgatgtaaactgctttgccagaagctgatggagaagaccggcattctcctgttgtgcgcgttcggattttggatgtttagcatacacttaccttctaagatgaaagtctggcaggatgattccatcaacggcccactgcagtcacttagactttatcaagaaaaagtacgccatcatagcggagagatccaggatcttcgaggctccatgaaccagcttatcgctaagctacaggaaatggaagcaatgagcgacgagcagaaaatggcgcagaaaattatgaagatgatacatggcgattatatcgagaagccagacttcgcgcttaaatctataggggcttccatcgactttgagcacacaagtgtgacatacaatcacgaaaaagcacactcttactggaattggatccagctctggaattatgcccagccccccgatgtaattttggagccgaatgttacacccggtaactgttgggcattcgagggcgacagggggcaggttaccatccagttggcgcagaaggtttatttgagcaatcttaccctacaacacattccaaaaacgattagtctcagcgggtcactcgacactgccccaaaggattttgtgatctacggtatggagggttcccccaaggaagaggtgttcctcggggctttccagttccagccagagaacatcatccaaatgttcccactccagaaccaacctgcccgagcatttagtgctgtaaaggttaagatatcctccaactggggcaatccagggttcacatgcctatacagggtcagggtgcacggctccgtggcaccaccccgggaacagccacaccagaacccttaccccaaaagagattag

SEQ ID NO: 133390 - DNA, 459 bp, Artificial Sequence
  Description of Artificial Sequence: Synthetic coding sequence
ggggctctgttggaggatgttgctcacaatccacgacccagaaggatcgcccagcgaggccgcaatacgagccgcatggctgaggacacctctccgaatatgaatgataatattctactgcccgttcggaataacgaccaggccctggggctgacacagtgcatgcttgggtgtgtttcttggtttacttgtttcgcttgttcactgagaacgcaggcccagcaagtgctgttcaatacctgcaggtgtaagcttctctgccagaagcttatggaaaaaaccggaattctgttattatgtgcctttggagtcagccagggcccggctcagtcccaggtggaggtgtccctgggcccagggaccgattacagaactctgggcaagaccctgcactgccacgtgactcagtttccacacttgccggatggatgctgctgtgagaactatgagatgaaatag

SEQ ID NO: 133391 - DNA, 387 bp, Artificial Sequence
  Description of Artificial Sequence: Synthetic coding sequence
atgtccgagggggggggccaggtcagttgtattttcgcagctccaacacggctttgtcgctggccagccctgatcgagtgtggggtcaatctcacccagccactgtgtgagtggatgatccaggttgcgcgcgatagaacactctcactggcctgggaagtcgcctctctcctgaccttgtccagttctgaggtgggccttgaaggggtgggaaccatttggccaagcagttactcatcagaagagtccagcagaaacggtgccgaacagggcaggcagctgagtatcgaaggaccttttcaggggcagaattgcccaagccatccagccgccgcactccctctaccaatgcgcggggaatcccaagccactagctgccaggtctag

SEQ ID NO: 133392 - DNA, 3975 bp, Artificial Sequence
  Description of Artificial Sequence: Synthetic coding sequence
atgtcccggaggaaacaagccaagccccagcactttcaaagtgatccagaagtggcgtccctgcctcgtagggatggcgacaccgagaaagggcagccgtctcgccctaccaagtccaaagacgcccatgtgtgtggccggtgctgcgccgagttcttcgaactatcggatctgctcctgcataagaaaaactgtacaaagaatcaactggtgctgatagtaaatgaaaacccagctagcccacccgagaccttttcaccctccccacctcctgacaatcctgatgaacaaatgaatgacaccgtgaataaaacagaccaggtggattgcagcgatttgtctgagcacaacggcctcgatcgtgaggagtctatggaggtggaagcccccgtcgccaataagagcggatcaggcacgagcagcggctctcatagcagcacagcaccttcttcgtctagctcgtcgagcagcagttcaggcgggggtggtagcagctccaccggtacctccgcgatcaccacaagcttgccccagctcggagacctgacaacattgggaaatttttcagttattaacagtaatgtgatcatagagaatctgcagtcaaccaaggttgccgtggcccagttctcgcaggaagctaggtgtggaggcgcctcgggcggcaagctggccgttcccgctctgatggagcaactactcgctctccagcagcagcagattcatcagctgcagctgattgagcaaatccgacaccaaattttattactagcatcccagaatgctgatcttcccacgtcatccagcccttctcagggaacactgagaacaagcgcaaacccactaagtactctgagctcccacctcagccaacagcttgcagccgcagcgggcctggcccagtctcttgcgagccagtctgcctctatatcaggagtcaagcagctgccccccatccagctgcctcagtcctcgagcggcaacaccatcatccccagtaattctggatcctctccaaacatgaacatcctggctgccgccgtgaccactccatcctccgagaaggtcgcttcttccgcaggtgcctctcacgtttctaacccggccgtcagctcttcatcctcacccgccttcgccatttcatcactgctgtcccctgccagcaatcctcttttaccccaacaggcctccgctaattcggtgtttccgagtcctctccccaacattggcacaaccgctgaagatttgaattccctgtccgcattggctcagcagcgcaaatcaaaaccacctaacgttacagcttttgaggctaaatcgacgagcgatgaggctttcttcaaacacaagtgccgattctgtgctaaagtgttcggcagcgactctgcactgcaaattcacctaagatcacacactggggagcgcccgtttaaatgcaacatctgcggcaacaggttttcaacaaaagggaaccttaaagtgcactttcagcggcacaaagaaaagtatcctcacatacagatgaatccataccctgtgccagagcaccttgacaatatcccgaccagtacggggattccttatggaatgtctataccccctgagaagccagttacttcttggctagataccaaacccgtattaccgacactgacaacatctgtaggcctgcctttacctccaaccctgcctagcttgatacctttcattaaaaccgaagaaccagcgccaattcctataagtcactctgccacatccccccctgggtcagttaaatccgacagtggagggccggaaagtgccacacgtaatctggggggtctgcccgaggaagctgaaggctctactctaccaccttccggaggtaaatccgaagaatcaggcatggtgacgaattccgtcccaacggcctccagtagcgtgctgtcgagccctgccgccgactgcggaccggccggaagtgcaacaacatttaccaacccattacttcccctgatgagcgaacagtttaaggctaagtttccattcgggggcctccttgattccgcacaggcctctgaaacttcgaagcttcagcaactcgtggaaaatattgacaaaaaagctaccgatcccaacgaatgtataatatgccaccgcgtcctcagttgccagtccgcactgaagatgcattaccgcacacatactggtgagcgaccttttaagtgtaaaatttgtggtcgcgcctttactactaaaggtaacctaaaaactcattactcagtacatcgggccatgccccctctacgagtgcaacactcttgtcccatatgccaaaagaagttcactaatgctgtggttttgcagcagcacatccgaatgcacatgggagggcaaatccccaacactcctgtgccagattcttactctgagagcatggagagtgatacaggtagctttgacgagaaaaacttcgacgacctagacaatttctccgatgagaacatggaagattgtcccgagggatcaatacccgacaccccaaagagtgccgatgcatcacaggacagtctttccagctctcctctgcccctcgagatgagttccatcgctgccctcgaaaatcagatgaaaatgatcaacgctggattagcagagcagctgcaggccagccttaaaagtgtggaaaacggttcaatcgaaggtgacgttttgaccaacgactcatcctctgtgggcggcgatatggaatctcagtcagccggcagtcctgcaatttccgaaagtactagtagtatgcaggcgctgtccccatccaatagtacacaggagttccacaagtctccctctatagaagagaagccccagcgtgccgttccctctgaatttgcaaatggactatctcccaccccggtcaacggaggcgccctggatctgacttcctcacatgctgaaaaaattatcaaggaggattctctgggcattttattccctttccgcgatcgcggaaagttcaagaacaccgcctgcgacatctgtggcaagactttcgcttgtcagagtgccttggacatacactacagatctcatacaaaagagcgacctttcatctgcaccgtttgtaatcgaggttttagtactaagggaaacctgaaacagcacatgctcacccaccagatgcgggacctgcccagccagctatttgaaccttcctcgaatcttggtccaaatcaaaatagtgccgtcatccccgctaactctctatccagcctgatcaagactgaggtcaacggattcgtccacgtgtccccacaagactccaaggatactccgacaagccatgtgccttcaggccccctgtccagctctgccacttcgcccgtgctgctgcctgctctcccaaggaggacccctaagcaacattactgtaacacctgcggcaagacgttctcgagctccagcgcacttcaaatccacgaacggacgcatacaggcgagaagccctttgcttgcaccatttgtggccgggcctttactactaaaggcaatctcaaagtgcacatgggtacacacatgtggaactccacccccgctcgcaggggtcggcgtctgtcagtggatggcccaatgactttcctcggagggaaccctgtcaagttcccagagatgtttcaaaaggatctggccgcccggtctgggtcaggcgaccctagctccttctggaatcaatacgccgctgcgttgagcaacggcctggccatgaaggccaacgaaatctccgttattcagaatggcgggatcccaccgattccaggttcactcggcagcgggaactcaagccccgtgtccggactgacgggcaatctggaacgtcttcaaaactcggagcctaacgcacctctagcaggactggagaaaatggctagctccgagaacggtactaattttcggtttacccggtttgttgaggatagcaaggaaattgttacctcctag

SEQ ID NO: 133393 - DNA, 3684 bp, Artificial Sequence
  Description of Artificial Sequence: Synthetic coding sequence
atgaacgacactgtaaataaaaccgaccaggtcgactgctccgacctaagcgagcacaatggcctggatagagaggagagcatggaggtcgaggcccctgtagcaaataaaagcggcagcgggacctcatccggaagccacagctccaccgccccttcttcatcctcatcctcttcctctagctccggaggcggcggatcctccagtaccgggacttctgctatcaccacctctctccctcaactcggggacctcacaacgctgggtaactttagcgtaatcaattctaacgttatcattgaaaatctgcagtctaccaaggtcgccgttgcgcaattcagccaagaggctcgttgtggcggcgcgtcggggggaaagctggctgtacccgcgctgatggagcaacttctggcactgcagcagcagcagattcaccagctccaactgatcgaacagattcggcaccagattcttctgctggcctctcagaacgccgacctgcccactagcagcagcccatcccaggggacactgagaacttccgctaatcccctgtcaacactgtcctcacaccttagtcagcagctggccgctgccgccggccttgcacagtctttggctagccagagcgcatcaattagcggggtcaagcaacttcctccgattcagttaccgcaatcctcatcgggcaatacaatcatcccatcgaattccggatctagcccaaacatgaacattctggcagctgctgtcaccactcctagcagcgaaaaagtggccagttctgctggagcctctcacgtctccaatccagccgtctcatcgtcctcttctcccgcgttcgcgatcagctcactgctttctccggcgtcaaacccactgctgccccaacaggccagcgccaactctgtgtttcccagccctttgcctaacattggaacaacggcagaagaccttaactccttatcagcccttgcacaacagaggaagtctaagcctccaaatgtgacggccttcgaggcaaagagtacttccgacgaagcattcttcaagcacaagtgtaggttctgtgcaaaagtatttgggagtgattctgctcttcagatccacctacgcagccataccggtgaacgtcccttcaaatgcaatatctgtggcaaccgtttctcgacgaaaggaaatctgaaagtccacttccagcggcataaagaaaaatacccacacatccagatgaatccctatcctgttccagagcatctggataatatccccacatcaaccggcattccttatggaatgtcaatccctcccgagaagcctgtgacctcctggctagacacaaaaccggtcctcccaaccctcaccacgagtgttggactgcctctccctcccacattaccatctctgatacccttcatcaaaacagaggaacctgcccccattccaattagtcattctgcgacaagccctcccggcagcgttaagtccgatagtggcggtcctgaaagcgctaccagaaatctgggtggcctgccagaagaggctgagggttccacgcttccgccatcagggggcaaatcagaggagagtggaatggtgacgaacagtgtgccgaccgcatccagtagcgttttgtctagtcccgcagctgactgcgggccagccggctccgcaactacgttcaccaatcctctgctccccttgatgagtgagcagttcaaggctaaattccccttcggagggcttcttgacagcgctcaggccagcgagacttcaaaactccagcagctcgtggaaaatatcgataaaaaagcgactgacccaaacgaatgcataatctgtcacagggtgctttcctgtcagtccgccctcaagatgcactatcggacccacacaggcgagaggcctttcaaatgtaaaatctgcggacgggcattcactaccaaaggcaacctcaagacccactattcagtccatagagctatgccacctctgcgtgtgcagcattcatgccccatttgtcagaaaaagttcacgaatgctgtggtactgcaacagcacatccggatgcacatgggcggacagatcccaaatacacctgtccctgacagctattcagaaagcatggaatcagatactggatcctttgacgagaagaacttcgacgacctggacaatttttccgacgaaaacatggaagactgcccagaaggaagcattccggacacacctaaatccgccgacgccagtcaggacagtttaagcagctccccgttgcctctggaaatgtcatctatagcagccctcgagaatcagatgaaaatgatcaatgccggcctagctgaacagctgcaggcgagtcttaagtccgtagaaaacggcagtattgagggggatgtgttaaccaacgactcatcttcagtcggaggagatatggagagccaaagtgctggatcaccagctatatccgaaagtacatcctcaatgcaggctctgagtcctagcaactcgacgcaagagtttcacaagtcacctagcattgaggagaagccacagagagccgtgccttccgagttcgccaatggtctttcaccaacacctgtcaatggtggtgcactcgacttgacatccagtcacgcggagaagatcattaaagaggattcccttggcattctgttcccattcagagatcgcggaaaattcaagaacacagcttgcgatatctgtggcaagactttcgcatgccagtcggctctggacatccattacagaagtcacactaaagagagaccgtttatctgcaccgtctgtaatagagggttctccaccaagggcaacctaaagcaacacatgttaacacaccaaatgcgcgatttgccttcccaactgttcgaaccctctagtaaccttgggcccaaccaaaactccgctgtgattcctgccaatagcttgtcttcactgattaagacagaggtgaatggttttgtgcacgtgtcacctcaggattctaaggatacccccacaagtcacgtacccagtggtcctttgtcaagctccgccaccagccctgtcctgctccccgccttgcctcgcagaactcctaagcagcattactgcaacacgtgcggcaagactttttcttcctcatccgccctccagattcatgaacgtactcacaccggtgagaagccatttgcttgtacgatttgcggcagggcatttaccacaaagggtaatctcaaagtgcatatgggcactcacatgtggaactcaaccccagcacggcgcggtaggcgactctccgtggatgggccgatgacgtttcttggcgggaatcctgtgaagtttcccgagatgtttcagaaggacttagccgccagatctggcagcggagatccctcttcattctggaatcaatacgcggctgccctgtccaacggcctcgcaatgaaggcaaacgagatttccgtgatccaaaatggcggcatccccccgatccctggatccctgggatccggtaatagttctcccgtttccggactcacggggaacttggaaaggttgcaaaacagtgagccaaacgcacctctggcagggttggagaagatggcctctagcgagaacggaactaactttagatttacacggttcgttgaagactcgaaggagattgttacatcttag

SEQ ID NO: 133394 - DNA, 3867 bp, Artificial Sequence
  Description of Artificial Sequence: Synthetic coding sequence
atgtcccgaagaaagcaggccaagccacagcacttccagagtgatcccgaggtcgctagtctaccacggcgcgacggagacactgagaaaggccagcccagccggccaactaaaagcaaggatgcccatgtctgcggtaggtgctgcgccgagttttttgaactgagcgatttactcttacacaagaaaaactgcaccaagaatcagctcgtgttaatagtcaacgaaaaccccgcctccccacctgagacattcagccctagtccacctccagacaatccggacgagcagatgaatgacactgtcaacaaaacggggtctcacagctcgactgcaccgtctagctcgagctccagttctagcagctccggcggcggcggttccagctccaccggaacaagtgctatcaccacttctctacctcagctgggcgatcttaccacactaggtaacttctcagtgatcaatagtaacgtgataatcgaaaacttgcaaagcacgaaggtagcagttgcccagttttcgcaggaagctcggtgcggcggggcctccggtggcaagctggcagttcctgccctaatggagcagttgctggcactgcaacagcagcagatccaccagcttcagcttatcgagcaaattcggcaccaaatactgctcctggcttctcagaacgcagatcttcccacgtccagcagtccgtctcagggaaccttgaggacatctgcaaatccactgtccacactcagcagccatctttcacagcagttagccgccgcagcgggcctagcacagtctctggcttcacagagtgcctcaattagcggggtcaaacaattgccacccatccagctgccacagtcttcatcgggtaatacaattattccttccaacagcggatctagcccgaacatgaatatcctggctgctgccgttaccactccttcttccgaaaaggtcgccagctcagcgggggcctcccacgtgtccaacccagccgtgtcgtcgtcttccagtcctgccttcgcgatttccagcttactgagccccgcctctaaccccctgctgccacagcaggctagcgcaaatagcgtgttcccatcccctttgcctaatatcggaaccaccgccgaggacctcaactccctgagcgccttagctcagcagcgcaaatctaaaccccctaatgttaccgcttttgaggcaaagagcacaagcgatgaagccttcttcaagcacaaatgcaggttctgcgccaaagtgttcggctctgacagtgctctccagatccatttgaggtcccacacaggagagagaccttttaaatgtaatatttgcggcaatcggtttagcactaagggcaacctaaaggtgcatttccaaagacataaggagaagtatccccacatccaaatgaacccttatccagttcctgaacatctcgataatattcctactagcacaggcattccatatggaatgagtatacctcctgagaagccagtgacctcttggctggataccaagcctgttctgcctacgctaacgacatcggtcggccttcctctgccaccaacacttccttctcttatcccctttataaaaaccgaagagccagcccctatcccaatatctcactccgctactagcccgcccggctcggtgaaatcagacagtggcggcccagaatccgcgacccgcaatctgggcggtctgcctgaggaggctgagggaagcacgctgcccccttccggcggtaaaagtgaagagagtggtatggtcactaactctgtgcctactgcgtcaagcagtgttctctcctcgccagccgccgattgcgggcctgctggatccgcaaccactttcactaacccgcttttaccgctaatgtctgaacaattcaaagccaagtttccgtttggggggctgctcgactctgcgcaagcttcagagaccagtaaacttcagcagctggtagagaacatcgataaaaaggccactgatcctaacgagtgtattatctgccatcgggtattgagctgtcagagcgctctgaagatgcactaccgcacgcacaccggcgagagaccctttaaatgcaagatttgtggtcgggcattcaccaccaaaggtaatctcaagacacattattctgtccatagagctatgcctcccctgcgcgtgcagcactcttgtcccatatgccaaaagaagttcactaatgcagtagtccttcaacagcacatacggatgcacatgggtggacagattcccaacactcctgtgcctgattcctattccgagtcaatggagtcagacactggcagctttgatgaaaagaatttcgatgacctggataatttctcagacgaaaacatggaggattgcccggaagggagcatccctgatactcctaagtcagcggatgcttctcaagattcgcttagctccagtcccctgcctcttgagatgtcctcaattgccgcacttgagaatcagatgaaaatgatcaacgccggattagctgagcagttgcaggcatccctaaaaagcgtggagaacgggagcattgagggagacgtcctgactaacgacagctctagtgtcggcggcgatatggaaagccagtcagccggttccccagctattagtgagtctacatctagcatgcaggctctgtcaccaagtaacagcacacaggaattccacaagtcaccctctatcgaggaaaagcctcaaagagcagtgccatcagagtttgctaacggattgtctcctacccccgtgaatggaggcgccctcgacctgactagctcccacgccgagaaaattatcaaggaagacagcctcgggattctgtttcccttcagggaccggggaaaattcaaaaacactgcttgcgacatctgcggaaagaccttcgcttgtcagagtgcgctcgacatccattatcgatcccatactaaggaaaggccattcatatgtacagtctgtaacaggggatttagtacaaagggtaatctaaagcagcacatgcttacccatcagatgagggacctgccttcccagctgtttgaacccagcagtaacctaggacctaaccagaacagtgccgtaatcccggccaacagcctgtcatctctgatcaaaaccgaagtgaatgggtttgtccatgtgtcaccccaggactctaaagacacacccacatctcacgtaccgagcggcccgctcagttcctcagccacttcccctgtgctgcttcctgccctccctcggagaactccaaaacagcattactgcaacacatgcggcaagacattttccagttccagtgctttacagatccacgaaagaacacataccggtgaaaagcccttcgcctgtactatctgtgggagagctttcaccacaaaggggaatttaaaggtgcacatgggtacgcacatgtggaactccactccagccaggcgaggacgtaggctcagcgtcgacggccctatgactttcctcggtggcaatcctgttaagtttcctgagatgttccaaaaagacctcgcggcacgctctggttccggtgacccctcctcattctggaatcagtatgcggccgccctaagcaatggcctggcaatgaaggcaaatgagatcagtgtgattcaaaatggcggaattccacccattccgggaagcctgggaagtggtaattcaagtcccgtcagcggcctgaccgggaacctggaaaggcttcaaaattcagagcctaatgcccccctggcgggcctggagaagatggcctcctctgaaaatgggactaactttcgcttcacaaggtttgtcgaggattccaaagaaatcgttacaagctag

SEQ ID NO: 133395 - DNA, 444 bp, Artificial Sequence
  Description of Artificial Sequence: Synthetic coding sequence
atggtgcacatggggacccacatgtggaattccaccccagcgagaaggggcagacgcctgtctgtggatgggcccatgaccttcctcggtggaaaccccgtgaaattccctgagatgttccagaaagatcttgcagcacgctccggatcaggcgatccaagttcattttggaaccaatacgctgctgctcttagcaatgggttagctatgaaggcgaatgagatatccgtcattcagaacggtggtatccccccaatccctggtagccttggctcgggaaacagctcccccgtttcaggcctgacaggaaatttggagcggctgcagaactcagagcccaatgcacctctggccggtctggagaagatggcctcatctgagaacggaactaatttcagattcacgcgatttgttgaggactcaaaagaaatcgtgacaagttag

SEQ ID NO: 133396 - DNA, 3024 bp, Artificial Sequence
  Description of Artificial Sequence: Synthetic coding sequence
atgtcacgcagaaagcagagaaagcctcaacagctgatctccgattgtgagggcccgagtgcgtccgaaaatggagatgctagcgaggaggaccatccccaggtgtgcgccaaatgttgtgcgcagttcaccgatcctacagagttcttggctcaccagaacgcctgctcaacagacccgcccgtgatggttatcattggcggacaggaaaacccaaacaattccagcgcttcttccgagccgaggcctgagggacacaacaacccccaggtcatggatacagagcactcaaatccacccgacagtgggagttctgtcccgacggatccgacgtgggggcctgagcgccgcggcgaagagagtcccgggcactttctagtggccgctacagggacggccgctggcgggggaggagggctgattctcgccagtccaaaattaggggcgaccccattgcctccggagtctacacccgcaccacccccaccccccccaccaccgcctcctcctggcgtgggcagcggccatttgaacataccactgattctcgaagagctgcgcgttcttcagcagcggcaaattcaccaaatgcagatgactgagcagatttgtaggcaagttttactgctgggatctcttggacagacagttggggcacctgcttccccttcggagttgccaggcacggggacagcatctagcacaaagccgctcttgcctcttttttcgcccatcaagcctgtccagaccagcaaaactctcgcctccagcagctcgtcaagctctagctcgtccggagccgagacacccaagcaggctttcttccacctgtaccaccctctgggaagccagcaccccttcagtgccggtggggttggcaggagtcacaagccgacccccgctcccagtccagcacttcccgggtctactgatcaactgattgcgtcccctcaccttgcgtttccatcaaccaccggcctgctggcagcacagtgcctcggagcggcgagggggcttgaagccactgcttctccaggactgctcaagcccaaaaacggaagcggcgaactctcctatggtgaggttatgggcccactcgaaaagccagggggtcggcacaagtgcagattttgtgccaaggtctttggtagcgattccgccctccagatccatctgcggtcccacactggagaacgcccatacaagtgtaatgtctgtggcaacaggttcaccacccgagggaacctcaaagtacatttccaccggcaccgagaaaaatatccccatgtgcagatgaacccgcaccccgtgcctgaacacttggactacgtgattacgagctcgggcctcccatacggaatgtctgtgcctccagagaaagccgaggaggaagctgccaccccaggagggggagtcgaacgcaaacctcttgtggcctctacgacagctctcagcgcgacagaatctctgacccttctgtctacttctgctggcacagctaccgccccagggctccccgccttcaacaagtttgtgctgatgaaggctgtagagcccaagaacaaggccgatgaaaacacaccccctggaagtgaagggagcgctattagcggagtggctgagtcctccactgccacaagaatgcaactgtcaaaactagttacttcactccccagctgggctctgctgaccaaccatttcaagtcaactggcagttttccattcccttacgtcctggagccgttaggcgcttccccctccgagacatctaagctgcaacagctcgttgaaaaaattgaccgacaaggggccgtcgccgtcacctccgccgcaagcggcgcccccaccacgtccgcaccggcaccctcgagctcggcatcatctggacctaatcagtgcgtaatttgcctgcgcgttctttcatgtccgcgtgcattaagacttcactacgggcagcacggcggagagcgcccctttaagtgtaaggtgtgtggaagagcattctccactcgaggcaatctccgcgcccacttcgtgggccacaaggcatcacccgctgctagggcacaaaattcatgcccgatctgccaaaaaaagttcacgaatgccgtcacactgcaacaacacgtgcgcatgcacttgggcgggcagatccccaatggagggacggctctgccagagggcggaggagcagcccaagaaaatggcagcgaacagagtacagtcagcggcgcagggtcttttccacaacagcaatcacagcagccatccccagaggaagaactgtccgaggaagaagaggaggaagatgaagaagaggaagaggatgtcacagacgaagatagtttggccgggagggggagtgagagtggtggggagaaggcgattagcgtgcgcggcgactctgaggaagcatctggcgctgaggaggaggtcgggacggtggcggctgccgcaaccgccggcaaagagatggattcaaatgagaagaccacccagcagagctcactgccccctccacctccccctgactctctggatcaacctcagcctatggaacagggttcctcaggcgtactgggcggaaaggaggaaggcggtaagcccgagagatcatcatctcccgcttccgcgctgacccctgagggcgaggcaacatctgtaaccttggtggaggagctctccctgcaggaagctatgagaaaggagccaggggagtcaagttcgagaaaagcgtgcgaagtgtgtggccaggccttcccaagccaggcggcactcgaagaacatcagaagactcatccaaaggaaggccctctctttacgtgcgttttttgcaggcagggttttctggagagggcgaccttaaaaaaacacatgcttttggcacatcatcaagtgcaaccctttgcccctcacggcccacaaaacatcgctgctctttctctcgtgccaggatgctcaccctctatcacgtccactggtctgtcccctttcccacggaaagatgatccaaccatcccctag

SEQ ID NO: 133397 - DNA, 1827 bp, Artificial Sequence
  Description of Artificial Sequence: Synthetic coding sequence
atgtcacggaggaaacagcgcaaaccacaacagcttattagcgactgcgaaggcccttccgcctcagagaatggggatgcatctgaagaagaccatcctcaagtttgtgccaagtgttgcgctcagtttaccgaccccacagaattcctcgcacaccagaatgcctgttccaccgaccccccagttatggttatcattggagggcaggagaacccaaacaattcgtcagcctcttctgagcccagacctgagggtcataacaacccacaagtgatggataccgagcattccaacccaccggattctggtagctcagtgccaaccgaccccacttgggggcccgagaggcgtggagaggagtcaccgggacatttcctagtagccgccactggcaccgccgctggaggaggaggcggcctaatcttagcctctccaaagctgggagcgactcctcttcccccggagtctactcccgcccctccaccaccacctccaccccccccgccacccggtgtgggaagcggacacttaaatattccattaattttggaggaactgcgggtcttgcagcagcggcagattcaccagatgcagatgaccgagcagatctgtcggcaggtccttctccttgggtcactgggtcagactgttggtgcccccgctagcccatcagaactaccaggcaccgggacagcgtcctcgacaaagcccctgttgccactgttttccccaataaagcccgtccaaacatcaaagacactggcctcaagcagttcgtccagcagctcgtcctctggggctgagaccccaaagcaagctttctttcacctgtatcatcctctgggttcgcagcatccattcagtgctggcggcgtaggcaggagccacaaacctacaccggcgccctctcccgccctgcccggctccacggaccagctgatagcatctccccacctggcttttccaagtacgaccggccttctggccgcccagtgtctgggcgcggctcgtggactggaggccacggcttccccagggttattgaaacccaagaatggcagtggggagctctcatacggggaggttatgggcccgctggaaaaaccagggggtaggcacaagtgtaggttttgtgctaaagtatttggttccgactccgcacttcaaatccatctgcggtcacacaccggcgaacgcccctacaagtgcaacgtgtgcggaaataggttcactacacggggaaatcttaaagttcacttccataggcaccgggagaagtacccccatgtccagatgaatcctcacccagtcccggaacatctggactacgtgatcactagctccggtttgccgtatggaatgtccgtcccccccgagaaggctgaagaggaagccgctactccgggcgggggggttgagcggaagcccctagtcgcatcgactaccgctttgtccgccacagaaagcctgacacttttgtcaaccagcgctggaacagctacagcccccgggcttccagccttcaacaagttcgtgctgatgaaagccgtggagcctaaaaacaaagcagacgaaaataccccccccggttcagaagggagcgccatctccggggttgctgagtcctctacggcaacacgaatgcagttgtctaaacttgtgacatctctgccttcctgggcactgctgacaaaccacttcaagtcaacaggatcattcccctttccatatgttccagaggaagtgcatcagtgctgccacagcgccgctgcttgtcctgatgcaccaggcggaccggacccccagaggtggtactgtactccctag

SEQ ID NO: 133398 - DNA, 3687 bp, Artificial Sequence
  Description of Artificial Sequence: Synthetic coding sequence
atgtcgcgtcggaagcaagcaaagccccagcacctgaagagtgatgaggaattgttgcctcccgacggcgcgcctgagcatgccgctcctggagagggtgctgaggatgcagatagcggacccgaaagtcgatcgggtggcgaggagacatctgtgtgtgagaaatgctgtgccgaattttttaaatgggccgattttctggaacaccaaagatcatgtactaaactcccacctgtgttgatcgtgcacgaagatgcccccgctccgcctcccgaggacttccccgagccatcccccgcctcttccccctccgagagagcagagtcggaggccgcagaagaagctggagcagaaggcgccgagggggaggcccgtccagtggagaaagaagctgagccaatggacgcggaacccgccggggacacacgtgcgcccagacctcctcccgctgcacctgcaccccccactcctgcctacggagccccaagcactaatgtgacgcttgaggccctcctcagtactaaggtcgccgtagcgcagttcagtcagggagctagggcagcaggaggctccggggcaggtggcggtgtggccgctgcggcggtgccgctcatcctggaacagcttatggcccttcagcagcagcaaatccatcagctgcagcttatcgagcaaatccggagtcaggtcgcgctgatgcagagacctccccctcgtccctctttaagtccagccgctgctccatcagcgccgggacccgcaccctcacagctgcctgggttagccgccctgcctctgagcgcaggggcccccgccgcagccatcgcaggttcgggccctgccgcccctgctgcttttgaaggggcacaacccctgtcaaggccagagagcggagcttccacacccggtggccccgcggaaccgtccgcacccgccgccccttccgcagctcccgcccctgcagctccggcccccgcccctgcaccacagtccgcagccagcagtcagccacagtccgcctccactcctccggctctggctccggggtctctgttgggcgctgcaccaggcttgccgagtccactgttgccacagacttccgccagcggagtgatttttcccaatccactcgtgtccatcgctgcaacagcaaatgcactcgatccgctgtccgcactgatgaaacatagaaaggggaagcctcccaacgtgagtgtttttgagccaaaagccagcgccgaggatccattcttcaagcataagtgtcgcttttgtgctaaggtcttcggctctgatagcgctctccagatccatttacggagccatacaggcgagcgtccttttaaatgtaatatctgcggcaatcgctttagcacaaaaggaaatttaaaggtgcactttcagagacacaaagagaaataccctcacatccagatgaatccttacccagtgcctgagtatctcgacaacgtgcccacctgttccggaatcccatatggcatgagtctcccaccagaaaagccagtgacgacttggctggactcaaagccggtgctccctactgtgcccacgagcgtgggactgcaactccccccgactgtgccaggtgcgcacggctatgcggatagcccctcagcaaccccagcgtcacggtcaccacagagaccgagccccgcctcctctgaatgtgcttctctgtcccccggcctgaatcatgtggaatccggggtgagcgccacagcggaatctccgcaaagcctgttgggaggacctccactaacaaaggctgagcctgtctctctgccgtgcacgaatgcgagagccggagatgctccagttggagcacaagcctccgcagctcccacctcggtggacggtgcaccaaccagtcttgggtcacctggattacccgctgtcagcgaacagtttaaagcccaatttccgttcggaggccttctcgactccatgcagacatctgaaacatcgaagcttcagcaactcgtagaaaatattgacaagaaaatgaccgatccaaaccagtgcgttatctgccacagagtgttgtcatgccagtccgcactgaaaatgcattatcgaacacacactggcgaacggccattcaaatgcaagatctgcggacgtgcgtttactacaaaaggaaacctaaagacgcactttggcgttcaccgggccaagccccctctgcgcgtgcagcactcctgtcctatttgccagaaaaagttcaccaacgcggtggttttgcagcagcacatcagaatgcatatgggcggacaaatcccaaacacccctttgcccgagggttttcaggacgctatggactctgaacttgcttatgatgacaaaaatgccgagactctgagttcctatgacgacgacatggacgaaaacagcatggaggatgacgccgagctgaaggacgccgctaccgaccctgcaaaaccactgctgtcctacgccggctcttgcccccccagccccccatcggtgatctcttctattgctgcacttgagaatcagatgaagatgatagacagcgtgatgtcctgtcagcaactaacagggctgaagtctgtggagaacggcagcggcgagtccgatcgactcagtaacgactcctcctcagctgtgggggacctagaaagccgttcggctggttcccccgcactcagcgaaagttcttcttcccaggccctttcaccagctccttcgaatggcgagtcatttagaagcaaatccccagggctgggagcccctgaagaaccacaggagattcctctcaaaactgagcggcccgattcccctgcagcggccccaggctccggaggtgcgcctggtagagccggaattaaggaggaggcaccattcagtctcctatttctaagccgggagcggggtcccagtcagagtaccccaagcctcatcagttcggccgctcctaccatgattaagatggaggtgaacggtcacgggaaggcaatggcgctgggagaagggcccccccttcccgcaggagtgcaagtgcccgcaggaccccagaccgttatgggacccggactggccccgatgttggcgcctccccctagaaggacacctaaacaacacaactgtcagtcgtgcggtaaaactttttccagtgcttccgccttgcaaatacacgagcgaactcatactggcgaaaaaccgttcgggtgtaccatttgtgggagggcctttactactaagggaaacttgaaggtacacatggggactcacatgtggaacaacgccccggcgcgacgcgggaggcggctgtctgtggagaacccaatggccctcctggggggggacgcacttaaattctccgagatgttccaaaaagatctagctgctagggcgatgaatgtggatccgtcgttctggaaccaatatgccgctgccatcactaacggcttggctatgaaaaacaacgagatctctgttattcagaatggcgggattccccaactccccgtgtcccttgggggctcagccctgccccctctcggatccatggcatccggaatggataaggcccgtactgggagctcccccccaatcgtttcgttggataaggcttcgtctgagactgcagccagtaggccatttacgaggttcatcgaggacaataaggaaatcggaataaactag

SEQ ID NO: 133399 - DNA, 3903 bp, Artificial Sequence
  Description of Artificial Sequence: Synthetic coding sequence
atgagccgacgaaagcaggcaaagcctcaacatctcaaaagtgacgaggaactcctgccacccgacggcgccccggaacacgctgccccaggagagggagccgaagacgcagactctgggccagagtccaggtctggtggtgaggagacttcagtgtgtgagaagtgttgcgcggagttcttcaagtgggcagacttcctcgaacatcagaggtcgtgcacgaaactcccgcccgttttaattgtgcacgaggacgctcctgcaccccctcccgaagacttccccgaacctagtcccgcgtcctccccctccgaacgcgcagagtctgaggccgcggaagaagctggcgctgagggagcggaaggagaggcccggcccgtcgagaaggaagccgagcctatggacgcagagcccgccggggacacccgcgcccccaggcccccccccgccgcccccgccccccccacccctgcttacggtgctccgtcaacgaatgtcacgcttgaggctctactctccacaaaagtggctgtcgcacagttctcccaaggggcaagagcagccggcggttctggggccggcggtggcgtagctgccgccgcagtgcctctgatcctcgagcagctcatggcgctccagcagcagcagatccaccaactgcaattgatcgaacaaatccggagtcaggtagcccttatgcagcgccccccaccacgaccctcactcagcccagccgccgctccatccgcccctggtcccgcacccagccagctcccaggacttgcagccctgccattatcggcaggggcccctgcagcagctatagcagggagtggtccggctgcccctgctgcttttgagggcgcccagcccctgtctcggcctgaaagcggcgccagcaccccagggggacctgctgaaccatctgctccagcggcccctagcgctgccccagctccagcggcacccgctcctgctcccgcaccccagtccgcagcttctagccaaccacagagcgcatccacgcctccggctctggccccggggtctctcttaggggctgcccccggcttgccctcccctctgctaccccaaacatcagcaagcggagtgatctttccgaacccattggtgtccatcgctgccactgctaatgccctcgatcccctctctgctcttatgaagcatcgcaaaggaaaaccgccaaatgtaagcgtattcgagcctaaggcttcggccgaagacccattcttcaaacataagtgtcggttttgcgccaaggtgtttggttccgatagtgctctgcagatacacctgcgttcccacaccggcgagcgaccattcaaatgcaatatttgtggcaataggttcagcaccaagggaaacctgaaggttcacttccagaggcataaggaaaaataccctcacatccaaatgaatccctaccccgtgcccgagtatctcgacaatgtgccgacttgtagcggtatcccatatgggatgagtcttccacccgaaaagcctgtgactacctggctggacagcaagcccgttctcccaaccgtgcctactagcgttggactgcagctgcctccaactgtgcctggggcccacggctacgcagactctccctctgccacccctgcaagcaggtccccgcagcgccctagcccggccagctcagagtgcgcttcgctttcacctggcctgaatcacgttgaatcaggggtctcggcaacagccgaatctcctcaatctctgctggggggtcctcctctcaccaaggctgaaccagtatcacttccgtgtacaaacgccagggctggggacgcccctgtaggggcacaagcatccgctgccccaacaagcgtcgatggggccccaacctcactcgggtctccaggccttcctgccgtctccgaacaatttaaagctcagtttccatttggcgggttgctggacagtatgcagacctcagagacttcaaaacttcagcagctggttgagaacatcgataaaaagatgaccgaccccaaccaatgcgtgatatgccaccgcgtgctgtcatgccaaagcgccctcaagatgcactatagaactcacacgggagaaaggccttttaaatgcaagatatgtgggagggcctttacaacaaagggcaatctgaagacacattttggtgtacaccgcgcaaagccacccctgagagtccagcatagctgtccaatctgtcaaaagaagtttacaaatgccgtggtgctgcagcagcatatccggatgcacatggggggccagattcccaacaccccgctgcctgagggcttccaggatgctatggactccgaacttgcttacgatgacaagaacgcagaaaccctttccagttatgacgacgatatggatgagaacagtatggaggatgacgctgaactaaaagatgcggctacagatccagccaagccccttctgtcctacgccggaagttgccccccctcaccgccctcagttatttcctcaatcgcggcccttgagaatcagatgaagatgattgacagtgtgatgtcctgtcagcaactgaccggcttgaaatctgtggaaaatggctccggagagagcgacaggctttcaaacgacagcagttctgctgtgggcgatctcgagagtagatcagccgggagccccgccctgtcggagtcttccagttctcaggctttgtccccagccccctcaaacggggagtcattcagatccaaaagccctggtcttggggcacccgaagagcctcaggaaattcctctgaagaccgagaggccagatagccctgctgcagcacctggtagcggcggagcacccggccgcgccggaattaaggaagaggctcctttctctctgctattcctgtcccgagagaggggaaaatgtcctagtaccgtatgtggtgtgtgtggcaagccattcgcttgtaaatccgcactcgaaattcattatcggtcgcataccaaggaaagaccgttcgtttgtgccctgtgccgaaggggatgttctaccatgggtaatctgaagcagcacctgctgacccatcgtctgaaggaacttcccagtcagctatttgatcccaatttcgcccttggcccatcacagagcacgccctccctgatcagcagcgccgcccctacaatgataaagatggaggtaaacggacacgggaaagcgatggccttgggtgaaggcccccccttgcccgctggagttcaggtacctgccggcccacagacagtaatgggccctgggcttgctccaatgttggctccacccccgcgcaggaccccgaaacagcataactgccaaagctgcggtaagacattcagcagcgccagcgcactgcagatacacgaaagaacgcacacaggcgaaaagccctttgggtgtacaatttgcgggcgcgcattcaccaccaagggcaatttgaaggtccatatgggtacccacatgtggaacaacgctcccgccagaagaggaaggaggctctcggtggaaaacccgatggccctgcttggaggagacgcgttgaagttctcagaaatgttccaaaaggacctggccgctcgggcaatgaacgtggacccctcgttttggaatcagtatgctgccgctattacgaacgggctggccatgaaaaataacgagatctccgtgattcagaatggggggattccccagctgcctgtctcgctgggcggaagtgcactgccaccactcggtagcatggcaagcggcatggacaaagcaagaaccggctccagcccaccgatcgtgtcgctcgataaagcctccagtgagacagccgcctcacgcccgtttacacgttttatcgaggataacaaggaaattgggattaattag

SEQ ID NO: 133400 - DNA, 2883 bp, Artificial Sequence
  Description of Artificial Sequence: Synthetic coding sequence
atgtctcgcagaaaacaagctaaaccacagcaccttaaatccgacgaggagctgttgcctccggatggtgcaccggaacatgccgcacctggcgaaggggccgaggacgccgactccgggccagagtcccggtctggcggggaggaaacatctgtgtgtgaaaagtgttgtgcggagttcttcaaatgggcggatttccttgagcatcaacggagctgcactaagttgccccccgtcctaatcgtccatgaagacgccccccctgggctgccgagcccccttttaccccagacatccgcatctggtgtgatcttccccaaccccctggtatcaattgccgcaaccgcgaatgcactagatccgctgtccgccctcatgaaacaccgtaagggaaagccccctaacgtttccgtcttcgagccaaaagcatccgccgaggatcctttctttaagcacaaatgtagattttgcgctaaggtgttcggcagcgacagtgccttgcagatccatctgcgcagtcacactggcgagagaccctttaaatgcaacatttgtggaaaccgcttcagcacaaaggggaatctgaaggtgcatttccagcgccacaaggaaaagtatcctcatattcaaatgaatccctaccctgttcccgagtatctggacaacgttcctacttgttcgggcattccctatggcatgtctctgccaccagagaagcccgtgaccacctggttagattccaaacctgtgctgcccaccgtccccaccagcgtaggactgcagctaccacccaccgtccccggtgctcatggctatgctgatagcccatccgctactcctgcgagcaggagcccccagcgtccttcacccgctagctccgagtgtgcaagtctgagcccaggcctgaatcatgtggaatccggggtgagtgccactgccgagtccccccagtctctgctcggcggtcctcctttgacaaaagccgagcctgtgtccctcccatgcacaaacgcccgagcgggtgatgctccagtgggagcccaagcttccgctgcgcccacttccgtggacggagcccccacgtcactaggcagtccaggccttcccgcagtctctgaacaatttaaggcccagttcccttttgggggcctcttggactctatgcagaccagtgagacatctaagttgcagcaactcgttgaaaacatcgataagaaaatgaccgaccctaaccaatgcgtcatctgtcacagggttctgagttgccagtctgctctgaagatgcactaccgtacccacacaggagagcggcccttcaagtgcaagatttgtggtagggccttcacaacgaaggggaatcttaagacacacttcggggtgcaccgcgccaaaccccccctgcgggtgcaacactcgtgccctatctgccaaaagaagttcacaaatgccgtcgttctgcagcagcacatccggatgcacatgggaggccagattcctaacacacctctgcccgagggcttccaagacgctatggacagcgaacttgcatatgacgacaagaatgcggaaactctgtccagctacgacgatgatatggatgaaaatagcatggaggacgatgcagagctcaaagatgctgccactgacccagccaagccattgctctcctatgcagggagctgccccccctctcccccctcggtgatctcttccatcgcggcactggaaaatcagatgaaaatgattgacagcgtgatgtcttgtcagcaacttaccggacttaagtccgtcgaaaacggaagcggcgagtcagatcgactgtctaatgacagttcaagcgccgtgggcgatctcgagtcgcgaagcgctggaagcccagcactttcggagtccagttctagtcaggccctgtctcctgctcccagtaacggtgagtcattcaggagcaagagtcctggcttgggagcgccggaagaacctcaggagatcccactgaaaactgagaggcctgatagtcctgctgcagctccggggagtgggggcgctcccggccgggccggaattaaggaggaggctccgttctccctgctgttcctaagccgggaaagggggccttcacagagcacacctagcctgatctctagcgcagctccaactatgataaagatggaggtgaacgggcatggtaaagctatggcactgggtgaagggccaccccttcccgctggggtgcaagtccccgccggacctcagacggtgatgggccctggtcttgctcccatgctggcacctccccctcgccgcacccccaagcagcacaactgtcagagctgcgggaagacattcagttccgcctccgccttacagattcatgagaggactcacaccggcgagaaacctttcggctgcactatctgcggcagagcctttacaactaagggaaacctaaaagtgcacatgggcacacatatgtggaataacgccccagctaggcgaggaaggagactgtctgttgaaaacccaatggcgctcctaggcggcgacgccctcaaattctcagaaatgttccagaaagaccttgccgccagagccatgaacgtcgatcccagtttctggaatcagtatgctgccgctatcacgaacggacttgcgatgaaaaacaatgagatatctgtgattcaaaatggaggaattccacagttgccagtaagcctgggaggtagcgctctgccacccctgggttctatggcctcagggatggacaaggcccgcacagggagtagtcccccgatcgtcagcctcgataaggcctcaagtgagactgccgccagccggcctttcaccagattcatagaggataacaaggagatcgggatcaattag

SEQ ID NO: 133401 - DNA, 516 bp, Artificial Sequence
  Description of Artificial Sequence: Synthetic coding sequence
atggtcaggccaccggtggtacctcggcgtccacctgctcatatttcatcagtgcgccaggcatcaacgcaggtgccgaggacggtgccacacacccagcgggtggccaacatcggtactcaaacaaccggaccttctggcgtcggatgctgtacgccgggcaggccattgcttccctgcaagtgttcctcggccgcccactctacctacagagtgcaggaacctgccgtccacatacctgggcaggagcccttgactgccagcatgctggccgctgcaccactccatgaacaaaagcagatgatcggcgagcggctctaccctttaatacatgacgtacatacacagctcgccgggaaaatcacgggcatgctgttggagatcgataactctgaacttctgcttatgcttgagtcaccggaatccctgcacgccaagaagagaaagagttctttgccctggctgcctaagggccagtgcttctggttgtccgctctgcgaccctgtaagttatag

SEQ ID NO: 133402 - DNA, 831 bp, Artificial Sequence
  Description of Artificial Sequence: Synthetic coding sequence
atgtccagacgcaagcaggcaaaaccacagcacatcaattcagaagaagatcagggagaacaacagccacaacagcagacacccgaattcgcggacgccgctccagctgcaccggcagcgggagaattgggacggagcagtctacctagtaccttcatcagggcccctcctacttacgtcaaggtggaagtgccaggcactttcgtcgggccatccacgctctctccaggtatgaccccactccttgccgcccagcctcgcagacaggcaaaacaacacggttgcactcggtgcgggaagaacttttcaagtgccagcgcacttcagatccacgagaggactcacacaggcgaaaagccatttgtttgtaatatttgcggccgggctttcaccacgaagggaaacctgaaagtgcactacatgacccacggagcaaacaacaactctgctcgacgtggaagaaagttggccattgagaacactatggcattactgggaactgacggcaagagagtatctgagatcttcccaaaagagattcttgctccctctgtgaacgtcgacccggtggtatggaaccagtatacctcgatgctcaacggtgggttggcagtgaagaccaacgagatatccgtgatccagagcggcggcgtccctacactcccagtgagcctgggggctacatcggttgttaacaacgccactgtgtctaagatggatggctcgcagagtggcattagtgccgacgtggaaaaaccctctgcaacagacggcgtgcccaaacaccagttcccccacttcttggaagagaataagatcgctgtgagttag

SEQ ID NO: 133403 - DNA, 1851 bp, Artificial Sequence
  Description of Artificial Sequence: Synthetic coding sequence
atgagccgcaggaagcaagccaagcctcagcatattaattcggaagaggaccaaggggagcagcagccccagcagcaaacacccgagtttgccgatgccgcccccgctgccccagcagcgggggaactgggggcccccgtaaaccatcccggaaacgacgaggtagcgagcgaggatgaggctacggtaaagcgactccgacgcgaagaaactcacgtctgtgaaaagtgttgcgccgaattctttagcatctccgagttcctggaacataaaaagaattgcactaaaaatccgcccgtgctgatcatgaacgactccgaggggccagttccttcggaggactttagcggggctgttctgtcccaccaacctacttctcccggtagcaaagactgccatcgtgagaacggtgggtcttccgaggacatgaaggaaaagcctgacgcggaatcagtggtgtaccttaaaaccgaaacagccctgccaccaacccctcaggacatctcctacctggcgaaggggaaggtcgcaaataccaacgtgacgctccaggccctcagagggactaaagtggccgtgaaccagcgatccgcagacgccttaccagcaccagtacctggagccaattcaataccatgggtgctggagcagatattgtgcctccagcagcaacagttgcagcagatacagttgaccgaacagattcggatccaggtcaatatgtgggcatcccatgcgctgcactcctcaggagccggtgccgacactctcaaaacactcggcagtcatatgagtcagcaggtttcggctgccgtcgccttgctctctcagaaagcgggctcgcaggggctctcactggatgcactgaagcaggctaagctaccacatgccaatatcccatccgctacctcatctctgagccccggactggcacccttcactctgaagccggacggcaccagggtccttccgaacgtgatgagccggttaccctccgccttgctccctcaagctcccggctccgtcctcttccagtcaccattttctactgtggccctcgatacatccaagaaagggaaaggcaagcctcctaatatcagcgccgtggatgtgaagcctaaggatgaggccgctctgtacaaacataaatgtcgatcctcgctgccttctaccttcatcagggctcctcctacttatgtgaaggtcgaagttccgggcacattcgttggaccaagtaccttatctccgggcatgactccactcttagctgcccagccccggaggcaggccaaacagcatgggtgtactaggtgtggtaagaatttcagctctgcctccgcgctccagattcacgaacggactcacaccggagagaaaccttttgtctgcaatatttgtggtcgtgcatttacaactaaaggaaatttaaaggtccactacatgacccacggagctaacaacaattctgcgcggcgagggagaaagctggccattgaaaatacaatggccctcctcggcacagatggcaaacgggtgtctgaaattttcccaaaagaaatcctggcacctagcgtgaacgtcgacccagttgtttggaaccagtatacatctatgctcaatggggggctagccgttaaaaccaatgaaataagcgtaatacaatccgggggcgtgcctaccctgccagtttccctgggcgcaactagtgttgtcaataatgctacagtcagcaagatggacggtagccagtctgggatctctgctgatgtggaaaaaccttccgcaactgacggcgttccaaagcatcagttcccgcactttctggaggagaataagattgccgtgtcctag

SEQ ID NO: 133404 - DNA, 2781 bp, Artificial Sequence
  Description of Artificial Sequence: Synthetic coding sequence
atggtgatggcggatgggccccggcatttgcagagaggccccgtgcgggtgggattctacgatatagagggaactctcggcaagggaaatttcgccgttgtgaagctggggcggcaccgtatcactaagaccgaggttgctatcaagatcattgataagtctcagcttgatgctgtcaacttggagaagatttaccgagaggtgcagatcatgaaaatgctggaccacccgcacataatcaaactgtatcaagtcatggagaccaagtccatgctctatctggtcactgagtatgcaaagaatggcgaaatctttgactaccttgctaatcatggcaggctcaatgagagcgaggcgcggcgcaaattttggcaaatactgtcagcggtcgattactgtcacggacgcaaaattgtccacagggatctgaaggctgaaaacctcttattggataataatatgaacataaagattgccgatttcggtttcggcaacttcttcaagagcggagagctgctagcaacctggtgcggatcccccccttatgccgccccagaggtgtttgaagggcagcagtatgaaggtccccagttggatatttggtccatgggtgttgtgctgtacgtgctagtgtgcggggctctgcctttcgacggccccacgctgccaattttgcgccagcgtgtgctcgaaggaaggttcagaattccatattttatgtcagaagactgcgagcaccttattagacgcatgctggtcctcgacccttctaagcgtctgaccatcgcccagataaaggagcataaatggatgctgattgaagtgcccgttcagagacctgtcttatacccgcaggaacaggaaaatgaaccttctataggggagttcaacgagcaggtgcttaggctcatgcacagcctgggtattgaccagcaaaaaactatcgaatcgttacagaacaagagctataaccatttcgccgctatttactttctgcttgtggagcggctgaaaagccacagatctagcttccccgtggaacagagactggacggcaggcaacgacgcccaagcaccatcgccgagcagaccgtagccaaagcccagacagtgggactccctgtgacaatgcactctccaaatatgagactcctgcggtcagcgctgctcccgcaggcctcgaacgttgaggcatttagttttccagcctctggctgccaggccgaggctgcttttatggaagaggaatgtgtggacacaccaaaagtgaacggttgcctactggaccccgtgcccccagttctcgttcgaaagggatgccagtccctgccatcaaacatgatggagacttccattgatgagggactggaaaccgagggcgaggccgaggaagatcccgcacacgcttttgaggcctttcagtccacacggtcaggacaaagacgtcacaccctatccgaggtcactaatcagctggttgtgatgccgggggccggcaaaatcttcagcatgaatgattccccttccctggattctgtggactctgagtatgatatgggttcagtacaacgcgatctcaatttccttgaagacaatcctagcctcaaggatatcatgctggcaaatcagccctctccgcgaatgactagccctttcatcagccttaggccgaccaatcccgccatgcaggccttgagcagccaaaagcgggaggtccacaacagaagtcccgtaagctttagggagggaagacgggccagcgatacttccctgactcaggggattgttgcttttaggcagcatctgcagaatctggcccgcaccaaagggattttggagctgaataaggtccagctgttatacgagcagattgggccagaagcagacccaaacctggctcccgcagcaccccagcttcaggatttagccagctcatgcccgcaagaagaggtctcccagcaacaggagtctgtgagcactctgccagccagcgttcaccctcagttgtctccacgccaaagcttagaaacacagtacttgcagcacaggctgcaaaaaccatctctgctttccaaggcccaaaatacatgccagctgtactgtaaggagccacctagatccctggaacagcagctgcaagaacatcgattgcagcagaagcggctctttctgcagaagcagagccagctccaggcttactttaaccaaatgcagatagctgaaagcagttacccacagccaagccagcagctgccactgcctcgccaggagacacctccccccagtcagcaggcccctcctttcagtctcacgcaaccactctccccagttctggaaccttccagcgaacaaatgcagtattcgcccttcctaagccagtaccaggagatgcagttgcagccgctgcctagcaccagtggaccccgcgccgcccctcctctacccactcagctgcagcagcaacagcctccgccacccccacctcctccacctcctcgacagccaggggccgctcctgctccactccagttctcttatcaaacttgtgagctgccttccgccgccagtcctgcccccgactatcccacgccgtgccagtatccagtggatggcgcgcagcagagcgacctaactgggcccgattgcccccgatcaccaggtttgcaggaagcaccgtcatcctacgaccccctcgccttgagcgaattgcccgggctctttgactgtgagatgctggatgctgtcgatccccagcataacggctacgtgcttgtcaattag

SEQ ID NO: 133405 - DNA, 1881 bp, Artificial Sequence
  Description of Artificial Sequence: Synthetic coding sequence
atgcaaagggcagactctgagcaaccctcaaaaagacccagatgtgatgatagtccaagaacccctagtaacaccccatctgcagaagcagattggtcacccggcctagagttgcaccctgactacaagacttggggccccgagcaagtgtgtagtttcctcagacgggggggttttgaggagccagtgttacttaagaatattagagagaatgagattacgggtgcccttttgccctgtcttgatgagagcaggtttgaaaatttaggtgtgtccagtttgggcgagcgcaaaaagctgctctcctacattcaacggttagtccagatccacgttgatactatgaaggtgataaacgatccaatccacgggcacattgagctgcatcccttactggttagaatcatcgacacccctcagttccaacgcttgagatacatcaagcagttggggggaggatactatgtattccctggtgcctcccacaaccggttcgagcactctcttggcgtgggatacctggctggatgtctcgttcatgctctgggagaaaaacagccagaactgcagatttctgagagagatgtcttatgtgtacagatcgccggactctgtcacgatctgggccatggcccgttttcacacatgtttgatggccgctttattcccctggcacgaccagaagtaaaatggacccatgagcagggcagcgtgatgatgtttgagcacctgatcaattctaatggaatcaaacctgtcatggagcagtatgggctcatccccgaagaagacatctgctttattaaggagcagatcgtagggccactggagtcccccgtggaggactctctctggccctataaaggacgtcccgaaaacaaaagtttcttgtatgaaatagtaagtaataagaggaacgggattgatgtggataaatgggactatttcgcacgcgactgccaccacttggggatccagaacaatttcgattacaaaagattcattaaatttgcccgcgtatgtgaagtagacaatgagttgaggatttgtgccagggataaggaggtcggcaatctgtacgacatgttccacacacggaatagcctgcaccggagggcctatcaacataaggtgggcaacatcattgacaccatgattacagatgccttcctgaaggctgatgactatattgaaattactggtgccggcggcaaaaagtacagaattagtaccgccatcgatgacatggaggcctacaccaagctgactgacaacatctttttagagatactgtatagcaccgatcctaaactcaaggatgcgcgggagattctgaagcagattgagtaccggaatctgttcaaatacgtgggcgaaactcagcccactggtcaaattaagattaagagggaggactacgagagcttgccaaaggaggtggccagtgcgaaacctaaggtattgttggacgtgaaactgaaggccgaagactttatcgtagatgttataaatatggactatggcatgcaagagaagaaccccattgatcacgtatcgttctactgtaagactgccccgaaccgggcgatccgcattactaaaaatcaggtctctcagctgctgcccgagaagtttgcagaacagctgatacgcgtctattgcaagaaagtagacaggaaatcactgtatgccgcgaggcagtacttcgtgcagtggtgcgcggacaggaattttactaaacctcaggacggcgacgtgattgccccacttatcactccccaaaaaaaagagtggaacgatagtactagcgtgcagaacccaactcggttgcgggaagccagtaagtcccgagtccagctttttaaggacgatcccatgtag

SEQ ID NO: 133406 - DNA, 513 bp, Artificial Sequence
  Description of Artificial Sequence: Synthetic coding sequence
atgttcgacggtcgcttcatacccctggcaaggcccgaggtgaagtggacccacgagcaggggagcgtgatgatgttcgagcaccttatcaacagcaacggtatcaagcctgtgatggagcaatacggactcatcccagaagaggatatctgttttataaaagagcaaatcgttggtcccctcgagtcacccgtcgaagattctctatggccatataaggggcgcccagaaaataaaagctttttatacgaaattgtctcaaacaagagaaacgggattgacgtggacaagtgggactacttcgcacgagactgccatcacctcggaattcagaacaacttcgactataagaggttcattaagttcgcaagggtgtgcgaagtggacaatgagctgcggatttgtgccagagataaagaggtcggcaacttatatgatatgtttcatacaagaaactctttacatcggcgagcctatcagcacaaggttgggaatatcattgataccatgtag

SEQ ID NO: 133407 - DNA, 1326 bp, Artificial Sequence
  Description of Artificial Sequence: Synthetic coding sequence
atggaaatccggctagacacactcagtgccagtttgggccgcagctctacgcttaacaactgcaaccttgaagataagctagcctggtatgagggtgaggcttacatgtggcatcactggaaaccctttcccgagaacccgctctggacctgcttagatttccagatcgcacaagtcggtccctgggatcattgctccagctgcatcagacacaccagattgaaaagttcttgctctgatatggatctcctgcattcctggaggagttcttcttttgggaactttgaccgctttagaaataactctctgagcaagcctgacgattcgacggaggctcacgaaggcgacccgacaaatggatccggggagcaatccaaaacaagtaacaatggtggaggcctaggcaagaagatgcgggccatttcatggacaatgaaaaaaaaagtgggaaagaagtatatcaaggcattgtccgaggagaaggacgaggaagacggtgagaacgctcacccttatagaaacagtgacccagtcatcgggacccacactgagaaggtttcactgaaggctagtgactccatggatagcctgtactcaggccagtcctcctcctccggtatcacctcatgttccgacggtacgagcaatcgcgattccttccgcttggatgatgacggtccctactcaggtcctttttgtggcagggccagagtgcatacggactttacgccatctccttacgacactgacagtttgaaaataaaaaagggtgatattattgatattatttgtaaaacgccaatgggcatgtggacaggtatgctcaacaataaagtgggcaattttaaatttatctatgtggatgtcatttccgaggaagaggcagccccgaagaagataaaagccaatagaaggtccaatagtaagaagagcaaaactcttcaggagttcctggaacggatccatctgcaggagtatacttcaaccctcttgcttaatggatacgagactcttgaggaccttaaggacataaaggaatctcatctaatcgagctgaatatcgagaatcctgatgaccggcggagattgctctctgccgcggaaaacttcctagaagaggagatcattcaggaacaggaaaacgagcctgagcctctctcactctccagtgacattagtttgaacaagagccagctggacgactgccctagggactcagggtgttacatctcctccgggaattcagataacggcaaggaggacctagaatccgagaacctgtctgacatggtccataagatcattattacagaacccagcgattag

SEQ ID NO: 133408 - DNA, 618 bp, Artificial Sequence
  Description of Artificial Sequence: Synthetic coding sequence
atgttgaaacggaagcccagcaatgtgtcagagaaggagaagcaccagaagccaaaaaaaggggatattattgatatcatttgcaaaaccccgatgggcatgtggacaggtatgctgaataacaaggtggggaatttcaagtttatttacgtcgacgtcattagcgaagaagaagccgcccccaagaagatcaaagctaaccggagaagtaatagcaagaagagtaaaaccctgcaggagttcctggagcgcattcacttgcaagagtatacatcaacactgctccttaatggttatgaaaccctggaggacctcaaagacattaaggaaagtcaccttattgagctgaacatagagaatcctgatgaccggcggcggttgttaagcgcggcagaaaatttcctggaagaagagattattcaggaacaggagaatgagccagagcctctgtcattgagcagcgacatcagcttgaacaagtcacagctcgatgactgcccacgcgactccggatgttatattagctcaggtaacagcgacaatggtaaggaagacctggaaagcgagaacctgtctgacatggtgcataaaattataatcaccgaaccctccgattag

SEQ ID NO: 133409 - DNA, 1122 bp, Artificial Sequence
  Description of Artificial Sequence: Synthetic coding sequence
atgttgaaacgaaagccctcaaatgttagcgaaaaggagaagcatcaaaagccaaaacgctcaagttctttcgggaactttgaccggtttagaaataattccctttcaaagccagacgattctacagaggcccacgaaggcgacccaactaatggcagtggagaacaatctaagacttccaataacgggggaggactcggtaaaaagatgcgcgctatctcctggacaatgaaaaaaaaggttggcaagaaatacattaaagccctttccgaggagaaagacgaggaggatggagaaaacgcacatccatacagaaattccgacccagtcattggaacacacaccgaaaaggttagcctcaaagcttcagatagcatggattctctctactccggacaatcgagctcctccggcatcacaagttgcagcgatggtacaagtaacagggactccttccgccttgacgacgatggaccctacagcggcccattttgtggacgggctcgagtacatactgacttcacaccaagtccttatgacacagactctctaaagatcaaaaagggagatattattgatattatctgtaaaacccccatggggatgtggaccggtatgctcaacaacaaggtgggaaattttaagttcatctacgtggacgttatttctgaggaggaagccgcacccaagaaaatcaaagcaaaccggcggtccaactccaaaaagtccaaaacccttcaggagttcttggagcgtatccatctccaagaatacacctcaaccctactgctgaacggttacgagacattggaggatttaaaggatataaaggagagccatcttatagagttaaacattgaaaaccctgacgatcggcgacggctgctgagcgccgctgaaaattttcttgaagaagaaattatccaggaacaagagaatgaacctgagcctctgtcactgagctccgatatatcccttaacaaaagtcagctggatgactgcccgcgagactccgggtgttacatctcctcagggaactctgacaacggtaaagaagatctggagagcgagaacctgtcagatatggtgcacaagattattatcaccgagccttcagactag

SEQ ID NO: 133410 - DNA, 1008 bp, Artificial Sequence
  Description of Artificial Sequence: Synthetic coding sequence
atgggtagtgcgagccctggactttcgagtgtgtctccctctcacctgctgttgcccccagacacagtcagtcgtacgggactcgagaaagctgcagccggggctgtcggcctcgaacgcagagactggtcgccgtccccccccgccacacctgaacagggtctaagcgctttctatctctcatacttcgacatgttgtacccggaggatagcagctgggccgcaaaagcccccggcgcctctagccgggaggaacccccagaggagcccgagcaatgtccagtgattgactcccaggccccagccggtagcctcgatttggtgcccggcggccttacactcgaggagcacagtctggagcaggtccagtctatggtagtaggtgaagtacttaaagatattgagaccgcctgtaaactgcttaacatcacagccgaccctatggattggagtcccagcaatgtgcagaagtggcttctctggacagagcaccaatataggctgcccccaatgggtaaagcctttcaagaactcgcaggcaaagagctctgcgccatgagcgaggagcagttcagacagcgttcacctctggggggggacgttctgcacgcccacttggacatttggaaatccgctgcctggatgaaagagaggacgtctcctggtgccatccactattgtgcatctactagcgaggaatcgtggaccgactcagaagtcgatagtagctgcagcggacagcccatccatctgtggcagtttctgaaagagctgcttctgaagccacacagctatggcagattcatccggtggcttaataaggagaaggggatatttaaaatagaggacagcgcacaggtcgctcgtctgtggggcattcggaagaacagacccgcaatgaactacgacaaactgagtcggtctattagacagtactacaaaaaagggatcattaggaagccggatatttcccaaaggctggtgtaccagtttgtccaccccatctag

SEQ ID NO: 133411 - DNA, 960 bp, Artificial Sequence
  Description of Artificial Sequence: Synthetic coding sequence
atgggtagcgctagtccaggcctcagcagtgtcagtcctagccaccttttacttccccccgatacggtcagccgaacagggctggagaaggcagctgctggggcggtaggcctggagagaagggattggagtccttcacctccagcgacaccggaacaggggctttctgccttttacttgtcttacttcgatatgctttacccagaagacagctcctgggccgccaaggcgccaggggcatccagccgagaggagccaccagaagagcctgaacaatgccccgtgatcgatagccaagctcccgcagggtcactagacctcgtgccaggaggcctgactctcgaggaacattcactggagcaggtccagagcatggtggtaggagaagttttgaaagacatagagaccgcatgtaaattgctcaatattaccgctgaccccatggactggagcccctccaatgtgcagaagtggctgctgtggaccgagcaccagtatcgccttcctcccatgggcaaggcatttcaggaacttgccggcaaagagctgtgcgccatgagcgaagagcagttcaggcagcgctcaccactgggaggcgacgtcttgcacgctcacctggatatttggaagagcgcatcaaccagcgaggaatcatggacagactccgaggtcgactccagctgtagcggccagcccattcacctgtggcagtttcttaaggaactgctcctgaaacctcattcatacggcaggttcatccgctggcttaacaaggaaaaagggatatttaaaattgaggattctgcacaggtggctcgtctatggggaattagaaaaaacagacctgcgatgaattacgacaagctgtctagatccatcagacagtattacaagaagggcattatcagaaagcctgatatctcacagagacttgtctatcagtttgtgcacccaatttag

SEQ ID NO: 133412 - DNA, 1218 bp, Artificial Sequence
  Description of Artificial Sequence: Synthetic coding sequence
atggcagcaagtgggaaaaccagtaaatctgagcctaaccatgtgatatttaagaaaatcagccgagacaagtcagtgaccatctatctcggcaacagagactacattgatcacgtcagtcaggttcaacccgttgacggagtggttcttgtagatcccgacctcgtgaagggtaagaaagtttatgtgacgctgacctgcgccttcaggtacgggcaagaagacattgacgtcattgggctgacttttcgaagagatttgtatttcagtcgggtacaagtgtaccctcctgtgggcgcggcttctactcctaccaagctgcaggagtcactcttgaagaaactcggatcaaacacatatccctttctcctgacatttccagactatctgccttgctcggttatgctccagcccgcgccccaggacagtgggaagagctgtggagtcgactttgaagtgaaagcctttgcgaccgattcaacggacgccgaagaagacaagatacctaagaagtcaagcgtgcgcctgcttatacgcaaagtacagcacgcccccttggagatgggtcctcaaccgcgggcagaggccgcatggcaattcttcatgtcagataaacctctccacctagccgtgagccttaataaagagatctacttccacggggaacccatacccgtaacagtgaccgtgactaacaacaccgagaaaaccgtaaaaaaaatcaaagcctttgtggaacaggttgccaatgtagttttatattcaagtgactattacgtgaagccagtggctatggaagaggcacaggaaaaagtccctccaaacagcacactgactaagaccttgactctacttccactgttggcgaataatcgggaacggagaggcattgcactggatggaaagatcaagcatgaagatactaacctggcaagctcgacaataattaaggaggggatcgaccgaacggtgcttggcatcctggtgagttaccagattaaggtgaaactgacggtatccggcatgacaggtagacagaaagctagtgaggtggctaccgaggttcctttcaggctgatgcacccccagcctgaagaccctggccaattctcctaccaagacgctaacttagtcttcgaggaatttgcccgccataatctgaaagacgccggcgaggccgaagaggggaagcgggacaagaacgacgtggacgaatag

SEQ ID NO: 133413 - DNA, 1218 bp, Artificial Sequence
  Description of Artificial Sequence: Synthetic coding sequence
atggccgccagtggaaaaaccagtaagtcggaacccaatcacgtcattttcaaaaagatctcgcgtgacaagtccgtcaccatctaccttggcaaccgcgattacatagaccatgttagccaggtgcaaccagttgacggagtagtgcttgtcgacccagaccttgtgaaaggaaaaaaagtctatgtgacattgacatgcgcttttaggtatgggcaagaggatatcgatgtgattggacttacgttccgcagagacctatacttctcaagggtccaggtttacccccccgtaggcgcggcttctacacccaccaagctacaggagtccctcctcaaaaaattggggtctaacacatatccgtttctcctgacttttcccgactacctgccctgttccgtgatgctccagccggcccctcaggactcagggaaaagctgcggagttgacttcgaagtcaaagccttcgctactgattctaccgacgccgaggaagataaaatccccaaaaagtcatccgtacgacttctgatacgcaaagttcagcacgcacctctggagatgggaccacagccccgcgcggaagctgcatggcagttttttatgtccgataaaccactgcacttggcagtgtcactcaacaaagagatctattttcacggcgagccaattcctgtgaccgtgacggttaccaataacacagagaaaacggtcaaaaaaattaaggcgttcgtggagcaggtcgctaacgtggtactgtacagctccgactattatgttaagccggtggccatggaagaggcacaggagaaagtcccaccaaacagcaccctgacaaagaccctgaccctactgccccttctcgccaataaccgagagagaagagggattgcgctggatggaaagatcaagcatgaggacacaaatctggcatcaagcaccattatcaaagaaggcatcgatagaacggtactgggtatcctcgtctcctaccagattaaggttaagctgacagtgtccggttttttgggagaactgacatctagcgaggtcgccaccgaggttccctttagacttatgcatccacaaccagaggacccagcaaaggagtcataccaggatgccaacttagtattcgaagagtttgcccggcacaacctgaaagatgcaggcgaagccgaggagggcaagagagacaagaatgacgtggatgagtag

SEQ ID NO: 133414 - DNA, 510 bp, Artificial Sequence
  Description of Artificial Sequence: Synthetic coding sequence
atggccgcaagtggaaaaaccagtaaatcagagcctaaccacgtgatttttaagaaaatctccagggataaatctgttactatatacctcgggaaccgcgattatattgatcatgtgtcacaggtacaacccgtggatggagttgtcctagttgatccagacctggtgaagggaaagaaggtatatgtgactctgacatgcgcatttcgctatggccaagaggacatcgacgttattggactgaccttccgacgcgatctctatttctcccgagtccaagtctatccacccgtaggcgcagcctcgactccaactaagcttcaagagagtctcctcaagaaactcggctcaaacacataccccttcctcctgaccttcccagattaccttccttgttccgtgatgcttcagcccgccccccaagactctgggaaatcttgtggcgtggattttgaagtcaaagcatttgccaccgattcgaccgatgcagaggaagacaaaatcccctag

SEQ ID NO: 133415 - DNA, 708 bp, Artificial Sequence
  Description of Artificial Sequence: Synthetic coding sequence
atgctccagcctgcccctcaggatagcggcaaaagctgtggagttgatttcgaagtgaaagcttttgcgacggacagtacagacgccgaggaagataagatcccaaagaagtcatcagtgcgcctgttaatacggaaggtccagcacgcacctcttgagatgggccctcagcccagggccgaggctgcctggcagttcttcatgtctgataaaccactacacctggcagtctcactgaataaagaaatttacttccacggagaacctatccccgtgacggtgacagtgacgaataacaccgaaaaaaccgtcaagaagataaaggcatttgtggaacaggtggcaaatgtggtcttgtattcatctgactattatgtaaagcccgtggcaatggaagaggcccaggaaaaagtaccccctaattccacactgaccaagacgctcacactgcttccactgctagcaaacaatcgggagaggagaggaattgccctcgatggtaagataaagcatgaggatacaaatctggccagcagcacaatcataaaagaagggattgaccgcacagtgcttgggatcctagtgtcctaccaaatcaaggtcaaacttaccgtgtcaggatttctcggtgaactcactagttctgaggtcgccacagaagtgcctttccgcctcatgcacccacagcctgaggacccaggcaaatag

SEQ ID NO: 133416 - DNA, 204 bp, Artificial Sequence
  Description of Artificial Sequence: Synthetic coding sequence
atggccgcctcgggtaaaacatctaaaagtgaaccgaaccacgttatctttaagaaaattagccgtgacaagtccgtatcaggagcccaggttactatctatctgggcaaccgtgactacatcgatcatgtatcccaggtccagcctgtcgacggggtcgtactggtggaccccgaccttgttaagggcaagaaggtgtcctag

SEQ ID NO: 133417 - DNA, 633 bp, Artificial Sequence
  Description of Artificial Sequence: Synthetic coding sequence
atggcaaccgaaacagtggagctgcacaagctgaagcttgccgagctgaaacaggaatgcctggccagggggcttgagacaaagggcatcaagcaggatttaatccacagactgcaggcctacctcgaggaacacgccgaggaggaagctaacgaggaggacgtcctaggcgatgagaccgaggaagaagagaccaagccgattgagctcccagtcaaggaagaagagcccccagagaaaaccgttgatgtagccgccgagaagaaagtggtgaagatcacttctgagatcccacagaccgagaggatgcagaagcgggccgagagattcaacgtcccagtgagcctggagagcaagaaggcagctagagccgcgaggtttgggatctcgagtgtccctaccaaggggctcagctccgacaacaaacctatggtgaacctggataagctgaaggagagagctcagaggtttggccttaacgtaagctcgatatcgcgaaaaagtgaggacgacgagaaactaaaaaaacgtaaggaacgctttggaatcgtcacgtcatcagccggtacggggacgaccgaagacactgaggcaaagaagaggaagcgggccgagcggttcggaattgcatag

SEQ ID NO: 133418 - DNA, 453 bp, Artificial Sequence
  Description of Artificial Sequence: Synthetic coding sequence
atggaggaggagacgaagccaatcgagctgccggtgaaggaggaagaacccccggaaaaaactgttgatgtcgctgcagaaaaaaaggtcgtcaaaatcacctctgaaattccgcagacagagcgaatgcagaagagagcagaaaggttcaacgtgccagtttctctggagagcaagaaagcggccagggcagctcggttcggaattagttcggttccaacaaaaggtctgtcctctgacaacaagcccatggtgaacctggataagctcaaagagagggcccagagatttggccttaatgtgtcatcgatctctagaaagtctgaggatgatgaaaagctgaaaaaacggaaagagcgtttcgggatcgtgacctcaagcgcagggaccgggaccaccgaggacacagaggcaaagaagagaaaacgagccgaacgtttcggcattgcgtag

SEQ ID NO: 133419 - DNA, 633 bp, Artificial Sequence
  Description of Artificial Sequence: Synthetic coding sequence
atggccacagagacagtggagttgcacaaactcaagctcgctgaactcaaacaagagtgcctcgcaaggggtttagagactaagggtattaaacaggatctgattcaccgtctgcaggcctatctggaggagcacgctgaagaggaagcaaacgaagaagacgtgctaggtgatgagacagaagaagaggaaaccaaacccatcgaattgccagtcaaagaggaggaacccccagagaagaccgtggacgtggccgcggaaaaaaaggtggttaaaattactagcgaaatcccccagacagaacgcatgcagaagcgggccgagcgatttaatgtgcccgtctctctagagagtaagaaggcggctcgagctgccaggttcgggatctcatcggtgcctacgaagggcctgagctccgacaataagcccatggtgaatcttgacaaactgaaagagcgcgcccagcggtttgggctgaacgtatcttctatttccagaaagtctgaagacgatgagaagctaaaaaaaagaaaggagagatttggcatcgtaacttcttctgcgggaacaggcaccactgaagataccgaggccaaaaagaggaagcgtgctgagaggtttggcattgcgtag

SEQ ID NO: 133420 - DNA, 879 bp, Artificial Sequence
  Description of Artificial Sequence: Synthetic coding sequence
atggctgggaagaaaaacgtgctgagctctctagccgtatacgccgaggattctgagccagagtccgatggggaagctgggatcgaagcagtgggcagcgcagccgaagagaagggaggcctagtgtctgacgcttacggcgaggatgacttcagtagactgggcggcgatgaagatggttatgaggaggaggaggacgagaactcgcgacagtctgataatacagaggcggaaaaaagggacccgcaggaactggtggcaagcttctcagagcgggtgcgtaatatgtccccagacgagattaaaatccccccagaacctccaggcaggtgctccaaccacctccaggataagatccagaaactgtacgagcggaagattaaggaagggatggatatgaactacataatacaaagaaagaaagagttcagaaatccctcaatctacgagaagctcattcagttctgtgcaattgacgagttaggaacaaactatcccaaggacatgttcgatccgcacggatggtccgaagatagctactatgaggccctcgctaaggctcagaaaattgaaatggacaagcttgaaaaagcaaagaaggagcggacgaagatcgagttcgtgaccggcacaaaaaaaggaacaacgacgaacgccacctccaccacaacgactactgcttccactgccgtggccgatgcacagaagcgcaagagtaagtgggacagcgcgatcccagtgacaacaatcgctcagcctacaatcctgaccactaccgccactctccctgccgtggtgacggtaacaacttccgcctccggtagcaagactaccgtcattagcgccgttggaacaattgtgaagaaggcaaagcagtag

SEQ ID NO: 133421 - DNA, 927 bp, Artificial Sequence
  Description of Artificial Sequence: Synthetic coding sequence
atggctgggaaaaaaaacgtgctctcttcattggcagtctacgctgaagattcagaacccgagtcagatggcgaagctggaatcgaagccgtgggtagcgccgccgaggagaagggaggccttgtgtcagacgcctatggggaagatgacttttcacggctggggggagacgaggacgggtatgaggaggaagaagacgagaactccagacagagcgaggacgatgacagcgaaacggaaaagcccgaggcagacgacccaaaagataacacagaggctgagaagcgcgacccgcaggagttggtggcctcttttagcgagagagtcagaaatatgtcaccagatgaaattaaaattcctcctgagccgccagggagatgcagcaatcacttacaagacaaaattcagaagctgtacgaaagaaagataaaggaggggatggatatgaattatatcattcagaggaagaaggagtttagaaacccctctatctacgaaaagctcatccagttttgtgccatagacgaattagggaccaactaccctaaagacatgtttgatcctcacggttggtcagaggacagctattacgaggctctcgctaaggcccagaagatcgagatggacaagctggagaaggcaaaaaaggagcgtacaaaaattgagtttgtcactggcactaagaagggaaccactactaatgccacatcaacaactaccacaacggcatccaccgcggtggcggatgctcagaaaagaaagtccaagtgggacagcgctatccccgtgacaaccatcgcacagcctacaatccttaccaccaccgccactctccccgcggtggttaccgtcaccacgtcagcttctggatctaagacaaccgttatttccgctgtagggacgatcgtcaagaaggcgaaacagtag

SEQ ID NO: 133422 - DNA, 507 bp, Artificial Sequence
  Description of Artificial Sequence: Synthetic coding sequence
atggcaggtaagaagaacgttctctctagcctggccgtatatgctgaggatagcgagccggagtctgacggcgaggccggaatcgaagcggtcgggagcgccgccgaggagaaaggtggcctggtcagcgacgcgtacggagaggacgacttcagtaggctgggcggagacgaagacgggtacgaggaggaggaggacgagaactccagacaatcagaggacgacgattccgagaccgaaaagccagaagccgatgacccgaaagacaatacagaagccgagaaaagagatccgcaagagcttgtggcgagcttcagtgagcgcgtgcgtaatatgtcacctgatgagatcaagattccacctgagccaccaggcagatgcagtaatcatctccaagacaagatccagaaattgtatgagagaaaaataaaggaaggaatggacatgaactatattatccagcgcaagaaagagttcaggaacccgagccaggggccagagaactag

SEQ ID NO: 133423 - DNA, 927 bp, Artificial Sequence
  Description of Artificial Sequence: Synthetic coding sequence
atggcaggcaagaagaacgtcctgtcttccttggcggtctatgccgaggattctgagcccgagtccgacggtgaggctggaatcgaggcagtgggcagcgctgctgaggagaaaggtggactggtgtcagacgcctacggggaagacgatttctccaggctcggaggggacgaggacggatacgaggaggaagaggatgaaaatagtaggcagtctgaagacgacgatagtgagaccgaaaaacccgaagccgacgaccctaaagacaatactgaggccgaaaaacgggacccacaggagttagtggcctcattttctgagcgcgtccgaaatatgtcccccgacgagatcaagataccaccagaacccccaggcagatgcagcaaccacctccaggataagatacaaaaactttacgagcgcaagatcaaggaaggaatggatatgaattacattatccagcgaaagaaagaattcaggaatccttctatatatgaaaaactgatccagttctgcgccatagatgagctcggcaccaattacccaaaggacatgttcgatccccatggatggtccgaagattcttattatgaggcccttgcaaaggcacagaagattgagatggataagctcgaaaaagccaagaaagaacgaacgaaaatcgagttcgtgacgggaaccaagaaaggtaccaccaccaatgccacttctacaaccactactacagcaagcacagcagtggcggatgctcagaaaagaaaaagcaaatgggattctgcgattcccgtgaccacaatcgcccagccgacaatcctgaccaccaccgccactctgcccgctgtggtgacggtcacaacgtccgcatctgggtctaaaactacagtaatttcagccgtgggcaccatcgttaaaaaggcaaaacagtag

SEQ ID NO: 133424 - DNA, 366 bp, Artificial Sequence
  Description of Artificial Sequence: Synthetic coding sequence
atgtccttcatcttcgaatggatctacaacggctttagctccgttctgcagttcctgggcttgtacaagaaaagtggtaagctcgtgttcctcggtctggataacgctggaaagaccaccctactgcacatgctaaaagacgatcgactcggtcagcacgtccccacactgcatccaacatcagaggagctgaccatcgccggaatgacctttaccaccttcgacctgggcggacacgaacaggctcgccgagtgtggaagaactacctgcctgcaattaatggtattgttttcttggtcgactgtgctgaccatagcaggttagtggagtcaaaagtagagctcaatgtctgctttgtgctgtag

SEQ ID NO: 133425 - DNA, 597 bp, Artificial Sequence
  Description of Artificial Sequence: Synthetic coding sequence
atgtcctttattttcgaatggatctacaatggcttctcaagcgtcctccagttcctaggactctataagaaatccggtaagctcgtgtttctgggcctggataacgctggtaagactaccctgctgcatatgcttaaggacgaccgcctcgggcaacatgtgccaaccctacatcctacctctgaggagctaaccatcgctggcatgaccttcaccaccttcgatctcggaggccacgagcaagccagacgagtgtggaagaattaccttcccgccatcaacgggatcgtgttccttgttgattgtgccgatcacagcaggctagtcgagtcaaaagtggagttaaacgctttaatgaccgacgaaaccatctctaacgtccctatcctgatcctcggcaacaagattgatagaacggatgcaatatctgaggaaaaactccgtgaaattttcggcttgtacggccagacaactggcaaagggaatgtcacactgaaggagctaaacgcccggcctatggaggtctttatgtgctcggtgctgaaacggcagggttatggagaaggcttccggtggctgagtcaatacattgattag

SEQ ID NO: 133426 - DNA, 597 bp, Artificial Sequence
  Description of Artificial Sequence: Synthetic coding sequence
atgtccttcatctttgaatggatctacaacggcttctcatctgtactgcagttcttaggactgtacaagaagtctggaaagctggtttttctggggttggacaacgctggcaaaacgactctgctccacatgttgaaggatgatcgcctcggccagcacgttcctaccttacatcccacttccgaagaactgactatcgcgggtatgacttttacgacctttgacctgggtggacatgagcaagccaggagggtttggaaaaattacctgcctgctatcaacggcattgtgttcctggttgattgcgccgaccactcgcgactggtggaatctaaggtagagttaaatgcactcatgaccgatgagaccattagtaacgtgcccatattgatcctcggcaacaaaattgaccggacagatgcaatttcagaggagaagctgcgggagatcttcggcctgtatggccaaacgaccggcaaagggaatgtgaccctcaaagagttgaacgctcggcccatggaggtctttatgtgctctgtgctcaagcgccaaggctacggtgaaggattcaggtggttgagccagtatatcgactag

SEQ ID NO: 133427 - DNA, 597 bp, Artificial Sequence
  Description of Artificial Sequence: Synthetic coding sequence
atgtccttcatctttgagtggatttataacgggttctcatccgtgctgcagttcctgggcctttacaaaaagagcggcaaattggtatttctggggctagataacgccggaaagaccactctactgcacatgttgaaagacgatcgcctggggcaacatgtcccaacgcttcatccgacgagcgaagagcttacaattgctggtatgacctttaccaccttcgacctggggggtcacgagcaggctaggcgtgtgtggaagaattacctgccagccatcaatggcattgtgttcctggtcgattgcgccgatcattctagactggtggaatctaaagtggagctcaacgctcttatgaccgacgaaaccattagcaacgtgcccattctgatcctgggcaacaagattgatcgcaccgacgcaatctcagaggagaaactccgggagattttcggactgtacggacagaccactggcaagggcaatgtgaccctcaaggaactgaatgctcggccaatggaagtcttcatgtgcagtgtgctcaagcgccaaggttatggcgagggattccgttggcttagccaatacattgactag

SEQ ID NO: 133428 - DNA, 597 bp, Artificial Sequence
  Description of Artificial Sequence: Synthetic coding sequence
atgtcattcatctttgaatggatatacaatggcttttccagcgtcctgcagttcctggggctctacaaaaaaagcgggaagttggtgtttttgggcctcgataatgccggaaagacgacacttctgcacatgctgaaggatgatcggctgggccagcacgtgcccaccctgcaccctacgtccgaggaacttactattgcaggaatgacttttaccaccttcgacctcggcgggcatgagcaggctaggagggtgtggaagaattacctgccagcaattaacgggattgtgttcctcgtggactgcgctgatcactcccggcttgtcgagtctaaagtggaacttaatgctctaatgaccgacgaaacaattagcaatgtgcctattctaatcctggggaataagatcgatcggactgacgctatcagcgaagaaaagctgagggagatctttggactctacggccagaccacaggtaaaggtaatgtaacactcaaggagctgaatgctcggcctatggaggtgttcatgtgtagcgtcctcaagcgacaaggctatggagagggatttcggtggttgagtcagtatattgactag

SEQ ID NO: 133429 - DNA, 354 bp, Artificial Sequence
  Description of Artificial Sequence: Synthetic coding sequence
atgggtctctcgttttggtggaccgtccagattattttggccagctggaaccctaagctatccctgatgatctattgctcatccctgctaaccctggcacccaacgcattaatgacggatgagaccatttctaatgtgccaatactgattttagggaacaagatagatcgtacagacgctataagcgaagagaagttgcgcgaaatcttcggtctgtatggccagaccacaggcaagggcaacgttacactgaaggagctcaatgctcgccctatggaagtgtttatgtgctcggtccttaagcgccaaggatacggcgagggatttaggtggctctcccagtatatcgattag

SEQ ID NO: 133430 - DNA, 597 bp, Artificial Sequence
  Description of Artificial Sequence: Synthetic coding sequence
atgagtttcattttcgagtggatatacaatggcttttcctcagtgttacaattcctgggtctgtataaaaaatctgggaagctcgtgtttctgggtctggataatgccggaaagacaacgctgctgcatatgcttaaggacgacagattaggacaacatgtaccaacactgcaccctacatctgaagaattaaccattgcaggcatgacatttacgacctttgacttaggcggtcacgagcaggcacgacgcgtgtggaaaaactacttacccgcgattaacggcattgtgtttttggtggactgtgcagaccatagtcgcctggtggaatccaaggtagaactgaacgccctgatgacagacgaaacaattagcaacgtgccaatcctaatcctcggcaataagatagataggacagatgctatctccgaggaaaaactccgagagatctttggcctgtacgggcaaaccaccggaaagggaaatgtcacccttaaagagctcaacgccagacccatggaggtttttatgtgctctgtcctgaaacgtcaagggtacggggagggcttccggtggctgtctcagtatatcgattag

SEQ ID NO: 133431 - DNA, 348 bp, Artificial Sequence
  Description of Artificial Sequence: Synthetic coding sequence
tgatcattttggtggactgtgcagatcatcctggcctcctggaaccccaagctgtcactgatgatatattgttcctctcttcttaccctggctcccaacgctcttatgacagatgaaaccatctccaacgtccctatcctaattctgggaaataaaattgataggacggacgccattagcgaagagaaactgagggaaatcttcggattgtacggccagacaacaggaaagggcaacgtgactctaaaggagttaaatgctcggcccatggaagtgttcatgtgctctgtcctaaagagacagggatacggcgaggggttccgctggctgagccagtacatcgattag

SEQ ID NO: 133432 - DNA, 468 bp, Artificial Sequence
  Description of Artificial Sequence: Synthetic coding sequence
atgctgaaggatgatcggctcgggcaacatgttccaaccctgcaccccaccagcgaagaactgaccatagcaggtatgactttcacgacctttgacctgggtggccacgagcaggcacggcgagtgtggaaaaattaccttccagcaattaatggcattgtgtttctggtggactgtgccgaccactcacgccttgtggagagcaaggtggagttgaacgccctgatgaccgatgagactatcagcaacgtccctattttgattctaggcaataaaattgacagaaccgacgccatctcagaagagaaactaagggagatcttcggactatacggccagacaacaggcaagggaaacgttaccctgaaggaactaaacgctaggcctatggaggtgtttatgtgttccgtgctgaaacgtcagggctacggcgaaggatttagatggctttcgcagtacattgactag

SEQ ID NO: 133433 - DNA, 393 bp, Artificial Sequence
  Description of Artificial Sequence: Synthetic coding sequence
atgacattcactactttcgacttaggggggcacgtccaggccaggagagtgtggaaaaattacctgccggctattaatggcattgtgttccttgttgattgtgccgaccacgaaagactgttagagtccaaggaggagctagattctttgatgacagatgagaccatcgccaacgtacctatattgatcctgggcaacaagattgacagacccgaggcaatctcagaggagcggctgagagagatgtttggcttgtacggtcagactaccggcaagggcagcatttcccttaaggagttgaatgcgagaccccttgaggtttttatgtgcagtgtgctgaagcgacaaggctatggggaaggatttcggtggatggcccagtacatcgattag

SEQ ID NO: 133434 - DNA, 597 bp, Artificial Sequence
  Description of Artificial Sequence: Synthetic coding sequence
atgagttttatattcgattggatatactcagggttttcctcagtgttacagtttctcgggctgtacaaaaagacgggtaagttagtctttctgggccttgacaatgccggaaagacaactctcttacacatgctgaaagatgataggctgggccaacacgtgccaaccttgcaccccacttctgaggagttgaccattgccggcatgacattcacaaccttcgacttaggtgggcacgtccaggccaggcgcgtgtggaagaattatctcccggctattaatggaattgtttttctcgtggattgcgctgatcacgagcgcctgttggaatctaaagaggagcttgatagcctgatgaccgacgagaccattgcaaacgtgcccatcctgatcctggggaataaaatagaccgcccagaagcgattagtgaagagcggcttcgcgagatgttcggattgtatggacaaaccacaggaaagggctccatttctctcaaggaattaaatgcacgccccctggaagtcttcatgtgctctgtgctgaaacggcagggctatggggagggctttcggtggatggcacaatacattgattag

SEQ ID NO: 133435 - DNA, 597 bp, Artificial Sequence
  Description of Artificial Sequence: Synthetic coding sequence
atgtctttcatctttgactggatctacagcggcttctcgtctgtcttgcagtttcttgggctttataagaaaaccggaaagctagtgtttctgggtttggataacgccggaaagacaaccctcctccacatgctcaaagacgaccgactgggacaacacgtccccaccctccaccctacaagcgaggaattgaccatcgccggaatgacgttcacgacgttcgacctcggaggacacgtgcaggcccgacgggtgtggaagaactacctcccagccattaacgggatcgttttcctggtcgactgtgctgatcatgagcggctgcttgaaagtaaagaagagctcgacagcctgatgactgacgagaccatagccaatgtgccaatactgatactgggtaataagatcgatagacccgaagcaatcagcgaagaacggctccgcgagatgtttggactgtacggccaaaccacaggaaaggggagcatttccttaaaggaattgaacgccaggccattggaggtgttcatgtgctccgttctgaaacgccagggctacggggaaggattcaggtggatggctcagtatatcgactag

SEQ ID NO: 133436 - DNA, 312 bp, Artificial Sequence
  Description of Artificial Sequence: Synthetic coding sequence
atgtcattcatcttcgattggatctatagtgggttcagtagcgtcctgcagtttttggggttatacaaaaagaccggcaaactggtgtttcttggccttgataacgctggcaagaccaccctgctccatatgctgaaggacgacaggctgggccagcatgtccctacactgcaccccacatcagaggaacttaccatcgccggcatgaccttcacaaccttcgatttgggggggcacgttcaagctaggagggtttggaaaaactacctaccagcaatcaatggcatcgtgtttcttgtggattgcgcctag

SEQ ID NO: 133437 - DNA, 393 bp, Artificial Sequence
  Description of Artificial Sequence: Synthetic coding sequence
atgacgttcacaacctttgatttaggggggcatgttcaggcccgccgcgtttggaagaactaccttccggcgataaacggtattgtgttcttagtggactgcgccgaccatgaaaggttgctcgagtcaaaggaggaattggactctctgatgacagacgagactatcgccaatgtacctatcctgattcttggcaacaagatcgaccggccagaggcaatctcagaagaacgtctgcgggaaatgtttggactgtatggtcaaaccacaggcaaagggtccatcagtcttaaggagctaaacgccaggccattggaagttttcatgtgtagcgtcctgaagagacagggatacggcgagggatttcgatggatggcacagtatatcgactag

SEQ ID NO: 133438 - DNA, 513 bp, Artificial Sequence
  Description of Artificial Sequence: Synthetic coding sequence
atgtccttcatctttgactggatatactccggattctccagtgtcttgcaattcctcggtttgtataagaaaacaggaaagttagtgttcctaggcctcgacaatgcaggtaaaaccacactgctgcacatgttaaaagacgatagattaggccagcacgtgcctactcttcatcccacctctgaggaattgaccattgctggaatgaccttcaccacgttcgacctgggcgggcatgtgcaggcgaggcgcgtatggaaaaattacctgcctgctataaacgggatcgttttcctggttgactgcgccgatcacgagagactccttgaaagtaaggaggaacttgattctttgatgacagacgagaccatcgccaacgtcccgattctgatactcggtaacaaaatcgatagacccgaagctatctcggaggagaggctgagagaaatgttcggactgtatggccagaccactggaaagggctcaatcagcctcaaggagctgaatgcctag

SEQ ID NO: 133439 - DNA, 393 bp, Artificial Sequence
  Description of Artificial Sequence: Synthetic coding sequence
atgacattcaccacatttgacctgggcgggcatgttcaggcccgtagagtatggaaaaattacctaccagcaattaacgggatcgtttttcttgttgactgcgcggaccacgaaaggctgcttgaatctaaagaagagctcgactctttgatgaccgacgaaactattgcaaacgtgccaattctcattctcggaaataaaattgatcgccctgaggcaatctctgaggagagactcagggagatgtttgggttgtacgggcagacaactgggaaaggtagcatcagtcttaaggagctgaacgcaaggcctttggaggtttttatgtgcagcgtattgaaacggcaggggtatggtgaaggtttccggtggatggctcaatacattgattag

SEQ ID NO: 133440 - DNA, 393 bp, Artificial Sequence
  Description of Artificial Sequence: Synthetic coding sequence
atgacatttacgacgtttgatctgggggggcatgtccaggctcgacgggtctggaaaaactatctgcccgctattaacggaatcgtgttccttgtggattgtgccgaccacgaaagactgctggagagcaaggaggagctcgacagtcttatgacagacgagaccatcgccaacgtgcctatcctgatactcggcaataagatcgacaggcccgaggccatctctgaagaacgcctgagagaaatgttcgggctgtacggccaaacgaccgggaaaggatcaatatccctgaaagagctaaatgccagacctctagaggtgtttatgtgctcagtgttaaagcgtcagggatatggagagggttttaggtggatggcacagtacatcgactag

SEQ ID NO: 133441 - DNA, 2796 bp, Artificial Sequence
  Description of Artificial Sequence: Synthetic coding sequence
atgcgagccttagttttgctcggctgtctgctggcaagtcttttgttcagtggacaggccgaactgcaggtctcagcgagtggcgggactgaggatgtgggaaatctcttagagaaccattttagcgcaggggatgcgtccctcgaggagaaagagagagccctctacgcagataccgccccccaagacaaaaagctgctcctccactacccagacggacgtgaagctgaatctcccaaaaagacacctgctagtgccgccagtgccgggccggacccggaagcgagcctttcaaatgcttctgctacagagagtcctccgcctggagagcgagacgatcgagatgccgcgggtccaggtgaagagaaaaatggcccccccgtggcttctgcattacctcctggtggggcaaaagggcccgtggaggaagaatggcctgaacctagtagcggagaaggccaaggcgaggaagaaactggctttggactccctactgaggggacagcttctggcgaggctgggggtcaggcaggggggcatgagttaccagaagaggtgcaagaggtccagggagatagcttagttcagggagctgttgccggcactgcagagcccaaagccgagggcgcaagcccacattccgagggagatggcgtcggacccctgaatgccgaggccgagggttctcctggtcctggcgaagaacctgccgtacccgagggcgcacctgacgtagcggccgtaggtggagaatccgaaccagacatcgatactcaggccagcgagggcaccgaagatcagggcgagccaggacctgcagccgaggcgtcagcagaacccggcggtgcccagagcgtcaaggccggcgataccgaggagaaccagtcaccggaaatgacagaagaggatgccgacgaagcttcctccgaggaggaatcaggcgacggcagtggatccgaggaagaggggggcgtgccttccgaagaggagtctgaagaggacagcggagatggcgccagctcagaggaagccgaaggcgccagcgaggaagctaccgagccccaagaggcaggagagccccaggaggcacgtgaaccacaagaggggggggatctgcaggaagctgaggaatctcaagagggtggcgatccccaagaggcggaggagcctcaggagggaggtgcaccacaggaggggggcgaacctcaggagggcggggatccccaagaggcaagggaaccccaggaggctagggagccccaagagggggccgagcttcccgaagccaccggcaccacaagccatagggacaggggtgcccaaccgggtccggaggagctaaacacggagagcatgggctccgagacactggatatgaaagcagaagagccagaagaaggacatcaacgtgagagccctattattgtggcccaggaggaaacagaggatgcaaacgaggaggcgcccttgagagatcgctcccatattgagaagaccctgatgctgaacgaagacaagccctccgatgattactctgccgtgctgcagcggctgcggaaaatctatcactcaagcattaaacctctcgagcagtcctacaagtataacgagctgcgccagcacgaaatcaccgacggcgagatcacatccaaaccgatggtactgtttctgggtccgtggtccgtaggaaaaagtacaatgattaattacctccttggcttagaaaacactcggtatcagctgtacaccggagccgagcccaccacctcagagtttactgtgctgatgcatggcccgaaactgaaaacaattgagggcatagtgatggcggcggactccgcaaggtcttttagcccactggagaaatttggccagaatttcctcgaaaagctgattggaattgaagtaccacataagcttttggaacgcgttacattcgtagatacgccaggcatcatcgaaaaccgcaagcagcaggagagaggttatcccttcaatgacgtttgccagtggttcatcgatcgggcagatctcattttcgtggtcttcgaccctacgaaactcgacgtgggattagagttggagatgctttttcggcagctcaagggccgggagagccaaattcgcatcattcttaacaaagccgacaatcttgcaacccagatgctgatgcgcgtctacggtgccttgttttggtccctggcaccactcattaatgtaaccgagccacctagagtttacgtgagcagcttctggccacaagaatataaacctgatacacatcaggagctcttcctacaggaggaaatctcccttttggaggatctgaatcaggtgattgagaaccgcctcgaaaacaagatcgcctttatccgacagcatgcaattagggtgcgcattcatgcgctgctggtggaccgataccttcagacatacaaggacaagatgacattcttctctgatggcgagttggtatttaaagacatagtcgaggatcctgacaagttttatattttcaaaacaatcctcgccaaaactaacgtcagtaaatttgacctgcccaaccgggaggcgtataaagacttttttggaatcaatcccatatcgagttttaagctgctgtctcagcagtgttcttacatggggggctgtttccttgaaaagatagaacgcgctatcacgcaggagctccccggactattggggagcttagggcttgggaaaaacccgggtgctctgaactgcgacaaaacggggtgctcagagacgcccaagaatcggtataggaaacactag

SEQ ID NO: 133442 - DNA, 1422 bp, Artificial Sequence
  Description of Artificial Sequence: Synthetic coding sequence
atgcgggcgttggttctgctcggatgcctcctggcatctttgctgtttagtggacaggcagaggagacagaggacgccaatgaagaagctcctcttcgagataggtcccacatcgagaaaactctaatgctgaacgaggataagccctcagacgactatagtgcagttctgcagagacttcgcaagatataccactcctctatcaagccgttggagcaatcttacaagtacaacgaactgcgccaacacgaaattactgacggagaaattacaagtaaacccatggtgctgtttctgggtccttggagcgtgggtaagagcacaatgatcaactatttgttaggcctggagaataccagataccaactgtacacaggtgcagaaccaactacgagtgaattcaccgtgctaatgcacggacctaaattaaaaactatagaaggtatagtaatggccgccgattctgcaaggtctttctccccattagaaaagttcgggcagaacttcttagagaagctcatcgggattgaagtgccacacaagctgctggagagagtgacattcgtggatacacctggcatcattgagaatcggaaacagcaagagagaggctatccctttaatgacgtgtgccaatggtttattgatagggccgatttaatcttcgttgtctttgatcccactaagctagatgtaggcctggagttagaaatgctctttagacagttgaaagggcgagaaagccagatcagaattattcttaacaaagccgacaacctggcaacacaaatgttgatgagggtgtacggggctctgttttggagcctcgcacctctgatcaatgtcacggagcctccaagggtctatgtgagttctttctggccacaagagtataagccagacacacaccaagaactgttcctgcaggaggagatatccctgctggaggatctgaatcaggtcatcgagaaccgccttgaaaataagattgcattcatcaggcagcacgccatacgagtgcgcattcatgccttgctggtggacaggtatctacaaacatataaagacaagatgactttctttagcgacggggagctcgtctttaaggacatagtcgaagacccggataagttctatatctttaaaacaatactagcgaagacgaacgttagcaagttcgatttgccaaacagggaggcatacaaggactttttcggaataaatcccatctctagtttcaagctcctctcccagcaatgcagttacatgggaggctgttttctcgaaaaaattgagcgggcgattactcaggagctgcctgggttgttagggtctcttggactgggtaagaatcctggagccttgaactgtgacaagacaggctgctcagagacgccaaaaaaccggtatcgcaagcattag

SEQ ID NO: 133443 - DNA, 1296 bp, Artificial Sequence
  Description of Artificial Sequence: Synthetic coding sequence
atgctgaacgaagacaaacccagcgacgattactccgccgttcttcaaagacttcgaaaaatctatcattcatctatcaaacccctagaacagtcttacaaatacaatgagctgcggcaacatgaaattactgatggagagatcactagtaaacctatggtgctctttctgggaccctggagtgtcggcaaatcaactatgattaactacttattgggactggaaaacacgagatatcagctgtacaccggagcagagcctaccactagcgagtttaccgtgttgatgcatggtcccaaactgaagacaatcgaaggaatcgtgatggctgccgatagcgcaaggagcttttcacccttggaaaagttcggccagaatttcttagaaaagttgatcggcattgaagttccccacaagctgctggagcgggtcaccttcgttgacacccctggcataattgagaatagaaagcagcaggagcgcggatatccgttcaacgacgtctgccagtggttcatcgacagggcagatttgatcttcgtggtatttgatcccaccaagctggatgtgggtcttgaattggagatgctgtttcgtcagctcaaggggcgtgagtcacagattaggatcatcttgaataaagccgacaatctcgctacacagatgctcatgagggtgtacggcgccctcttttggtcactagcgccccttataaacgtcaccgagcctccccgggtctatgtaagctcattctggccacaggaatacaaaccggacactcatcaggagctgtttctgcaggaagagatctctttgttggaggacctgaatcaggtgattgaaaatcgcttggagaacaaaatcgccttcatccggcagcacgcaatccgcgtacgcatccacgctctgttggtggatagatatttgcagacctataaagataagatgacctttttcagcgatggagagctcgtctttaaagatattgtagaggatcctgacaagttctatattttcaaaaccattcttgcaaaaaccaatgtgagcaaatttgacctgcccaatagggaagcctataaagacttcttcgggattaatcccatcagttcctttaaattgctatctcagcagtgcagctatatgggcggatgctttcttgaaaaaatcgaacgtgccatcacacaggagctgcctgggctcctgggcagcctggggctcggaaaaaatccaggtgcacttaactgtgacaaaactggctgctctgagacccccaagaataggtaccggaaacattag

SEQ ID NO: 133444 - DNA, 1164 bp, Artificial Sequence
  Description of Artificial Sequence: Synthetic coding sequence
atggctgaaaccttgttctggactccattgctggtggtactccttgctggtctcggtgacacagaagctcagcagaccactctccatcctttggttggccgggtcttcgttcacacactggaccatgagacgtttctctcactgcccgagcacgtggctgtgccacccgccgtgcatattacttatcacgcccacttacaaggccacccggacctcccccgttggcttcgttacacacagagatcacctcaccaccctggcttcttgtatgggtccgcaacccccgaagatcgcggcctgcaggtgatcgaggttacggcttacaatcgagacagttttgatacgacaagacaaaggttagttttggagattggcgaccccgagggtcctcttctaccgtaccaagccgagttccttgtgagatcgcatgacgcggaagaggtcctgccttccacacccgctagccgattcttgagtgcactaggcggactttgggagccaggggagctgcaattgctaaacgtcacgtccgcacttgatcgtggcgggcgggtgccgttgcccatagaaggtcgaaaagaaggagtctatatcaaggtcggcagcgcaagccccttttcaacttgtctcaagatggtggcctctcccgactcccacgctagatgcgcccaggggcaacctccactgctctcctgttatgatactctcgcaccccatttcagggtggattggtgcaatgtgactctggttgacaagtcagtgcctgagcccgcggacgaggttcccactccaggagacggaatcctggaacatgatcctttcttctgtcctcccacagaggcgcccgatcgtgactttttggtcgatgccctcgttacgttgctggtcccactcctcgtagccttgttattgaccctgttgcttgcctacgtaatgtgttgccggcgggaagggaggctcaagagagatctagctacctctgacatacagatggtgcaccactgtacgattcatggaaacacagaagagctccgacaaatggccgcatcaagggaggtgcccagacccttatctacactgcctatgtttaacgtgcacactggcgagagactgccaccccgagtcgactctgctcaggtacccctgatcctcgaccagcactag

SEQ ID NO: 133445 - DNA, 792 bp, Artificial Sequence
  Description of Artificial Sequence: Synthetic coding sequence
atggctgaaactttgttctggactcccttgttggtagtccttctagccggcctgggcgacacagaagctcagcagacaacactccaccctctggttgggcgggtgttcgttcatactcttgatcatgaaacttttctctccttgcccgagcatgttgctgtgccacccgccgtgcacataacataccatgcacatctccagggacacccagacctgccacgctggttgaggtacacacagaggagcccccatcatcccggctttctttacggctcggcgacaccggaagatcgggggctgcaagtgattgaggttaccgcgtacaatcgggactcctttgatacaacacggcagcgcttggtgctagaaattggcgaccccgagggcccacttctgccctaccaggctgagtttcttgtgcggtcccatgatgccgaggaagtgctgccttccacaccagcttcgcggttcctgagcgctttgggtggcctgtgggagccaggagagcttcaattgttaaacgtcaccagcgccttagaccgaggagggcgcgtacctctgcccattgagggccgtaaggaaggcctgaagagggatctcgccacatctgacattcagatggtgcaccattgtaccatacatgggaacaccgaagagctgcgccagatggctgctagtagagaggtcccaagacccctgtccactctcccaatgttcaacgtccacacaggagagaggctacctcctcgagtggattctgctcaggttcctcttattttggaccagcactag

SEQ ID NO: 133446 - DNA, 537 bp, Artificial Sequence
  Description of Artificial Sequence: Synthetic coding sequence
atgtctgtgacagcttacaaccgcgactctttcgataccactcgccaacggctggtgctggagattggagaccctgagggacccctgcttccctatcaggccgaatttctggtgcgctctcacgatgccgaagaggtgctccctagcactccagcctcacgcttcttaagcgccctgggaggcttgtgggagccgggcgagttacagctcctcaacgttacttccgcacttgaccgcggagggagggttcctttacccatcgagggtcggaaggagggcgtgtacatcaaggtcggatccgcttccccgttcagtacgtgcttgaagatggtggcctcacctgacagtcatgccaggtgcgcacagggacagcctccgctgctgtcatgctatgacactctggcgccacacttccgagtagattggtgcaacgtgaccctggttcggagggatccaggaagcggcggtggggttggtcatggtcctcacccaagtcctcccagtttgccctgttgtttccttagcccgagtctgtag

SEQ ID NO: 133447 - DNA, 792 bp, Artificial Sequence
  Description of Artificial Sequence: Synthetic coding sequence
atggcagaaactttattctggacacccctgttagtcgttcttctggcagggcttggggacaccgaggcacaacagaccacactccatcctcttgtggggcgcgtctttgtccacacactggaccacgaaacatttttgtccctgccagagcacgtagccgtgccgcccgctgtgcatatcacataccacgcgcatctgcaagggcacccagatttgcctcgatggttgcgctacacacagaggagtccacatcatcctgggtttctttacggaagcgccacacccgaggacagaggactacaggtgatcgaggtgacagcctacaacagagattcattcgacaccacccgccagcgcctggtcctggaaatcggggatcccgaaggcccactcttgccataccaggccgagttcctcgtcagaagccacgacgccgaagaggttcttccctctacaccagcatctagattcttatcagccctcgggggtctttgggagccaggcgagttgcagctgcttaacgttacctcggccctggatcgtggggggcgcgtgcccctccctatcgagggtaggaaggaggtgcttctcaggcacttagggactcccttaatccaaatggtccatcactgcaccattcatggaaatactgaggagctgagacagatggctgcctcccgagaagtcccccggccactctccaccctaccgatgtttaacgttcacacgggtgagcgcttacctcccagggttgattccgcgcaggtgccccttatattggatcaacactag

SEQ ID NO: 133448 - DNA, 957 bp, Artificial Sequence
  Description of Artificial Sequence: Synthetic coding sequence
atggccgctgctgctgctgctgccgccgaacagcagtcttcaaacgggccagtgaaaaaatcgatgcgggagaaagccgtggaacgaaggtcagtcaataaggaacacaattcgaacttcaaggcaggatacattcccattgacgaagaccgactccacaagactgggctgagaggtcggaagggcaacctcgcaatctgcgtgatcatactactgttcatcctggctgtcatcaatctgatcatcactctggttatttgggccgtgatccggattggccccaacggatgcgattctatggaatttcatgagagtgggctcctgcgattcaagcaggtctcagatatgggagtgatccatccgctgtacaaatcaactgtcggcggtcgaagaaatgagaatctggtcatcactggaaataatcagcccatcgtgttccagcaagggaccacaaaacttagcgtcgaaaataacaagaccagcatcacttcagacatagggatgcagttcttcgatccaagaacccagaatatcctgtttagcacagactacgagacgcacgagtttcacttaccgtctggggtcaaaagcctgaacgtacagaaggcttctactgagagaataactagtaatgccacatcggatcttaatatcaaagtagatgggcgagccatcgtgcgaggcaacgaaggcgtctttatcatgggcaaaacaattgaatttcatatgggaggcaatatggaactgaaagctgaaaattccattatcctgaacggaagcgtgatggtatcaacaacgaggctcccttccagttctagcggcgatcagctgggcagtggcgattgggtgagatataagctctgcatgtgcgcagatggcacgcttttcaaagtgcaagtgacatctcagaatatgggatgtcagatttcagacaatccctgtgggaacacccattag

SEQ ID NO: 133449 - DNA, 747 bp, Artificial Sequence
  Description of Artificial Sequence: Synthetic coding sequence
atggcagccgcagcagccgccgcagccgaacaaatcaccctcgtgatttgggcagttatcagaataggcccaaatgggtgcgatagcatggagtttcatgagagtgggctactgcggtttaagcaggtgagtgatatgggggttattcatcctctttataaatctaccgttggaggtcgacgaaacgagaaccttgtgatcaccggcaataaccagcccatcgtgttccagcagggaacaactaaactcagcgtggagaacaacaaaaccagtattacatcagacattgggatgcaattttttgacccccgcacccagaacatcctcttctctacagattatgagacacacgagttccacttgcccagtggcgtcaagtctctcaacgtccagaaggcctctactgaacggatcacttccaatgccaccagcgatctaaatatcaaagtggacggtcgcgcaattgtccgtggtaatgagggagtcttcattatgggaaaaactatagagtttcatatgggcggcaacatggaattaaaggcggagaattcaattatcctgaacgggagcgtgatggtctctactactcggctcccgagctcgagctccggcgatcagctgggatctggagattgggttcgctacaagctctgcatgtgcgcagatggtaccttgttcaaggttcaagttacctcacagaacatgggatgccaaattagtgataatccctgcggtaatactcattag

SEQ ID NO: 133450 - DNA, 873 bp, Artificial Sequence
  Description of Artificial Sequence: Synthetic coding sequence
atgatgcctcaggaacagtacacgcaccatcggagcactatgccaggcagcgtcggcccacaagtttataaggtggggatctatggctggaggaagcgatgcctgtatttctttgtgctgctcctcatgattctaatccttgttaatctggctatgacgatatggatcctgaaggtaatgaatttcaccatcgacggcatgggcaatctgcgcattacagagaagggactgaagctggaaggtgattctgagttcctgcagccgctttacgcgaaagagatccagtccagaccagggaacgccctgtacttcaaatccgcgcgaaacgttactgtcaacatcttgaatgatcagaccaaagtgctgacacaactgataacagggcccaaggctgtggaggcttatggaaaaaagttcgaggtgaagactgtcagcggaaagctgctgttcagcgcagataacaacgaggtggttgttggagctgaacggcttcgcgttctgggagccgagggaacagtattccccaaatcaattgaaactccgaatgtgagagcagatcccttcaaggagctccgactggaaagccctacccgatctcttgtcatggaggctcccaaaggcgtggaaatcaacgctgaagcgggaaatatggaggccacatgtaggactgagctccgcttggagtctaaggatggggagatcaaactggatgcagcgaaaatcagacttcccaggctgccccacggaagttacacccccaccgggacaagacagaaggtttttgaaatctgcgtgtgcgctaatggccgactgttcctgagtcaggccggagcaggctctacgtgccagattaatactagtgtgtgcttgtag

SEQ ID NO: 133451 - DNA, 870 bp, Artificial Sequence
  Description of Artificial Sequence: Synthetic coding sequence
atgccacaggaacagtacacgcaccaccggtctacgatgcccggaagtgtaggcccccaggtgtacaaggtgggaatttatgggtggcggaagaggtgtctctactttttcgtgctcttgctcatgattctgatactcgtgaacctagccatgaccatctggatcctcaaagtaatgaactttaccatagacgggatgggtaatttgagaattacagagaagggactgaagctcgaaggcgatagcgaattcttacagcctctgtacgccaaggaaatccagagccgacctggaaacgccctgtactttaaatctgccaggaacgttacagtaaatatcctgaacgatcagactaaggtgctgacccagcttatcacaggcccaaaagcagttgaagcctatggcaagaaatttgaggtaaaaacggtgtccggcaaactgctcttttccgccgataataatgaggtcgtcgtgggggccgaaaggttaagggtcttaggggcggaggggaccgtgttcccaaaaagtatcgagactcctaacgtccgggccgatcccttcaaggagctcaggctcgaatcccccacccgctctttagttatggaagctccaaagggtgtggagatcaatgccgaggccggcaacatggaagccacctgtcggacagagctccggctggagtcaaaagatggggaaatcaagcttgatgcagcaaaaattcggctgcctcgtcttcctcacggctcgtacactcccaccggcaccagacagaaggtctttgagatctgtgtatgcgctaatggcaggctgtttttgtcccaggctggggcagggtccacctgtcagatcaatacatctgtgtgtctatag

SEQ ID NO: 133452 - DNA, 771 bp, Artificial Sequence
  Description of Artificial Sequence: Synthetic coding sequence
atgatgccccaggaacagtatacacaccaccgcagcacaatgccgggtagcgtgggtccgcaggtgtacaaagtagggatatatgggtggcgcaaacgctgcctctactttttcgttctgctgctgatgattctgatactggtgaatttggcaatgacaatttggattctcaaggtcatgaatttcactattgatggcatgggcaacctgcggatcaccgaaaaagggctcaagcttgagggggacagcgagtttctgcaacctctgtatgccaaagagattcagagcaggccggggaatgcgctctatttcaaaagcgctaggaatgtgacggtgaacatcttgaatgatcagaccaaggtgctaacccagctaataacagggcctaaggcagtagaggcctacggaaaaaaatttgaggtgaagacagtatccggaaaactcttattttcggctgacaataatgaagtagttgtgggagccgagcgcttgcgagtgctcggcgctgagggtaccgtgtttcccaagtctatcgagacaccgaatgttcgggccgatccctttaaggagctacgcctggaatcacccacccggagtcttgtgatggaagcccctaaaggtgtggagattaacgcagaagcaggaaacatggaagccacttgtcgaacagagctgcgtctggagtctaaggatggagaggttcgagacgagaaagatcgttctagcaaaagctattcctttaaccgccccacacttccaattaccggatag

SEQ ID NO: 133453 - DNA, 771 bp, Artificial Sequence
  Description of Artificial Sequence: Synthetic coding sequence
atgatgccgcaggagcagtacacacaccacagatctaccatgcctggaagcgtagggccacaggtatacaaagtcggaatttacggctggagaaagcgatgtctgtacttcttcgttctgcttctgatgatcttgatcttggtgaatcttgctatgacaatctggatcctaaaagtgatgaactttaccatcgatggcatggggaatttacggatcaccgagaaaggcctcaaattagagggcgactccgaattcttacagcccctttacgccaaagaaatacaatcccggccgggtaacgctctatatttcaagtcagccagaaatgtcacagtaaatatcctaaacgaccagaccaaggtgctgacacagctgataacagggcccaaagctgtggaggcctacggcaagaaatttgaagtgaaaactgtcagcggcaaactccttttctccgctgataataacgaggtcgttgtaggcgctgaacgcctgagagttctaggtgcggaagggaccgttttccctaaatccattgagacacccaacgttcgcgccgacccctttaaggagttgcgcctggaaagccctacaagatccttggtaatggaagctccaaagggtgtcgaaatcaatgctgaggctgggaatatggaggctacttgccggactgaattaagactcgagtctaaggatggagaagttagagacgagaaggatcgatcctcaaaatcatactctttcaatcggcccactctgcctatcactgggtag

SEQ ID NO: 133454 - DNA, 1314 bp, Artificial Sequence
  Description of Artificial Sequence: Synthetic coding sequence
atgcagctcccgcggtggtgggaactgggggacccctgtgcctggactggccagggcaggggcaccagaagaatgagtcctgctacaacaggcacatttctgctgacagtttactccatcttctctaaggttcactcagatcggaacgtttacccatccgcaggcgtactgtttgtgcacgttctggagagggagtatttcaagggtgaatttcctccctacccgaagccaggcgagattagcaatgatccaattacttttaacacaaatctaatggggtacccggaccgccctggttggctgcggtacatccagagaacaccctactcggacggcgtgctgtacggctctcctaccgccgaaaacgtgggcaagcctacaataatcgagatcacggcgtacaatcgtcggacctttgagaccgcccggcataatctgattatcaatatcatgtcggctgaggatttcccattaccttatcaggctgaattctttattaagaatatgaatgtggaggagatgttagccagtgaggtgctgggtgatttcctcggcgccgtcaaaaacgtgtggcagccagaacgccttaacgccattaatatcacctcagcgctggaccggggcggtcgagttccactgcctattaatgatttgaaagagggagtgtatgtgatggtaggggccgatgtcccgttctcttcttgcctccgggaagtggagaaccctcagaaccagttgagatgcagccaggagatggaaccagtgattacctgcgacaagaaattccgaacacagttctacatagattggtgtaagatttctctggtggacaaaacgaagcaggtgagcacatatcaggaggtcatccgcggggaggggattctgcccgatggcggtgaatacaagcccccttcagactccctaaaaagtagggactattatacagactttctgattacccttgctgtacccagtgctgtggctctggtactcttcctcattttagcctacattatgtgctgcaggcgcgagggcgtagagaaacgaaacatgcagacaccagacattcagctggtgcaccactctgctatccagaagagcaccaaggaactccgggatatgtcgaaaaatcgagagatagcctggcctctgtctaccctgccggtgttccaccctgttacaggtgaaattataccccccctacacacagacaactacgactccacaaacatgccccttatgcaaacgcagcagaacttaccccatcaaactcagattcctcagcaacagacaactggcaagtggtacccttag

SEQ ID NO: 133455 - DNA, 1416 bp, Artificial Sequence
  Description of Artificial Sequence: Synthetic coding sequence
atgcagttgccccgatggtgggaactgggtgacccttgcgcatggactggacagggccggggaactagacgcatgtcaccagcaaccactggtaccttccttctcaccgctttcctgctcagctgcgcagacgggatcaatgggacagttaattggaagacccgccaagctaacaacttcatcatttcacgtaagatggccgccggcatgaaggacgtttacagtattttttccaaagtccactcggaccggaacgtctaccctagcgctggcgtcctcttcgtccatgtcctcgaacgagagtatttcaaaggggagttccctccctaccccaagccgggcgaaatttcaaatgaccccatcacatttaataccaatctaatgggttatcccgacagacccggctggcttagatatatccagcgaacaccctattctgacggggtgctctatggaagtccaactgccgagaatgttggcaagcctacaatcatagagattaccgcatataaccgtagaacttttgagaccgccagacataacctgataattaacattatgtctgcggaagatttccccctcccttaccaggccgagttctttatcaagaatatgaatgtcgaagagatgctcgccagcgaagttttgggggactttcttggtgctgtcaagaacgtttggcagccagaaagacttaacgccatcaatataacctctgctctggacagaggagggcgggtgccactccccatcaatgacctgaaagaaggggtgtatgtgatggtgggcgccgatgtccccttttccagttgtctgcgagaagtagagaatcctcagaaccagttacggtgctcccaggaaatggaacccgtgataacctgcgacaaaaaatttagaacacaattttatatcgactggtgcaagatctccttggttgataagacaaaacaggtgtccacctatcaggaagtgattaggggagagggcatattgccagatgggggtgagtacaaaccgcccagcgattccctaaagtccagagactattatacggacttcctgattaccctcgccgttccctccgccgtggccctggttctcttcctgatcctagcgtacattatgtgctgtcgacgtgaaggcgtggagaaacggaacatgcaaaccccagacattcagctggtgcaccattccgccattcaaaaatcaactaaggaactgcgtgatatgtccaagaaccgggagattgcgtggcctctctccactctgcccgtgttccatcccgtgactggcgagattattcccccattacacacggacaattatgactccaccaatatgcctctcatgcagactcaacagaaccttcctcaccagacacaaatcccacagcagcagactaccggggagtgttag

SEQ ID NO: 133456 - DNA, 1356 bp, Artificial Sequence
  Description of Artificial Sequence: Synthetic coding sequence
atgcagctgccaagatggtgggagctgggtgacccctgcgcttggacaggacaggggcgtggcaccagaagaatgagcccagcgacgacaggcaccttcctgcttaccgtttattcaatcttctcaaaagtgcatagtgaccgaaatgtgtaccccagtgcaggtgtgcttttcgtgcacgtgctggagcgtgaatattttaagggcgaatttcccccataccccaagcccggcgagatctcgaatgacccaatcacatttaacactaaccttatggggtatcccgaccggcctgggtggctgcgctacattcagcgcaccccatatagcgacggagtgttgtacgggagtcccacagccgaaaacgtaggcaaaccgaccatcatcgaaatcacagcctataaccgcagaaccttcgaaacagcccgtcataatcttatcattaacatcatgagcgccgaagactttcctctgccgtaccaggctgaatttttcatcaaaaatatgaatgtagaggaaatgctggccagcgaggtcttgggggactttctgggggccgttaagaacgtctggcagccggagcggctaaacgccatcaatatcacaagcgctttggatagagggggccgcgtgcctctgccaatcaatgatctaaaagagggcgtctacgtcatggtgggcgccgacgtaccattctcatcctgtctcagggaggtggaaaacccccagaatcagttgcggtgttctcaggaaatggaaccggtcattacatgtgacaaaaaatttagaacacagttctatatagattggtgtaaaatcagtctggtggacaagacgaaacaagtctcgacataccaggaagtgatacgtggagaaggcatcttaccggatggcggggagtacaagcctccttcagacagcttgaaatcgagagactactataccgacttccttattactttagctgtcccttcagccgtggctctggtgctgtttctcattcttgcctacatcatgtgttgcagaagagaaggggtgatccaactggtgcatcattcagccatccaaaaatctacaaaggagctacgggacatgtctaagaaccgggaaattgcatggccactttccacactgcctgtgtttcaccccgtgaccggggagattatcccacccctacataccgataattatgactccactaacatgcccctaatgcaaacccagcaaaatctaccacaccagacccagatcccccagcagcagacaaccggggactttcgtctgaccactttccaacggtttgaggtgaatggtattcctgaggaacgaaagctcacagaagccatgaatctgtag

SEQ ID NO: 133457 - DNA, 1389 bp, Artificial Sequence
  Description of Artificial Sequence: Synthetic coding sequence
atgcagctgcctagatggtgggaacttggggacccatgtgcttggactggtcagggcagaggtacgagacggatgagtcccgctacaaccgggactttcctgctgacagtatactcgatcttttctaaagtgcacagcgatcgcaacgtctatcccagcgcgggcgttctgtttgtgcacgtgctggagcgcgaatacttcaaaggagaattcccaccttatcccaaaccaggagagatatccaatgatcccattaccttcaacaccaacctcatggggtatcccgataggcccggttggctgaggtatattcaaaggactccatacagtgacggggtactatatggctcacccactgcggagaatgtcgggaagcccactataatagaaatcaccgcttataaccgtcgcacgtttgagaccgcccggcacaatctcatcatcaacatcatgtcggccgaagatttccctctcccttatcaggcggaattcttcattaaaaacatgaatgtggaggagatgcttgcgtccgaagtcctcggtgatttcttgggagctgtcaagaacgtctggcaacctgagcgcctcaatgcaatcaatataacaagcgcactggacagagggggccgagtgcctttgcccataaatgacctgaaggaaggcgtctacgtgatggtgggcgcggacgtaccattctcttcctgcctgcgagaggtggagaacccgcagaaccagctgagatgcagccaagagatggagccggtcatcacatgtgacaagaaattcaggacccagttctacatcgactggtgcaagatttcgctggtcgataagaccaaacaggtgagcacataccaggaggtgattcgcggagaaggtatcctgcctgacggcggtgaatataaacctccctccgactccttgaagtcccgggactattacaccgattttctgattaccttggctgtaccttcagccgtagcactggtactgtttttgattctggcctacatcatgtgctgccgccgtgaaggtgtggagaagcgtaatatgcaaactccagacatccagctggtccatcattccgctatccagaaaagcaccaaggagctgcgcgatatgagcaagaacagagagatcgcatggcccctctcaaccctgcctgttttccaccctgttaccggggaaatcatcccccccctccataccgataactatgactccacaaacatgcccctgatgcaaacccagcagtggagttttgccccagtggctcaagcaggagtccagtggagcgacctgggctcactgcaacccccgccccctcggaacctgccacaccagacacagatccctcagcaacaaaccactggaaagtggtacccatag

SEQ ID NO: 133458 - DNA, 2118 bp, Artificial Sequence
  Description of Artificial Sequence: Synthetic coding sequence
atgactgacaacagtaataaccaattggtggtacgcgcgaaatttaacttccagcagacgaacgaggacgaactctctttcagcaaaggcgatgtgatacatgttaccagagtggaagaaggcggctggtgggaaggaacgctgaatggccgaaccgggtggttcccctccaactacgtgcgtgaggtcaaggcatccgaaaagccggtcagtccaaagagtgggactttaaaatctccgcccaaaggctttgacactacagcgattaacaagtcttattataacgtggtcctgcaaaacatactggagacagaaaacgaatactctaaggaactgcagaccgtgttgtctacctacttgcgaccgttgcagaccagtgaaaaattgagttcggcaaatatctcctacctgatgggaaatttggaagagatttgtagtttccagcaaatgctagtacagtctctggaggaatgtactaagcttcccgaggcccagcagcgggtgggcggttgcttccttaatcttatgccccagatgaagacgctgtacctcacatactgtgccaatcatccttcagcagtgaacgttctaaccgagcactctgaggagcttggagagtttatggaaaccaagggcgcgagtagccccgggattttggtgctgacaactgggctttccaagccatttatgagactggataagtatcccaccttactgaaagagctcgaacggcatatggaagactaccatactgatagacaggacattcagaaatcaatggcagcatttaaaaacctctcagcccagtgccaggaagtccgcaagcggaaagagcttgagttacagattttaactgaagccatacgcaattgggaaggcgatgacataaaaacactcggcaacgtcacgtatatgtctcaggtgttgatccagtgtgccgggtcagaggaaaaaaacgaaagatacctgttattgttcccaaatgtgctattgatgctttccgcttctccaagaatgtccggtttcatctatcagggtaagttaccaacaactggaatgacaatcacgaagctcgaggatagcgaaaatcataggaacgcctttgaaatcagcgggtcaatgattgagcggattttagtctcttgtaacaaccagcaggatctacaggaatgggtagaacacctgcagaagcagaccaaggtcacatccgtcgggaatccaactatcaaacctcactcagtgcctagtcacacccttcctagccatcctgtcaccccatcgtccaaacacgcagacagtaagcccgctccacttactcctgcataccacaccttaccccacccttcacaccacggaacgcctcacactacaatcaactgggggccattggagcctcctaaaacccccaagccctggagtctctcctgcctgcgccctgcccctcccttacgtccgagtgcggcgctgtgttataaagaggacctgtccaaatctcctaagactatgaaaaagctactgccaaagcggaaaccagaacgcaaacccagcgatgaggagttcgcatccagaaagagcacagcagcactggaggaggacgcccaaatattaaaggtgatagaagcgtattgtacatccgccaaaacaagacagactctgaacagtacctggcaaggcaccgacctgatgcacaatcacgtgctcgcggacgatgaccagcccagtctggattccctgggcaggcgaagcagtctttcccgactcgagccatccgatctgtctgaagattcagactatgattctatctggacggctcattcatataggatggggagcaccagtcggtcaagaaaggagtctgccccacaagtcctacttcccgaagaggaaaaaatcatcgtggaagaaactaaatcaaacggccagacagtaattgaagagaagagtttggtggacaccgtttacgccctgaaagacgaggtgcaggagttgagacaggacaacaaaaagatgaaaaaatccctggaagaggagcagagagcaagaaaggaccttgagaagttagtgagaaaggtgttgaaaaacatgaacgaccctgcctgggacgaaactaatctctag

SEQ ID NO: 133459 - DNA, 876 bp, Artificial Sequence
  Description of Artificial Sequence: Synthetic coding sequence
atggttcgggaacagtacacaacggcaactgagggcatttgcattgaacgcccagaaaatcaatacgtttacaaaatcgggatttacggatggcgcaagcgatgcctgtacctattcgtcctcctactacttatcatcctcgtggttaatttggcgctcaccatttggatcctgaaagtgatgtggttttctcctgcagggatgggtcacctttgtgtgaccaaagacggcctacgcctcgaaggagagtccgaattcttgttccccctgtatgcaaaagaaattcactctcgcgtagattctagcttgcttctgcaaagtacgcagaatgttacggtaaatgcgagaaattcagagggcgaagtcaccggtcgcctgaaagtcgggcctaaaatggtggaggtccagaatcaacagttccagataaattccaatgatgggaagcctctgtttaccgtggacgaaaaggaagttgttgttggcactgataagttgagggtcactggacctgagggagccctgtttgaacattcggtcgagacacccctggtgcgtgccgaccctttccaggatctgagattggagtcccccaccagatctttatctatggacgctccacgcggcgtccacattcaggcacacgccggcaaaatcgaggcactgagtcagatggacattctctttcatagtagtgatgggatgctggtgcttgatgcggaaaccgtgtgtctgcctaagcttgttcaggggacatggggccccagcgggtctagtcaatcactctacgagatatgtgtatgccctgacgggaagctgtatttgtctgtcgcaggggtttcaacgacgtgtcaggagcataaccacatatgcctgtag

SEQ ID NO: 133460 - DNA, 876 bp, Artificial Sequence
  Description of Artificial Sequence: Synthetic coding sequence
atggttagggaacaatacacaacagcgactgaggggatttgcattgaaagacctgagaatcagtatgtctataagatcggtatttacggctggcgcaagcgctgtctttacctgtttgtgttgctcctcttgatcatcctggtcgtcaacctggctctaactatttggatcttaaaggtgatgtggttctcacctgctggtatggggcacctgtgtgtcaccaaggacggtttgcgattggagggcgaatcagagttcttgtttcccttatatgccaaggaaatccatagtcgggtcgatagctctttactgttgcaatctacccagaatgtcaccgtcaatgcacgaaacagtgaaggagaggttaccggccgcctcaaagtcggtccaaaaatggttgaggtgcaaaatcagcaattccagatcaactccaacgacggaaagcctctcttcacagttgacgagaaagaggtggtggtgggaactgacaaactacgggttacgggaccagagggagccctgtttgagcatagcgtggaaacccctctggttagagcagacccgttccaggatctgcgattggaaagcccaacaagatctctgagcatggatgcgcccagaggcgtccacatacaagcccacgcaggaaaaatcgaagcgttatcacaaatggacatcctgttccactcctcggatggcatgctggtgctggatgcagagactgtttgcctgccaaagctggttcaggggacatgggggccaagcggctcttctcagtctctgtatgaaatttgtgtgtgccccgacggtaaactgtacttgagcgtcgcaggggtgtcaaccacatgtcaagagcacaaccatatctgtctgtag

SEQ ID NO: 133461 - DNA, 96 bp, Artificial Sequence
  Description of Artificial Sequence: Synthetic coding sequence
atgggcattaatacgagagagctgtttctgaactttaccatcgtgctcattacggtcattctgatgtggcttctggttcgatcttatcagtattag

SEQ ID NO: 133462 - DNA, 96 bp, Artificial Sequence
  Description of Artificial Sequence: Synthetic coding sequence
atgggtatcaacactcgggagctcttcctgaatttcacaattgtactgatcaccgtcattctgatgtggctgctggtgaggagttaccagtactag

SEQ ID NO: 133463 - DNA, 96 bp, Artificial Sequence
  Description of Artificial Sequence: Synthetic coding sequence
atgggcataaatactcgcgagctcttcctcaactttacaattgttctcattactgtaattctgatgtggctgctcgttcgtagctaccagtactag

SEQ ID NO: 133464 - DNA, 732 bp, Artificial Sequence
  Description of Artificial Sequence: Synthetic coding sequence
atggggaaaaataaacaacctcgcggccagcagaggcagggcggtccaccagctgcagatgctgcaggaccggacgacatggagccgaagaaaggtaccggggcccccaaagagtgcggcgaggaagagcctagaacatgttgcggctgccggttccccctcctgcttgccttactccagctagcattaggtattgccgtgacagtggtgggatttcttatggcgtctataagtagttccctgctggttagagatacccccttctgggcagggattattgtctgcctcgttgcctatctcggcttattcatgctgtgcgtgtcctaccaagtcgacgagagaacatgcattcagttttccatgaagctcctgtacttcctgctctcggctctcggcctcaccgtgtgtgtgttggcagtcgcatttgcagcgcaccactacagccagctcacccagtttacttgtgagaccactttagacagctgtcagtgtaagctgcccagctctgagcccctttccaggaccttcgtttatcgggacgttactgattgcaccagcgtgaccggaacttttaaactgtttctactgattcagatgatcctcaatctggtgtgcggactcgtgtgcctgctcgcttgtttcgttatgtggaagcatcgctaccaggtgttctatgttggcgtgcgtatctgttctttgacagctagtgaggggccccaacagaaaatctag

SEQ ID NO: 133465 - DNA, 423 bp, Artificial Sequence
  Description of Artificial Sequence: Synthetic coding sequence
atgctgtgcgtgtcttatcaggtcgacgagcgaacctgcatacagttctctatgaaactactgtactttcttctttccgccctgggcttaactgtatgcgttctagctgtcgcctttgccgcacatcactattcccagttgacgcagtttacctgtgagactacactggatagctgccagtgcaagctgccgtcaagcgagcccctcagtcggacattcgtctaccgcgacgttacagactgcactagcgtgacaggaacattcaagctgtttctactgatccagatgatcctaaacctagtttgtggccttgtctgtcttcttgcatgctttgtcatgtggaaacatcgctaccaggtattctatgtgggagtgaggatttgctctcttacggcgagcgagggacctcaacagaagatttag

SEQ ID NO: 133466 - DNA, 654 bp, Artificial Sequence
  Description of Artificial Sequence: Synthetic coding sequence
atggaacctaagaagggcactggggctccaaaagaatgcggcgaggaggaaccccgaacttgttgtggttgccgattccctctcctgctagcattactccagctggccctggggatcgccgttacagtggttggctttctcatggctagtatttcctcatccctgctcgtgagggacacacccttctgggccggaattatagtctgtttggtagcctatctggggctgttcatgctgtgcgtgtcctatcaggtggatgagcggacttgtatccagttcagcatgaagctgctttatttcttacttagcgccctcgggctaacggtgtgtgtcctcgcagtggcctttgctgctcatcactactcccaattgacccagtttacttgtgagacaacactggattcttgtcagtgtaagcttcctagctctgagcctttatctcgcacgtttgtctatcgagacgtgacagactgcacgtcggtgaccggaactttcaaactttttctactcatccagatgatcctgaatctggtgtgcggcctggtctgtttactcgcatgctttgttatgtggaagcacaggtatcaggttttctatgtgggcgtgcgcatctgttcgcttaccgccagcgaagggcctcagcaaaaaatttag

SEQ ID NO: 133467 - DNA, 387 bp, Artificial Sequence
  Description of Artificial Sequence: Synthetic coding sequence
atgggtaagaacaagcagccacgggggcagcagcgccagggcggccctccggcagccgatgctgccggtccggatgacatggaacctaagaagggcacaggcgctccaaaggagtgcggagaagaggagccacggacctgctgtgggtgcaggttccccctgttattagccctgctgcagctggctttagggattgcagttaccgtcgtgggatttttgatggcttctatatccagttccctgctagtgagagatactcccttctgggctggaattatcgtgtgtctcgtagcttatctgggcctcttcatgctttgtgtgagctaccaggtcgacgaaagaacgtgcatccagttttctatgaaaatccattgccacgatttctag

SEQ ID NO: 133468 - DNA, 363 bp, Artificial Sequence
  Description of Artificial Sequence: Synthetic coding sequence
atgctgtgtgtgtcttaccaggtggacgaaagaacttgcattcaattctcaatgaaactgctctatttcctcctctcagcgttaggccttaccgtctgcgtgctcgcagtcgctttcgctgctcatcactatagccagcttacccaatttacttgtgaaactactctcgatagctgccagtgtaagttaccttccagcgagccactgtcaagaacctttgtataccgcgacgtgaccgattgtacaagtgtgaccgggacattcaagcttttcttgcttatccagatgattcttaatctggtttgtggcctggtgtgcctgctggcttgtttcgtgatgtggaaacatagataccaggtgtag

SEQ ID NO: 133469 - DNA, 423 bp, Artificial Sequence
  Description of Artificial Sequence: Synthetic coding sequence
atgttgtgcgtttcataccaggtggatgagcgtacatgtatccagttcagcatgaagctcctgtacttccttctgtcggccctcggccttaccgtctgcgtgttagccgtcgcctttgccgcccaccattattcacagcttacacagttcacatgcgagactacacttgattcttgtcagtgcaagctgccaagctctgaacctctctcccggacctttgtgtatcgggacgtcactgactgtacctcggtaaccggtactttcaagctgttcctgctgatccagatgatactcaatttagtctgtgggctcgtatgccttcttgcgtgcttcgtcatgtggaaacatcgataccaggtgttctatgtgggcgtcagaatctgtagcctcacggctagtgaagggccacagcagaaaatctag

SEQ ID NO: 133470 - DNA, 2292 bp, Artificial Sequence
  Description of Artificial Sequence: Synthetic coding sequence
atggatcacctgaatgaagcaacacagggcaaggaacactctgaaatgtcgaataatgtctctgaccctaagggccctcccgccaaaatcgctcggctggagcaaaatgggtccccactgggtagaggcaggctcgggagcaccggagccaagatgcagggtgtccctttgaagcattccggccatttgatgaaaactaaccttcggaaggggacaatgttgcccgtgttctgcgtggtggagcattatgagaacgccattgagtatgattgcaaggaggagcatgctgagttcgtccttgtccgaaaagatatgctgttcaatcagctcatcgagatggccctgctcagtctaggttatagccactcatcagcggcacaagccaaaggccttattcaggtagggaaatggaacccagtcccgctgtcctacgtcactgatgccccagacgccactgtggccgatatgctgcaggatgtgtaccatgtggttaccctgaaaattcaactacactcttgccctaaattagaggatttgccacctgagcagtggtcacataccactgtgcgaaacgcccttaaagacctcctcaaagacatgaaccagagctccctggccaaggaatgccctctgtcacagtctatgatcagctctatcgtaaactccacgtattacgctaacgtgagcgcagccaaatgtcaggagtttggccggtggtacaagcatttcaaaaagacaaaagatatgatggtcgagatggatagcctatctgaattgtcacagcaaggggcaaatcacgttaacttcggacagcagcccgttccaggcaatacggccgaacagccaccgagtcctgctcagctgtcacatgggtcgcagccatcagtgcgcacacccctgccgaatctgcatcctggactagtgagtacaccaattagtccccagctggtcaaccaacagctggtcatggctcaactgttaaaccagcagtatgccgtgaaccggctacttgcgcaacagtctttaaaccaacagtacttaaaccaccccccccctgtctcccgttctatgaacaagcctctggagcagcaggtcagcaccaacacagaagtatccagcgagatataccaatgggtgagagatgaactgaaaagagccggcatcagccaggccgtgttcgcacgcgtcgcgtttaataggactcagggcctgctgtccgaaatcttgcgaaaggaggaggacccgaagacggcctctcagagcctactggtgaatctgcgggccatgcaaaattttctacagctgcctgaagccgagagggaccgcatctatcaagatgaacgagaaagatcactcaatgctgcctcagctatgggtcccgccccccttatcagcacacctcctagtaggccgcctcaggtcaaaaccgccactatagccaccgagcgcaatggcaaacctgagaataacacaatgaacattaacgcttctatttacgacgaaattcagcaggagatgaaacgcgccaaggtcagccaagctctgttcgctaaggttgcagcaacaaaatcccaaggttggctgtgtgaacttctacgctggaaggaagaccccagccctgagaatagaaccctctgggagaatctgtctatgataagaagattcctcagcctcccccagcccgaaagagacgctatatacgaacaggagtcaaacgccgtgcatcatcatggagacagaccaccccacatcattcatgtgcctgccgaacagatccagcagcaacaacagcagcagcaacagcagcagcagcagcaacaggcgcccccacccccacagccccaacagcagccacagacgggacctaggctcccaccacgccagcccaccgtggcgtctcccgcagagagcgacgaagagaatagacaaaagacccggccgcggacgaagattagcgtggaggccctcgggattttgcagagtttcatacaggatgtaggtctatatcctgacgaggaggccatacagacgctgtctgcacagctggacctgcccaaatacaccataatcaagtttttccagaatcagcgatactacctgaagcaccacggcaaacttaaggataacagtggcttggaggtggacgtcgctgaatataaagaggaagagctgctcaaggatctggaagaaagcgttcaagacaaaaacaccaatacactgtttagcgtgaaactggaggaggagctctcagtcgaaggaaatacagatatcaatactgatcttaaagattag

SEQ ID NO: 133471 - DNA, 351 bp, Artificial Sequence
  Description of Artificial Sequence: Synthetic coding sequence
atggatcacctaaatgaagccacccagggtaaggaacactcagagatgtccaacaatgtgagcgaccccaaggggccacccgctaagattgcgaggcttgaacagaacggaagtcccctcgggcgggggagattggggagtacgggagcaaagatgcagggtgtgcctttgaagcactcaggacatctgatgaaaaccaatctgcgtaaaggtactatgctacccgtcttttgcgtagtagagcattatgaaaatgccatcgagtatgactgtaaagaggaacacgcagaatttgtccttgtcaggaaggacatgctgttcaaccagcttattgagatggcactcctgtag

SEQ ID NO: 133472 - DNA, 675 bp, Artificial Sequence
  Description of Artificial Sequence: Synthetic coding sequence
atggatcatttgaacgaggccacccagggaaaggaacactcggagatgagcaataacgtctccgaccccaagggcccacctgcaaagattgcccggctagaacagaatggctctcctctcgggcgaggtagactggggtcaaccggagcaaaaatgcagggcgtacccctgaaacactccggacaccttatgaaaaccaacctgcgtaaaggcacaatgctgccagtcttctgtgtagtcgaacactatgagaacgccattgagtatgactgtaaggaggaacatgctgaattcgtcctggtgcggaaagatatgttgttcaatcaactgatcgagatggccctcctgtcactgggctacagccatagctcagccgcccaggctaagggactcattcaggtaggtaaatggaaccccgtgcctctgagttacgtgaccgacgctcctgacgccaccgtggccgatatgctccaggacgtctatcacgtcgtgacattaaagattcagctgcactcttgtcccaaactcgaggatttacctccagagcagtggagccataccacggtccgcaacgcattgaaggatctcctgaaagacatgaaccaaagctcactggcaaaggagtgtccccttagccagagtatgatcagtagcatcgtgaattcaacatactag

SEQ ID NO: 133473 - DNA, 216 bp, Artificial Sequence
  Description of Artificial Sequence: Synthetic coding sequence
atggaccacctgaatgaagcaacccagggaaaggagcacagcgaaatgagcaacaacgtttctgatcctaaaggaccccccgctaagattgccagactggaacaaaacggatcgcccctgggacgcggcagactggggtctaccggggccaagatgcagggagtgcccttgaaacactccgggcacctcatgaaaacaaatctacggaaaggctag

SEQ ID NO: 133474 - DNA, 27 bp, Artificial Sequence
  Description of Artificial Sequence: Synthetic coding sequence
atggaccacctgaatgaggcgacctag

SEQ ID NO: 133475 - DNA, 519 bp, Artificial Sequence
  Description of Artificial Sequence: Synthetic coding sequence
atggaccacttgaatgaggcaactcagggcaaggaacacagtgagatgtcaaataatgtgtcagaccctaagggcccccccgccaaaatcgcaaggctggaacagaatggtagcccactgggccgaggccggctgggatccacgggagcaaagatgcagggagtgccactgaaacactccggccacctgatgaagaccaatctgcgcaaaggaaccatgctgccagttttctgcgtggtcgagcactatgagaacgccatagaatatgattgtaaagaagagcatgcagagttcgtcctggtccgcaaagacatgctgtttaaccagctgatcgaaatggcgctgttgtcattgggatattcacacagttcggctgcgcaggccaaggggctgatccaggtggggaagtggaatccggttcctctgagctatgtgactgacgctcctgacgccaccgtagccgacatgctgcaggatgtttaccatgttgtgacgctgaagatccagttacaccggtag

SEQ ID NO: 133476 - DNA, 2292 bp, Artificial Sequence
  Description of Artificial Sequence: Synthetic coding sequence
atggatcacttgaacgaagcgactcaaggaaaagagcattcagagatgtctaacaacgtttcagatcccaagggcccccccgcaaagatcgccaggcttgagcagaacggctctcctctgggacggggtcggttgggctccacaggagctaaaatgcaaggagtgcccttgaaacattccggacacttgatgaagaccaatctccgaaaggggaccatgctgcctgtgttctgtgtggttgaacattatgagaatgcaatcgagtatgattgtaaagaggaacacgccgagttcgtgttagttaggaaagacatgttgtttaaccagttaatcgagatggctttgctgtcactgggttactcgcacagtagtgcagcgcaagccaagggcctgattcaggtgggcaaatggaatccggtccccttatcctacgtgaccgacgccccagatgccacggtggcggacatgctgcaggatgtgtatcacgtggtgaccctgaagattcagctacactcatgccctaagctagaggacctgcctcctgagcagtggagtcacacgacagttaggaatgcactgaaggacctcctcaaggatatgaatcagtcctccttggccaaagagtgtcctttaagccagagcatgatctcctcgattgtcaacagcacttattacgcaaacgtgtccgccgcaaagtgtcaggaattcggacgctggtataagcactttaagaaaacaaaggacatgatggttgaaatggatagtctttcagaactgtctcagcaaggagctaaccacgtcaacttcggacagcagccggtccccggcaatacagccgagcaaccccctagtccagcccagctttcacatgggagccagccttctgtccgcaccccacttccaaatttacaccccggccttgtgagtacccccatttccccacaactagtgaatcagcagctagtgatggcgcagctcctgaatcagcagtacgccgtgaatcgcctacttgcccagcagagtcttaatcagcagtacctgaatcaccccccacctgtatcaaggagtatgaacaagcccttggaacagcaggtgtccacaaacaccgaggtatccagtgagatttatcagtgggtgcgcgacgagctcaagcgcgccggcataagccaggccgtgtttgctcgtgtcgcattcaacaggacacagggtttactgtctgagatattgaggaaagaggaagatccgaaaaccgcttcacagtctctcttggttaacctgcgtgccatgcaaaactttttgcaacttccggaggccgagagggatcgcatctaccaggacgagcgggagaggtccctgaatgctgcctctgctatgggtcctgcccccctgatctcaactccgccttccagaccccctcaagtgaagaccgcgaccatagcgactgaacgcaatgggaagcccgagaataacaccatgaacatcaacgccagcatttacgacgagatccagcaggaaatgaaacgggctaaagtcagccaggccctgttcgcaaaagtggcagctacgaagtctcagggctggctgtgcgagcttctcagatggaaggaggatccttcgcccgagaatcggacgctttgggagaatctcagtatgatcagaagatttctgtcacttccacagccagaacgggacgccatttatgaacaggaaagtaatgctgtgcatcatcatggcgatcgtcctccacacattattcatgtgccagccgagcagatccagcagcagcagcaacaacagcagcagcaacagcagcagcagcaggccccgccacccccgcagccacagcagcagccgcagacgggaccccgcctcccccctcgacaaccaactgtcgctagtcctgccgagagcgacgaggagaacagacagaagacacgcccacgcacaaagattagcgtggaagcactcggcatactgcagtcattcattcaagatgtgggtttgtacccagatgaggaggcaatccagacgctctccgctcagctcgaccttccaaaatacaccattattaagttttttcagaaccaaaggtactacctaaaacaccatggcaaattgaaggataactcaggcctggaggtcgatgtggcagaatacaaggaagaagaacttctgaaggatttggaggagtcggtgcaggacaagaacactaacactctgtttagcgtgaagctggaggaggaactcagcgttgaggggaataccgatattaatactgacctaaaggattag

SEQ ID NO: 133477 - DNA, 393 bp, Artificial Sequence
  Description of Artificial Sequence: Synthetic coding sequence
atggaccacctgaatgaggctacccaaggaaaagaacattctgaaatgtcaaacaatgtgagtgatcctaaaggcccaccagctaagatagcaaggttggagcagaacgggagtcccctgggccgcggtcgactggggtccaccggggccaagatgcaaggggtgccacttaagcattcaggccatctgatgaagaccaacctacgaaaagggaccatgctgccagtcttctgcgtggtggaacactacgaaaacgccatcgagtacgattgtaaagaggaacatgccgagttcgtcctcgtcaggaaggatatgctgttcaatcaactaattgaaatggccttgttaagcctaggatattcccattccagcgctgcacaggcaaagggttag

SEQ ID NO: 133478 - DNA, 2388 bp, Artificial Sequence
  Description of Artificial Sequence: Synthetic coding sequence
atggatcatttgaatgaggccactcagggcaaagagcacagcgaaatgtcaaacaacgtttctgaccccaaaggaccccccgcaaaaattgcaagactcgagcagaacggatctcctctcggtcgcggtagactgggaagcactggagctaagatgcagggagttccattaaagcatagtggccatctcatgaagacaaacctgaggaaaggtacaatgctccccgtgttctgcgttgtcgagcactacgagaatgctatagaatacgattgtaaagaggagcacgcagagttcgtccttgtgcggaaggatatgctctttaatcagctgatcgagatggcgctgctctctttggggtacagtcatagctctgcagcccaggctaaaggtctgatccaggtcggaaagtggaatccagtgcccctgagttacgtaaccgatgctccagatgcaaccgtggccgacatgctccaggatgtctatcacgtggtaactctgaagatccaactccatagttgccctaagcttgaggacctccctccagagcaatggagccacacgacagtgcgcaatgccctgaaggacctgttaaaagatatgaatcaatcgagcttagccaaagagtgtcctctctcccagtcaatgatttcttccattgtgaactcaacttactatgccaatgtttcagcagccaagtgtcaggagttcggccgatggtataaacatttcaaaaagacaaaggacatgatggtggagatggactcgctgagtgagctgagtcaacagggcgctaatcatgtgaacttcggtcagcagcctgtgccgggaaacactgcagagcagcctccgtcacctgcacaactcagccacggttcgcagccatccgtacgcaccccacttccaaacctgcaccccggcctggtttctactccaatatcgccgcagctagttaatcagcaactggtcatggctcaactgctgaatcaacagtatgccgtgaacagactcctggcacaacaatccctgaaccagcagtatctgaaccaccctcctcccgtgagtaggagcatgaataagccgctggaacaacaggtcagcacgaacaccgaggtgtcttctgagatttaccaatgggtgcgagacgaactgaaacgggccgggatcagccaggccgtgttcgcacgggtggcatttaataggacgcagggactcctctccgaaattctgagaaaagaggaggatccgaagacggcatcccaaagcctgctcgttaatttacgggcaatgcagaatttcctgcagttgcccgaagctgagcgggataggatataccaggacgaacgcgaaaggtctctcaacgctgcatccgccatgggcccagcgccgctgatctccacccccccctctcggcccccccaggtaaaaacggcgaccatcgccaccgagagaaacggcaagcccgaaaacaacacaatgaatatcaatgcaagcatctatgacgagattcagcaggaaatgaagcgggcaaaggtctcccaggcattattcgcgaaagtcgccgccactaagtcacaggggtggctgtgcgaattgttaagatggaaggaggacccatcccccgagaacagaaccttgtgggagaacctgagtatgatccgacggtttttgtcccttccccagcctgaacgggatgccatttatgaacaggagagtaacgcggtgcaccaccatggagaccgccctccgcacatcatacatgtgcctgccgaacagattcaatctccttctccaacaaccttggggaagggtgagtctaggggggtctttctccccgggctgcctactccggcgccgtggctcggcgctgcgccccagcagcaacagcagcagcagcagcagcagcagcaacagcagcaagcacctccgccaccccagcctcaacagcagccccagactgggccccgtttgcctccaaggcagccaactgtagcttctcctgccgagtctgatgaggaaaacaggcagaagacacgtccacgtacaaaaatcagtgtggaggctctcgggatcctgcaaagctttatccaggacgtaggcctctaccctgatgaggaggctattcagaccctgtctgcccagctcgatctacccaaatatactattatcaagttctttcaaaatcaacggtactaccttaaacaccacggtaagctgaaggacaacagcggcctcgaagtagacgttgccgaatataaggaggaggagctgctgaaggatctcgaggagtctgtgcaggataaaaatactaacaccttgttctccgtgaaattagaagaggagctgagtgtagaggggaacacggatatcaacacagacctcaaagattag

SEQ ID NO: 133479 - DNA, 2202 bp, Artificial Sequence
  Description of Artificial Sequence: Synthetic coding sequence
atggaacgacggagtgaatcaccatgtctgcgagattctcccgatagacgttctggatcaccagatgtcaaggggcctccccccgtgaaagtggctaggttggaacaaaacgggagccctatgggtgcacggggccgtcccaacggcgctgtggcaaaagccgtgggcggcctgatgattcctgtgttttgtgttgtggaacagttggacggtagcctggaatacgataatagagaagagcacgctgagtttgtgctcgttcggaaggacgtcctatttagccagctggtcgagactgctctgctggccctcggatactcccactcctccgccgcacaggctcagggcatcattaagttgggccgctggaaccctttgcctttatcttatgtgaccgacgccccggatgccaccgtggctgatatgttgcaagatgtctaccatgtggtcaccttaaagatacaacttcaatcctgcagtaagctggaggatcttcccgctgagcagtggaaccacgccacggtgcgcaacgctctgaaagagctattgaaagagatgaatcagtcgaccctcgcgaaggagtgcccgttgagtcagtcaatgattagctccattgttaattcgacctactatgccaatgtttccgccacaaaatgccaggagtttggtcgctggtacaagaaatacaaaaaaataaaggttgagcgcgttgagcgcgaaaatttatcagactactgtgtcctaggacagcgcccaatgcatcttccaaacatgaaccagttggcgtccctcggtaagactaatgaacagtcaccccactcacagattcaccactccacgcccatcagaaatcaggtcccggcgctacagcctatcatgagcccggggttactttctccccaattgtctccacagttagttaggcagcagatcgccatggcacatctgatcaaccagcagattgcggtgagtagattgcttgcacaccagcaccctcaagccataaaccagcagttcttgaatcaccctccaatcccgagagctgttaagccagaacctaccaattcatccgtagaagtgtctcccgatatctatcagcaagtccgggacgagcttaagcgtgcctctgtttcacaggctgtttttgcccgggtggcatttaatcggacgcagggactcctgagtgagatactgcgcaaggaagaagatccacgcacggcctctcagtcccttctggtgaacctgcgggccatgcagaattttctcaatctgccagaagtcgagcgcgacagaatctaccaagacgagagggagcggtccatgaacccaaatgtgtctatggtttcttctgcctcatccagtccaagttcctcgcggaccccacaagccaaaactagcacccccacaacagatctgcctattaaagtcgacggtgctaacattaacatcacagccgcgatttacgacgagatccagcaagaaatgaagcgggcgaaggtaagccaggctttgtttgccaaggtcgcagctaacaaatcccagggatggctgtgtgagctgctgcgctggaaagagaaccctagtccagaaaacagaactttgtgggagaacctatgcaccatcagaaggtttctcaacttaccacagcacgagcgggatgttatctacgaggaggaatctcggcaccatcacagtgagagaatgcagcacgtggtccagctacctcccgagccggtccaggttcttcatcgtcagcagtcccagcctgctaaagagtcgagtccgcctagggaggaagccccgcctccccctccccctacagaggactcatgtgcaaaaaagcctagaagtaggactaaaatttccttggaagctctcggaatactgcagagttttatacatgatgtgggcctctaccccgatcaagaggccatccataccttgtccgcccagttggacctgccaaaacacacgattatcaaattcttccagaatcaacgctaccacgtgaaacaccacggtaaactgaaagaacacctcggctccgcagtcgacgtggcagaatacaaagacgaggagctgctcactgaatctgaggagaacgattcagaagaagggtccgaagagatgtacaaggtggaagccgaggaagagaatgcagacaaatctaaggctgcaccagcggagatagaccagcgctag

SEQ ID NO: 133480 - DNA, 2202 bp, Artificial Sequence
  Description of Artificial Sequence: Synthetic coding sequence
atggagagacgcagcgagtctccgtgtctgagggacagccccgatcggaggtcagggagccctgacgttaaggggcccccaccggtcaaggtggcacggctggaacaaaatggttcccctatgggagccagaggcaggcccaacggtgccgttgccaaggccgtgggcggcctgatgattccggttttttgtgttgtggaacagttagacggcagtctggagtacgacaatcgggaggagcatgctgagttcgtccttgtcagaaaggacgtgctgttctcacagctcgtggagaccgctctgctggccctgggttactcgcatagctccgccgctcaagctcagggtatcattaagctcgggaggtggaatccactgccactgagctatgtgacagatgcacccgacgctaccgttgctgatatgctccaggacgtctaccacgttgtaacactcaagatccagctccagtcgtgtagcaagctggaggacctgcccgccgaacaatggaaccatgccacagtgcgcaatgccttaaaagagctgcttaaggagatgaaccagtccactctcgccaaggaatgtccattgtcccagtccatgatttcaagtattgtgaactctacctattacgctaacgtttcggccacaaagtgtcaggaatttgggcgttggtataaaaaatacaaaaagattaaggtcgagcgagtggagagagagaatcttagtgactattgcgtgcttggacagcgcccaatgcacctacccaatatgaatcagttggcatcccttggcaaaacaaacgagcagagcccgcattcacagatccatcactctacacccatccggaaccaagtgccagctctgcagcccattatgtccccaggtctgctgagcccccagttaagccctcagctggtgcgccagcagattgccatggcacaccttattaaccagcagattgccgtgtcccgcctgctggcccaccagcacccccaggccattaatcagcagttccttaaccaccctccaatccctcgcgcagtcaaaccagagccaacaaattcctctgtggaggtgagccccgatatttatcaacaggtacgagatgaactcaaacgcgcaagcgtgagtcaggccgtgttcgcaagagtggcctttaatagaacacaggggttactctccgaaatcctgcgcaaggaggaagaccctaggaccgcgtcccagagcctcttagtgaatctgagagctatgcaaaacttcctgaatctgcccgaggtcgaacgagatagaatttaccaagatgagcgcgagagaagtatgaatcccaatgtgagtatggtcagcagtgcctcttcgtccccatccagttccagaacacctcaggcaaagacatcaacccccaccaccgacctgcccattaaggtggatggtgccaatatcaacattacagccgcaatatatgacgaaatccagcaggagatgaaacgggcaaaggttagtcaggcacttttcgctaaggtcgcagccaacaaatcccagggctggctttgcgaacttctgcgctggaaggagaatccgtctccggagaacagaaccctgtgggagaacctgtgcactatccggagatttctcaatctgcctcagcacgaaagggacgtgatctatgaggaggaatcccgccatcaccactccgagcgaatgcaacacgtggtacaattaccacctgaacccgtgcaagtgctgcaccgccagcaatcacagcctgccaaggagtcctctcccccacgggaggaggctccacccccacctcctcctacagaggacagttgtgcgaaaaaacccagatctaggactaagatttcgctagaagccctcggtatactccaatcctttatacacgacgttgggctctatcccgaccaggaagccatccacactttaagtgcccagctggacttgcctaagcacactattattaaattttttcagaaccagaggtaccatgtcaaacaccatggcaagctgaaggagcacttgggatccgccgtggacgtggccgagtacaaggacgaggagctcctgacggagagtgaagagaacgattccgaagaggggtctgaggaaatgtataaggtggaggcagaagaggagaacgcggataaatccaaggccgcccccgccgaaatcgaccagcggtag

SEQ ID NO: 133481 - DNA, 1848 bp, Artificial Sequence
  Description of Artificial Sequence: Synthetic coding sequence
atggagcgccgttcggaatcaccctgccttagggatagtcccgatagacggagcgggtctccagacgttaaaggccctcctcccgtaaaggttgccaggctggaacagaatggatctcccatgggggcccgcggtcggcccaatggagccgtcgcgaaagccgttggcgggctgatgatcccagtgttttgtgtggtcgagcagctggatggatcactagaatatgacaatagagaggagcatgcggagtttgtgctggtccggaaggacgtgctttttagtcagctagtggagacagccctcttagccttgggttatagtcatagttccgcggcacaggcccaggtggagagggtcgaaagagaaaatctgagtgattattgcgtattgggccaaaggccaatgcatctgccaaacatgaaccagctggctagccttggaaagaccaacgagcagtcacctcactctcagatacaccactcaacgcccataagaaaccaggtgccagctctccagcccatcatgtccccaggtttgctttcgccacagctatctcctcagcttgtgcgtcaacagatcgccatggcacatctgatcaaccaacagatagcagtctctaggctcctcgcccatcaacacccccaggccatcaaccagcagttcctgaaccacccacctattcccagggcagtgaaacctgaacctactaacagctccgtcgaggtgtcccccgacatttaccaacaggtcagggacgaattaaaacgtgcctcggtctctcaagccgtgttcgccagagtggcgttcaatcgaacacaagggctgctcagtgaaatccttaggaaggaagaggacccacgtaccgcctcgcagagcctgctggtaaacttacgtgctatgcagaacttcctgaatctaccggaggtcgagcgagatcggatctatcaggatgagcgagagcgcagcatgaatcccaacgtctcgatggttagtagcgctagcagtagcccgtccagctcacgcacccctcaggcaaagacctccacacctaccaccgacctgcccattaaagtggatggcgccaatattaacataaccgccgccatctatgacgaaattcaacaggagatgaaacgcgcaaaagtcagccaagctttgtttgccaaagtggccgccaacaagagccagggatggctatgcgagctgctaagatggaaggagaatcccagtcctgagaaccggaccctctgggaaaacctgtgtacaatccggaggtttctcaatctgcctcagcatgagcgagatgtgatttatgaggaggagtcccgtcaccatcattctgagagaatgcagcatgtcgtgcagctccctcctgaaccagtgcaggttttgcaccgtcagcagtctcagcccgctaaggagagctcacctccacgtgaggaagctccgcctccacccccgcctaccgaggatagttgcgctaagaaaccccgatctcgaactaaaatctctctcgaagctctggggatcttgcagagcttcattcatgacgtgggcctctatcccgatcaagaagccattcacactctcagtgcccaactggacctgccaaagcatacaattatcaagtttttccagaaccagcgctaccacgttaagcaccacggaaagctcaaagagcatctggggtcagccgtggatgttgccgagtacaaggatgaggaactgttaactgagtcggaggaaaatgactcagaggagggatcagaggagatgtacaaggtggaggcagaagaagaaaatgccgacaagagcaaggccgcccccgccgaaatcgaccagcgatag

SEQ ID NO: 133482 - DNA, 2202 bp, Artificial Sequence
  Description of Artificial Sequence: Synthetic coding sequence
atggaaagaagatctgaaagcccttgtctgagggactcaccagatagaaggtcgggtagtccggacgttaagggtcctccaccggtcaaagtagcccgacttgaacagaacggaagcccgatgggcgctaggggaaggccaaatggggccgtggccaaagcagtgggcgggctcatgatccccgtgttttgcgtagtggagcaacttgacggcagcctcgaatacgacaatcgcgaggagcacgccgagttcgttctggtgagaaaggatgttctgttcagtcagttagtagagacggctcttttagccttaggctattcccacagttccgcagcccaggcccagggaatcattaaactgggcaggtggaatccactgccccttagttacgtgactgatgcaccggacgccaccgtagccgacatgctccaggatgtctaccacgtggttaccctgaagatccagctccagtcatgttccaaactcgaagacctccctgccgagcagtggaatcacgcaaccgttcggaatgctttgaaggagctcctgaaggaaatgaaccagagcaccttggctaaggagtgtccattgtcccagagcatgatcagctccatcgtgaacagcacctattatgccaacgtgagcgcaacaaagtgccaggaattcggtagatggtataagaagtacaagaaaattaaggtggaacgcgtggagagagagaatctgtccgattattgcgtgttggggcaacggcctatgcatctgccgaatatgaaccaattggcgtcactaggcaaaactaatgagcagtccccacatagccagatacatcacagtaccccgatcagaaatcaagtgccagcactccagcccattatgtcgcctggactactgtctcctcagttaagtccacagctggtcaggcagcagatcgccatggcgcatcttatcaaccagcaaattgcagtgagccggttgctggcccatcaacacccccaggccatcaaccagcagtttctcaaccacccccccatcccacgtgcagtgaagcccgaacctaccaacagcagcgtcgaagtctccccggacatctatcagcaggttagagacgagctaaagcgggcttcagtaagccaggcggtttttgccagagtagccttcaacaggacacaggggctcctgagtgaaatcttacggaaggaggaggatccgcgcacagccagccagagcctgctggtcaatctcagagcaatgcagaatttccttaatctgcccgaagtcgaaagagacaggatttatcaagacgaaagggaacggtccatgaatccaaacgttagcatggtcagctccgcctcctcaagtccgagctcatcacggactccacaagcaaaaacatccacacctacaacagatctgccgatcaaagtggatggagcaaacatcaatatcaccgccgccatctacgacgagatccagcaggagatgaagcgcgctaaggtctcccaggctctgttcgccaaggttgctgcgaacaagagccaaggttggctgtgtgagctgctccggtggaaggaaaaccccagtccagagaacagaaccctctgggagaatctgtgtaccattcggcgctttctgaacctaccccaacacgagcgggacgtcatctatgaggaagagagccgccaccatcatagcgaaagaatgcagcatgttgttcagttgcccccagagcctgttcaggtgctacataggcagcagtctcaaccagcaaaagagtcctccccccctagggaggaagctccgccccccccccccccaaccgaggacagctgcgcgaaaaagccccgttcaaggacaaaaatcagcctggaagctcttggcatcctgcaatccttcattcacgatgtgggattgtaccctgaccaggaagccatccatacactgtcagcccaactggatctgcccaaacatactatcatcaaatttttccagaatcaaagataccatgtgaaacaccacggaaagcttaaagaacaccttgggagcgccgtcgatgttgcggagtataaggatgaggaactgcttactgaaagtgaagagaatgatagcgaagagggctccgaggagatgtacaaagttgaggcagaggaggagaatgctgacaagagtaaagcagcccccgctgaaatcgaccagaggtag

SEQ ID NO: 133483 - DNA, 2748 bp, Artificial Sequence
  Description of Artificial Sequence: Synthetic coding sequence
atggcagagacgctgagcggcctaggagatagcggcgctgcgggcgctgcggccttgagcagtgccagcagcgaaactggaacacggaggttgagcgacctgagagtgatcgatctgagggcggaactgcggaagagaaatgtcgattcgtcagggaataagagcgttctcatggaacgcttaaaaaaggcaatcgaagacgagggcggcaaccctgatgagatcgaaatcacctcagaaggaaacaagaagacatcgaaacggagttccaagggtcgtaagcccgaggaggagggcgtcgaagacaatgggctcgaggaaaactcaggggatgggcaggaggacgtagagacttctcttgaaaaccttcaggatattgacatcatggatatctcggtgttagatgaggctgaaattgacaatggaagtgtggctgactgcgtggaggatgatgatgctgacaatctccaggaatccctgtctgatagccgcgagttggtggaaggcgaaatgaaggagttgccggaacagctgcaggagcatgctattgaagacaaagaaactattaataacctggacacatccagttccgatttcacaattctgcaggagatcgaggaaccttctttggaaccagagaatgagaaaatcctagacatccttggggagacctgcaagtcagagcccgttaaggaagagtcctcagaacttgaacagccattcgctcaggacactagctctgttgggccagaccgaaagctagctgaggaggaagacctttttgactcagcccacccagaagaaggtgacctcgaccttgcgtccgaaagtaccgcgcatgctcagagcagcaaagctgactcgctgttagcagtggtgaagcgcgaacccgctgagcaaccaggcgatggtgagcggacagactgtgaaccagtaggactcgaacccgcagttgagcagtcctcagcagccagcgagcttgcagaggcaagcagcgaagagctggccgaagcaccaacagaggctccttcaccagaagcccgagacagcaaagaagatgggaggaagttcgattttgatgcttgcaatgaagtgccaccagcaccaaaggagagctctactagcgaaggggcagaccagaagatgtcgtcacctgaagacgatagcgacacaaagcggctctcaaaggaggagaagggacggtcctcgtgcggtaggaacttttgggtgagtggattgagctccacaacgcgcgcaactgacctgaaaaacttgttcagtaaatatggaaaggtcgtgggcgcaaaagttgtcaccaatgcacgaagccccggggctcgctgctatggctttgtcactatgagcaccgcagaagaggcaacaaaatgtatcaaccatctgcacaagaccgaactccacgggaagatgataagtgtggagaaagccaaaaacgagcctgtcgggaaaaaaacctctgacaagagggatagtgatggcaaaaaggaaaaaagctctaattcagacaggagcaccaatctgaagcgggatgacaagtgcgaccgcaaggatgacgccaaaaagggggatgatgggagtggggagaaatcaaaggatcaagatgaccaaaaacctgggccatcagagagatctcgggctactaaatccggctctagaggcaccgagaggactgtggttatggacaagagcaagggcgtgccagtaatttcggtcaagacatccggaagcaaggaacgagcaagcaagagccaggaccggaagtctgccagtcgcgagaaaaggagtgtggtcagcttcgataaagttaaggaaccccgcaagtcccgggactccgagtctcacagtcgcgtgcgagaacgatctgaacgagaacagagaatgcaagcccagtgggaacgggaggagcgcgagcgcttggagattgccagggagcgactggccttccagcgccagcgactcgagcgggaaagaatggaaagagagagactggagcgagaacggatgcatgtagaacacgagagaagaagagagcaggagcgcatccaccgagagcgcgaggaattgcggcgtcaacaggagctaagatacgagcaggaacgccgccctgctgtgcggcggccttatgacctcgaccgacgggacgatgcctactggcccgaggcaaaacgagcagccctggacgagcgctatcatagtgactttaaccggcaggatagatttcacgactttgatcaccgggaccggggcaggtacccagaccattcagtggatcgacgagaagggtctcggtcgatgatgggtgagagagagggtcagcattaccccgagagacacggtgggcccgagaggcatggtcgagacagccgggacgggtggggcggatacggcagtgataagcgtatgtctgaaggaagaggactcccacccccacccagacgagattggggtgaccatggaaggcgagaggacgatagatcttggcagggcaccgccgatggcggtatgatggaccgggatcacaagaggtggcaaggaggtgagagaagtatgtcgggacactcaggacctgggcacatgatgaatagagggggcatgtcagggagggggagcttcgcccccggtggggccagtcggggccatccaatcccgcacggcgggatgcagggtggatttgggggtcagtcacgcggatccagaccgtccgacgcaagattcactcgccgctactag

SEQ ID NO: 133484 - DNA, 2244 bp, Artificial Sequence
  Description of Artificial Sequence: Synthetic coding sequence
atgaaagagctccctgaacaactgcaagaacatgccatcgaggataaggaaaccattaataacctggacactagctcttcagactttacaatcctgcaggagatcgaggagcccagcctggagccagagaacgaaaaaatattggacattctgggcgaaacctgtaagtccgaaccagtcaaggaggaatcatcggagcttgaacaaccattcgcccaggatacatcttccgtaggtcctgaccgaaagctggctgaagaagaggatctgtttgatagcgcccacccagaggagggggacctggacctcgcatcggaatcaacggcccacgcccagtcaagtaaagctgactccttgttagccgtggttaaaagagagcctgccgagcagccgggtgacggggaacgcactgactgtgaaccagtgggcttggagcccgcagtcgagcaaagtagtgccgcgtctgaattggctgaggctagcagtgaagaattggctgaggctcctaccgaggcaccgtctcctgaggcccgggattccaaggaagacggcaggaaatttgacttcgacgcttgtaacgaggtgcctcccgctcctaaggaatcctccactagtgaaggcgctgaccagaagatgtcatccccagaggatgattcggatacgaaacgtctgagcaaagaggaaaaagggcggtcctcatgtggaagaaatttctgggtgtcaggcctgtctagcaccacccgggccacagacctgaagaacttgttcagtaagtacggaaaagtggtaggtgcaaaggtagtgacaaacgctcgttccccaggcgcccgctgctatggcttcgtgaccatgtctacggcagaggaagctaccaagtgcataaatcacctgcataaaaccgagctacatggaaaaatgatttccgtcgaaaaagcaaaaaacgagccggtcggcaaaaaaacctcggataagagagacagtgatggtaagaaggagaagagttccaactcggacagatctacaaatttaaagagagacgacaagtgcgacaggaaggatgacgcgaaaaaaggagacgacgggtcaggtgagaaaagcaaagatcaggacgatcagaagccaggcccctccgaaaggtctcgtgcaacgaaaagcggaagccgcggtacagagagaaccgtagtgatggataagagtaaaggcgtgcccgtcatctcggtcaaaaccagcggatcaaaggagagagcatccaaaagccaggaccgcaaaagcgcctctagggaaaagcgtagcgttgtctcctttgacaaggtgaaagagcctaggaaaagtagagatagcgaaagtcattcacgcgtgcgagaaagaagtgaaagagagcagcgtatgcaggcccagtgggagcgggaggagcgggagaggctggagatcgcccgcgagcggcttgcgtttcagagacagcgattagaacgcgaaagaatggaaagagagcgactggagagagaaagaatgcacgtggaacatgaaaggcgtcgcgaacaagagcggattcacagggaacgggaagaactacgaaggcagcaggagttaaggtacgaacaggaacggcggcctgctgttagaagaccctacgatctcgatcggagagacgatgcatactggccagaggcaaaaagagctgccctggacgaacgttaccactctgactttaaccggcaggataggttccacgacttcgatcacagggaccggggtcggtacccagaccattcagtggaccgtcgcgagggatctcgctccatgatgggcgaaagagaaggccagcactatcctgagcgacatgggggaccagagcggcatgggagagactctagagatggttggggtggctatgggtcagataagcggatgagcgagggaagagggctcccccccccgccccgtggacgacgggactggggagaccacggtcggcgggaggacgacaggtcatggcaaggcaccgccgacggaggcatgatggatcgcgatcataagcgatggcaggggggcgagcgctccatgtcgggacacagcggccctgggcatatgatgaacaggggtggaatgagcggacgcggatcgttcgctcccgggggtgcttcccgcggtcaccctatccctcatggagggatgcagggcggctttgggggccagtcccggggttcacggccaagcgatgctcgattcacccgccgctattag

SEQ ID NO: 133485 - DNA, 2547 bp, Artificial Sequence
  Description of Artificial Sequence: Synthetic coding sequence
atggcggaaacattgtctggattaggcgattcgggcgccgccggggcggctgctctgtctagtgccagcagtgaaaccgggaccaggcggctctcagacctgcgggtgatagacttgcgggccgagctccgcaaaaggaatgtggattcctctggtaacaaaagtgtgctgatggaacgactgaagaaggctatcgaggacgagggcggcaaccctgatgaaatagagatcacctcagagggcaataaaaagacttccaaacgctctagcaagggaaggaaacccgaggaggagggcgtggaggataacggcttagaggaaaattccggggacgggcaaatcgaggacaaggaaactataaacaatcttgatacgtcaagcagcgactttactatcctccaggagatagaagagccttccctggaacccgagaacgagaagattcttgacatcctcggcgagacctgtaaatctgagccggttaaggaggagtcaagcgagctggaacagccattcgctcaggatacaagctctgtggggcccgaccgcaagcttgcagaggaggaagatctgttcgatagtgcacaccctgaagagggggacctggatttggcatcagagtccactgcccatgcccagagttccaaggccgactctctgctggccgtggttaaaagggaaccggccgagcagccgggcgacggggagcggactgattgtgagccggtcgggcttgaaccagctgtggagcaaagctctgcagcatctgaactcgccgaggcaagctccgaggagctcgccgaggcccccaccgaggctccctcccccgaggcaagagacagcaaagaggatggccgcaagttcgacttcgacgcctgtaacgaggtaccacctgcaccaaaggagagctctactagtgagggagccgaccagaagatgtccagccctgaagatgattccgacaccaaacgtttgtcaaaggaggagaaagggcgcagcagttgcggcagaaacttttgggtgagtggactgagctccacaacccgggcaactgatttgaaaaaccttttctcaaagtatggcaaggttgttggagcaaaagtagtgactaacgcgaggagcccaggcgccagatgttatggcttcgtgaccatgagtacagcagaagaagccactaagtgcatcaaccatctgcataaaacggagctccacggtaaaatgatttctgtcgagaaggccaagaacgagcctgtgggtaaaaaaaccagtgacaaaagagactctgacggcaagaaggagaagagctctaatagcgaccgttcaaccaatctgaagagagacgataaatgtgatagaaaggacgacgccaaaaaaggcgatgacggctccggcgagaaatccaaggatcaggatgaccagaagccaggcccaagtgaacggtccagagcaactaagtcagggagccggggtactgaaagaactgtggttatggataagtctaagggggtccccgtaatctccgtgaaaacaagcggatccaaggagagagcttcgaaatcgcaggatagaaaaagcgcctctagagagaagagaagcgtcgtgtcattcgataaggtgaaggaaccgcgtaaaagccgtgactccgagagtcactctagggttagagagaggagcgaaagagaacagcgcatgcaagcccagtgggagagggaggaacgcgagaggctggagattgcgcgggagagattggcgtttcagagacaacggttggaaagagagcggatggagcgggagagactggagcgggaaagaatgcacgtcgagcatgagcggagaagggagcaagagaggatccacagagaacgcgaggaactccggagacagcaggaactgcgctacgaacaagagcgcaggcccgccgtacggcgcccatacgatcttgataggagggacgatgcctactggcccgaggcaaagagggcagccctggatgaacgctaccactcggatttcaatcgacaggaccgcttccacgacttcgaccaccgggaccgtggccggtatcccgaccacagcgtggatcggcgcgaagggtcccggtcgatgatgggagagagggaggggcagcattatcctgagcgccatggcggacctgagcggcatgggagggattcgagggatgggtgggggggatatgggtcagacaaaaggatgagcgaagggcggggcctgccccctccaccgaggggcaggcgtgattggggtgatcatgggcggagggaggacgaccgctcgtggcagggaacagccgatggaggcatgatggatcgggatcacaaaaggtggcaggggggggaaaggagtatgtcaggccatagtggacccgggcatatgatgaatagaggcggaatgagtggccgggggtctttcgcgcccgggggagcttctcggggacaccccatcccgcacgggggtatgcaaggcgggtttggcggacagagtcgaggctctcgtccctcagatgcccgttttacccggcgttattag

SEQ ID NO: 133486 - DNA, 2280 bp, Artificial Sequence
  Description of Artificial Sequence: Synthetic coding sequence
atgaaagtagttatcctcactaagttgaagctcccacccagagaaaccaggaaacatcagaggggactggcaaagatcgaagataaagagacaattaacaacttggataccagcagcagcgatttcaccatactacaggagattgaggagccctcgctggaacccgaaaatgagaagatcttggatatccttggagaaacttgcaagagcgagcccgtgaaggaagagagttctgagctcgagcagccatttgcacaggatactagctccgtgggaccggacagaaagctggctgaagaagaagacttattcgattcagctcacccagaggagggtgacctggacctggcctctgagtctaccgctcacgcccagtcaagcaaagcggacagcctgttggcggtggttaagagggaacctgcggagcagcccggagacggcgagcgcactgattgcgagccagtcggactggagcctgccgtggaacaatcttcagcagccagcgaactggccgaggcttcctctgaggagctggcagaggccccaacagaagcaccatccccagaggctagggactccaaggaagacggtagaaagttcgattttgacgcatgcaacgaagtgccaccggccccgaaggagtcatctacctccgagggggccgaccagaagatgtccagcccagaagatgacagcgacacgaagaggctgtcaaaagaggagaaagggaggtcctcatgcgggaggaatttttgggtcagcggcctcagttctacgacccgggccacggatctgaagaatcttttctcgaaatacggcaaggtagtaggggcgaaggtcgtgacaaatgcccgctctccaggtgccagatgttatggctttgttaccatgtctaccgcagaggaggccaccaagtgcataaatcatttgcacaaaactgagctccatgggaaaatgatttccgtagaaaaggcgaagaacgagcctgttggcaaaaagacctcagataagagggatagcgacggtaaaaaagagaagtccagcaattccgatcgctcaacaaatttgaaaagagatgataagtgtgataggaaggatgatgcaaaaaaaggcgatgacggctctggagaaaagtcaaaggaccaagacgatcagaagccaggaccttcggagcgctcaagagcgactaaatcgggctctcggggaacagagaggacggtcgtaatggataagtctaaaggtgtacccgtaatcagtgtaaagacatcaggtagcaaggagcgggcgtccaagagccaggatagaaagagcgccagtcgagaaaagcgcagcgtcgtatctttcgacaaagtcaaggagcccagaaaatctcgggacagtgagagccaccgcgtcagagagagatccgagcgtgagcagaggatgcaggcccagtgggagcgagaggagagggaaagactggagatagcccgtgagagattggccttccagcgccagcgcctcgaacgggagcggatggaaagagaacggttagaaagggagaggatgcatgtagaacacgagcgaagacgcgagcaggagcgtattcacagagagcgggaagaactgcggcgccagcaggagttgcgctacgagcaagagaggagacctgcagtgcgtcggccttacgatctggacaggcgagacgatgcttactggccagaggcaaagcgcgctgctctcgacgagaggtaccacagtgactttaatagacaggataggttccatgacttcgaccacagagacagaggccgctacccagaccactccgtggatcgccgtgagggctctcgctcaatgatgggcgagcgggagggccagcactaccctgagcggcacggcggtcctgagcggcacggccgcgattctagagatgggtggggcggctatggcagcgacaaacggatgagcgagggacgcggtttgccaccccctccacgcgggcgacgagattggggcgaccatggacgcagggaggatgatcggtcctggcagggcacagctgatggcgggatgatggaccgcgatcacaagaggtggcaaggaggggaaagatcaatgagtggccattcagggccaggccacatgatgaatagaggcgggatgagcgggagggggtctttcgctccggggggagccagcaggggtcatccaatcccccacgggggcatgcaagggggcttcggaggccaaagccggggaagccggccaagcgacgcgcgtttcacacgaaggtactag

SEQ ID NO: 133487 - DNA, 2439 bp, Artificial Sequence
  Description of Artificial Sequence: Synthetic coding sequence
atggcagaaactctctctggccttggggactccggggctgccggcgctgcagccctctcgagtgccagttcagaaaccggcacacggcggctgtctgatctgcgggtgatcgacctgcgtgcagagctccgaaaaaggaatgtagacagtagcgggaacaaatccgtgctcatggaacgcctgaaaaaggcgatcgaagacgaaggaggaaacccagacgagatcgagatcactagcgagggcaataaaaagacatccaaaaggtctagtaagggtaggaaacctgaagaagaaggcgtggaagataatggtttagagcccgaaaacgagaaaatacttgatatccttggcgaaacttgcaaaagcgaacccgtgaaggaggagtccagtgagttagagcagcctttcgctcaagacacaagttctgtaggaccggacagaaaacttgccgaggaggaagatctgttcgatagcgcccatcccgaggagggagatctcgacctggccagtgagtctaccgcacacgcccagagcagtaaggccgattctctgttggccgttgtcaagagggagcctgccgagcagcctggagatggggagcgtacggattgtgagccggttggcctggaacccgccgtggaacagtcttccgctgcaagtgaactggcggaggccagtagcgaagaactcgcagaagcccccaccgaggccccaagcccagaggcccgcgactctaaggaggacgggcggaagtttgacttcgatgcatgcaacgaggtgccaccagcccctaaggaatcttcgaccagcgagggggcagatcaaaaaatgagcagtcctgaggatgactcagatacaaagcggctaagcaaggaggagaaggggcggtcgtcatgtggcagaaacttttgggtaagtggcctgtccagcacaactagagccacagacctcaagaatctcttcagtaagtatgggaaagtcgtgggcgcaaaagtagttactaacgccaggtcgcctggcgccaggtgttacggttttgtcacgatgtccacagccgaagaggctaccaagtgtattaatcacctacataaaacagaactacatggaaaaatgattagcgtggaaaaggctaagaatgaacccgtgggtaaaaaaacatccgacaagcgagatagtgatggcaagaaggaaaagagctccaattctgacaggagtaccaatctaaagcgggatgacaagtgtgaccggaaggatgacgccaagaaaggggacgacgggagcggagaaaagagtaaggatcaggacgatcaaaaacctggacctagtgaacgttcacgggctacaaagtctggctcaaggggaactgaacggacagtagtgatggataaatctaagggggtgccggtcatctcagtgaagaccagtgggtcgaaagagcgagcttccaaatcacaggacagaaagtctgcgtctcgggaaaagcgcagtgtggtgagctttgacaaggtgaaggagcctagaaagagcagagatagcgagtcccattcacgcgtgcgggagagaagcgaacgggaacagcgcatgcaggctcaatgggagagggaggagcgcgaacgattggagattgcccgcgaaagactggctttccagcgtcagcgacttgaaagagaaagaatggaaagagagcggctggagcgcgagagaatgcatgtcgaacatgagcggaggcgagagcaggagcgcattcaccgggagcgggaggaactgcggcgacagcaagaactccggtatgagcaggaaagacgccctgccgtgaggagaccatatgatctcgacaggcgcgacgacgcctactggcctgaggccaagagggccgctcttgacgagagatatcactctgatttcaatcgccaggatcggtttcatgacttcgaccatcgagataggggaaggtaccccgaccactcagtagatagacgggaggggtcccgatcaatgatgggcgagcgggagggtcagcactacccagaacgccatggcggccctgagcggcacggcagggacagccgcgacgggtggggagggtatggcagcgacaagcggatgtctgagggcagaggtctgcctccgccaccccgtggccggagggactggggagaccacggcagacgtgaggatgatcgctcatggcaaggaacagctgatggtgggatgatggaccgcgatcataagagatggcaggggggagagcgctcaatgtccgggcactccggtcccggtcacatgatgaataggggggggatgagtggccgcggtagcttcgcccctggtggtgcctcacgcggccatcccattccccacgggggaatgcagggtgggtttggaggacagtctcggggcagtagaccctccgatgcccggttcactagaaggtattag

SEQ ID NO: 133488 - DNA, 2862 bp, Artificial Sequence
  Description of Artificial Sequence: Synthetic coding sequence
atggctgagactcttccgggctctggtgactccgggcccggtacagcctctctcggacccggcgttgcagagactggcaccagacggctctctgaattacgtgtgatcgacttaagagcagaactgaagaaacgcaatctcgataccggcggcaacaaatctgttctgatggaacgcctcaagaaggccgtgaaagaagaaggccaggaccctgatgaaatcggcatcgagctcgaagctacctctaagaagtctgctaaacgctgcgttaaggggcttaagatggaggaggagggcacagaagacaacggacttgaagacgattcccgggatggacaagaggatatggaagcaagcctggagaacctccaaaacatgggaatgatggatatgagcgtacttgacgaaacggaagtggctaattcgagcgcgcccgactttggggaagacggcacagatgggttgcttgactccttttgcgattcaaaggaatatgtggccgctcagcttcgtcagctgcctgcccagccacccgaacacgccgttgacggcgaaggcttcaagaataccttggaaacatcctcactgaatttcaaagtaacccccgacattgaagaaagtcttctggagcctgagaatgagaagatcctggacattctcggcgaaacatgtaagagcgagcccgtaaaagaagaatcttcagaactggagcagccattcgcgcaagatacatcaagcgttggcccggaccggaaactggctgaagaagaggatctgtttgatagcgcccaccctgaagaaggtgacttggatctagctagcgagtcgaccgcacacgctcagtcatccaaggcagattccctgctcgccgtggttaaacgcgagcctgctgagcagccaggagacggggaacgcacagactgcgaaccagtcggccttgagcccgcggtggagcaatcctcagcagcctcagagctcgctgaagcctccagcgaggaattggcagaagcaccaacagaagcaccgtccccagaagctagggattctaaagaggacggccgaaaattcgacttcgacgcttgcaacgaagtgccccctgcccctaaggagagctccacctcagaaggggcggatcagaaaatgtcatcattcaaggaggagaaggatatcaagcccattataaaagacgagaagggtcgggtggggtcaggaagcggacgcaatctgtgggtgtccgggctctcttctaccactcgcgcaacagacctgaagaacctgttttcaaagtatggcaaggtcgtgggcgcaaaagtggtgaccaacgctagatcgccaggggctcgatgttacgggttcgtgacgatgagtacctccgatgaggctacaaagtgcataagccatctgcaccggacagaactccacggtaggatgatctcggtggagaaggctaaaaacgagccggccgggaaaaaattgtctgaccgcaaggagtgtgaggttaagaaagaaaaactgtcttctgtggatcgacaccactcggtggaaatcaagatcgaaaaaactgtgattaagaaagaagaaaagatagaaaagaaggaggagaagaaaccagaggacatcaaaaaggaagagaaggaccaggatgagctgaagcctggcccaaccaatcggagccgtgtgactaagagcggcagccgcgggatggaacggaccgtggtcatggacaaaagcaagggggaacctgtcatttcggttaagaccacctcccgctcgaaggagagatcaagtaaaagtcaagaccggaagtctgagtctaaggagaaaagagacattcttagctttgataaaattaaggaacagcgggagcgcgagagacagagacagcgagagcgcgagatccgcgagaccgagaggcgtcgggaaagagaacaacgcgaaagggagcagagactggaagcgtttcatgaacgcaaggaaaaagcccggctgcagagggagcgcttgcagctcgaatgccagcggcagaggctggagcgggagaggatggagcgcgagcggctcgagagagagcgaatgcgagtggagcgggagcgccgaaaggagcaagaaaggatacatagggagcgggaggaattgaggcggcagcaggaacaactgagatacgagcaggaacgccggcccggccgtagaccttatgacctcgaccgccgcgacgacgcatattggccagagggtaagagagtcgcaatggaggaccggtaccgcgcagatttcccgagaccagaccaccgcttccatgattttgatcatcgcgatcggggacagtatcaagaccacgccatcgaccggcgagagggctcacggccgatgatgggggatcatagagatggacagcactacggcgacgatcggcatggacatggcggcccacctgagcggcatggacgggatagtagagacggttggggcggctatggatctgataagcgtctgagtgaaggacgcggcctgcctcctccccccagaggtggcagggattggggcgagcacaaccagagactcgaggagcatcaagcacgcgcatggcagggcgctatggatgccggcgcggcaagtagggagcacgcccgatggcaagggggcgaaagaggattgtctggaccctctgggcctggtcatatggcctccagaggcggtgtggcaggtcgcggaggctttgcccaaggaggccactctcagggccacgttgtccccggcggcgggctcgagggcgggggtgtggcttctcaagaccggggctccagggtgccccatccccatccacacccccctccgtatccccactttacccggcggtattag

SEQ ID NO: 133489 - DNA, 1533 bp, Artificial Sequence
  Description of Artificial Sequence: Synthetic coding sequence
atggccgaaacccttcctggcagcggcgacagcggacccgggactgcgtctctcggacccggggtggcggaaaccggcacaaggaggctgagcgaactgcgggtgatagacctgcgcgcagagctgaagaagcggaacctcgacaccggcggtaacaagtccgtgctgatggaacgactgaaaaaggccgtaaaagaagagggccaggatccggacgagatagggattgaattggaggcaacttcgaaaaagagtgccaagcgctgtgtgaaaggacttaagatggaggaggagggcactgaagacaacggactggaggatgactccagagacggccaggaagacatggaagcaagcctagagaacctgcagaacatgggaatgatggatatgagcgtccttgatgaaacggaggtggcaaactcatctgctcccgactttggagaggatggtactgacggcctgctggattctttttgcgacagtaaggagtatgtcgcagctcagctgcggcagttgcctgcccaaccgccggaacacgcagtgggcaatctcgaaactaggcaggacgtgccaacttcttcctcactcagagtttccgtcgctgctgtccctgtcccacatctctctgtcgagaacgaaaaaatattagatattttgggtgaaacgtgtaagtccgaacctgtgaaggaggaaagtagcgaactggaacagccatttgctcaagacactagctctgtgggacccgaccgcaagctggccgaagaggaggatctgtttgactcggctcatcccgaagagggagacctggatttagccagtgagtcaactgcacacgcacagtcatcgaaggctgactcactcctggccgtggtcaagcgggagcccgccgaacagccgggggacggcgaacgaacagactgtgagccagtggggctggagccagctgttgaacaaagctccgccgcctctgagctagccgaagcttctagcgaagaactagctgaagctccgactgaggcacctagtccagaggcgcgtgactctaaggaagacgggcgtaaattcgatttcgacgcgtgtaatgaagtgcccccagcgccaaaagaaagctctaccagcgaaggcgctgatcagaaaatgagctcattcaaagaggagaaggatataaaacccattataaaagatgaaaaaggacgcgttggatctggctctggccggaatttgtgggtgtctgggctgagcagcacaacgcgggctacagatctgaaaaaccttttctctaagtacggcaaggttgtgggagccaaggtcgttactaacgcgagatctccaggcgcacggtgctatggatttgttacaatgagtacctctgacgaggctacaaagtgtatctcacatctgcataggaccgagctccacgggcgcatgatctctgttgagaaagctaaaaatgaacctgctggcaagaagctgtctgatcggaaggaatgcgaggtgaaaaaagagaaactctcctccgtggaccgctag

SEQ ID NO: 133490 - DNA, 786 bp, Artificial Sequence
  Description of Artificial Sequence: Synthetic coding sequence
atggccgaaacactgcccggtagcggcgattctggtcctggcacagcatccctcggacctggggtagccgagacagggacccggcgtctgagcgagctgagggtgatcgatttgagggccgaattgaaaaaacggaacctcgacaccggcgggaataaatcggtactgatggaacgcctaaaaaaagccgtgaaagaagaggggcaggatccagacgaaatcgggatcgagttggaggcaacttctaagaagtccgcgaagcggtgtgtgaaagcccctagcccagaagccagggactccaaggaggacggccggaaattcgactttgatgcttgtaatgaagtgccaccagcccccaaggagagcagtacctcagagggagccgaccagaaaatgtcatctttcaaggaggagaaggacattaagcctattatcaaagacgaaaagggtagggtgggaagtggcagcggccgaaacctgtgggtcagcggcctgtctagcaccaccagagcaactgatctaaagaacctcttcagtaagtatgggaaagtggtcggtgctaaggtggtgaccaatgctcgcagtccaggcgcaaggtgttatggattcgtaacgatgtccacttcagatgaggccactaagtgtatcagtcacctgcaccgtacagaactccatgggcgaatgattagcgtcgaaaaggcaaagaatgaacctgccggcaagaaactgtcagatagaaaagaatgtgaggtgaaaaaagagaagctgtcctctgtcgatcgatag

SEQ ID NO: 133491 - DNA, 1221 bp, Artificial Sequence
  Description of Artificial Sequence: Synthetic coding sequence
atggctgagaccctgccggggtctggtgatagcgggccaggtacagcatctcttggccctggcgtagctgagacaggaacaaggcggctctcagaacttcgggtcattgacctgcgggccgagctgaagaaaaggaacctggacactgggggaaacaagagcgtgctaatggaaagactcaaaaaggcagtcaaagaagagggccaggaccccgatgagatcggaattgaactggaggcaacctcaaaaaagtcagcaaaacgatgtgtgaagggcttgaagatggaggaagagggcacagaggataacggcctcgaggtcgagaacgagaaaatccttgatatcctcggggaaacctgtaaaagtgaacctgtcaaggaggagtcatccgagctcgagcaaccttttgcccaggatacatcatccgtggggcccgaccggaagttggctgaagaggaggacttgttcgactccgctcaccccgaagaaggcgacctggatctcgcatcagaaagtaccgcccatgctcagagctcgaaggctgactcgcttctggcagttgtcaaacgcgagcctgccgaacagccaggggatggagaacgaacagactgcgaacccgtcgggctcgagcccgccgtagagcagagcagtgctgctagtgaattggccgaagcgtccagtgaggagttggcagaagcccccacagaggctcccagccccgaggccagagatagcaaggaggatggacgcaagtttgactttgacgcctgcaacgaagttccaccagctccaaaagagtcatctacctcagagggggcggaccagaagatgagtagctttaaagaggagaaagatatcaagcccatcatcaaagacgagaagggcagagttggttctggctctggacggaacctgtgggtgagcggactgagcagtactaccagagcgactgacctgaagaacctgttcagcaagtacggcaaagtggttggcgcgaaggttgtaaccaatgccagatcaccaggggcaaggtgttacggcttcgtaactatgagtaccagcgacgaggcaaccaagtgcatcagccacctgcaccggaccgagctgcatggccgcatgatctcagtggaaaaggccaaaaacgagcccgccggaaaaaaattgtctgatcgaaaagagtgcgaggtgaaaaaggagaagctatccagtgtcgacagatag

SEQ ID NO: 133492 - DNA, 606 bp, Artificial Sequence
  Description of Artificial Sequence: Synthetic coding sequence
atggccgaaactgggacacgacgactgtccgagcttagagtgattgatctccgagccgagctgaagaaacggaacctcgacaccggagggaataagagcgtcctgatggagagattgaagaaggcagttaaagaggaagggcaagatcccgacgaaattggcatagaactggaagcgacttctaaaaagtctgccaaacggtgcgtgaaggggttaaagatggaggaagagggcacagaagacaatggtcttgaggatgattcccgcgacggtcaggaagacatggaagcgagtcttgagaatctgcagaatatggggatgatggatatgagcgtactggacgagacagaagtggccaattcctccgcccccgactttggcgaggatgggactgatggcctgctcgacagtttttgcgactctaaagaatacgtcgccgcacagctgagacagcttccagcccaaccaccagaacatgccgtcgacggagagggcttcaagaatacacttgaaacctcctcactcaacttcaaagtgactccagacattgaggaatctcttctggaacccgggacggataaaagaaacaccacagtgatggtctag

SEQ ID NO: 133493 - DNA, 1821 bp, Artificial Sequence
  Description of Artificial Sequence: Synthetic coding sequence
atgaaggtgagatccgcaggcggtgatggcgacgccctgtgcgttaccgaagaggacctggctggagacgacgaggatatgccaacattcccctgcacccagaaaggtcgccctggaccccggtgtagtaggtgtcaaaaaaacctgagtcttcacaccagcgtaagaatcttgtatctgtttttagctctattgttggtcgctgtggcagtgctggcatccctggtgtttcgaaaggtggactctctgtcagaggacatcagtttaacccaaagtatttatgacaaaaagcttgtgctgatgcaaaaaaatttgcaagggctcgatccgaaggcgctaaacaattgttccttctgccacgaggccggccaactcgggccagagatcagaaagctgcaagaggagctcgaaggcatccaaaagcttctgctggcgcaggaggttcagctggaccagaccctccaggctcaagaggtgctgtctacgacaagtcggcagataagccaggaaatggggtcttgctcattttccatccatcaagtcaatcaatcacttggtctctttctggcccaggtgcgaggctggcaagccaccaccgccggcctggatctgtcccttaaagatctaacccaagagtgttatgatgtaaaagctgcggttcaccagattaatttcaccgtcggccagacctctgagtggattcacggtattcagaggaagactgatgaggagacattaacattgcagaaaatcgttacagactggcagaactacacccggctcttcagtgggctacgcacaacaagcaccaaaactggcgaagcagtgaaaaacatccaggccactttaggggcatcaagccaacgaatcagccagaacagcgagagcatgcacgacctggtccttcaggtgatgggtcttcagcttcaactggataatatctcatcatttctggacgatcacgaagaaaatatgcatgatctacagtatcatactcactacgcccagaaccgaactgttgagcggttcgaatcattagagggtcggatggcaagccacgagatagagataggaaccatatttacgaacattaacgccacagataaccatgtacactctatgctgaaatacctcgacgacgtccgcctgtcctgcaccctggggttccacacacacgcggaagaactatattatctcaacaagagcgtgagtatcatgctgggtaccacagatctgctgcgggaacggttttccctgctgtcagcccgtctggacctgaacgtccgtaacctatccatgatcgtagaggagatgaaagcggtggacactcagcacggcgagattctgcggaacgttacaattttaagaggagcccccggaccccctggccctcgagggtttaagggagacatgggagttaagggtccagtgggcggccggggccccaaaggagacccgggcagtcttgggccattgggtccccagggaccccagggccagcccggcgaggctgggccagtgggagagagggggccagtcggacccaggggcttcccaggactgaaaggttcaaagggcagctttgggaccggcggccctagagggcagcccgggccaaagggagacatcggcccacctggtccggaggggccccctggatcccccgggccatctggcccccaggggaaacctggtattgcagggaagacggggagtcctggccaaaggggagcaatggggcccaagggagagcccgggattcagggtccccccggccttcctgggccacccggccccccgggatcccagtccttttattag

SEQ ID NO: 133494 - DNA, 1401 bp, Artificial Sequence
  Description of Artificial Sequence: Synthetic coding sequence
atgaaggtccgtagcgctggcggagacggagacgccttatgtgtgactgaagaggacctggccggcgacgacgaagatatgccaacgtttccatgcactcaaaagggtaggcccggccctcgctgtagtaggtgccagaagaacctctcactgcacacgtctgtccggattctgtacctttttctcgctctcctgctcgttgcggtggcagtattggcgtctctcgtttttagaaaagtggacagtctttccgaagatatctcccttacacaaagcatttatgacaagaagctcgtgctcatgcagaaaaatcttcaggggctagatccaaaggccctgaacaactgttcattttgccacgaggctggtcaacttgggccagaaatccggaagctccaagaggaattggaagggatccagaagctactgctggcccaggaggtgcagcttgatcagaccttacaggcccaggaagtgctctccacgacctcacgacaaatcagccaagaaatgggttcctgctccttctccatccaccaggtaaaccaatcactgggactgtttcttgcccaggtcagaggctggcaggcaacaacggcaggcctcgatctatccctgaaggacctgacgcaggagtgttacgacgtcaaagccgcagtccatcagatcaatttcactgtcggtcagactagcgagtggatccacggcattcagcgtaagacagatgaggagaccctaactctacagaagatcgttaccgactggcagaattacactaggctgttctcaggactgaggacgacgagtactaaaactggcgaggctgtcaagaatatacaggccactcttggtgccagttcccagcgcatcagccagaattctgagagtatgcatgacctcgttctgcaagttatgggcctgcagttgcaacttgacaatatcagctcatttcttgatgatcatgaagagaatatgcacgatctccaatatcacacccattacgcacagaatcgcactgtcgagagatttgagagtctcgagggcaggatggcatcccacgagatagaaataggcactatttttactaacattaacgccacagacaaccacgttcacagtatgctgaaatacctggacgatgtgcgtctctcctgcacgttaggctttcatactcacgccgaagaattgtattacttgaataaatctgtgagtataatgctgggaaccactgatctgttaagggagcgattctcactactctcagccaggctggatcttaatgtgcgaaacctgtccatgatcgtagaagaaatgaaagctgtggacacgcagcacggggagatcctgcgcaatgttacaattttgcggggccacacccttttctcacacaatcgtatatag

SEQ ID NO: 133495 - DNA, 1008 bp, Artificial Sequence
  Description of Artificial Sequence: Synthetic coding sequence
atgggtaggtgctgcttttataccgctgggaccttgtccctccttctactggtaacgtcggtcactcttttagttgccagggtcttccagaaggcagtcgaccagtctatcgagaaaaaaattgtgctgcgcaacggcacagaagcctttgacagctgggagaagccaccacttcccgtatacacacagttctatttctttaacgtgaccaacccagaggagattctgagaggtgaaacgcctcgcgtagaagaagtggggccatacacctatcgcagccttgattggtggatcacagacaaatgcaacatgattaacggaactgatggcgactcttttcaccccctcataaccaaggacgaggtgctctacgtcttcccttctgatttttgccgaagcgtctatatcaccttttccgactacgagagcgtgcaggggctgcctgccttcaggtacaaagtgcctgccgagattttggctaatacaagcgataatgctggtttctgtatccctgaaggaaattgcctggggagtggagtcctgaatgtgtctatctgtaagaacggtgcaccgattatcatgagcttcccgcacttctaccaagctgatgagcgctttgtttccgccattgagggcatgcaccccaatcaagaggaccacgagacatttgtggacattaatcctttaactggcatcatactgaaggcagccaaacggttccagatcaatatatacgtcaagaagctggacgatttcgtggaaactggggacatccgcaccatggttttccccgtcatgtacctcaacgagtctgtccacattgataaagagacggcctcacggcttaagtccatgatcaatactacactcataattactaatataccttacataataatggccctcggtgtcttcttcggactggtgtttacctggttggcgtgcaaaggacaaggatctatggacgaggggaccgcagacgagcgtgctccgctgattagaacctag

SEQ ID NO: 133496 - DNA, 1530 bp, Artificial Sequence
  Description of Artificial Sequence: Synthetic coding sequence
atgggatgttccgccaaagcccggtgggcggccggcgccctcggagtggctggcttgctttgcgcggtgctgggcgctgttatgatcgtgatggtgccgtctcttataaaacagcaggtcttaaagaatgtgagaatcgatccatcctcgcttagcttcaatatgtggaaggaaattcccattcctttctacctttctgtgtatttctttgatgttatgaacccatcggaaatcttgaaaggtgaaaagccacaggttagggaaagaggcccctacgtgtaccgggaattcaggcacaagtcaaatatcaccttcaataacaacgataccgttagctttttggaataccgaacctttcagtttcaaccaagcaagtctcacggcagcgaaagcgactacatcgttatgccaaacattttggtgctgggggccgcagtaatgatggagaacaaaccgatgacactgaagttgatcatgacactcgcatttaccacgttgggggagcgcgctttcatgaaccgcactgtcggagaaatcatgtggggatataaagaccctctggtgaacctcatcaacaagtactttccgggaatgtttccattcaaggataagttcggattgttcgccgagcttaacaatagtgattccgggctcttcaccgtgtttaccggagttcagaacatttctagaatacatctggtggataaatggaatgggctatctaaagttgacttctggcactctgatcagtgtaatatgatcaatgggacctccggtcaaatgtggcccccctttatgacccccgaatcatcactggaattttacagtccagaggcatgcagatccatgaagctgatgtacaaggaatccggcgttttcgagggcatccctacctatagatttgtcgcccccaagaccctctttgccaatgggagcatttatccacccaacgaaggattctgcccgtgcctggaaagcgggatacagaacgtatctacctgccgcttttctgcaccactatttctaagtcatccccacttcctgaacgccgatccggtgttagctgaggccgtcacaggccttcatccaaaccaggaggctcattccttattcctggatatacacccagtcacaggcatacctatgaattgttccgtcaaactgcagctgagtctgtatatgaaaagtgtggcaggtatcggccagaccgggaagatcgaacccgtcgtgctgcctctgctctggtttgctgagagtggtgccatggagggagagaccctgcacaccttttatacgcaactagtgctgatgcctaaggtgatgcattatgctcagtacgtactgctcgctctcggttgcgtgcttctcctggtgccagtcatatgtcaaattagaagccaggaaaaatgctatctgttctggtcgtcatcaaagaagggttcgaaagacaaggaagccattcaggcatattctgaaagcctgatgaccagcgctcctaagggctcagttcttcaggaagctaagctgtag

SEQ ID NO: 133497 - DNA, 1521 bp, Artificial Sequence
  Description of Artificial Sequence: Synthetic coding sequence
atggggtgctctgctaaggcacgctgggctgctggggccctgggggtggccggtctcctttgcgctgtgcttggcgccgtaatgatcgtgatggtaccttccctgatcaaacagcaggtcctgaaaaacgtgaggattgacccatcgtctctctcattcaacatgtggaaggagatacctattcccttctatctgagcgtctatttttttgacgtgatgaatccatcggaaattctgaaaggagagaagcctcaggtgcgggagcggggcccttatgtgtatagggaatttcgtcataaatctaatattaccttcaataataatgatacagtctcctttctggagtatagaaccttccagttccaaccatcaaagagccacggatccgagagtgactacattgtgatgccaaatatcctggtgctgggggccgcagtaatgatggagaataagcccatgactttaaaactgatcatgaccctggcatttacaacactgggcgagcgtgcgtttatgaacaggacagtgggggaaatcatgtggggttataaggaccctctggtaaatctgattaataaatattttcctggaatgttccccttcaaagataagttcggtctctttgccgagctgaataactctgatagcggcctgtttaccgtgtttactggagttcagaatatcagccgcattcatttggtcgacaagtggaacggcttatctaaagttgatttctggcactctgatcagtgcaatatgatcaacgggacctccggacagatgtggccgcctttcatgacacctgaatcgagcctggaattctactctcctgaggcttgtagaagcatgaagcttatgtataaggaatcaggtgtgtttgaagggatccccacgtatcggtttgtggctccaaaaaccctgttcgctaatggatccatctatccgccaaacgaaggattctgcccatgcttggaatctggaattcagaatgttagcacttgtcgttttagtgcccctctgtttctctcccatccccatttcctaaacgccgatcccgtgcttgcagaagcagtcaccgggcttcacccaaaccaggaagcccattctttgtttctggatattcacccagtaacaggaataccgatgaattgttccgtgaagcttcaactctccctttatatgaaaagcgtggccgggattggacagaccggtaaaattgagcctgttgtgctccctctgttgtggtttgccgaaagcggtgcgatggagggtgagactctgcacactttttacactcagctggtgctcatgccaaaggtgatgcattacgcgcagtatgtgctgctggctctcggctgcgtgctcttgctggtgccagtgatttgtcagatccggagccagggccccgaggatactgtcagccagccaggacttgccgccggcccggatagaccgccctctccgtatacccctctcctgcccgacagcccatccgggcagccaccttcacccacagcttag

SEQ ID NO: 133498 - DNA, 1230 bp, Artificial Sequence
  Description of Artificial Sequence: Synthetic coding sequence
atgggctgcagcgccaaagcacgctgggcagccggagccctcggcgtagctggcctgctgtgcgccgtgctgggagctgtaatgatcgtgatggtgccatcactgatcaagcagcaagtgctgaaaggggccgccgttatgatggagaacaaacccatgacactgaagctgatcatgacactggctttcaccaccctgggagaacgtgcctttatgaatcggactgtgggcgagattatgtggggttacaaggacccgttggtgaaccttattaacaaatattttcctggcatgttccccttcaaagacaaattcgggctgttcgctgagctgaacaattctgactcagggctgttcactgtcttcactggtgtccagaatatctctcggattcacttggttgacaagtggaacgggctgtctaaggtggacttttggcacagtgatcagtgcaacatgataaatggtacatccggacaaatgtggccacccttcatgacccctgagagttcgttggaattctacagccccgaggcatgcaggtccatgaagttgatgtataaagaatctggagtcttcgaaggcatccccacctatcgctttgtggccccaaaaacactgtttgctaacggctctatctacccccctaatgagggcttttgtccctgtcttgaatccggtatccagaatgtttcgacgtgcagattctcagcaccactgttcttgagccatccacactttcttaacgccgaccctgtcttggccgaagccgtgacaggcctgcaccctaatcaggaggctcactcgctgttcctggatatccacccagtgacaggcattcccatgaactgtagcgtcaaactacaactcagcctgtatatgaagagcgtggccgggataggacagaccgggaagatcgagccggtggttctcccacttctctggttcgcagaatcgggcgctatggaaggggaaacgctacacacattctacacccaactcgtccttatgcctaaggttatgcattacgcccagtatgtgcttctcgctcttgggtgtgtactcctgttggtgccagttatctgccagattcgatctcaagagaaatgttacctcttttggagctcctcaaagaaggggagtaaggacaaggaggctattcaggcctacagcgaatctctaatgaccagtgcccccaagggaagcgtgctacaggaggctaaattgtag

SEQ ID NO: 133499 - DNA, 1659 bp, Artificial Sequence
  Description of Artificial Sequence: Synthetic coding sequence
atggggtgctctgcaaaggctcggtgggctgccggggctctgggggtcgcagggctcctgtgcgccgtgttgggagccgtcatgatcgtaatggtgccttcccttatcaaacagcaggttctcaaaaacgttcgcattgacccttctagtctgtcatttaacatgtggaaagagattccaatccccttttatctgagcgtttacttcttcgacgttatgaatccttctgaaattctgaagggcgaaaaaccccaagttcgcgaacgaggtccatacgtataccgagagtttcgtcataagtccaacatcactttcaacaacaatgatactgtatcgtttctggaatatcgaactttccagttccagccatctaaatctcacgggagtgagtctgactatatcgtgatgccaaacatcctggtgctcggtgccgccgttatgatggagaataagcctatgactctgaagctgatcatgacactcgccttcactacccttggagagcgagcgtttatgaaccgcacggtgggagaaatcatgtggggatataaggatcctttagttaatcttatcaataagtattttcccggcatgttccccttcaaagataagtttggactctttgctgagctgaacaattcagattctggactgttcacggttttcactggggtacagaatattagccgcattcacttggttgacaagtggaatggtctaagtaaggtcgatttctggcactcagatcagtgcaatatgattaacgggaccagtggccagatgtggccgcctttcatgacgccagagagctccctcgagttttattctcctgaagcttgtcgatccatgaaattaatgtacaaagaaagtggagtgttcgaaggaatcccaacatatcggttcgtcgccccaaagaccctgttcgcgaacggttctatatacccacccaatgaagggttttgtccttgtctggaatcgggcatccagaatgtttccacatgtcggttcagcgcacctctgtttctcagccacccgcacttcctaaatgccgacccggtactggcagaggcggtcacgggcctccatcccaaccaggaagcccatagtctgttcctcgatatccatcctgttaccgggattccaatgaattgtagtgtgaagcttcagctttcactatacatgaaaagtgtggccggtatcggccagacaggcaaaatcgagcctgtcgtactgcccctgctgtggtttgctgagtctggagcgatggaaggagaaaccctccataccttctatacccagctggtgctgatgcctaaggtgatgcactacgcacagtacgtgctacttgcactaggttgcgttttgctgctggttccggttatttgtcagattagatcgcaagtcggggctggccagagggcagctcgcgcagacagtcattcacttgcttgttggggaaagggggcgagtgatcgtaccctctggccaaccgctgcctggtcaccccctccggccgctgtcctcaggctttgcagatccggaagcggccactgttggggcctacggtcaaccttggcctccttcgcctgtcgcgtcgcaaccactttgcccgtgttggaggggttgggacctagtctgggaggcggtacaggcagctag

SEQ ID NO: 133500 - DNA, 1551 bp, Artificial Sequence
  Description of Artificial Sequence: Synthetic coding sequence
atgtgtgccgttggaaacgtgcgcattgacccttcctccttgtcttttaacatgtggaaagagattcccatccccttttacctgagtgtgtacttcttcgacgtcatgaatccttctgagatactaaagggggagaagcctcaggtaagggagaggggcccgtatgtgtatcgcgaattcaggcataagtcaaatataacttttaacaacaatgatacagtcagtttcctggagtatagaactttccagtttcagccaagcaaatcccacggcagtgagtcagattacatcgtcatgcctaacatcctggtgcttggtgcagcagtcatgatggaaaataaacccatgacactgaaactgattatgacactggcctttaccaccctgggggagcgcgcatttatgaacaggactgtgggcgaaataatgtgggggtacaaagatccccttgttaaccttatcaacaagtatttcccgggcatgtttccgttcaaagataagttcgggctctttgcagaactcaacaactccgatagcggtctgttcaccgtatttacgggtgttcagaatatctctcggattcacctggttgacaagtggaatggcctttcaaaagtggacttttggcacagtgaccaatgcaacatgattaatggaacgagcggccagatgtggcctccttttatgactcctgagagctccttggaattctattcccccgaggcatgtcgcagcatgaaactcatgtacaaagaatcgggtgtgttcgagggtatcccgacttatcgattcgtggctcctaaaaccctgttcgccaatggcagcatctaccccccaaacgaagggttctgtccctgcctagagagtggcatccaaaacgttagcacctgcaggttctccgcgcccctgttccttagccacccccacttcctgaacgcagacccggtgctcgctgaggccgtaaccggattacaccctaatcaggaagctcactctctttttctggatatccacccggttacggggataccaatgaactgttccgtgaagctgcagctctcattgtatatgaaatccgtggctgggattggacagaccggcaagattgagccagtggtactgccactcctgtggttcgccgaaagtggtgctatggaaggggagaccctccatactttctacactcagctggtcttgatgcctaaggtgatgcactacgcgcaatatgtcctgctcgcactcggatgcgttcttcttttggtaccagtcatctgccaaattaggagtcaggttggggctggccagagagctgcgcgcgctgactcccattcactggcttgttggggaaagggagccagtgaccgcacactgtggccaaccgcagcttggagccctcctccggcagcagtgcttaggctgtgcagatccggttcaggtcactgctggggcctgaggagcaccctcgcctcatttgcctgtcgtgtggctacgacccttccagtgttagaaggactcggtccttctttggggggtggtaccggaggtttatag

SEQ ID NO: 133501 - DNA, 1539 bp, Artificial Sequence
  Description of Artificial Sequence: Synthetic coding sequence
atgaacgttcgtattgatccgagcagcctgagttttaacatgtggaaggagataccaatcccattctacctatccgtctactttttcgacgttatgaatccctccgagatactcaaaggggagaagccgcaggtgcgggaacgcggcccctacgtgtacagggagttcaggcataagtcaaacatcaccttcaacaataatgatactgtgtccttcttggagtatagaactttccagtttcagccaagcaagagccatgggagtgagtccgactacatcgtgatgccaaatatcctagtgctcggtgcagcggtgatgatggagaataaacctatgactctaaagttaatcatgacgctcgccttcacaaccctgggggagcgtgcctttatgaaccgtaccgtgggagaaatcatgtgggggtacaaagatcctctggtcaacctgatcaacaagtacttcccaggcatgttcccttttaaggacaaattcggcctttttgctgagcttaacaactctgactcaggcctgtttacggtcttcaccggcgttcagaatatctcaaggattcatctcgtggacaaatggaatggcttatcaaaggtggacttttggcactctgatcaatgcaacatgatcaatgggacaagcggtcaaatgtggcccccgttcatgactcctgagagctcgctcgagttttattcccccgaagcttgccggtctatgaagcttatgtacaaggaatccggagtctttgaagggatcccgacatataggtttgtggctccgaaaacactctttgcaaacgggtccatctacccccctaatgaggggttttgtccgtgcctcgaatccggtatccagaatgtgtctacttgtcgattctctgcgcctctgttcttgtcacatccccacttcctgaacgctgatcccgtacttgcggaagcggttaccggattgcatcccaaccaagaagcccacagtctttttctggacatccaccctgtgaccggaatcccgatgaactgtagcgttaagctgcagctgagcctgtacatgaaaagtgtggccgggatcggacagactgggaagatcgaaccggtggttctacctctgctgtggttcgccgaatccggtgcgatggaaggagagacactgcacacgttttacacccaactcgtgctgatgcctaaggttatgcattacgcccagtatgtcctccttgctctgggatgcgtattgctgctggtgccagtgatctgccagattagatcgcaggtgggggctggccagcgtgctgcccgggctgacagccactctctggcttgttggggaaagggcgcctcagacagaaccttatggcccactgcagcttggtcacctccaccggcagccgtgttgcgactgtgccggagcggatcggggcactgctggggcctccgctctacactggcctcctttgcatgccgagtggctactacactgccagtcctggaagggctcggccccagcctgggaggcgggactgggggcttgtag

SEQ ID NO: 133502 - DNA, 441 bp, Artificial Sequence
  Description of Artificial Sequence: Synthetic coding sequence
atggggtgttctgcaaaggccagatgggcagccggggctcttggtgtggccggactcctttgcgctgtacttggagcggtgatgatagtcatggtgccaagtctcattaagcagcaggtgctgaagaacgtgcgaattgatccctcttctctcagcttcaatatgtggaaagaaatccctatccccttctacctgtccgtgtatttcttcgatgtgatgaatccatcagaaattcttaaaggcgaaaagccccaggtcagagaacgcggcccatacgtgtatagggaatttaggcacaagagtaacataacgttcaataataacgatacagtgtcattcctagaataccgtactttccagtttcagccgagcaagtctcatggctctgaatccgactacatcgtcatgcccaatatcctcgtcctagtgcgactcccttag

SEQ ID NO: 133503 - DNA, 1446 bp, Artificial Sequence
  Description of Artificial Sequence: Synthetic coding sequence
atgggatgtagcgcaaaggcccggtgggctgcaggagctctaggggtggcaggcctactgtgcgctgtgctgggcgccgtcatgattgtcatggtcccctctcttatcaagcaacaagttctgaagaacgtgcgcatagacccttccagtttgtcatttaatatgtggaaagaaatccctatcccattctacctatcggtttatttcttcgatgtgatgaacccctcggaaattctgaaaggcgagaagccacaggtgcgggaacgtggtccctatgtgtatagggaatttagacataagtcaaatattaccttcaataacaacgataccgtgtccttcctggaatatcgaactttccagttccagccctctaagagccacgggagcgaatccgactacatcgttatgcccaatattttagtgctcggcgccgcggttatgatggaaaataaacccatgactctgaagctaatcatgaccttggcttttacaactctgggcgagcgagccttcatgaatcggaccgtaggcgagataatgtggggatataaggatccgctggtgaatctgattaataaatattttccaggcatgtttccctttaaggacaagttcggcctctttgctgaactgaacaacagcgatagcggcctcttcacagtcttcaccggggtgcaaaacatttcaaggatacatctagtcgataagtggaacgggctgagtaaagtcgacttctggcactctgaccaatgcaatatgattaacggcacatccggacagatgtggcctccattcatgacccccgaaagtagccttgagttctattcacccgaagcctgtagaagcatgaagttgatgtacaaggaaagtggagtgtttgagggtatccccacataccggtttgtggcacccaaaactctgttcgccaatggcagcatttacccgcccaatgaaggattttgcccttgcctggagagtggcatccagaatgtgtctacctgtagattcagtgcgcccctgtttctgagccatcctcacttcctcaacgccgaccccgtgctcgcagaggccgtgacaggcctgcacccaaatcaggaagcccatagcctgtttttggacattcaccctgttactggcattccaatgaactgttccgttaagctgcagctgtctttatatatgaaaagtgttgctggaatcggccagactggcaagatagagcccgttgtgctgcccttactttggtttgccgagagcggagcaatggagggagaaaccctgcacactttctatacccagttggttttaatgcctaaagagaaatgttatctgttttggagcagcagcaaaaaaggctccaaagataaggaggctatacaggcctactccgaaagcttgatgaccagcgctccaaaggggtccgtgctgcaggaggccaagctgtag

SEQ ID NO: 133504 - DNA, 1437 bp, Artificial Sequence
  Description of Artificial Sequence: Synthetic coding sequence
atgggacgttgctgtttttacaccgccggcaccctgtctcttttgctcctggtgactagtgtcacgcttttagttgccagggtgttccagaaggcggtcgatcagtcgatcgaaaagaagattgtgttaaggaatggcactgaggcctttgacagttgggagaagccacctctgcccgtctacacacagttttatttcttcaacgttaccaacccggaggagatcctgcgaggtgagacacctcgcgttgaagaagttggcccttacacctatcgcgagctgcgtaacaaggcaaatatccagtttggggacaatggaacgactatcagcgcagtatcgaacaaggcatatgtcttcgagagagatcagagtgttggggaccccaagatagatctgatccgaacactgaacatcccagtgttgactgtcatcgaatggtctcaggtgcactttcttcgggaaataatagaggccatgttaaaagcctatcagcagaagctgttcgtgactcataccgtggacgaattgctatgggggtacaaggacgagatcctgagtctgattcatgtttttaggcccgacatcagcccgtactttggcttgttttacgagaagaatggtacaaatgacggggattacgtttttttaaccggggaggacagttacctcaattttaccaagatcgtggaatggaatggcaaaacttcacttgattggtggataacagataagtgtaacatgatcaacggtactgacggcgatagtttccaccctctaattactaaagacgaggttctgtacgtgttcccttcagacttctgcaggtccgtctatattacattctccgattacgagtctgtgcaggggctgccagcattcagatacaaggtccccgccgagattctcgcaaataccagtgacaacgcgggcttttgtatccctgagggcaactgtctgggctccggagttcttaacgtgtcaatctgcaagaatggtgctcctattatcatgagttttccacacttctatcaggcggatgaacggtttgtcagtgctatcgaaggcatgcaccccaaccaggaggatcacgaaacttttgtcgatattaaccccctgacaggaatcattctgaaagctgccaagagattccagatcaatatctatgtgaagaaactggacgatttcgtggagaccggcgacattcgcaccatggtctttcctgtcatgtatttgaacgagtcagtgcacatagacaaggagaccgcaagtcgcttgaagtccatgattaatactaccctgataatcaccaacattccgtacattataatggccctcggtgtattcttcggcttggtgttcacctggttggcctgcaaggggcaggggtctatggacgagggcaccgccgatgaaagagcgccacttatcagaacttag

SEQ ID NO: 133505 - DNA, 1710 bp, Artificial Sequence
  Description of Artificial Sequence: Synthetic coding sequence
atgggcctgggcctcctcctgccgctccttctgctgtggactaggggcacgcaaggaagcgaattagaccccaagggccagcacgtttgcgtagcctcaagtccatctgctgaactccagtgctgcgccgggtggcggcagaaggaccaagagtgcaccattccaatatgtgagggtccagatgcttgtcagaaagacgaagtttgcgtaaagcccggtctttgccggtgcaaacctggcttctttggcgcccactgttcatcccgttgccctggtcaatattgggggcccgactgtcgcgagtcttgtccgtgtcatccccacggacagtgcgaaccagcaaccggtgcttgccagtgtcaggctgaccgctggggagccaggtgcgagttcccatgcgcttgcggcccccacggcaggtgtgatccggccaccggggtgtgccactgcgaacccgggtggtggtctagcacgtgtaggcgaccttgccagtgtaatactgcggccgcaaggtgtgaacaagcgacaggagcttgcgtatgcaagcctggttggtgggggaggcgctgttcattccggtgcaattgccatggcagcccgtgcgagcaggattctggtagatgcgcctgtagacctggttggtggggcccggagtgccagcaacagtgcgagtgtgtccgaggccggtgtagcgccgcctctggggaatgcacttgccccccaggtttcaggggagcccgatgtgaattgccttgtcctgctggcagccacggagttcaatgtgcccattcctgtggtcgatgcaaacataatgagccttgtagcccggatactggatcgtgtgaatcatgcgagccaggctggaatggtacccagtgtcagcagccttgtttaccaggcacctttggggagtcttgtgagcagcagtgtccacactgcagacatggcgaagcctgcgagcctgatacagggcactgtcagcggtgtgaccccggctggctcgggcctaggtgtgaggacccctgccctacaggcaccttcggggaggattgtgggagtacctgtcccacttgtgttcaggggagctgtgatacagtgacaggcgattgtgtatgttcggccggctactggggcccttcctgcaacgctagctgtccggcaggatttcacggtaacaactgtagcgtgccgtgtgagtgtcccgaaggattgtgtcacccagtgagcgggtcatgccaaccagggagcgggagcagggacacagcactgattgctggctcactggtgccactattgctcctctttttgggactggcttgctgtgcctgttgctgttgggcacctcggagtgatctgaaggatcgaccagctcgagacggtgctactgtgtcccgtatgaagctccaggtctggggtacactcacatctctgggctccacactgccttgccgcagtctctccagccacaagttaccatgggtgactgcctcatcttccagacccctgcctgctggacccctgatgaccccttcccaccccattctcagcctggagcgccagatgaggtttctgccaaccgtctgccaccccaagaagggctggagcctctggcctaggcagggtcgtcagcgacccgcctggttgcaggtattgtctcggccacttcgaacaccccctcgccatagtcccagccgtgccccaccagcgtag

SEQ ID NO: 133506 - DNA, 2613 bp, Artificial Sequence
  Description of Artificial Sequence: Synthetic coding sequence
atggagggtgccggccctaggggcgcaggacccgcacgccggaggggagctggcggacctccctcccccctgctgccgagtttgttactgctattgctactgtggatgttgccagacaccgttgccccacaggagttgaacccgcgcggacgcaacgtgtgtagggcccctggttcacaggtgcctacctgttgtgcagggtggagacagcagggagatgagtgtggaatcgccgtgtgcgagggtaactctacttgttctgaaaacgaagtttgcgtgagaccaggagagtgtaggtgccggcacggctattttggggcgaactgcgacaccaagtgtccacggcagttttggggccctgattgcaaagagttatgttcttgtcacccccatggccagtgtgaggacgtgactggccagtgtacttgccatgccagacgttggggagccagatgcgaacatgcttgtcagtgtcagcatggcacctgccatccccgcagcggggcatgccggtgtgagccaggttggtggggcgcccagtgcgcttccgcgtgttactgcagcgccacttctcgctgcgatcctcaaactggcgcttgtttgtgccacgccggctggtggggaagaagctgtaataatcaatgtgcatgcaatagctctccatgtgagcagcagagtggccgttgccagtgtcgagaacgtacgttcggcgcccgttgcgaccgctactgtcagtgcttccgcgggcggtgccacccagtagatggcacttgcgcgtgcgagccagggtacagaggtaaatattgccgggagccctgtccagctggcttttatgggctcggttgtcgtcgacggtgcggccaatgtaaaggtcagcaaccctgtaccgtcgccgagggccgatgccttacttgcgaaccaggctggaacggcactaaatgtgatcaaccttgtgctacaggattttatggagaagggtgctcgcatcggtgccccccatgtagagatggccatgcatgcaaccatgtcactgggaagtgcacgagatgtaatgccgggtggattggggacagatgcgagaccaagtgctctaacggtacttatggcgaggattgtgcatttgtgtgcgctgactgcggatcaggacactgcgatttccaatctgggcggtgtttgtgcagcccaggagtacacggcccccactgcaacgtaacgtgtcctcccggacttcacggggccgactgtgctcaagcatgttcttgccacgaggacacatgcgaccccgttacgggcgcttgccatttagaaactaaccaacgtaaaggggtgatgggggcaggggccctgctcgtcctactggtgtgcctcctgcttagcctgctcggttgctgctgcgcttgtcgtggtaaagaccccacacgaaggccgcggccacgccgcgaattgtcccttggacgcaagaaggccccacacaggctatgcggccggttttcaagaatatctatgaaactgcctcgcattccactgagacgccagaaactccccaaggtagtcgtggcgcaccacgacctggacaatactcttaactgcagctttcttgagccacccagcggcttggaacagccgtcaccatcttggagctcgcgggcatccttttcaagcttcgacaccacagatgagggcccggtctactgcgtgccccatgaggaggcccctgctgagagcagagacccagaagtccccactgtgcctgccgaagctcccgcaccctcaccagtgcctctcactacacctgcatctgctgaagaggccatcccgctcccagcttccagtgactcggagagaagcgcctcttctgtcgagggcccagggggcgcactttacgccagggtcgcacgacgcgaggccagaccggccagagcccgtggcgagatcggcggtctgagcctttccccaagtcccgagagaaggaaacctccacctccagatccggcaacaaagccaaaagtgtcctggattcacggcaagcacagtgcagccgccgccggtagagcacccagccctcccccacccgggtccgaggcagcgccctctccatcaaaacgcaagcgaacccccagcgacaagtcagctcacacagtggagcacggtagtccacggacccgcgatcccactccccgcccgcccgggctgccagaagaggccaccgcccttgcagctccatctccaccaagagccagggcacgggccgcccctaggcctttaggcgctcatggaagacgccggtctccagcaaagcgagctgaggctgctagcatgcttgccgccgacgtaaggggtaaaacccgcagtctgggccgtgcagaggtggctcttggggctcaaggtccgagagaaaaaccagcacctccgcagaaggccaaaagatcggtcccacccgcttctcccgcaagggcccctccggccaccgaaactccaggaccagagaaggctgctacggatctgcctgcaccggaaacaccccgaaaaaagactcctattcagaaacctccgcgaaaaaagagtcgcgaagccgccggtgagctcgggcgtgccggagctcctaccctttag

SEQ ID NO: 133507 - DNA, 2493 bp, Artificial Sequence
  Description of Artificial Sequence: Synthetic coding sequence
atgggtctggggctgttgctgccgctgctgttactgtggacacgcgggacacagggctctgagctcgatcctaagggacagcacgtgtgcgtggcctcctccccgagtgccgagctgcagtgttgtgctggatggcgccaaaaagatcaagaatgcacaattcctatttgcgaaggaccagatgcttgtcagaaggacgaggtgtgcgttaagcctggcctttgtagatgtaagccaggattttttggggctcattgctctagcagatgccctggacaatactggggccctgactgtagagagtcctgcccatgtcatccccatggccagtgcgagcctgccacgggagcatgtcagtgtcaggccgaccggtggggggccaggtgtgagttcccgtgtgcctgcgggccacatggaaggtgcgatccggcaacaggagtgtgccactgcgagcccggctggtggtcctccacgtgccggcggccatgccagtgtaataccgccgcagctcggtgtgaacaggctacgggtgcgtgtgtgtgcaaacctggctggtggggacgccgatgcagctttcgctgcaactgccacgggtccccttgtgaacaggatagcggcaggtgcgcatgtagacccgggtggtggggacccgagtgtcagcagcaatgcgaatgtgttcggggccgctgttctgcggcctctggggaatgcacgtgtccgcctgggttccggggcgccaggtgcgaattgccttgtccagctgggtcccatggcgtgcaatgcgctcattcctgcggtagatgtaaacacaatgaaccatgttctcctgacaccgggagctgtgagagctgcgaacctgggtggaacggcacccaatgtcagcagccctgtttgcctggtacctttggtgagtcatgcgagcaacagtgtcctcactgtcgccacggtgaggcttgcgaacccgacacagggcactgccagcggtgcgatcctggatggctgggccccaggtgtgaagatccttgtcctaccggcacgtttggtgaagattgtggatctacctgtcccacgtgtgtacaagggagctgcgatacggttaccggcgactgcgtctgttctgctggatactggggcccaagctgcaacgcgtcttgtccagcaggattccacgggaataactgcagcgtgccgtgcgaatgtcctgaaggcctgtgtcatcccgtttccgggagctgtcagcccgggtctggctctagggatactgcccttatcgccggaagtctagtgccattgctgctgttgttcttaggcctcgcctgctgtgcatgttgctgttgggccccgcgatctgatctgaaagaccgtcccgcaagggatggcgctactgtctcccggatgaagttacaggtgtggggtacacttacttcgctgggatccaccttgccctgcagatccctgagttcgcacaagttaccttgggtcacagtgagccatcatgacccggaggtgccgtttaatcatagctttatcgagccaccctccgctggctgggctaccgatgatagtttctcatccgaccccgagagtggcgaagccgatgaggttccagcctactgtgtgccgccacaagagggcatggtgccagtggcccaggcggggagtagcgaggcctctcttgccgccggtgcctttccgcccccggaagacgcaagcacccccttcgcgatccctcggacatccagcctagcccgagcgaaacgaccatcagtgagctttgcagagggaacgaagtttgccccacagtcacgccggagcagcggcgaactgagtagtccccttaggaaaccaaagaggctatccaggggggcccagagcggccccgaaggacgggaggcagaagagtcgaccggcccggaagaagcagaagcgcccgaatcatttcctgcagctgcaagccctggcgattccgccactggtcaccggaggcccccgctggggggaaggactgttgcggaacacgtggaggccatagagggatcagtccaagagagcagtgggcccgtcactacgatctacatgcttgctgggaaaccacggggctctgaggggcctgtccggtctgtattccgacacttcggctcatttcagaaaggacaggccgaggctaaggtgaagcgggcaatcccgaaacccccacggcaggcacttaaccgcaagaagggatctccggggttggcttctggatcagtcggacagtccccaaactcagccccaaaggcaggccttcctggcgcgacaggtcccatggctgtgcggcctgaggaggctgtgagaggattgggagctggaaccgaatcttctcgtcgagcacaagaaccggtgagtggatgtggcagtccagagcaggacccacagaaacaagccgaagaagaacgacaggaggagcccgagtatgagaacgttgtacctatctcccggcccccagagccctag

SEQ ID NO: 133508 - DNA, 2235 bp, Artificial Sequence
  Description of Artificial Sequence: Synthetic coding sequence
atgggcctcggactgctcctcccattgcttctgttgtggacccgagggacacagggaagcgagcttgatcctaagggtcaacacgtgtgtgtagccagctcaccttctgcggaattgcagtgctgtgctggttggaggcagaaggatcaggaatgcactatcccaatctgtgaggggcccgatgcttgccaaaaggacgaggtttgcgttaaacccgggttatgtcgatgcaaacctgggttcttcggcgcacactgttcctcacgctgtccagggcagtactggggccccgactgtagggaaagctgtccctgccatccacatggccagtgtgagcccgccaccggagcctgtcagtgccaggccgacaggtggggtgcacgatgcgaattcccctgcgcatgcggcccgcatggaagatgtgaccccgcgaccggcgtctgccactgtgagccaggatggtggagttccacatgtcggagaccctgtcagtgtaatactgccgctgctagatgtgagcaggcaacgggtgcctgcgtctgtaaaccagggtggtggggccgcagatgctccttccgctgcaattgccacgggagtccctgcgagcaggatagcggccgctgtgcgtgccgtcctggatggtggggccccgagtgccaacagcagtgcgaatgcgtccgcggccgctgctccgcagcctcaggtgagtgcacttgcccaccgggctttcgcggcgcacgatgcgaattaccttgtccagcggggtcccacggtgtgcaatgcgcccactcatgtggaagatgcaaacataacgagccttgcagtccagatacaggttcatgcgagtcctgcgagcccggctggaatgggactcagtgtcagcaaccttgtctgccaggtacatttggcgagtcatgcgaacaacagtgcccccattgccggcacggagaagcctgcgaaccggatactgggcactgccagcggtgctcaggatcccgcgacactgcactgatcgccggatccttggttccccttttgttgctgtttctgggtctggcgtgttgtgcatgttgttgctgggccccacgatctgatctcaaagacagaccagctagagacggggccacagtgtcccgcatgaagcttcaagtttgggggacactaactagcttgggctcaacgctaccatgcaggtcactgagtagccacaagctgccatgggtgaccgtttcgcatcacgatcctgaggtgccttttaaccactcctttatcgaacctccaagtgccggatgggcgacggacgatagcttttcgagtgatccggaatccggagaggcggatgaggtaccagcatactgcgtgcccccacaggagggcatggtgcccgtggcccaagcaggttccagtgaggcaagcctcgcagcaggagccttccccccgccagaggacgcatcaaccccatttgccattccgcggacttcttccttggccagggctaaacgaccgagtgtgagttttgcagaggggacgaaattcgcccctcaaagcagacggagcagcggagaacttagtagccccctccgaaaaccaaaacgcttaagcagaggcgcacaatcagggcccgagggaagagaagccgaagagagtacaggtcctgaagaggctgaagctccagaatcctttccggccgctgcaagtccaggtgattccgcaacagggcaccgtaggccgcccctgggaggtagaacagtagcggaacatgtcgaagccatagaggggtctgtgcaggaatcatctgggcccgtgaccacaatatacatgctggccggcaagccccgggggtcggagggacccgtaagatcagtgttcagacacttcgggagtttccaaaaaggccaggccgaagctaaagtcaaaagggccattccaaagcccccacgccaagccttgaatcggaaaaagggctccccgggactcgcttcgggttccgtggggcaatcacctaacagcgcacctaaagccggcctgcccggcgctaccggcccaatggccgtgcgccccgaagaagctgtcaggggcctgggcgctgggaccgaaagttcccgccgagcacaagagcccgtcagtggctgtggtagtcccgagcaggaccctcagaaacaggccgaggaagaacggcaggaagaacctgagtacgaaaatgtggtgccaatttcccgtcctccagaaccgtag

SEQ ID NO: 133509 - DNA, 1710 bp, Artificial Sequence
  Description of Artificial Sequence: Synthetic coding sequence
atgggcctggggctcctcctgcctttgctgttgttatggaccaggggaacccagggatctgaactagacccaaagggccaacatgtttgcgtggcgtcctccccttctgccgaactgcagtgttgtgccggctggaggcagaaggatcaggagtgcaccattcccatttgcgaggggccagacgcctgccaaaaagatgaggtttgcgtgaagccaggcttatgtcgctgtaaacctggcttcttcggtgcacattgtagctcaaggtgcccgggacagtattggggaccagactgcagggagtcttgcccgtgtcacccgcacgggcagtgtgaacctgccactggcgcctgtcaatgccaagccgacagatggggggctcggtgcgagttcccttgtgcttgtgggccccacggacgctgcgaccccgctaccggagtgtgtcattgcgaacctggctggtggtcctcaacatgccgaaggccctgccaatgcaacacggcagccgctagatgtgaacaggcaacgggagcttgtgtgtgcaaacctggctggtggggccgaaggtgttcctttcgctgcaattgccacggtagtccgtgcgagcaggactccggcaggtgcgcctgcagacccggttggtggggaccagagtgtcagcagcaatgtgagtgcgtgcgggggcgctgttcagctgcttccggggaatgtacttgtcctcccggttttagaggagcacggtgcgagctcccatgccctgcgggatcacacggcgtccagtgcgctcactcatgcggacggtgtaagcataacgagccatgtagtccagatacaggctcctgtgaaagttgcgagccaggctggaatggtacacagtgtcaacagccgtgtttgccaggcacgttcggggaaagttgcgagcagcaatgtcctcattgtcgccacggggaggcatgcgagcccgacaccgggcactgtcagcgttgtgatcccggatggctgggcccgcggtgcgaagacccctgcccaactggtactttcggagaggattgtgggtcgacctgcccaacatgtgtccagggaagttgcgacactgtcaccggagattgtgtttgcagcgcaggatactgggggccctcctgtaatgcttcttgtccagccggctttcacggtaacaactgtagtgtcccttgcgagtgtccagaggggctttgccacccagttagcggtagctgtcaaccaggctccggatcacgggacacagccctaatcgctggcagtctcgttcccttgcttctcttgttcctgggtctggcctgctgtgcatgctgttgctgggcgcccagatcagacctcaaggatcgcccagctcgtgacggcgccaccgtgtccaggatgaaactgcaagtctgggggactctcacctctttgggatccactcttccatgcagatcccttagcagtcacaagcttccttgggttactgctagctcatctcgtcccctgcctgccggccctctgatgacccctagccatcccatcctctcgctcgagcggcagatgcgatttctacctacagtgtgccaccccaaaaagggctggtcactttggccgcggcaggggaggcaacgccccgcctggctccaggtcctgtcacgcccactgcgtacaccacctaggcacagcccatctagggcccctcccgcatag

SEQ ID NO: 133510 - DNA, 2595 bp, Artificial Sequence
  Description of Artificial Sequence: Synthetic coding sequence
atggaaggggctggaccgcgaggggcgggcccagcccggagaaggggggccgggggacctccctccccactcctgccctcacttctgctcctattacttctatggatgctcccagacacagtggctccacaggagctgaacccccgaggacgcaatgtgtgccgggctccgggctcacaggtgccaacctgttgcgccggatggcggcagcagggtgatgagtgtgggatcgccgtgtgcgaagggaactctacctgttctgaaaacgaggtttgcgtgagacctggcgagtgccgctgcaggcacggatactttggcgctaactgtgacaccaagtgcccacggcagttctggggtcccgactgtaaggagttgtgctcctgccacccgcacggtcaatgcgaggatgtgactggccagtgtacgtgtcacgcccgaagatggggggcgcgttgtgagcatgcctgtcagtgtcagcacgggacttgccacccccggtcaggggcatgtaggtgtgagccgggttggtggggtgcccagtgtgcctcagcatgctactgctcggcaacttcccggtgcgacccccagacgggcgcctgcctgtgtcatgccggctggtggggcagatcctgtaataaccagtgcgcatgtaattccagtccatgtgagcagcaaagcggtcgatgtcagtgtcgcgaaagaacttttggagccaggtgcgatcgttattgccagtgctttcggggaaggtgtcaccctgtagacgggacctgcgcctgtgagccaggttacaggggtaagtactgccgcgaaccttgtccggcgggtttctacggcctggggtgccggcgcagatgcgggcagtgtaaaggacaacaaccttgtaccgtagcagagggtagatgcctcacatgcgagcctggctggaacgggaccaaatgtgaccaaccatgcgcaacaggtttctatggggagggttgctcacatcggtgtcctccctgccgggatggccacgcatgcaatcatgtgacaggaaagtgtacgcggtgcaatgccggatggatcggcgacaggtgtgagacaaaatgtagtaacggaacttacggggaagactgcgcctttgtttgtgctgactgtggaagcggtcattgtgatttccagtccggaagatgcctctgcagcccaggcgtgcatggccctcactgtaatgttacctgccccccggggctgcacggcgctgactgtgcgcaagcatgttcctgccacgaagacacgtgtgacccagtgaccggcgcatgtcacctggaaacaaatcagcggaaaggtgtgatgggtgccggagccctactggtacttctcgtatgcttgctcctgtcactgctcggttgctgttgcgcatgtagggggaaggacccgaccaggagagagctttctctcggcagaaagaaagccccacacagactttgcggaagattctcacgaatctctatgaaactgccgagaatacctctacggcggcagaagctgcccaaggtggtggtcgctcatcacgacctggataacactctgaactgttcattcctggagccgcccagcgggttggaacagcccagtccctcatggtcttcgcgggcttctttttcatcattcgacactactgacgaggggcccgtgtactgcgtccctcatgaagaagctcccgccgagtcgcgcgacccagaggtgcccacagtgcccgctgaagctccagccccgtctccagttccactgacgacacccgcgtctgctgaggaagcgattcctctgccagcctcttccgactctgaacgatccgcttcttcagtcgagggtcccggcggtgccctttatgcgcgcgttgctagaagggaggcacgcccggctagggctcggggggaaatcggaggactctctcttagtccaagcccggaaaggcggaagccaccgccgcccgaccccgccacaaagcctaaagttagctggatacatgggaaacactctgcagccgccgctgggcgtgcacccagcccaccccctcccggaagtgaggcagccccaagtccctctaaacggaagcgcacccccagcgataaatccgcgcacacggtggagcatgggagcccacggacacgggaccccacgcctcggccccctggtctcccagaggaggctacggccctggcagcgccaagcccccccagagcccgcgctcgtgcccggccaggactcctggaaccaacagatgcagggggacccccgaggtctgccccagcggcttctatgctggctgctgatgttcgaggcaagactaggtctcttggccgggcagaagtggccctgggcgcccagggacccagggagaagcccgcccccccacagaaagccaagagatctgtgccccctgctagcccagcccgtgctccgcctgctacggaaacccccggtccggaaaaagcagcaaccgacttgccagctcccgaaacgcctaggaaaaagactccaattcagaagccgcctaggaagaagagcagggaagcagcgggcgagcttggacgcgccggagctcccacattgtag

SEQ ID NO: 133511 - DNA, 2598 bp, Artificial Sequence
  Description of Artificial Sequence: Synthetic coding sequence
atggagggggccggcccccggggtgcgggtcccgcgagacgcagaggtgccggcgggcctccttcgcccctccttccatcattgttgttgctgcttttgctctggatgttacctgatacagtggctccccaggaactgaatccgaggggcagaaacgtctgtagagcccctggtagccaggtgccaacatgttgtgctgggtggcggcagcaaggcgacgaatgtgggatcgccgtctgtgaaggcaacagcacctgtagcgaaaacgaggtctgcgttagaccaggggagtgtaggtgccggcacggctacttcggtgcaaactgcgacactaagtgcccgcgtcagttctggggcccagattgtaaagagttgtgttcctgtcatccccatgggcagtgcgaagatgtaacagggcagtgcacatgtcatgcacgaaggtggggcgctagatgtgagcacgcgtgccagtgccagcacggaacatgtcatcccaggtccggagcttgtcggtgtgagccaggctggtggggcgctcagtgcgcaagcgcttgctattgcagtgctaccagtaggtgcgacccccagacaggagcctgtctgtgccacgctggctggtgggggcggagctgcaataatcagtgtgcatgtaacagctctccctgcgaacaacagagcggacggtgccagtgtcgtgagagaacgtttggcgcgcggtgtgacaggtattgtcagtgtttccggggacgatgtcacccggtggacggtacctgtgcatgtgaaccgggatatcgcggtaaatactgtcgggaaccctgtcctgcaggattctacggacttgggtgtagaaggcgctgcgggcaatgtaaggggcaacagccatgcaccgttgccgagggccgctgcctgacttgcgaacctgggtggaacggcactaaatgcgatcagccctgcgctactggcttctatggcgaggggtgcagtcatagatgtcccccctgtagagacggccatgcatgtaaccacgtcactggaaagtgtaccaggtgtaatgctggatggattggtgataggtgcgagaccaagtgtagcaatggcacatacggagaggattgtgccttcgtgtgtgctgactgcggatcaggacattgtgattttcagagtggccggtgtctgtgttctccaggagttcatggacctcattgcaacgtcacctgtcctcccgggctccacggagcagattgcgcccaggcatgttcttgccacgaagacacctgtgatccagtcactggtgcctgtcacctagagacgaaccaacgcaagggcgtgatgggagctggagcattgctagtcctgttggtttgtcttctgctgtcactgctcggatgttgctgtgcatgcagaggcaaagatccgaccaggagggaactcagtttggggagaaaaaaagctcctcataggctctgtgggaggttctcccgaatttccatgaagctgccccggattcctctgcggcgacagaaactcccaaaagtggtcgtggcgcatcacgatcttgacaacacactgaattgcagcttcctcgagcccccttcaggcctggaacagccttctccctcatggagctctagggcatccttctcttcttttgataccaccgatgagggccccgtgtactgcgtcccccatgaggaggcccccgccgagtcgagagaccccgaggtacccacggtgccagctgaagctccggctccctctcccgtgccgctgaccactccagctagcgccgaagaagccattcctttacctgctagctcagattcagaacgctcagcaagttccgtggagggccccgggggggccctttacgcccgtgtagccagacgtgaagcccgacccgcccgagcccgtggagagatcggaggtctcagcctgtccccaagcccagagcgacgcaagccacccccccctgatccagcaactaaacctaaagtgtcatggatccacggaaaacacagtgccgccgccgccggcagagcaccgtcacccccgcctcctggttccgaggccgctccctcaccttctaaaaggaagcgtacaccgtcagataaatctgcgcacaccgtcgagcacggctccccacggacaagggaccctaccccacggccgcctggcctgccggaggaagcaaccgctctggcagccccatcacctcctcgcgcgcgggcaagggcagcgcccagaccattaggtgcccatgggcggagacgatctcccgccaagcgcgccgaggcggctagcatgttggctgctgacgtgcggggtaagacgaggagtctcggacgggcagaggttgctttgggggcgcaggggccacgtgaaaaacccgctccacctcaaaaggcaaaaaggtccgttccaccagccagcccagctagggcccctcctgctacggagacacctggacccgaaaaagcagccacagatttaccagctccggaaactcctagaaagaaaacgcctatccagaagccaccgcggaagaaaagcagagaggccgcaggagaactggggcgcgccggcgccccaacgctttag

SEQ ID NO: 133512 - DNA, 1728 bp, Artificial Sequence
  Description of Artificial Sequence: Synthetic coding sequence
atgcacaaggaggcggagatgctcatcggcccacagctggatgagaagagatggggttggcggctgggcgatggttctgcggccccgccattcttgccccaggcgctcagctttctcttattattgcctctggccagcgctctgcaaccaaccccattgcctttccaagagctacgactagtgggtggaccttcgcgctgtcgcggcagactggaggtgatgcacggggggtcttggggatcagtctgcgacgacgattgggatgtcgtggatgctaacgtagtgtgccgccagctgggatgtggacttgctttacccgttccgcggccactggccttcgggcagggccggggcccaatactgctcgataacgtcgagtgtcggggtcaagaggcagctcttagcgagtgtgggagtcgagggtggggcgtgcataattgcttccactacgaggacgtcgctgtcctatgtgacgaatttctgcccacgcaaccaccgactagaaagatgttgacctctagagcgccgcccactaccttacccaatggaaagagtgaaggttctgtcaggctggtcggtggcgccaacctgtgtcagggacgcgtggaaatcttgcactcggggctgtggggtacagtgtgcgacgacgattggggcctgcctgatgcggccgtagtgtgccggcaactagggtgcggcgctgccatggccgctaccactaacgccttttttggctatggcactggccatatcctgctggacaacgtgcactgcgagggcggggagcccaggttggcagcctgtcagtcattaggctggggggtccataactgtggccaccacgaggatgccggcgccctgtgcgctggcctcggacccccaacactgacagctctgcccagttctgcgacccgggaggactgggcttggcagactgacccttccgccactggcgttggaccacagccctctagagagacggcattgctcacaactgccgcctgggccgcaggtaagaagagtggccgacttcgcctggttgggggaccaggcccttgtaggggacgcgtggaggtgctgcatgccggaggctggggaaccgtgtgcgatgacgattgggattttgcagatgcccgggttgcttgcagggaagctggctgcgggccggccttaggagctactggattgggtcatttcggctacggccgcggacctgttctactggacaacgtgggctgcgcgggaaccgaggccagactaagcgactgtttccatctgggctggggccagcacaattgtggacaccacgaggatgcgggcgccctgtgcgctgggccggaggagctgggtctgcaggtccaacaggatgggtctgagaccaccagagttccaacgccaagaccgcgcgacggccatctgcgccttgttaatggcgctcacagatgcgaaggccgagtggagctgtatctgggacagaggtggggaactgtatgcgacgatgcatgggacctgcgcgctgctggagtactctgtagacagctgggatgtggccaggcactagccgcaccaggggaggcccactttggcccaggccgtggtcctatcctgctagacaatgtcaagtgccgcggagaagaatccgctctgcttctctgctcccacattcgctgggacgcccataattgcgaccatagtgaagacgccagcgttctctgccagcccagctag

SEQ ID NO: 133513 - DNA, 849 bp, Artificial Sequence
  Description of Artificial Sequence: Synthetic coding sequence
atgtcaaacgtcacactccgaaagatgtcccccacaggcaatgaaatgaagtctaccacgcaaggaaccacccggaagcagcaggacttccatgaagttaataagagacgcacatttctgcaggacaactcttggatcaaaaagagaccagaagaggagaaggatgagaattacggacgtgtagtactgaatcgccacaactcccacgatgcacttgaccgaaaagtaaatgagcgcgatgtcccaaaggccactatctctcggtactcatctgacgacaccctggatcgctctatgtcaatgtttcggtcacttgaggtgaccaagctgcagccagggggaagcctgaacgcgaatactagtaacaccattgcatcaacatccgcaactacccccgtcaagaagaaacggcagtcctggttccccccccctccaccgggctacaatgcctcctcctctaccgggacgcgaagaagagagcccggagtgcacccacctatccctcccaagcccagtagtccagtctcttcgcccaaccagttaagacaagacaaccgacaaatccaccctccgaaacctggtgtgtatacagaaactaatagatcagccgagcgcaatataagcgaggaacttgataaccttataaagatgaacaagagtctgaaccgcaatcagggccttgattcactcttccgggccaacccaaaagtggaagaacgcgaaaagagggccaagtctctggagagcttgatttatatgagtactagaactgacaaagacggtaaggggattcagtctcttggttcacccattaaagttaatcaacgtacagacaaaaacgaaaagtag

SEQ ID NO: 133514 - DNA, 2067 bp, Artificial Sequence
  Description of Artificial Sequence: Synthetic coding sequence
atgtccaatgtcacgctgcggaagatgtctccaactggcaacgaaatgaagagcaccactcaggggacaacgaggaaacaacaggacttccatgaggtgaataagagaaggacgttcctgcaggataattcctggattaagaagaggcctgaagaagaaaaggatgaaaactatggcagggtggtgctaaataggcacaactctcacgacgcactggatcggaaggtcaatgaacgggatgtacctaaggccaccatttcccgttatagctctgacgatacgttagaccgcatcagtgatcgtaacgacgccgcaaagacttacaaagctaacactctcgacaaccagctgactaataggtctatgtctatgttccggtctctggaagttacaaaactacaaccaggaggttcacttaatgcaaacacatctaacactatcgcctcaaccagcgctacaacacccgtgaaaaagaagagacaatcctggttcccgccacccccaccggggtataacgcttccagtagcaccggcaccagacggagggaacctggcgtgcaccctcccataccgcctaagccctcttcacccgtgagctcccccaaccagctgaggcaggacaacaggcagatccatccccccaaaccaggggtctatactgagactaaccgcagtgctgagagaaatattaggtcccaggatcttgataatattgtcaaagtggcgacttcactgcagagatcagataaaggggaggaattagacaatctgattaagatgaacaaatcgttaaacaggaatcaaggtctggattccctctttcgcgccaatccaaaggtagaggagcgggagaaaagggccaaatctctggagagccttatctacatgtcaactcgtactgacaaagacggcaagggcattcagtctctggggagcccaatcaaagtcaatcagcggacagacaagaatgaaaagggaagacagaatctggaaagtgtcgctaaagtgaatgcgcggatgaataagacatctcggaggagtgaggacctcgacaacgcgactgaggtgaacccaaagggccatgaaaatacaacaggtaaaaaagacctggatgggctaattaaggtcgatcctgaaactaataagaatatcacccgcgggcaatccctagataacctgatcaaggtcacccccgaagttaaacggtctaaccaggggagcaaggacctgaacaacttcatcaaagtgtaccctggaacagagaaaagtacagaaggcggccagtcactagactccctgataaaggttacccctgagagaaaccgcaccaatcagggcaaccaggacttggaaaatttgatcaaagttatcccctccgccaacaaatcgagcgagcaggggctcgacgagcatattaatgtgtcacctaaggccgtgaagaacacagacggaaagcaggatctggacaaattgatcaaagtcaatcccgaaatctttaccaacaaccagcgaaaccaggacctggcgaacctgattaaagtgaatcctgccgtcatccgcaataaccagtctcaggatctggataatctgatcaaggtgaaacctagcgctctgcgaaacactaaccgcgaccagaacctggagaatttgatcgaagtgaattcacatgttagcgagaataaaaatgggtctagcaatacaggagctaaacaggctgggcctcaggacacagtggtatacacccgaacctatgtggaaaattctaagtctccgaaggacggttaccaagaaaatatcagcggaaagtacatccagacggtgtattctacttcagatcgttccgttatagagagggatatgtgcacctactgccggaaaccactaggcgtcgagacaaaaatgatcttagatgaacttcagatctgttgtcactccacctgcttcaaatgtgaaatctgtaagcagcccttggaaaacctccaggccggggattcgatatggatctatagacagaccatccactgcgaaccctgctacagcaaaattatggccaaatggataccatag

SEQ ID NO: 133515 - DNA, 2007 bp, Artificial Sequence
  Description of Artificial Sequence: Synthetic coding sequence
atgtctaacgtcactctacggaagatgagcccaacgggcaacgagatgaagtccactacccaaggcacaacaaggaaacagcaagacttccacgaagtgaataaacgccgcaccttcctgcaggacaattcctggattaagaagcgccccgaggaggagaaagacgagaactacggaagggtcgtgttgaacagacataacagccatgacgcactggacaggaaggtaaacgaacgggatgtcccgaaagctacaatttcaagatatagcagtgacgacacactggacagaatttctgaccggaatgatgccgccaagacatataaggcgaacaccttagataaccagctgaccaatagatccatgtctatgtttagaagtctcgaggtgacaaaactccagcccggcggatccctgaatgcaaatacctcaaataccatcgccagcaccagcgctacaacgccagtaaaaaagaaaaggcagagctggttcccgccgcccccccctggatataatgcttcgagctcaacaggcacccgccgccgagagcccggtgtacacccccccattcccccgaaacctagctcacccgtaagctcaccgaaccagcttagacaggacaataggcaaatccatcctccaaagcccggggtctatactgagaccaacaggtcagcagaaagaaacatctctgaagaattggacaatctgataaaaatgaacaaatctctaaacagaaaccagggattagatagcctttttcgagctaatcctaaagtggaggagcgcgagaaacgcgccaaatccctcgagagtctgatctacatgtctacccggacggacaaggatggtaagggaatccaaagtctgggctcacctattaaagtgaaccaacgtaccgataaaaatgagaagggacggcagaaccttgaaagcgtagccaaggtgaacgccagaatgaataagacatctcggcgtagtgaggacttggacaacgcaaccgaggtgaaccctaaaggacatgagaatactacagggaaaaaggatctggacggcctgatcaaggttgatcccgaaactaacaaaaatatcactcgggggcagtccttggataatctgatcaaggtgaccccggaggtcaaacggtcaaaccagggtagtaaggatcttaataatttcatcaaggtttacccaggaacagaaaaatccacggaggggggtcaaagtctggactctttgatcaaggttacccccgagagaaacagaaccaatcaagggaaccaggatctcgagaatttgattaaagtaatcccttcagctaataaatcctccgaacagggactggacgaacacatcaatgtgagtcccaaggccgtgaaaaacacggatggcaaacaagatttggacaaactcatcaaagttaatcctgaaatctttacaaataaccagcgtaaccaggacctggccaatctcatcaaagtaaatcctgcggtgattcgcaacaaccagagccaagatctggacaatcttataaaggtcaagccaagtgctctgcgaaacacaaatcgcgatcagaatctggaaaaccttatcgaggttaactcccatgtatctgaaaacaaaaacggtagtagcaacacgggcgccaaacaagctggtccccaggacaccgtcgtgtatacccggacatatgtggaaaactcgaagtctcccaaggacggttaccaggaaaatataagcggcaaatatatccaaactgtatactctacatcggaccgatcggtcattgaacgggatatgtgcacatattgtcggaagccccttggcgttgaaactaaaatgattctggatgagctgcaaatctgttgccatagcacttgctttaagtgcgagatatgtaagcagccacttgagaatctccaagccggggactcgatatggatatatagacagaccatccactgcgagccttgttacagtaagattatggctaaatggatcccttag

SEQ ID NO: 133516 - DNA, 1941 bp, Artificial Sequence
  Description of Artificial Sequence: Synthetic coding sequence
atgagcaatgttacactccggaagatgtctccaacgggcaacgaaatgaaatcaactacacagggcaccacccgcaaacagcaggattttcacgaggtaaacaaaagacgcaccttcctccaagataacagttggatcaaaaaacgacccgaagaagagaaggacgaaaactacggacgggtggtgctgaataggcacaattcccatgacgccctcgatcggaaagtgaacgagcgcgacgtaccaaaggcaaccatctccaggtactcctcagacgacaccctggatcgaatttctgatagaaacgatgcagcaaagacgtataaggccaatacgctggataaccagctcactaatcgctccatgtccatgttcagatccctggaagtaacaaaactgcagccgggtggttcgcttaacgctaatacttcaaacaccatagcgtccacatccgccacgacacctgtgaagaagaagagggaaccaggagttcacccacccatccccccaaagcccagctcccctgtgtctagcccgaaccagctcaggcaagataaccgacagattcacccaccaaagccaggggtctatacagaaacaaaccgctccgctgaacgaaacatccgtagtcaagatctagataatattgtcaaggtcgccacaagcctgcagcgttcagataaaggggaggagcttgataacctcatcaaaatgaacaagagcttgaacagaaatcaggggctcgattctctttttcgagcaaaccctaaagtcgaggagcgagaaaagcgggctaagagcctggagtcattaatatacatgtctacccggacagataaggatgggaagggaatccaatctttggggagtccgattaaagtgaaccaacgtacggacaagaatgaaaaaggtcgtcagaatctcgagtccgtagcaaaagtcaacgcacggatgaataaaacgagtaggaggagcgaagatttggataatgccaccgaagtgaacccgaagggccacgaaaataccactggaggacagtccctcgataacttgatcaaagtcactccggaggtgaaaagatcaaaccaaggcagtaaagaccttaacaactttatcaaggtctaccccggaacagagaaaagtaccgagggaggtcagagcctggactcccttattaaagtgacgcctgaaaggaatagaactaaccagggaaatcaggatctggagaatctgatcaaggtaattcctagcgcaaacaagagttctgagcaaggcttggacgaacacattaatgtgagcccaaaagccgtgaagaatactgatggaaaacaggacctggacaaactgattaaggtcaacccagagatctttactaacaatcaacgaaaccaggacctcgccaacttaatcaaagtgaaccccgcagttattcgaaacaatcagtctcaagatctggacaaccttattaaggtaaaaccttcggccctcagaaatacaaatcgcgatcaaaatctggagaacctgatagaagtgaacagtcacgtgtccgagaataaaaacgggtcttccaacactggtgccaagcaggctggaccgcaagatactgtggtctatacacgcacatacgtagagaactcaaagagcccgaaagacggctatcaagagaacatttcaggtaaatatatccagacagtgtactccacaagcgatcggtcagtgattgagcgggacatgtgcacctattgtaggaaacccctgggtgtcgagaccaagatgattctggacgagctgcagatctgttgtcattccacctgcttcaagtgcgagatttgcaaacagccactggaaaacctgcaagcaggagactccatctggatctacagacaaaccatccattgtgaaccctgttactccaaaattatggccaaatggatcccctag

SEQ ID NO: 133517 - DNA, 2148 bp, Artificial Sequence
  Description of Artificial Sequence: Synthetic coding sequence
atggcccgcgagctttaccatgaagaattcgctcgggccgggaagcaggccggattgcaggtgtggagaatagagaaactggagctggtacccgtcccccagtcagcccacggcgatttttatgtgggcgacgcatatcttgtgttgcatactgctaaaactagccgaggcttcacgtaccacctgcacttttggttgggaaaggagtgctctcaggacgagtcaactgctgcagcaatctttacagttcagatggatgattatctgggcgggaagccggtgcagaatagggagctccagggctacgagtctaatgacttcgtcagttactttaagggtggtttgaagtacaaggcaggtggcgtggccagtggactcaatcatgtcttgaccaacgacttgaccgcgaagcggctgctccatgttaaagggaggcgggtagtccgcgctaccgaggtccccctcagttgggattcatttaataaaggagattgttttatcattgaccttggcacagagatttaccagtggtgcggcagctcctgtaataagtatgagagattaaaagcgaaccaggtggccacgggaattcgctataatgagcggaaggggcggtctgagttgatagtggtagaggagggctccgagccgtctgaactgatcaaggtgctaggagagaagccagagctgccagatgggggcgacgatgatgacatcatagcagacatcagcaacaggaagatggcgaagctgtacatggtttccgatgccagcggcagtatgcgagtcaccgtagtcgctgaagaaaaccccttttcaatggcgatgctcttaagcgaagaatgcttcatcctggaccacggagctgctaagcagatcttcgtgtggaagggcaaagatgctaatccacaggagcgaaaagctgcgatgaaaacagccgaggaatttttacagcagatgaattattccaaaaatacccagattcaggtgttgcccgaaggcggagagacgccaattttcaaacaattctttaaggactggagggacaaagaccagtcggatggcttcggcaaagtctacgttactgagaaagtcgcccagatcaagcagatcccattcgatgcctctaaactgcactctagccctcaaatggcagcacagcacaatatggttgatgacgggagcgggaaggtggagatctggagggttgaaaacaacgggaggatccaggttgaccagaacagttacggcgagttttatgggggcgactgttatataattctctacacgtacccgagaggccagataatctacacctggcagggcgccaacgccacccgcgatgagctgaccactagcgccttccttaccgtgcagctggacaggagcctcggcggacaggcagtacagattagggtgtctcaagggaaagaacccgtgcacctcctgagcttatttaaggataagccattaataatctataaaaatgggacatctaagaagggtggtcaagctcctgcccctcccacccgtctgtttcaggtgaggaggaatctggcgtctatcactagaattgtcgaggtagacgtcgacgcaaactctctgaactcaaacgatgtattcgtgctgaagctgccacagaatagcggctacatctgggtgggtaaaggtgcctcacaggaggaggaaaaaggggccgaatatgtggctagtgtactgaaatgcaagacgctgagaattcaggaaggtgaagaacccgaagaattttggaacagcctgggcggtaagaaggattaccagacttctccactcctagagactcaggccgaggaccatcctcccagactttatgggtgtagtaacaaaactgggagattcgtcattgaagaaattccgggcgaatttacccaggatgacctcgctgaggatgacgttatgctgctagatgcttgggaacagatatttatatggatcggaaaggacgccaacgaggtcgagaaaaaggagtctctgaagagcgcaaaaatgtatctcgaaacagatccctctggcagagacaagcggaccccgatcgtgatcataaagcaagggcacgagcccccaaccttcacgggatggttcctcggatgggattcatctaaatggtag

SEQ ID NO: 133518 - DNA, 1407 bp, Artificial Sequence
  Description of Artificial Sequence: Synthetic coding sequence
atggcaaaattgtatatggtgtccgatgctagcggatctatgcgggtgacggtggtcgcagaagaaaatcccttctctatggccatgcttttatcagaggaatgttttatcctcgaccacggcgccgccaagcagatcttcgtatggaaggggaaggatgccaacccccaggagcgcaaggcagcaatgaagacagccgaggagtttctgcaacagatgaattacagcaagaacactcagatacaggtactgcctgagggtggcgagactcccatttttaaacagttcttcaaagattggagggacaaggatcaatccgacgggttcgggaaggtctatgtaactgagaaagtggcccagatcaaacaaattcccttcgacgcctccaagctgcacagcagtccccagatggccgctcagcacaatatggtggacgacggctctggcaaagtcgaaatatggcgcgtcgagaataacggcaggatccaggtcgatcagaattcttacggggaattctatggtggcgattgttatatcatcctttacacttaccctagaggccagatcatctacacatggcagggtgccaatgccactcgggatgagctgacaaccagcgcctttctcaccgtccagcttgataggtccctgggcgggcaagccgtccaaatacgcgtctctcaaggaaaggaacctgtccacctgctcagcttgttcaaagataagccattgattatttacaaaaatggcacctccaaaaaaggtggacaggccccagcgccaccgacaagactgttccaagtccgccggaacttggcctcaattactaggattgtggaagtggacgtggacgcaaactccctaaattcgaatgacgtcttcgtcttaaagctcccacagaactcgggttacatctgggttggcaaaggggcgtctcaagaggaagaaaagggggctgagtatgtggcttccgtcttaaagtgcaagactctaagaatccaggaaggagaggagcctgaagaattctggaacagccttggaggcaaaaaagactaccagacaagcccgctcctcgagacacaggccgaggatcatccaccaagactgtatggatgtagcaacaagactgggagatttgttattgaggaaattccaggggagttcacgcaggatgacctcgcagaagacgacgttatgcttctggatgcctgggaacagatcttcatttggatcggtaaggatgccaacgaagttgagaagaaagaatctctgaagtctgccaaaatgtacttggagacagacccatccggaagagataagaggacccctatcgtgatcattaaacagggtcacgaaccaccaacttttacaggctggttcctgggttgggatagcagcaaatggtag

SEQ ID NO: 133519 - DNA, 1407 bp, Artificial Sequence
  Description of Artificial Sequence: Synthetic coding sequence
atggcgaagctttatatggttagcgatgcgagtgggtccatgcgcgtgactgtggttgcagaagagaatccattcagtatggctatgttgttgtctgaagagtgttttatcttagaccatggtgcagctaaacagatcttcgtgtggaagggcaaggatgccaacccacaggaacgcaaagccgcgatgaagacagcagaggaattcttgcagcagatgaattacagcaaaaatacgcagattcaggtccttcccgagggtggggagaccccaatctttaaacagttctttaaagattggcgagataaggaccagtctgacggatttggtaaggtatacgtaacggagaaggtggcccagatcaagcagatcccctttgacgcctcaaaactccactccagtccccaaatggctgcacaacacaatatggtggacgacggatctgggaaagtggaaatctggagagtcgagaataatggaaggattcaggtcgaccagaactcttatggtgagttctatggcggagattgttacatcattctctacacatatccacgaggccaaatcatttacacatggcagggcgccaatgccacccgggatgagctcacaacttccgcatttctgactgtacagctggacagaagcctgggcggccaggcagtgcagattagagtctctcagggcaaagaacctgtccacctgctcagtttgttcaaagataaacccttgattatttataagaatggtacaagtaagaagggtgggcaggctccagccccacccaccaggctattccaagtaaggcggaacttggcctccataacgcgtatagttgaggttgatgtggatgcgaacagcttgaattccaacgatgttttcgttcttaagcttccccaaaattcagggtacatttgggtaggcaagggcgcctcccaggaagaggaaaaaggcgccgaatacgtagccagcgtgttaaagtgtaagacattacggatacaggagggcgaggagccagaggaattctggaattctttgggtggtaaaaaagattaccagaccagcccattactggagacccaggcggaagatcaccccccaaggttgtacggctgcagcaataagactggccgctttgtcatagaagaaattcctggcgaattcacacaggatgacttagcggaggatgatgtgatgttgctcgacgcgtgggaacagattttcatttggattggaaaggacgccaatgaggttgaaaaaaaagaaagcttaaaatccgctaagatgtaccttgaaaccgatccaagcggccgcgacaagcgtacacccatagttatcattaaacaggggcacgaaccaccaacatttaccggttggtttctgggatgggattccagcaagtggtag

SEQ ID NO: 133520 - DNA, 3864 bp, Artificial Sequence
  Description of Artificial Sequence: Synthetic coding sequence
atggaacctatctatcccttcgcccggccccagatgaatacgcgttttccttcctctagaatggttcccttccatttcccacccagtaagtgtgccctgtggaatcccactccgaccggagattttatttacctacatctcagttattacaggaacccaaagcttgtggtaacagagaagaccatccggttggcgtaccgtcacgcaaaacagaataagaagaattccagttgcttcctgcttggatctctcactgcagatgaagatgaagagggcgtgaccctaacagtggatcgcttcgacccaggccgagaggtccctgagtgtctcgagattactcctactgcttccctcccaggagactttctcatcccatgcaaggttcacacccaggaactgtgctctagggaaatgatcgttcactcagtagatgacttctcgtcagcccttaaggccttacagtgtcatatctgttccaaggactccctggactgtggaaaactgttgtccttaagggtacacatcactagccgggaatcacttgattccgtcgagttcgatctccactgggcggctgtcacacttgcgaataatttcaaatgtaccccagtgaagccaattccaatcataccgactgctctggcaagaaacttgagcagtaatctgaacataagccaggtacagggcacttataaatatggatacttgaccatggacgaaactcgaaaacttctcctactcctggaatctgatcctaaggtatactccctgcctctggtgggtatatggttaagcggaatcacccacatttactcgccacaagtttgggcctgttgcctgagatacatcttcaacagcagtgttcaggaaagagtttttagtgagtcaggcaatttcattatagtgttatacagtatgacgcacaaagaaccggagttttacgagtgttttccatgtgatggtaagattcccgactttagattccaactcctcacatcaaaagagaccctacaccttttcaagaacgttgagcccccagataagaaccctatccggtgtgagttaagcgcagagtcacagaatgcagagaccgagttcttctctaaagcctcaaagaacttcagtatcaaacgcagtagtcagaagctaagttcaggcaaaatgcctattcacgaccacgactcaggcgtagaggatgaggatttttcacctcggcctatcccatctccccatccggtatctcaaaagatctccaaaattcagccatcagtgccggagctcagtctggtcttggacggcaactttatcgaatccaaccccctccctacgcccctggagatggtcaataacgaaaacccacccctcatcaatcatctcgaacatctcaagccgctgcagcctcaactatatgatgaaaagcactcacccgaggtagaagcaggcgagccatcgctgcgtggcattccaaaccagctaaaccaggataagcctgcacttctacgacattgcaaagtgcgccagccccctgcttataagaaggggaaccctcacactcgtaatagtattaagccaagctctcataatggaccgagtcacgacatcttcgaaaagctacaaacagtgagcgctggtaatgtccagaatgaagagtaccccatccgcccatctactttgaattctagacagtctagcctggccccacagtcccagccccatgactttgtgttttctccacataattcagggaggcctatggaactgcagattcccaccccccctttgccatcttattgctctaccaacgtttgccggtgttgccagcaccactcccacatccaatattcacccctaaactcatggcagggcgcaaataccgtgggctcaattcaggacgtccaatcagaggccttacagaaacattctctttttcacccctccgggtgtcccgctctttattgcaacgccttttgctcaagctcttcccccattgccctccgtccacagggagatatgggctcgtgctccccccacagcaatattgaaccttcccctgtggccaggccgccgagtcacatggacctctgtaatccgcagccttgcacggtgtgcatgcacacacccaaaacggagtctgataatggtatgatggggttgtccccagacgcctacaggtttttaactgaacaggaccgtcagctgcggttacttcaggcccagattcagagactcttagaagcacagagcctgatgccttgcagccctaagacaactgctgttgaagatactgttcaagccggaagacaaatggaactggtatcagtcgaggctcagagttcaccaggtctccacatgcgcaaaggggtgagcatagcagtgagcaccggggccagcctgttctggaacgctgctggagaggatcaggaaccagattcacaaatgaagcaggacgacactaagatttcaagcgaggatatgaatttcagcgtggacataaataacgaagttacatctctgcccggctcagcctcatccttgaaggcggtggatatccctagtttcgaagagtctaacattgctgtggaagaggagtttaatcagcccctgtcagtgtcaaactcgtcgctggttgtgagaaaagaacctgatgtgccagtcttcttcccctcaggtcagctggcagagagtgtctccatgtgcttgcagaccggtcccactggcggagcctctaataattccgaaacgtcagaggagcctaagatcgaacatgtaatgcagccactgttgcaccagccttccgacaatcaaaagatctatcaggatctcttggggcaggtcaaccatctactaaactcaagctcgaaggagacagagcagccgagtactaaggctgtcatcatcagtcatgaatgcaccagaactcagaatgtgtaccatacgaagaaaaagacacaccactcccgcctcgtcgataaggactgtgttttgaatgccacgctcaaacagcttagaagtctgggagtcaaaatagactctcccacgaaagtgaagaagaacgcccacaatgtcgatcatgctagcgtactggcatgcatctcccctgaggcagttatttctgggttaaactgcatgagcttcgcaaatgtgggaatgagcggcctgagcccaaacggggttgatctctctatggaggcgaatgccattgcgctaaagtacttgaacgagaaccagctttcccagctcagcgtgacgcggagtaaccagaataattgtgatccattctctctattacacattaacaccgaccgctcaacagtgggattaagtctcatttcccccaacaatatgagcttcgccactaagaagtacatgaaacgatacggtttactgcagtcctctgacaacagtgaggacgaggaggaacctccagataacgccgacagcaagagcgagtacctgctcaaccagaacctacggtcgataccagaacagttgggaggccagaaggagccctccaagaacgaccatgagattataaattgttcaaactgtgaaagcgtcggaacaaatgcagatacgccggtgctgaggaacatcactaacgaagttttgcagaccaaagctaaacagcagctaacggagaaaccggcgttcctagtgaaaaatctgaaacccagtccagccgtgaatctgagaaccggcaaagccgaatttactcagcatcccgagaaagagaacgagggcgatataacgatctttcccgaatctctgcagccgagcgaaacgctgaagcaaatgaattccatgaattctgtgggcaccttcctggatgtcaagagacttcggcaactccccaaactattttag

SEQ ID NO: 133521 - DNA, 3864 bp, Artificial Sequence
  Description of Artificial Sequence: Synthetic coding sequence
atggagcctatctatccgttcgcccggcctcagatgaatacacgctttccctcctcaagaatggtgccttttcacttcccaccttcaaagtgcgcactgtggaacccaactcccacaggcgattttatctatttacacctttcttactacagaaatccaaagttggtggtaactgaaaagacaatcaggctggcgtatcggcatgccaagcagaataaaaagaactctagctgctttttgttgggtagtttaaccgcggatgaagatgaggaaggagtcacactaactgttgatcgctttgaccctggacgtgaggtgcctgaatgcctcgagattacccctacggcgtctcttcccggcgatttcctgatcccatgtaaggtgcatactcaagaattgtgcagtagagaaatgatcgtgcacagtgttgatgacttctctagtgcccttaaagcgctgcagtgccacatatgttccaaggatagtttagactgtggaaagttgctctctctgcgtgtgcacataacctctcgtgaaagtcttgatagcgtcgagttcgacctgcactgggccgcagtgaccctggctaacaattttaagtgcacccccgtaaagcctattccaattattcccacagcacttgcgcgtaatctgtctagtaacttaaacataagccaggtacagggcacctacaaatatggctatttgacaatggacgaaaccaggaagctgcttttactgcttgaatccgatcctaaggtttacagtctgcctcttgtcggcatttggctgagcgggattacgcatatttatagtcctcaagtgtgggcctgctgtctgaggtatattttcaattcctcggtgcaggagcgggtgttttccgagtccggcaactttattattgtgctgtattccatgacccacaaggagccagaattttatgagtgcttcccttgcgacggtaaaataccagatttcaggttccaactgctgacatctaaagagacgctgcacctgttcaagaatgttgaacctcctgataagaacccaatccgctgcgagctgtctgccgagagccagaacgccgaaacagagtttttctctaaagcaagcaagaacttttcaataaaacgaagctctcaaaagctgtccagcggcaagatgccaatacacgatcatgatagtggggttgaagatgaagactttagtccacggccaattccttcacctcaccctgtttcccaaaagatcagcaaaattcagccctccgtccccgaattgagcctggtgcttgatggcaacttcatagagtcaaaccccctgcctacacctcttgaaatggtgaacaacgagaacccccccctaataaatcatctggaacacctcaaaccgcttcaacctcaactgtatgatgagaagcacagtccagaggtcgaagctggagaacctagccttcgggggatccccaaccagcttaatcaagacaagccagcactgctcagacattgcaaggtacgccaaccccccgcctataagaagggaaatccccacactcgaaatagtatcaagccctcttctcataacggacccagccacgatatcttcgaaaaactgcagacagtctccgccggcaacgtgcagaatgaggaatatcctatccgtccctcaactctgaatagtcgccagtctagtctggcaccacaaagccagccccacgactttgtcttctcgcctcataattctggcaggcctatggaacttcagatccctactcctccactcccctcctattgctccacaaatgtgtgtcggtgctgccaacatcattcccatatacagtactccccactgaattcctggcagggcgcaaacactgtggggagcatccaggacgttcagagtgaagctttgcagaagcacagcctcttccatcccagtgggtgtccagccttgtattgcaatgctttctgctcatctagcagccccatagctttacgaccccagggagatatggggtcctgctccccccacagcaacatagaacccagtcccgtggcgcgcccgccaagccacatggacttgtgcaacccccagccgtgcactgtttgtatgcacacaccaaagaccgagagcgataatggaatgatgggactttctccggacgcctatcgcttcctgaccgagcaagataggcagctgcggcttctgcaggcacagatccagcggctcctggaagcacagtccctaatgccttgtagcccaaagacgacagccgtggaggatacagtgcaggcggggcgccaaatggaactcgtcagtgtggaggcacagagtagccctgggcttcacatgcgcaagggcgtgtctatcgctgtttccacaggtgctagtctgttctggaacgcagccggggaggaccaggaacccgactcgcagatgaagcaggatgacaccaaaatctcttccgaggatatgaacttcagcgtcgatattaacaacgaagttacatccctgcccggctctgccagcagcctgaaggccgttgatatcccaagcttcgaagagtctaacatcgccgtggaagaggaattcaaccagcccctgagcgtttccaactcctctctggtcgttagaaaagagccagacgtccctgtctttttcccctctggacagctggccgagagtgtcagcatgtgtctccagaccggccccactggcggggcatcaaacaattctgaaaccagtgaggagcctaagatcgaacacgtgatgcagcccctactgcatcagccatccgacaaccaaaaaatctaccaggatcttttggggcaggtcaatcatttacttaactcatcttctaaggagaccgagcagcccagcacaaaagctgtaatcatctctcatgagtgtactagaacccagaacgtctaccataccaagaaaaagacgcaccactccaggctcgtggacaaagattgtgtacttaacgctaccttgaagcagctgcggtccctgggcgtgaagatcgactcccctaccaaagtgaaaaagaatgctcacaacgtggaccacgcaagcgtcctggcatgcatcagtcccgaggccgtgattagcgggctgaattgtatgagttttgctaacgtggggatgagtggcttgagtcctaatggagtggatcttagcatggaggccaacgcgattgcgcttaagtacctcaacgaaaatcagctatcacagctttccgtcacccgttctaatcagaataactgcgaccccttcagtctcctgcatattaataccgaccgtagtaccgtcgggctgagcctgatctctcccaacaacatgtcctttgcgaccaaaaagtacatgaagcgctatggcttgctgcagtctagcgataattctgaagacgaagaggagcctcctgataatgccgacagcaagtcggaatacctgctcaatcagaatttgcggtctattccagaacagcttggcgggcagaaagaaccttccaagaatgaccacgagattataaactgtagtaactgtgagtccgtggggaccaatgcagatactcctgtattgagaaatatcactaatgaggtgttacagactaaggccaagcagcagctcacggaaaaacctgccttcctagtaaagaatctgaagccctctccagcggttaatctgagaacgggcaaagctgagttcacccagcatcctgagaaagaaaatgagggagacattactatctttccggagagtctacagccctctgagacgctcaaacaaatgaactccatgaacagcgtggggacgttcctcgacgtgaagcgactgcgtcaactgcctaagctcttttag

SEQ ID NO: 133522 - DNA, 3864 bp, Artificial Sequence
  Description of Artificial Sequence: Synthetic coding sequence
atggaacccatatatccgtttgcccgccctcagatgaacactagatttccctctagccgcatggttccattccacttccctccaagcaaatgtgcattgtggaaccctaccccaactggcgactttatttacttgcatctcagctattacaggaacccgaaactggtggtgactgagaagactatcagactggcttatcgccacgccaaacagaacaagaaaaatagcagctgctttttgttgggatcactgactgccgacgaggatgaggagggggtgactctcacagtagataggttcgatccggggagagaagtgcctgagtgtctcgaaattactccgacagcaagcctgccaggtgatttcttgataccatgtaaggtccacacccaggaactctgcagcagggagatgattgtccatagcgtggacgatttctctagcgcgctcaaagccctccagtgccatatatgctctaaggatagcctggactgcggcaagcttctgtcgttgagagtgcatataacatccagagaaagtctggattctgtcgagtttgatttgcactgggctgctgtaacgctcgccaataactttaagtgtactcctgttaagccaatccctattatccccaccgcactggctcggaacctcagctccaacctgaacatttcacaggtacaaggtacatacaagtacggctacctgaccatggatgagacgagaaagttactgctgctgttggagtccgacccaaaggtgtacagcctgccactcgttggaatttggctgtctggcattacgcacatttactcacctcaggtctgggcctgctgcctgcgctatatcttcaactcctccgtccaagaaagagtgttctctgaatcaggcaacttcatcatcgtgctgtacagtatgactcacaaagaacctgagttttacgagtgtttcccatgcgatggtaagatccccgatttcaggtttcagttgctgacatcaaaagagaccctacatctgtttaaaaatgttgagcccccagataagaacccaatacggtgtgaactgagtgctgagtcccagaacgctgaaaccgaattctttagtaaagcaagtaagaatttttccataaagaggtctagccaaaaattgagttcaggcaagatgcccattcacgatcatgattcgggagtggaagatgaggatttctcaccgcgccctatcccctctcctcaccccgtgagtcagaagatatccaaaatccagccaagtgtgcctgagttaagcttggtgctcgacggaaacttcattgaatccaatcccctcccgacaccgctcgaaatggtcaacaacgaaaaccctcccctgatcaaccatctggaacacctcaagccactgcagccacaattgtatgacgagaaacactcacccgaggtcgaagccggagagccttccttacgcgggatccccaaccaactgaaccaggacaagcctgcgctcttgcggcactgtaaagtgaggcagcctcccgcgtacaaaaaaggtaacccacacactagaaattcaatcaaaccctcctcgcataacgggcctagccatgacatcttcgagaagctgcagactgtgtccgccgggaacgttcagaacgaagagtatccaattagaccgagcaccctgaacagtcgacaaagttccctggcgccgcagtcacagcctcatgattttgttttctccccccacaattccgggagacctatggaactccagattcccacaccccccctgcccagctattgctctacaaatgtctgccggtgttgccaacaccactcacacatccagtattcccctctaaactcttggcagggcgccaacacagtgggtagcattcaggacgtccagagcgaggctttacagaaacactctctgtttcacccaagtggctgccccgccctgtattgcaatgctttctgttcctccagcagcccgattgctctccgcccacagggcgatatgggtagttgttctccacatagtaatatcgagccatctcctgttgcaaggcctccgtctcatatggacctctgtaatccccaaccctgcaccgtttgcatgcacacacccaagacagagagcgacaacggaatgatggggctgagtccagacgcttatcgcttcctcactgagcaggaccgacagctgcggctgctgcaggcacaaatacaaagactgctggaggctcaatctctaatgccatgttcgcctaagaccacagccgttgaggacaccgtgcaggctggacgtcagatggagctggtgtcagtcgaggcccagtctagcccggggctgcacatgcgaaaaggggtctcaattgccgtgtctacgggggcttccctgttttggaacgctgccggggaagaccaagagccagatagccaaatgaagcaggacgatactaagatttcatcggaggatatgaatttctctgtggatatcaacaatgaggtgaccagccttcctggctcagcaagttcccttaaagccgtggacatccccagcttcgaggaatccaacattgccgtagaagaggaatttaaccagccattgagcgtcagcaacagttctttggtggtgaggaaagagccggacgtccccgtgttcttcccttccggccaattggctgagtccgtctccatgtgtctgcagaccggcccgactggaggcgcctcaaataactctgaaacgagtgaagagcctaagatcgaacatgtaatgcagcccctgcttcaccagccatcagataatcagaagatctaccaggatctcttgggccaagtgaaccatttgctgaacagttcctccaaggaaaccgagcagccgagcaccaaagccgtaataatttcgcacgagtgtactcggacccaaaatgtgtaccacactaaaaaaaaaactcaccattctcgtctcgttgacaaggactgcgtcctgaacgccactttaaaacaactacgcagccttggagtgaaaatcgattcaccaacaaaggttaagaaaaacgctcacaacgttgatcacgcatctgttctcgcatgcatcagtcccgaagctgttatcagcggcttaaattgtatgagcttcgccaatgtcggaatgtctggactgagtccaaatggcgtagacctgagcatggaggcgaacgccatcgcactgaagtacctcaatgaaaaccagctcagtcaactctccgttaccaggagtaaccagaataattgcgacccgttttcactgctgcatatcaatacagatcgctccaccgtcggccttagcttgataagccctaacaatatgagctttgcgactaaaaaatatatgaaacgatatgggctgctgcagtcaagtgataactcagaagacgaagaggagccaccagataatgctgacagtaaatctgagtatctgctgaatcagaatctcagatccatccctgagcagcttgggggccagaaggagccctccaaaaacgaccatgagataattaactgttctaattgtgagtctgtcggaactaatgctgatacaccggtccttagaaacattacaaatgaagtcttgcagaccaaagccaaacagcagctgacagaaaaacctgcttttctggtaaagaacctgaagccgtctccggcggtcaatctgcggacaggcaaagctgagtttacacaacatcccgaaaaggagaacgagggggacatcacaatcttcccggagtctctgcagccatcagaaacactgaaacaaatgaactcaatgaattctgtgggtactttccttgacgtgaaacgattgcgccagcttcctaaactgttctag

SEQ ID NO: 133523 - DNA, 633 bp, Artificial Sequence
  Description of Artificial Sequence: Synthetic coding sequence
caactgtacgatgagaagcatagccctgaggtggaagccggtgagccgtcactgcgtgggatccctaatcagctaaatcaggacaaacccgcattgctgcgtcactgcaagccttgcacagtttgcatgcataccccaaagaccgaatccgacaacggaatgatgggtttgagtccagacgcctaccgctttctgacggaacaggacagacagttgaggcttctgcaggcacaaatacagaggctcttggaggcccagtccctgatgccatgtagtccgaagacaacggctgttgaagacactgttcaggcggggcgccagatggaacttgtaagcgtcgaagcacagtcatcacctggactccacatgcgaaagggtgtcagcatagctgtgagtaccggcgcttctctgttctggaatgccgctggggaagatcaggagccagacagccagatgaagcaggacgataccaagatctcatccgaagacatgaatttctccgtagacattaataatgaggtcacttccctgcccggctccgcctcgtcattaaaagcagttgatatccccagctttgaggaatctaacattgctgtggaggaggagttcaaccaacccctgtccgtctcatag

SEQ ID NO: 133524 - DNA, 3867 bp, Artificial Sequence
  Description of Artificial Sequence: Synthetic coding sequence
atggagccgatataccctttcgctcggccacaaatgaacacacgatttccctcaagcagaatggtgcctttccatttccctccttccaaatgcgcactttggaacccaacgcctacaggagacttcatatacctgcatctgtcgtattaccgcaatcccaagctggtggtgacagaaaagacaatccgtttggcctatcgccacgctaagcaaaacaagaaaaacagcagttgtttcctcttgggctcactcacggctgacgaagatgaggagggcgtgaccctcacggtcgataggttcgatccgggacgcgaagtgcccgaatgcctggaaattacacctactgcaagtcttcccggcgatttcctcattccctgtaaggtccacacccaggagctgtgctcgcgcgagatgatcgtacattcagtggacgatttctcctccgcattaaaggcactccagtgccatatttgctcgaaggattcgctggattgtgggaagttattgtccctgagagtgcacattacctctcgcgagtcactggattccgtagagttcgacctgcactgggccgccgtgacccttgcaaacaacttcaagtgtacacccgtgaaaccaataccaattattcctacggctctcgctaggaacctgtcgagtaacctaaatatcagtcaggtccaaggtacctacaaatacggatacctgaccatggacgaaacaaggaaattactcctcttgctggaaagtgatccaaaggtctacagcctccctcttgtgggtatctggctctccggcatcacccacatttactctccgcaggtatgggcttgttgcctccggtacattttcaatagtagcgtgcaggagagggtcttctctgagtccggcaacttcatcattgttctgtactccatgactcacaaggagcctgagttctatgagtgttttccttgtgatgggaagattcccgatttccggttccagctcctaaccagcaaagagacactccatctgttcaaaaacgtggagccgccagacaagaaccctatcagatgcgagctaagtgccgaaagccagaacgccgagacggaattcttttctaaggcctccaagaacttttccatcaagcggtcatcccaaaaactgtcttctggcaagatgccaattcacgaccacgatagcggagtggaagacgaggatttcagtcccaggccaatcccaagtccacacccggtcagtcagaaaatctccaaaattcagccctcagtccctgagctgtccctggtgctggacggtaactttatcgagtccaacccactgcctacacccctagagatggttaacaacgagaacccacccctgatcaatcatttggaacacttgaaacccctacaacctcagttgtacgacgaaaaacacagtccggaggtagaggccggagaaccatcattacgaggaatccctaatcaacttaaccaggacaaacccgccttgctgagacactgcaaggtaaggcagcctccagcatataagaaaggtaatccacacactcgcaactcaatcaagccctccagccacaacggccccagccacgacatattcgaaaagcttcagacagtgtccgcaggtaatgtccagaatgaggagtacccaattagaccttccactctgaacagccgccagtcgtctttagccccacaaagccagccccacgatttcgttttctctccacacaattcaggacgccctatggaacttcagataccgaccccgcccctgccgtcctactgttccacgaatgtatgtcgatgctgccagcaccattcacatattcagtattcaccactcaacagttggcagggggccaatactgtcggatcaatccaggacgtccagtcagaggctctgcagaaacactcgcttttccacccttcaggttgtcctgctctttattgtaatgccttttgtagctctagctctccgatagctctccgcccacaaggggacatgggaagctgtagcccgcattctaacatagagcccagccccgttgcaaggccgccttcccacatggacctctgtaatccgcagccctgtactgtctgtatgcacacacccaagacggagagcgataatgggatgatgggtttaagtccagatgcttaccggtttctgacggagcaggatagacagctccgtttactccaagcacagatacaacggctgctagaggctcaaagcctgatgccatgtagccccaagactacggccgtggaggacactgttcaagccggccggcagatggaactcgtgagcgtcgaagcccagagctccccggggctccacatgcgaaagggcgtgtctatcgccgtctcgaccggtgctagcctgttctggaacgcagccggagaagaccaagaaccggatagccaaatgaagcaggacgacacaaaaatttcaagcgaggacatgaacttttctgtcgacatcaataacgaggtcacctccctgccgggatccgcgtcgtcacttaaagccgtggacattccctcttttgaagagtccaatattgcggttgaggaggaattcaaccagcccctgtctgtgtccaacagctcttcgctcgtcgtcaggaaggaacccgatgttcctgtattcttcccttctggacaattggcagaaagcgtttccatgtgccttcagaccgggcctacagggggggcctctaataattccgaaacatctgaagagcccaagatagaacatgtcatgcagcctttactgcatcagcccagcgataatcagaagatatatcaagacctgctggggcaagttaatcatctgctcaactcctcctccaaagagaccgaacagccctcgacgaaggccgtgatcatcagccatgaatgcacacgaacacagaacgtatatcacacgaaaaagaagacacaccactccagattggttgataaggattgcgtgctcaacgccaccttgaaacaacttaggagccttggcgttaaaatcgatagtccaaccaaggtgaagaaaaacgctcacaatgtggatcacgctagcgtgctcgcttgcatttctccggaggctgtgatcagcgggctgaactgcatgagctttgcgaatgttggcatgtccggcctgagcccgaacggggtggacttaagcatggaggccaacgctatcgctctcaaatacttgaatgaaaatcagttgtctcaattgtctgtcacacgttcaaatcagaataattgcgatccattctctttattgcatattaacactgataggtcaaccgtcggactttcgttgatcagccctaataatatgtccttcgccacaaagaaatacatgaagcgctacggcctgttacaatcaagcgacaattccgaagacgaggaggagcctcctgataatgctgacagtaagagtgagtacctgctgaatcagaacctgcgatctatccccgaacagctcggggggcagaaggaaccttccaaaaacgaccacgaaattattaactgtagcaactgtgaaagtgtggggacaaatgcagataccccagtattgagaaacattactaatgaagtgcttcagacgaaggccaagcaacagttgacagagaaaccagcattcctggtgaagaatttgaagccctcgccagctgtgaatcttcgaaccggtaaagctgaattcactcagcatccagagaaagagaatgaaggagacattacgatctttcctgaatctctgcagccgtctgagacactaaagcagatgaactctatgaatagcgttggcacctttctggatgtgaaacgcctgaggcaactgcccaagctcttctag

SEQ ID NO: 133525 - DNA, 606 bp, Artificial Sequence
  Description of Artificial Sequence: Synthetic coding sequence
atgagtttcgctaccttgaggcccgctccaccgggccgatatctttatcctgaagtatctcccctgtctgaagacgaagaccgcggttcagacagttccggatccgacgaaaagccatgtcgtgtccatgctgctagatgtggattgcaaggagcgcgccggcgtgccggaggcaggagggcaggaggaggaggccccggggggagacccgggagggagcctcgccaacgtcacacagcaaatgccagggaaagagacagaacaaactccgtcaataccgcttttacagctctgcgcacccttatccctacggagcctgctgatcgtaagttgtccaagattgagaccctgcgcctggcatcaagttatatcagccatcttgggaatgtgctgctagctggtgaagcttgcggagacggccaaccctgccattctggtcccgcatttttccatgccgcccgcgccggttccccgccccctccacctcctcctcccccagcaagggacggtgaaaacacccaaccaaaacagatctgtactttttgtctctctaatcaacggaagctgagcaaggaccgagaccggaagacagccattcgctcctag

SEQ ID NO: 133526 - DNA, 642 bp, Artificial Sequence
  Description of Artificial Sequence: Synthetic coding sequence
atgcagctacctctggccctgtgtctggtttgcctcctcgtgcataccgcattccgcgtggtggaaggccaaggctggcaggcatttaaaaacgatgcaactgagattatacctgaactgggcgagtacccagaaccacctcctgaactggagaacaacaaaaccatgaatagggccgagaatggggggcgtccgccccaccatccctttgaaacaaaggacgtgtctgaatactcctgccgggaactgcatttcactcgatatgtaaccgatgggccttgccgatcagccaagcctgtcaccgaactggtgtgctccggtcagtgcggaccagcccgtcttcttccaaatgctatcggcaggggaaagtggtggagaccgtccggcccagacttccgttgcattcctgatcgctaccgggcccagagggtgcagttgctctgtcccggcggcgaggctcccagggctcgtaaagtgaggctggtggcttcttgcaaatgtaagcgcttaaccagattccacaaccagagcgagcttaaggacttcggcaccgaggccgcgcgccctcagaagggaaggaagccaaggcccagagcacgctccgccaaggcaaaccaggcagaactggagaacgcgtattag

SEQ ID NO: 133527 - DNA, 906 bp, Artificial Sequence
  Description of Artificial Sequence: Synthetic coding sequence
atggccatgttagtgctcgttccaggaagagtgatgagacccctcgggggccaactctggcgtttcctgcctaggggtctagagttctggggccctgctgaaggcaccgctcgggtcttgctgcggcagttctgtgcgaggcaggccgaagcttggagggcatccggccgcccaggctactgtctggggacccgccccttgagcaccgccagacctccacccccatggtcccagaaggggcccggtgatagcacccgcccttctaagcctggtcctgttagctggaagagtttggccatcactttcgccattggcggggccttgttagcaggtatgaaacacgtgaagaaggagaaggctgagaaattggaaaaggagaggcagcgccacatcggaaagccactgcttggcgggcccttctctctgactactcacaccggtgagcggaaaacagataaggactatttgggccagtggcttctgatctacttcggatttacccattgccctgacgtgtgcccagaggagcttgaaaagatgatccaggtcgtcgatgagatcgattccattactactctccctgacctgactcctctgtttatatcgatcgaccccgagcgtgatacgaaggaagccattgcaaactatgtgaaagagttctctccaaaactagtcggcttgaccgggacccgggaggaggtagaccaggtcgccagggcctatagggtgtactatagccctgggcctaaagatgaagatgaggattatatcgtagatcatactataatcatgtatctcatcggaccggatggtgaatttcttgattacttcggacaaaacaagcgcaagggagagatagctgcgagtatcgcgacacacatgcgcccctataggaagaaaagttag

SEQ ID NO: 133528 - DNA, 813 bp, Artificial Sequence
  Description of Artificial Sequence: Synthetic coding sequence
atggcaatgctggtgttggtgcctggccgggtcatgcgccccctgggcggccagctgtggcgttttctgccccgcggcctcgagttttgggggccggccgaaggcacagctagagtgttgctccggcagttttgcgcccggcaggccgaagcctggcgcgcaagtgggcgacccggctactgtcttggtacccgacccttgagtacggcccgccctccgccgccttggtctcaaaaagggcctggcgattccacccgcccttctaagcccgggcctgtgagctggaagagtctcgcaatcaccttcgcgattggcggtgcgctgctggctggtatgaagcacgtcaagaaggagaaggccgagaaacttgagaaggagcgacagcgacatatcgggaagcccctgcttggcggacccttctctctgacaacacacaccggcgagcggaagacagacaaggactacctcgattcgataaccaccctacccgatttgaccccacttttcatatccattgatccagagagggacacgaaagaggcaatcgccaactatgtgaaggagtttagccccaaactggtcggcctcacagggactcgggaggaggtcgatcaggtggccagagcatatcgggtttactacagtcctggcccgaaagacgaggatgaggactacatcgtggaccacacgataatcatgtacctgataggccctgacggtgagttcctagactactttggccagaataaacgaaaaggagaaatagcagcgtctatagccacccatatgagaccatacagaaagaagagttag

SEQ ID NO: 133529 - DNA, 801 bp, Artificial Sequence
  Description of Artificial Sequence: Synthetic coding sequence
atgctgttgctgactagatcccctaccgcatggcatcgactgtctcagctcaagccccgcgtcctcccggggaccctgggtggccaggctctgcatctgcgtagttggctgctctcacgccaaggtcccgccgaaaccggcgggcaggggcaacctcagggaccagggctaagaacccggctgctgattactggcctgttcggggcagggctcggcggtgcgtggctggctctgcgggccgagaaggaacggttgcaacagcaaaaacgtacagaggcacttagacaggcagccgtaggacagggagactttcatcttttagatcacagaggccgcgctcgatgcaaagctgacttccggggccagtgggttcttatgtatttcggatttacgcattgccccgatatctgccccgatgaattagaaaagctagtgcaggtggtgcgacaactcgaggccgaacctggcttgcctccagtgcagcccgtgttcataaccgtggatcctgagagagacgacgtcgaggcaatggcccgatatgtgcaggactttcatccccgactcttgggcctcaccgggagtacaaaacaggttgcccaggcctcacactcctaccgggtgtactacaacgcaggacctaaagatgaggaccaggactacatagtggaccattctattgcgatctatctgctcaaccctgatgggctgttcacagactactacgggcgtagtagaagcgcagagcaaattagtgattcagttcggagacatatggcagcctttcggagtgtcctgtcctag

SEQ ID NO: 133530 - DNA, 801 bp, Artificial Sequence
  Description of Artificial Sequence: Synthetic coding sequence
atgctcctgctgaccagatccccaaccgcctggcatcggctctctcagctcaaaccccgggtactcccagggactctcggcggacaggctctccacctgaggtcttggctgctctcgagacagggaccagcagaaacaggcgggcagggccaaccacaggggccaggattgcggacccgccttttaattactgggcttttcggtgccggtctggggggagcctggctggccctgcgggccgagaaggagcgactgcagcagcagaagagaactgaggctctgagacaagcagccgtggggcagggagatttccatttactcgatcataggggtagagcccgttgtaaagccgatttccgaggtcagtgggtactaatgtactttgggttcacacattgcccagacatctgtcctgatgagctagagaagctcgttcaggtggttcgacaacttgaggccgagccaggcttgccccccgttcaaccagtgttcataactgttgatccagaacgagatgacgtagaagccatggccaggtacgtgcaagacttccaccccaggctcctcgggctgaccggcagcactaagcaagttgcacaagcctcccactcttaccgggtgtactataacgcagggcctaaggatgaagaccaagactacattgtcgatcattcaattgcgatctatctgctcaaccccgatggcctgttcacagactattatggacggagccgcagtgcggagcagatctcagattccgttcgaagacacatggccgctttcaggagcgtgctatcctag

SEQ ID NO: 133531 - DNA, 411 bp, Artificial Sequence
  Description of Artificial Sequence: Synthetic coding sequence
atgctcctcttgacccgctcaccaactgcctggcaccgcctcagccagctcaaacccagagtgctgcctggcacgcttggcggccaggccctacatctgaggtcctggctactgtctaggcagggtccagccgaaactgggggccagggccagccacagggccccggcctgagaaccaggcttctgatcactgggttgtttggagctgggctaggcggtgcttggctggctctcagggcggaaaaggagcgacttcagcagcagaagaggaccgaggctctgaggcaggccgcggtaggccagggtgatttccatctgctggaccatcgggggcgtgccagatgtaaagctgatttcaggggacaatgggtcctgatgtacttcggttttacccactgcccagacatatag

SEQ ID NO: 133532 - DNA, 411 bp, Artificial Sequence
  Description of Artificial Sequence: Synthetic coding sequence
atgctcctcctgactcgcagtcccactgcctggcaccgcctgagccaactgaaaccaagagtgcttccggggaccctgggcggacaggcgctgcacctgcgatcctggctgctgagcagacaaggcccagcagagactggcggtcagggtcagccccaaggccccggactgcggacccggttgttgattacaggccttttcggagcggggctaggaggcgcgtggcttgccttgagagcagagaaggaaagattacagcagcagaagaggaccgaagcactccgacaggcggctgttgggcagggggactttcacctgttggatcacagggggagagctaggtgcaaggctgactttagaggccaatgggtgttgatgtactttggatttacacactgtcccgatatttag

SEQ ID NO: 133533 - DNA, 801 bp, Artificial Sequence
  Description of Artificial Sequence: Synthetic coding sequence
atgctcctgctcaccaggagtcccacggcatggcatcgcctaagtcagctgaaaccccgggttttaccagggacactgggtggtcaggctcttcatctgcggagctggctgctcagtcggcaggggcccgctgaaaccggagggcagggacagccgcaggggccagggcttcgtaccaggcttctaataaccgggctgttcggggccggtcttggcggggcctggctggctctgcgggccgagaaggagcggctgcagcagcagaagcgtaccgaagcccttcgccaggctgccgtggggcagggtgacttccatctgctggaccacaggggcagggcgagatgcaaggccgatttccgcggtcagtgggttctgatgtactttggcttcacacattgtcccgacatctgccctgatgaattggaaaaattggtgcaggtcgttcggcaactcgaagccgagccaggattaccacctgtgcagccagtgttcattacggtggatccagaacgagatgacgtcgaagctatggccaggtacgtgcaggatttccatccaagactgctgggtctgactgggagcactaaacaggttgcccaggcctctcactcgtatagagtctactataatgcaggtccgaaggatgaggaccaggattatatcgtcgatcacagtatcgctatttacctgctcaatcccgacgggctgttcaccgattattatggcagatcccgcagcgccgaacagatcagtgacagcgtgcggagacatatggcggcttttcgaagtgtgctctcttag

SEQ ID NO: 133534 - DNA, 801 bp, Artificial Sequence
  Description of Artificial Sequence: Synthetic coding sequence
atgctgctccttacccggtcccctacagcctggcaccgacttagccaacttaaaccacgtgttctgcctggcacccttggcggacaggccttacaccttaggtcctggttattgtcgcgccagggcccagctgaaactggaggccaggggcagccccaggggcccgggctcagaaccagattgctcattacggggcttttcggggcggggctgggaggcgcatggctggctctgcgcgcggagaaggagcgcctgcagcaacaaaaaaggaccgaagcactgagacaggccgcagtgggtcagggcgacttccacctactggatcatagagggagggcgcgctgtaaagccgatttccgtggacaatgggtacttatgtactttggcttcacacactgccctgatatttgccccgatgagctggagaaacttgtacaggtcgtcagacagctcgaggctgaaccaggacttccccctgtgcagcccgtgttcattactgttgatcccgagcgagatgacgtcgaggccatggctaggtatgtacaggactttcaccctcgcctgctcggcctgacagggtcaactaagcaggtggctcaagcttcccacagctacagagtatattataacgccggacccaaagatgaggaccaggattatatagtcgaccactccattgcaatatatctcttgaatccggacgggttgttcacagattactacggaagatccagatcagccgagcagatctcagactctgttcgtaggcacatggccgcgtttagatcggtgttgtcttag

SEQ ID NO: 133535 - DNA, 1047 bp, Artificial Sequence
  Description of Artificial Sequence: Synthetic coding sequence
atgcccaggagcttccttgttaagaaggtcaaactggacgccttttctagtgcagatctcgagagcgcttacgggcgcgctagaagtgatttaggtgcccccctgcatgacaagggttatctgtctgattacgtcggcccatcctccgtctacgacggcgatgccgaggctgcccttctgaagggacctagccctgaacctatgtacgcagcagcagtgcgaggagagctggggcctgctgcagccggcagcgcgccaccccccacacctcgcccagagctcgctacggccgccgggggttatataaacggtgatgccgctgtgagcgaagggtatgccgcagacgccttttttattactgatggtaggtctaggcgaaaggccagtaatgccggtagcgccgcggctcccagtaccgcttcggcagccgctcccgacggcgatgccggcgggggaggcggtgcaggcggtaggtctttgggatcaggtcccggcggtcggggtggaactcgtgccggagccggcacagaggcaagagctgggccaggcgccgcaggagcaggcggacgccatgcttgcggcgaatgtggaaaaacctacgctacttcttctaacctgtctcgacataagcagacccacagatcacttgactcacaactggccaggcgttgtcctacctgtggtaaggtttatgtgtctatgcctgccatggccatgcacctgctcacacacgatctgcgacataagtgtggagtgtgtggcaaagcatttagccggccatggctgttgcagggccatatgaggagtcatacaggcgagaagccctttggatgtgcacactgcggtaaggctttcgcggaccgtagtaacctgcgagcccatatgcagactcattccgctttcaaacacttccagtgtaagaggtgcaaaaaatcttttgcacttaagagttacctaaacaagcattacgaatccgcatgtttcaaggggggtgctgggggacccgccgcacccgcccctccacagctgagtccagtgcaggcctag

SEQ ID NO: 133536 - DNA, 4893 bp, Artificial Sequence
  Description of Artificial Sequence: Synthetic coding sequence
atgctgaagtgtatccccctctggcgctgcaacaggcacgttgaatccgtcgacaagagacattgcagcctacaggctgtccccgaagagatctaccgatatagcaggagcctcgaggaattgttattggacgcgaaccagctgcgggagttacctaaacccttttttcgcctccttaacctgagaaaactcggtttatctgataatgaaatccagaggcttcctcccgaagtcgccaattttatgcagttggtggagttagacgtcagccgaaacgatatcccagagatccctgaatcaattaagttctgcaaggcactagagattgctgactttagcggaaatcccctatcccgtctgcccgacgggtttacacaactgcggtcacttgcacacctcgctctgaatgatgtcagcctccaggcccttcctggagacgtggggaacctggctaacctggtgacactggagcttcgggagaatttacttaagtccctgccagcatcattgtcttttctcgttaagctcgaacaactggatttgggtggtaacgacctggaagtgctgcctgacacactgggcgctctgcccaaccttagggaactctggttggataggaatcagttgagtgccctgcccccagaactcggcaatcttcggcgcttagtctgtctcgatgtgtccgaaaatcgactcgaagaactccccgccgagctgggtgggctcgtgttgctgaccgaccttctccttagccagaacctgctaaggagactacctgacggcatcgggcagctgaagcagcttagtatcttaaaagttgatcagaacagattgtgcgaggtcacagaggccatcggggactgcgaaaacctctcagagctgattctgaccgaaaacctgctcatggcactgccgcgatctttgggcaagcttacgaaattaaccaatctcaatgttgatagaaatcatcttgaggcattaccacctgagattggcgggtgtgtggcactgtccgtgctatcactccgcgacaacagactggccgttctgcccccagaattggcacataccacggagctgcacgtgttggatgtagccggcaaccgcctacaatccctgccattcgcactgacgcacttgaatctgaaagcattatggctcgctgagaaccaggcccaacctatgctgagattccagaccgaagatgacgcaaggacaggcgagaaagtcctcacctgctatctgctcccccaacagccccccccctctttggaggacgctggccagcaggggtccctgtctgaaacttggtccgatgcccccccttcccgtgtatcagtcatacaattccttgaagcccctattggagatgaagatgcagaggaggcggccgcagagaaacgaggcttgcaacggcgtgctaccccacaccccagtgagttaaaagtgatgaaacgatcaatcgagggaaggagaagcgaggcttgtccctgtcagcccgatagtgggagccccttgcccgccgaggaggaaaaacgcctgagcgcggaaagcggcttgtcggaggattcccgcccttctgctagcacggtgtcagaagctgaacctgaaggtccctccgcagaggctcagggaggctctcagcaagaggctactaccgctggcggggaggaagacgccgaggaggattatcaggagccaaccgtgcactttgccgaagatgcactactcccgggtgatgatcgcgagatcgaggaaggacagcccgaggcgccttggactctgccgggcgggcggcagcggctgatcaggaaggacacgccacattacaaaaaacatttcaaaatatctaagttgccacagccggaggctgttgtggctctcctccagggcatgcagcctgacggggaagggccagtggcccccgggggctggcataatgggcctcacgccccttgggcaccacgggcccagaaggaagaggaagaggaggaggagggttccccccaggaggaagaagttgaggaagaggaagagaacagagctgaggaggaggaggcttccaccgaggaggaggataaggagggggcggtcgtttccgctccctcagtgaagggagtgagtttcgaccaggccaacaatttactgattgagcctgcaagaatcgaggaagaggaacttacattaacaatcctgcgacaaacaggcgggctcgggatttcaatcgcaggcggcaaagggagcactccttataaaggagacgatgagggaatctttatctctcgcgtgtccgaggagggaccagcagcgagagccggggtaagagtgggggataaactgctcgaagtgaacggagtggccctgcagggtgccgagcaccacgaggccgtggaagccctgcggggcgcaggcaccgccgtccagatgagggtgtggagggagagaatggtggagccggagaacgcagtgaccatcacaccattgcgtcctgaagacgactattcacctagggaacggcggggtggaggccttaggttaccactgctacctcctgagagcccagggccattgcggcagagacatgttgcgtgcctagccagaagtgagaggggactcggcttttccattgctggcgggaaaggcagcactccatatcgcgccggtgacgcgggaatcttcgtctcaagaatcgccgagggaggcgcagcccatcgcgccggcacgctgcaggtgggcgacagggtgctgtcgataaacggggtagatgttaccgaggctcgacatgatcacgctgttagtctcctcaccgctgcttcacctacgatcgctctcctcctcgaacgcgaggctggcggacccttacccccgtcccctctcccacatagtagcccccctaccgcggccgtggccacaacctccattacgaccgcgactcctggggtcccaggcctcccctcacttgcgccaagtcttctcgcagccgcattggagggaccctacccagttgaggaaatacgactgcctagggcagggggccctttggggttatctattgtgggcgggtctgaccacagttcacatcccttcggtgtgcaggagcctggggtgttcatttctaaggtcctgcctcggggcttggccgcacgcagcggcttgcgagtgggtgatcggattttggccgtgaatggacaggatgtgcgtgacgccacccatcaggaggcagtgagtgcacttcttaggccctgcctggagctgagtcttctggtgcggagggaccctgcccctcctggactgagggaactttgtatccagaaggccccaggagaaaggctcggaatcagtattagaggaggagcacgcggacatgcagggaatcctcgggaccctaccgatgagggtatttttatatccaaggtaagtcctactggcgctgctggtagggacgggagattacgggtgggactccgattactagaggtcaaccagcagtccctgttgggtctgacacacggagaggctgtccagcttctgcgctcggtgggggacactttgaccgtgttggtttgtgacggttttgaggcgtccactgatgcagcgcttgaggtgagcccaggggttatagccaatccgttcgctgccggcattggccacagaaacagccttgagtctatttcaagtattgaccgagaactcagccctgaggggccaggcaaggaaaaagaattacctggccaaacccttcactgggggccggaggctaccgaggccgccggacgcggattacaacccctcaaactggattatcgcgcactcgcggcagtccccagtgcagggagcgtgcagcgggtaccgagcggcgcggcaggtggtaaaatggctgagtctccttgcagtccatcagggcagcagccaccctcccctccttctccagatgagcttccagccaatgtgaaacaggcatacagggcatttgctgcagtacccaccagtcatcccccagaagatgcaccagctcaacccccgactccagggcctgccgcctcccctgagcaattgtcgttccgggagcggcagaaatattttgagctggaggtccgcgttccacaggcagagggtcctcccaaacgcgtgagcttggtcggtgctgatgatttaaggaaaatgcaggaggaggaggcacggaagcttcaacagaaaagagcccagatgcttagagaggcagctgaggctggggcagaagccaggttggcccttgatggagaaacattaggcgaggaggagcaggaagacgagcagccgccgtgggcctcgccgtcccctacgtctcgccagagccctgcctcgcctcctccgctaggaggaggggcaccggtccggaccgctaaagcagagcggaggcaccaggaacggctgcgggtgcaatcaccagaacctcctgctcccgaacgggccctgagccccgcagagctaagggcgcttgaagctgagaagagagcactgtggagagcagccagaatgaagagcctggagcaagatgccctgcgcgcccagatggtgctctcacgttctcaggagggacgcggaactcgaggtcctctggagcgcctcgccgaggctccctctcctgcccccactccgtcccccacgccggtggaggatctcggcccccaaaccagtactagccctggccggctctccccagattttgcagaggagctgcggtccttggaaccctcccccagtcccgggccgcaggaagaggacggagaagtggccttagtgctattggggaggccctccccgggtgcggtgggcccggaagacgtcgctctctgtagctcccgaaggccagtgcggccagggaggcgcggtctgggacccgtacctagctag

SEQ ID NO: 133537 - DNA, 4650 bp, Artificial Sequence
  Description of Artificial Sequence: Synthetic coding sequence
atgcaacttgtcgaactggatgtgtcaagaaatgatattcccgaaattccagagagtattaaattctgtaaggcactggagattgcagacttttctggaaatccacttagcaggctgcccgatggtttcacgcagcttcggtctctagcacatttggcgctcaatgacgtatcgctgcaagctctccccggcgacgttgggaacctggctaatttagtcactctcgaattgcgagagaatcttctgaagagccttccagcatctctgagctttctcgttaagcttgaacagctcgacctcgggggtaatgatctggaggtcttaccggatacacttggcgcactccctaacctcagggagctgtggctggatcgcaaccagttgtcagcccttccccctgaactgggtaacttaaggcggttagtgtgcctcgacgtgtcagagaatagacttgaggaactgcccgctgagctgggaggactggtcttgctgaccgatctgctactgagtcagaatttgctgaggcggctcccagacggaatcggacaactcaaacagctgtctattctgaaggtggatcaaaataggttgtgtgaggtgaccgaggccatcggtgactgtgagaatctgtccgagctgattcttaccgagaatctactgatggctctgccacgttcattgggaaagctgacaaagctaactaacctgaatgtggatagaaatcatttggaggccctgcccccagaaattggagggtgcgtggccctctccgttttgtctctgcgcgataaccgtcttgcagtgctccccccagaactggctcacacaactgaactgcacgtgttggacgtagcaggcaacagattgcagtctctgccattcgcccttacccatctcaacttgaaagcattatggctggccgagaatcaagcccagccgatgctgcgatttcagaccgaagacgatgcccggacaggcgagaaagtcctgacatgctatctactcccccagcagccaccaccaagcctggaagacgctggccaacagggctccctgagtgagacgtggtcagatgctccccctagccgggtctctgtcatacagttcctcgaggctcctatcggagatgaagacgctgaggaggctgccgccgaaaagagggggctgcagaggcgagccacaccccacccctccgagctcaaagtcatgaagcgaagtatcgaaggccgccgcagcgaagcctgcccctgccagcccgactcaggctcaccccttccggctgaagaggagaaacgtctatccgctgagtcagggctttcagaggacagcagaccttctgccagcactgtttctgaagcagagcccgagggcccgagtgccgaggcccagggaggctcgcaacaagaggcaaccacagccggcggtgaggaggacgccgaagaggactaccaggagcccactgttcatttcgccgaagacgcccttttgccaggagacgaccgtgagatcgaagagggccagcctgaagcaccatggacattgcccggtggcaggcagcgcctgattcggaaggatacaccccattacaagaagcattttaaaatctccaagctccctcagccggaagccgtggtcgccctgctgcagggcatgcagccggacggcgaaggacctgtggctccaggtgggtggcacaatggacctcacgccccctgggcgccgcgggcccagaaggaagaagaagaggaagaagaaggctctccccaggaggaggaagtagaggaggaggaggagaacagggccgaagaagaagaggccagcactgaagaggaggacaaagagggagcggtggtttcagcgccatcggtgaagggcgtgtcttttgaccaggccaataacctgctcatcgagccggcacggattgaggaggaggagttaactcttacaattctccggcaaaccggcggtctgggcatttctattgctggaggtaaaggatcaactccctacaaaggcgatgatgaggggatttttatttcccgggtctccgaggaaggacctgccgctagggctggggttagggtgggagacaaacttcttgaagtcaatggggtcgctttacagggggcagagcatcatgaggctgtagaggctctacgtggtgcaggcacagcagtgcagatgcgggtctggagagagagaatggttgagcctgagaacgccgtgactatcacccccctgaggcccgaagacgactactcaccccgcgagaggcggggaggcggcctccgattgcctttgctcccgcccgaatcaccggggccactcagacaaagacatgttgcgtgtctggctcgatccgagcggggcttaggatttagcatagcaggcggaaagggttctactccctaccgagccggggatgcaggtatttttgtgtcacgcatcgctgaagggggtgcagcccatagagcggggaccctgcaggtgggggaccgtgtgctatccataaacggtgtggacgtgactgaggcccgacatgaccacgcagtttcccttctgacggccgccagtcctacgattgccctgttgctggagagagaagccggaggcccactgcccccttctccccttccgcactcctcacctcctaccgccgcggttgcaactacttcgataaccacggccacgcccggggtccctggactcccttctctggcccccagcctccttgcggctgcactcgaagggccctatccagtggaagagatcagattacccagagctggaggcccgttaggcctttcaatcgttgggggctccgaccactccagtcaccctttcggcgtccaagagcccggggtctttattagcaaggtattgccccggggtctcgccgctaggagcggccttagggtgggagatcgcatccttgcagtgaacggccaagacgttcgcgacgcaactcatcaagaagcggtgagtgccttgttgcgcccatgtctggagttatcactgttagtcagaagggatcccgctccgccaggtctgagggagctctgtattcaaaaggccccaggtgagcgtttagggatcagcattcgcggcggggctcggggacatgccgggaatccacgcgaccccaccgatgaggggattttcatctccaaagtctctccaaccggggccgccggcagagacggacggctgcgagtgggcctgcgtctgctagaggtgaatcagcagagtctgcttggcttaacgcacggagaggcagtgcaattgctgaggtcagtgggtgatacactcactgtgctggtgtgtgatggctttgaggccagtacagacgctgccctagaggtcagcccgggtgtgattgcaaacccttttgctgcaggaataggacaccgtaatagcctggagagcatcagttccattgaccgcgaactttcccccgaaggaccgggcaaggagaaggaactgcctggacaaacactccactggggccctgaagctaccgaagcggcaggaagaggcctgcagccactgaagttggactaccgagccttggctgcagtgcccagtgcagggtcagtccaacgggtgccctccggggcagccggaggaaagatggccgagagtccctgctccccatcgggccagcagcccccttctccccccagtccagacgagttacctgccaacgttaagcaagcatatcgcgctttcgctgccgttcccaccagccaccctcctgaggacgcgcctgcccagccgcctacgcccgggcccgccgctagccccgagcagctcagcttccgcgagagacagaagtatttcgagctggaagtgcgcgtgccacaggctgaagggccccccaagagggtgagcctcgtgggcgcggacgatctgcggaagatgcaggaggaggaagcacgtaagcttcagcagaagcgcgcccaaatgctgcgcgaggcggctgaagctggagcagaggctcgcttggccctggacggggagacactgggcgaggaagagcaagaggatgaacaaccaccatgggcttccccctctccaacaagcaggcagtcacctgcatcccctcccccccttggcgggggcgcccccgtaagaacagctaaagccgagcggcgccaccaggaaagattgcgcgttcaatcaccggaaccacccgcccctgagcgagctctgtcaccggccgaattgagggcactggaggcagaaaaacgcgccctgtggcgagcagcacggatgaagtcgctggaacaggatgcactgagggcacagatggtcctttcgcggtcccaggaaggccgcggcactaggggaccactggagcggctcgcagaagctcccagccccgcccccacaccttcacctacaccagtggaggatctcggaccccaaacttctaccagccctgggagactctccccagactttgcagaggaactacgaagtctggagccctcaccaagtcctggaccacaagaggaagatggggaagtagctcttgtcctcttgggacgcccctctcccggcgctgtggggcccgaagacgtggccctatgttccagcaggcgccccgtgcgccctgggcggcgaggactcggaccagtccctagttag

SEQ ID NO: 133538 - DNA, 2268 bp, Artificial Sequence
  Description of Artificial Sequence: Synthetic coding sequence
atgcaaccggacggtgaagggcccgtcgctccaggtgggtggcacaatggaccccacgctccgtgggcgccgagagcccaaaaagaggaagaagaagaggaggaaggcagtcctcaagaggaggaggtggaagaggaggaggagaatagggcagaagaagaagaggcaagtactgaagaggaggataaagagggtgccgtcgtttcggctccctcagtcaaaggagtgtctttcgatcaggctaacaatctcctcattgaacccgcgcggattgaggaggaggaattgactctgaccattctgcggcagactggcggtctgggcatctctattgccgggggtaaggggagtacgccttacaaaggcgacgatgagggcatatttattagtcgcgtatcagaggaggggccagcggcaagagcaggcgtgcgggtgggagataaactcctggaggtcaacggagtcgcgttacaaggcgcagaacaccacgaggccgttgaagccctgcgcggtgccggaacagctgttcagatgcgggtctggagggagcgcatggtggagcccgagaatgcagtgaccattactcctctaagacccgaagatgactatagccccagagaacgaaggggagggggtttgaggctcccacttctccccccagagtccccaggcccattgcggcaaaggcatgttgcgtgccttgctcgctcggaacggggtttggggttttcaatcgctggaggcaagggttctactccatacagggctggggatgcagggatctttgttagtaggatcgccgagggcggtgcagctcatagagccggcaccctgcaggttggcgaccgcgtgctgtcaattaatggcgtggatgtcacagaggccaggcacgaccacgccgtctctctgctcaccgccgccagtcccacaattgcactactgctagaaagggaagccggtggtcctcttccgccctctccgttgcctcatagttctccccccacagctgccgtggcaacaactagcatcactactgcaacgcctggcgtgccaggtctcccgtctctggccccttccctgttggctgctgctctggagggcccctaccccgtggaggaaatacgcttgcctcgtgcaggcggccctctcggactcagcatcgttggaggcagcgaccacagttctcatccttttggggtacaggagcctggcgtttttatcagcaaagtactcccccgtggattggccgcccggagcggcttgagggtgggagacaggattttggctgtgaacggacaggatgttcgtgatgccactcaccaggaggccgtgtccgcactcctgaggccctgcctggagctatctctcctggtgcggagagatccggccccacctgggctgagggaactatgcatccagaaagctcccggggagagactgggtatatccattcgaggaggcgcaagaggtcacgccggcaaccctagagatcctacagatgagggcatatttatatccaaggtgtcacccaccggggcagctggcagagacggaaggttgcgagttggcttacgtctgctggaggtgaatcagcagagccttctcggactgacacacggcgaagctgtgcagcttctccgatcagtgggagatactcttactgtgttagtttgcgatggattcgaggcaagcacagacgccgcgctcgaggtttcccccggggtcatcgccaaccctttcgcggccgggatcggccacagaaattcactggagagcatcagctcaattgacagagaactgtcacccgagggccctggaaaggagaaggaactccccgggcagaccttgcattggggccctgaggccacggaagcagcgggccgcggtttacagcctctgaaactggattacagagcattggccgccgtgccctccgctggttctgtgcagcgggtgccctcaggagccgctgggggtaaaatggctgaaagcccgtgctcaccctcaggacagcagcccccaagtccaccttctcccgatgagcttccggcaaatgtcaaacaggcgtaccgagcctttgctgcggtaccaacatcacacccccccgaagatgcacccgctcagccgcctacaccaggaccggccgcgtccccagagcagctgagtttcagagagagacagaaatacttcgaattggaggtcagagtgcctcaggccgagggaccccttaggccgggaagacgtgggcttggaccagtcccctcgtag

SEQ ID NO: 133539 - DNA, 4968 bp, Artificial Sequence
  Description of Artificial Sequence: Synthetic coding sequence
atgctgaaatgcatacccttgtggaggtgcaatcgtcatgtcgagagcgtggacaagcgccactgttcactgcaagctgtaccggaggaaatttacagatattctagatccttagaggaactcttgttggacgcaaaccagctgagagagttgcctaagcctttttttcggcttctgaacctgcgaaagttaggcctctctgacaatgagattcaaagacttcctccggaggttgctaacttcatgcagttggtggagctggatgtatctagaaatgacataccagagataccagagtccattaagttctgtaaagctctggagatcgccgatttttccggaaacccactgagccggctgccagatggcttcacgcagctgcgctcactggcgcacctagctctgaacgatgtgagccttcaagccctgccaggagacgttggaaacctggctaacctcgtgactttggaactcagagagaatctgctcaaatctctgcctgcttctctgtcctttctcgtcaaacttgagcaattagatctaggtggaaacgacctggaagtgctgcccgataccctcggtgccctccccaatcttagggaactctggctggatcgaaatcagctctcagcactaccccctgaacttggtaatctcagacgcctggtatgtcttgacgttagtgagaataggctggaagagctgccagcagagctcggcggtttagtcttacttacagatcttctactctcacagaacctgcttagacgacttccggacggaattggacagctgaaacagttgagtattttgaaggtcgaccagaacaggctgtgtgaggtaacggaggcgattggggactgcgaaaacctgtcagagctcatccttacagagaacctgctaatggccttgccacgttcgcttggaaagcttactaagctgacgaatctgaatgtcgatcgtaatcatttggaagctctgcctccagaaatcggcgggtgcgtcgccttatccgttctgtccttgagggacaacaggcttgccgtcctcccgcctgagctggcccacaccactgagttgcatgtgctcgatgttgcagggaacagactccaaagcctaccctttgctttaacacacttgaacctcaaagctttatggctggccgagaatcaggcccaaccaatgctcagattccagactgaggacgacgcgcgaaccggtgaaaaagtgcttacatgttatttacttcctcagcagccccctccgtcccttgaggatgctggacagcagggcagcctgtctgaaacgtggtccgatgcccctcctagtcgggtatccgtcatccaattccttgaggcaccaatcggggatgaggatgctgaagaagcagcggccgagaagagaggcctgcagaggagggccacacctcatccttccgaactgaaggtgatgaagaggagcatcgagggccgcagatcggaggcctgtccatgtcaacccgacagtggaagtccgcttcccgctgaagaggagaagcgtctctccgcggagtcaggtctgagcgaggattcccgtccttccgccagtaccgtgtcagaggctgagcccgagggcccgtctgccgaagcccaggggggcagccagcaggaggccaccacagcggggggagaggaggacgccgaagaggattaccaggagcccacagtgcacttcgccgaggatgccctactgcccggagacgatagagagattgaggaggggcagcctgaagcgccttggacgctgccaggaggacggcaaagactgatccggaaagacaccccacactacaagaaacatttcaagattagtaaactcccccagccagaggccgtggttgctctgttacaggggatgcagccagacggcgaaggtccagtcgcgcccggtggctggcacaacgggccgcacgccccgtgggcaccccgggcccagaaggaggaggaggaggaagaagaagggtccccacaggaagaagaggttgaggaagaggaagaaaacagggccgaagaagaggaagctagcacggaggaagaagacaaggagggggcagtagtgtccgccccttctgtgaagggcgtgagcttcgatcaggctaacaacctgttgatagagcccgccaggattgaggaggaggagcttaccctcactatcttacgtcagactgggggtcttggcataagtattgctggaggaaaaggcagtaccccctacaaaggagacgatgagggtattttcatctctcgggtgtccgaagagggacctgctgctcgcgctggggtcagagtaggcgacaagttgttagaagtcaatggcgttgccttacagggagccgagcaccacgaggcggtcgaggccttgcgtggggccgggacagctgtgcagatgcgggtgtggagggagcgcatggtcgaaccagagaatgcggtgaccatcactccgcttcgccccgaagacgattactctccgagagagaggcggggcggggggctgaggctgcccctactgccccctgaatccccagggccattgcgtcaacgccacgtcgcctgtctcgcacgttcagagaggggcctggggtttagcatagcaggcggcaaagggtctactccgtaccgcgctggagatgcggggattttcgtgtcaaggatcgctgagggtggggcagcccacagggcgggtaccctgcaggtcggtgatagggtgctgtctattaacggggtggatgtcaccgaggctaggcacgatcatgccgtgtctctgctgactgccgcctcccccactatcgctttgctgctggaacgcgaggcgggtgggcccctgcctcctagccctctaccccatagctctcccccgacagccgcagtcgcaacaacctcaataacaaccgccaccccaggggttcccgggctgccctcgcttgctccctcgttgctggctgccgcattggagggaccctatcccgtggaggaaattaggctgccgagagctggagggcctctcgggctttcaatagttggtggctctgatcattctagtcatccttttggagtgcaggagccaggcgtcttcatttcaaaagtgctgccacgggggcttgctgcgaggagcggtctaagagttggggaccggattctggccgttaacggacaggatgtgcgggacgcgactcaccaggaggccgtgtcagctctgttgaggccttgcctcgagttgtcccttttagtgaggagagatcctgccccgcccggtcttcgcgagctttgtatccagaaggcccccggagaaagattgggcatttcaatccgcggaggagcccgcgggcacgccgggaatccaagagatccgactgatgagggcatattcatatccaaagtgtccccaacgggggctgccggtcgtgacggccggcttcgggtgggccttaggttgctcgaggtaaaccagcaaagcctgttggggctcacacacggagaggctgtgcaactactgcgatctgtgggcgacacccttactgtacttgtgtgtgacggctttgaagcctccactgatgctgccctggaggtgtctcctggcgtgattgccaacccttttgccgcgggcatcggacatcgaaactctctggagagcattagctcgatagaccgagagttatcccccgaggggcctggaaaggaaaaggaactgccaggccagaccctccactgggggccggaagctaccgaggctgctggccgcggccttcaaccgctgaagctcgactaccgggccctggccgcagtgccttctgcaggaagcgtccaaagagtgccatcaggggcagcaggcgggaaaatggccgagagtccatgcagccccagcgggcaacaaccaccaagccccccgtctcctgacgaattacctgcaaacgtcaagcaagcataccgcgccttcgcagccgtgcccaccagccatccacctgaagacgcacctgcccagcctcctacacccggccccgcagcatccccagaacaactgagtttccgggaacgacagaaatatttcgaattggaggtgcgtgtaccacaggccgaaggtcccccgaaaagagtgtctcttgttggggcagatgatcttaggaagatgcaagaagaggaggcccgcaaactccagcagaagagggcccagatgttgcgcgaggccgccgaagccggcgcggaggcacgacttgcgctggatggcgagactctgggtgaggaggagcaggaagatgaacagcctccttgggcttctccaagtccaacttctagacagagcccagctagcccaccacccctgggtgggggagcccctgtgcgcaccgctaaggcggaaagacggcatcaagagagattgcgagttcagtctccggaaccaccagcgcccgaacgggccctgagccccgccgagttacgtgcactggaagcagagaagagggcgctctggcgcgccgcaaggatgaagtccttggaacaagatgctttaagggcccagatggtcctgtcaaggtctcaggaaggcaggggaactagaggcccattagagcggctggcagaggcgccttctccagcaccaacaccaagtcctaccccagtggaagacctggggccccagacctcaacatctcccggtcgactgccgctatccggcaagaagttcgattaccgggccttcgcagccctccccagcagtcggcctgtgtacgacatacaatcccctgactttgctgaggagctgaggagcttggagccttcaccatctcctggcccccaggaagaagatggagaagtcgctttggtgctactgggtcggccctcacctggtgctgtgggacccgaggatgtggcattatgctcctccagacggccggtgcgcccagggcggagagggctcggccccgtcccttcctag

SEQ ID NO: 133540 - DNA, 2427 bp, Artificial Sequence
  Description of Artificial Sequence: Synthetic coding sequence
atgtggtttttcgcccgggaccccgtgcgggacttcccctttgagttgatccctgagcccccagaaggaggcctgcccggtccctgggccctgcatcgcggcaggaagaaggctacgggctctccagtctccatttttgtgtatgatgtgaaacccggggccgaggagcaaacccaggtggccaaggccgcttttaagcgcttcaagacactgcggcacccgaatatacttgcatatattgacggtctggaaactgagaaatgcttacacgtagttaccgaggcggtaacccccctcggaatatatctgaaggcccgcgtagaggccggaggtctgaaagagctcgagatatcttggggactgcatcagatcgttaaggccctgagttttctagtcaatgactgttctctgatccataacaacgtatgcatggcagctgtgttcgtagatagggccggggaatggaagctgggcggtctcgactacatgtactctgctcagggtaatggagggggacccccaagaaagggaattccagagctagagcagtatgatccaccggagctcgcggactctagcggtagggtggtacgcgagaagtggagtgcagatatgtggagattaggttgccttatctgggaggtcttcaacggccccctgcccagagcagcggcccttcggaacccgggtaagatcccgaagaccctggtcccccactattgtgaactagtgggtgctaatccgaaagtccgacccaaccccgctcgattcctgcaaaactgccgggccccaggcggctttatgagcaaccggtttgtcgagacaaacctcttcctcgaggaaatccaaattaaggaacctgctgaaaaacaaaagttctttcaggaactgagcaagtcactggatgctttccctgaagacttctgccgccacaaggttctccctcagctgctgactgcattcgagtttggaaatgccggcgcagtagtgctcacgccactgttcaaagttggaaagttcctttccgccgaagaatatcagcaaaagatcattccggtggtggtcaagatgttctcctctacagatcgggccatgcggattcgtctcctgcagcagatggagcaatttatccagtatcttgacgagccaacggtgaatacgcagatctttccgcatgtggtgcacgggtttctcgacactaatccagcgataagagagcaaaccgttaagtctatgttacttctcgcaccaaagctgaatgaagctaatctgaatgtggagttgatgaaacattttgcccgcctgcaggcgaaagacgaacaagggcccatcagatgtaataccacggtttgcttaggcaagatcggatcctatcttagtgcatccacgcgacaccgcgtgctgacttccgctttttcccgcgctaccagggacccctttgcccctagccgtgtcgccggggtgctgggctttgcagctacccacaatctgtattccatgaatgattgcgctcaaaagatcctacccgtgttgtgcgggctgacagtggaccctgaaaaatccgttcgagatcaagccttcaaggccatcaggtcgtttttatcaaaactggagtccgtgtccgaggacccaacccaactagaggaggtggaaaaggatgtgcatgccgcatcatcccccgggatgggaggggcagcagcctcctgggccgggtgggcagtgaccggggtatcctctctgacaagtaaattgatcaggagtcaccccacaacagcccccaccgaaacaaatatcccccagcgccccactccagagggagtgcctgctcccgcccccacacctgtgccggcaaccccaaccacttcagggcattgggaaactcaggaagaggacaaggacaccgcggaagatagctctaccgccgaccgatgggacgatgaagactggggctccctggaacaggaggccgaaagcgtgctggcccagcaggatgattggagtaccggcggccaggtcagtagggcttcccaggtctcaaattcagatcataaatcttcgaagtcgcctgagagtgattggagttcttgggaagctgagggttcttgggagcaaggctggcaggagccgtcatctcaggaacctccgccagatggaacacggctggctagcgagtacaactgggggggtccagaatcatcagacaaaggcgatccattcgcaaccctgagcgctcggccaagcacacaaccccgccccgacagctggggggaggataattgggagggtcttgagaccgacagtagacaggtaaaggcagagcttgcaagaaagaagcgcgaagaacgcaggagggaaatggaggcaaagagggccgagcgcaaagtagccaagggccccatgaagttgggggcccgcaaactggattag

SEQ ID NO: 133541 - DNA, 2346 bp, Artificial Sequence
  Description of Artificial Sequence: Synthetic coding sequence
atgtggttctttgccagagatcctgtgagggactttccattcgagttgatccctgaaccaccagaaggtggtctacccggaccgtgggccctgcatagaggtcgcaaaaaagccacagggtccccagtgagcatctttgtctacgatgttaagcccggcgctgaagagcaaacacaggtggccaaagccgcttttaaaaggttcaagaccctaagacatccgaatatcctcgcatatatcgacggactggaaactgaaaagtgtttgcatgtcgttaccgaggccgtcacacccctgggcatctaccttaaagcacgcgtcgaagccggagggctcaaagaactggaaattagctggggattgcaccaaatcgtcaaagctctctcattcctggttaacgactgctcacttattcacaataatgtgtgcatggcagctgtcttcgttgaccgagccggcgagtggaagctggggggcctcgactacatgtactccgcacaaggcaatggaggagggcctcctaggaagggaattccagagctcgaacaatacgatcccccagaactcgctgatagcagcggtcgcgtggtgagggaaaagtggagcgctgatatgtggcggctcggatgcctgatctgggaagtgtttaatggtccactcccccgggccgccgcgttacgtaaccctggcaagatccctaaaaccctggtgccacactattgtgaactggtcggggcgaacccaaaggtccgcccgaatcccgcaaggttccttcagaattgcagggcacccgggggatttatgtctaatcggttcgttgagactaacctcttcttggaggagattcagatcaaggaaccggccgagaaacaaaaattctttcaggagctgtccaagtcactggacgcgttccccgaagatttttgtcgccataaggtgctgccgcaactactcactgccttcgaattcgggaatgctggagccgtggtgctaacaccattatttaaggttgggaagtttctttctgctgaagaataccagcagaaaatcattcccgttgtcgtgaagatgtttagttcaaccgaccgggctatgcgcattagactgcttcagcagatggagcagttcattcagtatctcgacgaacccacggtgaacacccagatctttccgcacgtcgtgcacggattcctagataccaaccctgccataagggaacagacagttaagtcaatgctgctgctggccccgaaactgaacgaagccaatctgaatgtggagctgatgaaacactttgctaggctccaggcgaaagacgaacagggtccgatcagatgcaataccaccgtgtgcctcgggaagattgggtcatacctgtcagcgtccacgaggcatcgcgtactgacttctgcattttcccgggctaccagggacccattcgccccctccagggtcgcaggagtgctgggcttcgccgccactcataatttgtattcaatgaacgactgcgcccagaagattcttcccgtgctctgcggactgactgtagatccagaaaaaagcgtgcgtgaccaggccttcaaggcgatcaggtcctttctgagcaagctcgagagtgtgtcagaagatcctacccaactagaggaggtggagaaggatgttcacgcggccagctcacccggtatgggtggggctgccgcttcatgggctggctgggcagtgactggagtatcatctctcacatcaaagctaattaggtctcaccccactactgctcccactgagacaaatattccacagaggcccactcccgagggcgtgccagccccggccccaacccccgtgccagcaacacctacaaccagcggtcattgggaaacacaggaagaagataaagacaccgcagaagactcttctacggcagaccgatgggacgacgaggactggggaagtctggaacaggaggcggagtccgtgcttgcccagcaagacgactggtcaacagggggtcaagtctcacgagcatcacaggtgtctaattcagaccataagtcgtctaagagtcctgagtccgattggtccagttgggaggccgagggatcttgggaacagggatggcaggagccaagttctcaagagcccccgcccgacggcaccagactggcaagcgagtacaattggggtggaccagagtcctctgataaaggggatccattcgccaccttgtcggcccggccaagtacacaggaccggagccggttgtcctggccaggtagatcagcccggagcggcgggggcagatggcgacctaatgcaccacgggggcggtggccccgcgctccgtag

SEQ ID NO: 133542 - DNA, 2124 bp, Artificial Sequence
  Description of Artificial Sequence: Synthetic coding sequence
atgtggttcttcgcccgcgacccggtgagggattttccatttgagctgattcccgagccccccgaaggcgggctgcccgggccctgggcattacacagggggaggaagaaagcaactggctccccagtctccatctttgtatacgacgttaagcccggagccgaggagcagacccaggtcgccaaggcagcatttaagaggttcaagaccctgcggcatcctaatatcctggcatacatcgatgggctcgagactgaaaagtgcctgcacgtggtgactgaagctgtcaccccactggggatttatttgaaagcccgcgttgaggccggaggactgaaggaactagagatctcctggggtctgcaccaaattgtaaaggccctcagctttctggttaatgattgcagcctgatccacaacaacgtgtgcatggccgccgtgtttgttgaccgtgctggggagtggaaattaggcggactagattacatgtatagcgctcagggcaacggaggaggtccccctcgcaagggaataccagagcttgagcagtatgacccacctgagctggctgactctagcgggcgggtcgtgagggagaagtggtcggcagacatgtggcgcctgggttgcctgatctgggaagtgttcaacgggccactgcccagggcagccgctctgcggaatcccggtaaaatccccaaaacattggtcccccactactgcgagttagtcggcgcaaacccgaaagtacgaccaaatcccgcacgattcttacaaaactgccgggcaccaggaggattcatgtccaatcggtttgtggagacgaatttattcttggaggagatccaaatcaaggagccggcggaaaagcagaaattttttcaggaactaagtaagtcactggatgccttccctgaagatttctgtcggcataaggtactgccccaactactcactgcctttgagtttggcaatgccggcgccgtcgtgctgacaccgctcttcaaagtaggcaagtttctgagcgccgaagagtaccagcagaagatcatcccagttgtggtgaaaatgttttcttcaactgatcgagctatgagaattcgtttgcttcagcagatggaacagttcattcaatatttggacgagcccacggttaacacccagatttttccacatgtggttcatggattcctagataccaacccggctattcgcgaacaaaccgtcaaatcaatgctgttgctcgcgccaaagttgaatgaggcaaacttgaatgtcgagttgatgaaacatttcgcacggctgcaggccaaggatgaacaaggaccaattagatgtaacacaactgtatgcctgggcaaaattggtagctatctatcagcctcaactcgccaccgggttctgaccagcgcgtttagcagagccactcgagacccatttgccccttcccgcgtcgccggggtgcttggtttcgcagctacacacaatctgtatagcatgaatgactgtgcgcagaagattctccctgttctatgtggcctaactgtggatcctgagaaaagtgtacgcgaccaggctttcaaggccatcagatccttcttgtcaaaactggaaagcgtatctgaagacccaacgcagctagaggaggtggagaaggatgttcacgcagcttctagccctgggatgggtggggcagcagcttcatgggcagggtgggccgttacaggtgtgtctagcctcacttcgaaactcattcgatcccatcctactacggcacctactgagacaaacattcctcagcgccccactcccgaggggcactgggagactcaggaacctccacctgatgggactcggctcgcctctgagtacaattggggaggccccgaatcctcagacaaaggtgatccctttgccaccttaagcgcccgccctagcacacaaccccgccctgactcatggggcgaagacaattgggagggcctcgagacagattctcgccaagtcaaggctgagctggcaaggaagaagcgggaagagcggagacgagagatggaggcaaagagagccgagaggaaggtggctaaggggcctatgaagctcggcgccagaaaactagactag

SEQ ID NO: 133543 - DNA, 1071 bp, Artificial Sequence
  Description of Artificial Sequence: Synthetic coding sequence
atgtggttttttgcgcgagatccagtcagagactttcccttcgagcttatacccgaacctccagagggcgggctcccagggccctgggcattgcacaggggaagaaaaaaggctaccgggtcccctgtgtctatcttcgtgtatgatgtgaaacctggcgcggaagagcaaactcaggtggctaaagctgcattcaagcgcttcaagacactaaggcatcccaatattctcgcctacattgacggtctggagaccgagaagtgtctccacgtagtgactgaagcagttacaccgctgggtatctacctgaaagcaagagttgaggctggaggccttaaggagctggagatctcttggggcttgcaccaaatcgtgaaagcgttatctttcttggtgaatgactgtagcctgatccataataacgtttgcatggctgccgtcttcgtggatagggctggagagtggaagttgggaggactggactacatgtactccgctcaaggaaatggaggaggtccaccaaggaaaggcattcctgaattggagcagtacgaccctcctgagttggctgattcctctggccgggtggtgcgcgagaaatggtctgcagacatgtggcgactggggtgcctgatttgggaagttttcaacggacctcttccgagagccgccgctctgcggaaccctggaaagatccctaaaacacttgtgccccactactgcgagctcgtgggggccaacccaaaggtccgtccaaaccccgccagattcctgcagaactgccgcgctccaggcggtttcatgtccaacaggtttgtagagacaaacttgtttctggaggagatccagccaaaggatcctagactaaaggaatttcttccccagcctccccccctctttcttccccccttacaacctcaggcaactggccggcggaggcggcgaactcggacacagcagagaacagcagcattgctgacagacgggacgacaaagaccggcgctgcctggagcagacgcccgagcttgtgttggccatcaaggactacaggcgcaccaggggctaagtag

SEQ ID NO: 133544 - DNA, 2376 bp, Artificial Sequence
  Description of Artificial Sequence: Synthetic coding sequence
atgtggtttttcgcccgagatccagttcgggactttccattcgagctgattcccgaaccacctgagggaggactgcccgggccatgggccctgcataggggtcgcaagaaggctaccgggagcccagtgagcattttcgtgtacgacgtcaagcccggagcagaggaacagactcaagttgctaaagctgcctttaagcgatttaagactttaagacatccgaacattctggcctacatcgatggcttggagactgagaagtgcttgcacgtcgtaacagaggccgtgacacccttaggtatttatctgaaagctagggtcgaggcaggcggtcttaaggaactcgagataagctggggtctgcatcaaatagtgaaggcactaagtttcttggtcaacgattgttctctcattcataataacgtgtgtatggcagctgtgtttgtggatagggccggggagtggaaactagggggtttggattacatgtattcggcccagggtaacgggggtgggcctcctcggaaggggattccagaactggagcaatacgaccctcccgagttagctgattcctctgggagggttgttcgcgaaaagtggagcgcagatatgtggaggttaggctgcctgatctgggaagtttttaacgggccactgccacgcgccgccgcactacggaatcccggcaagatccctaaaacactggttcctcactattgcgaattggtcggggcgaatcctaaagtgcgtcctaatcctgcacggttcctgcagaattgtcgtgcccccggaggtttcatgtccaacagatttgtcgagactaatctctttcttgaagaaattcagattaaggaacccgctgagaaacagaaattttttcaggagctgtctaaaagccttgatgccttccctgaggacttttgccggcataaggtgctgccacagctgctgaccgcgtttgagttcggcaacgcaggtgcagtggtcctcaccccgctgttcaaggtaggcaagttcctgagtgcagaggaatatcagcagaagatcatccccgtggtggtgaagatgttttcatcaaccgaccgagccatgcggatacgcctgctgcaacaaatggaacagtttatccagtatttggacgaaccaacagttaacacccagatcttcccacacgttgtccacggctttttagatacgaatcctgctatacgtgaacagaccgtgaagtcaatgctcctgttggcccccaaattgaacgaggctaacttgaatgttgagctaatgaagcacttcgctcgtctgcaggcaaaggatgagcagggaccaatccgttgtaataccaccgtttgcctgggcaagataggtagctatctgtcagccagcaccaggcatcgcgtgttaacttcagctttttctagggcaacacgagatccttttgctccttccagagtggccggtgtactgggtttcgcagctactcacaacctgtatagcatgaacgattgtgcccagaagatcctgcctgtgctctgtggattgaccgttgaccccgagaaatctgttcgggaccaggcatttaaggccataaggtcatttctctcaaagctggagtcagtgtcagaggaccccacccagttagaggaagtcgagaaggacgtccacgccgcatcttcccctggtatgggaggggccgcagctagctgggctgggtgggccgtgacgggcgtcagctctctgacttctaaactcataaggagtcatccaacaactgctcccacggagaccaacatcccacagaggcccacccccgagggacattgggagacgcaggaggaagataaggataccgccgaagactcgagcaccgcagatcgctgggatgatgaggactggggaagcttagagcaggaagcagagtcagttcttgcgcagcaggatgactggtccaccggtggacaggtgtctcgggccagccaggtttccaacagcgaccacaaatcaagtaaaagccctgaaagcgactggtctagttgggaggccgagggctcctgggagcaaggatggcaggagccaagctctcaggagcctccaccagatggtacgaggctggcaagcgaatacaactggggcggccctgaaagttcagacaagggcgatcctttcgccaccctctcggctaggccctcaacacagccccgaccagattcatggggggaggacaattgggagggattggagaccgatagtcgacaggtaaaagcagaacttgcgcgaaagaaaagagaagaaaggcggagggagatggaagccaaacgggctgaaagaaaagtcgcaaaagggcccatgaaattgggggccaggaagctggactag

SEQ ID NO: 133545 - DNA, 2343 bp, Artificial Sequence
  Description of Artificial Sequence: Synthetic coding sequence
atgtggttcttcgccagagatcccgtccgagattttcctttcgagttaattccagaaccacctgaagggggcttaccaggaccctgggcactgcataggggccgcaaaaaagctactggaagccctgtatcgatcttcgtgtacgacgtgaagcctggtgcggaggagcagacgcaggttgccaaggccgctttcaagaggttcaagacgttaagacacccaaatatcttggcctacattgatggattggaaactgagaagtgcctacatgtggttacagaggctgtgaccccactggggatctatttgaaggcacgtgtggaggccggaggactcaaggagcttgaaattagctggggcctgcatcagatagtgaaagcactgagctttctagtgaacgattgttccctcatccataataatgtgtgtatggctgccgtgtttgtcgaccgagccggcgagtggaagctgggggggctagattacatgtatagcgctcaaggaaacgggggcggcccgccaaggaagggcatccctgagcttgaacagtatgatcctcccgaacttgctgacagctcgggccgtgtcgttcgagagaaatggagcgcagatatgtggagactggggtgtctcatttgggaagtcttcaatgggcctctccctcgagctgccgcattgcgaaaccccggaaaaataccgaaaactctggtgcctcattactgtgaactggttggggctaacccaaaggtgcggcctaaccccgccaggttcctccagaactgtagggccccgggagggttcatgtcgaacagattcgtggagaccaatcttttcctggaggagatacaaataaaggaacccgccgagaagcagaagtttttccaggagctgtccaaaagtcttgacgctttccctgaggatttttgtaggcacaaggttctgccacaactgcttacagctttcgagttcggcaatgccggcgctgtcgtcctgacccccctgtttaaggtcgggaagtttctttctgctgaggagtaccagcagaaaatcatccccgttgtcgtgaagatgttttccagcacagaccgagcaatgcggattaggctgctccagcaaatggaacagtttatccagtatttagacgagcctaccgttaatacccaaatctttccccatgtggtgcacggattcctggacaccaacccagcaatacgggaacaaacagtcaagagcatgctactgttggcgcctaaactaaacgaggctaatcttaatgtggaactgatgaaacactttgcaagattacaagccaaggatgaacaggggccaatccggtgcaatactaccgtgtgtctaggtaagatcggctcatatctgagcgcttccacaaggcaccgtgtccttacgtccgctttcagccgggcaacaagagacccttttgctccgtccagggtcgcaggggtcctcgggttcgccgctacccataacctctatagtatgaatgattgcgcacaaaaaatcctgccagtattgtgcggtctgactgtcgaccccgaaaaatctgtgagggatcaggctttcaaggccatcaggtcttttctaagcaaactcgaaagcgtcagtgaggaccctacacagctggaggaagttgaaaaggatgttcacgccgcttctagcccaggaatgggaggcgcagcagcaagctgggctggttgggccgtgaccggagtgagttcattgacctcaaaactcatccgctcccacccaactaccgctccaacagagactaatattccacagaggcctaccccagaaggggtccccgccccagcacctacaccggtaccagccacacctacaacctcaggccactgggagactcaggaagaagataaagatacagcagaggactcctccacagcagatagatgggatgacgaggactggggatcgctggaggaggccgaatcggttctggcccagcaggatgattggtctacaggaggccaggttagcagagcttcacaggtgtctaacagcgaccataaatctagcaaatcacctgagtcagattggagctcttgggaggccgaaggatcttgggaacagggctggcaggagccctcatcacaagaaccccctcccgatggaaccaggctggcgagtgagtacaattggggtggccccgagtccagcgataaaggggatccctttgccaccctgtcagcccgaccgtctacccaagatcgctctaggttgagctggccaggtcggtccgcgcggtccggtggcggccgctggagaccaaatgcaccacgagggcggtggcccagagctccctag

SEQ ID NO: 133546 - DNA, 2124 bp, Artificial Sequence
  Description of Artificial Sequence: Synthetic coding sequence
atgtggtttttcgcacgagaccccgtgcgtgatttcccttttgagcttattcctgagccccccgaagggggcctccccggaccatgggctctccaccgcgggcgaaagaaggccactggttcccctgtcagtatatttgtctatgacgtgaaacccggagccgaggagcagactcaggttgccaaggctgcatttaagaggttcaagactcttaggcatcccaatattctggcctacatcgacggtctggagacagagaagtgtctgcacgtcgtaacagaagccgttacgcccctcgggatctatttgaaggcccgggtagaggctggtgggctaaaggagctggaaatttcatgggggctacaccaaattgtcaaagctctgtcattcctcgttaacgattgcagcctgatccacaacaatgtgtgtatggcagccgttttcgtggacagagccggggagtggaaattgggaggcctggactatatgtacagtgctcagggtaatggcggtggacccccacggaagggaatacccgagttggagcagtacgacccgccagaattagccgattcgtccggtagggttgtgagggaaaagtggtccgctgacatgtggagactgggctgtctcatttgggaggtttttaacggacctctccccagggccgccgcgctcaggaatcccgggaagatacccaaaactttagtgccccactactgtgagctcgttggagctaaccctaaggtgaggccgaatccagctcgtttcttacagaactgccgggcccctgggggattcatgtcaaaccgattcgttgaaaccaatctcttcctggaagagatacagatcaaggagcctgccgaaaaacagaaattcttccaggagctgtccaagtcacttgatgcctttccagaagatttttgtaggcacaaggtcttaccccagctgttgaccgccttcgaattcggcaatgccggcgccgtggtgctgactcctcttttcaaagtgggcaagttcctttccgccgaggaataccagcagaagatcatcccagttgtggtgaaaatgttttcatctaccgaccgcgctatgcggattagattactgcagcaaatggagcagtttatacagtaccttgacgagcccaccgtgaatacacagattttcccccacgtggtccacggctttctagataccaacccagctattcgagaacagaccgtcaagtctatgcttctcctggcacccaaactcaatgaagccaatctcaacgtggaattgatgaaacacttcgctagattgcaggcgaaggacgagcaggggcctattagatgcaatacaacagtctgtcttgggaagattggctcatatctgtccgcgtccacccgacaccgagtccttacatcagctttcagcagggccaccagagacccttttgccccatcccgagttgcaggtgtactgggctttgccgccacgcataacctctacagtatgaatgactgcgctcagaagattctgcccgtcctttgcggattaacagtggatcctgagaagagcgtcagagaccaggcatttaaggccatccgcagctttctcagcaagctggagtctgtgtctgaggaccctacccagctggaagaggttgagaaagacgtgcacgccgcatcctctccaggcatgggcggagcagccgcatcatgggccgggtgggctgttacgggcgtgtcaagcctaacatcgaaactcatccggagccatcctacaaccgcacccacggaaaccaacatcccacagcgccctacccctgaaggccattgggaaacccaggagccacctcccgatggcaccagattagccagcgagtataattggggcggtcccgagagttctgataaaggcgatccatttgccaccttgagtgcccgtccctccacccagcccagaccggatagctggggagaggataactgggagggactggagaccgacagtcggcaggtgaaggctgaacttgccagaaaaaaaagagaagaacggaggcgcgaaatggaggcgaagcgggcagaacgaaaggtcgccaaagggccaatgaagttaggagctcggaagctcgactag

SEQ ID NO: 133547 - DNA, 2364 bp, Artificial Sequence
  Description of Artificial Sequence: Synthetic coding sequence
atgtggtttttcgcacgtgaccccgtgcgcgatttcccatttgagctgatccctgagcctccagaagggggactgccaggaccctgggcactgcacagaggtaggaaaaaggccaccggcagccctgtgtccatcttcgtctatgatgtcaagccgggggccgaagaacagacccaggtcgcaaaagcagccttcaaacgctttaaaaccctgcggcaccctaatatcctcgcatacatcgacggactggaaactgaaaagtgcctccatgtcgtgacggaagctgtcactcctctggggatttatttaaaagctcgtgtggaggcagggggcttaaaggagttggaaatcagctgggggttgcatcaaatcgtaaaggccctttccttcctcgtgaatgattgctccctcattcacaataatgtgtgcatggcggccgtgtttgtcgatcgggccggtgagtggaaactcggggggctcgattacatgtatagcgcccagggtaacggaggggggccgcctcgcaagggcattccagaactcgagcaatacgatcctccggaattggctgactcctccgggcgcgtggtgagggagaagtggtctgccgacatgtggagactgggctgtctgatttgggaagtgttcaatggaccattgcctcgagctgcagcacttcgtaatccaggcaaaatcccaaaaactcttgtccctcattactgcgaactggtgggagcaaacccaaaggttagacctaacccagccagattcttgcagaactgcagagcacccggggggttcatgtccaatcgttttgtggagaccaatttattcttggaagaaattcagatcaaagagcccgcggaaaaacagaaatttttccaagaacttagcaagtctcttgatgccttcccagaagacttctgcagacataaggtacttcctcaactcctgacagcgtttgagttcggcaacgcaggcgcagtggtgctgacccctctgttcaaggtcgggaagtttctgtccgcagaggaatatcagcagaaaataattcccgtggtcgtgaagatgttctcttctacagaccgggccatgcggattagactattacaacaaatggagcagttcatccagtaccttgacgagccaaccgtgaatactcagatattcccccatgtggtgcatggatttcttgacactaatcccgccatccgcgagcaaacagtgaaaagcatgctcttgctcgcaccgaaactaaacgaagccaacttgaatgtggagctgatgaagcacttcgcgcgactccaggcaaaagacgaacaaggtccgattcgctgtaacacaaccgtctgcctggggaagatcggcagttacctttctgcttctacgagacacagggtacttacctcagctttctccagggcaacacgggacccatttgccccgtcacgggtggccggtgttctggggtttgcagccacccacaacctgtactcaatgaacgactgcgcccagaaaattctccctgtactgtgtggcctgacagtcgatcccgagaaatctgtccgcgaccaagccttcaaagctataaggagtttcttatcaaaattagagtccgtaagtgaggatccaacgcagttagaagaggtggaaaaagatgtgcatgcagcatcatcccccggaatggggggagcagcagcaagttgggccggttgggccgtcacaggggtaagttccttaacgagcaaactgatcagaagccacccaacgactgcacccacagagaccaatataccacagcggcctacccctgagggcgttccagcgccagcccctacccccgtccctgccacacccaccacatcagggcactgggagacccaggaggaagataaagacaccgctgaggatagctctaccgccgaccgctgggatgacgaggattggggctccctcgaacaggaggccgaatccgttctggcacagcaggatgattggtccacaggcggacaggtgagccgggcttcgcagtctccgaccggcgcagctggcaagctgcgagctccaggcaatcgggcaggcaggtcccaggcacctcgctcacacttgctgacggtccacgggtggcctgcctccattactggagttgcgcagtctcccgctactcgagccactccgagtctgccatgcctgcacgttccagcccctagcagaggtcagacacttggagtgaggactaccggccgcgcttcccgacttacggtcgaccgatcccgtctctcttggccgggacgaagtgcgaggagtggcggaggccgatggaggcctaacgcacctaggggacgttggcctagggctccctag

SEQ ID NO: 133548 - DNA, 663 bp, Artificial Sequence
  Description of Artificial Sequence: Synthetic coding sequence
atgatcaaacccaaatggggaggattggtttgggcacaatggcatggtccactggctcggccatctggtacactgccattcgcgtctagtatgccatctcccgtcgacgccagtagtgctgatgggggaagcggcctgggcagccaccgccgcaagcgcacaaccttcagtaaaggccagttactggagctggaaagagcatttgcagcttggccataccccaatatctcgacccatgagcatcttgcctgggtgacatgtctgcccgaagccaaagtgcaggtatggttccagaagagatgggccaagatcatcaaaaacaggaagagcggcatcctcagccccggttccgagtgtccacagagctcatgctcactgcctgacacattacagcaaccctgggaccctcagatgcctggacagccccctccctcaagcggaacccctcagcgtacaagtgtgtgccgtcacagctcgtgccccgctcccggtttgtcccccagacaggggtgggagggcgctaaggccgtcgccccttgggggtcagcgggcgcgtcagaggtgcacccgtcgctcgaacgtgccacaccacaaacaagcctaggttccctgtccgacctgatttacgctctggcaatcgttgtgaacgtcgatcacagctag

SEQ ID NO: 133549 - DNA, 651 bp, Artificial Sequence
  Description of Artificial Sequence: Synthetic coding sequence
atgggtggatccggtgtcggcaccgcctggcacggccccttggcccgaccgtctggaactcttcctttcgcatcgtctatgccatcgcccgttgatgcctcctcggccgacgggggaagcggactgggcagccataggcgtaagagaacaacgttctccaaaggccagcttttggagttggagcgcgcatttgccgcctggccttatcccaatatctcaacccacgaacacctggcatgggtgacctgtctcccggaagccaaagttcaggtgtggttccaaaagcgttgggccaaaatcatcaagaatagaaagtcaggtatactttcaccaggatctgaatgtccacagtctagctgctccctccccgacaccttgcagcagccttgggaccctcagatgcctggacagccacctccctcctcggggactcctcagcggacatcagtgtgtcggcactcgagctgtcccgcccccgggttgtctcccagacagggatgggaaggcgccaaagctgtcgcgccttggggttccgccggcgctagcgaggttcacccatctctggagcgagcaacacctcagacgagtctcggatctttgtcagacctgatctacgctttggccatcgtcgtgaacgtagaccattcttag

SEQ ID NO: 133550 - DNA, 648 bp, Artificial Sequence
  Description of Artificial Sequence: Synthetic coding sequence
atgatgaccacaggctggacgggactctgcctcccgcctgtgaatccaagcagagtcagcagctcctcactcgaaacctccaccactgagagcatctttgcgcacgacggcgggagtggcctgggctcacataggcggaaacgcaccacttttagcaaaggtcaactactcgagttagagagggcctttgcggcatggccttaccccaatatcagtacacatgaacatcttgcctgggttacatgcttgccggaagccaaggtccaggtgtggtttcaaaagcggtgggcgaagatcattaagaatcgcaagagcggcattctcagtcctggttcggagtgtcctcagtccagctgtagtctaccagacacactccagcagccatgggacccacagatgccaggccagccaccccctagcagcggcactcctcaaagaacgagcgtctgcaggcatagtagttgccctgcccctgggctgagtcctcgacaggggtgggagggagctaaggcagtcgctccatggggcagcgctggagcatcggaagtacacccaagcttggagagggccacaccccagaccagtttgggaagtctgtccgatctgatttatgctctcgccattgtggtgaatgtggatcactcctag

SEQ ID NO: 133551 - DNA, 648 bp, Artificial Sequence
  Description of Artificial Sequence: Synthetic coding sequence
atgatgaccactggctggactggcctgtgtctaccacccgtcaatccctctagagtctcttccagttcgttggagacaagtaccacggagtctatctttgctcacgatggggggagcggactcggcagtcaccggcgcaagaggaccacattctctaaaggacaactactggaactcgaacgagcctttgccgcttggccatatccgaacatttcaactcacgaacatcttgcatgggttacctgcctcccagaggccaaggttcaagtctggtttcagaagagatgggctaaaatcattaaaaacaggaaatcaggaattctcagtccagggtccgagtgcccccagtcttcttgttctcttcccgacaccctgcagcagccctgggacccacagatgccaggccaacccccaccgagcagcggaacaccacaaagaacaagcgtgtgccgtcattcctcctgtccagcacctggattgtctcctcgccagggctgggagggagcgaaagccgtggccccctggggctccgccggagcttctgaggtgcacccttcacttgagagagcaacacctcaaacatctctggggtccttgtccgacctgatttacgctctcgccattgtcgttaatgtggaccattcttag

SEQ ID NO: 133552 - DNA, 1212 bp, Artificial Sequence
  Description of Artificial Sequence: Synthetic coding sequence
atgtccggacgcgttggcgacctttctccacggcagaaagaggccctggcaaagttccgtgagaacgtacaggacgtgctgccagctctgcctaatccagatgactatttccttcttcgatggcttagagcaaggtctttcgatctgcagaagtccgaagcaatgctccggaagcacgtcgaatttagaaagcagaaggacattgataatattatatcgtggcagcctcctgaggtgatccagcagtatctgagcgggggtatgtgcgggtacgacctggacggttgtcccgtctggtatgatattataggacccttagacgctaaggggcttctcttcagcgcctcaaagcaggacctgctgagaaccaagatgcgggaatgcgaactgctgctgcaggaatgtgcccaccagactaccaaacttggtcggaaagtcgagaccataaccataatctatgattgtgaggggctggggttgaaacatctgtggaagcccgcagtagaagcatacggggagtttctgtgtatgttcgaagagaattaccccgagactctgaagagactcttcgtagtaaaagctccaaaactgtttcctgtggcatacaacctgattaaaccatttctgagcgaggacacgcgcaaaaagataatggtgctgggagccaactggaaagaagtattattaaaacatatcagtccagatcaggtacctgtcgagtatggcggaacaatgaccgatccggacggaaacccaaaatgcaaatctaaaatcaactacggaggagacatcccgcgcaagtattatgtacgggaccaggtcaaacagcaatacgagcattccgtgcaaattagtcgggggtccagtcaccaggtagaatacgagattctgtttcccgggtgcgtcttgaggtggcagttcatgtctgatggcgcggatgtggggttcggaatatttctgaagacaaaaatgggggaacgacagagagcgggcgaaatgactgaggtgttgccaaaccaaagatacaacagtcacctggtgccagaagacggcacactcacttgctccgaccctggtatctatgtgctcagatttgacaacacctattctttcatccacgctaagaaggttaacttcacggtggaagtccttctgccagataaagctagcgaagaaaagatgaagcaactcggcgccggcaccccaaaatag

SEQ ID NO: 133553 - DNA, 963 bp, Artificial Sequence
  Description of Artificial Sequence: Synthetic coding sequence
atgtctggtcgtgtgggagacctgtcgccacgtcagaaagaggctcttgccaaattcagagagaatgtgcaggacgtcttaccggccctgcctaatcctgacgactatttcctgcttcggtggcttcgtgctcggtcatttgacctgcagaaatccgaggccatgctaagaaagctgggccgtaaagtggaaaccataacaataatctacgactgcgaaggcctgggactcaaacacttgtggaagcccgcggtagaggcatatggagagtttctgtgtatgttcgaagagaattaccccgagactcttaagaggctattcgtcgtcaaggcccctaagctgttccccgtggcttacaatctaataaagccatttcttagcgaggacactcgcaaaaaaattatggtgctgggggccaattggaaggaggtgctgcttaagcacatcagccccgatcaggtgccagttgagtacggcggaacgatgaccgacccggacggcaatcctaaatgtaagagtaaaataaattatggtggtgacataccccgaaagtactacgtgcgggaccaggtcaagcagcagtatgagcactctgtccagatttccagaggatcttcccatcaggtggagtatgagatactgtttccaggttgtgtgctgcggtggcagttcatgtcggacggggccgacgtgggtttcggcatctttctcaaaaccaagatgggagagcgtcaaagagcaggagaaatgacagaagtgttgcccaatcaacgctacaactcccacctcgtgcccgaagatgggacgttgacctgctctgacccgggcatttacgtgctgaggttcgataatacctactcttttatacacgcgaagaaggtaaactttaccgtggaggtattgctccccgataaagcatctgaagaaaagatgaagcagctgggtgccggcactcccaaatag

SEQ ID NO: 133554 - DNA, 990 bp, Artificial Sequence
  Description of Artificial Sequence: Synthetic coding sequence
atgctccggaaagttatccagcagtatctgtcgggtggtatgtgtgggtacgatcttgatggctgtcctgtttggtatgacatcatcggcccactagacgctaaaggcttgctgtttagcgctagcaaacaggatctgctgcgtactaagatgcgtgaatgcgagttactcttgcaagagtgtgcgcatcaaactactaagctggggcgcaaggtcgaaacgattacgataatatatgactgcgagggcttgggactgaagcatctctggaaacctgccgtcgaggcgtatggtgaatttctatgtatgttcgaggaaaattacccagagactctgaagagattatttgtggtaaaggcccctaagctgttccccgtggcctataatctgatcaagccatttttgtccgaagatacaaggaagaagattatggtgctgggcgcaaactggaaagaagtactgttgaagcacatatcccctgatcaagtgccggttgaatacggcgggacaatgacagacccagacggtaaccctaaatgtaaaagcaagatcaactatggtggcgatataccccgcaaatactacgtaagggatcaggtaaagcagcagtacgagcactccgtgcagatttccagaggtagctcacaccaggtggaatatgagatcctcttccctgggtgcgttctacgctggcaatttatgagcgacggtgccgacgtgggcttcgggatcttcctgaaaacaaaaatgggtgagcgtcagcgtgcgggcgaaatgaccgaggtactgcccaaccagcggtataacagtcacctggttccagaggacggaactcttacatgtagtgaccctggtatctacgtgctgagattcgacaacacttatagtttcatccacgctaaaaaagtcaatttcacagttgaagtcctactgcccgataaagcaagtgaggagaaaatgaagcaattgggggccggcactccaaagtag

SEQ ID NO: 133555 - DNA, 1179 bp, Artificial Sequence
  Description of Artificial Sequence: Synthetic coding sequence
atgtcaggtcgcgtgggagatctctcccctcggcagaaagaggcgctggcaaaattcagagaaaatgtgcaggacgtccttcctgcattgccgaatcccgacgattactttctgctgcggtggctgagagctagatccttcgatctgcagaagagcgaggcaatgttgcgtaaacatgtggaatttcggaagcagaaagacatcgataacattatttcctggcaacctcctgaggtgattcagcagtacctcagcggaggtatgtgcgggtacgatctcgacggttgtccagtctggtatgatatcattggaccattggatgctaaaggcctcctatttagtgcctccaagcaagatcttttacggaccaagatgcgagagtgcgagttgctgcttcaggagtgtgctcaccagacgactaaattgggacgcaaggtggagactattactataatttacgactgcgagggcctcggactcaaacatctttggaaacctgccgtcgaggcctacggggaatttctttgcatgtttgaagagaactaccctgagaccctgaagaggttgtttgtcgtgaaagctccaaaattgttcccagtggcatacaatttaataaagccctttttaagtgaggacacccgtaagaagattatggtcttgggtgcaaattggaaagaggtgctcctgaagcatattagccccgatcaggtgccagtagagtacggaggcaccatgacggacccagatggtaatcccaagtgtaaaagcaaaatcaactacggcggagatatcccaaggaaatattatgtcagggatcaagtgaaacaacagtacgaacactctgtgcagatatctcgcggatctagccaccaggtggaatatgaaatcttgttccccggatgtgtgctgcgctggcaattcatgagtgacggggctgatgtggggttcggtatcttcctgaaaaccaagatgggggaacgccagcgtgctggggaaatgactgaggtgttgcccaatcaacggtacaattctcatctggttccggaagacggcactctcacatgttcagatcctggaatttgcaagtatctgtgtttaggaaacgcgctgaagccccacgttcagctcagcgcctgtgaagttccactacccccatggatcttcgggagtgagtgttag

SEQ ID NO: 133556 - DNA, 1119 bp, Artificial Sequence
  Description of Artificial Sequence: Synthetic coding sequence
atgtccaaggcttttggattgttgcgacagatctgccaatctattctcgcagagtctagtcaatcacctgcggacctggaagaaaagaaggaagaagactccaatatgaaaagagaacaaccccgtgaacgaccgagagcttgggactaccctcatggtctggtaggattacataacataggtcagacttgctgtttgaatagcctgatccaagtatttgtaatgaacgtagactttacaaggatcttgaagcggatcacagtgccccgaggcgcggatgaacagcgtaggagtgtgccgtttcagatgttgttgctgctggaaaaaatgcaggacagccgccagaaggccgtccggccactcgagctggcttactgtttgcagaagtgtaacgtccccctatttgtgcaacatgatgccgctcagctgtacctcaaactgtggaatctgattaaggaccagataacagacgtgcacctggtcgagcgtttacaggcgctgtacaccattcgggtgaaagactccttgatttgtgtcgattgtgctatggagagctcaaggaacagttcaatgctaaccctgcctctcagtctgttcgatgtggatagcaaacccctgaaaacactggaggacgccctccattgcttttttcagcctagagagttgtcctcaaagtccaagtgcttttgcgaaaactgcggaaagaaaacccgagggaagcaagtgctcaaactcacccatctgcctcagacactgaccattcacctgatgagatttagtattaggaacagtcagacaagaaaaatatgccacagcctgtatttcccacagtccctcgatttctcacagattctcccaatgaaacgagagtcctgtgatgctgaagagcagtctggcgggcagtacgagctctttgcggtcatcgcccatgtgggaatggccgatagcgggcactactgcgtgtacattcgaaacgcagtggacggtaaatggttttgctttaatgattctaacatatgcctggtgtcttgggaggatattcagtgtacttacgggaaccccaattaccactggcaggagaccgcatatctgctcgtgtatatgaagatggagtgttag

SEQ ID NO: 133557 - DNA, 1062 bp, Artificial Sequence
  Description of Artificial Sequence: Synthetic coding sequence
atggagttccgcaagaccatggatattgatcatattctggactggcagcccccagaagtgatacagaaatacatgccaggcggcttatgtggctatgaccgggatggctgccctgtctggtacgatattattgggcctctcgatcccaaggggctgttatttagtgtgaccaagcaggatctgctaaaaacgaaaatgcgggattgtgagaggattcttcacgagtgtgatctacaaactgaacggttaggcaagaaaatcgaaaccatcgtcatgattttcgactgcgaaggtctaggcttgaaacatttctggaaacctttggtggaggtctatcaagagtttttcggcttgttggaggaaaactaccctgaaacccttaagtttatgctgatcgtcaaagcaaccaaactcttccctgtcggatataatctgatgaagcccttcctgagcgaagacacccgacggaagattattgtcttggggaataactggaaagaagggctcctgaagcttatttcccctgaagaactccccgcccaattcggtggaaccttgacagaccccgacggcaacccaaaatgcctgacgaagataaactacgggggagaaattcccaaaagtatgtacgtccgcgatcaggtgaagacgcagtatgaacatagcgttcaaatcaacagaggctcctcccatcaggtcgagtacgaaattctgtttcctggatgtgtgctcagatggcagttcagtagtgatggcgccgatattggattcggcgtgtttctgaagacaaagatgggcgagagacagagagccggagagatgacagacgtcctgccttcccagaggtacaatgcccatatggtgccagaggacggtaatttgacatgcagcgaggccggcgtgtacgtcgagagcgagagcgggaagtcctgctgtcatctgcccgttataatttgcagtcacgagctgcagaattcgcactctaattctcaggttatggcgtatcaaatggtacgcaaatgcaagttgtcacggcctctgcctctgcccgcatcgaactag

SEQ ID NO: 133558 - DNA, 1026 bp, Artificial Sequence
  Description of Artificial Sequence: Synthetic coding sequence
atggagttccgcaaaaccatggacatagatcatatcttagactggcagcctccggaggtcatccagaagtacatgccaggagggctgtgtggctacgatcgtgacggatgtccggtgtggtacgacattatagggccgctggaccctaaggggctgctgttctctgtgaccaagcaagatctcttaaagacgaagatgcgagactgcgagaggatcctccacgagtgtgacctgcaaacagaacgactgggaaagaagattgaaaccatcgtcatgatctttgattgcgagggcttgggccttaaacacttctggaaacctcttgtggaggtatatcaggagttctttggactgctggaggaaaattatcctgaaaccttaaagtttatgctcatagtgaaagccactaaactcttcccagtcgggtacaatttgatgaagccatttctctctgaggatacacgtcgtaaaattatcgtgctcggcaataactggaaggagggactgctgaaactcatttcccccgaagagctgcctgctcagtttggaggaacactgactgatcctgatggaaaccccaagtgcctgaccaaaatcaactatggtggcgaaatcccaaaaagtatgtatgtgagagaccaggtgaaaactcaatatgagcactccgtgcagattaaccgcggttcatcacatcaggtggagtacgagatcctgttccctggctgcgtacttaggtggcagttttcctccgacggagccgacatcggttttggcgtgtttcttaagacaaaaatgggcgagagacagagagccggcgaaatgactgacgtcctgcccagtcaacgctacaacgcacacatggtgcccgaagatggaaatcttacatgcagcgaggccggagtgtacgtccttaggtttgataacacatactcattcgtgcacgctaaaaaggtttctttcacggtggaggtgctcttgccggacgagggcatgcagaaatatgacaaggaactcacccccgtatag

SEQ ID NO: 133559 - DNA, 972 bp, Artificial Sequence
  Description of Artificial Sequence: Synthetic coding sequence
atggtgatccagaaatacatgcctggtgggctttgcggttacgatcgcgatggttgtcccgtctggtatgacatcataggtcctctggacccgaagggcctccttttcagcgtgaccaagcaggacctcctgaaaactaagatgcgcgattgcgagcgcatcctccacgagtgtgacctgcagacagaaaggttgggtaagaagatcgagaccattgtaatgatattcgattgtgagggattggggcttaagcatttctggaagcctctggtcgaggtatatcaggaatttttcgggctcttagaggagaattatccggagactctaaagtttatgttaatcgtgaaggcgactaagctgttccccgttggttacaatttgatgaagcctttcctgtctgaagacacaaggcggaaaatcattgtcctagggaataattggaaggagggactcctgaagctaatctctcctgaggagttgcctgcacagttcggagggaccctaactgaccctgacgggaaccccaaatgtctaaccaaaattaactacgggggcgaaatccctaaatcgatgtacgtccgagatcaggtgaagacacagtacgaacacagtgtgcagatcaaccgggggtcatcacaccaagtggagtatgaaatattattcccgggctgcgtcctccgctggcagtttagcagcgacggggccgacattggctttggggtctttttaaagacgaagatgggagagagacagagagccggagagatgaccgacgtgttacctagccagcgctataatgcccacatggtgcccgaggacggaaaccttacctgctctgaggctggcgtatacgtgctccgttttgacaacacctatagctttgtgcacgccaagaaagtctcattcaccgtcgaggtgttgctgccggacgagggtatgcaaaagtatgataaggaactaacaccagtgtag

SEQ ID NO: 133560 - DNA, 972 bp, Artificial Sequence
  Description of Artificial Sequence: Synthetic coding sequence
atggtgatccagaagtacatgccaggtgggttatgtgggtatgaccgggacggctgccccgtgtggtatgatatcattggtcccctggaccccaaggggctgctgttctccgtgacaaagcaggacctgcttaagactaaaatgcgggattgtgaacgtatcctccacgaatgtgatctacagacagaaaggcttggtaagaaaattgaaacaatcgtcatgatcttcgattgcgagggattgggactgaagcacttctggaaacctctggtcgaggtctaccaggagttctttgggctactcgaggagaattaccccgagaccctcaaatttatgctcatcgtgaaggccactaagctgtttccagtgggatacaatctcatgaagccgttcctgagtgaggatactaggagaaagattatcgtgctggggaacaattggaaggagggattgctcaagctcatttcacccgaggagctacctgcccagtttggcggaactcttaccgacccagacggaaacccaaaatgcctgacaaaaattaattacggaggagagattccaaaaagcatgtatgtcagagatcaggtcaagacccagtacgagcattccgtccaaatcaaccggggtagcagtcaccaggtggaatacgagattctgtttccaggctgtgtgctgcgctggcagtttagctcggacggcgccgacatagggtttggtgtgttcctgaaaacaaaaatgggcgaacgccaacgagccggggagatgaccgacgtgctcccctctcagcgctataacgcacatatggtgcctgaagatgggaacctcacctgttctgaggcgggcgtctatgtgctgcggtttgataacacgtatagcttcgtccatgctaaaaaagtttccttcacagtggaagtgctgcttcctgatgaaggaatgcagaagtacgataaggagctcaccccagtctag

SEQ ID NO: 133561 - DNA, 1221 bp, Artificial Sequence
  Description of Artificial Sequence: Synthetic coding sequence
atgagctcccgggttggagatctatctccacagcaacaggaagcacttgcacggttccgggaaaacttacaggacctgctgcccatcctcccgaacgctgacgattactttctcttaagatggctgagggctcggaactttgatctgcagaagtctgaagatatgttgaggaggcatatggaatttagaaaacagcaggatttagacaacatcgtaacctggcagccccccgaagtgatccagctatacgattctggcgggctctgtggatacgactatgaaggttgtcctgtgtatttcaacataatcggctctctggaccccaagggcctcttgctgtccgctagcaagcaggatatgatccggaaacgtattaaggtttgtgaactcctactgcacgagtgcgaactccagacacagaaactgggccgaaagattgagatggccctcatggtttttgacatggaggggctctcccttaagcacctctggaaaccagcagtggaggtgtatcagcagttcttctccatcctggaagccaactatcccgagacattgaagaacttaattgtgattagggccccaaagctttttccagtcgcgtttaatttggtgaagagctttatgagcgaagagaccagacgaaaaatcgtgatccttggcgataattggaaacaggaattgaccaagtttatttctcctgaccagctccctgtggaattcggcggaaccatgacagatccagatggaaatccgaagtgtttgacaaaaattaattatgggggcgaggttcctaagagctattacctgtgtgagcaggtcagactccagtatgagcataccaggagcgttggcagaggttctagtctgcaggtcgagaatgagatcttattcccggggtgcgttcttcggtggcagttcgcgtctgacggcggcgatatcggcttcggcgtctttctgaaaacgaagatgggcgaacaacaatccgctagggaaatgacagaggtgcttcctagccaacgatacaatgcccatatggtgcccgaggacggctctctcacctgcctacaggcaggagtgtacgtgttgcgcttcgacaatacttactcccggatgcacgctaagaagctgagctacactgttgaagtccttttacctgacaaggcgagtgaagagactctgcagtctctgaaagccatgcgccccagccccacacaatag

SEQ ID NO: 133562 - DNA, 1083 bp, Artificial Sequence
  Description of Artificial Sequence: Synthetic coding sequence
atgtcatcgagggtcggcgatctcagtccccaacaacaggaggccctggcacggtttagagaaaatcttcaggacctcctacctatattgccaaacgcagatgactattttttactgcggtggctgagagccaggaatttcgatcttcagaaatccgaagatatgctccgtcgccacatggaatttaggaaacaacaggatctggataatatcgtgacatggcagccaccagaagttatccagctgtacgactccggaggtctctgcggatacgattacgagggctgccccgtgtactttaacattattggtagcttagatccaaaaggactcctcctgagtgcctctaagcaggatatgatccgcaagcgtataaaggtttgcgagctactattgcatgaatgtgaattgcaaactcaaaaactgggacggaagatcgagatggctctgatggtcttcgacatggagggtctgagcctcaaacacttgtggaagccagctgtggaggtgtaccaacagtttttcagcattcttgaggctaattaccctgagaccctcaagaacttgatcgttataagggcccccaaactctttcccgttgctttcaatctggtaaaaagcttcatgagtgaagagacaaggagaaaaatcgttatactgggagataactggaagcaggagctgacaaagtttattagtccagatcaattgcccgtggaattcgggggcactatgactgatccagacggaaatcccaaatgtctcaccaaaattaattatggtggagaagtgcccaagtcatattacctgtgcgagcaggtgcggctccagtacgagcacaccagaagcgtcgggcgcggatcatcgctgcaagtggagaatgagattctgttccctggctgcgtgctccgatggcaatttgcttctgacggaggggatatagggttcggagtgtttctgaagaccaaaatgggcgagcagcagagtgctcgggagatgactgaagtccttcccagtcagcgctacaacgcccacatggtacctgaagacggatccctcacctgcttgcaggccggggtgtag

SEQ ID NO: 133563 - DNA, 1083 bp, Artificial Sequence
  Description of Artificial Sequence: Synthetic coding sequence
atgttgcgccggcacatggagttcaggaagcaacaagacttggataatattgtcacctggcagccgcccgaggttatacagctgtatgactcaggcggcctatgcggatatgattatgaggggtgtcctgtgtacttcaatataatcggctctctggaccctaagggactcctgctctcagcaagcaagcaggacatgatcagaaagagaatcaaggtatgcgaactgctcctccatgagtgcgagctgcagacccaaaaactaggaaggaaaatcgagatggctctgatggtatttgatatggagggactgagtttgaagcacttatggaaaccagccgtggaagtctaccagcagtttttcagcatcctggaagcaaactacccagagacactgaaaaacctgatagtgatacgagcgccgaagctgttccccgtggccttcaatctagtgaaatccttcatgagtgaagagacacgccgaaagatcgtgatcctaggggataactggaagcaggagctgaccaagttcataagtccggaccagttacccgttgagttcggtggcaccatgaccgaccctgatggtaatccaaaatgtctgacaaaaattaattatggaggtgaagtgcccaaatcatattacctgtgcgaacaggttcgccttcagtatgaacacactcggtccgtggggcgcggcagctcgcttcaggttgagaatgaaattctgtttcctggttgtgtgctccgttggcagttcgctagtgacggcggcgatatcggcttcggggtgttcctgaaaaccaagatgggcgaacagcagagcgcaagggaaatgacggaggttctccctagccagcggtataatgcacacatggtcccagaggatggctcccttacctgtcttcaggcaggggtgtacgtccgaggcttgtgtagtctgataacgtcgccaagtctccagatgtcttgtgcatccactactcccaccgcaggttgcatgccaaggagtagcgccactctgtggaggtgttgttttccgacacgtccgctgcgacggcggtgtcgcgtgagtcggagatag

SEQ ID NO: 133564 - DNA, 1176 bp, Artificial Sequence
  Description of Artificial Sequence: Synthetic coding sequence
atgctgatgacaacctcatcttgtgccgggtgcgaattggagacactgacatgtcggaaccccaagacctgttctgaagggccgaaatcaccccaacctacctcatgcccacacgcactacgggcatggcacatggagtttaggaagcagcaagacctcgacaatattgtgacctggcaacctcctgaagtgatccaactctatgatagcggggggctgtgtggctatgactatgaaggctgtccagtgtacttcaatatcatcggtagtcttgaccctaaaggcctcttgttatccgcatccaagcaagacatgatccggaaaaggatcaaagtgtgtgagctcctgctgcacgaatgtgagttgcagacccagaagctcggacgcaaaatagaaatggcattaatggtgttcgacatggagggcctgtctttgaaacatctctggaagcctgcggtggaggtgtaccagcaattcttcagcatcttagaggcgaactaccccgaaactctgaaaaatctgattgtaattcgggctcccaaactgttccccgtggcttttaatctggtcaagtcatttatgtccgaggagacacgacgaaaaattgtcattctaggggacaattggaagcaagagctgacaaagtttatatctccagaccaactcccagtcgagttcgggggcacgatgaccgacccggatggaaacccaaagtgtcttaccaaaatcaactatgggggagaagttccgaagtcttactacctgtgtgaacaggtgcggctgcagtatgagcatactcggtcagtgggccggggcagttccttgcaggtcgaaaacgaaattctgttccccggttgcgtgctcaggtggcaattcgcgtccgacgggggagacatcggcttcggggtcttcttaaagaccaaaatgggcgagcagcagagtgctagagaaatgactgaggtgctgccctcacagcggtataatgcacacatggtgccggaggacggttctctgacatgcctgcaggctggagtctatgttttgagattcgacaacacctactctcgcatgcatgcgaagaaactttcgtataccgttgaggttctcctgccagacaaagcctcagaagagaccctgcagagtttaaaggcaatgcgaccctcccctactcagtag

SEQ ID NO: 133565 - DNA, 2256 bp, Artificial Sequence
  Description of Artificial Sequence: Synthetic coding sequence
cccgcggctgccgccagtagtctggaaagggaaactgagcggtttagagaacttttattatatgggcggaagaaggacgctcttgagtctgcaatgaaaaatggtctgtggggacacgccctgttattagcatctaagatggactccagaactcacgccagggtaatgaccaggtttgcgaacagcctacctattaacgatcccttgcagaccgtgtatcagctcatgagcggtcgcatgcctgccgcatctacctgctgcggggacgaaaaatggggcgattggaggccacacctggccatggtgctgtctaatctgaataataatatggatgtcgagtctcgtaccatggcaactatgggcgatacgttggcctctcggggcttgctggatgctgcccatttctgctatttgatggcccaggcgggtttcggggtgtatacaaagaagaccaccaaactggtcctgatcggaagtaaccactccctgccgttcctgaaattcgcgacaaacgaagcgattcagcgcactgaagcctacgagtacgcacagtctctcggtgcagagacatgtcctctgcctagctttcaagtcttcaagtttatctatagttgcagactggcagagatgggacttgccactcaggctttccactattgcgaagcaatcgccaaatccatcctgactcagcctcatttgtactcacctgtgttgataagtcagctcgtgcaaatggcctcacagttaagactgttcgacccccaacttaaggagaaacctgaggaggaatctctggcagcccccacatggcttgtgcatttgcagcaggtggagcgtcaaatcaaagagggagctggggtctggcaccaggacggcgcactcccccagcagtgccctggtactcccagctcagagatggaacagctcgatagaccaggtctctctcagccgggcgcactcgggatcgcaaatcctttgcttgctgtgccagcaccctcacccgaacacagttccccatccgttagacttttgccaagcgcaccgcaaactctccctgacggacccctcgcaagtccagcgcgtgtacctatgttccctgtacccctgccacccggccctctagagccaggccccggctgtgtcacccccgggccagccctgggctttttagaaccatccgggcccggattgcctcctggcgtgcctcctctgcaagagaggcgtcacttgttacaggaggcccgatcccctgatcctggaatcgttccacaagaggctcccgtcgggaactctctttccgagctatccgaagaaaacttcgatggaaagtttgcgaaccttacccccagtagaacagtccctgactcagaagctccaccagggtgggatagagcagactccgggccaacccagcctccattgtcgctgtctcctgcccccgaaactaagagacccggacaggcagccaagaaagagacaaaagaaccaaaaaagggagaatcctggttttttcgttggctccccggcaagaagaaaacagaggcttacctgcccgacgataagaacaaatcaatagtgtgggatgagaagaagaaccagtgggtgaacctcaacgagccagaagaggagaaaaaagcccctcccccgccccccacgtctatgcctaaaacagtgcaggcagccccacctgctctgccaggtcccccgggagctccggtgaacatgtattctcggcgggctgccgggactcgtgctaggtatgttgacgtgctaaatccctccggcacccagcgcagcgaacccgcccttgctccggccgacttcgttgctccgctggcccccttacccatcccctcgaatttattcgtgcccacccctgacgccgaggaaccgcaactaccagatggaaccggtagagaggggcccgctgcagcacgcgggctggcgaacccagaacctgctccagagcccaaggttctctcctctgccgcatcactgccaggatctgagttaccctcttcaaggccagagggcagccaggggggcgaactaagcaggtgtagcagcatgagctctctgtctcgagaggtgagtcagcacttcaaccaggctccaggtgatctcccggctgccgggggccctccttctggggcaatgcccttctacaaccctgcccagctggctcaagcatgtgcaacaagtggatcctcacgacttggaaggatcgggcagagaaagcaccttgtactgaactag

SEQ ID NO: 133566 - DNA, 6480 bp, Artificial Sequence
  Description of Artificial Sequence: Synthetic coding sequence
atgccaggacttgatcggccactctctcgccagaacccacatgatggagtggtcacacccgctgcttccccctcgttgccacagccgggtctgcaaatgcctgggcagtggggccccgtgcaaggcggaccacagccctccggccagcataggtctccatgtcctgaaggccctgtgccctcaggtgtgccatgtgcaacatctgtaccccacttcccaaccccatctatactccaccagggaccaggacacgaacaacattctcccctggtcgcgccgccggcagctttgccatctgatggcagagacgaggtttcacacctgcaatcggggtctcatctcgccaacaatagcgaccctgagtctaccttcaggcaaaacccaagaattgtcaaccactgggcctcccccgagctccgccagaaccctggagtgaaaaatgagcacagacctgctagtgcgttggtgaatcctctggctcggggcgactccccagagaatagaactcaccatccactcggggccggagctgggtctgggtgtgctcccctggaagcagactccggcgctagtggtgcactggccatgttcttccagggtggcgaaaccgagaatgaagaaaacctgtccagcgagaaggccggactgtcgggtcaggccgattttgacgacttctgttcatcacccgggctgggcaggccaccggcccctacccacgtgggagctggctcactttgccaggcactcctacccggtccaagtaatgaagctgctggagatgtttggggggacaccgcatcaactggtgtgccagatgcttcaggaagtcagtacgaaaacgtcgagaatttggagttcgtgcaaaaccaggaagtattgcccagcgaacccttgaatctcgatccgagcagccccagtgatcagttcaggtatggaccgcttccaggacctgccgtcccaagacacggtgctgtgtgccataccggcgctcctgatgctaccctgcatacagtgcacccggactccgtttctagtagttatagctctaggagtcacggtcgactatctggatccgcccgaccacaagagttggtgggcacctttatccagcaagaagtgggtaaaccagaagacgaggcgtccggctccttctttaagcagatcgattcctcacctgtcggtggagaaacagatgagaccactgttagtcagaattatcgcggctcagtgagccagccaagcacaccctccccccctaaacctaccgggatctttcagacatctgctaatagttcttttgaacctgtgaaatcacacctggtcggggttaaaccctttgaggccgatcgcgccaacgtggtgggagaagtgcgagaaacctgcgtcaggcagaagcagtgtcgaccagccgcagcattaccagatgccagcccgggcaatttggagcagccaccagacaatatggaaacgctttgtgcaccacaagtctgtcctctccccttgaacagcaccaccgaagcagtgcatatgctgccgcatgcgggcgcgcctcccctggacaccgtataccccgcccctgagaagcggccctctgcacgcactcaaggcccggtcaagtgtgagtccccagccaccacactgtgggcacaatccgagttgccggacttcggggggaatgttctcttggcgcctgccgctccagccctttatgtatgcgccaagccacagcctcctgtcgtccagcctcccgaggaggctatgagcggacagcagagcaggaaccctagcagcgctgctcctgtacaatcacgagggggtatcggggcctccgagaatctggaaaatccccctaagatgggggaggaggaggcactccagagtcaggcctctagcggatacgcatcactgcttagttcaccccctacagagtcacttcagaacccccccgtactgattgcacagcctgaccactcctataacttggcccagccaattaacttctcagtttcattatcaaattctcacgagaagaaccaaagctggcgagaggccttggtgggtgatcgacccgccgtaagttcttgggccctgggcggggactcgggtgaaaacacgtccttgtcaggtataccgacctcatccgtgctaagcctatccctgcccagctctgtggcccagtccaattttccacagggatcaggcgccagtgagatggtgtcaaaccagccggcgaacctgctcgtgcaacccccttcccagccagtacccgaaaatctggtgccagaatcccagaaagatcggaaggccggaagcgccctgccaggtttcgcaaactcacccgcaggaagcacgtccgtggtgctggtaccccctgcccatgggacactggtaccagacggaaataaagccaatcatagttctcaccaggaggacacatatggggccctggactttaccctgagtaggactttggaaaaccccgtcaatgtttacaaccccagtcattctgattccttggcatctcagcagagcgtcgcatcccatccccgccagagcggccctggcgctcctaacctcgataggttctatcaacaagtgacaaaagacgcacaggggcagccgggcttggagcgggcccagcaggaattggtccctccacagcagcaggcatctcctccacagttaccaaaagctatgttctcggaacttagcaaccctgagtccctgcctgctcaagggcaggcccagaactcggctcagagcccagcctcactcgtgctagtggacgccggccagcaactgcccccgcgccctccccagtcatccagcgtgagtctagtcagtagcgggtccgggcaggccgctgtaccctcagaacagccctggcctcagccagtcccagcactcgcccccggccccccaccacaggacctggctgcctactactactataggccattgtatgacgcatatcagccacagtactcccttccctatccacctgaacccggtgctgccagcctatattaccaggacgtctatagtctttatgaaccgaggtaccgaccttacgatggcgctgcatcagcctacgcacagaactaccggtatcctgagccagaaaggcccagctcaagggcctctcacagttccgaacgcccaccaccccgccaaggctacccagaaggttactattcctcaaaatccggctggtctagtcaatctgactactatgcctcctactacagtagccagtacgactacggagacccaggccactgggaccgatatcactacagcgcccgagtgcgtgacccccgcacctacgacagacgttactggtgcgacgctgagtatgacgcttatcgcagggaacactcggcctttggcgaccgaccagagaagcgagataacaactggcgttacgacccgcggtttaccggttcatttgacgacgatccagatccgcatcgggatccttacggggaggaggtggataggcgctctgtccactcggagcactcagctagaagcctacattccgcgcatagcctggcctccaggcggtcatctctgtcttcccacagccaccagtcgcagatttatagaagccacaatgtggccgcagggtcgtacgaggctccccttccccccggctcgttccacggagactttgcctacggaacctatcgcagcaactttagtagtgggcctggcttcccagagtacggttaccctgccgatactgtgtggcccgccatggagcaggtatccagcagacccactagccctgaaaagtttagcgtgccgcatgtctgcgcccgttttggccctgggggtcagctgatcaaggtgatccccaacctcccatctgaggggcagccggccctggtggaggttcactcaatggaagcactgttacaacacactagcgagcaggaggaaatgcgagcgttccccggacccctagctaaagacgacacccacaaggtcgacgttatcaacttcgctcagaacaaagctatgaaatgtctgcagaacgagaacttaatcgacaaagagagcgcttctttgctgtggaactttattgtcctgctctgccggcaaaacgggacagtagtcggcaccgatatagccgagctattgcttcgagaccacagaaccgtctggctgcccgggaagtcacctaacgaggccaatctgatagatttcacgaacgaagccgtggaacaggtagaagaagaggaaagcggggaggcccagctgagtttcctcactggagggcccgctgctgccgcctcctctctcgagcgcgagaccgaacggttccgggaactattactatacgggaggaaaaaagatgccttggagagcgccatgaaaaacggcctctggggtcacgccctgctgctcgcctctaaaatggattctagaacgcatgcccgcgtgatgactcggttcgcaaatagcctcccaattaatgatcctctccagacagtataccagctaatgagcggaaggatgccagcggcctctacgtgttgcggcgacgaaaaatggggagactggcggccgcacctggctatggtgctttccaatctaaataataatatggacgtggagagccgaacaatggccactatgggggatacactggcctcgcgaggcctgttggatgctgcccacttttgctatctgatggcacaggcaggtttcggggtctataccaagaaaactaccaagctggtgctgatcggatccaatcacagtctgccctttttaaaatttgcgacgaacgaagccatccagaggacagaagcttacgagtacgcacagtctctgggagcggagacttgccctctgccctctttccaagtgtttaagttcatttactcctgccgcttggccgaaatggggttagcaactcaggcctttcactattgcgaggccatagccaaaagcatactgactcaaccacacctgtacagccccgtgctcatttctcagttagtgcaaatggcttcccagctcagattattcgacccccaactgaaagagaagccggaggaagaatctcttgccgcacctacttggttggtacacctgcaacaggttgaaagacagatcaaggaaggagccggggtctggcaccaagatggagccctgccacaacagtgcccgggcacgccctcttctgaaatggagcagctcgataggcctggactcagccagcccggcgcactgggcatagccaatccactactggccgttccagcaccgtcacctgagcacagcagcccttcggtgaggcttctgccttccgccccgcagactttgccggatgggcctctggcctctcctgcgcgcgtgcccatgttccccgtacccctgccgccaggcccactggagccagggccaggctgtgtgacacctggccccgccctgggattccttgagccctctggcccaggcctgccgcctggtgtaccacctctgcaggagaggcgccatttgttgcaggaggccaggtctccagatccagggatcgtgccacaggaagccccagtcggaaattcgctgtccgagctgtccgaggaaaattttgacggaaaatttgcgaacctcaccccttcgcgaacggtgccagattctgaggcacctccagggtgggatagagccgacagtggcccaacgcagccgcccctgtccctgagtcctgcgcccgaaactaaaaggcccggacaggcagccaaaaaggagacaaaagaacccaaaaagggagaaagttggttctttcggtggctgccagggaagaagaaaaccgaagcatatctgccagatgacaagaacaagagtatagtttgggacgagaaaaaaaaccagtgggtcaacctaaatgaacccgaagaagagaaaaaggccccacctcccccccccacatctatgcctaaaacggtgcaggctgccccccctgccctcccaggcccccctggtgctcccgttaatatgtattccaggcgtgcagccggaacgcgtgccaggtatgttgatgtcttgaacccttccggaacgcagcgctcagagccggccttggcacccgcagatttcgtcgccccactggcacccctacctatcccctccaacctttttgtgcccactcccgacgctgaggaaccacagctgccagatggcaccggccgagagggtccagccgctgcccgcgggctggctaatcccgagcccgcgccagaaccaaaggtgctgagttctgccgcctctctccccggaagcgagttgcctagctcccgccctgaagggagccaggggggagaagcccccggagacctacccgctgcggggggtccgccatccggcgccatgccattctataacccagcccaattggctcaggcatgtgcaacttccggatcgtcccgactcggaaggatcggacagagaaaacacttggtgcttaactag

SEQ ID NO: 133567 - DNA, 7074 bp, Artificial Sequence
  Description of Artificial Sequence: Synthetic coding sequence
atgcagccccctccccagaccgtccccagcggtatggctggaccaccccccgcaggcaatccccggtctgtgttttgggcctctagcccttacaggagacgcgctaacaacaacgccgccgttgctccaactacttgcccgcttcagccagtaacggatccgttcgccttctcccggcaggctcttcagtccacgccccttggaagcagttcgaagtcatctccacctgttctgcaggggccagcgcccgcaggattctctcaacaccctggtctgttagtgcctcacacccacgccagagattcaagccagggcccgtgtgagccacttcctggccctctaactcagcctagagcccacgccagtcctttcagcggcgctctcacaccaagcgcaccaccgggaccagaaatgaaccgctccgcggaggtgggcccatcctctgaacctgaggtgcagactctgccgtacttgccccactatattcccggtgtggatccggagacatcccacggaggccaccctcacgggaatatgcctggcctggacagacctctgagccgccagaacccacacgacggtgtggtgacccctgctgcatccccatcattacctcagccaggccttcagatgcctggtcagtggggacctgtgcaaggtggaccccagcccagcggccaacatcgaagcccctgcccagaggggcccgtgccttctggtgttccatgtgctacctctgtcccacatttcccaacgccatccatcttacaccaggggcccggccatgaacaacattcgccactggtcgccccaccggctgccttgcctagcgatggccgcgatgaggtgagccatctgcagtctggctcacacctggccaataacagcgatccagagagcacgttccgccagaacccccggattgtgaatcattgggctagccctgagctgcgccaaaatcccggagtgaaaaatgaacacagaccggcatccgctcttgtgaatcctctggcccgaggcgactccccagaaaatcgaacacatcatccgctgggtgctggcgctgggtccgggtgtgcccctcttgaggccgactccggcgcatccggtgccttagccatgtttttccaagggggagagaccgaaaacgaggaaaacttaagctccgaaaaggccggactgtccggccaagccgactttgatgatttctgttcgagccctgggttgggaagacctccggcgcctactcatgtgggggcaggcagcctgtgtcaggcccttcttcccggtccctcaaacgaggccgcaggggatgtgtggggggataccgctagtacaggggtcccagatgccagtggttcccagtatgagaatgtggaaaacctggaatttgtgcagaaccaggaggttttgccctcggaacccctaaatttagacccgagcagcccttctgatcagttcaggtatgggcctttacctggaccagccgtgccccgacacggggcagtttgtcacacaggggccccagacgccacgctccacaccgtgcaccccgacagtgtctcatcttcttatagcagccgtagtcacggacgactgagtgggagcgcacggccccaggagctcgtggggaccttcattcagcaagaggtcggcaaacccgaagacgaggcgtcaggttcattctttaaacagattgattcgtcaccggtgggcggggaaactgatgagacgaccgtctcacagaactatcgcggatcagtgtctcaaccgtctacgcccagccctccaaaaccaacaggaatctttcagacgagcgctaactccagcttcgagcctgtgaagtcccatttggtcggcgttaagccctttgaagccgatagagcaaatgttgtgggtgaagtgcgcgagacttgtgtacgccagaagcagtgtagacccgccgcagctttgccagacgcctcccctggaaatctcgagcagccccctgataatatggaaacattgtgcgcaccacaggtgtgccccctgcctcttaatagcactaccgaggccgtgcacatgctgccacacgccggagcccctcccctggacactgtttaccctgcccccgagaagcgaccatctgccagaacacagggcccagtcaagtgtgagagccctgctacaacgctgtgggcccagtccgagctgcctgacttcggcgggaacgttttgctggccccggcggcccctgcactctacgtgtgcgcgaaaccgcaacctccagtagtgcagccacctgaggaggccatgtctggacagcagtcacggaacccctccagtgccgctcccgtgcagagtcggggcggcatcggcgcctcagagaatctcgagaatccgcctaagatgggcgaagaggaggccctacagagccaggccagcagcgggtatgccagtcttctatccagtcctcccaccgagtctctgcaaaatccgccagtgctcatagcccagcccgaccacagttataacttagcacagccaatcaacttctccgtatctctgtctaattctcacgaaaagaaccagagttggcgtgaggcgttagtaggcgatcgtcctgctgtctccagttgggctctgggcggcgactctggagaaaatacctcgctgtcaggcattccaacatctagtgtcctcagtctttctctgccatctagcgtggctcagtcaaacttccctcaggggagtggcgctagtgaaatggtgtccaaccagcccgccaatcttctggtccagcccccttcccagcctgtgcccgagaatctcgttccggaaagtcaaaaagatcgcaaagcagggagtgcactgcccggttttgccaattcaccagctgggtcaacaagtgtggtgctggtgccccctgcccacggcaccttggtgcccgatggaaacaaggcaaatcattccagccatcaagaggatacatacggagccctggacttcacactgagccgtactttggagaacccagtgaacgtgtataacccatctcattccgatagcctcgcgagtcagcagtctgtcgcttcccaccctagacagtctgggcccggcgctcctaatctggatagattctaccagcaggtgacaaaggacgctcagggacaaccaggtctggagagggcacagcaagaactggttcctcctcagcagcaggcgtcaccacctcagctcccgaaggcgatgttcagcgagctttcaaatccagaaagccttccggcgcagggacaagctcaaaatagtgctcagtccccggcttctttagtgctggtagacgcaggtcagcagctgcctccccgacctccccagtcgtcctctgtaagtttagtgtcctctggaagcgggcaggccgctgtccctagcgaacagccctggccccaacccgtcccagccctggcccccgggcctccgccacaagacctggcggcctactactattaccggccgctgtatgatgcctatcagccacaatattctcttccgtaccctcccgagccaggggccgcctcactgtactatcaagatgtttacagcctgtacgaaccaaggtaccggccctacgacggcgcggcctccgcatacgcacagaactaccgttatcctgagccagaacgcccctcatctagagcatcacactcatcggaacgaccacctccccggcagggctatccggagggctattatagcagcaagagtgggtggtcttctcagagcgactactatgctagttattattcgtcacaatatgattatggtgaccctggccactgggatagatatcactacagcgcaagggtaagagatccccgaacgtatgaccggcgttactggtgcgatgcagaatacgacgcctacaggcgggaacactccgcttttggagaccgtccggagaagcgagacaataattggaggtatgatccacggttcaccggctcatttgacgacgatccagatcctcatcgtgacccctatggagaggaggttgacaggaggagcgttcacagcgagcacagtgcccgctctctgcattcagcccatagtttggctagtagaagaagtagcttgtcttcacactctcaccagtctcaaatctatagaagccataatgtggccgctggcagctatgaggcccctctgccacccggctctttccacggggactttgcctacgggacttatcgctctaacttctcatcgggccctggttttcctgaatatggatatcctgctgacacggtctggcccgcgatggagcaagtgagctccaggcccacctcccccgagaaattttccgtgccacacgtctgtgccagattcggtccaggtgggcagctgattaaggtaatcccgaatctgccctccgagggccaacctgcactggtcgaagtccatagtatggaggcgctgctccagcacaccagcgagcaggaggagatgcgggcttttcctggtcctctcgccaaggacgatacccacaaagtggacgtgattaatttcgctcagaacaaggctatgaaatgtctccagaacgaaaaccttatcgacaaagaatctgctagcctcctgtggaatttcatcgttctcttgtgtcgccagaacggtactgttgtcggcacagacatcgcggaactgctgctacgtgatcacaggactgtgtggttaccaggaaaatcaccaaatgaggcaaatctcatcgacttcactaacgaagctgtggagcaggttgaggaagaggaaagtggtgaagcccagttaagcttcctgacgggaggccccgcagccgcggccagttcactggagcgagagactgagcgattccgagagctgttgttatatggccggaaaaaggacgccttggaaagtgctatgaaaaatggcttgtgggggcatgcgctactgctggcatccaagatggatagtagaacccacgctcgtgtgatgacccggtttgctaatagtctgcctataaacgatccactacaaacagtctatcaactcatgtcaggaaggatgcctgctgcttctacgtgttgcggggatgaaaagtggggtgattggcgccctcacctggccatggtcttgtctaaccttaacaacaacatggacgtcgaaagccggacaatggcaaccatgggggataccctagcatcgcggggtttactggacgcagcccatttttgttatcttatggctcaagctgggtttggtgtgtacacgaagaagacgacaaaactcgttttaatcggaagtaaccacagtctccccttcttgaagttcgccacgaatgaggccatccaacgcacagaggcatacgagtacgctcagagcttgggagccgaaacctgccccctgccaagttttcaagtatttaaatttatctatagctgcaggctagccgaaatgggccttgcaacacaggcgtttcactactgtgaagcaattgctaagtccattctgacgcagccacacctctattcacctgtcctgatctctcagctcgtccagatggcgtcgcaactgcggcttttcgatccacagctgaaagagaagccagaggaggaaagcctcgcggcacctacatggcttgtgcacctgcagcaggtggaaagacagattaaagaaggggcaggcgtttggcaccaggacggagctctgcctcagcagtgccccgggactcccagcagcgagatggagcaactggatcgccctggcctgtcccagccaggcgccctggggatagccaaccctcttctggcggtacccgccccctcccccgagcactcttcaccctccgtcaggctgctgccctctgccccacagacacttcccgatgggccgctcgccagcccagcaagagtccccatgtttcctgtgcctctgcccccagggccactggagcccgggccaggttgtgttacacctgggccagctttaggctttcttgagcctagcggtcccggtctccccccgggtgtcccacccttacaggaaaggcgccatctcctccaggaagctcgctcccctgatcccgggattgtccctcaggaagctcctgtcggaaactctctgagtgaactctccgaggagaacttcgatggcaaatttgctaacctgactccgagccgcaccgtgccagatagcgaagcgcccccaggctgggatcgggctgactcaggtccaacccagccacccctttccctgagccctgcccctgaaaccaagcgacctggccaagccgccaaaaaggaaacaaaggaacccaagaagggcgagagttggtttttcagatggttgcccggcaagaagaaaactgaagcctacctccctgatgacaagaacaaatccatcgtgtgggatgaaaaaaagaatcagtgggtgaatctcaacgaacctgaagaagaaaaaaaagcacctcccccccctcccaccagcatgcccaagacagtgcaggctgccccaccagccctgcccggtcctccgggggccccagttaacatgtactcacggcgggccgcaggaaccagggcgaggtacgtggacgtgctgaacccatctggaacccagcggtccgaaccagctctcgcccctgcagattttgtcgccccactcgcacctctgcccatcccctcgaacctgtttgtccccacccccgacgctgaagaacctcagctcccagatggtaccggtagggaagggcccgctgctgctcgggggcttgccaacccggaacctgcccctgaacccaaggtgctgtcctcagccgcatccctgcccggctctgaactgccaagttctaggcccgaaggcagccagggtggagagttgagtcgttgcagcagtatgtcaagcctgtcaagggaggtttcacaacacttcaatcaggcccctggggacctcccagcagcaggaggcccacctagcggagcaatgccattctacaatcctgcccagcttgcacaagcttgtgcaacctctgggagcagtcgattgggcaggataggacaaaggaagcatctcgttttaaattag

SEQ ID NO: 133568 - DNA, 1158 bp, Artificial Sequence
  Description of Artificial Sequence: Synthetic coding sequence
atggatctgctgcccacttcgatactgctggcaagcctatggatctgcagccacctacacccccctggagtatcagtggatttgccgcctaccagcatactgctcgtttcgttgtggatttgcagccatttacacccacccggtgtttcagtagatcgaccccccccaccgtcctcatggtgcctctgtggaagtcctcctacttcaatcctgctcgttagtctttggatttgttccccacctcccagtagctggtgcctctgcggctccgccccgactagcattctgttagtgagtctttggatctggagattatggggcctgacagaaggagaatcgtggtttttccgctggctgccgggaaagaagaaaacagaggcctacctgcctgatgacaagaataaaagcattgtgtgggacgagaaaaaaaatcagtgggtaaacttgaacgagcccgaagaagagaaaaaagctccgccaccaccccctacaagcatgcccaaaacggtccaggcggctcctcctgctctgcccgggccaccaggagctcccgtaaacatgtatagccggcgcgccgccgggactcgagcgaggtatgttgacgtgctgaatccatcaggcacccagagatccgagcctgccctcgctcctgcagacttcgtcgcacccctcgcgccactacctatacccagtaatctgttcgtccccaccccggtgtcatcagttcggcctcaggggagaagtgggagaaacgatgggctattggccttgtcaagtccggacgcagaagaaccacagctgcccgacggcacggggagggaggggccagccgcagccagaggcctggctaatcctgagcctgctccagagccaaaagtgctgagcagtgcagcatctctgccaggaagcgagttaccatcctctaggcctgagggcagtcaagggggcgagttgagtaggtgttcctcgatgagctccctgtccagagaagtgagccagcactttaatcaggcacctggcgatttgccggcagcgggcgggccgcccagcggagctatgcctttttacaatcccgctcagctggcccaggcatgcgccacgtctgggagttcacgcctcggacgcatcggtcaacggaagcatctggtgctgaattag

SEQ ID NO: 133569 - DNA, 6405 bp, Artificial Sequence
  Description of Artificial Sequence: Synthetic coding sequence
atgccaggcctggacagacctctgtctcggcaaaatccacatgacggagttgttaccccagctgcctccccctcactcccgcagcccggcctgcaaatgccaggacagtggggcccagttcagggaggcccccagccttcaggccagcatagaagtccgtgtccagagggacccgtacccagcggggtgccctgcgcgacatccgtgcctcactttccaaccccatcaattctccaccaagggcccgggcatgagcagcactcgccacttgtagccccccctgccgcgctgccatcagacggtcgggacgaggtgagtcatcttcagtcagggagccacctagcaaacaactccgatcccgagtctaccttcaggcagaatcccaggatagtaaatcactgggcaagccccgagctgagacaaaaccccggcgtgaagaacgagcaccgaccagcctccgcgctcgttaacccattggcgaggggggatagtcctgaaaataggacacatcaccctttaggcgccggagctggctctgggtgcgcacccctcgaagcggactcaggggcatcaggtgctttggcgatgttcttccagggtggcgagaccgagaatgaagaaaaccttagttccgaaaaagccggattgagtggccaagccgatttcgacgatttttgctcctcgcctgggctaggccgcccccctgcccccacacatgtcggtgctggaagcctgtgtcaggccctcctcccgggaccaagcaacgaggcggcgggcgatgtatggggtgataccgcgtctactggcgtcccagatgcctccggcagtcagtacgagaatgtagagaacctggaattcgtacagaaccaagaggtgctcccgtctgagccgcttaatctcgatcccagctcgccatccgatcaattcaggtacggacctctgccagggccagcggtccctaggcacggtgcagtgtgtcataccggggctccggacgccactctgcacaccgttcaccccgactcagtttcctcttcctactctagcaggtcccatggacgcctcagcggctctgctagaccccaggagttagtaggcacttttattcaacaagaggtaggaaagccagaggatgaggcctccggcagtttctttaagcagattgattcctcacctgtggggggcgaaacagacgagactacagtaagccagaattaccgtggctccgtgtcacaaccttcaacacctagcccccccaagcctaccggcatcttccagacttctgcaaacagctccttcgagcccgttaagagtcatctagtgggcgtgaaaccgttcgaggcggacagggcaaatgttgtcggcgaggttcgggagacgtgtgtgcggcagaagcagtgtagacctgctgctgccctgcctgacgccagtcctgggaacctggagcagccaccagataacatggagacactgtgtgcccctcaggtgtgccctctacctttgaattcaaccacagaagccgtgcatatgctgccacacgccggggcccctccgctagacacagtgtacccagccccagagaagaggccgtctgccagaacacagggacccgtgaagtgtgagagcccggcaacaaccctgtgggcacagtccgagctgcccgactttgggggcaacgttcttctcgcccctgcagccccggccctgtatgtctgtgccaagcctcaacctccagtcgtgcaaccacctgaggaagcgatgtctggacaacaaagccgaaacccatccagtgcagctcctgtgcagtcccgcggcggaattggcgcctccgagaatctcgagaatccgcccaaaatgggtgaggaagaagcgctgcaatcgcaggctagctctggttatgcctcactcctatcatccccaccaacagagtctcttcagaacccacctgtcctgatcgcccaaccagaccactcttacaaccttgcccagccgatcaatttcagcgtcagcctgtctaatagccatgagaagaatcaatcgtggcgcgaagctttagtgggggatcgacccgctgtatcatcctgggcactcggaggggacagcggcgagaacaccagcctgagcgggattcctacctcctccgtgctatccctcagtctcccttcttcagtagcacagtcgaacttcccccaggggtctggagcgagcgagatggtgagcaaccagccagcaaacttgctagtccagccgccatcccagcccgtgccagaaaatctggtaccagaatcacaaaaagatcggaaggccgggtctgcactccccgggtttgccaactccccggcggggagcaccagcgtggtgctggtccccccggctcacggtactttggttcctgacggcaacaaagcgaaccactcatctcaccaggaggacacctacggggccctggacttcaccctgtctagaacactcgagaaccctgttaacgtttacaacccttctcactctgattcattagcatcccagcagtcagtcgcctctcacccgcgacagagtggccccggcgcccctaacttagaccggttctaccaacaggtgactaaggacgctcaaggacaacctggcctggagcgcgcacagcaagagctcgtgccccctcagcagcaggcctctccaccccagctccctaaagccatgttcagtgagctgagcaatccagaatcattgcccgcgcaaggtcaagctcagaactctgcacaatctccagccagtttggtgctggtggacgcgggacaacaactgccaccaagaccaccccaatcatcaagtgtgagtctcgtgagctcaggttccggtcaggctgccgtgccgtccgagcagccttggccccaacccgttccggctctcgccccgggcccccccccgcaggaccttgcagcgtactactattaccgaccactgtacgatgcttatcagcctcagtacagtttaccttaccctccagaacccggagcagccagtctgtactaccaagacgtgtacagtctttacgagccgcgctacagaccttacgacggggcagcctccgcttatgcacagaattaccggtatccggaacctgagaggccatcaagccgcgcgtctcattcctccgaacggcccccccctcggcaggggtaccccgagggctactactcgtcaaagtcaggatggtcatctcagagtgattattatgcaagctactacagcagccagtatgactatggggaccccggacattgggatagatatcactactctgcccgggtgcgcgatccgaggacatatgaccggcgatattggtgcgatgccgagtacgatgcataccgacgagagcattcagcgttcggcgaccgtccagagaaacgagacaacaattggcgctacgacccacgctttactgggtccttcgatgatgatcccgacccacacagagacccctatggcgaagaggtggatcgtagaagtgttcacagcgaacattccgcccgaagtttgcattccgctcattctttagccagccgaagatcatccctttcatcacatagccaccagtctcagatttacaggtcccacaatgtcgctgcgggtagttacgaggctcctctgcccccgggatcttttcacggtgactttgcctacggcacctaccggtctaatttctcttccggaccaggatttcctgagtacggctacccagccgatacggtgtggcctgccatggagcaagtctcctctcgccccacatctcctgaaaagttttctgtgcctcacgtatgtgcccggttcgggcccggaggacagctgattaaggtgattccaaacctgcccagtgagggacagccggcacttgtggaagttcattccatggaagcgttgctccagcataccagtgagcaagaagagatgcgggcatttcccgggccgctagctaaggatgacacacataaggtggacgtcatcaacttcgcgcagaataaggccatgaagtgcctccagaacgaaaatcttatagacaaggagtccgcctcactgctgtggaatttcattgtccttctgtgccgccagaatggcactgtggtgggcactgatattgctgaactgctcctgagagatcaccgtacggtgtggctgccgggaaaatcccctaacgaggctaacttgattgacttcactaacgaagcagtagagcaggtggaagaggaggaatctggagaagcccagctctcattcctgactggcggcccagccgcagcggcatcttcattggaacgcgagaccgaacgtttcagggaactcctcctctatggccgaaagaaggatgccctggaatcagccatgaagaacggcctgtggggccatgcgttactgcttgcgtcaaagatggattctagaacccacgcccgggtcatgacccgctttgctaactctcttcctattaatgaccccctccagacagtctaccagttgatgagcgggaggatgcccgcggccagtacatgctgtggagacgagaagtggggggattggcgaccccacctggcgatggtgctatcaaacctgaataacaatatggacgtagaatcacggaccatggctacaatgggcgacacactcgccagtcggggcctactggacgccgcgcatttctgctatctgatggcacaagcaggcttcggcgtttacacaaagaaaacaactaagcttgtgctgatcggaagcaaccattctctccctttcctcaagtttgccaccaatgaagcaattcaaagaaccgaagcctatgagtatgcacaatctcttggggcagagacttgtcccctgccaagtttccaggtattcaagtttatttactcatgcagactcgcagaaatgggcctggccacccaagcatttcattactgtgaggcgatcgccaagtcgattctgacgcagcctcacctgtactccccagtcctgatctctcagttagttcagatggcttctcagctcagactcttcgacccgcaacttaaggagaaacccgaggaggagtcactcgccgctcctacctggctcgtgcatctgcaacaggtggagaggcaaatcaaggaaggcgccggcgtgtggcatcaggatggtgctcttcctcaacagtgtccaggcactccgtcatccgaaatggaacagttagaccgaccaggcttaagccagcctggagccctcggaatcgctaatccacttctcgctgtgcctgctccctcccctgagcattcatcaccttcggtgcgactccttccgtctgcccctcagaccctacccgacggcccattagcgtcgccagccagggttcccatgtttcctgtgcccctcccacccggccctctcgaacctgggccagggtgcgttacacccggcccagcccttggctttctagagcctagtgggccaggtttgcctcccggtgtacccccactgcaagagcgtcggcatttactgcaagaagctaggagcccagatcctggtatcgtgcctcaggaagcccctgtcggaaactctctctcagagctctctgaggaaaactttgacggaaagtttgctaacctgaccccttcaagaaccgttccggatagtgaagctccccctggatgggatagagctgacagcggcccaacccaaccccctctttccttgtctccagcccctgagactaaaagacctgggcaggcggccaaaaaggaaaccaaagagccgaaaaagggtgaaagctggttctttcggtggctgcctgggaaaaaaaagaccgaggcatatctccccgacgacaagaacaaatcaatcgtctgggatgagaagaaaaatcaatgggttaacctgaacgaaccagaggaagaaaagaaagcccctccccccccaccaacttccatgccaaaaacagtgcaggcagccccgcccgctctgcctgggccacccggagccccagtcaatatgtatagccgcagagccgcaggcacacgagccagatacgtggacgttctcaaccccagcggaactcaacggagcgagcctgcccttgctcccgccgacttcgtggcccccctcgcacctttgcccatcccttcaaatctgtttgtgccaactcccgatgcagaggagcctcaactgcccgatggcaccggtagagaagggccagcggcagcccgggggctggcaaatcccgagcccgcaccagaacctaaagctccaggagatttgccagccgctggaggtccacctagcggcgcaatgccattctacaaccccgcacaattggctcaggcttgcgctacgagcggttccagccggctaggtagaatcggtcagcgcaagcatctcgtgctgaattag

SEQ ID NO: 133570 - DNA, 423 bp, Artificial Sequence
  Description of Artificial Sequence: Synthetic coding sequence
atggatttgttaccgacatctatccttctcgcctcactgtggatctgttctcaccttcaccctcccggagtctcagttgacctgccaccgacctccattctactggtctccctatggatttgctcccacctacaccccccaggggtgagcgtcgataggccgcctccgcctagtagttggtgcctttgcgggtctccccctacatccatcctcttggtcagcctgtggatttgctcacccccccccagttcctggtgcctgtgtggaagtgcaccgacaagcatccttctggttagtttgtggatctggcggctttggggcctcacagaagtggggcacgttgaattcgtcttcctgccatggctcatcagctggaacatcatgtttagcaaacttttcagctgtttcttgtacctgggttag

SEQ ID NO: 133571 - DNA, 2205 bp, Artificial Sequence
  Description of Artificial Sequence: Synthetic coding sequence
atgttctcagagctgtctaatccagaatcgttgcccgcgcagggccaggcacagaactcagcccagagtcccgcttctctcgtgcttgtagatgccggccagcagctccctcccaggcccccacagagcagctctgtctccctagtgagttcaggcagtggccaggcagctgtgccctccgagcagccctggccacagccagtgcccgctctggctccagggccaccgccacaggacctcgccgcctattattattatcgacctctgtatgatgcctaccagccccagtactcgctgccttatccacctgagcccggggcagcgtctttgtattatcaggacgtgtattccttgtatgagccaagatatagaccttacgacggcgccgcatccgcttacgctcagaactacaggtatcctgagcccgagcgcccctcatccagggcatcgcactcttccgaacggccccctcccagacaagggtatcccgaaggctactacagctcaaaatctgggtggagtagccagtctgactattatgcgtcctattactcctcacagtatgactatggagatcccggtcactgggaccggtaccattacagtgcccgtgttcgggacccgcggacctacgatagacgctattggtgtgacgccgaatatgacgcttatcgcagagagcatagtgcattcggcgatcggcctgaaaaaagagataacaattggaggtatgatcctcgctttaccggcagcttcgacgatgacccagacccccacagggatccatacggtgaggaggtggacaggcggagtgttcactccgagcacagcgccagatcacttcactccgcccatagtcttgccagtagacgaagctctctatcctctcactctcatcaatcgcagatctatagaagccataacgtggcagcgggatcctacgaggcgccattgccccccggtagtttccatggcgactttgcctatggcacatatagaagcaatttctcttccggcccaggattcccagagtacggttatcgcccggctttaggtttcctggagccatcaggacccggcctgcccccgggggtgcccccgttgcaggaaaggcgacacctgttgcaagaggccagaagccctgatccaggcattgttccacaggaagcgccagtcggaaattccctgtcggagctgtctgaggaaaatttcgatgggaaattcgcaaacctgacccccagtcggaccgtgccggattcagaggctcctcccggctgggaccgtgctgactcaggacccacacaaccccctctgtcattaagcccagctcctgagaccaagaggccaggacaagcagccaagaaagagaccaaggaacctaagaagggcgaatcctggttcttccgctggttgcccggcaaaaaaaagactgaggcttatctgcccgatgataagaataagtctattgtgtgggacgaaaagaaaaaccaatgggtgaatcttaacgaaccagaggaggaaaagaaggcccctccccccccccctacatcaatgcctaagacagtgcaggcggcacccccagcacttcccggacccccaggggcgcctgttaacatgtactctcgacgagcagccggtacccgcgcccggtatgttgatgtgctgaaccctagcggaacacagagatccgagcctgcacttgccccagccgatttcgtcgcccccctggcccctctgcccattccatccaatctgttcgtcccaaccccggtgcgcccacagggtcgtagcggccgaaatgacgggctacttgctttaagcagcccagacgccgaagagccccagctgccagacgggactggtcgggaaggtcctgcagccgcgcgaggtctggcaaatccagaacccgcaccagagccaaaagtgctgtcaagcgcagccagtctgccgggctcagaactccctagtagtcgacccgagggctctcagggtggtgagctcagcagatgttcctccatgtcatctctcagtcgcgaggtttcgcaacatttcaatcaggcccccggcgacttacccgccgcgggcggccccccaagtggggcaatgcctttctataaccccgctcaactggcgcaggcctgtgctacatctggcagttcccgactgggtcggatcgggcagcgcaagcacctcgtgctgaattag

SEQ ID NO: 133572 - DNA, 5184 bp, Artificial Sequence
  Description of Artificial Sequence: Synthetic coding sequence
atgttttttcaaggcggagagacagaaaacgaggagaacctcagctccgagaaagccggcctttctggtcaagccgacttcgatgacttctgttctagtcctggcctcggaaggccacccgccccaacccacgtgggagccggatctctctgtcaggccctgttacccggtccaagtaacgaggcagccggggacgtttggggagacactgcatcaaccggggtacccgacgcttcaggctctcagtacgagaatgtggagaacctcgagtttgtgcagaatcaggaggtgctgccttccgaacctttaaacctcgacccctcttccccaagcgaccagttcagatacggaccacttcccggccccgccgtgcctcggcatggtgcagtctgccacaccggggcccctgacgccacattgcatactgtgcatccagattctgtgagcagttcctacagctccaggagtcatgggcgccttagtgggagcgccaggccccaagagcttgttgggacattcatccagcaggaggtgggtaagcccgaagatgaagcgagcggctcatttttcaaacagatagatagtagccccgtcgggggcgagaccgatgagactaccgtcagccagaactatcgaggaagtgtttcccagccatcaaccccaagcccaccaaaacctacaggaatcttccagacatctgcgaacagctctttcgagccagtgaagtcacatctggtaggtgtgaagccctttgaagcggatcgtgccaacgtggtcggcgaagtgagagagacttgcgtccgacaaaaacagtgccggccagccgctgctcttccggatgccagccctggtaatctcgagcagccgcctgacaacatggagaccctttgcgctccccaggtttgtccactgcccctgaactcaaccaccgaagccgtccacatgctgcctcacgcgggggctcctcctctggatactgtctaccccgctccggagaagaggccgagcgctagaactcagggccccgttaagtgcgagagccctgcgacgacgctctgggcacagagcgagctcccagattttggcggaaacgttctgctggcacccgccgctcccgctctctatgtgtgtgctaaaccccaacctcctgtagtgcaaccccccgaagaagctatgagcggccagcaaagtcgcaatccctcatctgccgcccccgtacagtcgaggggcggcatcggggcttctgagaacttggagaacccccccaagatgggcgaagaggaagcgctccagtcccaagtgacaaaggacgcacaggggcagcctgggcttgaaagagcccaacaagagttggtgcccccccaacagcaggcttccccccctcaattgcctaaagctatgttcagtgagttgagcaatcctgagagcctgccagcacaggggcaggcacagaactcagcacagtccccagcgtcgctggtgttagtcgacgcggggcagcagctccccccacggcctccccagtcaagcagtgtctctttagtgtcttccggctccggacaggccgcggtgcccagcgagcagccatggccgcagcccgttcccgccctggcccccggcccccctccccaagatctggccgcctattattattatagacctctgtatgacgcctaccagccccagtacagcctgccctaccctccagaaccaggcgccgcctctttatattaccaggacgtttattcgctatacgaacctaggtatcgcccttatgacggggccgcatcagcatacgcacaaaactatcgctatccggaaccggaacgaccttcctctcgagcgtcacattcttccgaaagacctccaccgcgacaggggtacccagaaggatactactcgtccaaatcagggtggagttctcagagcgactactacgcctcttactattctagccaatacgattacggagaccctggacattgggataggtaccactactccgcacgagttcgggatcctaggacttatgatcggaggtactggtgcgacgcagagtatgatgcctaccggcgggaacactccgctttcggagaccgccccgagaaacgagataataactggagatacgaccctcggttcacgggtagctttgacgacgatcccgatcctcaccgtgatccctatggagaggaggtcgaccgcaggagcgtccactccgagcattctgcaaggtccttacacagcgcgcacagtctcgcgagtcgtaggagctctctaagttcacatagtcatcagtcccaaatctatcgctcacataacgtcgccgctggctcctacgaggcccccttacctccaggaagttttcacggggactttgcatatggtacctataggtccaatttctcctcaggcccaggctttccggagtacggctatcctgccgatactgtttggcccgctatggagcaggtgtcctctcgcccaaccagcccagagaaattctctgtaccacacgtctgtgcccggttcggacctggcgggcagctgataaaagtgatccctaacctaccctccgagggacagcctgcactcgttgaggtgcatagcatggaagccttgttgcagcacacatccgagcaagaggagatgcgagctttcccaggccccttggccaaggatgacacgcataaggttgacgtgataaatttcgcccagaacaaagcaatgaagtgccttcagaatgaaaatcttatcgataaggaatccgcttcactgctctggaacttcatcgtgctcctgtgcaggcagaatggcactgtggttgggacagacattgcagagctcctccttcgggaccaccgaaccgtgtggctgcccggtaagtcccccaacgaagcaaaccttattgacttcacaaacgaggcggttgagcaggtggaggaggaggagtcgggggaggcacagctctcattcttgaccggaggcccagcagccgccgccagttccctggaacgggaaaccgaacgcttccgcgagctgcttctatacgggcgtaagaaggacgcccttgagtctgcaatgaagaatggcctctggggccacgcactgctcctcgcttcaaagatggacagcaggacacacgctcgcgtgatgaccagattcgccaattccctgcccataaacgatccactgcaaacggtgtatcagctaatgtctggcaggatgccagctgctagcacctgttgtggcgatgaaaagtggggggattggcggccacacctcgccatggtgctttcaaatctaaataataacatggacgtggagtcccgcactatggcaactatgggagatacgttagcctcaaggggcctcctagatgcagcccacttctgctacctcatggcccaggcagggttcggcgtgtataccaagaaaaccactaaactggtccttatcggaagcaatcattccctgcccttcctcaagtttgccacaaacgaggcaattcagaggaccgaggcatatgagtacgcccagtctctgggagctgagacctgccctctgccgagcttccaagttttcaagttcatttactcgtgtagactcgctgagatgggtcttgccacacaggctttccactactgtgaagcaatagctaaatctatactcactcagccacacttgtacagcccagttctgattagtcagttggtgcagatggcaagtcaactgcgcttgtttgacccacaactgaaggagaagccagaggaagagtcactggccgccccgacctggctggttcacttgcagcaggttgagaggcaaattaaggagggcgccggcgtttggcatcaagatggcgccctgccacaacagtgtcctggtactccttcgtccgaaatggaacagctggatagacccggcctaagccagcccggggcccttggcatagcaaatcccctcctggccgttccggcccctagccccgagcattcttctccatctgtaagactcctgccatctgctccgcaaaccttgcccgatggccctctcgcatccccagctcgcgttccgatgtttccagttcccctaccacccgggcccctcgagccaggaccaggttgtgtgacccctggccccgctcttggctttttagagccatccggacctgggcttcctcccggcgtgccaccccttcaggaaagacgacatctgttgcaggaggcacgatctcccgatcccggaattgtgccccaagaggccccggtaggaaattctctcagcgaactctctgaggaaaactttgatggaaagtttgcgaatttaacaccatctaggaccgtacccgattcggaggcccctcctggatgggaccgtgccgacagtggacccacgcagcccccgctgagcctgagcccagcgcccgaaacaaagaggcctggccaggctgccaagaaggaaacaaaggagccaaaaaagggcgaatcctggtttttccgatggcttccaggtaagaagaagacagaggcttacctgcctgacgataaaaataagtcaatcgtctgggacgaaaagaagaatcagtgggtcaatcttaacgagccagaggaggagaaaaaagctccccccccaccgcccactagtatgccaaaaacagttcaggccgcccctccagccctgcccggacctccgggggctcccgtgaatatgtacagccgccgtgccgccggaacgcgcgccagatacgtcgacgtcctgaacccatctggcactcagagaagcgagcctgccctcgcaccggccgattttgtggcccctctcgctcctctccccatcccatcaaacctgttcgtccctaccccagacgccgaggaaccccagctcccagatggtacaggacgggagggccccgctgcagcaaggggactcgccaaccctgaaccggcccccgaaccaaaagttctgagtagtgccgccagtttgcctggctcagagctgccttcctccagaccggaaggctcccaaggcggagaggctcccggcgatttacctgctgccggaggtccgccctcgggcgccatgcctttttataaccctgctcagctcgcccaggcctgtgccacttccgggtccagtcggctaggaagaataggtcagagaaagcacctcgtgctgaattag

SEQ ID NO: 133573 - DNA, 6465 bp, Artificial Sequence
  Description of Artificial Sequence: Synthetic coding sequence
atgcccgggttggaccgacccctttcaaggcaaaatccacatgatggggttgtaacgccagcagcaagcccttccctacctcagcccggactgcaaatgcccggacaatgggggcctgtgcagggaggtccccaaccgtctggccaacatcggagtccgtgccccgaaggaccagtgcctagtggtgtcccatgtgccacttcagtgccgcattttcctaccccctcgatattacatcagggaccgggccacgagcagcatagccctctcgttgccccacccgcagctctgccaagtgatgggcgggatgaagtgagccacctgcaaagcggtagccaccttgcaaacaacagcgatcccgaatctacatttaggcaaaaccctcggatcgtcaaccactgggctagtccagagttgaggcagaatccaggcgtgaagaacgagcacagacctgcttccgctttagtgaaccctctggcgcgaggggattccccggagaatagaacccatcatcccctcggcgccggagctggctccggctgtgctcctctggaggcagactcaggcgcctccggtgcattggcgatgtttttccagggcggcgaaaccgagaatgaagagaatctgagtagcgagaaggcgggcttaagcggccaggcggactttgatgacttttgttcttctcctgggctgggacgcccaccagcgccgacacacgtgggcgccgggtcactgtgtcaagcactgctaccagggccctcaaacgaggcagccggcgatgtttggggtgacacagcttcgacaggagtgccagatgctagcggatcccagtacgaaaatgtggaaaacctagagttcgttcagaatcaggaagtcctgccttctgagcctctgaacctggaccctagttctccaagcgaccagtttcggtacggccctctgccaggccccgcagtgccccgacatggtgcggtgtgccatacaggggcgccagatgccacactgcacactgtgcacccggattctgtgtcaagcagttatagttcccggtctcacggcaggttgtcaggtagtgcccgccctcaggagctggttggcaccttcattcaacaggaagttggaaagccagaggatgaagcgtcaggatctttctttaaacagatagatagctcccctgttgggggagagactgatgagacaacggtgagccaaaattaccgtgggtccgtatcacagccaagcactcccagcccacctaagccaacaggaatattccagacgtccgcaaacagttctttcgaaccagtcaagtcccacttagtgggcgtgaaaccttttgaggccgatcgagcgaatgtcgtcggtgaggtgcgcgaaacctgcgtccgacagaaacagtgccggccagccgccgccctccccgatgccagtccaggcaatctggaacagcctcccgataacatggagacgctttgcgctccgcaggtctgtccgctgccactaaatagcactacagaggccgtgcacatgttgcctcatgcaggagccccccccctagatacagtgtaccctgctccggagaaacgcccttctgctaggacacagggtcctgtaaaatgtgagtctccagctactactttgtgggcacagagtgagttaccagactttggcgggaacgtcctgctggcccccgccgcccctgctctctacgtgtgcgcaaaacctcagccacctgtggtgcagcctccagaggaggcgatgtctggccagcagagtcgaaatcccagcagtgccgcccccgtccagagcagggggggcatcggagcatccgaaaatctggagaacccccccaagatgggagaggaggaggccttgcagtcccaggcttcaagcggatatgcctctctcttatctagccccccgacggagtcccttcagaatccgcctgtcctgatcgcccaaccagatcacagctataacctcgcccagcccatcaacttttccgtctctctgagtaactctcatgaaaagaatcaaagctggcgggaagccttggtgggagacaggcccgctgtgagctcctgggccctaggcggcgattccggggaaaacacctctctgagcggaattcctacatcatctgtgctcagcttgtccctgccctctagtgtggcccagtcaaatttcccccagggatccggagcttccgaaatggtctcgaaccaaccagcaaacctgttggtccagccccccagtcagccagttccagagaacttagtacccgaatctcaaaaggatcggaaggcgggcagcgctctgccgggtttcgctaactcccctgccggcagtacaagcgtggttctggtcccacccgctcacggcaccctcgttcctgacggcaacaaggcaaaccacagttctcaccaggaggatacatacggagctctcgacttcaccctcagtcgaaccctggaaaatcctgtcaacgtgtacaatccatcccatagcgactccctggcgtcacagcagtctgtggcgagccacccccgccagtctgggcccggggcacccaacttggaccggttctaccagcaggtcactaaggacgctcagggccaaccaggcctcgagcgcgctcagcaggaactggtgccccctcaacaacaagcctcccctcctcagctgccaaaagcaatgttctccgaactgagtaatcctgagtccttgcctgcccaaggccaagcccagaacagtgcccagtccccagcctctctggttttggtagatgccggtcaacagcttccgccccggccacctcagtcgtcctccgtgtctcttgtttcctcaggttccggacaggcggccgtcccctctgaacagccctggccgcaaccggtcccggctctggctcccgggccacctccccaagacttggcggcctattattactataggcccctgtatgacgcgtaccagccacaatacagcctcccttatcctcctgagcccggcgccgcctccctgtactatcaggatgtgtactcactgtatgagcctagataccgcccttatgatggggccgccagtgcttatgcccagaattacagataccccgaaccagaacgccctagctcccgcgccagccactcctctgagagacctcccccgaggcagggctaccctgagggttactactcaagcaagagtggctggagttcacagtcagattattatgcatcttattactctagtcagtacgactacggcgatcctgggcactgggatcgctaccactactctgccagggtgagggatcccagaacctacgataggaggtactggtgcgatgctgaatacgatgcctaccggcgggagcattctgcgttcggcgacaggccagaaaagcgtgataacaactggaggtatgaccctcgcttcaccggatccttcgacgatgaccccgaccctcacagggatccttatggcgaagaggtggataggagaagcgtgcacagtgagcattcagccagaagtcttcactccgcccactcccttgcatctagacggtccagcttgtcgagccactctcatcagagtcagatctaccgtagtcacaatgtggcagccggaagttacgaggctcctcttccgcccggaagcttccatggtgatttcgcttacggcacttatagatcaaacttctcatccgggcccggtttccccgagtacgggtatcccgccgacactgtgtggcctgccatggagcaggtttcatcacgccccacatcccccgagaaattttcagtcccacatgtgtgtgcccgttttggcccagggggacagctaatcaaggtaatccccaacctgccctccgaagggcagcctgccctcgtcgaggtccacagcatggaggccttgctgcagcacacatcagaacaggaagagatgcgagcattccctggtccccttgctaaagatgacacacacaaagttgatgtcattaatttcgcccagaacaaggctatgaagtgcctccagaatgaaaatctgatcgacaaggaaagcgccagtctcctctggaactttattgtcttactgtgcaggcaaaacggcaccgtcgtggggaccgacatcgccgagttacttctccgcgaccatcgtacagtttggctccctggcaagagccccaatgaagccaacttgattgattttaccaacgaggcagtggaacaggttgaagaggaggagtcaggggaagcccaattgtcattcctgacgggaggccctgccgccgcggccagttccctggaacgagagaccgaacgattccgggagcttctattgtacggcagaaaaaaagacgccctggagagtgcaatgaaaaatggactttggggccatgctctgctgctcgcatccaagatggacagtcggacccacgcccgggtcatgaccagatttgccaacagcctcccaataaatgacccgctgcaaacagtataccagttgatgagcggtagaatgccggccgcctcaacttgctgtggagatgagaaatggggcgactggcggcctcatctggccatggtgctgagtaatctgaacaacaatatggacgtcgaatccaggacaatggctacaatgggggacacactggcctcacggggactgcttgacgccgcccatttttgctaccttatggcacaggccggttttggagtgtacaccaaaaagaccactaagctggtgttgataggtagcaatcactcgctgcccttcctgaaatttgccaccaacgaggccattcagcggacagaggcatacgagtacgcgcaatcattgggcgccgagacatgccctcttcctagtttccaggtgttcaagttcatctatagttgtagactggccgagatggggctggcaactcaggcttttcactattgcgaggctatagcaaaatctatccttacacagccccacctgtatagccccgtgctcattagccagctggtccagatggcaagccagttaagactgtttgatccacagctaaaggagaagccagaagaagagtctttagccgcaccgacctggttggtgcacctgcagcaggtagaacgacagattaaagagggcgctggcgtctggcaccaggacggcgcactgccccagcaatgccctggcacccccagctcagagatggagcagctggaccgtcccgggctgtctcagcccggggcactgggcatcgcaaatcccctgctcgccgttcctgcgcctagtccagaacactccagcccatccgtcagactcttgccctctgcgcctcagacattgccagatggcccgctggcctcccccgcaagggtgccaatgtttcccgtgccactgccacctggccctctggaaccaggtcccggctgcgtgacccctggcccagccctcggcttcttggaaccctccgggcccggcctgccccccggggtaccacctctccaagaacgacggcatctcctacaggaagcacgcagccccgacccaggtatcgttccccaggaggcaccagtggggaactctctctccgagttatccgaagaaaatttcgatggaaaatttgctaacttgacgccaagccgcacagtgcccgactctgaggccccacccggctgggaccgggcagatagcgggccaacccagccccccctttccctgtctccagcgcccgaaacaaagagacctgggcaggcagctaagaaggaaactaaagaaccgaagaagggagaatcctggttcttccgctggctacctggtaaaaagaagacggaagcttatttacctgacgataaaaacaagtctattgtctgggatgagaaaaagaaccagtgggtgaatctgaatgagccagaggaagagaagaaggctcctcccccaccgccaaccagtatgccgaaaaccgtccaggccgcccctccagccctcccgggccctccaggtgcacctgtgaatatgtattctaggcgcgctgccggcacccgcgctcgttatgttgacgttctcaacccaagtggcacacagcgaagcgagcctgccctggctccagctgattttgtggctccactggcaccactacccatcccaagcaatctgttcgttccaacccccgacgccgaggagccacaactgccagacggtaccgggcgagagggcccggccgccgctagagggttggcaaaccccgaacccgccccagaaccgaagcttagccggtgcagctccatgagcagcctcagccgtgaagtgtctcaacactttaaccaagcgcccggtgatttgcctgccgctggaggacctcccagcggagcaatgccattctataacccagctcaactggcccaggcctgcgcgacaagcggcagtagtcgactcgggcgtattgggcaacggaaacatctggtactgaactag

SEQ ID NO: 133574 - DNA, 1521 bp, Artificial Sequence
  Description of Artificial Sequence: Synthetic coding sequence
tgaagtgctttcggggatcggcctgagaagcgtgacaacaactggcgctatgatccccgtttcaccgggtcctttgatgacgaccctgacccacatagggacccctacggggaagaggtagatcgtaggagtgtgcacagcgagcacagtgctaggtcgctgcactcggctcactctctcgcatctcgcaggtcttcgttgagtagccactcacaccagtcacaaatttacagaagccacaatgtggcagctgggtcgtatgaagcacctctcccgcctggttcctttcatggggacttcgcatacgggacataccgcagcaatttcagctcagggcctggcttccccgagtacggctaccccgcccttggtttcttggaaccttctgggccagggctaccaccgggggttccaccactccaggagaggcgacatctcctccaggaagctcggtcccccgaccctggtatcgtgccgcaggaagcacctgtgggaaactcactgtccgaattgtctgaggaaaactttgatggaaagttcgctaatcttacacccagcagaactgtccctgactctgaagctccccctggttgggacagagctgatagcggcccaacacagccaccgctcagtctgagcccagcaccggaaacaaagaggcctggacaggccgccaagaaggagacaaaggaacccaaaaagggagagtcttggttttttagatggctgccagggaaaaagaaaaccgaagcttatctgcctgatgataagaacaagtcgatcgtgtgggacgaaaagaaaaatcagtgggtgaatctgaatgaacccgaggaggaaaagaaggcgccacccccgccacctacatctatgcctaaaactgtccaggccgccccgccagctctcccaggccccccaggggcccccgtgaatatgtatagccgcagggccgccggaaccagggcgcggtatgtggatgtgctgaatccttctggcactcaacgctccgagccagcactggctccagctgatttcgtcgcgccgttggcaccactgcctattcccagtaaccttttcgtgcctactccagtgcggccgcagggcagatccggtcgcaatgatgggctgcttgcgctctcaagccctgatgctgaagagccgcagctacccgatgggaccggacgtgagggaccggccgccgcgcgaggcctcgctaaccctgaacctgctcccgagcccaaagtgctctcttcagccgctagcctgcctggaagtgaattgccgtcttctcggccagagggctcccagggaggggagctatcccgctgtagtagcatgtcgagcctatctcgagaggtttcccaacattttaaccaggcccctggagacctccccgccgctggtggacctccatctggggcgatgcccttttacaaccctgcccagctcgcccaggcttgcgccacaagcggttcatcgcgactcggacggatcggacagcgcaagcacctggttttgaactag

SEQ ID NO: 133575 - DNA, 3180 bp, Artificial Sequence
  Description of Artificial Sequence: Synthetic coding sequence
gcgcgggtgcgcgatcctcgaacttacgacaggaggtattggtgcgatgctgagtatgatgcttatcgccgggagcacagcgcctttggggataggccggaaaagagagacaacaactggagatacgaccctagattcaccggaagctttgatgatgacccagatcctcatagggacccttatggtgaagaagtggaccggcgttctgttcacagtgaacactctgcccgaagtctgcactccgcccatagcctggcgagtaggcggagcagcctgtcttcccactcccatcaatcccaaatttaccggtctcacaacgtggcagccggctcttacgaggcaccactgcctccgggatcatttcatggggacttcgcttatgggacgtatcgttctaatttcagctccggacccggatttccagagtatggctacccagccgacacggtgtggcctgccatggaacaggtgtcttctcggcccacgagccctgagaaattcagcgtcccacatgtgtgtgctaggtttgggccaggtgggcagctcatcaaagtgatcccaaaccttccctccgagggtcagcccgccctggtggaagttcactctatggaggctctgttacagcatactagcgaacaggaggagatgcgcgcatttcccggacctctggctaaggatgacactcacaaggttgacgtcataaactttgctcaaaataaagccatgaagtgcctgcagaatgaaaatctaatcgacaaagaatccgcatctctcctatggaatttcatcgttttactctgtcgccaaaacggtaccgttgtcggcaccgatatcgctgagctcttactgagggaccaccgcacagtttggctccccggaaagtctcctaatgaggctaacctgatcgatttcacgaatgaggctgtggagcaggtggaagaggaagaaagcggagaagcccagctgagcttcctgacgggcggccctgcagcagcagcgtcttctctggaacgcgaaacagaacgtttccgggaactcttgctctacggaagaaagaaggatgccctggagtctgctatgaaaaacggcctctggggtcatgcccttctcctcgcttccaagatggacagcaggactcacgcccgagttatgacgcgatttgcgaactctctgccaatcaatgaccctcttcagactgtgtatcaactgatgtctggccggatgcccgcagctagtacatgctgcggagacgaaaaatggggagattggcgaccccatctggccatggtgctttccaacttgaataacaatatggatgtggaatcaagaactatggccacaatgggagacacactggcgagtaggggactgctggacgcggcccatttttgctacctgatggcacaggctggattcggtgtttacacaaagaagactactaaattggtgctcattggtagcaatcatagtctgccgttcctgaaatttgccacaaatgaagcgatacagcgaactgaggcctacgagtatgcccagagcctgggggctgaaacatgccctcttccttcattccaggtatttaagtttatttactcttgccggcttgctgaaatggggctcgcaacccaagcattccactactgcgaggcgatcgctaaatccatcctgacgcaaccccacttgtactcgcccgtgcttatttcccagttggtacagatggcctcacagttaaggctcttcgaccctcaactcaaagagaagcctgaggaggagtcactcgccgcgccaacgtggttagtgcatctccagcaagtagagcggcaaattaaggagggcgcaggggtgtggcaccaagacggggccttgccccagcagtgtccgggaactccttcctccgagatggagcaactggataggcctggtcttagccagccaggtgctctcggcatcgccaaccctctacttgcagttccagctccttctcctgaacactcaagtcctagtgtgaggcttctgccatctgccccccagacattaccagatgggcctcttgcctccccagctcgggttcctatgttcccagtccctttgcctccgggaccgttggagcccggacctggctgtgtaacccctggcccagccctggggtttctcgaaccttccggcccaggtttacccccgggggtgccccctcttcaggaaagacggcacctccttcaagaagcacgcagccctgaccccggcattgttccacaggaagccccagttggcaactcgctaagtgaactgtcagaggagaactttgatggcaaatttgcgaacttgacaccttctcgaacagttcctgactcagaggccccaccaggctgggacagagccgactctggtccgactcaacctcctttaagcctgtcccccgcccccgaaacaaagaggcccggccaggcagccaaaaaggagaccaaagagcccaaaaagggcgagagctggttcttcaggtggctgcccggcaagaagaagacagaggcctatctccccgatgataaaaacaagtcaatcgtctgggatgaaaagaagaatcaatgggtaaacctaaacgagccggaggaggagaagaaggctcccccgccccctccaactagcatgcccaagaccgttcaggccgctccgcctgcccttcctggcccgccaggagcacctgttaatatgtatagccgaagggcagccggtacccgggcaagatatgtggatgttttgaatccaagtggcacgcagcgctctgagcctgctcttgcccccgccgatttcgtggcacccctggctccactacctatcccttccaacctgttcgtgcctactcctgacgctgaagaaccccagcttccagatggcactggtagggaaggacctgctgccgcccggggtctggccaatcccgagccggcgcccgagccgaaggtcctctccagcgcagcctccctcccaggtagtgagctaccttctagtcggccagaaggcagccaaggcggggaagcacccggagatcttccagcagccggcggacctccgtctggggctatgccgttctacaatcctgcccaactggctcaagcatgcgccacctcagggtctagtcgactgggacggattggacagaggaaacacctggtgctcaattag

SEQ ID NO: 133576 - DNA, 603 bp, Artificial Sequence
  Description of Artificial Sequence: Synthetic coding sequence
atgccaaaaaccgtacaggccgccccgcccgcccttcccgggccacccggcgcgccagtaaacatgtacagtagaagggcagccgggacaagagccaggtacgtggacgttctgaatccctcaggaactcagcgtagcgagcctgcactggctccagccgatttcgtcgccccccttgcccctttgcccatcccaagtaatttgttcgttcccacgccagtgagtagtgtccgcccccaaggacgttctggaagaaatgacggcctcttagccctttcaagccctgacgcagaggagccccagttgcccgacggaacaggacgtgaaggacccgccgctgcgcgcggtctcgcaaatcctgaaccggcgcctgagcctaaagtgctaagctcggccgcttctctgccaggaagcgagctgccctctagtcggcccgagggtagccagggtggcgaggccccaggtgacctgcccgctgctggcggaccccctagcggagcaatgccgttctataatcccgcacagctagcccaggcctgtgcaacctctggttcctctcggctaggtaggattgggcagaggaagcatttagtgctgaactag

SEQ ID NO: 133577 - DNA, 924 bp, Artificial Sequence
  Description of Artificial Sequence: Synthetic coding sequence
atgagcatgattcttagcgcctcagtgatacgggtccgtgacggccttccgctgtccgcctctactgactacgaacagtccacaggaatgcaagagtgtcggaaatacttcaagatgttgtcccgcaagctggctcagctgcccgaccgctgcaccctcaagacaggtcattataatatcaacttcatttctagcctgggtgttagttacatgatgctgtgtaccgagaactaccctaatgtgcttgccttctctttcttggatgagctgcagaaggagttcataacgacgtataacatgatgaaaaccaatactgccgtccgaccctattgctttatagaatttgacaacttcattcagcggaccaagcagaggtacaacaacccaagatctctctccaccaaaattaacctttccgacatgcagactgaaatcaagttacgccccccataccagatatctatgtgtgaactcggctccgccaatggagtaacgagcgctttttccgttgattgtaagggcgccggaaaaatcagtagtgcgcaccagcgcctcgagccagcaactctgagtgggattgtggggtttattttaagccttctgtgtggggctctgaatctgatccggggtttccatgccatagagtcacttttacaaagcgatggtgatgactttaactacattattgcattttttctgggcaccgcggcttgcctctatcagtgctacttattagtttattacacaggctggaggaacgtaaaaagttttcttacatttggcctgatttgcctttgcaacatgtatctgtacgagctgcgcaatttatggcaacttttttttcatgtaacagtgggggcttttgtcacattgcagatttggctcagacaggcacaaggcaaagctccggattatgacgtgtag

SEQ ID NO: 133578 - DNA, 330 bp, Artificial Sequence
  Description of Artificial Sequence: Synthetic coding sequence
atgagtatgatactttcagcttctgtgattcgcgttcgggatggcctgccactgagtgcctccacagattatgagcagtccaccggaatgcaggaatgcaggaagtatttcaaaatgctgtcacgcaagctggcacagcttcctgatcgctgtaccttaaagacggggcactataacataaactttatcagttctttgggtgtatcgtacatgatgctgtgcactgaaaattacccgaacgttctcgcgtttagctttctcgatgagctccaaaaagaattcatcactacctataacatgatgaaaaccaacactgccgttaggccatag

SEQ ID NO: 133579 - DNA, 870 bp, Artificial Sequence
  Description of Artificial Sequence: Synthetic coding sequence
atgagtatgatcctctctgcctcggtgattcgggtccgagatggactaccgcttagtgcgagcactgactatgagcaatccacaggcatgcaggagtgccgaaagtatttcaagatgctgtctcgtaagctagcccagctgcccgaccgctgcacactgaagacggggcactacaatataaactttatcagctccttaggggtgagctacatgatgctatgcacagagaactaccccaacgtgctcgccttctcttttctggatgaattacagaaggaattcatcacgacctacaacatgatgaaaacaaacaccgccgtgagaccttattgcttcatcgagtttgacaatttcatccagaggaccaagcagcgctacaataatcccaggtctctgtccacaaagatcaacctgtctgatatgcaaacagaaatcaagctcagaccaccttatcaaattagtatgtgcgagctgggaagtgccaatggggtgactagtgctttcagcgttgactgtaagggtgccggaaagatatcctcagcgcaccagagactggaacccgctaccctgtcaggtatcgtgggcttcattctgtcattgctgtgcggtgctctgaacttgatccgcggttttcacgcgatcgagagcctgctgcagtcagatggggacgatttcaactacattatcgcctttttcctaggaaccgccgcctgcctataccagtgctacttacttgtgtactataccggttggcggaatgtaaaatcttttctgacctttggactgatttgcctgtgtaacatgtatctatacgagttgaggaacctttggcagttgttcttccatgtgaccgtgggtgcctttgtttag

SEQ ID NO: 133580 - DNA, 417 bp, Artificial Sequence
  Description of Artificial Sequence: Synthetic coding sequence
atgtcaatgatcctgtcagcgtcagtaattagggttagagatggtctgcctctgtcggcgtcaactgactatgagcagagcacaggcatgcaggagtgtcggaagtacttcaagatgttatctagaaaactggcacaactcccggaccggtgcaccttgaagaccggccattataacatcaatttcatttcctccttaggtgtgtcatatatgatgttgtgtacggagaactaccccaatgtactggctttcagcttcttagacgaactgcagaaggaatttatcactacttataatatgatgaaaaccaacaccgcagtgcggccctactgttttatagaattcgacaacttcatccagagaacgaagcagcggtacaataacccaaggagtctttcaacaaagataaatctgtag

SEQ ID NO: 133581 - DNA, 657 bp, Artificial Sequence
  Description of Artificial Sequence: Synthetic coding sequence
atgagcatgattctgtcagcctccgtgatcagagttcgagacggactgccactctctgctagtactgattacgaacaatccacgggcatgcaggagtgccggaagtactttaagatgctttcacgcaaactcgcacagctgcccgatcgctgcactctaaaaacaggccactacaatattaactttatctcgtcattgggagtcagctatatgatgctgtgcacggaaaactatccaaatgttctggcttttagttttttggatgagctacagaaagaatttatcacaacatataacatgatgaaaaccaatacagccgtgcgcccctattgcttcatcgaatttgacaattttatacagcgaacaaaacagagatacaacaatccacgaagcttgagcacaaaaatcaacctgagcgacatgcagacggaaatcaagttaaggccgccatatcagattagcatgtgtgaactgggaagtgcaaacggagtaactagcgccttctctgttgactgcaaaggggctggcaaaattagtagcgctcatcaacgactggaacccgccactctgagtggaatcgtgggtttcatcttgtcgttgctctgcggtgcgcttaacctgattagaggatttcacgctatcgagagtctcctgtag

SEQ ID NO: 133582 - DNA, 306 bp, Artificial Sequence
  Description of Artificial Sequence: Synthetic coding sequence
atgtctatgatcctcagcgcctccgtcataagagtgcgagatggcctccccctgagcgctagcacagattatgaacaatcgactggcatgcaggagtgcagaaagtattttaaaatgctgagcagaaagcttgcacagcttcctgatagatgcacgctgaaaacaggacactataacatcaattttattagttcccttggggtgagctacatgatgctgtgcacggaaaattaccccaacgtactcgccttttcctttcttgacgaactacagaaggagtttatcacaacttacaacatgatgtag

SEQ ID NO: 133583 - DNA, 924 bp, Artificial Sequence
  Description of Artificial Sequence: Synthetic coding sequence
atgtcaatgattttatccgcttctgttattcgggtgcgtgatggcttgccgctctccgcctccacagattacgaacagagcaccggaatgcaagaatgccgaaagtacttcaaaatgctgtctaggaagctggcacagctccctgatagatgcaccttgaaaacgggccactataatatcaactttatctcttccttgggagttagctacatgatgttatgtacggagaattatcccaatgtattggctttttctttcctggatgaactgcagaaagagtttattacaacatataacatgatgaagactaatactgccgtgcgcccctattgcttcattgaattcgacaattttatccagcgcacaaagcaacgctacaacaatcctcggtctctgtcgaccaagatcaatctgagcgatatgcagaccgagatcaaacttagacccccataccaaattagtatgtgcgagcttgggtcggccaacggggtgacttctgccttctctgttgattgtaagggagctggaaagatttctagcgctcaccagagactcgagcctgccactttgtcggggattgtgggcttcatcttatccctactctgcggcgcgctgaacctcattcgaggatttcacgctatcgagagcctacttcaatccgacggagatgacttcaattacatcattgcttttttcctggggacggcggcgtgtttgtatcagtgctatcttctggtatactacactggctggcggaatgtgaaatcttttctgactttcggcctgatctgtctatgcaatatgtacctctatgagctgcgcaacctttggcagctatttttccatgttacagttggtgcctttgttactcttcagatatggttgcgccaagcccaaggaaaagcacccgattacgacgtttag

SEQ ID NO: 133584 - DNA, 2298 bp, Artificial Sequence
  Description of Artificial Sequence: Synthetic coding sequence
atgaccacctatcttgaattcattcaacaaaacgaagagagggatggcgtgcggttcagttggaacgtttggccctcgtctcggttggaggcaacaagaatggttgtccccgtggcagccctgttcacccccctcaaagagcgcccggacctcccacccatccagtacgagcccgtgctgtgttcccggaccacatgtcgggcggtattaaaccccttatgccaagtggattacagggccaagttgtgggcttgcaatttctgctaccagcggaaccaattcccaccctcatacgctggaatctccgaactgaaccagcctgccgagttactccctcagttcagcagtattgagtacgttgtgctgcgcggcccccagatgccccttatctttctgtacgtcgtggacacttgcatggaggacgaggacctccaggccctcaaagagagcatgcagatgagcctcagtttgctcccccctaccgccctagtcggcctcatcactttcggcagaatggttcaagtacatgaactcggctgcgagggtatctctaagagctacgtcttcagaggcactaaggatctgtccgccaagcagctccaagagatgctgggattgagcaaggtgcctttaactcaggcaacccgcggaccccaggttcaacagccaccgccatcaaaccgttttcttcagcccgtgcaaaagatcgatatgaatctcaccgacctgcttggggaactgcaacgcgacccttggccggttcctcagggtaagcgaccccttcgctcctccggggtggccctctcgatcgccgtgggactcctggaatgtacgtttcccaacacaggggcccgcatcatgatgttcattggcggaccagccacccagggcccgggtatggtcgtgggcgatgagctgaagactcctatccgatcctggcatgacatcgataaagataacgctaaatacgtcaagaaaggcacaaaacacttcgaggcactggccaacagagccgccaccaccgggcatgtgatcgacatctacgcatgtgcccttgaccagactggccttctggagatgaagtgctgtcccaacctcacgggggggtatatggtgatgggagattcttttaatacatcactgtttaagcagacgttccaacgggtgttcactaaagatatgcatggacagtttaagatgggttttggtggcactctggagatcaaaacttcacgagaaatcaagatctccggcgcaatagggccatgcgtatctttaaattctaaggggccctgcgtcagcgagaatgaaataggcacaggcggaacttgtcagtggaagatctgtggcctctcccctacaacaaccctcgcaatttatttcgaagttgtgaaccagcacaacgccccaatcccacagggtggcaggggcgcaattcaatttgtcacacagtaccagcacagctccggccagcggcgcatccgcgttaccacaattgcgcgcaattgggcagacgctcagacccagatccaaaacatcgccgcctctttcgaccaggaggccgcggcaatcctaatggcccgcctagcaatctatcgggcagaaaccgaggaaggaccagacgtactcagatggttggaccgccagctaatcagactgtgccagaagtttggggaatatcacaaagatgatccgagtagtttcagatttagtgagacctttagcctataccctcagttcatgttccacctgaggagatcatccttcttacaggtctttaacaatagtcccgacgagagcagttactacaggcatcacttcatgcggcaggaccttacacagtctctgattatgatacagcctattctttatgcttactctttttccggtccaccagagcctgtcttgctcgactctagttccatacttgctgatcgaattctgctgatggatacctttttccaaatcctcatataccatggtgagaccatcgcccagtggcgcaaaagtggatatcaggatatgcctgaatacgagaatttcaggcacctgttacaggcacccgtcgacgatgcccaggagattttgcatagtaggttcccgatgccaagatacattgacactgagcacggagggtctcaggcgcggtttttgctgtccaaagtgaaccctagccaaacccataataatatgtatgcctggggtcaggaatcaggcgccccaattctgacggacgatgtgtcactgcaggttttcatggaccatctgaaaaaactggcagtgtcatctgccgcttag

SEQ ID NO: 133585 - DNA, 1992 bp, Artificial Sequence
  Description of Artificial Sequence: Synthetic coding sequence
atgcccctcatattcctgtatgttgtagacacttgtatggaagacgaagaccttcaggctctaaaggagagcatgcagatgtctctcagtctgctgcctccaaccgccctggttggactgatcacctttggccggatggttcaggtgcacgaactagggtgtgaggggatatccaagtcctatgtgttcaggggaaccaaggacctgagtgccaagcagctgcaagagatgctggggctgtccaaggtgcctcttacgcaggcaacgcgagggcctcaggtccagcaacccccaccatcgaatcgctttctccaacctgtgcagaagatcgatatgaatttaaccgatcttctgggcgaactccagcgcgatccatggcctgttcctcagggcaaaagaccactgaggtcaagcggagttgccctgtctattgctgtggggcttctcgagtgcacattccctaacacaggagcccgaatcatgatgtttatcggcggacccgccactcagggtcccggtatggttgttggggacgaactgaagaccccaattcgttcctggcatgatatcgataaggataacgcgaagtacgtgaaaaagggaactaaacattttgaggctctcgcaaaccgcgcagccaccactggccacgtgatcgatatctacgcatgtgctctcgatcagaccggtctgcttgaaatgaagtgctgtcctaacctgacagggggatatatggtcatgggcgacagttttaatacatctttgtttaaacagactttccagagggtattcacaaaagacatgcacgggcagttcaagatgggctttgggggcacactggaaattaagacctctagagagatcaagatctccggggcaataggcccttgcgtgtcccttaactctaagggcccttgcgtgtcagaaaatgaaattggcacaggcgggacctgccaatggaaaatctgtgggctgtcccccacaactacactggcaatttatttcgaggttgttaaccagcataatgcaccaataccccagggcggaaggggcgctatccagtttgtcacacagtaccagcacagcagcgggcagcgtcggatacgggttaccaccatagcgcgcaattgggccgatgcgcaaacacagatccagaatatcgcagcaagcttcgaccaggaggccgcagccatcttaatggctcgtctcgctatctaccgcgccgaaaccgaagaggggccagacgttttaagatggcttgacagacaactcattcgcctgtgccaaaagttcggcgagtaccataaggatgatcctagcagcttccggttctctgagacatttagtctctaccctcagcgtcgggatttccccaagactagcggcgagatcctcgaaaatcaggagaaggcccggagtgcatgtctgaaattcatgttccacttaaggcggagtagttttctccaagtttttaataacagtcctgacgagagctcttactacaggcaccacttcatgaggcaggatcttacacagagccttatcatgatacagccaatactgtatgcatacagctttagcggcccccccgagcccgttctgctcgatagcagcagtattctcgcagacaggattctgctgatggacacgtttttccagatcctgatctaccacggcgaaacgattgcgcagtggcgaaaatcaggataccaagacatgccagaatatgaaaattttcgacaccttctgcaggcaccagtggacgatgcacaggagatattgcatagtcggttcccaatgcccaggtacatcgacactgagcacggtggctctcaggcacgcttccttttgtcaaaggtgaacccatcacagacccacaataacatgtacgcctggggacaggagagcggagcccccattctgacagacgacgtgtctttgcaggtgttcatggaccaccttaagaagcttgccgtgagctcagccgcctag

SEQ ID NO: 133586 - DNA, 1692 bp, Artificial Sequence
  Description of Artificial Sequence: Synthetic coding sequence
atgcttgggctatctaaggtacctctaacacaggctacacggggaccgcaggtgcagcagcctcctccgtcaaacagattcttgcagccagttcagaaaatcgacatgaatctcacagatctcctgggagaactgcagcgcgacccttggccagttcctcaagggaagcgccccctcagatcttcaggcgttgcactaagcattgccgtcggattgctcgagtgcacctttccaaacacaggcgctagaatcatgatgtttatcgggggacccgcaactcaggggcctggcatggtagtgggcgacgaacttaaaacaccgatacggtcatggcatgatatcgacaaggataacgccaagtacgtgaaaaaagggacaaaacactttgaggctttggcaaatcgagcagccacgacgggccatgtgatcgatatatacgcttgcgccctagaccagactgggctcttggaaatgaagtgttgtcccaacctcactggagggtatatggtcatgggggactcatttaacacctctctcttcaaacagaccttccagcgggtctttactaaggacatgcacggtcaattcaagatgggcttcggagggaccctcgagattaaaacctctagagagattaagatttctggtgcgatagggccatgcgtcagcttaaattccaagggaccgtgcgtgtcggagaatgaaattggtactggaggaacatgtcagtggaaaatctgcgggctctcacctacgacaactctggcaatctatttcgaggtggtcaatcagcacaatgcgcctatcccacagggcgggaggggcgctatccaatttgtgacacagtatcagcattcttcaggccagcgtcgcattagggtgacaacaattgcacgaaactgggctgatgcccagactcaaattcagaacattgccgcatcttttgatcaagaagctgctgccatccttatggcccggctcgctatttaccgggctgaaacagaggaggggcctgatgttcttaggtggctcgacaggcagctgatcaggctgtgtcaaaagttcggcgaatatcacaaggatgatccctcatcctttcggttcagcgaaacattctccctgtacccacagtttatgtttcatctccgcagaagcagcttcctgcaggtttttaacaattcaccagatgagtcctcctattataggcaccatttcatgcgacaagacctgacccagagtctgatcatgatccagccaatcctctacgcgtacagtttcagtggaccccctgaaccggtactgctggactcgtccagcattctggctgaccgcatcctgctgatggataccttctttcaaatactgatctaccacggtgaaacgatcgctcagtggaggaaatccgggtaccaagatatgcctgagtacgagaacttcagacatctgcttcaggcacccgtggacgatgcccaggaaatcttacatagtaggttcccaatgcccagatatattgataccgaacacggcggaagccaggcgaggttcctcctgtccaaagtgaatccatcacagacccacaacaatatgtatgcatggggtcaggagagtggtgccccaatcctgacggacgacgtatcactacaggtcttcatggatcatctgaagaagctagcggtgagtagcgcagcctag

SEQ ID NO: 133587 - DNA, 2211 bp, Artificial Sequence
  Description of Artificial Sequence: Synthetic coding sequence
atgaccacataccttgagtttattcaacagaatgaggaacgcgacggcgtgcgcttctcttggaacgtgtggcctagttcccgactagaagccacccgaatggtggttcccgttgccgcattatttactcctctgaaggagagaccagacttaccacccattcagtatgagcccgtgctctgtagccgaacaacttgtagagctgtgctgaacccattatgtcaggtcgattatcgggctaagctgtgggcctgtaatttctgttaccagcgaaatcagagagggccccagatgccccttatctttctgtacgtggttgacacttgcatggaggacgaggatttgcaggcactgaaggaaagcatgcagatgtctctgtctctcctgcctccaacagcgcttgtcggactaattacttttggcaggatggttcaagtgcatgagctcgggtgtgagggcattagtaagtcctacgtcttcaggggcaccaaggacctctccgcgaagcagcttcaagagatgcttggtttgtcgaaggttccgctcacacaggccacccgcgggcctcaagtccagcagccgccaccgagtaaccgtttcctacagccagtgcagaaaatcgatatgaatttaacagatctgcttggggaactgcagcgcgacccttggcccgttccacagggaaagcgccccctgcggagctccggggtagccttgtcgatcgctgtcggactgctggagtgtaccttcccaaacactggagcccggatcatgatgttcattggaggccctgcaactcagggaccggggatggtcgtcggagacgagctgaaaacgccaattcgcagttggcacgatattgacaaagataacgcgaagtatgtgaagaagggtaccaagcactttgaagcactcgccaaccgcgctgccacgacaggccatgtgatcgacatctacgcgtgtgccctggatcagacaggacttctcgagatgaaatgttgtcctaacctgactggaggatacatggtgatgggagactcgtttaacacctccctgtttaagcagacctttcagagggtgttcacaaaagacatgcacgggcagtttaaaatgggttttgggggcacccttgaaatcaagacaagtcgagaaatcaaaattagtggcgctattggtccctgcgtttcactgaattccaaaggtccctgtgtaagtgaaaacgaaatcggcacaggcggcacatgccagtggaagatctgcggactttcacctacaaccacactcgccatttactttgaggtggtgaaccagcacaacgcacctattccccagggcgggagaggcgctatccagttcgtaacacagtatcagcacagctccgggcagaggcggattcgcgtcactacgattgcgaggaactgggccgacgcacaaacccagatccagaacatagccgcgtccttcgatcaggaagcagcagcaatcctgatggcacgcttagctatctaccgtgctgaaacggaggaaggcccagacgtactgcgctggctggatcgtcagttaatccggttgtgtcaaaagttcggggagtaccataaagacgatccgagcagcttccgcttctctgagaccttctcactgtaccctcagttcatgttccatctgcgcagaagctccttcttacaggtcttcaacaatagccctgacgaaagtagctattacagacaccatttcatgaggcaggatttgacacagtcactgatcatgatccagccaatcctctacgcgtactcgttttccgggccccctgagcctgttctgctcgacagctcttctatactggctgatcgcattcttctgatggatacttttttccaaatcctgatttatcacggcgagacaatcgcacaatggagaaagagcgggtaccaggacatgccagaatacgagaatttcaggcacctgttacaagcgccagtggatgatgctcaggagatccttcactctcgtttcccaatgccacggtacatagacacagagcacgggggctcccaagctcgcttcctcttgtctaaagttaacccatctcagacgcataataacatgtatgcttgggggcaggaaagtggtgctccaatcttgaccgacgacgtgagcttgcaggttttcatggaccatctgaaaaaattagctgtgagctcggcagcttag

SEQ ID NO: 133588 - DNA, 510 bp, Artificial Sequence
  Description of Artificial Sequence: Synthetic coding sequence
atgacaacttacttggaattcatccagcagaatgaggaaagggatggggtgcggttcagctggaatgtgtggcccagctccagacttgaagcaacaagaatggtggtgcccgtggcagcccttttcacccccctcaaagaaaggccggatttaccccccatacagtatgaaccggtcctgtgttccaggacaacatgcagagctgtattgaaccccctgtgccaagttgactaccgggcaaaattgtgggcgtgtaacttctgctaccagagaaatcagtttccaccatcttatgctggcatttccgagctcaatcaaccggccgagttattgccacagtttagtagcatagagtacgtcgtcctccggggcccccagatgccgctgatatttctctacgtagtcgatacgtgtatggaagacgaagacctgcaggctctgaaggagtccatgcagatgagtctttctcttttgccaccaacagccctcgttggcctgatcacattttag

SEQ ID NO: 133589 - DNA, 285 bp, Artificial Sequence
  Description of Artificial Sequence: Synthetic coding sequence
atgacgacatacctggagtttattcagcagaacgaggaaagggatggagtgcgcttcagttggaacgtatggcctagtagtcggcttgaagctactaggatggtggtgccagtcgcagctctgtttacacctctgaaggaaaggcccgacctccccccaatacagtacgaacccgtgctgtgcagcaggactacatgtcgcgcggtgctgaaccctctttgccaggtcgactaccgtgcaaagctgtgggcatgcaacttctgctatcagcggaaccaggtgtag

SEQ ID NO: 133590 - DNA, 423 bp, Artificial Sequence
  Description of Artificial Sequence: Synthetic coding sequence
atgactacttatctagagttcatccaacagaatgaggagagggatggagtgagatttagctggaatgtgtggccctccagtcgattggaagccacacggatggtggtgcctgtagcagcactgtttaccccgctgaaggagaggccggacctcccccccatccagtacgagcccgtattgtgttcacgtaccacatgcagagcggtgttgaaccccctttgtcaggtggactatagagccaagctctgggcttgcaatttctgctatcaacgcaaccagttcccaccctcgtatgccgggatctcagagctcaaccaacccgccgagctgttgccccagttttcaagcattgagtacgttgtactgcggggcccccaaatgcccctgatttttctctatgtcgtggatacttgtatggagtag

SEQ ID NO: 133591 - DNA, 123 bp, Artificial Sequence
  Description of Artificial Sequence: Synthetic coding sequence
atgacaacttatctcgagtttattcaacagaacgaggaacgcgacggcgttaggttcagctggaacgtatggccttcgtctcgtctcgaggctacacgtatggtcgtgcctgtagcagcatag

SEQ ID NO: 133592 - DNA, 2304 bp, Artificial Sequence
  Description of Artificial Sequence: Synthetic coding sequence
atggcaacttatttagaattcatccaacagaacgaagaaagggatggagtccgcttctcgtggaatgtgtggccaagcagtaggctggaggcaactcgcatggtggtccccctggcgtgtctgctgactccactgaaggagcggcccgatctgccccctgtgcaatacgagccagtcctgtgttccaggcctacctgcaaagccgtcctgaatccactttgtcaagtcgactaccgcgcaaaactttgggcctgcaatttttgctttcagcgcaatcaatttcccccagcgtacggggggatatcagaggtgaatcaacctgccgaactcatgccacagttcagcaccatcgagtatgtaatccagcgaggggcacagagtccactgatattcctgtacgtagtcgacacatgcctggaggaggatgatctgcaggctctgaaggagtctctacagatgagcttgtcattactgccacctgatgctctggtgggtctgatcacctttggccgcatggtacaggtgcatgagctgagctgcgaagggatcagcaagagttatgtgtttcgaggcaccaaagacttaaccgccaaacagattcaggacatgcttggccttaccaagcctgccatgcctatgcaacaagctcgccctgcccaaccccaagagcaccccttcgctagcagccgctttctccagcccgtacacaagatcgatatgaacctgaccgatttgctgggagagttacagagagacccctggccagtgactcagggaaagcgacctctgcgatccacgggagtagcactgtctattgccgttggtctgctggagggcacttttcctaatacaggggcccgcattatgctattcacaggaggccctcccactcaaggccctggtatggtggtgggagacgagctgaaaatacccattaggtcctggcatgatatcgaaaaggacaacgcgcgattcatgaaaaaggcgaccaaacactacgagatgctcgccaacagaactgccgccaacggtcattgtatcgacatatacgcttgcgctctcgaccagaccgggctgttagagatgaagtgctgcgccaatctgacaggggggtacatggtgatgggcgatagttttaatacttccctgtttaagcagaccttccagcgtatctttacaaaagattttaatggtgacttccggatggcctttggagccaccctagatgtcaagacaagccgcgaactcaagattgccggtgccattggaccctgcgtgagtctgaatgtaaagggaccctgtgtgagtgagaatgagctgggcgtcggcggcacttcacaatggaaaatctgcggcctggatccaaccagtacactgggtatttacttcgaggtggtgaaccaacacaatacgcccattccccagggaggaagaggggcaattcagtttgtcacccactaccagcacagctccacccaacggaggattagagtcaccaccatcgcccgtaactgggccgacgtgcaatcccagctgaggcatattgaggctgctttcgatcaggaggcggctgctgtgctgatggcccggcttggcgtgttccgagctgagagtgaggaagggcccgacgtactgaggtggttagaccgacagttgatccggctttgccagaagttcggccagtacaataaagaggaccctacatcttttcggctgtcggacagtttcagtctgtaccctcagttcatgttccaccttaggcgaagtcccttcctgcaagtgtttaacaatagccccgatgaatctagttattaccggcaccatttcgccagacaagacctcactcaatccctgatcatgatccagcctattctctacagctacagtttccatggaccacccgaaccagtcctcttggattctagctccatactagcggatcgcatactcttaatggacacgttttttcagatcgtcatttaccttggcgagacaattgctcagtggcgcaaggccggctaccaggacatgcccgagtacgagaacttcaaacacctgctccaggcccctctggatgatgcacaggagattctacaggcacgattcccaatgccccgctacattaataccgaacacggtgggtcccaggcaagattcttactatccaaagtaaatccttcgcagacacacaataatctgtacgcatgggggcaggagactggtgcacccattttgaccgacgatgtgtccctccaagtgttcatggatcacctgaagaaactggccgtcagctccgcctgttag

SEQ ID NO: 133593 - DNA, 2304 bp, Artificial Sequence
  Description of Artificial Sequence: Synthetic coding sequence
atggccacatacctggagtttatccagcaaaacgaggaaagagatggtgtccgcttctcgtggaatgtttggccatccagtcggttagaggccacgcgcatggtggtcccactggcatgtttgctgacccctcttaaagaaaggcctgaccttccaccagtgcagtacgaaccagttctgtgtagcagaccaacctgcaaagccgtcttaaatccattgtgccaggtcgattatcgtgcgaaactttgggcatgcaacttttgcttccaacgtaaccagttccccccagcatatggtgggatcagtgaagtgaatcaacccgccgagcttatgccgcagttttctaccatagagtacgtgatacagcgcggggctcagtcgcccctgatattcctgtatgttgtggacacctgcctggaggaggacgacttgcaggcacttaaagaatccctgcaaatgagtttgagtctactgccccccgacgcgcttgtcggcttaatcacatttggcaggatggtccaggtgcacgagctgtcctgtgagggtatatcaaaatcttacgtgtttcggggcacgaaggatctgactgccaaacagatccaggacatgctgggtctgactaagcccgctatgccgatgcagcaagcccggccagctcaaccccaggaacacccattcgcttccagccgattcttgcagcccgtgcacaagatcgatatgaacttgacggacctcctaggggagctacaacgtgacccatggcccgtcacccagggcaagcggcccctgcgctctactggggtagcattgtctatcgccgtcggtcttctcgaagggacttttcccaacaccggagcccggataatgctgtttacgggaggaccgcctacacagggccccggaatggtcgtgggcgacgaactaaaaatccctattcgaagctggcatgacattgaaaaggataacgcaaggtttatgaagaaagccaccaaacattatgaaatgctcgccaataggaccgcagctaatggccattgcattgatatttacgcctgcgctttggatcagacgggcctgctcgagatgaaatgttgtgccaaccttacaggtggctatatggttatgggggactcgttcaatactagcctgttcaaacagactttccagcggatttttactaaagatttcaatggcgacttccgtatggcttttggagccactctggacgtgaagaccagcagggagctgaaaatcgcaggagctataggcccctgtgtgtcactaaacgtgaaagggccctgtgtgagcgagaacgagttgggagtcggaggtacaagccagtggaagatctgcgggctggacccaacctctactctgggaatttactttgaggtcgtgaatcaacataacacgccaatcccacagggggggaggggtgccatacagtttgtaactcattaccagcattcatctactcagcgtaggataagggtcactacgattgcccggaattgggctgacgtccagtcacagctgcgacacatcgaggcagcgtttgaccaagaagccgcagctgtcttaatggcacggcttggagtgttcagggcagaaagcgaagagggcccggatgtcttgcgatggctggaccgacaactgatacgcctgtgtcaaaaatttggccagtacaacaaagaggacccaacctcattccgactcagcgactctttcagtctgtatccgcagtttatgttccacttgcggcgtagtccattcctgcaggttttcaataacagcccggacgagagcagctactacaggcaccattttgcccgacaggatttaacacaatccctgattatgatccagcccatcctgtattcttacagctttcatggtccacccgagccggtattgctggacagtagcagcattctggctgatcggatcctgttaatggataccttcttccagatcgttatatacctcggggaaaccatcgcacaatggagaaaggcaggctaccaagatatgcccgagtatgagaactttaagcatctgttacaagctccattggatgacgcacaggagatcctccaggcccgcttccccatgcctcgatacatcaacactgaacacggcgggtcacaggctaggtttctgctctcaaaggttaacccaagtcagacgcataataacctttatgcctggggacaagaaacaggtgctcctatacttactgatgacgtctcgctccaggtgtttatggatcacctgaagaagctggcggtcagctcagcctgttag

SEQ ID NO: 133594 - DNA, 2304 bp, Artificial Sequence
  Description of Artificial Sequence: Synthetic coding sequence
atggcaacatacctcgagttcatccagcagaacgaggagcgggatggtgttcggttcagttggaatgtgtggccttcttctagactggaagcaacacgaatggttgttcctttggcctgcctgctcaccccgttgaaggaacgccccgatctacccccagtacagtatgaaccagtgctgtgctcacgacccacatgcaaggccgttctgaatcccctttgccaggtagactatcgcgctaaactgtgggcctgtaacttttgcttccagaggaaccagtttccccccgcatatggaggtatttccgaggtcaatcaacctgccgaactgatgccgcagtttagcaccatcgaatacgtgatccagcggggggcccaatcgcctctcatctttctgtatgttgtcgacacttgccttgaggaagatgacctgcaagccctcaaggaatccctgcagatgtctctatccctactcccccccgacgcgcttgtgggacttatcacattcggaagaatggtccaggtgcacgagctgtcatgcgaaggaattagcaaatcctacgtgttccgcggaactaaggatctgacagccaagcaaattcaggatatgctcggactgacgaaacccgccatgccaatgcagcaggcaaggcctgcccagccacaggagcaccctttcgccagcagccgattcctgcagcccgtgcataagatagatatgaatctgacagacctgctgggggagcttcaacgcgatccgtggcctgtgacacaaggaaagagacccctgaggagtaccggcgttgcattgtccatcgccgttggactcctggagggtacttttcctaacactggcgcaaggatcatgcttttcacaggtggcccaccaacacagggacctggaatggtcgtaggagacgagctgaaaataccaatcagatcatggcacgacatcgagaaggacaacgccagatttatgaagaaagccacaaagcactacgaaatgctggccaatagaaccgctgctaatggccactgcatcgacatctacgcatgtgcactcgatcaaaccggcctgctggaaatgaagtgctgtgccaatctgactgggggatatatggtgatgggagacagtttcaacacctctttgtttaaacagaccttccagcggatttttacaaaggactttaatggcgactttcgaatggcctttggcgctacattagatgtcaagacctccagggagctaaagatcgcaggggccatcgggccctgcgtcagtttgaacgttaagggcccttgcgtttccgaaaacgaacttggagtcgggggaacgagccaatggaagatttgtgggctggaccccacctcaacactgggcatatatttcgaggttgtaaaccagcacaatacccccattcctcagggtggacgcggcgccatccagtttgtgactcactaccagcacagttcaacacagcggcggatacgcgtaaccaccatcgcccgaaattgggctgatgtgcagtcacagttgcggcatattgaagctgcattcgatcaggaggcagctgccgtattaatggcccgccttggggtgtttcgcgccgagtctgaggaaggtcctgacgtccttaggtggcttgatcgccagctcatccggctgtgccagaaatttggccagtataataaagaggatcctaccagctttcgactgtccgactcattttccctgtaccctcagttcatgttccatttgcggagaagtcctttccttcaggtatttaataactcgcccgacgaatccagctattataggcatcatttcgcacgccaagatcttacacaaagtttgatcatgattcaacccatcctgtacagctatagcttccatggcccgcctgaaccagttttgctcgattcctccagcattctggcagatcgaatactgctaatggatacattcttccagatagtgatatacctgggagagacaatcgcacagtggcgaaaggcaggataccaggacatgccagagtacgagaattttaaacacctgctgcaggccccactggacgatgcccaggagatactgcaggcacgcttccccatgccgcggtatatcaacacagaacacggggggtcccaggcacggtttctgctgtctaaggtgaatccgagccagacccacaataatctgtatgcttggggacaagaaactggggctccaatcctcacagacgatgtgtctctgcaagtctttatggaccacttaaagaaattggcagttagtagtgcgtgctag

SEQ ID NO: 133595 - DNA, 2304 bp, Artificial Sequence
  Description of Artificial Sequence: Synthetic coding sequence
atggcaacctatctggaatttatacagcaaaatgaggagagagatggcgtccggtttagttggaatgtttggccatctagccggcttgaggctacccgcatggtagtgcctctagcctgcctgctgacacccctgaaggagcgtcctgacctgccccccgtccaatacgaacccgtgctgtgtagtcgccctacatgcaaagctgtattgaatcctctatgtcaggtggactatagagctaagctgtgggcctgtaacttctgcttccagagaaaccagtttccgccagcctacggcggcatcagtgaggtcaaccaaccagcggaactgatgccccaattctccacaattgagtacgtcattcaaaggggggctcagtcacctttaatcttcctctatgtcgtggacacttgtctggaggaggacgacctccaggctttaaaggaaagccttcagatgtctctttctctgttaccccccgacgctttggtggggctaatcacattcggcaggatggtgcaagtgcacgaactatcttgtgaaggtatctcgaagagctatgtgtttagaggcaccaaagatctgaccgccaaacagattcaagatatgctagggctcactaagccggccatgccaatgcaacaggcccggcccgcacagccacaagagcacccctttgcatcatctagatttttacagcccgtgcacaagattgacatgaatctcaccgacctgctcggcgaattgcagcgcgacccatggcccgtgacacagggcaagcgacctctgagaagtactggggttgcactcagtattgccgtgggcctgctggagggaacttttccaaatacaggagcccgtatcatgctgtttactggtggtccccccacccaaggtcccggcatggtggtcggtgatgaactcaagattcccattcgtagttggcatgacatagagaaagataatgcccgattcatgaagaaagctaccaaacactatgagatgttggctaatagaactgcagccaatggccactgtatagacatttacgcctgtgcgttggatcaaaccggcctgctggaaatgaaatgttgtgcgaacctgacaggtggttatatggtaatgggagattcttttaatacgtccttgttcaaacagacctttcagcggatattcacgaaggacttcaatggggacttcagaatggcatttggagcaaccctggatgtcaagactagtagagaactgaagattgctggcgcaataggaccatgcgtcagtctgaatgttaagggtccctgcgtgtcagagaatgaactgggtgtcggcggaacaagccagtggaagatttgcggcctggatcctactagcactttgggcatttacttcgaggtggttaatcagcacaacactccaatcccccagggcgggcgaggggccatccagtttgtcactcactatcagcactcctctacacagagaagaattcgcgttacaactatcgctagaaactgggccgacgtgcagtcccagctccggcacattgaggcggcctttgatcaagaggcagctgctgtgcttatggccaggcttggtgtgtttcgggccgaaagcgaggaagggccagatgtactgcggtggctggaccgacagctcattcgcctctgccagaagtttggccagtataataaagaggaccccaccagttttaggctgagtgattcattttctctgtacccccagtttatgtttcatctccgacggagtccattcctgcaggtgttcaacaacagcccagatgagtcatcttactatcggcatcatttcgccagacaagacctgacacagagcctgatcatgatccagcctatactatattcttattcgtttcacggtcctcctgagccagttctcctggattcatcttctatcctggccgatcggattcttcttatggacactttcttccaaatcgtcatctaccttggcgagaccatcgctcagtggcggaaagcagggtatcaagatatgccagaatacgagaacttcaaacatctgcttcaggcacccctcgatgacgcgcaagaaatccttcaagccaggttccctatgccacgctatattaacaccgagcatggaggctcccaggccagatttctcctgtctaaagtaaacccatctcaaacgcacaataatctgtacgcttgggggcaggaaacgggggccccgatcctgacagatgacgtctctctgcaggtgttcatggatcacctgaaaaagctagctgtgagctcagcctgttag

SEQ ID NO: 133596 - DNA, 741 bp, Artificial Sequence
  Description of Artificial Sequence: Synthetic coding sequence
cagcggcggattagggtgacaacaattgctcgcaattgggctgacgttcagtctcagttgcgacacattgaggctgccttcgaccaggaagcagctgctgtcttgatggcacgcctgggcgttttccgcgccgaatctgaggaagggcctgacgtgctgcggtggctggataggcagctgatcaggctttgtcaaaagttcggccagtacaacaaagaagaccccacaagcttcaggctcagtgatagcttttcactctacccgcagtttatgttccacctgcgacgaagtccctttctgcaggttttcaataactcacccgacgagagctcatactaccgtcatcacttcgcaagacaggacctgacacagagcctcattatgattcaaccaattttatacagctactcttttcacggaccccctgagacaatcgcccaatggagaaaagccgggtatcaggatatgcccgaatacgagaacttcaagcacttactgcaagccccccttgacgacgctcaggagatcctccaggctagattccctatgccccgctacatcaatacagagcacggagggagccaggctaggttcctcctgagtaaagtcaacccgtctcagacacacaacaacctgtacgcctggggccaggaaactggagccccgatacttacagatgacgtgtctttgcaggtcttcatggatcacctgaagaagctggccgtgtcatctgcatgctag

SEQ ID NO: 133597 - DNA, 996 bp, Artificial Sequence
  Description of Artificial Sequence: Synthetic coding sequence
atggcaacatatctcgagttcatccagcagaatgaggagagggacggggtacgctttagctggaacgtctggccttcctcgcgtctggaagccacccgcatggtcgtgccgctggcatgtctgttgaccccattgaaagagcgcccggacctgcctccagtccaatacgagcccgtcctgtgtagtcgcccgacatgtaaggcggttcttaaccccctgtgtcaggtggactatcgtgccaagctgtgggcctgtaatttttgctttcagagaaaccagttcccgccagcgtacgggggcataagcgaggtcaatcagcctgctgagctgatgccacagttctctacgattgagtacgtgattcagcgcggcgcccagagtcctttgatctttctgtacgtcgtggatacctgcctcgaagaagacgatctgcaagctctgaaagagagcttgcagatgtccttgagcctgctgcctcctgacgcactggtgggattgattactttcggaagaatggtccaagttcacgaactctcttgtgaaggcatcagtaaaagctatgtgtttcggggcaccaaggatttaactgccaagcagattcaggacatgcttgggttaaccaaaccagccatgccgatgcagcaggcccgcccagcacagccccaagagcaccctttcgccagtagcagattcctacagcccgtgcacaaaatcgacatgaacctgaccgatctcctgggggaactccaacgggacccatggccggttacgcagggcaagcgccctctgcgctccactggcgtggcactgagcatcgctgttggccttctcgagggcacatttcccaatactggtgccagaatcatgctcttcacgggtggcccccccacgcaaggccccgggatggtggtgggcgacgagctcaagattccaattcggtcctggcacgatatcgagaaggataacgcccggtttatgaaaaaggcgaccaagtag

SEQ ID NO: 133598 - DNA, 1200 bp, Artificial Sequence
  Description of Artificial Sequence: Synthetic coding sequence
atggccgagcgcaggcgccacaagaagcgcatccaggaggtcggagagccttctaaagaggaaaaggcagtcgccaagtacctgaggtttaattgtcccacaaagtccacgaatatgatgggccatagagttgactactttatcgcttccaaagctgtagattgtttactcgactctaagtgggccaaggcaaagaagggcgaagaggctctgttcaccacccgtgagtccgtagtggactattgtaacaggttgctgaagaaacagttttttcaccgcgcactgaaggtcatgaagatgaaatacgacaaagacattaaaaaggagaaggacaaaggcaaggctgaatccgggaaagaagaagataaaaagtcaaagaaagaaaatatcaaggatgaaaagacaaagaaagaaaaagagaagaaaaaggacggtgagaaagaagaaagtaaaaaggaagaaactcctggcacacctaagaagaaggagacaaagaagaagttcaagctcgaacctcacgacgatcaggtgttcctggatgggaacgaggtctatgtgtggatctacgacccggtgcattttaaaacgtttgtcatgggactgatcctggtgattgctgtgatagcagctacgctgtttcccctgtggcccgcagagatgagagtcggcgtgtattatctgagcgttggcgccggttgttttgtcgctagcattttactgctcgccgtggcgaggtgcatactcttcttgataatctggctcattacaggcgggaggcaccatttctggtttctccccaatcttacggccgacgtggggttcattgactctttccgtcccctgtacacgcacgagtacaagggcccgaaagccgatttgaaaaaagatgaaaagagcgagacaaaaaaacagcagaagtccgattcagaagagaaatccgactcggaaaaaaaagaggatgaggagggtaaggtggggcccggaaaccacgggaccgaaggtagcggcggcgaacgtcacagcgatactgactccgaccggcgggaagacgaccggagccagcattcgagcggaaacgggaatgactttgagatgataaccaaagaagagcttgagcagcagactgacggcgattgtgaagaagatgaggaagaagagaacgacggggaaacccccaagtcgtcacacgagaagtcctag

SEQ ID NO: 133599 - DNA, 1200 bp, Artificial Sequence
  Description of Artificial Sequence: Synthetic coding sequence
atggccgagcgtcgcaggcacaaaaagagaattcaagaggtcggggagccatcgaaggaggagaaagctgtcgcaaaatatctccgtttcaactgccctaccaagtccactaacatgatggggcaccgggttgattatttcatagcatctaaagccgtggattgtctcctggactccaagtgggccaaagctaaaaagggggaagaggccttgttcacaactcgcgagagtgtcgtggattactgcaataggcttctgaagaagcaatttttccaccgggccctgaaagttatgaagatgaagtacgataaggacataaaaaaagagaaggataaagggaaagcagaatccggaaaggaggaagataaaaaaagcaagaaagaaaacataaaagacgaaaaaacaaagaaggaaaaggagaagaaaaaagacggggaaaaggaagaatccaagaaggaagagactcccggaactcccaagaaaaaggagacaaagaaaaaatttaagctcgaaccacacgatgatcaggtgttcctagatggaaacgaagtttacgtgtggatctatgacccagttcactttaaaacttttgtcatgggtctgatcttggtcatcgctgtcatcgctgcaaccttgtttcccttgtggcctgccgagatgcgggttggggtatactacttgagtgtgggagctggatgcttcgtggccagtattctgctgcttgcagtagcccgctgcattctgttccttatcatctggctcatcacaggaggccggcatcacttttggttcttacccaacctcaccgccgacgtggggttcatcgatagcttcagacccctctatacccatgagtacaaagggccaaaagccgatctcaaaaaagacgagaaaagcgagacaaagaagcagcaaaaatccgacagtgaggaaaaaagcgacagtgagaagaaggaggatgaggagggaaaagtgggcccaggaaatcacgggactgaaggctccggtggagaacggcattctgacactgactcagatcggcgcgaggacgaccgtagccagcatagcagcggtaacggcaatgacttcgagatgattacaaaggaggaactggagcagcagacagatggggactgcgaggaggacgaggaggaagagaacgacggcgaaacgccgaagtcgtcacatgagaagagctag

SEQ ID NO: 133600 - DNA, 372 bp, Artificial Sequence
  Description of Artificial Sequence: Synthetic coding sequence
atggcagagcggaggagacacaagaagcgcatacaggaggtcggggaaccatcaaaggacgagaagtctgaaaccaagaagcagcagaaaagcgattccgaagagaagtctgattcggaaaagaaggaggacgaggaaggaaaagtcggcccaggaaatcatgggacagagggcagtgggggggaaagacattccgatactgactctgatcggcgggaggatgaccgatcccagcactcctcaggcaacggaaatgattttgagatgatcactaaggaagaattggagcaacagacagacggagactgcgaggaggatgaggaggaggagaacgacggagagactcccaagagtagtcatgagaagtcttag

SEQ ID NO: 133601 - DNA, 2283 bp, Artificial Sequence
  Description of Artificial Sequence: Synthetic coding sequence
atggccggacagcagttccagtatgacgactcggggaacaccttcttctactttctgacctcgttcgtgggtctcattgtgatccccgccacatactacctctggccaagagaccaaaatgcagaacaaatcagattgaaaaatatcaggaaagtttatggtcggtgcatgtggtaccgtctcagacttctcaagccacagccaaacattatacccacagtgaagaaaatcgtcctccttgccggctgggccctgtttctcttcctggcgtataaggtatccaagacagacagggaataccaggaatacaacccgtacgaagtgctgaacctggaccccggcgcgacagtggcagaaattaagaagcagtatcgcctgctctcgttaaagtatcaccccgataagggaggtgacgaggtgatgttcatgcgcatcgcaaaagcttatgcggccctgaccgacgaagaaagccgaaaaaactgggaggagtttggcaatcccgatggcccacaggccacctcttttggaattgccctccctgcttggatcgttgatcaaaagaacagcatccttgtgctgctggtctacggcctggcatttatggtgatattacccgtggtggttggcagttggtggtacaggagcatccgttacagcggggaccaaatcttgatccgcacgacccagatctatacttattttgtttataagacacggaacatggacatgaagagactcatcatggttctggccggcgccagcgaattcgacccccaatataacaaggatgccacaagccgaccaacagacaatattctaattccgcagcttatcagagaaatcggctcaatcaacttgaaaaaaaacgagccccctttgacatgtccatatagtctgaaagccagggtgttgctgcttagtcacctcgcaaggatgaagatccctgaaacactggaagaggaccaacagtttatgctgaagaagtgtcccgccctgcttcaggagatggtcaacgtaatttgccagctcatcgtgatggccagaaacagagaggagagggaatttcgcgctccaaccctggcatctctggaaaattgcatgaagctcagccagatggctgtgcagggcctacagcagtttaagtcccccctgctacagctaccacatatcgaggaagacaacctgaggagggtctcaaaccacaagaaatataaaattaagaccattcaagatctggtgagtctaaaggagtccgaccggcatactcttctgcatttcctggaggatgagaaatacgaggaagtcatggctgtgcttggcagcttcccttatgtgacgatggatatcaagtcccaggtactcgacgatgaggactcaaataatatcacggtcggcagtctggtcactgtattggttaagctcacccgtcaaaccatggctgaagtgttcgaaaaggagcagtctatctgtgccgcggaggagcagcccgccgaagatggtcagggtgagaccaacaagaacagaactaagggcggatggcagcagaagtctaaagggcctaagaagacagcgaagtcaaagaagaaaaagcctctaaaaaaaaagcctaccccagttcttctgcctcagtcgaaacaacagaagcaaaagcaggcaaatggcgtcgtcgggaacgaggccgcggtcaaagaggatgaggaagaagtctctgataaaggatccgattcagaggaagaggaaacaaaccgggattcacagagtgaaaaggacgatgggagcgatcgggacagtgatcgggaacaggacgaaaaacaaaataaagacgatgaggccgagtggcaggagcttcagcagtcaatccagcggaaagagagggcgcttctcgaaaccaaatcaaaaatcacccaccctgtctacagtctctattttcctgaggagaagcaggagtggtggtggttgtacatagcagaccggaaggagcaaaccctcatctcgatgccgtatcacgtgtgcactctgaaagacactgaagaagtggaattaaaatttcccgcgcccggtaaacccggcaactaccagtatacagtcttccttcggtcagactcgtatatggggctcgaccagatcaagcccttgaaactcgaggtccatgaggcaaagcctgtaccggagaatcaccctcagtgggataccgcaatagaaggcgacgaagaccaggaagactccgagggtttcgaggactcctttgaagaggaggaggaagaagaggaggacgatgactag

SEQ ID NO: 133602 - DNA, 1254 bp, Artificial Sequence
  Description of Artificial Sequence: Synthetic coding sequence
atgttcatgaggatcgccaaggcctacgcagccttgactgacgaggagtcacggaagaactgggaagagttcggaaacccagatgggcctcaggctacttctttcggaatcgcgttgcctgcctggatagtggatcagaaaaacagtatcctcgtgctgctggtgtacggactggcgttcatggttatattaccagttgttgtcgggtcctggtggtacagaagcatcaggtattcgggagaccagatcctgattagaacaacccagatatacacttattttgtgtataaaactaggaatatggacatgaaacgcttgatcatggttctggccggtgcttcggagtttgacccacaatacaacaaagacgcaaccagtcgccctacagacaatatcttgatcccacagctgattcgcgaaattggaagcataaaccttaaaaaaaatgaacccccactcacctgtccctactccctcaaagcaagagtgctgctgctgtcgcacctggctcggatgaagatcccggaaacgttggaggaagaccagcagttcatgctgaaaaaatgcccagcacttttacaggaaatggtaaacgtaatttgccagctgatcgtaatggcccggaatagagaggaacgggagttccgcgcccccactcttgcctccctcgagaattgcatgaaactctcccagatggctgtgcaaggcttgcagcaatttaagtcccccctcttgcaactcccgcacattgaggaggacaatctgagacgcgtgagtaatcacaagaagtataagataaagactattcaggacttagtctccttgaaagagtctgacagacataccctattgcactttctcgaagatgagaagtacgaagaggttatggctgtgctggggtcttttccctatgtgacaatggatattaaaagccaggttttggacgatgaggactctaacaacatcaccgtgggttccctggttactgtattggtcaagctgaccagacagaccatggcagaggtctttgagaaggagcagagcatctgcgcggccgaagaacagcctgccgaagatggccagggcgaaaccaacaagaatcggacaaaaggaggttggcaacaaaagtccaaaggacctaagaaaacagcaaaaaagaagaaagaaacatttaagaaaaaaacttacacatgcgcaatcactacagtcaaagcgactgagacaaaggcaggcaagtggtccagatgggaatag

SEQ ID NO: 133603 - DNA, 1137 bp, Artificial Sequence
  Description of Artificial Sequence: Synthetic coding sequence
gagcacgaaagagaatttcgggccccaacacttgcctccctggaaaattgcatgaaactgtctcagatggccgtgcagggtctgcagcagtttaagtctccgctgctccagctcccccacatcgaagaagataacctgagacgagtatcaaaccacaaaaagtacaagataaagaccatccaagatctagtgagtctgaaggaatcagaccgccacactctgttgcactttctcgaggacgaaaagtatgaggaggtcatggcagtgcttgggtccttcccctacgtgaccatggacatcaaaagccaggtgctggacgacgaggattctaataatatcacagtggggagtttggtgactgtactcgtcaagctcaccagacagaccatggccgaagttttcgaaaaagaacagtccatctgcgctgcagaggaacagcccgcagaggatggccaaggggaaactaacaaaaaccgaacaaaaggtggctggcagcagaaaagcaaagggcctaaaaagacagccaagagcaaaaaaaagaagcccctgaagaagaaaccaacccctgtgcttctcccacaaagtaagcagcagaagcagaaacaagctaacggagtagttgggaatgaagccgccgtcaaggaagacgaggaggaggtgtctgataagggaagcgattctgaggaggaatggcaagaactccagcaatccatccagagaaaagagagggccttattggaaacaaagtcaaaaattacacaccctgtttactcattgtactttccagaagaaaaacaggagtggtggtggctgtatatcgccgataggaaggagcagacattaatctcaatgccatatcacgtgtgtaccttaaaggatactgaggaagtcgagctcaagtttccagcacccgggaagcctggcaattatcaatacaccgtctttttgcgcagcgactcatatatgggccttgaccagattaagccgctgaagttggaggttcacgaggccaaacctgtgccagagaatcatccacagtgggataccgcaatagaaggtgacgaggatcaagaggatagtgaaggattcgaggacagttttgaggaagaagaagaggaggaggaggacgatgactag

SEQ ID NO: 133604 - DNA, 2346 bp, Artificial Sequence
  Description of Artificial Sequence: Synthetic coding sequence
atggttcgagtgcttaggtccatgtgtctaccgcagctctgctctcacatcctgtcagtctgcagcggcactacttccgatcgaaacgtttattcagtgccaggatcacagtacctgtacaaccaaccttcgtgttaccgcgggttccagactgtgaaacacaggaacgagaatacatgccccttgcctcaggaaatgaaggctttattcaagaaaaagacttatgatgaaaagaagacctacgatcaacagaagttcgattccgagcgggcggacgggacaataagctccgagattaaaagcgctcgcgggtctcaccacctttctatttacgcagagaattccctaaagtctgacggataccacaaacgcaccgataggaaatcaagaataatagcgaaaaacgttagtacatctaaacctgaattcgaattcacaacacttgacttccctgagcttcagggggctgaaaacaacatgagtgagattcagaaacaacccaagtggggacctgtgcattctgtgagcaccgacatttctctccttagggaggtggtcaagccagccgccgtactctcaaagggggagatcgtcgtgaagaacaacccaaacgaatccgtaaccgccaatgctgctactaactccccatcatgtactcgtgagctctcctggacacccatgggctatgttgttagacagacactaagcacagaattaagtgccgcccctaagaatgtcacatcaatgattaacctcaagaccatcgccagttctgccgatcctaagaatgtttctatacctagttccgaggcactaagtagcgacccttcctacaacaaagaaaaacatatcatccacccgactcagaagtcaaaggcgtcccagggtagcgatctggaacagaacgaagcgagccggaaaaacaagaagaagaaggaaaaatctacatcaaaatacgaggttctaacagtgcaggagcccccacgcatcgaagacgcagaagaatttcccaacttggccgtggccagcgagagacgcgatcgtatcgagactccaaagttccagagcaaacaacagccacaagataatttcaaaaataatgtgaagaagtcccagcttccagtccaactggatttaggtgggatgctgacggctctagagaagaagcaacatagccagcatgcaaagcagagttccaaacccgtcgtcgtgtctgttggtgcggttccagtcctgtcaaaagagtgcgccagcggcgaacgcggccggcgcatgtcacagatgaagaccccacataacccgctggacagctcagcaccattaatgaagaagggaaaacagcgtgagatacccaaggcgaagaaacctactagtctcaagaaaattatacttaaagagagacaagagagaaagcaacgactgcaggaaaacgccgtttcacctgcttttaccagtgatgatacacaagatggcgaatccgggggagacgatcagttcccggagcaagccgaactgtctgggccagaaggcatggacgagctcatctccaccccttcggtcgaggacaaatctgaagagccacctggcacagaactgcagcgcgatactgaggcgagccatctcgcaccgaaccacactactttccccaagatccattctagaagatttcgggactattgcagccaaatgttgagtaaggaagtcgatgcctgcgttactgacctcctgaaggaactggtgagattccaggaccgcatgtatcagaaagacccggtgaaggccaagaccaaacggagattggtcttgggtttgagagaagtgctcaaacacttaaaactgaagaagctgaagtgcgtcatcatcagtcctaattgtgaaaaaatccaatccaaaggaggcttagatgataccctccataccatcattgattacgcctgcgagcaaaatattccatttgtgttcgctctcaatcgcaaggcgctagggcgttcactcaacaaagccgtgccggtgtcggtggtgggcatcttttcctatgacggtgcccaggaccagtttcacaaaatggtggaactcaccgtagcagctcgccaggcttataaaacaatgcttgagaacgtgcagcaggagctggtcggcgagccacggccccaggcgcctccatccctccctacccaaggcccgagctgtcccgcggaagacggtccacccgcactgaaggaaaaggaggaacctcactatatagaaatctggaagaagcacctggaggcatattccgggtgtacacttgaactggaagaatccctggaggcctctacaagtcagatgatgaacctcaacctgtag

SEQ ID NO: 133605 - DNA, 2565 bp, Artificial Sequence
  Description of Artificial Sequence: Synthetic coding sequence
atggcctcggaagggcctagggaaccagagtctgagggtatcaaactgagcgcagatgtcaagccattcgtcccgcgcttcgctgggctgaacgtggcctggctcgaaagctccgaagcatgtgtcttccccagcagcgctgctacctactaccccttcgtccaggagcctccagtgactgaacagaaaatttatacagaggatatggcatttggcgcatctactttcccgccccagtatctgtctagtgagattaccctccacccgtatgcctacagcccttacacactggacagcacccagaatgtctattcagtacctggtagtcagtatctgtataaccagcccagctgttacaggggctttcagactgtcaaacaccgtaacgagaatacatgtcctttacctcaggagatgaaggctctgtttaagaaaaagacctacgacgagaaaaaaacctacgaccaacagaagttcgacagcgagcgagcagatggaacaatctcctctgagatcaaaagcgcccggggctctcatcacttgtctatttatgccgaaaattcacttaaatctgacggttatcacaagcgtacagacaggaagtcccggatcattgctaagaatgtatcaacttccaaaccagaatttgagttcaccaccctggactttcccgagctgcagggggctgagaacaatatgtccgagattcaaaagcagccaaagtgggggccagttcatagcgtcagtaccgatattagtctgctgcgcgaagtagtgaagccagctgcagttctgagcaagggcgagatcgtggttaagaacaaccccaacgaaagtgtgactgctaacgccgcaactaattccccctcctgcaccagagaactgtcgtggaccccaatgggctacgtagtgagacagaccttatcaaccgagctttctgcagccccaaagaatgtgacgtccatgataaacctgaagaccatcgcctcatccgccgatcctaagaatgtgtctattcctagttcagaggcgctttctagtgacccatcttacaacaaagaaaaacacatcatacaccctacccagaagtcaaaagcctcacagggctccgacctggagcagaatgaggctagccgcaagaacaaaaagaagaaagagaagtcaacctccaaatacgaagtccttacagtacaagagcctcctcgaatagaggacgcagaggaattccctaacctcgctgtcgccagtgagcgtcgagatcgaatcgagactccgaaatttcagtccaaacaacagccgcaggacaacttcaaaaacaacgttaaaaagagccaactgccagtgcagcttgacctgggcggtatgctgaccgcactagagaagaagcagcacagccagcacgccaagcagagttcaaagccagtcgtggtcagcgtaggcgcagtgccggtgttgtctaaggaatgcgccagcggtgagagaggcaggagaatgtcgcaaatgaaaacaccgcataaccccctggactcaagcgcacccctcatgaaaaagggaaagcagcgtgaaattcccaaagccaagaagcctacctcactcaagaaaataatcctgaaggagagacaggagcgaaaacagcggctgcaggagaacgctgtctcccccgcttttacatcagatgatacccaagatggtgaaagcggtggcgatgatcaattcccagagcaggccgagttgagcgggcccgaggggatggacgaactgattagcacaccatctgtagaggataaatcggaggagccccccggcacagagctacagagggacacagaagcctcgcacttggctcccaatcacaccaccttccctaagatccattcaaggcgcttcagggattactgcagccaaatgctgtctaaggaggtggacgcctgtgtcactgacctgcttaaagagctagtgagatttcaggatagaatgtatcagaaggaccctgtcaaagctaagactaaacgccggcttgtgctgggccttagggaagtcctcaagcacctgaagctgaagaaactgaagtgcgtaattatcagtcctaactgcgagaagatccagtcgaagggcgggctggatgatacactgcataccataatcgattatgcctgtgagcagaatatcccttttgtcttcgccctcaacaggaaggcgttggggaggagcttgaacaaggcggttcctgtgagcgtggtgggaatattctcatatgacggggcgcaggatcagtttcataaaatggttgaactcactgttgcagcccgacaggcttacaagactatgttggaaaatgttcagcaagaacttgtgggcgagccacggccccaggctccaccctccctcccaacacagggaccctcttgccccgcagaggacggaccgccggctctgaaggagaaggaggagcctcattacatcgaaatttggaagaaacatctggaggcctattcaggctgcaccttggagttagaggagtcccttgaagctagcacaagtcagatgatgaacttaaacctgtag

SEQ ID NO: 133606 - DNA, 2583 bp, Artificial Sequence
  Description of Artificial Sequence: Synthetic coding sequence
ccggccagtaggcgaccggcagccggcctacgagatgccgctagttctgcccctcgggggatggcctctgaaggcccaagggagcccgagtcagaaggaatcaagctctccgctgatgtcaaaccattcgtgccccgttttgcaggcctgaacgttgcctggctggagagcagcgaagcctgtgtgttccctagctccgccgccacttattatcctttcgtgcaggaacctcccgtgaccgagcaaaagatttacactgaggacatggccttcggtgcctctaccttcccaccacaatatctcagctcagagattacgttacatccttatgcatacagcccttataccctggactccacgcagaacgtatattcggtgcccggctcacagtacctctacaaccaaccctcatgctaccgaggcttccagactgtgaagcacaggaatgagaacacatgccctctgcctcaggaaatgaaggcactgtttaaaaagaagacttacgatgagaagaaaacgtatgatcaacaaaagttcgattctgaacgggccgatggcactattagttcagagataaaaagtgccagaggcagccatcacctgtctatctacgcagaaaacagtttaaagtctgacggataccataagcgaacggatagaaagagtaggatcattgctaagaatgtttctacgtccaagcctgagttcgagtttaccaccctggatttccccgaactacagggcgccgaaaacaacatgtcagagatccagaagcaacctaaatggggccctgtgcattctgtgtcgaccgatattagccttctgcgggaagtcgtcaagcctgcagctgtcctctctaaaggagaaatcgtggtgaaaaataatcccaatgagtccgtcctgatgccgttaccaatacttttacatgtgcaggagactttatctactgagctcagcgcagctcctaaaaacgtgacctctatgatcaacctcaaaacaatagccagctctgccgatcccaaaaacgtgagcattccctcctcagaagctttgtctagcgatcccagctacaataaggagaagcatataattcacccgacccagaagagcaaagcctcacagggatctgatctcgaacaaaatgaggcctctagaaagaataagaagaagaaggaaaagtccacttcaaagtacgaggtgcttacggttcaagagcctcccaggattgaagatgctgaggagtttccaaacctcgccgtggctagcgaacggcgggaccgcattgaaacacctaagttccagtctaagcagcagcctcaggacaattttaagaataacgttaagaagagccagctgccggttcagttggacttaggcgggatgttgacggcactggagaagaagcagcactcccagcatgcaaagcagtcctctaaaccagttgtagtgagcgtgggcgctgttcccgtgctatcaaaagaatgtgcctcaggagagagggggagacgaatgagccagatgaagaccccgcataacccgctcgattcttccgccccattaatgaagaagggaaagcagagagaaatcccgaaagctaagaaacctactagtctcaaaaaaattatcctaaaggaacgtcaggaacggaaacagaggctccaagagaacgccgtttcgcccgcatttacctccgacgatacacaggacggagagtccggaggcgacgaccaatttcccgagcaggcagaactgagcggacctgaggggatggacgaattaatttccaccccgtctgttgaggacaagtccgaagagccgcctggtaccgaactgcagagggatacagaagcctcccatctcgccccaaatcacactacattcccaaaaatacattcccgaagatttagggattattgcagccagatgctgagcaaggaggtggatgcatgcgtgacagatttgctgaaggagctggtgagattccaggacagaatgtatcagaaggaccctgtcaaggcaaaaaccaaacgccggcttgtactggggctgcgtgaggtgctgaaacacctcaaattaaagaaattaaagtgtgtgataattagtccgaactgtgaaaaaattcaatccaaaggaggcctggacgatacgttacacacgatcattgactacgcctgtgagcagaatatccccttcgtttttgctctgaatcggaaggcgctggggcggtctcttaacaaggctgtacccgtctccgttgtcggtatcttcagctacgacggagcccaggaccaatttcataaaatggtcgagcttactgtggctgctagacaggcttacaaaactatgttagagaacgtccagcaggaacttgtgggggaacccagacctcaggcgccaccctccctacctacacaggggcctagctgccctgccgaggacgggcctccagcactcaaagagaaggaggagccccattacatcgagatatggaaaaaacaccttgaggcatactcaggatgtactctcgagctcgaggaatcactggaggcatccacctctcagatgatgaatctgaacctgtag

SEQ ID NO: 133607 - DNA, 828 bp, Artificial Sequence
  Description of Artificial Sequence: Synthetic coding sequence
ggcacaatatcatccgagatcaaatctgctcgcggctcgcaccatcttagcatctatgccgaaaactcactgaagtctgacggttatcacaagcgtaccgatcgcaaatcccgaattattgcaaagaacgtctctacatcgaaacccgaattcgagttcaccactctggattttcccgagctgcaaggtgccgagaacaatatgtccgagattcagaaacagcccaagtgggggcccgtccactccgtctccacagacatctccctgctgagggaggtggtgaaacctgccgccgtgctgtctaaaggtgaaatagtcgtcaaaaataacccgaacgagtcagtgacagccaacgctgccacaaacagcccgagctgcacaagagccgatccgaagaatgtcagcataccctcctctgaggccctgagctctgatcctagctacaataaggagaagcacataatccaccccactcagaaaagtaaagcttcgcaaggttccgatctggaacagaatgaagccagtcgaaagaataaaaaaaaaaaggagaagtccacaagtaaatacgaggtgcttaccgtacaggaacccccacgtattgaggatgccgaggagttccccaaccttgccgtcgccagtgagagacgcgaccggatagagacccctaagttccagagtaagcagcaaccacaggataacttcaagaataacgtcaagaaaagccaactgcccgtgcagctggacctaggcggcatgctgactgcactggagaagaaacagcactctcagcatgctaagcagagcagtaaacccgtggtagtgtcatag

SEQ ID NO: 133608 - DNA, 183 bp, Artificial Sequence
  Description of Artificial Sequence: Synthetic coding sequence
atgccactcccaattcttttacacgttcaggaacagattctaaaaatgttggtttatcacttactgaagctgtaccttaggatcttacccacaacaaagaaaaacaccctcttcatcctgcccaagagtcttaaacaccataaggtcgtcaccctaaacaaaatgaagcctcaggaacgatag

SEQ ID NO: 133609 - DNA, 2361 bp, Artificial Sequence
  Description of Artificial Sequence: Synthetic coding sequence
atggcctttggcgcctccacctttcctccacagtatttgtcatccgagatcactctccatccatacgcatattccccttataccctggactctacccaaaacgtgtactcggtgccaggctctcagtacctgtacaaccagccatcgtgctatcgcggatttcagacagtcaagcacaggaacgaaaatacctgcccgctgccgcaagaaatgaaggctttattcaaaaaaaaaacctatgatgaaaaaaaaacctacgaccagcaaaaattcgattccgagagagcagatggcactatttcttccgagattaagtcggctcgtggctctcaccacctgtcgatttatgctgaaaactccctcaagtccgatggataccacaagaggactgacaggaagtctcgcataatagcaaagaatgtgtctacgagcaagccagaatttgaatttactaccctcgatttccccgaactacagggagcagagaacaacatgtccgaaattcaaaagcagcctaaatggggccccgtacactccgtctccacagatatcagcctactgagagaggttgtgaagcccgcagccgtgttaagtaaaggggaaatcgtcgtcaagaataatcccaacgagtcggtgacggcaaatgctgcaaccaactccccctcgtgcactcgggagctgtcatggacaccgatgggctacgttgttaggcagacgttgagcacagagttgagcgcagcgcctaaaaacgtcactagcatgatcaatctcaaaacaatcgcttcctcagcagatcccaagaatgttagtatcccatcctctgaagcactgagctccgatccttcctataacaaggagaagcacatcatccacccaactcagaagtccaaggcgtcgcagggctccgaccttgagcagaatgaggcctctagaaagaacaagaaaaaaaaagagaaaagcacatccaagtatgaagttctgaccgtccaagagcctccacgaatcgaagatgccgaggagttccccaacctcgcggtggctagcgagcgccgtgatagaatagaaaccccaaaattccagagcaagcaacagccacaggataactttaaaaacaacgtgaagaaatcacaactgcccgtccaactcgacctcggtggaatgcttacggcgctcgaaaagaagcagcactcacagcatgccaagcagtcttcaaagccagtcgttgttagcgtaggggccgtgcccgtcctctcgaaggagtgcgcctctggcgaacgcggcaggcgtatgtcacagatgaagaccccccataaccctttggactcaagcgctccactcatgaagaaaggaaagcagcgcgagatccccaaagctaagaagccaacttccttaaagaagattattctaaaagaaaggcaagagagaaagcagaggctgcaggagaatgccgtgagcccagcgtttacttctgatgacacacaggatggggagtccggcggagatgatcagtttcccgaacaggctgagctgtctggccctgagggcatggacgaacttatctccaccccatcagtagaagacaaatctgaagagccccctggcactgagctgcagagggatacagaggcttcccacctggcgcctaatcataccaccttccccaaaatccattctcgccgcttccgggactactgtagccagatgctgtcaaaggaggttgatgcctgtgttaccgacctcctgaaagaacttgtgaggtttcaggatcggatgtaccaaaaggatccagtgaaagccaagacaaagaggcgtctggtcctgggattacgcgaagtcttaaagcacctcaaattaaagaagttgaagtgcgttatcatcagtccaaactgcgagaagatacagtccaaaggaggactggatgatacgctccacacaatcatagattatgcctgtgagcaaaacatcccatttgtgtttgctctgaaccggaaggcgcttggcaggtcgctgaataaagccgtgcctgttagcgtggttggtatttttagttacgatggagcccaggatcagtttcataagatggtcgaactgaccgtcgctgcccgccaagcctataagactatgttggagaacgttcagcaggaactagtgggcgaacctcgtccacaagccccgccgtccctacctacacaaggtcccagttgtcctgctgaggatggcccacctgccctcaaggagaaggaggaaccccattacattgagatttggaagaagcacttggaggcctactctgggtgtacacttgagctggaggagtctctcgaggccagcaccagccaaatgatgaacctgaatctgtag

SEQ ID NO: 133610 - DNA, 747 bp, Artificial Sequence
  Description of Artificial Sequence: Synthetic coding sequence
atgcaaacatgtccactggcattccccgggcacgtgtctcaggcgctcggcacccttctattcctggccgcctcactctccgcacagaacgagggctgggacagtccaatttgtacggagggcgttgtgagtgtttcttggggggagaacacagtgatgagctgcaatattagcaatgccttctcgcatgttaacattaagctgcgcgctcacgggcaagaatctgctattttcaacgaggtcgctcctggatattttagtagggatggctggcagttgcaagtacagggaggcgtagcgcagctcgtgatcaaaggcgcacgggattcccacgcaggactgtacatgtggcatttggtgggccaccagcggaataataggcaggtcaccttggaagtgtccggggctgagccacagagcgctcccgacaccgggttttggcccgtgccggctgtggtaaccgctgttttcattctgctggtggctctggtgatgtttgcctggtaccgatgcagatgcagtcagcagaggcgggaaaaaaagttcttcttattggaaccccaaatgaaagtggccgctcttcgggctggcgcgcagcagggcctgtcccgagcgtcggccgagctctggacccctgattctgagccaacccctcggccactggcactggtgttcaaaccatctccattgggagccctcgaactccttagtccccagccattattcccctatgctgcagacccctag

SEQ ID NO: 133611 - DNA, 888 bp, Artificial Sequence
  Description of Artificial Sequence: Synthetic coding sequence
atgctgcagggccccggttcacttctcttgttgtttttagctagccattgctgtctgggaagcgcaagagggctctttctgttcggtcaaccagatttctcatacaaaagaagcaactgcaaaccaattcctgcaaaccttcagctgtgtcacggtattgaataccagaatatgcgacttcccaatctgctgggacatgaaaccatgaaagaagtcctggagcaagccggggcatggattccgttggttatgaagcagtgccacccagatacgaagaaatttctgtgctctctgtttgctcctgtctgcctggatgaccttgatgagaccatccagccctgccattcactctgtgtacaagtcaaagacaggtgtgcacccgtgatgtctgccttcgggttcccctggcccgacatgctggagtgtgaccggtttcctcaagataacgatctatgtataccgctggcatcttccgaccacttgctcccagccactgaggaggcccctaaggtatgcgaagcgtgtaaaaataagaatgacgatgacaacgacataatggagacgttgtgtaagaatgactttgccttaaagattaaggttaaagagattacctacataaatcgggataccaagatcatcctggagactaagtctaaaaccatatacaagctcaatggtgtctcggaacgggacctgaaaaagagtgtgctctggctgaaggattcacttcagtgtacatgcgaggagatgaatgacattaacgccccatacctcgtcatggggcaaaagcaaggcggtgagttggtgatcaccagcgtcaagcgctggcagaagggccagagggaattcaagagaatatctcgcagcattcggaagttgcagtgctag

SEQ ID NO: 133612 - DNA, 312 bp, Artificial Sequence
  Description of Artificial Sequence: Synthetic coding sequence
atggccagtaggtgggccgtgcaattgctactggtagcggcatggtcaatggggtgtggcgaagcgctgaaatgttacacttgcaaagagccaatgacttccgccagttgtaggacgattacgcgctgcaagcccgaggacacagcctgcatgactacgctggttaccgtggaagccgaataccccttcaatcagagcccagtggttacacggagctgttccagctcatgtgtggctacggacccagacagtattggggcagcgcacctgatcttttgctgcttcagggatctgtgcaacagcgagctgtag

SEQ ID NO: 133613 - DNA, 636 bp, Artificial Sequence
  Description of Artificial Sequence: Synthetic coding sequence
atgatcagcagaatggaaaaaatgaccatgatgatgaagattctcattatgttcgccttgggcatgaactattggtcatgttcaggattccccgtctatgattacgacccatcttccttaagagacgccctctctgcctcagttgtgaaggtgaacagccagagcctgagcccctacctgtttagggcattccgctctagcttgaagcgcgtggaagtgctggatgagaacaacctagtcatgaacctggaatttagcattagagagaccacctgtagaaaggactccggcgaagatcctgccacatgtgcatttcagagagactactacgtctccactgccgtttgcagaagtacagtcaaagtgtccgcccaacaggtgcagggcgtgcacgccaggtgctcttggtcatcttctacatccgagtcatacagctccgaggagatgattttcggggacatgctcggcagccacaagtggcgaaacaactatctgttcggcttgattagtgatgaatccatctccgaacagttctatgaccgaagtctgggcattatgcggcgggtccttccacccggtaataggcggtaccctaaccataggcacagagctcgcatcaacactgattttgaatag

SEQ ID NO: 133614 - DNA, 636 bp, Artificial Sequence
  Description of Artificial Sequence: Synthetic coding sequence
atgatctctagaatggaaaaaatgactatgatgatgaaaatacttatcatgtttgccctgggaatgaactactggagctgctctgggtttcccgtatatgattatgatccatccagcctgagggatgccttgtctgctagcgtggttaaagtaaactcccagagtctgtccccttatctattccgcgcattccgatctagcctgaagcgcgtcgaagtgctcgatgaaaataacctggtaatgaacctggagttcagtatccgagagactacctgtaggaaggactccggcgaagaccccgccacttgcgctttccagagagactactatgtgtctaccgccgtgtgcaggagtacagtgaaagtcagtgcccagcaggttcagggcgtccacgcaaggtgtagttggtcatctagtaccagtgaaagttatagttccgaagaaatgatcttcggagacatgctgggcagccacaagtggagaaacaactaccttttcggcttgatctccgacgaatctatttctgagcagttctatgatcggtcactgggcattatgaggcgagtgttgcctccaggcaacaggcgataccccaaccatcgacatagagcgcgaattaacaccgactttgaatag

SEQ ID NO: 133615 - DNA, 366 bp, Artificial Sequence
  Description of Artificial Sequence: Synthetic coding sequence
atggctccccgccctctgctgttgctcttgcttctcctgggggggtccgcagcaagaccagcccctccaagggcccggagacattctgatggcacatttacctccgaactgagccgcctgcgcgaaggtgctcggctgcagcgactcctgcagggccttgttggtaaacgatccgagcaggatgctgaaaattctatggcttggacacgcttgagtgcagggctcctgtgtccctccggctctaatatgccaatcctgcaagcttggatgcctctggatggaacatggagtccatggttacctcctggccccatggtcagtgagcctgccggggccgccgcggagggaacgcttcgccctaggtag

SEQ ID NO: 133616 - DNA, 1323 bp, Artificial Sequence
  Description of Artificial Sequence: Synthetic coding sequence
atgcgtccacacctttcacccccgctgcaacagctgctacttccagtcctgttggcttgtgcggctcactccaccggagcccttccccgcctctgcgacgtgctacaggtgctctgggaggagcaagatcagtgtctgcaagaattatccagggagcagacaggagatcttgggaccgaacaaccggtgccaggatgcgaggggatgtgggataatattagttgctggccaagttcagtcccaggcaggatggtcgaggtggagtgtccgaggtttttgaggatgctcaccagtcggaacggaagtcttttccggaactgcacccaggatggttggtccgagactttccctagacctaaccttgcttgcggcgtcaacgtaaacgattccagtaatgaaaaaaggcattcctatcttctcaagctgaaagtcatgtacacagtggggtattcttcaagtttggtcatgctgctggtcgctttgggcatcctgtgcgctttccggaggctccactgcacacggaattacatccacatgcatctgttcgtgtccttcatactgagagccctgtctaacttcataaaggatgcggtgctgttcagtagtgatgacgtcacttattgtgatgcacaccgcgccggatgtaagcttgtaatggttctgtttcaatactgcataatggccaattactcctggctcctcgtagaaggtttgtatctgcacacgctcctggctatttccttcttcagcgaaagaaagtacctccaggggtttgtggcattcggttgggggtcacctgcgattttcgtcgctctgtgggcaatagcaaggcactttttagaagatgttggctgttgggatattaacgctaatgccagtatctggtggattattagaggccccgtgatcctttctatcctaattaacttcatcctgttcatcaacattttgcggatattgatgcggaagctgcgcacacaagaaactcgtggcaacgaagtctctcactacaagcgcctagctcgttcgactctcctccttattcctctgttcggaatccattatatcgtgttcgcattcagccctgaggatgctatggaaattcaactgttcttcgaactagctctcggcagctttcaagggctggtggtagctgtattgtactgctttcttaatggcgaggtgcagctggaggttcaaaaaaagtggcagcagtggcacttgcgagagtttcctttacacccagtcgcatctttctctaattccaccaaggcatctcatctggagcagtcccagggaacatgccggacaagtatcatctag

SEQ ID NO: 133617 - DNA, 288 bp, Artificial Sequence
  Description of Artificial Sequence: Synthetic coding sequence
atgaagctacttatggtactgatgcttgcagcgctcctcctccactgttatgccgattccggctgcaagctgctggaagatatggtcgaaaagactataaattcagacatttctatcccagagtacaaagaactgctccaggagttcatcgatagcgacgctgccgccgaggctatgggcaaatttaagcagtgctttctgaaccagagtcataggaccctgaagaatttcggcttaatgatgcataccgtgtacgactccatctggtgcaatatgaagagtaactag

SEQ ID NO: 133618 - DNA, 1746 bp, Artificial Sequence
  Description of Artificial Sequence: Synthetic coding sequence
atgccggcccctcgtgctagagaacagccaagagtccctggggagcgtcagcccctcctgcctcggggcgccagagggccaaggaggtggcgtcgggccgccggagcagcagtgttgctcgtggaaatgctggagcgggccgctttcttcggagtcaccgccaacctcgtcctttacctgaacagcacgaattttaattggactggagaacaggccactcgagccgctttggtgtttctgggggcctcgtacctccttgcacctgtgggtggatggcttgctgatgtttatctgggaagatatagagcggttgccctgtctctgctactgtacctggctgcctcgggcttactccccgctaccgccttcccagacggccggagctctttttgcggagaaatgcccgccagccccctcggtcccgcctgccccagtgcaggctgtccgcgttcctccccttccccctattgtgcacccgtgctctatgcaggcctgcttctgctcggtcttgcagctagttccgtccggtcaaatctcacttcctttggcgctgaccaggtgatggacctgggtagagacgccacccggaggtttttcaattggttttactggagcatcaatttaggcgcagttctaagcttgctggtagttgccttcatccagcagaatatctcttttctactggggtacagtattccagttggatgcgttggtctagcgtttttcatcttcctctttgcgacccccgtcttcattacgaagccaccgatggggagccaggtctcttcaatgctgaaattagctttgcagaattgttgcccacagctgtggcagcgccacagcgcacgcgatcggcaatgcgccagagttctggcagacgagcgatcacctcagccgggtgcatctcctcaggaggacattgccaacttccaggtcttggtgaaaatcttgcctgtgatggttacacttgttccttactggatggtctattttcagatgcagtcgacctacgtcctgcagggccttcacctccatatccctaacatcttcccagcaaaccccgccaatatcagtgtggctctccgggctcagggctcaagctatacgatacctgaggcctggcttctcctcgccaacgtggtggtggtgttgattctggtgcccctgaaggataggctgattgatcccctgctactgagatgtaaattactcccttctgccttgcagaagatggccctggggatgtttttcgggtttacatccgttatcgtggcaggagttctagaaatggaaaggttacactatatacatcataacgagaccgtatcgcaacagataggcgaggtcctgtacaacgccgcccctctgtctatatggtggcaaatcccccaatatctgttgataggtatttcggagatttttgcgagtattcccggacttgaatttgcttactccgaggcacctcgctccatgcagggagccatcatgggcatctttttctgcctgagcggagttgggtctctgctcggaagcagtctcgtagcactactgtcactccccggcgggtggctgcattgtccaaaggacttcgggaatattaataactgtagaatggatctctacttttttttattggcaggtattcaagccgttactgcgctcctattcgtgtggatagccggccgctacgagcgcgcgagccagggccctgctagccatagccggttttcgagggataggggttag

SEQ ID NO: 133619 - DNA, 363 bp, Artificial Sequence
  Description of Artificial Sequence: Synthetic coding sequence
atgaagctcctcatggtcctgatgctggcggctttgagtcaacattgctacgctggctccggctgccccctgctggaaaacgtgatttcaaaaaccatcaacccgcaggtgtcaaagactgagtacaaagaattgttgcaggaatttattgatgacaacgctaccactaacgccattgacgaactgaaggaatgtttcttgaaccaaaccgacgaaacattgtctaacgtggaggttttcatggttattagcttctcatcgtataaattatttaaatctccggaccagggccaagtgggaagctccttccttaccgataacgccaaagctacaagtgaacaggcattttcatacattggttag

SEQ ID NO: 133620 - DNA, 315 bp, Artificial Sequence
  Description of Artificial Sequence: Synthetic coding sequence
atgaaattggcagccctgctgggcctctgcgtagccttgtcatgtagcagtgccgccgcattcctcgtgggttcggccaaacctgttgcccagcccgtggcggcgctcgaatccgccgccgaagccggagcggggaccctagcgaacccactgggcactctcaatccactcaaactcctactttccagtctggggatcccagtgaatcacttgatagagggtagtcagaagtgtgtcgcagagctgggcccgcaggcagtcggagcggtgaaggctctgaaagcccttctgggtgccctgacagtgtttggctag

SEQ ID NO: 133621 - DNA, 282 bp, Artificial Sequence
  Description of Artificial Sequence: Synthetic coding sequence
atgaagctcgtgaccatcttcctcctggtgactattagtctgtgtagttacagcgccactgctttcctcattaataaagtaccactgcccgtggataaattggctcccctgccactggacaacattctgccctttatggatcctcttaaacttttgctcaaaacccttggcatcagtgtcgaacacctcgtggagggactccgtaagtgcgtgaacgaacttggccccgaggcctccgaagccgtgaaaaagctgctcgaagccttaagtcaccttgtctag

SEQ ID NO: 133622 - DNA, 1854 bp, Artificial Sequence
  Description of Artificial Sequence: Synthetic coding sequence
atggccgaggcgaaaacgcattggctgggagccgctctatccctcatccctctaatatttcttatttccggagctgaggctgcatctttccagcgaaaccagcttttacagaaggaacccgacctaaggctggagaacgtccagaaatttccctcaccagaaatgataagggcactagaatacattgagaatcttcgccaacaggcacacaaagaggagtcatctccagactataacccttaccaaggggtctccgtgcccctgcagcaaaaagagaatggggatgagagccatctcccagagcgagactccctcagtgaggaggactggatgcgtatcatcctggaagcgctacggcaggccgagaacgagccgcagagcgcccccaaggagaataaaccctacgcgctgaacagcgaaaaaaattttccaatggatatgagtgacgattacgagactcagcaatggccggagaggaagctcaaacacatgcagttcccccctatgtacgaagaaaacagccgggacaatccgtttaaaaggaccaacgagatagtggaagagcagtacacccctcagagtcttgcaacccttgaatccgtgtttcaggagctgggaaagctaacaggcccaaataaccaaaaacgggaaaggatggatgaagagcagaagctctacaccgatgatgaagacgatatctataaggccaataatatcgcatatgaggatgtcgtgggcggtgaagattggaaccctgtcgaggagaagatagaaagtcagactcaggaggaggtgcgcgactcaaaggagaacatcgaaaagaacgagcagatcaatgatgagatgaagcggagcggacagcttgggatacaggaggaagatctgcgcaaggagagcaaggaccagctgtcagacgacgtcagcaaggtgatcgcttatctgaagcggctagtgaatgcagctggcagcggaagactgcaaaacgggcaaaacggggagcgcgcaacacgcttatttgaaaaacctctggactctcaatctatttaccagctaattgaaattagcaggaatctgcaaattccccccgaggacctcattgaaatgcttaagaccggtgaaaaacctaacggtagcgttgagccagagcgtgagctcgacctgccagttgacttggacgatattagcgaggcggacctggaccacccagacctgtttcagaatcggatgttgagcaagtctggctaccctaaaaccccaggccgggctgggactgaagccctgcccgacgggctgtctgtcgaagacatcctcaatttactgggcatggagtccgccgctaatcagaagacctcctacttcccaaatccatacaatcaggaaaaagtcttgcccaggctaccgtacggcgccggccggtcccgttcaaaccagctccccaaggcggcatggattccccacgtcgagaaccgccagatggcgtatgagaacttgaatgataaggaccaagaacttggcgagtacttggcccgtatgctggttaagtaccctgagattattaattccaaccaggtcaaacgcgtcccagggcagggctcttccgaagatgacttacaggaggaagagcaaatcgaacaggctattaaagagcacttgaatcagggctcttcacaggaaactgataagctggcaccagtaagtaagaggttccctgttggaccaccaaaaaatgacgacacaccaaatcgtcagtactgggacgaggatcttctgatgaaggttctggagtacttgaatcaggagaaagccgaaaaagggcgcgaacacatcgcgaagcgggcgatggaaaacatgtag

SEQ ID NO: 133623 - DNA, 435 bp, Artificial Sequence
  Description of Artificial Sequence: Synthetic coding sequence
atggccgaggccaaaacacactggctcggtgcagcgctgtctttgatcccattaatctttctcatttcaggagctgaggccgcatcattccaaagaaaccaactcctgcagaaggagcccgacctgagacttgagaacgttcagaagttcccgagccccgaaatgattagggcccttgagtacattgaaaacctgcgtcaacaagcccacaaggaggagagtagtcccgattacaacccctatcagggagtttctgtccctctccagcaaaaggagaatggtgatgagtcacacctgcccgagcgcgacagtctgagtgaagaggactggatgaggatcattctggaagcactgaggcaggccgaaaacgagccccagtctgcgcctaaagaaaacaagccgtacgctctcaactctgagaagaattttccatag

SEQ ID NO: 133624 - DNA, 378 bp, Artificial Sequence
  Description of Artificial Sequence: Synthetic coding sequence
atggctgaggccaaaacccattggcttggcgcagctctgtcactgattcccctcattttcctaattagtggggcagaggccgcctcttttcagcggaaccaattgctgcaaaaagagccggacctccgactggaaaatgtgcagaagttcccttccccagaaatgatccgagctcttgagtacatcgagaatctccgacagcaggctcataaggaggagtcgagcccggactataatccttatcaaggagtttccgtgcctctgcagcagaaggagaatggagacgaatctcatctccccgaacgggactcgctgtctgaggaggattggatgagaatcatactggaggctctcagacaagccgagaacgaaccatag

SEQ ID NO: 133625 - DNA, 1434 bp, Artificial Sequence
  Description of Artificial Sequence: Synthetic coding sequence
atggctgaagcgaaaacccactggttgggagccgccttgtctcttatcccactcatctttctcattagcggcgcggaggccgcgagcttccagagaaaccagcttctgcagaaggagcctgacctaaggctcgaaaacgttcagaaatttcctagtccagagatgattcgggccttagaatacatcgagaacctgagacagcaggctcataaagaagagtcttctccggattataacccttaccaaggggtttctgtgcccttgcagcaaaaggagaatggtgatgagagccacctgcccgaacgcgactccctgcggggagaggactggaatcccgtggaagaaaaaatcgagagccaaacccaggaggaagttcgagattccaaagagaacattgaaaagaacgaacagatcaacgatgaaatgaagcggtctggccaactggggatacaagaggaagatctccgcaaagagagcaaagaccagctgagcgatgacgttagcaaggtgattgcatacctcaagcgactggtgaatgcagctgggtctggacgtctgcagaacggacagaacggtgaaagagctacacgcctgttcgagaagcccttagactctcaatcaatttatcagctcatcgaaatcagcagaaatttgcagattcccccggaggacttaatcgaaatgctaaaaaccggggagaaacccaacggcagcgtcgaacccgaacgggaactggatctacccgtggatctggacgatatcagtgaggcagatctggatcaccctgatttattccagaaccggatgctctctaaaagtgggtaccccaagacacccggtcgcgccggcaccgaggctctaccagacggcttgagcgtggaagacatcctcaacttgctcgggatggagagtgctgctaatcagaagacctcatactttccaaatccttacaaccaggaaaaagtgctcccacgactcccttacggtgccgggagatcgcgatccaatcagttgcccaaagccgcctggattcctcacgtcgagaatagacagatggcatacgaaaaccttaatgataaggaccaggagctgggtgaatatctcgcacgcatgctggtgaaatatccagagatcattaactctaaccaggttaagagagtgcctgggcagggatcatcagaggatgatcttcaggaagaggagcagattgaacaggcgattaaagaacacctgaaccagggctcctcgcaggagacagacaaattagccccagtcagcaagaggttcccagtcggacctccaaagaacgatgacacacccaatcgccagtattgggatgaagaccttctgatgaaagtgctcgagtacctgaaccaggaaaaagctgagaagggcagagagcacatcgctaaaagagctatggaaaatatgtag

SEQ ID NO: 133626 - DNA, 390 bp, Artificial Sequence
  Description of Artificial Sequence: Synthetic coding sequence
atggagccttcgcagtgtgtagaagagctcgaggacgacgtgttccagcccgaagacggcgagcccgtaacacagcccggatcgctattaagtgccgacctgtttgcacaaagcctcctcgattgccctctttcgaggctccaactgtttcccctgacccactgctgtggccctggcctgcgccccactagccaggaagataaggccacccagacactgtcacctgcgtcacctagccaaggcgtgatgcttccctgcggcgtgacagaagagccacagcgattgttttacgcccctgcagagcctaagagctgcgtggtggcagacccccctctccctgcacagccctgctttgagtggaggagagagcaagaacggggcaggccttag

SEQ ID NO: 133627 - DNA, 711 bp, Artificial Sequence
  Description of Artificial Sequence: Synthetic coding sequence
atggctgccattcaagatggtctcgcaaaaggggagaacgacgagactgttagtaatactttgaccctcactaacggactcgaacgccgtaccaagacatacagcgaggacaacttcgaggagctccagtatttccccaatttctacgctcttctgaagagtatcgatagtgagaaagaagctaaagaaaaggaaaccctgatcaccataatgaaaactctgattgacttcgtcaagatgatggttaagtatggtacaatctctcccgaggaaggcgtctcatacttagagaacttggacgaaatgatcgctctccaaacaaaaaataagctggagaaaaatgcaacggataatattagtaaattgtttcccgcccctagtgaaaaatcgcatgaggaaacagatagcaccaaggaggaggccgctaagatggagaaggaatacggaagtctcaaggactctacgaaagatgacaacagcaatcctggcgggaaaacagacgaacccaaaggtaaaacagaagcctacctcgaggctattcggaaaaacatcgaatggctgaagaaacatgacaaaaagggcaacaaagaagactacgatctgagcaagatgagggactttattaacaaacaggccgatgcctacgtggagaagggaatcttagataaagaagaagcggaagctataaagcggatttactcctctctctag

SEQ ID NO: 133628 - DNA, 174 bp, Artificial Sequence
  Description of Artificial Sequence: Synthetic coding sequence
atggccgccatccaggatggattggctaagggggagaacgacgagaccgtgagcaacactttgaccctcacaaatgggcttgagaggcgtaccaagacttattctgaggacaactttgaagagctgcagtattttcccaacttctatgcacttctgaaatccatagactcctag

SEQ ID NO: 133629 - DNA, 990 bp, Artificial Sequence
  Description of Artificial Sequence: Synthetic coding sequence
atgtctgctttcgacacaaacccctttgctgacccagtggacgtcaatccattccaggatccatcggtgactcagctgactaacgccccacaaggaggcctggccgagttcaaccctttttcagaaaccaacgcggcgacaacagtgcctgtgacacagttgccaggctcctctcagccggcggttcttcagcctagtgtcgagccgacccaaccaacgccccaggccgtggtgtccgccgcccaggcaggactcctgcgccaacaggaagaactggacaggaaagcagcagaattggagcggaaggaacgcgagctgcaaaataccgtggcgaacttgcacgtcagacagaacaactggcctcctctgccttcttggtgtccggtgaaaccttgtttctatcaggacttttccacagagattcctgccgactatcagaggatctgtaagatgctatattacctgtggatgctgcacagtgtgaccctgttcctcaatctcctggcgtgcctggcatggtttagcggcaatagttctaagggtgtggatttcggtctcagtatcctttggtttctgatctttacaccgtgcgcttttctgtgctggtaccggcctatctataaggcatttcgtagcgataactcattttcctttttcgtgttcttctttgtgtttttttgccagattgggatctacataatacagttggttggaatccctgggttgggcgattctggctggattgccgccctgagtaccctcgataaccacagtctggcgatctctgttatcatgatggtggtggcagggttctttaccctctgcgccgtgctgagtgtctttctacttcaaagagtgcatagcctgtatcgccgaaccggggcttcctttcagcaagcgcaggaggagttttctcagggaatttttagcagcagaacatttcaccgtgcagcctcctccgccgcacagggcgcttttcagggtaactag

SEQ ID NO: 133630 - DNA, 864 bp, Artificial Sequence
  Description of Artificial Sequence: Synthetic coding sequence
atgtccgcctttgacactaacccttttgcagacactaacgccgccacaactgtccccgttactcagctgcccggctccagtcagcctgctgtgctgcagccatccgtagaacctacacaacccaccccccaggccgtagttagcgctgcacaggcaggactcctgaggcagcaggaagagctggatcgaaaagctgctgaacttgagagaaaggagcgagaactgcaaaacacggtggccaatctacacgtccgtcagaacaactggccgccactgccttcatggtgccccgtaaagccctgtttttaccaggatttttcaactgaaattccagcagactaccagcggatttgcaaaatgctctattacctgtggatgctccattccgtaaccctgtttctgaacctgttggcctgtttggcatggtttagcgggaactcctcaaaaggggtagatttcgggctgagcattttatggttcctgatatttacaccttgtgccttcctttgctggtacaggccaatctataaagcattccgctcagacaattccttcagtttctttgtttttttctttgtcttcttctgtcagataggaatttacataatacagctcgtgggcatacccggccttggagacagtggttggattgcagctttatccacactggacaaccactcactggctattagtgtcatcatgatggtggtggcaggctttttcaccctgtgtgctgtgctgtccgtttttctcctgcagcgggtgtctggcgtgggccgagccgactccaaatgggaggaggccggtaaccggttcctgcctctgcctagagacgtattccaccactgcagttgggcctcctag

SEQ ID NO: 133631 - DNA, 1044 bp, Artificial Sequence
  Description of Artificial Sequence: Synthetic coding sequence
atggcacaatctcgggatggtggaaatccattcgccgagccatcagaactcgacaacccgttccaagaccctgccgtgatccagcaccggccatccaggcagtatgctactttagacgtgtacaacccattcgagacacgggagcctcctccggcttatgaaccccctgctccagcacctttgcctcccccttctgcaccttcactgcaaccgagccgaaaactcagtcctaccgagcccaaaaattatggtagctacagtacacaagcgagcgcggcagcagcaaccgcagagcttctaaagaaacaggaagagcttaatcggaaggcagaggagctcgaccgccgcgaaagagagctgcaacacgccgcactcggaggcaccgccacacgacagaacaactggcccccccttccaagcttttgccccgtgcagccgtgcttttttcaagatatcagtatggaaatcccccaggaatttcaaaaaacggtctcaacaatgtactacctctggatgtgctcaacactggctcttctcctcaactttctagcttgcctcgcctccttttgtgtagagaccaacaatggcgccggattcggcctctcaattttgtgggtgctgcttttcacaccctgctcattcgtttgctggtacaggccaatgtataaagcctttcggagcgacagctccttcaacttcttcgtgttcttctttattttctttgtgcaagacgtgttgttcgtgttacaggccataggtatcccggggtggggatttagcggatggatttcagcgcttgtcgtgcctaagggaaatacagccgtgtctgtgttaatgcttctggtagcgctgctgttcaccggcattgccgtgttaggcattgtgatgctgaagaggatccacagcctgtaccggcggactggcgcctcattccagaaggcacagcaggagtttgctgcaggcgtcttttctaatccggctgttagaaccgcggccgcaaatgccgccgctggggcagctgaaaacgctttcagagccccttag

SEQ ID NO: 133632 - DNA, 966 bp, Artificial Sequence
  Description of Artificial Sequence: Synthetic coding sequence
atggcccagtcacgcgatggcgggaatcctttcgcggaaccatctgaacttgataatccattccagcctcctcccgcctacgaaccccccgctccagcacctctgcctccacctagtgcaccatctctgcagcctagcagaaagctcagtcccaccgagccaaaaaattacgggtcttactctacacaggccagcgctgctgccgctacggcagagttacttaaaaagcaggaggagttgaatcgaaaagcagaagagcttgatcgccgggagagagagctccagcacgctgctctgggaggtaccgctacacggcagaacaactggccccctcttccctcattttgccctgtccagccctgtttttttcaagacatttctatggagatccctcaggaatttcagaaaacagtcagtaccatgtactatctctggatgtgttcaaccctggctctgttactcaacttccttgcttgccttgccagcttttgtgtcgaaactaacaacggggcgggctttgggctgtctattttatgggtcctgctcttcacaccctgcagttttgtatgctggtacagacccatgtacaaggcttttaggtctgacagtagttttaatttcttcgtgttcttctttatatttttcgtgcaggatgtgctctttgtcctgcaggcaattggcatacccggctggggcttctctggctggatttctgcactcgtcgttccgaaagggaacaccgctgtgagcgtgctgatgctcctggttgcgttgctcttcactggcattgctgtgctgggcatcgtgatgttaaaacgaattcactctctctacaggagaacaggtgcgtcattccagaaagcgcagcaggaattcgcagcaggcgttttttcgaacccggcagtaaggaccgcggccgccaacgcggctgccggagcagccgaaaacgctttccgggccccttag

SEQ ID NO: 133633 - DNA, 690 bp, Artificial Sequence
  Description of Artificial Sequence: Synthetic coding sequence
atgtctgagaaggagaataactttccacctcttccaaaattcattcctgtcaagccgtgtttttaccagaatttttctgacgagattcctgttgagcatcaggtcctggttaagcggatctatagactctggatgttttattgtgccacactgggagtcaacctaattgcatgtcttgcctggtggatcgggggagggtctggcacgaattttgggctcgcatttgtctggctgctcctgttcacaccatgtggctacgtgtgctggttccgcccagtgtacaaggcattcagagccgattccagcttcaacttcatggcattcttctttatctttggtgcgcaatttgtgctgaccgtgatacaggcaatagggttttccggctggggagcctgtgggtggctttcagcaatcgggttttttcagtactcacccggggcagccgtggtaatgcttttgccggctattatgttctctgtgagcgccgctatgatggcaatagccataatgaaggtgcatcgaatatataggggggctggcggcagtttccaaaaggcacagaccgagtggaataccggtacttggagaaacccgccatcccgtgaggctcagtacaataacttctctggcaactcattgcccgagtacccaaccgtcccatcttatccggggagcggccagtggccgtag

SEQ ID NO: 133634 - DNA, 588 bp, Artificial Sequence
  Description of Artificial Sequence: Synthetic coding sequence
atgtcggagaaggagaacaacttcccccccctgcctaaatttatccctgtgaaaccttgcttctatcagaatttttctgacgagatccctgtggaacatcaggttctcgtgaaacgcatctatcgtctctggatgttttactgtgcaacgctaggtgtgaatctgatagcctgtctggcatggtggatagggggcgggtctgggaccaactttgggctggcgtttgtatggctgcttttgtttaccccatgtgggtatgtttgttggttccggccagtgtacaaggctttccggggctggttgtcagcgattggcttttttcagtacagccccggggccgctgtagtaatgctcctcccagcaatcatgttcagcgtttccgccgccatgatggccattgccatcatgaaggttcataggatctaccggggcgccggcgggagcttccaaaaggctcagaccgagtggaataccgggacatggaggaaccctcctagcagggaggcgcaatacaacaatttctccggcaactccctgcccgagtatcccaccgtaccctcctacccaggctctggccagtggccctag

SEQ ID NO: 133635 - DNA, 588 bp, Artificial Sequence
  Description of Artificial Sequence: Synthetic coding sequence
atgatccagagacacattccagtatgtggcaggagccgtccttatcagcggggctgtgtcgtacaggcagggtcctctggcagccccggttggtctcacttcaagatcatatgtgggttggcacccgcaccttctgaggctgtgctgagcgcccggaacaattgcgagcataccggagggtgtaggctgcaacctgcgctggttggggaaacagagatgagcgagaaggagaataatttcccacccttgccaaagtttattccagtgaagccctgtttctaccaaaactttagtgacgagatccctgtggagcaccaggtgcttgtgaaaagaatttaccgactatggatgttctattgtgccacacttggggtcaacctaatcgcttgtcttgcttggtggattggcggcggctcagggaccaattttggattggctttcgtgtggctcctcctgttcaccccttgtgggtatgtctgttggttcagaccagtttataaggctttcagggctgactccagttttaatttcatggcgttttttttcattttcggagcccaattcgtgctaaccgtgattcaggcctag

SEQ ID NO: 133636 - DNA, 708 bp, Artificial Sequence
  Description of Artificial Sequence: Synthetic coding sequence
atggcagagaaagtcaataatttcccacccctcccaaaatttatcccactgaaaccctgcttctatcaggatttcgaagcagacattccaccacagcatgtgagtatgaccaaacgcctatactacttgtggatgttgaattctgttaccttggccgtgaatctggttggttgccttgcttggctgatcggtggcggaggagcgacaaacttcggccttgctttcctctggcttatcctgttcaccccatgctcctatgtctgttggtttagaccaatttataaagcattcaaaaccgactccagtttctcctttatggcgtttttttttactttcatggctcagctcgtgatctccattattcaggccgtgggtattcccgggtggggagtgtgtggctggatcgcaaccatcagctttttcggcactaacattggatcggctgttgtcatgctgatccccacagtaatgtttactgtcatggcggtgttcagttttatcgcattgtcaatggttcacaagttttatcgggggtcgggtgggtccttctccaaggcccaagaggagtggaccaccggggcttggaaaaatccccacgtgcagcaagccgcacagaacgccgctatgggggcagctcagggtgctatgaaccaaccccagacccagtacagcgctacccctaactacacctattcaaacgagatgtag

SEQ ID NO: 133637 - DNA, 708 bp, Artificial Sequence
  Description of Artificial Sequence: Synthetic coding sequence
atggctgagaaagttaacaattttccacccctacctaagtttattcctctgaagccatgtttctaccaggatttcgaagccgatatccctccccagcacgtcagcatgacgaagcgactgtactatctatggatgctcaattctgttacattagccgtaaacctggtgggttgtctggcttggctgatcggaggaggaggcgcgaccaatttcggcctcgcattcctttggttgattctgtttacaccatgtagctacgtgtgctggttccgccccatctataaagcatttaaaaccgactctagtttttcctttatggcctttttctttacatttatggctcagctcgtgatctccattatacaggccgtaggcattccaggctggggtgtgtgtgggtggatcgcaaccatttctttctttggaactaacattggaagcgcagtggtgatgctgataccaacagtgatgtttaccgtaatggctgtctttagttttattgcactctcaatggtccacaagttctataggggtagtggggggagcttttcaaaggcgcaggaagagtggactacaggggcctggaagaacccccacgtgcagcaagccgcacagaatgcagcaatgggagctgcccagggggcaatgaatcaaccgcaaacacagtatagtgccacgccaaactacacgtacagcaacgaaatgtag

SEQ ID NO: 133638 - DNA, 495 bp, Artificial Sequence
  Description of Artificial Sequence: Synthetic coding sequence
atgtttctacctcgcctcagaggcaggtactcctccccagcctgccagcacgaccaggccccgctgctgcctctggacgtcactgactcatccttctccttcatggccttttttttcacatttatggctcagcttgtgatcagcatcattcaggctgttggcatcccagggtggggcgtctgtggctggattgccactatcagtttttttgggacaaacattggatctgcagttgtcatgctgattccaacagtcatgtttaccgtcatggccgtgttctccttcattgcactttccatggtccacaagttttatcggggcagcggtgggagtttctcaaaggcccaagaggagtggaccaccggcgcctggaaaaatccgcacgtacagcaagcggcccagaacgccgccatgggagcagcccagggcgctatgaatcaacctcaaacgcagtattcggccacacctaactacacctactccaatgagatgtag

SEQ ID NO: 133639 - DNA, 1083 bp, Artificial Sequence
  Description of Artificial Sequence: Synthetic coding sequence
atgtttgtcgcgcgtagtatagccgctgatcacaaggatcttatacatgatgtctcgttcgactttcatggtagacgcatggccacttgctcttccgatcagagcgtcaaagtgtgggacaagtctgaatctggtgactggcattgcactgcctcgtggaagacccactctggctcagtgtggagggtgacctgggcgcaccccgagttcggccaggtgctcgcgtcatgctccttcgaccggactgccgccgtttgggaagagatcgtaggcgaatccaacgataaactcaggggccaatcccattgggtgaagagaacaaccctggtagactctagaacgagtgtaaccgatgtgaagtttgctccaaaacacatgggactaatgctagcgacgtgctctgcagatggaattgtgaggatatatgaggcgcccgacgtcatgaacctctcccagtggagcttgcaacacgagatctcatgcaagttgtcttgtagttgcatttcttggaatccatcatctagcagagcccattcacctatgatagcggtcggctcagacgattccagcccaaatgccatggcaaaggtacagatcttcgagtacaacgaaaatacccgcaagtatgccaaggctgaaacccttatgacagttaccgaccccgtgcatgacattgccttcgcacctaacctgggtagaagctttcatattctggcgattgccaccaaagacgtgcgcatcttcactctcaaacctgtcaggaaggagttgacttcatctggcggcccaacgaagttcgagatacacatcgtcgctcagttcgataatcataatagccaggtatggcgggttagctggaacataacaggaacagtgctggccagcagtggtgacgatggctgcgtgagactgtggaaagcgaactatatggataactggaagtgcacggggattctcaaaggaaacggctctccagtgaatggaagttcccagcaggggacttcgaatccatcacttgggtctacaatccccagtctgcaaaattctctgaacgggtcatctgccggccggaagcatagttag

SEQ ID NO: 133640 - DNA, 1266 bp, Artificial Sequence
  Description of Artificial Sequence: Synthetic coding sequence
atgttcgtagcccggtcaattgctgcagatcacaaagacctgatacatgacgtctctttcgatttccacggtcgcaggatggccacctgttcgtcggaccagtcagtaaaggtttgggataaaagcgagagcggagactggcattgtacagcatcctggaaaactcactccggatcagtgtggcgtgtcacatgggctcatcccgaatttggacaagtacttgcctcctgcagcttcgaccggacagctgcagtctgggaggaaatcgtgggcgaatcgaacgacaagcttcgcggccagtcacattgggtaaaaagaacaacactcgtggactctcgcacttctgtcaccgacgtaaagttcgccccgaaacacatggggctgatgctggctacctgtagtgcagacggcattgttcgcatctacgaagctcctgatgtgatgaacctcagccagtggagcttgcagcacgaaatatcttgcaagctgagttgtagctgtatcagctggaaccctagtagcagcagagcccattctccaatgatcgccgtgggcagcgacgacagtagtcctaatgcaatggctaaggtccagattttcgagtacaatgagaacacaaggaaatatgctaaggccgagactctcatgaccgtcaccgatccggtgcacgatatcgccttcgccccaaacctcgggcgctctttccacattttagcgatcgccaccaaggacgtgagaatcttcactctgaagccggtgaggaaggagctgacgagttccgggggtcccaccaagtttgaaatccacattgtggcacagtttgacaatcacaactcccaggtttggagagtaagctggaacatcacggggaccgtactggcatcatctggggatgacgggtgcgtccgcctctggaaggcaaactatatggataattggaagtgtacaggcatcctcaagggcaacggaagccccgtgaatggttcttctcaacaaggcacctctaacccaagcctgggctcaacgattccttccctgcagaactccctgaacggctcaagcgctggaagatacttttttacgcctctggacagtcccagagccgggagcaggtggtccagctatgctcagcttttgccaccccccccaccaccactagtagagcactcttgtgatgcggatacagctaacctgcagtaccctcacccccgtagacgctacttatctaggcctctgaacccacttcccgaaaacgaggggatttag

SEQ ID NO: 133641 - DNA, 3075 bp, Artificial Sequence
  Description of Artificial Sequence: Synthetic coding sequence
atgcccgccgctagaccccctgcggctggtttgcggggaatctcccttttcctggccctgctcctgggaagccccgcagctgctctcgaaagagatgctttgccagaaggcgatgcttctccgctgggcccatatctattaccatccggcgccccagagcgcggcagcccagggaaagaacatccagaagagcgggtggttactgcacccccaagttcaagccagtcggcagaagtgctcggcgaacttgttttggacggcacagcaccgtccgcacatcacgatattcccgccctgagtccactgctccctgaggaggcgaggccaaagcacgctttgcctccgaaaaagaaactccctagccttaagcaggtgaattcagcgcgcaagcaactgaggcctaaagcaacctcagccgcaaccgtgcaacgggctggttctcagcctgcatcccaaggcctggatctcctgagctcctcgacagagaaacccgggcctcctggagaccctgatccgatagtggctagcgaagaagcaagcgaggtgccattgtggctggacaggaaggagagtgctgtgcccaccactccagctccactgcagatttctccctttacctctcaaccctacgtcgctcacacattacctcagcgtccagagcccggtgagccaggtcctgatatggcccaggaagctccacaggaggatacgtctcctatggctctcatggacaagggcgaaaacgagctgaccgggagtgcatctgaagaatctcaagagaccacaacttccaccattattacgactacggtgatcaccaccgaacaggcccctgcactctgtagcgtgagcttctcaaaccctgaagggtatattgactcaagtgactaccctttgcttcccttgaataactttctggaatgcacctataacgtaaccgtgtacaccggttatggggtggaattgcaagttaaatctgttaacctgtcagatggcgaactgctctcaattcgaggcgttgatgggccaactttgacagttctggccaaccagactctgttagtagagggccaggtaattaggtccccaacgaatactatctccgtctattttcggacatttcaggatgacggacttggcacattccagctgcactaccaggccttcatgctgtcatgtaatttccccaggcgtccggattcaggagacgtaaccgtgatggatctgcattccggaggagtggcacatttccattgtcacttgggttatgaactgcaaggtgcgaagatgttgacctgtataaatgcttcaaagccccactggtccagtcaggagccaatttgtagtgctccatgcggtggagctgtccacaatgccaccatcggaagggtcttatctccttcctatcccgagaatacgaacggcagtcagttttgtatttggacaattgaggcaccagaaggccaaaagcttcacctgcattttgaacggctgctcctgcatgataaggataggatgactgtccactctggtcagacaaacaaaagtgcgttgctgtacgacagtttgcagacagagtcggtgccattcgaagggctcctgagcgaaggcaacactattcggattgagttcacaagcgaccaggcccgtgctgcctcaacatttaacattcgctttgaagccttcgagaagggtcattgttatgagccttatatccagaacggcaacttcacaacatcggatcccacctataacatcggtactatcgtggaattcacatgtgatcccgggcactcactggagcagggccctgctatcatcgaatgcatcaacgttcgggatccatactggaatgataccgagcctctgtgtcgggcaatgtgtggcggcgagctgagtgctgtagctggtgtcgtgctctccccaaattggccagaaccctatgtcgaaggcgaggactgcatctggaaaatacatgtaggagaggaaaagcgaatatttcttgacatccagtttctgaacctctcgaacagcgatattctgactatttatgatggcgacgaggtaatgcctcacatcctcgggcagtacttaggcaattcagggccgcaaaagctgtattctagcacgcctgatctcacgatccaatttcattcagatcccgccggactgatctttgggaaaggccaaggctttattatgaattatatcgaggtgtccaggaacgatagttgtagcgacctgccagagatccagaatggctggaaaactacgtcacacactgaactggttagaggcgcaagaataacctaccaatgcgaccctggctatgacattgtgggcagcgacaccttaacctgtcagtgggacctgtcctggtcctccgaccctcccttctgcgagaagattatgtactgcactgacccaggcgaggttgatcatagtacccggctgatatccgatccagtgctactcgtcgggactaccattcaatacacctgtaatccgggctttgttctcgaaggcagcagccttcttacgtgttattcacgcgaaacaggcacaccgatctggacgtcgcggctgcctcactgtgtgtccgaggagtccctagcctgtgacaacccaggcctcccagagaatggataccaaattctgtataagagactctatctgccaggcgagtctctgacattcatgtgctacgaaggctttgagcttatgggagaggtgaccatacgatgtatcctggggcaacccagccattggaacgggcctctgcccgtctgcaaggtgaatcaagactcctttgaacatgcacttgaagtggctgaggcagccgcagagacatccctcgaaggaggcaatatggctctggccatctttatccctgtcctgataattagcttgctgctgggcggcgcttacatttacatcacccgctgtaggtattactctaacttgcgtctgcccctgatgtattcacacccttattctcaaataaccgtggaaaccgagtttgacaatcccatttatgaaacgggtgagactcgcgagtatgaggtctccatctag

SEQ ID NO: 133642 - DNA, 2847 bp, Artificial Sequence
  Description of Artificial Sequence: Synthetic coding sequence
atgcctgcagccagaccacctgccgccggactgcgcggcatcagccttttcttggctctgctcctgggcagcccagctgctgctctcgaacgtgatgccctgcctgaaggcgacgcctctccccttgggccctatctgttgcccagtggcgcccctgagcggggttctcccggaaaagaacacccagaggagcgtgtggtgacagctcctccttcctccagccagtctgcggaagttctcggagagctggtattggacggcacagccccatcagcccatcacgacatccctgcactgagcccattgctcccggaagaggccagacctaaacatgcactcccccctaagaaaaaactgccttcattgaaacaagttaacagtgcacggaagcagttacgaccgaaagccacatcggcagcgacagtgcagcgtgccggctctcagcccgccagtcaagggctggatctgctgtcctcgagcacagaaaagccagggccaccaggagacccagacccgatagttgccagtgaggaggcctctgaagtaccactctggctggatcggaaagaatcggccgtgccaaccacacctgctcctttgcagatcagtccattcaccagtcagccatatgtcgctcacacactgccgcaacgccctgagcctggtgagcccggacccgacatggcacaggaagccccccaggaggacacaagtccaatggccttgatggacaaaggcgagaatgaactgaccggctccgcttccgaggaaagccaggagactactactagcaccataatcaccactaccgtgatcacaactgaacaggcgcctgctctttgttcagtctccttttcgaatccagagggctatatcgatagttcagactatcccctgcttccactgaataacttcttagagtgtacgtacaacgtgacagtctacactggctatggcgtcgagctgcaggtgaaatctgtgaatcttagcgatggcgaactgctctctattaggggagttgacggtcctacattaaccgtgcttgcgaatcaaaccctgttggtcgaaggccaagtgatcaggtctcctacaaacaccatcagcgtttacttccgcacatttcaggacgatggattaggtacattccagctacactaccaagcctttatgttaagctgcaacttccctagacgacccgattctggtgatgtaaccgtgatggatcttcacagcgggggcgtcgcccattttcattgtcacctagggtatgagttacaaggggctaaaatgctgacatgcatcaacgcctccaagccacattggtcctcacaggagccaatctgttcagcaccatgtgggggagcagtccataacgctaccatcggccgcgtgctgagcccttcataccctgagaacacaaacggatcacagttttgcatctggaccatcgaggcacctgaaggacagaaactgcatttacacttcgagcggcttttgctgcacgacaaggaccggatgaccgttcatagtgggcaaaccaacaaatccgcacttctatacgactcactgcagacagagtccgtgccttttgaggggttgctctctgaaggcaacacgattaggatcgaattcacatcagatcaagcccgagccgcaagcacattcaatatacggtttgaggctttcgagaagggacattgctacgaaccatacatccagaatggaaacttcaccacctctgatccgacctacaatatagggaccattgtggaatttacctgtgaccccggtcattcattggaacaggggcctgcgattattgaatgcataaatgttcgcgatccgtattggaacgataccgagcccctttgtcgggcgatgtgtgggggtgagctttctgccgttgctggtgtggtactgtcgccgaattggccagaaccctacgttgaaggcgaagattgcatatggaagatccatgtcggcgaggaaaagagaatcttcttagatatccagtttctgaatctctcaaattctgacattctcacgatctacgatggagacgaagtgatgccacatatattagggcaatatcttggaaactcgggtccccagaaattatactcatcaactccagacctaaccatccagtttcactctgatcccgctggactaatttttggtaaaggacaggggttcattatgaactacattgaggtaagccggaatgactcctgttccgatctgccagaaatccagaacggctggaaaacaacctctcatacagaactggtccgtggagcccgcatcacctatcagtgcgacccagggtatgatatcgtaggcagtgatacacttacatgccagtgggatctgtcttggagcagcgaccccccattttgtgaaaagataatgtactgcacagaccctggagaggtggatcacagcactaggcttatctctgatcccgttctgttggtggggaccactattcagtacacttgcaacccaggattcgtgctcgagggctcgtccttgctcacgtgttactcacgggaaactggtaccccgatctggacctcaaggctcccccactgcgtccttgcagaggccgcagctgagacatccttggaaggaggcaatatggccctcgccattttcattcccgtgttgatcatctcgctactcctgggcggcgcgtatatctatattacccgctgccggtactattctaacctccgcctgccccttatgtatagtcacccgtatagccagattacagttgaaacagagtttgataaccctatctatgagacaggcgaaacaagagaatatgaagtatctatctag

SEQ ID NO: 133643 - DNA, 2850 bp, Artificial Sequence
  Description of Artificial Sequence: Synthetic coding sequence
atgcctgccgccagaccacctgccgcaggcctgcgagggatttcgctgttccttgctcttctcctgggctcccctgctgcagccctcgaaagagatgctttgcctgaaggggatgcctcccctttgggtccgtatctgctgcccagtggggctcccgaacgggggtcccctggaaaggagcaccccgaggaacgggtcgttaccgcccctccaagcagttctcagagtgctgaggtgcttggtgaacttgtactcgacgggaccgccccctcagcacaccacgacataccagctctgtcacccctcctgccagaggaagctcggcctaagcatgccctgcctcccaagaagaaactcccatctttgaaacaggtcaattctgctcgcaaacagcttcgaccgaaagccacatccgctgccacagtccagagagctggatcgcagccagcgtcgcaagggctcgatttactctccagctctaccgagaaacccggcccccccggcgaccctgacccgatagtggcgtccgaagaagccagcgaggtgccattgtggctggataggaaggagagcgccgtccccactacaccggctcctttgcaaatttctcctttcacctcccagccttacgtggctcatacacttccccagagacctgagccaggggagcccggccccgatatggctcaggaagcccctcaggaagacacctcaccaatggctctgatggacaaaggggagaatgaactcaccggctccgcatcagaagaatctcaggagactacgaccagcaccattataacaaccaccgtgattacaacagagcaggcccccgccctgtgttctgtgagtttcagcaatcctgaggggtacatcgatagttcagactatccacttctgcctttgaataacttcttagagtgtacttataacgttaccgtgtatacaggctacggcgtggagctacaggtaaagtcggtcaatctctcagacggtgaactgctctccatccgcggagtagatggtccaaccctgacagtgctggccaatcaaaccttgctcgttgaaggacaagtgatcagatctccaacaaacacaattagcgtctattttagaactttccaagacgatggtcttggcacatttcagttgcactaccaggcctttatgttgagttgtaactttccccgaaggcctgactctggtgatgtaaccgtgatggacctccactctggtggtgttgcacactttcactgccacctggggtacgaactgcaaggggcgaaaatgctgacttgcatcaacgcaagtaagccacactggtcatcccaggagccaatctgtagcgccccatgcggcggggccgtccataatgctacaatcggacgagtactctctcccagctatccggagaacaccaatggatcacagttttgtatctggaccatagaggcacccgaggggcagaaactacatctgcacttcgaaaggttgctgctgcacgataaggatcggatgacagttcactctggacagacgaataagtccgctttattgtatgatagccttcaaactgaaagcgtcccgtttgaagggcttttaagcgagggaaacaccatccggattgagtttacatctgaccaagcccgggcagccagtaccttcaacatcaggttcgaggccttcgagaaagggcactgttacgagccgtatatccagaatgggaacttcaccacatccgatcccacttataatatcggcacaatcgtggagtttacatgtgaccccgggcactcacttgaacagggacctgcaattattgaatgcatcaatgtacgcgatccatactggaatgacacagaaccactctgtcgcgccatgtgcggtggtgagttaagcgctgtggctggggtggtcctcagtcccaattggcccgagccgtacgtggagggggaggattgcatctggaagatacacgtgggagaagaaaaacggatctttctggacatccagttcctgaacctatcgaattccgacatcctcaccatatacgacggtgatgaagtgatgcctcacatccttggccagtatctgggcaattcgggaccccagaagctatacagcagtacgccggacttaacaatccagtttcacagcgatcctgcaggattgatctttggaaaggggcagggatttatcatgaattacatcgaggtgtctaggaatgattcctgttcggatctaccagagattcagaacggatggaaaacaacctcgcacactgagctcgtaaggggggcccgcattacctatcagtgtgaccctgggtatgacatcgttgggtctgacacactcacatgtcagtgggatctcagctggtccagcgatccacctttttgtgagaagaccgaggagtccctagcctgcgataaccctggactgcccgaaaatgggtatcagatcttgtacaagcggctgtacctgcctggagagtctctgacctttatgtgttatgagggcttcgagctgatgggagaagtgacaattcgctgcattcttggccagcccagtcactggaacggaccattgccagtttgcaaggtggcagaagctgccgctgaaacttctctcgaggggggtaacatggctctagccatcttcattcccgtcttgatcatttccctactcttgggaggcgcatacatctacattactcgctgccgctactatagtaatttgaggcttccactcatgtacagccacccctattctcagattaccgttgagaccgagttcgataaccctatctacgagactggggaaactagagaatatgaagtatccatctag

SEQ ID NO: 133644 - DNA, 420 bp, Artificial Sequence
  Description of Artificial Sequence: Synthetic coding sequence
atgtattgcaccgacccaggagaagtggaccacagcacacgactaatcagcgacccagtactacttgttggaaccactatacagtacacttgtaacccaggcttcgtgcttgagggctccagccttctgacttgttactctagagagactggtactcccatctggaccagccgcctgccacactgtgtgtcagaggaatccctggcctgtgataatcccggtctgccagaaaacggttaccagatcttgtacaagcggctgtatttgcccggagagtcgttaactttcatgtgttacgagggcttcgagctaatgggcgaggtgaccattagatgcatactgggacagcccagccactggaatggacctctcccagtgtgcaaggatgtggcaaccatcccaacttcagcttgtctgtag

SEQ ID NO: 133645 - DNA, 3042 bp, Artificial Sequence
  Description of Artificial Sequence: Synthetic coding sequence
atgcccgcagcaaggcctcccgcagccggacttagaggcattagtttgtttcttgccctcctactcgggtccccagcagcggcactggagagggatgccctgcctgagggggacgcttcacccctgggaccttatctgctgcctagcggcgcccccgaacgcgggtctcctgggaaagaacatcccgaggaacgggtcgtcacggctccacctagttcatcccagtcagctgaagtgctgggcgagctggtgctggatgggactgccccatcagcacatcatgatatcccggcactctctccactgctgccggaggaagcccgcccaaaacatgccctccctccgaagaagaagctgccatccctcaaacaggtgaattccgcccgaaagcaattgaggccaaaggccacttctgctgccacggtacagagggcaggttcacagcccgcctcccagggattagacctgctgtcctcctctacggagaaacccggaccacccggggacccagacccaatagtggcctctgaggaagcctcagaggttcccctgtggctggatagaaaggagtcagctgtccccacaactccagcccctttacagatatctccatttaccagccagccatacgtggcccatactcttccccaacgcccagaacctggcgagcctggaccggacatggcccaggaggcccctcaggaggacactagccctatggccctgatggataaaggcgagaacgaacttaccggaagcgcatccgaggaatcacaagaaaccaccacctcaacaatcatcacaaccaccgtgattacaaccgagcaggcaccagccctgtgtagtgtcagttttagcaaccccgagggatatattgattcctccgactacccactgctgcctctcaacaactttctggaatgcacatataacgtgacggtttatactggatatggcgttgagttgcaggtcaaatcagtgaacctttcagatggcgaactgttatccatccgtggtgtggatggccccactctaacagttctggccaaccaaacactcctggtggaagggcaggtcatcaggtctcctactaacacgatcagtgtgtacttcaggacattccaagacgatggattgggcactttccaattgcattaccaggctttcatgcttagttgtaactttccaagacgcccagactctggagatgtgacggtgatggatctacatagcggcggtgttgcacacttccattgccatctcggctacgaacttcagggcgccaagatgctcacttgtatcaacgcaagcaagccccactggagtagccaggaaccgatctgttcagcaccttgcggcggcgctgtccacaatgcgacaatcgggagagtattgtcccctagctatccagagaacaccaatggatctcagttttgtatttggactattgaagcgcccgaaggacaaaagctgcatctgcacttcgaaagactcctgctacacgataaggacaggatgactgtgcacagcggtcagacaaataagagcgctctgctgtatgacagtctacaaactgaaagtgtgccgttcgaggggctcttgtcagaagggaacacaataagaattgaatttacgtctgaccaggcccgagctgcgagcacatttaacattcggtttgaggcgttcgagaagggtcactgttacgagccctacattcaaaatggaaactttacaacctccgaccccacctataacatcggaactatagtagaattcacatgcgatcccggacatagcctggagcagggaccagcgattatagagtgcataaacgtgcgggatccttactggaatgatacagagcctctgtgtagagccatgtgcggtggggagctatctgcagtggccggtgtggtgctgtcccccaactggcccgagccatatgtggagggggaggactgtatttggaagatccacgtgggagaggagaagaggatctttctggatatacagtttttaaacttgagcaacagtgatatcctgaccatctacgacggtgatgaggtcatgccacacattctcggccagtatttagggaacagcgggccacagaagctttacagctcgacacctgatttgaccattcagttccactcagaccctgccgggcttatctttggtaaggggcagggatttattatgaactatatcgaagtgtctcgaaacgacagctgtagcgatctgcccgagattcagaatggctggaaaacaaccagtcacacggaactggtgaggggagcaaggattacctaccagtgcgacccagggtatgatattgtgggtagcgatactctgacttgccagtgggacctctcttggagtagcgatcccccattctgtgaaaagatcatgtactgtacagatccaggtgaagtggatcatagtacacggctgataagtgatccagtgttgctcgtcggcacgactattcagtacacctgtaatccaggtttcgtcctggagggcagttcactgttgacctgctacagccgagaaacaggcacccccatctggacttctcggctcccccattgtgtgagcgaagaatccttggcctgtgacaaccctggtctgccagagaacggataccagatcttgtacaaacgcctctacttgccaggagagtcccttacgttcatgtgttacgagggctttgagctgatgggggaggttactatcagatgtatcctggggcaaccatctcattggaacggtcccctaccagtatgcaaggttgctgaggccgccgctgagacgtcactcgagggcggtaacatggccctggctatatttatacccgtgttgatcataagtctgcttctcggcggcgcttacatatacataacacgttgcagatactattccaatttgcggctgcccctgatgtacagtcacccatattctcagatcaccgtggaaaccgagtttgataaccctatttatgaaacaggcgaaacacgagaatatgaggtgagtatctag

SEQ ID NO: 133646 - DNA, 3072 bp, Artificial Sequence
  Description of Artificial Sequence: Synthetic coding sequence
atgccggcagcccgccctcccgctgcagggttgcgcggcattagtctgtttctcgcactcctgctggggtccccagccgcagccctcgaaagggatgcactgccagagggggatgcctcaccattgggcccctacctgctaccatctggggcccccgagaggggctctccaggcaaggaacatcctgaggaacgcgtcgttacagctcccccatcgagctcccaatcagccgaggttcttggagagctggtcctagacggcaccgccccttctgcccaccacgacatccccgccctgtcccctctgttgcccgaggaggccagaccaaagcatgccctgcctcccaaaaaaaaactgccatccctgaaacaggtcaatagtgccagaaagcagttgcggcccaaagctacctcggcggccacggtccaacgagcaggttctcagcctgcatctcagggtctggatctgctaagctctagcacagaaaagcccggaccacctggagaccctgaccccattgtggcttctgaggaggctagcgaagttcctttatggctggatcggaaggagtccgcagttcctactacccctgcccccttacagatctcacccttcaccagccagccctacgtggcccacactctgccgcagcgtcctgagcctggcgaaccgggaccagacatggcccaggaggcccctcaagaggacacctcccccatggcactgatggataagggcgaaaatgaacttaccggcagcgccagcgaagaatcgcaggagacaaccacgtctacgattatcacgactaccgtgatcactacggagcaagcgccagctctgtgcagcgtaagctttagcaaccctgaaggatacatcgactcatctgactatccactgttgccgttaaacaacttcctagaatgcacttataacgtaaccgtgtatactggctacggagtggagctgcaggtgaagtccgtaaatttaagcgacggtgagttactgagtatcaggggcgtcgacgggcctaccctcacggtcctggctaatcagaccctccttgtcgaaggacaagttatccggtcccccactaatacgatatctgtttattttaggacgtttcaagatgacgggcttgggacttttcagctgcattaccaggcgttcatgctctcctgcaacttccccagacgccctgatagcggcgacgtgacggttatggatctccattccgggggcgtggcacattttcattgtcatcttgggtacgagttgcagggtgcgaaaatgctgacctgcattaatgcatctaagccacattggtctagccaggaacccatctgctcagccccctgtggtggagcagtacataatgcaacaataggtagagtgctctctcctagctatccagagaataccaacggatcacagttttgcatctggaccattgaagctcccgaaggtcagaagctgcatctgcacttcgaacgtctgctccttcatgacaaggatagaatgaccgtgcactcaggacagacgaataaatcagccctcctgtacgactccctgcaaaccgaaagcgtcccttttgagggtctgctgtctgaaggaaacacaattcgaattgaatttacaagcgaccaggctcgggccgctagtaccttcaatatccggtttgaggccttcgaaaaagggcattgttacgaaccgtatatacagaacggaaattttactacgtcagaccctacttataatataggaacgatcgttgagttcacatgcgatcccggtcactccctcgagcagggtccagccataattgagtgtattaatgtgcgggacccatattggaatgacacagaacccttgtgtcgagccatgtgtggtggagagttgtccgctgtggctggcgtggtcttgagcccgaattggccagagccgtatgtggagggcgaagactgtatctggaagatccacgtaggcgaagagaagagaatattcctggacatccagtttctaaatttaagcaattctgacattctcacaatctacgacggcgatgaggttatgcctcacattctcggacagtatctaggcaattccgggccccagaagttatacagcagcactccagaccttactattcagtttcacagcgaccctgctggtttgatcttcgggaagggacaaggttttataatgaattacatcgaggttagccggaatgattcatgtagcgacctgccagaaatccagaacggttggaagactacttcccacactgagctggttagaggggccaggattacttaccagtgcgatccaggctatgatattgtgggctccgataccctcacatgtcagtgggacttgagctggtcaagcgatccccctttctgcgagaaaatcatgtattgcaccgaccccggagaagtggaccatagtacgaggttgatctctgatccggtgcttttagtgggaaccaccattcagtacacctgtaacccgggtttcgtactcgaagggtccagcctacttacctgctactcacgcgagacggggacacctatttggaccagccggctgccccactgcgtatccgaggagtcactggcgtgtgataatcctggcctgccggagaacgggtaccagatcctttacaagagactttatttgcctggagagtcccttacattcatgtgttacgagggatttgagctcatgggcgaggttaccatacgctgcatactgggacaacccagccattggaatggtcctttacccgtgtgcaaagtcaaccaagactcatttgagcacgctttagaggccgaggccgcggccgagactagcctggagggaggcaatatggctctggcaatctttattcccgtcctaattataagcctcctcctgggcggcgcttatatatacatcacacggtgcaggtattatagcaaccttaggctcccgttgatgtacagccacccttacagccagattacagtcgagactgaatttgacaacccaatctatgaaacaggggaaacgcgcgagtacgaggtatccatctag

SEQ ID NO: 133647 - DNA, 258 bp, Artificial Sequence
  Description of Artificial Sequence: Synthetic coding sequence
gggtttgggaccgatgtcgattatgagaccgccttcatccactacaggctcgcctccgagcagcaacattccgcccaagcaatgtttaatttgggatacatgcatgaaaaaggcctgggcatcaaacaggacattcatctggccaaaagattctacgatatggcggcctctcaacctcggtgcacttctagcagcctgccctcaccactgcagatcggccggcggctcttccttgctgttcacactggtaataaatag

SEQ ID NO: 133648 - DNA, 2385 bp, Artificial Sequence
  Description of Artificial Sequence: Synthetic coding sequence
atgagggtgcgcatagggctcactctcttactgtgtgcagtactgctctctctggcatccgcctcctcagacgaggaaggttctcaggacgagagtctcgattcaaaaacaaccctgacctcggatgagagcgtcaaggaccacactacagcaggacgagtggtggctgggcagatcttcctcgacagcgaggagagcgaactcgaaagcagcattcaagaggaggaggacagcctcaaatcacaggagggcgaaagtgtgaccgaagacatcagtttcctagagtcccccaaccctgaaaataaagactatgaagagcccaagaaagtgcgtaagcccgctctgacagcgattgagggaacggcccatggtgagccttgccatttccctttcctgtttctagacaaggagtatgatgaatgtacttctgatggcagggaggacggcagactttggtgtgctactacttacgactataaggcggacgagaagtgggggttctgcgaaaccgaggaggaggccgcaaaaaggcgccaaatgcaagaagccgagatgatgtaccagacggggatgaagatactcaacggaagcaacaaaaaaagccaaaaaagggaagcatatcggtacctccagaaagccgcaagtatgaatcacactaaggccttggaacgggtaagttatgcattgctgttcggcgactatctacctcagaacatccaggcggctagggagatgttcgagaaactcacagaggagggcagtcccaagggtcagaccgccttgggttttttgtacgcctctggcttgggggtgaattctagccaggccaaagccctggtatattacacgtttggcgcacttggaggaaacctgattgcgcatatggtactgggataccggtactgggccggtattggcgttctgcagagttgtgagtctgcgctgactcattacagactggtcgccaaccatgttgcatcagacatctcactgacagggggctctgtggtgcaacggatccgcctgcccgacgaagtggagaaccccgggatgaactctggcatgctggaggaggatctgatacagtattatcaattcttagctgaaaaaggcgacgtgcaggcacaggtggggctggggcaactacatcttcacgggggtagaggcgtggaacagaatcaccaacgggctttcgactatttcaatctggccgcaaatgccggtaatagccatgccatggcctttctgggcaaaatgtacagcgagggatccgatattgtcccccagtccaatgagacagcactccactactttaaaaaggcagctgacatgggcaatccggtcggtcagagcggtctcggcatggcctatctgtatgggcgaggcgtacaggtgaattacgacctggccctgaagtacttccaaaaagccgccgaacaaggctgggtggatggtcaactgcagctgggtagcatgtattataacggaataggagtaaaacgcgattataagcaggccctgaagtatttcaaccttgccagccagggaggtcacattctagcattttacaacctggctcaaatgcacgctagtggcactggagtcatgcgctcttgccacaccgcagttgagttgttcaaaaatgtgtgtgagcgtggacgctggtcagagagactcatgaccgcctataattcctataaagatggcgattataacgccgccgttatccagtatctgctgctggctgagcagggatacgaagtagcccagtctaatgctgcctttattctcgaccagagggaggcgtctattgttggcgagaatgaaacttatcctagagcacttttgcattggaatagggcagcatcccaaggttacacagtggcacggattaaactcggggactaccatttctatggattcggcaccgatgttgattacgaaacagcttttattcattaccggctagcttctgaacagcagcacagtgcacaggctatgtttaatttaggttatatgcatgagaaaggcttgggcatcaaacaggatatacacctggcgaagcggttctacgatatggctgcagaggcttctcctgacgcccaggttcctgtcttcctggccctctgcaagttgggagtcgtatacttcctccagtatatcagggaaactaacattcgggacatgtttacccaattggatatggatcaactgcttggcccagaatgggatctttatctcatgacaataattgctctgctgctgggcacagtgatcgcctaccgccagcggcagcatcaagacatgccagcgccacgacccccagggccccgtccagccccacctcagcaagaaggcccgcccgagcagcagcccccccagtag

SEQ ID NO: 133649 - DNA, 906 bp, Artificial Sequence
  Description of Artificial Sequence: Synthetic coding sequence
atgagagtccgaattggcctcacgttgttgctgtgtgctgtgttactgagcctggccagcgcctcttccgacgaggagggaagtcaggatgaatccttggattcgaagaccaccctgacttccgatgagagtgtgaaggaccacacaaccgcgggacgggtggtcgctggacagatatttttggacagtgaggaatccgagttggaatcaagcatccaggaagaggaagatagcctcaagagtcaggagggcgaaagcgtcaccgaggacatctcctttctggaatccccaaatcctgaaaacaaagactacgaagagccgaagaaagtaaggaagccagccttaactgcgattgagggaaccgcacatggggagccatgccacttccccttcctatttctggacaaggagtacgacgaatgcacttcagacggtcgggaagacggacgtctgtggtgtgccacgacctacgactacaaggcagatgagaagtggggattctgcgagacagaagaagaggccgctaagcgaagacagatgcaggaggccgaaatgatgtatcagacaggaatgaagatcctcaacggatcaaataaaaaatctcagaagcgcgaggcctatagatacctgcaaaaagcagctagcatgaaccatactaaagccttggagagagtctcctatgccctgttatttggtgactacctcccccagaacattcaagctgcccgtgaaatgttcgaaaagcttacagaggaaggtagtccaaaaggccaaacggcattaggtttcttatacgccagtggccttggagtaaactcctctcaggcgaaagccttggtctattacacattcggcgccctgggcgggaatttgatcgcacatatggtcctcgtgtcaagactttag

SEQ ID NO: 133650 - DNA, 2067 bp, Artificial Sequence
  Description of Artificial Sequence: Synthetic coding sequence
atgaagcccttatcacttttaatagaaatcctcatcattttgggcgtgacgataaagaccatcaaggctgaagaacacaacaaaaggcagaaggaacgtaatgtgaccacccaggttagtgttaatgagattaaacaatacttgagccacatcctggagcaaagaaccagctcaaatgtcatcaataagagggaaaacctactggagaaaaagaagaaccagaggaaaatccggattaaagggattcagaataaggacatcctgaagagaaacaagaaccacttgcaaaaacaagccgagaaaaattttaccgacgagggagatcagctctttaaaatgggaataaaggtgcttcaacagagcaagagccagaaacagaaggaggaagcatacctcttgttcgctaaggctgccgacatgggcaacctcaaggctatggagaagatggctgatgctctcctgttcgggaacttcggagttcagaacatcacagcggcgattcagctgtacgaatccctggcgaaggaaggttcctgtaaggcgcagaatgcgctggggttcttaagcagttatggcatcggtatggagtacgaccaggcaaaggccttaatttactacacattcggctcggcaggtggtaatatgatgtcacagatgatcctgggctacagatacttatccggtatcaacgtgctgcagaattgtgaggtggcattgtcctactataagaaagtggccgactatatcgctgatacattcgagaaatccgaaggtgtgccagtggaaaaggtccgactgactgaacggccggagaatctctcgtctaactcagagatccttgattgggatatttaccaatattacaagtttctggcagaacggggtgacgtgcagatacaggtcagcctcggtcagctacacctgatcgggcgcaagggcctggaccaggactactataaggcccttcattactttttaaaagctgcaaaggcagggtctgcaaacgcaatggcatttattgggaaaatgtatctggagggcaatgcagcggtaccccagaataacgcaaccgccttcaagtattttagcatggcggcgtcaaaaggcaacgcaattggactccatgggctgggacttctgtacttccacggcaaaggggtccctctcaattatgctgaggccctgaagtatttccagaaggccgctgaaaaaggatggcctgacgcccagtttcagcttggctttatgtactactccgggtctggaatttggaaggactataaattggccttcaaatatttctatttggcctcccaaagtggtcagcctctggctatctattatctggcgaagatgtacgccacaggcactggagtcgtgcggtcgtgcagaactgcagttgagttatataagggggtgtgtgagctgggtcattgggccgagaagtttctaaccgcctatttcgcatacaaggacggcgatatcgatagctctctcgtacagtacgctctgctggctgagatgggctacgaagttgcacagtccaactcagctttcatcttggaatcaaagaaagcaaacatcttggagaaagagaagatgtacccgatggctctgttgctgtggaatcgcgctgcaatccagggaaatgcctttgccagggtgaagatcggagattatcattattacggctacggcacaaaaaaggattatcagactgctgccactcattattccattgctgctaacaagtaccacaatgctcaggcaatgttcaacctggcctacatgtacgagcatggacttggcatcacgaaggacatacacctagctcggcggctgtacgacatggccgcccagacatctcccgacgctcatatcccagtattattcgcagtgatgaaactggaaacaacacacttgctgagggacatcctgttctttaactttactacgaggtggaattggttgaagctcgacaatacaataggcccacactgggatttattcgtcattgggcttatcgtccccgggttgatcctgttgttgagaaaccaccacgggtag

SEQ ID NO: 133651 - DNA, 1728 bp, Artificial Sequence
  Description of Artificial Sequence: Synthetic coding sequence
atgaagcccctgagcctgctgatcgaaattttgattattttaggagtcactatcaagactataaaagctgaggagcacaacaaaagacagaaagagcggaacgttaccactcaagtctctgtgaatgaaattaagcaatacctttcacatatacttgaacagaggaccagctccaatgttatcaacaaacgcgagaatctgcttgaaaagaagaagaaccagagaaaaatccggataaagggaatacagaacaaggatatattaaaaagaaataaaaatcaccttcagaaacaagctgaaaaaaactttacagacgagggcgaccagctgtttaagatgggcattaaagtgctgcagcaaagtaaatctcagaaacagaaggaggaggcatacctcctgtttgcaaaggcagcagatatgggaaacctgaaggccatggaaaagatggctgacgctctcctgtttgggaactttggggtgcagaatattacggcggccattcagctgtacgaaagcttggcaaaagagggatcgtgtaaagctcagaatgctctgggattcctcagtagctacggcataggaatggagtacgaccaggctaaggcgctgatctattacactttcggctcggcagggggcaatatgatgtcacagatgatccttggttaccgctacctcagtggaatcaatgtgctgcagaattgcgaagtggcccttagctattacaaaaaagtcgccgactacatcgctgacacattcgagaaatcagagggcgtgcccgtggaaaaggttagactgacggagcgccccgagaacctgtcaagcaacagtgagatactagattgggacatctaccaatactataagttcctagcggaacggggtgacgtccagatacaggtgagtttgggacagctgcatttaatcgggaggaaaggtctggatcaggactattacaaggccctgcactattttctgaaggccgctaaagctggcagcgccaatgccatggctttcatagggaagatgtacttagagggcaatgccgcagtcccccagaacaacgcaacggcctttaagtacttctctatggcggccagcaaaggaaacgccatagggctgcatggactgggcctgctgtatttccacggcaagggagtacctctgaattatgcggaagccctcaagtactttcagaaggcagccgagaaagggtggccagacgcccagttccaactcggttttatgtattactccggaagtggaatttggaaagactataaactagcctttaagtatttttatctggctagtcagtcggggcagcccctagccatctactacttggcgaaaatgtacgccaccggaactggggtggttcggtcctgtaggactgcagtggagaagaggctcacatttttaaaaaagcgtaggtgtattcagtggcggtttagctacggcatcgaactccccttcaaggacatccatctggctcggagactgtacgacatggcagctcagaccagccccgacgcccacattcctgtcctgttcgcagtgatgaagctggagacaacccatctgctgcgggacatcctttttttcaactttacaacacgatggaactggctaaaactggataatacaataggcccacactgggacctgttcgtgatcggattaatcgttccaggcttgattctgctgctacggaatcaccatggatag

SEQ ID NO: 133652 - DNA, 1833 bp, Artificial Sequence
  Description of Artificial Sequence: Synthetic coding sequence
atgattgcaagccagttcctgtcagcgttgaccttagtgttgctgattaaagagtcaggcgcctggagctataatactagcacagaggcaatgacctacgatgaggcctccgcctattgccagcagcggtacacccatcttgtcgccatacagaataaggaagagattgagtacctgaactcaattttgtcatattctccctcatactactggatcggaatccggaaggtgaataacgtgtgggtgtgggtggggacacagaaacccctgacagaggaggccaaaaactgggctccgggggagccgaacaatagacagaaggacgaggattgcgtggaaatctacattaaaagagagaaagacgtcgggatgtggaatgatgaacgatgctctaaaaagaagttagcgctgtgctacaccgctgcatgtacaaacacaagctgctctggtcatggggagtgtgtcgagacaatcaacaattacacatgcaagtgcgatccaggtttttcaggtctgaagtgcgaacaaattgtgaattgtacagcgcttgaaagtcccgagcatggatccctggtctgcagtcaccccctgggcaatttctcgtataacagttcctgtagcatcagctgtgatcgaggctatctcccgagtagtatggagacaatgcagtgtatgtccagcggagagtggagcgcccccattcccgcttgcaatgtggtggagtgtgatgcagtgactaatcccgctaacggattcgtggagtgttttcagaatccaggcagcttcccctggaacacaacatgcacatttgactgtgaagaaggcttcgaactgatgggcgctcagtccctccagtgcacatctagcgggaactgggataatgagaagcccacctgcaaagccgtcacttgtcgcgcagtgagacagccccagaacggttctgttcgatgcagccattcaccagcaggagaatttacattcaaaagttcctgcaatttcacttgtgaagaggggtttatgcttcagggccccgcccaggtcgagtgcactacccaaggacaatggactcagcagatccctgtgtgcgaagcttttcagtgcacggccctgtctaacccagagagggggtacatgaactgcctgccttccgcaagcggtagttttcgatacggatcatcgtgtgaattctcttgcgaacagggtttcgtcctcaaaggttctaagcgcctgcagtgtgggccaaccggagagtgggacaatgagaaaccgacctgtgaggctgtccgatgtgatgcagtacatcagcctcctaaaggactggtgaggtgtgctcatagcccaataggcgagtttacatataagtcctcgtgcgccttctcatgcgaggagggtttcgagttacacggatccacacaacttgagtgtacgtcccaaggccaatggacagaagaagttccaagctgtcaggtggtaaagtgctctagtctggcagtgcctggaaagatcaacatgagctgcagcggggagccggtgtttgggacagtgtgtaagtttgcctgtcccgagggatggacattaaacggctccgccgctcggacctgcggggcaacgggccactggagtgggctcctgcccacctgcgaagcaccaacggagtccaatatcccgctggttgctggtctttcagcggctggactgtccctgctcaccttggcacctttcctgctgtggctgcggaaatgtctccgaaaagccaaaaagttcgtccccgcttccagttgtcagtccctggagagcgacggatcctaccaaaagccttcctatattctttag

SEQ ID NO: 133653 - DNA, 1455 bp, Artificial Sequence
  Description of Artificial Sequence: Synthetic coding sequence
atgatagccagccaatttctgagtgccctgaccttggtacttctcatcaaggagtctggagcatggagttataacacttccaccgaggccatgacctatgacgaagctagtgcgtattgccaacagcgatacacgcacctcgtagccatacagaacaaggaggaaatagaatacctcaactcaatcctgtcttattcaccatcttattactggataggcatccggaaggtcaataatgtctgggtttgggtgggaacgcagaagccgctgaccgaggaggcaaagaattgggcccccggcgaacccaataacagacagaaagatgaggactgtgttgagatttatatcaagcgggagaaagacgttggaatgtggaatgacgagcgctgcagcaagaaaaagctggcgttatgttataccgctgcatgtactaacacctcctgctctggacacggggagtgcgtggaaaccatcaacaattacacatgcaagtgcgacccgggtttttccggtcttaagtgcgaacagatagtgaactgtactgcgctggaatcccccgagcatgggagcctggtgtgtagccaccctttaggcaacttctcttataactcatcctgttccatatcctgcgatcgcggttacttgccaagtagcatggaaaccatgcagtgcatgagtagcggagagtggtccgcccctattccggcctgtaatgtggtggagtgcgatgccgtgactaacccagctaacggctttgtggagtgtttccaaaatcctggttcctttccctggaacaccacatgcacgtttgattgcgaggaggggttcgagttgatgggcgctcaaagtctgcaatgtacatcatccggcaattgggataatgagaagcccacctgcaaagctgtaacatgtagggctgtgcgacagccacaaaatgggagcgtaaggtgttctcatagtccagctggagagtttactttcaaaagcagctgtaatttcacatgcgaagaaggattcatgctccagggtccagctcaggtggagtgcacgacccaggggcagtggacgcagcaaattcctgtctgcgaggtggtcaaatgttccagcttagcagtcccagggaaaataaatatgagttgttcaggagagccagtctttggcactgtctgcaagttcgcctgtccagagggatggaccctgaatggaagcgcagctcggacttgcggtgccacagggcactggagcgggctactccctacgtgtgaagcccctacagagagtaatatccccttggtcgcgggcctatccgccgccggcctatccctgcttactctggcacccttcctgctgtggctgcggaagtgtctgagaaaggctaagaagttcgttcctgcatctagttgtcagtcactggaatccgatggttcttaccagaagccgagttatatcctttag

SEQ ID NO: 133654 - DNA, 1458 bp, Artificial Sequence
  Description of Artificial Sequence: Synthetic coding sequence
atgatagccagccaatttctgtctgcactgactttggtgctgcttataaaggagagtggggcgtggtcttacaacacaagcacagaggcaatgacctatgacgaggcctccgcctactgccaacagcgatacactcatcttgttgcaattcaaaataaggaagaaattgaatatcttaatagcattctctcttacagcccgtcttattattggatcggcatccgaaaagtgaataacgtgtgggtgtgggtcggcactcagaaacccctgacagaagaggcaaaaaattgggctcctggcgagccaaataatcggcagaaagatgaagactgcgtggagatatatatcaaaagagagaaagacgtcggcatgtggaacgatgagcgatgcagcaaaaagaaattggcgctatgctacaccgctgcctgtacgaatacgtcgtgctccggccacggcgagtgtgtcgaaaccattaataactacacctgcaaatgcgacccgggctttagcggcttgaaatgcgagcagatggtagaatgtgacgctgtcaccaacccggccaacggcttcgtagagtgttttcaaaatccgggatcatttccgtggaatacgacctgcacatttgattgtgaggaaggctttgagcttatgggcgctcaatcgctccagtgcacgagttccggtaactgggacaacgagaaacccacatgcaaagcagtcacatgccgtgctgtccggcaaccccagaacgggtcagtgcgttgtagtcactctcccgccggcgaatttactttcaaatcatcttgcaatttcacttgtgaggaaggctttatgcttcagggcccagcccaggtggaatgtacaacccaaggacaatggacccaacagattccagtctgcgaggccgtccggtgtgacgccgtgcatcagcccccaaagggtctcgtgaggtgcgcacacagcccaataggtgagttcacttataagtcatcctgcgctttcagttgcgaagaaggattcgaactacacggcagtacacagctggagtgcactagtcaggggcagtggacagaagaggtcccctcatgccaagtcgtgaaatgttcctcactcgccgtgccaggcaaaattaatatgtcatgctcaggcgaacccgtgttcggtaccgtgtgcaaatttgcttgtcctgaaggatggaccctgaatgggtccgccgcccgcacgtgtggcgccacaggacattggagcgggctgttgccaacctgcgaggccccaacagagagtaatatccccctggtagcaggcctgtcagccgccgggctgtccctgctcaccctagctccattcctcctctggttgaggaagtgtctcagaaaggctaagaagtttgtgccggcctcatcctgccagagtcttgagtcagacggctcttatcagaagccatcatacattctttag

SEQ ID NO: 133655 - DNA, 1644 bp, Artificial Sequence
  Description of Artificial Sequence: Synthetic coding sequence
atgatcgcatctcagtttctgagcgcgctgactcttgtgctgctgataaaggagtccggggcgtggagctacaatacatcaacagaggccatgacttacgatgaggcgtctgcgtattgtcaacagagatatacacacctcgtcgctatccagaataaagaggagatcgagtatctgaattctattctgtcctatagtcctagctactattggattggaattcgaaaggtcaacaatgtgtgggtatgggttggaacacagaagccgctgactgaggaagctaaaaactgggcccctggcgagcccaataatcggcagaaagacgaggactgcgtggaaatctatatcaagcgcgagaaagatgtcggcatgtggaacgatgagagatgctctaagaagaagctcgccctgtgctacacagctgcctgcaccaatacctcctgtagtggccacggagagtgcgttgaaaccattaacaactatacttgcaaatgcgatcctggcttcagtgggctgaaatgtgaacagatagtgaattgtacagctctagagtccccggagcacggaagtctggtgtgctcccaccctctcggcaacttttcttataattcttcttgcagcatcagctgtgaccgtgggtatcttccctcaagtatggaaacaatgcagtgcatgtccagtggggaatggagcgcacctatccctgcctgcaatgtggtggagtgtgacgccgtgacaaaccccgctaatggattcgtggagtgtttccaaaatccagggagcttcccctggaacactacctgtacgttcgactgcgaggaaggtttcgagcttatgggcgcccagtcacttcaatgcacttcctctggcaactgggacaacgagaagcctacatgtaaagccgtgacttgcagagccgtgcgccagccacaaaacggtagtgtgaggtgctctcacagccctgccggtgagtttacctttaagtcatcttgtaactttacatgcgaggagggtttcatgctgcaagggccagcacaggtagagtgcactacacagggccagtggacgcaacaaattcccgtgtgtgaggcagtgcggtgcgatgccgtccaccagccaccgaaaggattagtacggtgcgcgcactcacctatcggagagtttacgtacaagagttcatgtgccttttcctgtgaggaaggctttgagcttcatgggtcaacacagttggaatgcacctctcagggtcagtggaccgaagaagtgccctcctgccaggttgtcaagtgcagcagcctcgctgtgcccggaaagatcaatatgtcttgttcaggggaaccagtctttggcactgtttgcaagtttgcctgtccagagggatggacacttaacgggtcagctgcgcggacttgtggcgcaacgggtcattggtcgggacttcttccgacctgtgaggcccctacagagtccaacatcccactcgtggcgggacttagtgccgccggcctatcactgctcacccttgcccccttcctcttgtggttacgcaagtgcttgcgcaaagccaaaaaattcgtgcctgccagctcttgtcagtcactggagtcagatggtagttatcagaaaccaagctacatactgtag

SEQ ID NO: 133656 - DNA, 1644 bp, Artificial Sequence
  Description of Artificial Sequence: Synthetic coding sequence
atgattgccagccagtttctgtctgcgttgaccctggttctgctcatcaaagagagcggagcctggtcctataatacctctacggaagcgatgacatatgacgaagcttccgcctattgtcagcaacgctacacacacctcgttgcgatccagaacaaagaggaaatcgagtatctgaactccatccttagttatagccccagttattattggattggtatacgaaaggtcaacaacgtgtgggtgtgggtagggacccagaaaccactaactgaggaggcaaaaaactgggcgcccggcgagcccaacaaccggcagaaagatgaggattgtgtcgaaatctatataaagcgtgaaaaggatgtcgggatgtggaatgatgagcgctgcagtaagaaaaagctcgctttatgctacaccgcagcttgcacaaatacgagttgcagcgggcacggtgaatgcgtagagaccatcaacaactacacatgtaagtgcgaccccgggttttctggccttaagtgcgaacaaatagtaaactgcactgcattagagtccccagagcatggaagtcttgtgtgttctcatccattaggtaattttagctataattcaagttgctccattagttgcgataggggctatctgcctagctctatggagaccatgcagtgtatgtctagcggcgagtggtcggcccccatcccggcgtgcaacgtggtggagtgtgacgccgtgactaaccccgctaatggatttgtggaatgcttccagaatcccgggagcttcccctggaataccacttgcaccttcgactgcgaggagggattcgagctgatgggcgcacagagcttacagtgtacatcaagcggcaactgggataacgagaagccaacatgtaaggcagtgacatgcagagctgtgaggcagccccagaatggctccgtgaggtgttcccatagcccagccggagagttcacctttaagtcatcgtgcaacttcacgtgtgaagaaggcttcatgctgcagggcccggctcaggtcgaatgcaccacacaagggcaatggacccaacagattcccgtgtgtgaggcattccagtgtacggcgctcagcaaccctgagagggggtacatgaattgtctgcctagtgcctccggatcctttcgatatgggtccagttgcgagttctcttgcgagcaggggttcgtgcttaagggctcaaagaggctgcagtgtggcccaacaggtgagtgggacaatgagaaaccgacttgcgaagtagtaaagtgcagctcattggccgtgcccggcaagataaatatgagctgctcaggggagccggtgtttggtactgtttgcaagtttgcatgtcctgaaggatggaccctgaacgggagcgctgctaggacctgcggcgccactggacattggtcagggctcctgccaacatgcgaagctcccaccgaaagcaacatcccactcgtggcaggcctctccgcagctggactgtccctgctaacactcgctcccttcctgttgtggctgagaaagtgcttgcgaaaagctaagaaattcgtgcctgcttcatcatgtcagtccctggagagcgatggaagctaccaaaagccatcttacattctctag

SEQ ID NO: 133657 - DNA, 1455 bp, Artificial Sequence
  Description of Artificial Sequence: Synthetic coding sequence
atgatcgcatctcaattcctgtccgcattaacgctcgtcctcctgattaaagagagcggcgcctggtcttataacaccagcactgaagccatgacatacgacgaggccagcgcatactgtcagcaacggtacacccaccttgttgccatccagaacaaagaggaaattgaatatttgaattccattctgagctactctcctagctactactggattggcatcagaaaggtgaataatgtgtgggtatgggtgggtacacaaaaaccattaacggaggaagctaagaactgggcccccggagagccgaacaaccgccagaaagatgaggattgtgtcgagatatatattaagcgcgaaaaggatgtgggtatgtggaacgacgagcgatgttccaagaaaaaactggctctgtgttacactgcagcctgtacaaatactagctgctccggccatggcgagtgtgtagagactatcaataactacacctgtaaatgcgatcccggctttagtgggctcaaatgtgaacagatagtgaattgcaccgcactggaatcacctgaacacggaagcctggtgtgctcccatcctctcggcaatttctcttataactccagctgctcaattagttgtgaccgggggtatctcccctcatccatggaaacaatgcagtgtatgtcctcaggagaatggtccgcacccatacccgcgtgtaacgtggtggaatgcgacgcagtcaccaatcccgcgaatggcttcgtagagtgtttccaaaaccctggtagctttccatggaacacaacttgcacttttgattgtgaagaggggttcgaactcatgggcgctcagagcctgcaatgtacaagttctgggaattgggacaatgagaagccaacttgcaaagcagtaacttgtagagcagtgaggcaaccgcaaaacggcagcgtaagatgtagtcactcccccgcgggggagtttacatttaagtcatcttgtaactttacttgtgaggaaggtttcatgcttcaaggtccggctcaagttgaatgcaccactcagggccagtggactcaacagatcccggtgtgcgaagtggttaagtgcagctcattagccgttcccggtaaaatcaacatgtcttgctctggcgagcccgtttttggtacggtttgtaagtttgcctgccccgaaggttggaccctgaatgggtccgccgccaggacctgtggggcaactggccactggagcgggttgctccctacatgtgaggcacccactgagagtaatatacccctggtggccgggcttagcgctgccggcctgtcccttctaacactggcgccatttttgctctggttacggaaatgcctgcgtaaagcaaaaaaatttgtgccggcgtccagctgtcaaagcctggaaagtgacggttcttaccagaagccatcgtacattttgtag

SEQ ID NO: 133658 - DNA, 1458 bp, Artificial Sequence
  Description of Artificial Sequence: Synthetic coding sequence
atgatcgcctctcagttcttatcagctctgacactggtgctgttgataaaagaatcaggagcctggtcctataatacttcgaccgaggcgatgacctacgacgaagccagtgcatattgccagcagcggtacacacacctcgtcgccatccagaataaagaagagattgagtacttgaattcaattctctcttatagcccaagctactactggattggaatccgcaaggtgaacaacgtttgggtctgggtcgggacacagaagcccctgacagaggaggcgaaaaattgggctcccggcgaacccaacaaccgccagaaagatgaggattgcgtggagatctatataaaacgcgaaaaggacgtaggtatgtggaacgacgagcggtgtagtaaaaaaaagctcgccctttgctacacggccgcgtgcacaaatacatcctgcagcggacacggagaatgtgtggaaacgataaataactacacttgcaagtgcgatcctggcttcagcggcttgaaatgcgaacagatggtggaatgtgatgcggtcacaaacccagccaacgggttcgtggagtgtttccagaaccccgggtccttcccatggaataccacttgcacatttgattgcgaagaggggttcgagctcatgggtgctcagtcactacaatgtacaagctctggcaactgggacaacgaaaagcctacctgtaaagctgtgacatgtcgggcagttcgacagccccagaacgggtccgtgcgatgcagtcactctccagctggggaatttacattcaagagctcttgcaactttacctgtgaggaggggtttatgttgcaagggccggcacaggtcgaatgtaccacgcagggccagtggacccagcagatacccgtgtgcgaggccgttcgctgcgatgccgtccatcagcctcctaagggtctcgtgagatgcgcccacagccctatcggtgaatttacatacaaaagctcgtgtgctttttcctgcgaggaaggtttcgagctgcacggcagcactcaattagagtgtacttctcaggggcagtggactgaagaggtgccaagctgccaggtcgtaaaatgtagttccctcgccgtgcccggaaaaatcaacatgtcttgtagcggcgagcccgtttttgggaccgtctgcaaatttgcctgcccagagggatggaccttaaatggaagtgccgcaaggacttgtggtgccacagggcattggagtggactacttccaacatgtgaggcccccacagaatccaacatacccctcgtggcgggcttgtcggcggcaggcttgtcgctgctaacattggcaccattcctgctgtggctgcggaagtgcctccgtaaggccaaaaaatttgttcctgcctcaagctgtcagtcactggaatctgacggcagctaccagaagccttcatatattctttag

SEQ ID NO: 133659 - DNA, 1644 bp, Artificial Sequence
  Description of Artificial Sequence: Synthetic coding sequence
atgatagcctctcaatttctgagcgctctaacactcgtccttttaattaaggagtccggagcttggagttataataccagcactgaagccatgacctacgatgaggcttccgcctactgccagcagcgttatacccatcttgtggctatccagaacaaagaagaaatcgaatacctcaattccattctctcttatagccccagctactattggatcgggatcagaaaagtcaataatgtctgggtgtgggttggcacacagaaaccactgacagaggaggctaagaattgggcacctggcgaacctaacaacagacagaaggacgaggattgcgtcgagatctacataaaacgtgaaaaggacgttggcatgtggaatgatgagagatgtagcaaaaaaaagctggcactgtgttacactgctgcctgcactaacaccagttgttcgggacacggggagtgcgtcgagaccatcaacaactatacatgtaagtgcgatccggggttcagcggtctgaaatgtgaacagatcgtgaactgcacagcccttgagtcccctgagcacggaagtctagtgtgcagccacccactgggcaacttctcctataattccagttgttcaatctcttgcgatagggggtacctgccatcaagtatggagacgatgcaatgtatgagttcaggtgaatggtctgctcctatccctgcttgtaatgtggttgaatgcgatgctgtgactaatcctgcaaacgggttcgtggagtgcttccagaatcccggttccttcccatggaataccacttgtactttcgattgtgaagaaggattcgagctgatgggagctcaatccctgcaatgtacgtccagtgggaattgggataacgagaagccgacatgcaaggcagtgacatgccgcgctgtacgtcagcctcagaatggaagtgtaagatgctcccacagccctgctggagagttcacattcaagagcagttgcaacttcacttgtgaggagggtttcatgctgcagggacctgcccaagtcgagtgcacaacacaaggccaatggacccagcagattccagtatgtgaggccgttagatgcgacgccgtacatcagcctccgaaaggactggttcggtgcgcgcacagcccgatcggagaattcacatacaaatcttcatgtgccttttcttgtgaggaaggctttgaactgcatggcagtactcaactggaatgcaccagtcagggacagtggacggaggaagtgccatcatgtcaggtggtaaaatgcagctcattagcagtccctggtaagattaatatgtcttgttctggagagcctgtgttcggtactgtgtgcaagttcgcctgcccagaaggttggaccctgaatggcagcgcagccaggacgtgtggagccaccgggcactggtccggactgcttcccacttgcgaagcccctactgagtctaacattcccctggttgcaggtctttcagctgcaggtctctcactgctgacactagccccatttttactttggctccggaaatgcctaagaaaagccaagaagtttgtgcccgcctcttcatgccagtcacttgagtccgacggcagttaccagaagccaagttacattttgtag

SEQ ID NO: 133660 - DNA, 1644 bp, Artificial Sequence
  Description of Artificial Sequence: Synthetic coding sequence
atgattgctagccagtttctatccgctctgaccttagtgctccttattaaagagtcgggagcctggtcatacaatacctctactgaggctatgacgtatgatgaggcctcggcctactgtcagcaacggtacactcatctggtcgccatccagaacaaagaagaaattgaatacttgaatagcatcctgtcatatagcccttcttactattggatagggatacgtaaggtgaacaatgtttgggtgtgggtggggacccaaaaaccactcactgaggaagccaagaactgggctccaggagaacccaacaatcgtcagaaagacgaggactgtgtggaaatttacatcaagagggagaaagatgtggggatgtggaacgatgagcggtgcagcaagaagaaactggctctctgttatactgctgcatgcactaacacgagctgcagcggtcatggcgaatgcgtggagaccataaataactatacctgcaaatgtgacccagggttttctgggctgaaatgcgagcagatcgtgaattgtacagctctcgagtcccccgagcacggttccttggtgtgtagccatccactggggaacttctcctacaacagctcttgcagtatcagttgcgaccggggctatctgccttcatcaatggagaccatgcaatgcatgtccagtggcgaatggtctgcaccgatacccgcctgtaatgttgtcgagtgtgacgccgtaactaaccccgcaaatggattcgtggagtgctttcagaacccggggagcttcccctggaacaccacgtgcactttcgactgcgaagaaggattcgagctcatgggcgcccagagcctgcagtgcaccagtagcggtaactgggataatgaaaaaccaacttgcaaggcagttacgtgccgcgcggttaggcagcctcagaatggctctgtgcgctgctctcatagcccagccggcgaattcactttcaagtcgtcttgcaactttacatgcgaggagggtttcatgctccaggggccggcccaggtggagtgcaccacgcagggtcaatggacccagcaaatccccgtatgcgaggccttccaatgcactgctctgagcaatccagagagaggctatatgaactgccttcccagcgcctcaggtagcttccggtacgggagctcctgtgagttcagctgtgagcagggattcgtgctgaagggtagcaagcggttacagtgtgggcctaccggagagtgggacaatgagaagccaacctgtgaggttgtgaagtgcagctccttggcagtccccggaaagattaacatgagttgcagcggcgagccagtgtttgggacggtctgcaagtttgcatgccccgagggctggaccctcaacggtagcgccgccaggacatgcggtgccaccggccactggtctgggttgcttcctacatgcgaagcacccacggaaagcaacattccattagttgccggtctttccgcggcagggttgtctctgcttaccctggccccgttccttctgtggctaagaaaatgcctgcggaaagctaaaaagtttgtgccagcctcttcttgccaaagcctggagagcgatgggtcctaccaaaagcctagttacattttgtag

SEQ ID NO: 133661 - DNA, 1158 bp, Artificial Sequence
  Description of Artificial Sequence: Synthetic coding sequence
atgggttgtaggcgcacgcgggagggcccttcaaaggctatgatctttccatggaaatgtcagtcaacacagagagatctgtggaacatttttaagctatgggggtggacaatgctctgttgcgactttcttgctcaccacggcaccgactgctggacttatcattattccgagaagcccatgaactggcaacgggcgaggaggttctgccgtgataactacaccgacttggtagctatccaaaacaaggctgagattgaatatttggagaaaaccctcccattttccagatcttactactggattggcatcaggaaaatcggtggcatttggacttgggtcgggaccaataaatccctcaccgaagaagcagagaattggggtgatggcgagcctaacaacaaaaagaacaaggaggattgcgtcgagatctacattaaacgtaacaaggacgcaggcaagtggaatgacgacgcttgtcataagttaaaagcagctctgtgctacactgcaagttgccagccttggtcttgtagcggacacggcgagtgcgtggagataatcaacaactatacttgcaattgtgacgttggctattatggaccccaatgtcaattcgtcattcagtgtgaacctctggaggcccctgagctggggactatggactgtactcatcctctgggaaatttttctttcagctcacagtgtgcattctcatgctcggagggaaccaatctaacaggtatcgaggagaccacctgtggcccgttcggtaattggtcttccccagagcctacctgccaggtcatccagtgtgagcctctgtctgcaccagaccttggaataatgaactgcagccaccccttggcgtcattttcctttacttctgcatgtacattcatctgctctgagggcactgagctgattgggaaaaagaagacaatttgtgagtcaagcggtatctggagcaatccaagccctatatgtcagaagctggacaagagcttctctatgattaaggaaggagattacaaccctttgtttattcctgtggcagtgatggttactgctttctccggactggcgtttatcatctggctggccaggaggctcaagaaaggtaaaaagtctaaacggtccatgaatgatccttattag

SEQ ID NO: 133662 - DNA, 2493 bp, Artificial Sequence
  Description of Artificial Sequence: Synthetic coding sequence
atggctaactgccagatcgctattctgtaccagcgcttccagcgggtcgtttttgggattagccagctcctatgttttagcgccctgatttcggagctgaccaatcagaaggaggtcgctgcatggacgtaccactacagcacaaaagcctactcctggaatattagccgcaagtactgccagaacagatacaccgacctcgttgctatccaaaacaaaaatgaaatcgactatcttaacaaagtgcttccctattattcatcttattactggatcgggattcgaaaaaacaacaagacatggacatgggtgggcacgaagaaagcactgacaaacgaggcggaaaattgggcagataacgagcctaataacaagagaaataatgaggattgcgttgagatctatattaaaagtccatcggcccctggcaaatggaatgacgagcactgtcttaagaaaaaacatgccctgtgctacaccgccagctgccaagacatgagctgcagcaaacagggtgagtgccttgaaaccattgggaactatacgtgctcatgttatcctggattttatggccctgaatgtgaatacgtccgggagtgtggggagcttgagctgcctcaacacgttttgatgaattgctcccaccccctcggcaacttctccttcaacagccagtgttctttccactgcacagacggttaccaggtgaatggtcccagtaaattagagtgtctggcttctggaatctggacaaacaagcctccccagtgcttggcagctcagtgtccacccctcaagattcccgaacggggcaatatgacctgcctgcacagcgccaaggcctttcagcatcagtctagctgtagcttttcctgcgaagaagggtttgcattggtcggcccagaggtagtgcagtgtaccgccagcggtgtttggacagctcctgcgccagtctgtaaggctgtgcagtgccagcatctcgaagcccccagtgaaggaaccatggattgcgtccaccctctgaccgcgttcgcctatggctcgagctgcaagttcgagtgccagccgggctacagagtgagagggcttgatatgctccgatgcatcgactcagggcactggagcgccccactacccacctgcgaggctattagctgcgagcctctggagagtccagtccacggctctatggactgtagccccagtctgcgggcattccagtacgatactaattgcagttttagatgtgccgaaggttttatgctgcgcggtgctgacattgtgcgatgtgataatctgggccagtggactgccccagccccagtgtgccaagcgctccagtgccaggatctgccagtgccaaacgaggcacgggttaactgttctcacccctttggggcattcagataccagtccgtttgttcctttacttgcaacgaggggctgctcctggttggtgccagcgtcctacaatgtctggcaactggaaactggaactccgttccccctgagtgccaggccatcccctgcaccccgctcctgagtccccagaacggaactatgacatgcgtgcaaccactcggcagctctagttacaagtccacgtgtcagtttatttgtgacgaaggctattctttgtctggcccggagagactagattgtacaaggtctgggcggtggacagattcacctcccatgtgcgaagctatcaagtgtcctgaactctttgctccagaacaggggtcactcgactgttccgacaccaggggagaattcaatgtgggctccacttgccactttagttgcgacaacgggttcaaattggagggcccaaacaatgtagagtgcaccacaagcggccgatggtctgccaccccgccgacctgtaagggaatagcaagtctccccacccctggtgtgcaatgccccgccctgactacacctggccaaggaacaatgtattgtcgtcaccacccaggtacattcggtttcaatacgacttgttactttggatgtaacgccggtttcacacttatcggcgacagcacactctcctgcagaccaagtggtcagtggacagcggtgactccagcctgtcgggcagtcaagtgttctgagctgcacgtcaataaaccaattgccatgaactgcagcaacttgtggggaaacttcagctacggctcaatctgtagtttccactgtctggaagggcaactcctgaacggctcagctcaaacagcatgccaggagaatgggcactggagtactaccgtgcctacttgccaggctgggcccctaaccatccaggaggccctgacgtacttcggcggtgccgtggcctccactatagggctcattatggggggcaccctgctggccctgctcagaaaacgttttcgacagaaggatgacggtaagtgtccactcaatccccactctcatctgggtacctacggagtgttcacaaacgccgcattcgatccctccccttag

SEQ ID NO: 133663 - DNA, 2307 bp, Artificial Sequence
  Description of Artificial Sequence: Synthetic coding sequence
atggcgaactgccagattgccatcctgtatcaacgttttcaaagggtggttttcggaatcagccagctgctgtgtttctctgccctcatcagcgagctgacaaaccagaaagaagttgctgcttggacttaccactactctacgaaagcatactcttggaatatcagtagaaaatactgccaaaaccgttatacagacttggtagccatccagaataagaatgaaatcgattacctgaataaagttctaccatactacagttcatactattggatcgggattagaaagaacaacaaaacctggacttgggttggaaccaagaaggctttaacaaatgaagccgaaaactgggccgacaatgaacctaacaacaagagaaataacgaagactgcgtcgagatttacattaaatccccctccgcgccaggcaagtggaatgatgagcattgcctgaaaaaaaagcacgccctgtgctatacggccagttgccaagacatgtcttgtagcaagcagggagaatgtctggagacaataggaaattatacatgctcttgttacccaggtttctatggccccgagtgcgagtatgtccgcgaatgcggagagctagagctgccccagcacgtgctgatgaactgtagccacccccttggcaacttttcttttaacagccaatgctctttccactgcactgacggctaccaagttaacggtcctagcaagcttgaatgcctggcctccgggatttggactaacaaaccgcctcaatgcctggctgcccagtgtcctccactgaagatccccgagcggggcaatatgacatgcctgcacagcgcgaaggccttccagcaccagtccagttgctcattttcctgtgaggagggtttcgccctcgtcggtcccgaggtagtgcagtgtacagcgagcggagtgtggacagctcccgcaccggtatgcaaagcgatcagctgtgagcccctggagtctcccgtccacggaagcatggattgcagcccatccctccgggctttccaatacgacacaaattgttccttccgatgcgctgaagggttcatgctgagaggcgcagatattgtcagatgcgacaacctcggtcagtggacagcccccgctcctgtgtgccaggctctgcagtgtcaggacttacctgtccctaacgaggcccgcgtgaattgctcccaccctttcggcgccttccgctaccaatctgtgtgttccttcacctgtaacgagggacttctactcgtcggggcttcagtccttcagtgccttgcgaccggcaattggaacagcgtcccaccggaatgccaggcaattccctgcactccactcctaagtcctcagaatggcaccatgacatgcgtgcagcctctgggaagctcctcttacaaatcaacctgtcaattcatctgcgatgagggatatagtttgagcgggcccgagagattggattgtacacgctcaggaagatggacagacagtccccctatgtgcgaggcaatcaagtgtcccgagctcttcgccccagagcaaggatcgctggattgttcggatacaaggggtgaatttaatgtgggcagcacatgtcatttcagctgcgacaatgggtttaaacttgagggacccaacaatgtcgaatgtactacctcaggtaggtggtcggctaccccccctacctgcaagggaatcgcctctctgccaactccaggggtgcagtgtccagcactgaccacgccaggacaaggtacaatgtactgtaggcaccacccaggcacatttggctttaacactacttgttactttggctgcaatgccggcttcaccctcatcggagactcaacactgtcctgccgcccttccggacagtggaccgcggtcacccccgcttgccgagcagtcaagtgttccgaactgcacgtcaataaaccaattgcaatgaactgttcgaatctttgggggaacttcagctatggctccatctgctcgttccactgtctagagggtcagctgttgaacggaagtgcacaaaccgcctgccaggaaaacggccactggagtacaactgtgcctacatgtcaggcgggaccactaactattcaggaggcgttgacatattttggaggcgcagtagccagcaccatcgggctcattatgggcggcaccctactggctctcctgagaaaaaggttccgacagaaggatgacggcaaatgccctctcaacccacatagccatcttggtacctacggagtctttacaaacgctgcctttgatccgtccccttag

SEQ ID NO: 133664 - DNA, 2307 bp, Artificial Sequence
  Description of Artificial Sequence: Synthetic coding sequence
atggcgaactgccaaattgccatactctaccagaggtttcagagggtcgtatttggaataagccagcttctttgcttctctgccttgattagcgagctcacaaatcagaaagaagtggctgcctggacataccattacagcacaaaagcctactcgtggaatataagcagaaagtactgccagaataggtatacagacctggttgcgattcaaaacaagaatgagattgattatttgaataaggtgttaccatactactccagctattactggatcggcatcaggaaaaataataaaacctggacatgggtggggaccaagaaggcactgaccaacgaggcagagaattgggccgataatgaacccaacaataaaaggaacaacgaggattgcgtagagatctatattaagagtcccagcgcaccagggaagtggaatgatgagcattgtttgaaaaaaaagcatgcactgtgctatactgcatcctgtcaggatatgagttgctcaaagcaaggtgagtgtttagaaactatcggcaactacacttgttcatgttacccaggcttctacggacccgagtgtgagtacgtccgagaatgcggtgagttagaacttcctcaacacgtgctcatgaactgttctcaccctctggggaattttagcttcaattctcagtgctcattccactgcactgacggctaccaggtgaatggcccgagcaagctcgaatgtctggccagtggaatatggactaataaaccccctcagtgtctggccgttcagtgccagcacctagaggctcccagcgaaggcacaatggattgcgtccacccactgaccgctttcgcttatggatcaagttgtaagttcgaatgccagccagggtaccgagttcgtggccttgacatgctgcggtgcattgatagcggacactggagcgctccactgccaacttgcgaggctatcagctgcgaaccacttgagagccctgtgcacgggtctatggattgtagcccttcgctccgtgcatttcaatacgataccaactgctcatttcggtgtgcagaaggttttatgttacgtggagccgatatcgtgagatgtgacaatctgggacagtggactgctccagcacccgtatgtcaggcgctccagtgccaggacctgcccgtccccaatgaagccagggtgaattgttcccatccgtttggagcgtttcgctaccaatcggtgtgctcattcacctgtaatgagggacttttactagtgggagcgtctgtattgcagtgtcttgcgactggcaactggaactccgtccctcccgaatgccaggcgatcccatgcactccattgctctcccctcagaacggtactatgacctgtgtccagcccctggggtcgagctcctacaagagcacatgccagttcatatgtgacgaagggtactctctttccggcccggagcggctcgactgtacaagatccgggcgctggaccgactctcctcccatgtgcgaagcaatcaagtgtcccgaactttttgcacccgaacaaggctctctcgattgctccgacacacgaggagaattcaacgttgggtctacctgccatttttcatgcgataacggctttaagcttgaggggccgaataacgtggagtgtacgacaagcggcaggtggtcagcaactccccctacctgcaaaggcatcgcaagcctccctacccccggagtgcagtgccccgccttaacaacccctgggcaggggacaatgtactgccggcaccaccctggaactttcgggttcaacactacatgctacttcggatgcaacgccggctttacactcataggcgactccacactgtcatgccgtcctagtggtcagtggactgcagtcactcccgcttgcagagcagtaaagtgctcggagctgcacgtgaataagcccatcgcgatgaattgttctaatctgtgggggaatttctcgtacggtagcatatgctctttccactgtctcgaggggcagctgttgaacggctctgcccaaaccgcctgccaggagaatgggcattggtcaacaactgtgcctacctgccaagccggccctctgacaattcaggaagccttaacgtacttcggcggcgcggtagctagtacaattggcctaattatgggaggtacccttctggctctcctgcggaaacgcttcaggcagaaggacgacgggaaatgtcccctgaatcctcactcgcatctgggaacttacggcgtgttcaccaacgcggccttcgacccatctccatag

SEQ ID NO: 133665 - DNA, 1941 bp, Artificial Sequence
  Description of Artificial Sequence: Synthetic coding sequence
atggccaactgtcagattgcgattttgtatcagagattccaacgggtggtgttcggcatctcccagttactgtgtttctctgctctcatatccgaactgaccaaccagaaggaagtagccgcttggacttaccattatagcaccaaggcgtacagctggaacataagccgcaaatactgtcaaaatcggtacaccgatctggtggcgattcagaacaagaacgaaatcgattatttaaacaaagtgctgccatactactccagctactattggatcgggatcaggaagaataataaaacttggacgtgggtgggaaccaagaaggcgcttaccaatgaggccgaaaactgggccgacaatgaaccaaacaacaaacgaaataatgaagattgcgtggagatctatattaaatcgccttcagcccctgggaaatggaacgatgaacactgcctgaagaaaaagcatgccctctgctatacagccagttgccaagacatgtcgtgttcaaagcagggagaatgtctcgagaccatcggaaactacacatgtagctgttacccggggttttacggaccagagtgtgaatatgtgcgggagtgcggagaacttgaattgccacagcacgtgctcatgaattgcagccaccccctcgggaattttagtttcaactctcagtgctccttccactgcaccgacggttaccaggtgaatggcccttccaaattagaatgtttggcatcaggcatatggacaaataagccacctcagtgcttggcggctcagtgtccgccgcttaaaattcctgagaggggaaacatgacgtgcctgcatagtgctaaagctttccagcaccagtcatcctgtagtttctcctgcgaagagggcttcgctctcgtagggcccgaagtggtgcagtgcaccgcgagcggggtttggacagctcccgccccagtctgtaaggccatatcatgcgagcccctggagtccccagtgcatggcagcatggattgctctcctagccttcgcgcatttcagtacgacacaaactgttccttcagatgcgccgagggatttatgttgaggggcgccgatattgtgcggtgtgacaacttgggccagtggaccgctccggcccccgtctgtcaggcactgcaatgtcaggatctgcctgtgcccaatgaagcaagagtcaactgctctcaccctttcggtgccttccggtaccagagtgtctgcagcttcacctgcaatgaaggcttactcttggtgggtgcatccgtcctgcaatgtttagcaaccggaaattggaacagtgtcccaccggagtgtcagggcaagtctatagcctcactgcccacaccaggggtgcagtgccccgccctgacaactccagggcagggtaccatgtattgcaggcaccaccccggaacctttggatttaatactacatgctactttggatgcaatgccggctttaccctgattggcgactctaccttatcttgtcggccctcaggtcagtggaccgcagtgacacctgcttgcagggccgtgaaatgctcagagctgcacgtcaacaaacccattgccatgaattgctcaaacctgtgggggaactttagttatggttcgatctgctcatttcactgcctcgagggacagctgcttaatggcagtgcccagacagcttgccaggagaacggtcactggtctactaccgtccctacttgtcaagcaggtccactgaccattcaggaggccctaacatacttcgggggagcagtggcctccaccattggcctcatcatgggcggtacactgcttgcacttcttagaaagcggtttcggcagaaggatgatggcaaatgtccactaaatccccacagccaccttggcacctacggcgtgtttactaacgccgctttcgatcctagcccatag

SEQ ID NO: 133666 - DNA, 2493 bp, Artificial Sequence
  Description of Artificial Sequence: Synthetic coding sequence
atggccaactgtcagatcgcaatcctgtatcagcgtttccagagggttgtgtttgggatatctcagctgctctgcttcagcgctctcatctccgaactgactaaccagaaagaagtggctgcatggacctatcattactctactaaggcgtacagttggaatatcagtcgcaaatattgccagaatcgttatactgacttagtagcaatacagaacaagaacgaaattgattatctgaataaggtgcttccatattatagctcctattactggatcggcattagaaagaataacaagacgtggacatgggtgggtactaaaaaggcattaaccaatgaggccgagaattgggcggacaacgagcccaacaataaacgtaataacgaggactgcgtggagatctacattaaatcgccctctgctcccggaaaatggaatgacgagcattgtcttaagaagaaacacgccttgtgctacaccgcaagctgtcaagacatgtcctgcagtaaacagggtgagtgcctcgagacaataggaaactacacctgtagctgttatccaggcttttatggccccgagtgtgagtacgtgcgcgagtgtggcgagctagagctgccgcagcacgtgctaatgaactgcagccatccactcggtaacttctcttttaacagtcaatgctcgttccactgcacggacgggtatcaagttaatggtcctagtaaactcgagtgccttgcatctggaatttggacaaataaacctcctcaatgtttagctgcccagtgccctcccctcaagattccagaaagggggaatatgacttgtcttcatagtgccaaggcattccaacaccaatcgagctgttcctttagctgcgaggagggatttgccctagtgggcccagaggttgttcagtgcaccgcatcaggtgtatggaccgccccagctcccgtgtgcaaagccgtccagtgtcagcacctagaggcacccagcgaaggtacgatggactgtgtgcacccactgactgccttcgcctatggttcctcctgcaaattcgaatgccaacctggttacagagttcgcggcctcgacatgctgcgctgcatcgattccggacactggtctgcaccattgccaacatgtgaggccatttcctgcgaacccctggagagccctgtgcacggatcgatggactgctctccttctctacgtgcctttcagtatgatacaaactgtagctttcgttgtgctgagggctttatgctgagaggagcagacattgtacgttgcgacaatctgggccagtggactgccccggcacccgtgtgccaagcgctgcagtgtcaggatctaccagtgccgaacgaagctcgggttaactgctctcacccctttggcgcttttcgttaccagtcagtttgtagtttcacttgtaatgaagggttgctgcttgtgggggcttccgtcttacagtgcctggccaccggcaactggaactctgtaccccccgagtgccaggctattccttgcacaccactattgtctccccagaatggtaccatgacgtgcgtgcagccactaggctcatcttcgtataagagcacttgccagtttatctgcgatgagggatactcccttagtggacccgaacgactggattgcacacgttcagggcggtggacagattctccaccgatgtgcgaagccattaaatgtcccgagctgttcgctcccgagcaaggaagcctcgactgcagtgatacaagaggagaatttaacgtgggctcaacatgtcatttcagttgtgacaatggttttaagctcgaagggcctaacaacgtggaatgtaccacaagcggcagatggtcagccacgcctcctacctgcaaaggcatcgccagtctacccactccgggtgtacagtgcccagctctgactacaccaggccagggaacaatgtactgcaggcaccaccctggaacattcgggttcaatacaacctgttatttcggctgtaatgccggttttactttaataggcgattccaccctctcatgccgcccatctggccagtggactgccgtgactccagcttgcagggcagttaagtgctccgaactccatgtcaataaaccaattgctatgaattgttccaatctgtggggaaattttagctatggaagtatttgttctttccactgccttgagggacagctgcttaatgggagcgctcagaccgcctgtcaggagaacggtcactggtcaaccactgttcccacatgtcaggctggaccactcacaatacaggaggctctgacgtacttcggaggagcagtggcctccacaatcgggctgatcatgggcgggacgctcttggcgctactgcgaaaaaggtttcggcagaaggacgatggcaagtgcccgctcaacccacattctcacctaggcacttatggagtgtttaccaacgccgccttcgatccctccccgtag

SEQ ID NO: 133667 - DNA, 1935 bp, Artificial Sequence
  Description of Artificial Sequence: Synthetic coding sequence
atggcaaactgtcagatcgccattctgtaccagaggtttcaacgcgttgtatttggaatatcccagctcctatgcttctctgctttaatctccgagctcaccaaccaaaaagaagtcgccgcctggacataccactattcgactaaagcgtactcttggaacatcagtcgcaagtactgccaaaaccgctacaccgatctagtcgcgattcagaataagaatgagatcgattatctcaacaaagttctgccatactactccagttactattggattgggataagaaaaaacaataagacttggacctgggtagggaccaagaaagccctgactaatgaggccgaaaattgggccgataacgagcctaacaataaacgcaataatgaggactgtgtggaaatatacatcaagtctccaagtgcacccggcaagtggaacgacgaacactgcctgaaaaagaaacacgctctttgctataccgccagttgccaggatatgtcctgtagcaagcagggagaatgcttggagacaatcggcaattacacctgcagctgttaccccgggttttacggtcctgagtgcgagtacgtgagagaatgtggagagctcgaactaccacaacatgtcctaatgaattgtagccaccccttaggcaacttttccttcaattcgcaatgttcctttcactgtactgacgggtaccaagttaacgggccaagcaaactggagtgtctcgcatccggcatatggaccaacaagcctcctcaatgtcttgcggcccagtgcccaccgcttaagatcccagaacgcggtaacatgacctgcctccactcggccaaggctttccagcatcagtcctcttgttcattctcctgtgaggagggcttcgctctggtggggcctgaggtggtccagtgtaccgccagtggggtgtggaccgctccagcacccgtgtgtaaggcactgcagtgtcaggaccttcctgtcccaaacgaggcccgtgtgaattgcagccatccttttggagctttccgataccagtcagtgtgcagctttacgtgtaatgaggggctcctgctggtgggggcctcagtccttcagtgcctggcaaccggaaattggaactctgtgccgcccgagtgtcaggccatcccatgtacacccctgctcagcccacaaaacgggactatgacttgtgtgcagccacttgggagttcttcatacaaaagcacctgccaattcatttgcgacgagggctatagcctcagcggcccagagcggctggattgtactcggtccggccggtggacagacagcccacctatgtgtgaaggcattgccagcctccccacccctggagtgcagtgtccagccttaacaaccccaggccagggtaccatgtattgtagacaccaccccggcacgtttggcttcaataccacatgctatttcgggtgtaacgccggctttaccctcatcggcgattccacccttagctgcagaccttctgggcaatggaccgccgtcacacccgcttgcagggcagtcaagtgcagcgaactgcacgtgaacaagccaatcgctatgaattgtagtaatctgtgggggaacttctcctacggatcaatttgcagtttccactgtcttgaaggacagctgctcaatggatctgcccagaccgcttgtcaggagaacgggcattggtctacaacagtgcccacctgtcaggcgggaccactaaccatccaggaagccctgacttatttcggcggagcagtcgcctctactataggcctcataatgggggggacactcctcgcactcctcagaaaacgatttaggcaaaaggatgatgggaaatgccctctgaacccacactcacacctggggacgtacggcgtgttcaccaacgctgcgtttgaccccagtccatag

SEQ ID NO: 133668 - DNA, 1941 bp, Artificial Sequence
  Description of Artificial Sequence: Synthetic coding sequence
atggccaattgtcaaatcgccatactttaccagcggtttcaacgcgtagtgtttgggatttcccaactgttgtgtttcagcgccctgatctctgagctcaccaaccagaaggaagtggccgcttggacctatcattactccacaaaggcatatagttggaacatctccaggaaatactgccagaaccgatacactgacctggtggccatccagaacaaaaacgagatagactatcttaacaaggtgctcccttattatagctcctactactggatcggcattcgcaagaacaataagacatggacttgggtcgggacaaagaaggcccttactaacgaagccgaaaactgggccgataatgagccgaacaataagcgaaataatgaggattgcgtcgaaatctacatcaagagcccttccgcacctggtaaatggaacgacgaacattgtctgaagaaaaagcacgctctatgttatacagctagctgtcaagacatgtcctgcagcaaacagggagagtgcctggaaaccatcggcaattacacatgctcttgctatcctgggttctatggccccgagtgtgagtatgttcgggagtgcggggagttggaactgccacagcatgtactcatgaattgctcacaccccctgggaaacttcagctttaattcacagtgtagtttccattgtaccgacggctaccaagtaaacggccccagcaagcttgagtgtctggcaagtggcatttggacaaataaacctccccagtgcttagctgcccagtgccctccattgaagatacccgagcgggggaacatgacctgtctgcactccgcaaaggcatttcagcaccagtctagctgcagcttttcttgcgaagaaggatttgccctggtggggccggaagtggtccagtgcaccgccagcggcgtgtggacagcgcctgcacccgtgtgtaaggctatcagctgtgagccccttgaaagccccgttcatggtagcatggattgttctccttccctccgagccttccagtatgacaccaactgctccttccgctgcgctgaggggtttatgctgcggggagcagatattgtaagatgcgataacctgggccagtggacagcccctgctcctgtgtgccaggccttgcagtgccaggacctgcctgtgccaaatgaggccagggtcaattgcagccatccctttggggctttccgttatcagtcagtctgtagcttcacctgcaatgaggggctgcttctggtcggcgcctccgttcttcagtgcctagctacgggaaactggaactccgtaccgccagagtgccagggaaaatcgattgcttcgctgcctacaccaggtgtgcagtgtcccgccctgacaacacccgggcagggcacgatgtactgccgtcatcacccaggcacgttcggattcaatactacttgttatttcggatgtaacgcaggtttcacactgatcggcgattcaaccctttcctgccgacccagcggccagtggactgccgtgacaccagcttgcagagctgtaaaatgcagcgagctgcatgtgaataaacccattgccatgaactgcagtaacttatggggcaacttcagttacggctccatttgtagtttccattgtctcgaaggccagctcctgaatggctccgcccagactgcatgccaggagaatggccattggagtacaacagttcctacatgtcaggccggacctctgacgattcaggaggcacttacctactttggaggcgctgtcgcgagtacgataggcttgatcatgggcggcaccctactagccctgctcaggaagaggtttcgccaaaaagacgacggaaaatgcccattgaacccgcattctcacctgggaacctatggagttttcaccaatgccgctttcgatccttctccttag

SEQ ID NO: 133669 - DNA, 2307 bp, Artificial Sequence
  Description of Artificial Sequence: Synthetic coding sequence
atggccaactgtcagatcgcaatactctaccagaggtttcagcgggtggtatttggcatttcccaactcctatgcttttccgcactaattagcgaattgactaatcaaaaggaagttgctgcctggacttatcattactctacgaaagcctatagttggaatatcagcagaaagtactgtcaaaacaggtacacagatttggtggccatccagaacaagaatgagatcgattacctcaataaagtcctgccttactattcttcatattattggatcggcattcgtaagaacaataagacgtggacctgggtggggaccaagaaggcattgactaatgaggctgagaattgggccgacaacgagcccaacaataagagaaacaatgaagattgcgtggaaatctacatcaagtcgccaagcgctcctggcaagtggaacgacgaacattgtctcaaaaagaagcacgccctctgctacacagccagttgtcaagacatgagttgttccaaacaaggtgaatgccttgagacaatcgggaattacacatgtagctgttaccctggcttctatggccctgaatgtgaatatgtgagagagtgcggcgaactggagctgcctcagcacgtgttgatgaactgttcccacccacttggcaacttctcttttaattcccagtgttcgtttcactgcactgatggctatcaagttaatggaccctcaaagctggagtgtctcgcatccgggatttggactaacaagccaccgcagtgtttggccgtccagtgccagcatttggaggccccatccgagggcacaatggactgtgtacaccccctgactgctttcgcatacgggtctagttgcaaatttgagtgtcaacccgggtaccgtgttcggggtcttgatatgcttaggtgtatcgacagcggacactggtccgcaccactacctacgtgtgaggcaataagctgcgaaccacttgagtctccagtacacgggtccatggactgttctccgtcgcttagagcattccagtatgataccaactgcagcttcagatgtgcagaaggcttcatgctgaggggcgcggatatagtcagatgtgataacctcggccagtggactgcccccgcccccgtgtgtcaggccctgcaatgccaggatctgcccgtccccaacgaggctcgcgtgaattgctcccacccattcggagcttttcgctatcagtctgtctgctcattcacctgtaatgaggggcttttgctagtaggggcctccgtgttgcagtgtctggcaaccggaaactggaacagtgtccctccagaatgtcaggccataccctgcaccccactcctctcacctcagaatggtactatgacctgtgtgcaacctctgggttcaagttcttacaaatctacgtgccagttcatctgcgatgagggatactcgttgagtggtcccgagagattagactgcactaggagcgggcgctggacggacagtccacccatgtgcgaggcaatcaaatgccccgagctgttcgcaccagagcaaggaagcctcgattgttccgacacaaggggcgaatttaacgtaggcagcacctgtcacttttcttgtgataatggttttaaattagaagggcccaataacgttgaatgtacgacgtcgggaagatggtcggctacacccccaacctgtaagggaatagcatctctgccaacccccggagtacagtgtcccgccttgaccacaccaggtcaaggaactatgtattgtaggcaccacccaggtaccttcgggttcaatacaacttgttacttcgggtgcaacgctgggtttaccctgataggggattcaacactctcctgcaggccatcagggcaatggacagcagtcactccagcatgcagagctgtgaagtgctccgagctacatgtgaacaagcccatagcgatgaattgctccaatctttggggcaactttagttacggcagtatctgtagcttccattgcctagagggccagctacttaatggtagcgctcaaaccgcttgccaggagaatggccattggtccactaccgtccctacctgtcaagccgggcctctgaccatacaggaggccctcacctattttggcggtgccgttgcgtcaaccattgggttaattatgggcggcactctcctggcgctcctaaggaagaggttccgccagaaagatgacggcaagtgccccttaaatcctcactctcaccttggcacctacggagtgtttacaaatgctgctttcgacccctcaccctag

SEQ ID NO: 133670 - DNA, 2307 bp, Artificial Sequence
  Description of Artificial Sequence: Synthetic coding sequence
atggcgaactgccagatagccatcctataccagagatttcagagggtcgtctttggaatctctcagttgctgtgcttttcggctttgatttccgaactgaccaatcagaaggaggtggctgcttggacataccattactcaactaaagcatactcatggaacattagtcgcaagtattgccaaaatagatataccgacctggttgctatacagaacaaaaatgaaatcgactatttgaataaagtgcttccttactactctagttattactggataggtattcgcaagaacaataaaacttggacatgggtagggactaagaaggcattaaccaacgaggcggagaactgggctgataatgagccgaataacaaacgtaacaatgaggattgtgtggaaatctatatcaaaagcccaagtgcccctggcaagtggaacgatgagcattgcttaaaaaagaagcacgctctttgttacactgctagttgtcaagacatgagctgttccaagcaaggagagtgcttagagacgatcgggaattatacttgcagctgttaccccgggttttatgggcccgagtgcgaatacgtgcgagagtgcggggagttggaactcccccagcacgttctgatgaattgttcccacccactgggcaattttagctttaacagccagtgtagtttccactgcaccgatggttatcaggtgaacggaccatcaaagctggaatgccttgcttcgggaatctggactaataaaccacctcaatgccttgctgctcagtgcccgcctctgaagatccctgagcggggaaacatgacctgccttcattccgctaaggcctttcagcaccagtctagttgtagcttttcgtgtgaggagggcttcgccctggtcggccccgaggtggtgcaatgcacagcttccggagtgtggacagcgccggccccagtgtgcaaggctatatcttgtgagccactcgaatctccagttcacgggtcaatggactgttctccttcactccgcgccttccagtacgataccaactgctcttttagatgcgctgagggtttcatgttgcgcggggctgatatcgttaggtgcgacaatctgggccagtggaccgcccctgcccctgtctgtcaagcgctgcaatgtcaggatctgcccgtgccgaatgaggcaagagtgaattgttctcatcctttcggtgcatttagataccagtcagtctgctctttcacatgcaatgaggggctcctgcttgtgggggctagcgtcttgcagtgcttagccacggggaattggaacagtgtgccgccagaatgccaagctataccgtgtacaccactcttgtctccacagaatggtaccatgacatgtgttcagcccttagggagttcaagttacaagagcacctgccagtttatatgcgatgaaggctacagtttaagcggcccagagaggctggactgtactcggtctggccgatggactgatagcccccccatgtgtgaggcgattaagtgcccagaactgttcgctcctgaacagggctccctagactgtagcgacactaggggagagttcaatgtgggctcaacctgtcacttctcctgcgacaacgggtttaagttggaggggcctaacaatgttgagtgcactacctccggtagatggtccgccaccccccccacttgcaaaggcattgcttctcttccgacccccggagtccagtgtccggcactcaccaccccaggccaaggcaccatgtactgccggcatcatcctggcaccttcggttttaacactacttgttatttcgggtgcaatgctggatttacactaattggagattcaaccctgtcctgcaggccttcgggtcagtggacggctgtgacaccggcttgccgagcagttaagtgctctgagctacacgtgaacaagccaatcgctatgaattgttccaatctctggggcaacttctcttacgggagtatctgcagctttcattgtttggagggccagctgttgaacggatctgcacagacagcctgccaagaaaacggccattggtccaccacggtgcccacatgtcaggccggacctcttactatccaggaggcattgacctactttggaggtgccgttgcctctaccattggcttgataatgggaggtaccctgctcgccctgctccgaaagagatttaggcagaaggacgatggtaagtgccccctcaatccccactcacaccttggcacctacggagttttcactaatgcagcctttgaccccagcccctag

SEQ ID NO: 133671 - DNA, 1935 bp, Artificial Sequence
  Description of Artificial Sequence: Synthetic coding sequence
atggcgaattgtcagatcgccatcctttatcagcggttccaacgcgtggtgtttggtatctcacagctgctctgcttctctgcactgatttcagaactgacaaaccagaaggaagtcgctgcatggacatatcattattctacaaaggcctattcctggaacatctccaggaagtattgtcagaatcggtatacagacctcgttgcaattcagaacaagaacgaaatcgactacttaaacaaagtcctgccttattactccagctattactggatcgggattcgcaaaaataacaagacctggacatgggttggcaccaagaaggccctgacgaatgaggcggaaaactgggccgataatgagcccaataataaacgcaataacgaagactgtgttgagatctacatcaaatccccgtcggccccaggtaaatggaatgatgagcactgtttgaaaaagaagcacgccttatgttatacggcctcttgtcaggacatgtcgtgctccaagcaaggagaatgcctggaaaccattgggaattacacctgttcttgttaccctggtttttatgggcctgagtgcgagtatgtacgggagtgtggggagttggagctgcctcaacacgtcctgatgaactgctctcacccactcggaaactttagcttcaacagccaatgcagctttcattgcacagacgggtaccaggtcaatggcccatcaaagctagagtgcctggcctcaggaatttggaccaacaagcctcctcagtgccttgcagcccagtgccccccgttgaagatccccgaaagggggaacatgacctgtttgcacagcgccaaagccttccaacaccaaagctcctgttccttttcatgtgaagaaggatttgctttagtcgggccagaggtggtgcaatgcacggccagtggagtgtggaccgctcccgctccggtatgcaaggccctgcagtgccaagacttgccagtacctaatgaggcgagagttaattgtagccacccgttcggtgcattcagataccagtctgtctgctcattcacctgcaatgaaggccttttactggttggcgcatccgtgctccagtgtttggcaacagggaattggaacagtgtgccgccagaatgccaggctattccctgcacccctctcttgtctcctcaaaacggcacgatgacctgcgtgcagcctctgggatctagcagttataagtccacttgtcagttcatttgcgatgaaggatattctctctctggccccgagcggctggattgtacaaggagcggacggtggaccgacagtcccccaatgtgcgaagggatagccagcctgcccacacctggagtgcaatgcccagctctgaccactccaggccagggcaccatgtactgcagacaccatcccggcactttcggcttcaacactacgtgttactttgggtgtaatgctgggtttaccctgatcggggatagcacattgtcttgccgcccgagcggacagtggactgctgtaacacctgcctgccgagccgttaagtgctccgaactgcacgtaaataaaccgattgcgatgaattgcagcaacttgtggggcaatttttcttatggcagtatctgttcctttcactgcttggaaggccagctgctcaatggaagtgctcaaaccgcctgtcaagagaacggccattggagcaccaccgttccaacttgccaggcaggtccactgacgatccaggaagcactcacctatttcgggggcgccgtggcatcaacaatcgggctcatcatgggcgggactctcctcgctttgctccgtaaacgattcagacagaaggacgacggcaagtgtcctctgaatccccacagtcatctggggacctatggagtgtttaccaacgccgcctttgatccctcaccatag

SEQ ID NO: 133672 - DNA, 2490 bp, Artificial Sequence
  Description of Artificial Sequence: Synthetic coding sequence
gcgaactgccaaatcgctatcctataccagcggttccagcgtgtggttttcggcatctcccagctgctgtgctttagcgccctgatcagtgaacttacaaaccagaaggaagtggcggcctggacctatcattattccacgaaagcatactcatggaacattagccgcaaatactgtcagaatagatataccgatctggttgctatccagaataagaacgagatcgactacctgaataaggtgcttccatattattcctcatattattggatcggcataaggaaaaataataaaacatggacctgggtcggaacaaaaaaggcgctgaccaacgaggccgagaactgggctgataacgagcctaacaacaagcgtaacaacgaagattgcgtggaaatctatataaaatccccctcagcgcccggcaaatggaatgatgagcattgcttaaagaagaaacatgctctatgttacacagcctcctgccaggacatgagctgctcgaaacagggtgaatgcctggaaaccataggcaattatacttgctcatgctatccagggttttacggccccgagtgcgagtatgtgcgagaatgcggggagttggagctgccccagcacgtgctaatgaattgctcccaccccctggggaacttttccttcaactcccagtgtagcttccactgcaccgacggataccaggtcaatggtccctctaagcttgaatgtctcgcctctggcatctggaccaataagcctcctcagtgtctggccgcgcaatgccctccactcaagattccagaacgtggcaacatgacgtgtcttcactccgctaaagcttttcagcaccagtccagttgcagtttttcatgcgaggaggggttcgcacttgtaggaccagaggtggttcagtgcactgcctccggcgtctggacagcccccgccccagtctgtaaggccgtacagtgtcagcacctggaagccccgtctgaggggactatggactgtgtgcacccactcaccgctttcgcatatggcagcagctgcaagttcgagtgccagcccgggtacagagttaggggcctggatatgttaaggtgcattgacagcggacactggagtgcccccctccccacttgtgaagctatcagctgcgagccccttgagtctcctgtgcacggctccatggattgtagcccctccctcagagccttccagtatgacaccaattgttcctttcggtgtgcggaggggttcatgttgagaggagcagacattgtgaggtgcgacaatctgggccagtggaccgcccctgctcccgtttgccaggctctgcaatgccaggacttgcccgttcctaacgaggctagggtcaactgtagccatccctttggagcgttccgctaccagtccgtatgttccttcacatgtaacgaaggccttcttctcgttggcgcttctgtcctgcaatgcctggccactgggaactggaactccgtccctcccgaatgtcaagccattccatgcacacctcttttgtcgccacaaaacggtacgatgacatgtgtccagccactcggcagctcttcctataagtccacttgccagtttatttgcgacgaggggtactccttgtctggccctgagcggttagattgtacacgaagtgggcgctggacagattcgccacccatgtgcgaggccatcaagtgccctgagttattcgcacctgagcaggggtctctcgactgttctgacaccaggggcgagtttaacgtgggctctacttgccacttttcgtgcgataatggattcaaactcgagggcccaaacaatgtagagtgtaccacgtccggcagatggtcagctactcctcctacttgcaaaggtattgcgtcccttcctacgcccggagtccagtgtcccgctttaacaacgcccgggcagggcaccatgtattgccgtcaccaccctggtaccttcggattcaacaccacctgctatttcggatgcaatgcagggtttaccctgattggagacagtaccctgtcttgcagaccttcaggccaatggacagccgtgactcccgcctgccgcgctgtgaagtgctctgagttgcacgtgaacaagcctatcgctatgaattgctcgaatctctggggaaacttctcctatggaagtatttgttccttccactgcctggagggccagcttctgaacggctctgctcaaacagcctgtcaggaaaacgggcactggagtactactgtccctacatgtcaggctggacctcttacaattcaggaggccctgacctacttcggtggcgccgtggccagtaccattgggctgattatggggggcacactactcgccctgctccggaagcggtttagacagaaggacgacggtaagtgcccgctgaaccctcattctcatctcgggacgtatggcgtattcacaaacgccgccttcgacccatctccctag

SEQ ID NO: 133673 - DNA, 1941 bp, Artificial Sequence
  Description of Artificial Sequence: Synthetic coding sequence
taagcaaactgtcagatcgccatcctgtatcagcggtttcagagggtcgttttcggcatttctcagttactatgtttctcagcactcatcagtgaactgacgaatcaaaaagaggttgccgcatggacctatcactattctaccaaggcatactcatggaatataagtcgaaaatactgtcaaaacagatatacagacttggtcgcaattcagaacaaaaacgagatcgattatcttaacaaagttttgccatactactcctcctactactggatagggattcgtaagaacaataagacttggacctgggtgggcaccaaaaaggcgctgaccaacgaggctgagaattgggctgataatgaaccaaataacaaacgcaataatgaggattgcgtggaaatttatatcaaatccccgtccgctcccggcaagtggaatgatgagcactgcctgaagaaaaagcacgcgctgtgctacaccgcttcttgccaggacatgagttgtagcaaacagggtgaatgccttgaaaccataggaaattatacttgctcgtgttatccaggtttttacggcccggagtgtgagtacgtccgagagtgtggggagctggagttgcctcagcatgtgctgatgaattgttcccaccccctgggaaacttctcttttaactctcagtgtagctttcactgtaccgacggataccaggtgaatggtccctccaagcttgaatgtcttgcctctgggatctggactaataagcctcctcagtgtttggctgcgcagtgcccccccctgaaaattcctgaacgaggcaacatgacatgcctgcattctgctaaggctttccaacaccaatcatcgtgctccttcagctgcgaggaaggcttcgccctggttggaccggaagtggtccagtgtaccgcaagcggtgtctggaccgccccagcgcctgtgtgtaaggccattagctgcgaaccgctggaatctcccgtgcacgggagcatggattgttcaccttctctccgagcattccaatatgatactaattgtagcttcaggtgcgccgaaggctttatgctgcgcggcgcagacatcgtcaggtgcgacaacctgggacaatggacggctcctgctcccgtgtgccaagctctgcagtgtcaagacctgccggtgccgaacgaggcacgggtgaactgttctcacccttttggagcttttcggtaccagtctgtttgttcatttacatgcaacgaaggcttactactggttggggccagtgtcttacaatgcctggccaccggaaattggaacagcgtgccccccgaatgccagggcaagagtatagcctcgttgcccactcctggcgtacagtgtccggctctgactaccccaggtcagggtactatgtattgccgacaccatcctggtacgttcggtttcaatacaacctgctatttcgggtgtaatgcgggctttaccctcattggggattctaccctctcttgccgcccttccgggcagtggaccgctgtgacacccgcctgtcgagcagtgaaatgtagtgaactgcatgtcaacaagcctatcgcgatgaactgctccaacctgtgggggaatttctcctacgggtcgatttgttctttccactgcctcgagggccaactgttgaatgggagtgctcagactgcttgtcaggagaatgggcactggtctactacagtgccaacttgtcaggccggacctctaaccatccaggaggcactgacgtatttcggcggagctgtggcatctaccatcgggctaataatgggcggtaccctcctggcgctgctccggaaacgcttcagacagaaggacgacggcaaatgccccctaaacccacactcccatcttggcacatacggcgtattcactaacgctgcctttgatccatccccttag

SEQ ID NO: 133674 - DNA, 2262 bp, Artificial Sequence
  Description of Artificial Sequence: Synthetic coding sequence
gttgttttcggaatcagccaattactttgtttcagtgccctgattagcgaattaacaaaccagaaggaggttgccgcatggacctaccactactccaccaaagcctactcttggaacatttctcggaaatactgccaaaatcggtacaccgatctggtagcgatccagaataagaatgagatcgattatctcaacaaggtgctaccttactattccagctattattggatcgggatccgaaagaataacaaaacatggacctgggttggaacgaaaaaagccctaacaaatgaggcggagaactgggctgacaatgagcctaataataaacggaataatgaggattgcgtggaaatatacatcaagtctccgtctgcacccggaaagtggaacgacgaacattgtcttaagaagaagcatgcactctgctacactgcttcatgtcaggatatgtcatgtagcaagcagggagagtgtctcgagaccatcgggaattacacttgtagttgctatccgggcttttacggccctgagtgcgagtatgtccgcgaatgcggggagctggagctcccccagcatgttttgatgaactgctctcaccctctgggcaacttcagtttcaatagccagtgctcttttcactgcaccgacgggtaccaagtcaatggaccctccaaactggaatgcttagcgagcggaatttggaccaataagcccccccaatgtctcgccgctcagtgtccacccctgaagattcccgagcggggcaatatgacctgcctgcactctgccaaggcttttcagcatcagtcctcttgtagttttagctgtgaggaaggatttgccctcgtcggccctgaagtcgttcagtgcaccgcatccggagtctggaccgcaccagctcccgtatgtaaggccatctcctgtgaacccttagaatctcccgtccatggaagcatggattgctctccttctcttcgcgcctttcagtacgacactaactgttcttttcgctgtgccgagggctttatgcttcggggagcagacattgtcagatgtgacaatcttggacagtggaccgccccagctccagtgtgccaggccctgcagtgtcaagacctgcctgtccccaacgaagctcgcgtgaactgcagccacccttttggagcctttcggtatcagtccgtctgctcttttacctgcaacgagggactgctgctcgttggcgcatcggtactacaatgcctggccacagggaactggaacagcgtgccgcctgaatgccaggctattccgtgtacacctctgctttcaccacagaacgggacaatgacatgcgtgcagccgcttggctcgagtagctacaagagcacttgtcaattcatttgtgacgaaggatattcattatctgggcccgagcgcctggactgcacccggtctggaagatggactgatagccctccaatgtgcgaggcaattaagtgtccagagctgttcgcccccgagcaggggtccctggattgctccgacaccaggggcgagtttaacgtcggaagcacatgtcacttctcttgtgataatggcttcaagctggagggccctaacaacgtggaatgcaccacttccggtagatggagcgctacccctcctacttgcaaaggcatcgcctcgcttcctacacctggcgtccagtgtccagctctgactacaccaggacaggggactatgtattgtcggcaccatccaggcacatttgggtttaatacaacgtgctattttggatgtaatgccgggttcaccctgatcggagattcaactctcagctgtaggccctccggccagtggaccgctgttacccctgcatgcagggccgtgaagtgctctgagcttcatgttaataaaccgattgctatgaattgtagcaatctgtggggaaatttcagctatggatctatttgtagcttccattgtctggagggccagctgcttaatggctcggcgcagacagcatgtcaggaaaacggacattggtcgactactgttcctacttgtcaagctggtcctctcacaattcaggaggccctcacatactttggtggagccgtggctagcactattgggctcataatgggagggaccctacttgcgctcttgcgcaagagatttagacagaaggacgacggaaaatgccccctgaacccccattcacatctgggaacctatggggttttcacaaatgctgcattcgatccttctccgtag

SEQ ID NO: 133675 - DNA, 2373 bp, Artificial Sequence
  Description of Artificial Sequence: Synthetic coding sequence
atggctaactgtcaaatagctattctgtaccagaggttccaaagagttgtctttggcatctctcagctactgtgttttagcgccctgataagtgagttgactaaccagaaagaggtcgcagcatggacctaccattacagcaccaaggcctacagttggaacatcagtcgaaagtattgtcagaataggtatacggatcttgttgctattcagaacaaaaacgagatcgactatttaaacaaggtgctcccctattactctagttattactggatcgggatcaggaagaataataaaacctggacctgggtgggtaccaagaaagcattaacaaacgaggcggagaattgggccgataacgagcctaataacaaaaggaacaatgaggattgtgtagagatctacatcaagtcaccctcggccccagggaagtggaacgacgagcattgcttgaaaaagaaacacgctctttgctacaccgcatcgtgccaggatatgtcttgttctaaacagggagaatgtctcgaaaccatcgggaattacacttgctcttgttatcctggcttctatgggcctgagtgcgagtacgtcagggaatgtggcgagctcgaattgcctcagcacgttctgatgaattgtagccatcccctcggaaacttttcctttaacagtcagtgctcattccactgtactgatgggtatcaggtaaatggacctagcaagttggagtgcctggccagcggtatttggacgaacaagccacctcagtgcctagcagcacaatgtccacctctgaaaatccccgagcgcggtaatatgacctgtcttcacagtgccaaagcctttcaacaccaatcatcatgcagtttttcctgcgaggagggttttgctttggtggggcctgaagtggtccagtgtacagcttccggagtgtggacggcgcccgcaccagtttgtaaggcagtgcaatgccaacacttggaggcgccttccgaaggaaccatggattgtgtccatccactaacagctttcgcttacggaagcagctgtaaatttgaatgccaaccaggctatcgggtccgaggcttagacatgctccgctgcatagatagcggacactggtctgccccgctgcccacgtgcgaggccatatcctgtgaaccccttgagtctccagtacacgggtctatggactgtagcccttcactccgagctttccagtacgatacaaattgtagcttccggtgcgcagagggcttcatgctgaggggcgcggacattgtaagatgtgacaatctgggacaatggacggccccggctcccgtgtgccaagcattgcaatgccaggatttgcccgtgcccaacgaggctcgggtgaactgcagccacccatttggtgcttttcgatatcagtcggtctgcagcttcacatgtaacgagggactcctacttgtcggcgcatcagtgcttcagtgtctagctaccggtaattggaacagtgtgcccccggagtgtcaggcaatcccatgcaccccattgctgtcccctcagaatggcacaatgacatgtgtgcagcctcttggtagttcctcctacaagtccacctgtcagttcatttgtgacgagggctattctctgagtgggcctgagcgcctcgattgcacacggagtggccgctggactgattccccgcccatgtgcgaggccatcaagtgcccagagcttttcgccccagagcagggctcactggattgttccgacacccggggagagttcaatgttggttctacttgccatttcagctgcgataacgggttcaaacttgaaggtcccaacaacgtagaatgtactacatccggccgctggtcggccaccccgcccacttgtaagggaatagccagcttacctacccccggagtacaatgcccagctctaacgacccccggtcaagggaccatgtattgccggcaccatcccggcacattcgggttcaacacgacttgctattttgggtgcaatgccggctttaccttaataggagactcaactctgtcttgtcggccttctggccagtggactgctgtgacaccagcatgcagggcagtaaaatgttccgaattacacgtgaataaaccaattgctatgaattgttccaacctgtgggggaacttctcctacggctctatttgtagcttccattgcctggaaggacagctgctgaatggatcagcacagactgcttgccaggagaacggccattggagcactaccgtcccgacttgtcaggacgatggcaagtgtcccctgaatccacactcacatctggggacatatggagtcttcacaaatgcggcgttcgatcccagcccatag

SEQ ID NO: 133676 - DNA, 450 bp, Artificial Sequence
  Description of Artificial Sequence: Synthetic coding sequence
atgatgactaagcataaaaagtgctttattattgtcggggtactgattaccacaaacatcatcaccttgattgtgaaactgacccgtgattcacaatcactatgtccttacgattggatcggctttcagaataaatgttattacttttccaaagaagaaggagattggaattcatccaaatataactgttccactcaacacgccgatctgacaataatcgataatatcgaagagatgaatttcctcagacggtacaagtgctcaagcgaccattggatcggtctcaagatggcaaagaatcgaaccggacagtgggttgacggggccacttttacaaagagtttcgggatgcgcggatccgaaggctgcgcttacctgtccgatgacggcgctgctacagcgcgctgctatacagaaaggaaatggatctgccggaagcgcatacattag

SEQ ID NO: 133677 - DNA, 1209 bp, Artificial Sequence
  Description of Artificial Sequence: Synthetic coding sequence
atgcccctgcaactcttgcttctgctcatactcttgggaccaggcaactcgttacagctgtgggacacctgggccgatgaggcggaaaaagctctaggccccctcctggcccgcgatcggaggcaggccactgagtacgaatacttagactacgacttcttgccagagaccgaacctcctgagatgttgagaaatagcactgatacaacaccgctcacgggaccagggacccctgagagcacaaccgtagaaccagctgcccggaggtccaccgggctggacgctggaggcgctgtcacggaactgactacagaacttgcgaacatggggaatctgagcactgatagcgctgcaatggagatccagaccacccagcccgctgcaacagaggctcaaaccacacccttggccgctactgaggctcagaccacgcgtctgaccgcaacagaggctcagacgacccccctcgctgccaccgaagcacaaaccacaccccccgccgccaccgaggcacagaccacccagcctacaggccttgaggcacagaccaccgctcccgctgcgatggaggcgcagaccacagccccagcggccatggaggcccagactacacctcctgccgccatggaggcccagacaactcaaaccaccgcgatggaagcgcagactacagccccagaggctacagaggctcagactacccagcctaccgccaccgaagcccagactactccgctcgccgccatggaagcgctttcaaccgaacccagcgctacagaagcacttagtatggagcccactacaaagaggggcctgttcataccttttagtgtctccagtgtgacccataaagggatccccatggcagcttcaaacctctcagtcaattatccagtcggcgccccagaccacatctctgtcaagcagtgcttactagccatcctgatcctggctcttgtagcaacaatcttctttgtctgcaccgtggtgttggctgtgcggctgagcagaaaaggccacatgtatccggtgaggaactattcaccaacagaaatggtttgcatcagcagcctgctgcctgatgggggagagggaccgtccgcaacggccaacggaggtctcagtaaagcgaaatcccctgggcttacacccgagcccagggaagatcgagagggggatgacctcacccttcattcatttctcccgtag

SEQ ID NO: 133678 - DNA, 1239 bp, Artificial Sequence
  Description of Artificial Sequence: Synthetic coding sequence
atgccactgcagttattgctattactgatcctccttggccctggaaacagcctgcagttgtgggatacatgggcggacgaggcggagaaggcacttggacctctgctggccagagaccgacgtcaggctacagaatatgagtacctggactatgattttctcccagagaccgagccacctgagatgctgagaaatagtactgatactacccctctgaccggccccgggaccccagagagcaccacagtcgagcccgcagccagacgcagcaccggcctagacgccggcggagcggtgaccgagttgactaccgaactggccaatatgggcaatctatcaaccgacagcgctgccatggaaatccagacgacacagccggctgcaactgaagcccagaccactcagcccgtaccaactgaggcccagacgacacccctggccgcaactgaggcacagactaccaggctgactgctacggaggctcagactacccccctggccgctacggaggcgcagacaaccccccccgctgccacagaggctcaaactacacagcccacagggctggaggcacagactaccgcccctgcagctatggaagcccaaacaaccgcccctgcagccatggaggcccagaccacccccccagcagctatggaggctcaaaccactcagaccactgcgatggaggcccagaccaccgcgccagaagcaaccgaggcacagacgactcagccaaccgccactgaggctcagaccactcccctggcggccatggaagctctatccacagagccgtccgcaactgaagcacttagcatggagccaactacgaagaggggcttgttcatccctttctccgtgagcagtgtgacccacaaaggtatccctatggcagccagcaacctgtccgttaattatcccgttggggcaccagaccacattagcgtaaagcagtgcctgttagcgatacttatactggctctggttgcaaccatcttctttgtgtgtacagtcgtgctggccgtgcgactcagcaggaaaggccacatgtacccagttcggaattatagccccacggaaatggtgtgcatctcttccttgcttcccgatggaggagaaggaccatccgccacagccaatggggggctttcaaaggctaagagcccaggacttactccagagccaagggaagatcgagaaggggacgacttgaccctacacagcttcctcccttag

SEQ ID NO: 133679 - DNA, 1419 bp, Artificial Sequence
  Description of Artificial Sequence: Synthetic coding sequence
atggctaccaaatgcgggaattgtgggcccgggtactcaacccccctcgaagcgatgaaaggccccagagaggagatcgtttacctcccatgcatttatagaaacactgggaccgaagccccagactaccttgccactgtcgacgtagacccaaagtccccccagtactgccaagtgatccacagattacctatgccgaacttgaaggacgagttgcatcatagtggatggaatacatgctctagctgctttggggactcgaccaagtcacgcaccaagctggtcctgccatccctgatcagtagccgcatttacgtcgtcgatgtgggatctgagccgcgggcccccaagctgcacaaggtgatcgagccgaaggatatccatgctaaatgtgaactagcttttctgcacacgtcccactgtctggcgtctggggaggtgatgataagctctcttggagacgtcaaggggaacggcaagggcggctttgtcctgttagatggagagacatttgaagtgaaaggcacttgggaaagaccagggggcgctgcccctctcggctatgacttttggtatcagccccgtcataatgtgatgattagcaccgaatgggcagcccctaacgtgttaagagatgggttcaaccccgccgacgttgaggctggcctatacggctctcacttatacgtgtgggactggcagagacacgagatcgttcagacactgtcccttaaagacgggttgatacccctcgagatccgcttcctgcacaacccggacgctgcccagggatttgtaggctgcgctctgagctccacaattcaacgcttctataagaacgagggcggcacttggtcagttgaaaaggttattcaggtcccaccaaagaaggtgaaggggtggctcctgcccgaaatgcccggtctgattaccgacattctactgtcactggatgatcgcttcctttacttctccaactggctgcatggagacttgaggcagtacgacatctccgaccctcagagaccaagactgacagggcagcttttccttgggggctcgatagtgaaaggcggacccgtacaggttctcgaagatgaggaattaaagtcacagccggagcctcttgtggtgaagggaaagagggtggcaggagggcctcaaatgatccagctgagcctggacggaaagcgcttatacatcacgacctctctttatagtgcttgggataagcagttctatcctgacctgatccgtgaggggagtgttatgttgcaggtcgatgtagataccgtcaaagggggcctcaagctgaaccccaattttttggttgacttcggcaaggaacctctcggaccggccctggcccacgaattgaggtacccgggcggggactgctcaagcgacatttggatttag

SEQ ID NO: 133680 - DNA, 1227 bp, Artificial Sequence
  Description of Artificial Sequence: Synthetic coding sequence
atgcccaatctcaaggacgagttacaccattccggctggaatacttgctcctcctgctttggtgattcaactaaaagccggaccaagctcgtgctcccgtcacttatctcctctaggatatacgtggtggacgtaggctcagaaccaagggcgccgaaattgcataaagtgatagaaccgaaagatattcatgccaaatgtgagctcgcttttctccatacaagtcactgccttgcttcaggcgaagtgatgatcagcagcctgggcgatgtgaaaggcaacggcaagggcggttttgttctgctggatggcgagacatttgaagtcaagggtacgtgggaacgaccaggtggcgccgcccctctggggtatgatttttggtatcagccccgccacaacgtaatgattagcaccgaatgggcagcacctaacgtcctgagagacggttttaaccctgcggatgtggaagcaggattatatggctcacacttgtacgtgtgggattggcagcgacacgagatcgtgcagaccctatcacttaaagatggtctgatcccactggaaatacgctttttgcataatccggacgctgcgcaaggtttcgtgggctgcgctcttagctcgactattcagcgtttctataaaaacgagggcggcacgtggagcgtagaaaaggtgatccaggtgccccctaaaaaagtcaaaggatggctcctccccgaaatgcccgggcttataactgatatcctactgtcccttgatgatcgtttcctgtactttagcaactggctgcatggcgatctgcggcagtacgacatttctgatccccaaagaccgaggctcactggccaactgtttctggggggctcaatagtgaaagggggtcctgtacaggttcttgaagatgaggagttaaagagtcagcccgaacctcttgtggtgaaaggcaagcgagtcgccggcggacctcagatgatccaattgtctttagatgggaaaagattgtacatcaccacaagtctgtattctgcttgggacaagcagttctatccagacctgattagagaggggtccgtgatgttacaagtggacgttgacacggtcaaaggcggattaaagctgaacccaaattttctggttgactttgggaaagagcctttagggcccgccttagcacatgagttaaggtacccgggtggggactgttcgagtgatatttggatctag

SEQ ID NO: 133681 - DNA, 1233 bp, Artificial Sequence
  Description of Artificial Sequence: Synthetic coding sequence
atggcgactaagtgcgggaattgtggccccgggtactccacaccattggaggccatgaagggcccaagagaagagatcgtctaccttccctgcatttatcggaacacgggtaccgaagcacccgattatctggcgacagttgacgtggaccctaagagccctcagtactgtcaagtcatcgaacctaaggatattcacgctaaatgcgagctagcctttctgcacacatcgcattgcctggcgtcgggtgaggtcatgatctcttccctgggcgatgtgaaggggaacggcaaggggggtttcgtccttctcgacggagaaaccttcgaagttaaaggcacatgggaacgacccggcggggctgcgccactgggctatgatttttggtaccagcccaggcataacgtcatgatatctactgagtgggctgcacccaatgtgctacgggatggctttaaccccgctgatgtggaggccggtttatatggatcccacttatacgtctgggactggcagcgacatgagattgtgcagaccctatccttaaaagatggtctgatcccacttgagattcggtttttgcacaatccggatgccgcacaaggcttcgtcggctgcgccctgtcctccaccatccagagattctataagaacgagggtgggacttggagcgtggagaaagttatccaagtgccgcctaaaaaggtcaaagggtggctcctgcccgagatgcccggcctgattaccgatatcttgcttagtctggatgaccgctttctgtatttctcaaactggctccacggagatctcaggcagtatgatatcagtgaccctcagaggcctcgactgaccgggcaactgtttctggggggaagcattgtcaaggggggtcccgtgcaggtactagaggacgaagaactgaagtcccaacctgaacccttggtggttaaaggcaaacgcgtcgctggcggtccacagatgatacagcttagtctggatggcaagagactttacattactaccagcttatatagtgcctgggacaaacagttctatccagacctcatccgagagggtagcgtaatgctgcaggtggacgtcgacactgtgaagggcggcttgaaattgaacccaaactttctggtagactttggtaaggaaccactgggacccgccttagcccacgagctgaggtatccggggggagactgctcctccgacatttggatatag

SEQ ID NO: 133682 - DNA, 1362 bp, Artificial Sequence
  Description of Artificial Sequence: Synthetic coding sequence
atgcccggctccagtggcgccggcatggaagctgccgtggctccaggccgtgatgcgccagctccagccgcctcacagcccagtggttgcgggaagcataattcccctgagcgcaaggtgtacatggactacaatgccacaacgccactggaacccgaggttattcaggcgatgaccaaggctatgtgggaggcatggggaaacccaagcagcccctattccgcgggccgaaaggcaaaagacatcatcaatgcagcaagggagtctctcgccaaaatgatcggaggcaagccccaagatatcatttttacttctgggggcactgagtctaacaatctcgtgatccattctgtggttaagcattttcatgccaaccagacctctaagggacacaccggaggacatcatagtcctgtaaaaggagccaaaccgcacttcatcaccagcagcgtggaacacgactctatcagactcccattggaacaccttgtcgaggagcaggtggccgccgtcaccttcgtccctgtgagcaaggtctccgggcaggcggaagtcgatgacattctggcggccgtcagacctaccactaggttggtgactataatgttggcaaacaatgagaccggaatcgtgatgcccgtgcccgaaatttctcagcggatcaaagccctcaatcaggaacgggtggccgccggactgccaccgattttagtccacaccgacgcagcacaggcgctgggtaaacaacgggtggacgtcgaggatctgggcgtggacttcctcacgattgtgggacacaaattctatgggcccaggattggagcactgtacataagaggtctaggcgagtttactcccctctatccaatgctcttcggcggaggccaggagaggaattttcgacccggcaccgaaaatactcctatgatcgcggggcttggcaaagcggctgagcttgttacccagaactgcgaggcttacgaggcccatatgagagacgtgagagactatctagaagagaggctggaagcagaattcgggcagaagcgtatacacttaaattctcagttccccggtacccaaagactgcctaacacctgtaacttttccattcggggcccccgcctgcagggccacgtggttctcgcacaatgtcgggtgctgatggccagcgtcggcgcagcatgccactccgaccacggtgaccagcctagccctgtgctactgagctatggggttccttttgatgtcgctcgaaacgccctacgtcttagcgtgggtcgcagtacaacccgagctgaggtcgatctcgtggtacaggacctaaaacaagccgttgcccaattggaggaccaggcatag

SEQ ID NO: 133683 - DNA, 708 bp, Artificial Sequence
  Description of Artificial Sequence: Synthetic coding sequence
ttcagtaatcctttctgtggagagacttttccccgtaaacccgacttaaaggggactcatcgctgggccccccagccatcagaagggggacaggccccgttccactacttcctgggcgggacccgactgcaccctgccgccccaggcgctcccgggggacgcacatctggttcactgctaaacgtcaaaatgatgaaaatgaagactttcatgatgatttgcttccatttaattaacaccgtcacatttgtccccgtatctaaagtgtctggccaggccgaggtcgacgatatcctggctgccgtgagaccaaccactagactggtaactattatgttggcaaataatgagaccgggatcgtgatgccagtcccagagatatcccagcgcattaaggcactgaatcaggagcgggtggccgccgggttgcccccaattcttgtgcacactgacgccgcacaggccttggggaaacagcgcgtagatgttgaagacctcggcgtagacttcctgactatagtagggcacaaattttatggccctcggatcggcgctctgtacataagaggtctcggtgaattcactcccctctacccaatgctattcggaggaggccaggagcggaattttcgcccgggcacagagaatacgcctatgattgcagggctcgggaaagtctctccaggagagctggaggaaatgagttag

SEQ ID NO: 133684 - DNA, 954 bp, Artificial Sequence
  Description of Artificial Sequence: Synthetic coding sequence
atggaggccgctgtggcccctggccgtgatgcaccagcacctgcagcctctcagccctctggatgtggtaaacacaattcccctgagcggaaggtctacatggattacaacgctaccaccccactcgaacccgaggtcatccaggctatgaccaaagccatgtgggaggcgtgggggaatccctcatccccgtactctgcaggtcgcaaggccaaggacattattaacgctgcaagggaatcacttgcaaagatgattggtggcaagccacaggacatcatctttaccagcggagggaccgagagcaacaatctagtgatccacagcgtagtcaaacatttccacgcaaatcagacctctaaaggtcacacagggggtcaccattctcccgttaagggagccaaaccccactttatcactagctcagtggagcacgatagtatcaggctccccctggaacatcttgtggaggagcaagtggcggccgtgacttttgtccccgtatccaaggtttctggccaagcagaagtggatgacatcctggctgctgttcgtccgacgacacgcttggttactatcatgttagccaacaatgagactggtattgtgatgccggtgcctgagatatcacaacgaataaaagctctcaaccaggaaagagttgcggccggccttcccccaatactggtgcacactgacgctgcccaggctctgggaaaacagcgggttgatgtggaggatctcggtgtggatttcctcaccatagtgggccacaagttttacggcccccgtattggcgctttgtacattcggggcctgggcgaattcacgcccctgtatcccatgcttttcgggggcggccaggaaagaaactttaggcctggcacagaaaatacacccatgattgccggactcggcaaagtcagtccaggcgagctggaggagatgagctag

SEQ ID NO: 133685 - DNA, 1056 bp, Artificial Sequence
  Description of Artificial Sequence: Synthetic coding sequence
atggaagccgctgtggcgccaggtcgcgacgctccggctcctgctgcatctcaaccttccggatgtggaaaacacaattctccagaacgcaaagtttacatggattataacgcgactaccccactagagcctgaggtcatccaggcaatgacaaaggctatgtgggaagcgtggggcaacccaagtagtccatactcagctgcagtgacctttgtccctgtgagtaaggtgagcggccaggctgaagtcgacgatattctggcggcagtgcgccctaccacgcgtttggtcaccatcatgctggccaataatgagacgggcatcgtcatgccagtcccggagataagccagaggatcaaggctctgaaccaggagagggtggctgcaggcctgccacccatcttagtccataccgatgcggcacaagcgcttgggaaacagcgggtcgacgtagaagaccttggcgttgactttttgacaatcgtcggtcataaattttatggcccacgtattggcgcactttacattcgggggctcggagaattcacccccctttatcctatgctgttcggtggaggccaagaaaggaacttccggccaggtactgagaataccccaatgatagcagggttgggaaaagctgctgagcttgtcacgcagaattgtgaggcctatgaagcccatatgcgcgacgtaagagactatctggaagagcggcttgaagccgaattcggccaaaagcgcatccacctcaactctcagtttcctggaacccagagactccccaacacatgtaatttctccattcggggaccaagattacaaggccatgtcgtattagcacagtgccgcgtgctgatggccagtgtcggcgccgcgtgccattctgaccatggcgatcagcctagcccagtgctactgagctatggggttccatttgatgttgcacggaacgcactgagattgtccgtaggacgctccaccacccgcgccgaagtggaccttgtcgtccaggacctgaagcaggcagttgctcagctggaagaccaggcatag

SEQ ID NO: 133686 - DNA, 720 bp, Artificial Sequence
  Description of Artificial Sequence: Synthetic coding sequence
atggaggcagccgtggctcctggacgcgatgccccagcccccgccgctagccagccttccggatgtgggaaacataatagtccggagaggaaagtttacatggactacaatgccaccactcctctcgaacctgaagtcattcaggccatgactaaagcaatgtgggaagcatggggaaatccatcaagtccatattccgcgggcaggaaggccaaagacattatcaatgctgcgagagagtccctcgctaagatgatcggcggtaaaccccaggacattatctttacctctggaggaacagaggccgcagagctggtgacacaaaactgtgaggcttatgaggcgcacatgagagacgttcgcgattatctggaagagaggcttgaggccgaatttggccagaaacggatccatcttaactcccagttcccagggacacagaggctccccaatacttgcaacttttctattcgcgggcctcggttacagggacatgtggtgctcgcacagtgccgtgtgcttatggcgtctgttggcgctgcatgccacagcgaccatggagatcagcctagcccagtcctcctttcatatggagtgccgttcgatgtagccagaaatgctctgagactgagcgtcgggagaagcaccactcgggcagaagttgacctcgttgttcaagacttgaaacaagctgtggcacagctggaggaccaagcatag

SEQ ID NO: 133687 - DNA, 1338 bp, Artificial Sequence
  Description of Artificial Sequence: Synthetic coding sequence
atggaggctgcagtggcgcctggacgggatgcacccgcaccagctgctagccagccaagcggctgtgggaaacacaattctccggagcgcaaagtctacatggactataatgccacaacaccactggagcctgaagtgatccaggccatgaccaaagctatgtgggaggcttggggaaacccaagtagtccctattctgcaggccggaaagccaaagatatcataaacgccgctagggagagtctggctaaaatgatagggggaaagcctcaggacatcatcttcacgtcaggagggaccgaatcgaacaacctcgtgatacacagcgtggtgaagcattttcacgccaatcagacctcgaaaggacacactggtgggcaccattcaccagtcaagggcgcaaagccccatttcatcacgtcatccgtcgaacacgattccattcggttgccgctggagcatctggtggaggagcaggttgccgcagtcacgtttgtgcccgtgtctaaagtgtctggacaggctgaagtcgatgatattcttgcagcagtccgacctacaaccagattggtcaccatcatgctcgctaataatgaaactggcatagtcatgcccgttccagagatcagccagagaatcaaggctttaaaccaggagcgagtggccgctgggctgcccccaatcctggttcatactgatgccgcccaggcgcttggcaagcaaagggtagatgtggaggatttgggcgtggactttctgactattgtcggtcataagttttacgggccacggatcggggccctttatatccggggtctcggcgagttcacaccgctctacccaatgttgttcggcggagggcaagagcgtaatttcaggcctggaaccgagaacactccaatgattgcaggccttggaaaagccgcagagctggtgacccagaattgtgaggcttatgaagcccacatgagagacgttcgcgactatttggaggagagattggaagcagagttcggacagaaacggatacaccttaactctcaattcccaggcacccagcgcttacccaatacatgtaatttctccattcgcgggcctcgtctccagggacacgttgtgttggcccagtgccgggttctcatggcttccgtcggggcggcgtgccacagcgaccacggcgatcagccctcaccagtgctgctgtcttatggggtgccatttgatgttgccaggaacgccctcagactctctgtcggccgctcgactacaagggccgaggttgacctcgtcgtccaagacctcaagcaggcggtcgcacagttagaggaccaggcctag

SEQ ID NO: 133688 - DNA, 966 bp, Artificial Sequence
  Description of Artificial Sequence: Synthetic coding sequence
atgtctaccagggagtctttcaatcctgagtcctatgagttggacaaaagttttaggcttacccggttcacagagcttaaaggtaccgggtgcaaagttccacaagatgtcctgcaaaagctgcttgagagcctgcaagagaatcatttccaggaagacgaacagtttctaggcgccgtgatgcctagactaggcataggcatggatacttgcgtcataccgctcagacacgggggtctgagtctggtgcagaccaccgattacatctaccccattgtggacgacccctacatgatggggagaatagcctgcgcgaatgtgttaagcgatctgtatgcaatgggcgtgacggagtgcgataatatgttaatgctcctgggcgtgtctaataaaatgacggatcgtgagagggataaagtgatgcctctgatcatccagggcttcaaggatgctgctgaagaagccggtacctctgtaacagggggccagaccgtcctcaatccttggattgtgctcggcggcgtggcaacaactgtctgccagcccaatgagttcatcatgcccgacaatgctgttcctggggacgtgctcgtgctcacaaagccactgggaacacaggtggccgtggccgttcatcagtggctggacatccctgagaagtggaataagataaaactcgttgtcacccaggaggacgtcgaactggcttaccaggaggctatgatgaacatggctcggctcaaccggaccggtggtctgctcatctgcctcccccgggaacaggccgcgaggttttgtgccgagatcaagtcccctaaatacggagaagggcatcaagcctggattatcggtatcgtggagaagggcaaccggacagctcggataattgataaaccccggatcatcgaggttgctccccaagtggccacccagaatgttaaccccacacctggcgccacaagctag

SEQ ID NO: 133689 - DNA, 1179 bp, Artificial Sequence
  Description of Artificial Sequence: Synthetic coding sequence
atgtccacccgagagagctttaatcctgagagctacgaactcgacaaatcatttcggctgaccaggtttacggaactgaagggcaccggctgcaaagtcccccaggatgtgttgcagaagcttttggagtctttgcaggagaatcactttcaggaggatgagcaatttctgggagcagtgatgccacggctcggtatcggtatggatacatgtgtgattccactccggcatgggggactctcgctggtgcaaaccacagactacatatacccgatcgtggatgacccttatatgatgggtaggattgcttgcgccaatgtcttatccgacctttatgctatgggagtcacggagtgtgataatatgcttatgttactcggagtgagcaacaagatgactgaccgtgaaagagacaaagtgatgccactcatcatccagggcttcaaggacgccgcagaagaggccggaacgtcagtgactggaggacaaaccgtgctgaatccttggatcgtactgggaggagttgcgacaacggtctgtcagcccaatgaattcatcatgccagataacgcagttcctggcgatgtcctggtcctgaccaagcctctgggcactcaggtggcggtggctgtccaccagtggttggacataccagagaagtggaacaaaataaagttggttgtgactcaagaagacgtggaactggcttatcaggaggctatgatgaacatggctcgcctgaatagaacagccgctggcctcatgcacacctttaacgcgcatgcagccacagacatcaccgggttcggaatcctcggccacgctcaaaatcttgcgaaacagcagcgcaacgaggtctctttcgtaattcacaacctgcctgtacttgccaaaatggccgcagtaagcaaggcttgcggcaatatgtttggccttatgcatggaacatgtccagaaacatccggaggattactcatttgccttcccagagagcaggccgcccggttctgtgccgagattaagtcccccaaatatggagagggccatcaggcttggatcattgggattgtagagaagggcaataggacagcgcggattatcgataagcctaggattatagaggtagccccccaggttgcaacacaaaatgttaatccaacacctggagccactagctag

SEQ ID NO: 133690 - DNA, 966 bp, Artificial Sequence
  Description of Artificial Sequence: Synthetic coding sequence
atgtccacccgggagtcttttaaccctgagtcctacgaactcgacaaatccttccgcctcacgcgtttcaccgagctgaaaggcactggctgcaaagtcccacaagacgttctgcagaaactcctggagagcctgcaggagaatcacttccaggaggacgagcaattcctaggggctgtgatgcctcgtttgggcataggtatggatacctgtgtgatcccactaagacacgggggcctctcattagtgcagaccactgactacatctaccccatagtggacgacccatatatgatgggcagaatcgcctgtgcaaatgtcctttctgacctatatgcaatgggtgtcactgagtgcgacaacatgctcatgctgctgggagtctccaacaaaatgaccgaccgagagagagacaaggtcatgcctttaataattcagggatttaaggatgccgctgaggaggccggcacttccgtaactggtggacaaacggtcctcaacccttggattgtgctgggtggcgtcgctacaaccgtgtgtcaaccaaatgagtttatcatgccagacaatgctgtccctggggacgtgctcgtgctgactaagcctctgggtacccaagtcgcagtggccgttcaccagtggcttgatatcccagagaaatggaacaagatcaagctcgtggtgacgcaggaggatgtagaactggcatatcaagaggctatgatgaatatggcgcggctaaatcgcacaggtgggttgctgatttgtttgcccagggagcaggcagctcggttttgtgccgagattaaatcacctaagtatggagagggacaccaggcatggattattggcattgtggagaagggcaaccggaccgcccggataatcgacaaacccagaattattgaagtcgcccctcaagttgcaacccagaatgttaatccaacaccaggggcaacctcctag

SEQ ID NO: 133691 - DNA, 501 bp, Artificial Sequence
  Description of Artificial Sequence: Synthetic coding sequence
atgagcacacgggaatcatttaatcccgagtcttacgaacttgacaagtcttttcgcctaacgcgcttcactgagctgaaagggactggttgtaaggttccacaggacgtactgcaaaagctgctggagagtctccaggagaaccacttccaggaggacgagcaattcctgggggcagtaatgccacgcctaggcatcgggatggatacgtgcgtcatccccctccggcacggaggcttgtctctggtacaaacaacagattatatctatcctatcgttgatgacccttacatgatgggacgcatcgcctgcgcaaacgtgctgtctgacctctacgccatgggagtcactgaatgcgataacatgttgatgctgctcggggtgtccaacaagatgacagatagggagagagataaggtgatgcccctaattattcagggtttcaaagatgccgccgaagaggcgggtacatcggttaccgggggccaaacggtgctgtag

SEQ ID NO: 133692 - DNA, 279 bp, Artificial Sequence
  Description of Artificial Sequence: Synthetic coding sequence
atggacacttgcgtgatccctctgagacacggaggattgtccttagtccaaaccactgactacatctatcctatagtggacgatccctacatgatgggaaggattgcctgtgccaatgtgctgagtgacttatacgctatgggggtgaccgaatgcgataacatgctcatgctgcttggggtgtctaataagatgaccgacagggagcgagataaggtcatgcctctcatcattcaaggattcaaagatgccgctgaagaggccggcaccagcgtttag

SEQ ID NO: 133693 - DNA, 978 bp, Artificial Sequence
  Description of Artificial Sequence: Synthetic coding sequence
atggatacttgcgtgatccccctgcgccatggcggcctgtcactcgttcaaaccacagactatatctatccaatcgtcgacgatccctacatgatggggcggattgcatgcgctaacgtgctcagcgatttgtacgctatgggagtgacagaatgtgataacatgctcatgttgctcggtgtgtctaacaagatgacagaccgcgaacgcgacaaagtgatgcccttaattattcagggatttaaagatgctgccgaggaggcaggtacctcagttaccggagggcagaccgtcttgaatccatggatcgtgctggggggagtggccaccactgtgtgtcaacctaatgagttcatcatgccagataacgctgtgccaggagatgtcctcgtactgaccaaaccattaggaacccaagtcgcggttgctgtgcaccaatggctagacattcctgagaagtggaataagatcaagctagtcgtgacacaggaggatgttgagctggcctatcaggaagcaatgatgaacatggccaggctgaataggacagcggcaggcctgatgcataccttcaacgcccatgccgctaccgacatcactggctttggtattctgggacacgctcagaacctcgctaagcagcaacgcaacgaggttagcttcgtgatacacaacctcccagttctggctaaaatggccgccgtgagtaaggcatgtggcaatatgttcggactgatgcacgggacttgtccagaaactagcggaggcctgctgatctgcctgccccgcgagcaggccgcccgtttctgtgctgaaataaaaagtcccaagtacggagaaggacaccaggcatggattattgggattgttgagaaaggaaatcggactgcacgcattattgacaagccaaggatcatagaagtggctccacaggttgctacccaaaatgtaaacccaactcctggagccacttcctag

SEQ ID NO: 133694 - DNA, 975 bp, Artificial Sequence
  Description of Artificial Sequence: Synthetic coding sequence
atgagcacccgtgagtcgttcaatcccgaaagttatgagcttgataaatctttcaggctgacacgtttcaccgagctcaagggaaccggctgcaaggttcctcaggacgtgttgcaaaagttgttagaatctttgcaagagaatcactttcaagaggacgaacaatttctgggggcagtaatgccacgacttggcattggtatggacacttgtgtgatccccctccggcacgggggccttagcctagtgcagacaacggattacatctaccctattgtggacgatccttatatgatggggcgaattgcctgtgcaaatgtgctgagcgatctctatgccatgggggtcactgagtgcgacaacatgctcatgctgctgggcgtgtccaacaaaatgacggacagagagagggacaaagtgatgcctttgatcatccagggctttaaggacgctgcagaggaggcgggaacctccgttaccggcgggcagacagttctgaacccttggatcgtgctgggcggcgttgccaccactgtctgtcagccgaacgaatttatcatgccggataatgccgtaccgggcgacgtgcttgttctgacaaagcccctcggtacgcaggtggccgtggctgtccaccagtggctcgacatcccagagaaatggaacaagattaaactggtggtcacccaggaggatgttgaactcgcctaccaggaggcgatgatgaacatggcgaggcttaaccgaacggcagccggcctgatgcatacttttaatgcccatgcagctacagatatcaccgggttcggcatactcgggcatgcccaaaacctcgccaagcaacagcgcaatgaggtctctttcgtcattcataaccttcctgtcctggctaagatggccgccgtaagcaaggcctgtggcaatatgttcgggcttatgcacggcacttgccccgaaaccagtgatgtgcagtag

SEQ ID NO: 133695 - DNA, 1200 bp, Artificial Sequence
  Description of Artificial Sequence: Synthetic coding sequence
atggccgaagcttctgcaaccggcgcctgcggagaggccatggctgccgcagagggaagctcaggtccagcagggctaactctgggcagattaacgggcttctccggaatgaaggggttagtcgggggtcaggaggaggcctctcaggaggccggtctaccagctggggcaggtccgagcccaaccttccctgctctcggtattgggatggattcctgcgtcatccccctgaggcacggaggccttagcctggtgcagactacagactttttctacccactcgtggaggacccatatatgatgggccgtatcgcctgtgccaacgtcctttcagacttgtacgcaatggggatcacggaatgtgataatatgctcatgctgctgagtgtctctcaatccatgagcgaagaggaaagggagaaagtcactcctctcatggtgaaaggttttagggatgccgcagaggagggagggactgctgttactggaggacagaccgtggtaaacccctggatcataataggaggtgttgccacggttgtgtgtcagcctaatgaattcatcatgcccgatagcgcagtagtcggggatgtgctggtgctaaccaaaccgctgggcactcaggtcgcagtcaacgcccaccagtggctggacaatccggaaagatggaataaagtcaagatggtggtgtccagagaggaggtggaactcgcctatcaggaagctatgttcaatatggccacgcttaatagaacggcggccggactgatgcacacgtttaacgcacacgcggccacagatatcactgggtttggtatactcgggcatagtcagaacctggctaaacagcagcgaaatgaggtttcttttgtaatccacaacttgccaatcatcgccaaaatggcagctgtgtcaaaggcttctggccggtttggtttactccagggtacctcagctgaaacctcgggcggcttactaatctgcctacctcgcgagcaggcagcaaggttttgctcagaaatcaaatcctccaagtatggcgaaggccaccaggcttggatcgtcggaattgttgagaaaggtaacagaactgcaaggatcattgataagcctagggtgatagaagtgctgccccgtggcgcgaccgcagcagtgttggctccagacagctcaaacgcctccagcgaaccttcatcatag

SEQ ID NO: 133696 - DNA, 1452 bp, Artificial Sequence
  Description of Artificial Sequence: Synthetic coding sequence
  Description of Combined DNA/RNA Molecule: Synthetic coding sequence
atggcggaagcgagcgccactggagcttgcggggaagcaatggccgcggcagaaggaagttctggaccagctggtctcaccctgggacggtcattctcaaattaccgccctttcgagccccaggctctgggccttagcccatcatggcgcctcacgggctttagtggcatgaagggaugaggctgcaaggttccccaggaggccctgttgaagctgcttgccggcctgacacgccccgacgtgaggcctccccttgggcgggggctggtcggaggtcaggaggaagccagtcaggaggccggactacccgccggtgcaggtccatcacccaccttccccgccctggggattgggatggactcgtgcgttatacctctacgccatggtggcctctccctggtacagacgactgacttcttctaccctctggtcgaagatccttacatgatgggccgcattgcttgcgcaaatgtgctctccgacttgtacgctatggggataacagagtgtgataatatgcttatgcttctgtctgtgtctcagagcatgtctgaggaggagagagagaaagttacccctctgatggtgaaagggtttcgggatgctgccgaggaggggggcaccgcggtgaccgggggtcagacagtagttaacccctggatcatcatcgggggcgtggctaccgttgtttgtcaaccaaacgaatttattatgcctgacagcgccgttgtcggggatgtgctggtgttgacaaaacctctgggcacccaggtcgccgttaacgctcatcagtggctggataacccggaaagatggaataaagttaagatggtcgtcagcagggaagaggtggagctcgcgtaccaggaagccatgttcaatatggcaacattaaataggactgccgcaggacttatgcacaccttcaacgcccacgcagccacagacatcaccggattcggcatattgggacattcgcagaacctcgctaaacaacagcgaaatgaagtgtccttcgtcattcacaaccttccaatcattgctaagatggccgccgtgtcgaaggctagtgggcggttcggcctgctgcaggggacctccgctgaaacatcaggaggcctgctgatctgtctcccacgagagcaggctgcacgcttctgtagcgagataaaatcctctaagtacggggagggccatcaggcatggattgtaggtattgtggaaaaaggaaacaggacagccagaataattgacaaacccagagtcattgaggtcttacctcgtggcgctacagcagccgtgctggccccagactcttccaacgccagttccgaaccatcctctugagatgaacggactgaggttgtatggaccttagagcccctatctaccataacagatggctctcaagagctgatcgtacgcaattttcagcgacgacttccagcctag

SEQ ID NO: 133697 - DNA, 1347 bp, Artificial Sequence
  Description of Artificial Sequence: Synthetic coding sequence
  Description of Combined DNA/RNA Molecule: Synthetic coding sequence
atggccgaggctagtgcgaccggcgcttgtggggaagcaatggccgcagccgaaggctctagtggacccgccggcctcactctgggccgatctttctcaaactataggcccttcgagccccaggccctgggactgtccccttcatggcggttaacgggctttagcggaatgaaaggaugagggtgcaaggtacctcaggaggccctgctgaagctgctggcagggctcacgaggcccgacgttcgcccgccattagggaggggccttgttggtggacaagaagaagcatcccaagaagcaggactgcctgccggcgctggaccttcccctacattccccgccctaggcatcggcatggattcctgtgtaatccccctcaggcacgggggattgagcctcgtgcagacaacggactttttttatcccctggtcgaggacccgtatatgatgggccgaattgcatgtgccaatgtcctgtccgacttgtacgcaatgggaatcaccgagtgcgacaacatgctcatgctgctgagtgtgtcccagtccatgtcagaggaagagagggagaaggtgaccccattgatggtgaaaggctttcgagacgctgcggaagagggtggtaccgctgtgacaggcgggcaaaccgtcgtcaacccttggattatcatcggcggagtcgcaacagtggtctgtcagccaaacgaatttattatgccagactcggccgtggtaggagacgtattagtcctcaccaaacctctggggacgcaagtggccgtgaatgctcaccaatggcttgataaccccgaacggtggaataaggtaaaaatggtggtgtcaagggaagaagtggagctggcttaccaggaggctatgttcaatatggcgaccctgaataggacggctgccggcctaatgcacacctttaatgctcacgctgctaccgacatcaccggattcggcattttgggccattctcaaaacctggcgaagcagcaacgcaatgaagtttcctttgtgattcacaacctgccaatcatcgccaaaatggccgcagtgtctaaggcaagcggtcggttcggcctcctccaagggacttccgccgagacttcagggggcctcctcatctgtctgcccagagaacaagcagcccggttctgctcagagattaagtcatccaagtacggtgagggtcatcaggcttggatcgtgggaatcgtggaaaaggggaatagaactgcaagaatcatcgataaacctcgggtgatcgaggtattgccccgaggcgccaccgctgcagtgcttgcgccggacagtagcaatgcgagttctgagccaagtagttag

SEQ ID NO: 133698 - DNA, 1176 bp, Artificial Sequence
  Description of Artificial Sequence: Synthetic coding sequence
atggccgaggcatccgccacaggagcttgcggagaagctatggcagccgccgagggctcctcaggcccggccggactcaccctagggcggtcttttagcaactataggccttttgaacctcaggaagcgggtctgcctgctggagcaggaccttcaccaactttccctgcgttaggcattgggatggactcttgtgtcatcccattgcgacatggcggcttatcactggtgcaaaccacagattttttctatccactcgtcgaggacccatatatgatggggcgcatcgcctgtgctaacgttctcagcgatctttatgcaatgggcataacggagtgcgacaacatgctgatgctgctgtcagtttcacagagcatgtctgaggaggagagagaaaaggtgactcctctgatggtgaaggggtttcgagatgccgctgaggagggaggaaccgccgtgactggcggccagacggtcgtcaatccctggatcatcattggcggagttgccaccgtggtctgtcagcctaacgagtttataatgcctgattcagcggtggtcggggacgtccttgtgctgaccaagccactcggtacccaggtggcagtgaatgcccaccagtggctggacaaccctgaacgctggaacaaagtgaagatggtggttagccgggaagaagtagagctggcataccaggaggccatgttcaatatggctaccctcaaccgtaccgctgccgggttgatgcatacctttaacgctcacgccgctacagatattacaggcttcggtatcctgggccactcacaaaacttggccaagcaacagcgcaatgaggtgtcattcgtaatccataacctgcccattattgccaaaatggccgctgtatccaaagccagtggccgctttgggttactgcagggcactagtgccgagacgagcggcggactgttgatatgtcttccacgcgagcaggccgcacggttttgtagtgaaatcaagtcatccaagtatggtgaagggcaccaggcctggatcgtgggtatagttgaaaaagggaataggactgcccgaatcatcgataagccgagagtcatagaggtgttgccacggggtgccaccgcagctgtgctcgcacccgattcctctaatgcatcttctgaaccaagtagttag

SEQ ID NO: 133699 - DNA, 1671 bp, Artificial Sequence
  Description of Artificial Sequence: Synthetic coding sequence
atgggaagggcaagaccaggacagcgcggtcccccatctcccgggccagccgctcagccacctgcacccccccgcagacgtgcaaggtccttggcactgctgggggctcttctcgcagctgccgccgctgcagcagtacgggtgtgcgcccgccacgccgaagcccaagccgcagcccgacaggaattagccctgaagacactgggtaccgacggtttgtttctattctcctctttggatacagacggcgacatgtacatttcgcccgaggaattcaagcctattgccgagaaactcacaggcagcactcctgctgcaagttgtgaggaggaggagctgccccctgatccaagtgaggaaacattaacaatcgaagctcgattccaaccgctgctccctgaaactatgaccaagagtaaagatggatttctgggcgtttcaaggctggcactcagcgggttaaggaattggacagcagctgcttccccaagcgcagttttcgcaacacgccattttcagccgttcctcccaccacccggtcaggagctcggcgagccttggtggatcatacctagcgaattaagtatgttcacaggctacctcagtaataatcgtttctaccctcccccaccaaaagggaaggaagtgattatccatcggttgctgtccatgttccacccaagacccttcgtcaaaacacggtttgctcctcaaggggccgttgcctgtcttaccgccatttctgatttttactatactgtaatgttccgcatccacgccgagtttcagctgagcgaaccgccggactttccattctggttttctccggcccagttcactggacatataattctgtcaaaggacgctacccatgtccgtgatttccgacttttcgtgcccaaccataggagtctgaacgtggatatggagtggctgtatggggccagtgagagttcaaatatggaggtggatattgggtatatcccccagatggagctcgaggccacaggcccgtctgtaccttctgtcatactcgatgaagacggcagtatgatcgactcccacctgccttccggcgagccattacagtttgtgtttgaagagatcaaatggcagcaagaactcagctgggaggaagctgctagacggctggaggtcgctatgtacccttttaaaaaagtgtcgtatctccctttcacagaggcttttgatagagcgaaagctgagaacaaattagttcactccatccttttgtggggggctctggatgatcaatcgtgccactgcagcggccgcaccctgcgcgaaaccgtgctggaatcctctcctattctgacgttgctgaacgaatctttcatttcaacttggtcactggtgaaagaattggaagagttgcagaacaatcaggaaaactcttctcaccaaaaactggccggtctccatctcgagaagtatagttttcctgtggagatgatgatctgtctgcctaatgggaccgtggtgcaccacataaacgcaaattactttctggatatcacttctgtcaaacctgaggagatagagagcaatctgttttccttttcatcgacgtttgaagacccaagcaccgccacttacatgcagtttttgaaggaaggcctgaggcgcggactccccctcctccagccttag

SEQ ID NO: 133700 - DNA, 1773 bp, Artificial Sequence
  Description of Artificial Sequence: Synthetic coding sequence
  Description of Combined DNA/RNA Molecule: Synthetic coding sequence
atgggaagggcccgaccaggtcaaagaggaccccccagtccgggcccagccgcacagcctcccgcgcccccgcggcgccgggctcgctcactggcactgctgggtgccttactggccgctgccgcagcagccgcagtgcgggtatgcgcacgacacgcagaagcgcaggccgccgccagacaggagctggcactgaagactttgggtactgacggattgttcttattcagcagccttgacactgacggggatatgtatatctcaccagaggaattcaaaccaatcgctgaaaagctcaccggttcatgcagcgtcacgcagacaggggtgcagtggtgctcccactccagccttcagcctcaactgccctggcttaacugatcgagttgcctgagtttactaagaagcactcctgcggcctcatgtgaagaggaggaattgccccctgaccccagcgaggaaactctgactatcgaagctagatttcagcctctattacctgaaactatgaccaaatccaaagatggatttctcggcgtctccaggctggctctatcgggtctcaggaactggaccgcggctgcgtcaccctccgctgtcttcgcaacccgacacttccaaccctttctcccaccacctggacaggaactgggggaaccctggtggatcattccttcagaactgagcatgtttaccggctacctctccaacaacagattctatccaccaccccctaagggcaaggaagttattatacatcgccttttatcaatgtttcatccaaggcctttcgtgaagacccgcttcgcccctcagggcgctgtggcctgtctgaccgctatatctgacttctattacactgtgatgttcaggatccacgcggagttccagctctctgagccccctgatttcccattttggttttctcccgcccaattcaccggccacatcatcctgtccaaagatgcgacgcatgtcagagatttccgcctcttcgttcctaaccatcgttccctgaacgtcgacatggagtggctatacggcgcctctgagagctccaacatggaagtagacatcggatacatcccacagatggaactagaagcgaccggcccctccgtgccctctgtaattcttgatgaagatgggtctatgattgactctcacctcccttctggggaaccacttcagttcgtctttgaggagattaaatggcagcaggagctctcctgggaggaagcagctcggcgcctcgaggtggccatgtaccccttcaaaaaggtgtcatacctaccctttacagaggccttcgacagggctaaggctgagaacaagctagtgcatagcatcctactttggggggcgttggacgatcagtcctgcugaggttccgggagaacacttcgagagacggtgctggagtcctcacccatcctaactctcctgaatgaatcttttataagcacatggtccttggtcaaggagctggaggagctgcagaataaccaggaaaattcgtcacatcagaagctcgccggcttgcacctggagaaatactccttccccgtagagatgatgatctgtctgcctaatggaacagtcgtgcaccatattaacgccaattacttccttgatattaccagtgtgaagcccgaggaaatagagtcgaaccttttttccttctctagcactttcgaagaccctagcactgccacatatatgcagttcctcaaggagggactgaggcggggcctgcctctgctgcaaccttag

SEQ ID NO: 133701 - DNA, 1671 bp, Artificial Sequence
  Description of Artificial Sequence: Synthetic coding sequence
  Description of Combined DNA/RNA Molecule: Synthetic coding sequence
atgggacgagcccgacccggacagaggggaccaccctcaccaggccctgccgcccaaccaccagctcccccccgtagaagggctcgttcacttgccctcttaggagcactgttggctgcagccgcggctgcagcggtgagggtttgtgcgagacacgccgaagcacaggccgccgctcgtcaagagctggctctgaaaaccctgggaacagatggactgtttttattctcgtccctggacacagacggagacatgtacatcagtcccgaagaattcaaacccattgccgagaagttgacaggaagtaccccagcagccagctgcgaggaggaagagctgccacccgaccctagtgaagaaacgttgaccatcgaggctcgctttcagccactgctccccgagactatgaccaagagtaaagatggctttttaggggtttcccgactggccctctcaggccttagaaattggactgcggcagccagcccctccgccgtattcgctacgaggcacttccagccatttctgccccctcccgggcaagagctgggcgagccttggtggatcatcccttcagagctttcgatgttcaccgggtacctgtccaataatcgtttctacccgcccccacccaaaggcaaagaggtcattatccatagattgctgtccatgttccatcctagaccattcgtgaaaacacggtttgccccgcagggcgcagtggcctgcttaaccgccatctcagacttctactacacagtgatgttccggatacatgctgagttccagctcagcgagcccccagatttccctttctggttctctcctgcccagttcaccggacatatcatactgagtaaggatgcaacccatgtgcgggattttcggttgttcgtgccgaaccatagaagtcttaatgtcgatatggaatggctttatggtgcttctgagtcctcaaacatggaggttgatatagggtacatcccacagatggagctggaagcaactggacctagcgtgccttccgttatcctggacgaggatggttctatgatcgacagccacctgccatcaggtgagcccctgcagtttgtctttgaagaaataaaatggcaacaagagctgtcctgggaggaggcagcccgacgccttgaagtggcgatgtatccctttaaaaaggtgtcttatttgccttttacagaggcctttgacagagccaaagcggaaaacaagctagtacatagcattctgctttggggcgccctcgacgaccagagctgcugaggaagtggccgaactcttagagaaacagtgctggaaagcagtcccattctcaccctgttgaatgaatcattcatcagtacttggagcctcgtaaaagaactggaggagctccagaacaaccaagagaattcaagtcaccagaagcttgctgggctgcatttagagaagtattctttccctgtagagatgatgatctgccttcctaatggtacggtcgtgcatcacatcaacgctaattattttctcgacatcacatcagttaaacccgaagaaatcgaatccaacctcttctccttctcttccacttttgaggatccatccaccgccacttacatgcaattcctcaaggaagggctgcggagaggcctgccgctactacagccctag

SEQ ID NO: 133702 - DNA, 1146 bp, Artificial Sequence
  Description of Artificial Sequence: Synthetic coding sequence
  Description of Combined DNA/RNA Molecule: Synthetic coding sequence
atgtggaggagcctcggccttgcgctggctctatgcttgttgccgtcaggcggcaccgagagccaggaccagagtagtctgtgcaaacagcccccagcatggtccattcgcgaccaagatcccatgctgaatagtaatggttctgtgacagtggtggcccttctgcaggcaagtugatacctatgcatattgcaagcatccaagctggaggatcttcgcgttaaactcaagaaggaaggttacagtaacatatcttacattgttgtgaatcaccaaggaatcagcagcaggctgaagtatacccacctaaagaacaaggtctctgagcacatccctgtgtaccagcaggaggagaatcaaaccgacgtgtggacactgctcaatggctcaaaagatgacttcctgatctacgacagatgcggacgacttgtctatcatctgggcctccccttcagcttcctaacattcccttacgtggaggaggccataaaaatcgcttactgtgagaaaaaatgcgggaattgctcactcacaactttaaaagacgaggatttttgcaaacgcgtctcacttgctactgtagataagacggtggaaaccccctctccacactaccaccatgaacatcaccacaatcacggccaccaacatctggggagtagcgagctctcagagaaccagcagcccggcgctccgaacgcccctacacaccccgcgcctcccggtctgcaccaccatcacaagcataaaggacagcaccgtcaaggacaccccgagaaccgcgacatgccggctagtgaggacctgcaggatctccagaaaaagctctgccgcaaacggtgtatcaatcaacttctctgtaaactcccgaccgattcagagctggcccctcgctctugatgttgtcattgcagacacctcatctttgaaaagaccggttccgccatcactugacagtgcaaagagaacctgcctagcctctgtagcugacaaggacttagggctgaagagaacattactgagagctgccagugacgcctccctccggctgcaugacagatctcccagcagctcataccaactgaggcatccgcatccugaagaugaaagaatcaggccaagaaaugagagugaccctccaattag

SEQ ID NO: 133703 - DNA, 630 bp, Artificial Sequence
  Description of Artificial Sequence: Synthetic coding sequence
  Description of Combined DNA/RNA Molecule: Synthetic coding sequence
atgtggagaagcttgggtctggctctagcgctgtgcctgctcccatcaggaggcacagagtctcaagaccaatcaagcctttgcaaacaaccccccgcgtggtcaatcagggaccaggacccaatgctaaatagtaatgggtcagttacagtggtggcacttctgcaggcctcgugatacctgtgcattctgcaagccagtaagcttgaggatctccgtgtcaagcttaagaaggaaggctactccaacatatcttacatagtggtcaatcaccagggcatctccagtcgcctgaagtacacgcacttgaagaacaaggtgagcgaacacattcctgtctatcagcaggaggagaatcaaactgatgtctggacactgctgaatggctctaaggatgacttcctgatctatgacaggtgcggccgtctcgtgtaccatttgggtctcccattctctttcctcacatttccctacgtggaagaagccatcaaaatcgcctattgcgaaaagaaatgtggcaactgctcattgactacactaaaggatgaagatttttgcaagcgcgtgagcctcgcgacggtggataagactgtggagacccccagccctcactaccaccatgagcactag

SEQ ID NO: 133704 - DNA, 1146 bp, Artificial Sequence
  Description of Artificial Sequence: Synthetic coding sequence
  Description of Combined DNA/RNA Molecule: Synthetic coding sequence
atgtggaggagcttgggtctggcactggctctctgcctgttaccctccggcggaactgagagccaggatcaatcaagcctgtgcaaacagcccccagcatggtccatcagggaccaggatcctatgctgaatagcaatgggagcgtaaccgttgttgcccttttgcaggccagcugatacctttgtattttgcaagcctccaaactggaagatctgagagtgaagctgaagaaggagggatacagcaacatttcttacatcgtcgtaaatcaccaaggtatctcgagccgcctgaagtatacccatcttaaaaataaggtgtccgaacacattccagtgtatcagcaggaggagaaccagactgatgtgtggactttgctcaacgggtctaaggacgatttcctcatctacgaccgttgtgggaggctggtgtaccacttaggcctacccttttccttcttaactttcccatacgtggaagaggctatcaaaatcgcctattgtgaaaaaaaatgtggcaactgctctcttaccacattaaaagacgaggatttttgcaaacgggtctcccttgcaacggtcgataaaactgtcgaaactcccagcccacattaccatcacgaacaccaccacaaccatggccatcagcacctgggatcttcagaactgagcgaaaaccagcaaccaggggctcccaatgcacccacccaccccgcacccccgggcctgcatcatcaccacaagcataagggtcagcacagacagggtcatcctgaaaatagagatatgcctgccagcgaggacctacaagacctgcagaagaaactctgccggaaacgctgtattaaccagcttctatgcaaattacccaccgactccgagttagccccccgcagtugatgctgtcattgtcgccatcttatattcgagaagacaggaagcgccattaccugacagtgcaaagagaatctgccttctctctgttctugacaggggttgagggctgaggagaatattactgagagctgccagugacggcttcctccagccgccugacaaatctcacaacagctgataccaaccgaagcttccgccagtugaaggugaaagaaccaagctaaaaagugagagugaccctctaattag

SEQ ID NO: 133705 - DNA, 933 bp, Artificial Sequence
  Description of Artificial Sequence: Synthetic coding sequence
  Description of Combined DNA/RNA Molecule: Synthetic coding sequence
atgtggagatccctagggctcgcccttgccctatgtctgttgcctagcggcggcacagaatctcaggaccaaagttccctgtgcaagcaacctccagcttggtcgattcgtgatcaggaccccatgttgaacagcaatggaagtgtgactgtggtggccttgttgcaggcctcaugatacctctgcatactccaggccagcaagctagaagacctacgagtcaaactgaagaaggaaggctacagcaacatatcctacatcgtggtgaaccaccaaggaatatcatctcggctgaaatacacccacctgaagaataaggtcagcgaacacattcctgtgtaccagcaggaagaaaatcagactgatgtgtggaccctgttgaatggcagtaaggacgatttcctcatttacgatcggtgtgggcgactagtttaccacctgggcctaccattttcattcctgaccttcccatatgtcgaagaggccattaagattgcctattgtgagaagaaatgcggtaactgctccttgactactttgaaggacgaggacttctgtaagcgggtcagcctcgcaaccgtcgacaagacagtagaaacaccatccccccactatcaccacgaacaccatcacaatcatggccatcagcacctgggttcctctgagttatccgagaatcagcagcctggtgcccctaatgccccaacacacccagctcctccaggattgcatcatcatcataagcataaagggcagcataggcagggacatccagagaatagagacatgcctgcgagcgaagaccttcaggacctccagaagaagttgtgtaggaaaagatgcattaatcaactactgtgtaagctgccaaccgattcagagctggctccaagatctugatgctgtcactgtcgccatctcattttcgaatag

SEQ ID NO: 133706 - DNA, 1146 bp, Artificial Sequence
  Description of Artificial Sequence: Synthetic coding sequence
  Description of Combined DNA/RNA Molecule: Synthetic coding sequence
atgtggagatcactaggcctggctctggcgctttgcctgttaccatctggtggcaccgagtcccaggaccagagtagcctgtgcaaacagcccccggcatggagcattagagaccaggaccccatgttgaacagcaatggaagcgtgactgtcgttgcccttctgcaagcctctugatacctgtgtatcttacaggccagtaagttggaagacttaagagtgaagctgaagaaggagggatattcaaacataagttacatcgtcgtaaatcaccagggaattagctctaggcttaagtatacccacctcaaaaataaagtgtccgagcacattcctgtctaccaacaggaagagaatcagactgatgtttggaccctgctgaacgggtccaaggacgattttctgatctacgaccgctgcgggcggctcgtctatcacctcggactgcccttttctttcttgacattcccctacgtggaggaggccattaaaattgcttactgtgagaaaaagtgcggaaactgcagtttgactacccttaaggatgaggatttttgtaagagagtaagcctcgctacggtggacaagacggtggagacaccttccccccactaccaccacgaacaccatcataatcacgggcaccagcacctcggttctagcgaactgtcagaaaaccagcagccgggagcaccaaatgcgcctacacatcctgccccacctggacttcaccatcatcataaacacaagggccagcaccggcaggggcaccccgagaaccgagatatgccagcttctgaagatctacaggatctgcagaaaaagctttgtaggaaaagatgcatcaatcagctgctgtgtaaactgccaacggacagcgaactggcgcctcggtcaugatgttgccactgcaggcacctcattttcgagaagacaggctctgccataaccugacagtgtaaggaaaacctccccagcctgtgcagtugacaggggttgcgggcagaggagaatataaccgagtcctgtcagugacgtctgccccccgctgccugacaaatcagccaacagctcattcctactgaggcgagcgccagtugacgtugaaagaaccaagctaaaaaaugagaaugacccagcaattag

SEQ ID NO: 133707 - DNA, 264 bp, Artificial Sequence
  Description of Artificial Sequence: Synthetic coding sequence
  Description of Combined DNA/RNA Molecule: Synthetic coding sequence
atggccctggccgtgagggttgtttactgtggcgccugagggtataagtctaagtacctccaactcaaaaagaaactcgaggatgaatttccagggagactggatatatgcggggagggcaccccacaggctaccggtttcttcgaagtaatggtggccggaaaactgattcactctaagaaaaaaggagatggttacgttgacacagagtctaagttcctgaaacttgtcgccgcaatcaaggctgcgcttgcccaggggtag

SEQ ID NO: 133708 - DNA, 267 bp, Artificial Sequence
  Description of Artificial Sequence: Synthetic coding sequence
atggccttggctgtcagggttgtttactgctgcggcgctggcggctacaaatccaagtatttacaactgaagaaaaagctcgaggacgaatttcccggccggttggatatctgcggggaaggtaccccgcaagccacaggctttttcgaagtgatggtcgccggtaaactgatccactccaagaaaaagggagatgggtatgttgatactgaatcaaagtttcttaaactagtggctgctattaaggccgctctggcccagggttag

SEQ ID NO: 133709 - DNA, 351 bp, Artificial Sequence
  Description of Artificial Sequence: Synthetic coding sequence
  Description of Combined DNA/RNA Molecule: Synthetic coding sequence
atgtcgttctgtagcttctttgggggtgaggtgttccagaaccatttcgaacccggggtgtacgtctgcgctaagtgtgggtacgagctttttagttctcgttctaagtacgcacacagttctccatggcctgctttcacggaaacaatccatgcagattctgttgctaaaagaccggagcataaccgctccgaagctctgaaagtgagctgtggtaagtgcggcaacggtctcggtcacgagttcctgaatgatgggcccaaaccgggccaatctaggtttugaatcttcagtagctcattaaaatttgtgcctaaaggcaaagagacatcagccagtcagggtcactag

SEQ ID NO: 133710 - DNA, 681 bp, Artificial Sequence
  Description of Artificial Sequence: Synthetic coding sequence
atgtctttctgctctttcttcgggggcgaagtctttcagaaccactttgagcctggtgtctatgtgtgtgcaaaatgtgggtatgaactgttcagttccaggtccaagtacgcacatagcagcccttggccagccttcacagagaccatacacgccgattccgtcgcaaaacggcccgagcataatagatcggaagcactgaaggtaagggggcaccggggcggcggagggacgggcgccgcacgcgaaagcagggaaccagtgcccccctctagtctgtgtctcccacactccagccggggattagaggcttccattcccgggctgctaccactgcccgggtcatgccacccccgactgtctggtgagccggggctgctcgtgcaaatgtgggagactggtcaggtgagctgtactggatccaggactaaagttaatttactgtgcagaaggtctgcgtgggagattggagtgtgggaagagaccccttcggcgtcccctagcaaagggctgcactgtggctgcattatggcccgatccagcccatcatgtctggttatttttccgggggtgttatggcaagtctggcagtgggtaggccctcgggttccagagcgcagaccccaggcaggagcagtgcctatcctcaatatacagcaactggccgaagtttgcccatag

SEQ ID NO: 133711 - DNA, 2328 bp, Artificial Sequence
  Description of Artificial Sequence: Synthetic coding sequence
atggccagtgccggacacatcattacattgttgttatggggatatctgctggagctctggacaggaggacacaccgcggacacgacacatcccaggctgaggctgtcccacaaggagttgctcaacctgaacaggacatcaatcttccactccccatttgggttcctggatttacatacaatgttgctggacgagtatcaggagcggcttttcgtaggaggtcgcgacctggtttacagtctgtcgcttgagagaatcagcgacggatacaaagagatacactggcccagtacggctctgaaaatggaagagtgcattatgaagggcaaagacgccggagagtgcgcgaactacgtgcgagtcctgcaccattataaccgaacccatcttctgacctgtggcaccggtgcatttgacccagtttgtgcattcattcgcgtcggttatcacctcgaggatcctctgttccatctggaatcaccccgctctgaacggggcaggggccgctgtccattcgacccctcatccagcttcatcagcaccctcatcggcagcgagctgttcgccgggctgtactccgactattggtccagagatgccgccatttttcgcagtatgggaagactggctcacatacgtaccgaacatgatgatgaacggctcctcaaagagcccaaatttgttggatcttacatgatacctgacaacgaagatagggacgacaataaagtgtatttcttcttcactgagaaagctttggaagccgaaaataatgcccatgccatttacactagagtgggccggctttgcgtcaatgacgtgggcggtcagaggatcctcgtgaacaaatggagcacattcctcaaggcacgattggtatgctctgtcccgggaatgaacggaatcgatacatactttgatgagctggaggatgtgtttctcctgcccacgcgggaccacaagaaccccgtcatttttggattgtttaatacgaccagcaacatctttaggggacacgctatctgtgtataccacatgtcgagcattagggcggcctttaacgggccctacgcacataaggagggaccggaatatcactggtccgtttacgaggggaaagtgccgtacccgcggccaggatcatgtgcctcaaaagttaatggtggacggtatgggacgaccaaggactacccagacgatgcaatcaggttcgctcggagtcaccccctgatgtaccaggctattaagcctgcacacaagaaacccatcctcgtcaaaacagatggtaagtataacctcaagcagatcgccgttgaccgggtcgaggcagaggatggccaatatgacgtcctctttattggcacagacaacggcatagttctgaaagtgatcactatttataaccaagaaatggaaagtatggaggaggtgatcttagaggagttgcagatattcaaggaccccgtaccaatcatctccatggagattagctctaagaggcaacagctgtacataggaagtgctagcgctgtcgctcaggtgaggttccaccattgcgacatgtatggaagtgcttgcgccgattgttgcttggcacgggatccctattgcgcttgggatggaatctcctgttcacgctattaccccacaggtacccatgcaaaacggaggttcagacgccaggatgtaaggcatgggaacgcggctcagcagtgctttggacaacaatttgtgggcgatgcccttgacaagaccgaggaacatttggcctacgggattgagaataactctacactgctggaatgcacgccacgttcactgcaggccaaagtgatatggttcgtccaaaaaggtagagaaacaagaaaggaagaggtcaagacggatgatagggtggtgaaaatggatcttgggctcctcttcctcaggctgcacaaatctgatgctggtacttatttttgtcagactgtggaacactccttcgtccatactgttagaaagatcacactggaggttgttgaagaggagaaggtcgaggacatgtttaataaggatgatgaggaagataggcaccatcgtatgccatgcccagcccaaagctcgatatcgcagggagctaaaccttggtacaaggagtttctgcaactgataggctactctaacttccagcgggttgaagaatactgcgagaaagtgtggtgcacggataggaagcggaagaaattgaaaatgtcgccctcaaagtggaaatacgctaatccccaggagaagaagctgcgttctaagccggagcactatagacttcctcgccatacactcgactcatag

SEQ ID NO: 133712 - DNA, 2148 bp, Artificial Sequence
  Description of Artificial Sequence: Synthetic coding sequence
atgcttttggacgaatatcaagaaagattgttcgtaggcgggcgcgacttagtgtatagtctgtccctcgaacgcataagcgatgggtacaaggagattcattggccttccacggccctgaaaatggaggagtgtatcatgaaaggcaaagatgcaggcgagtgtgcaaactatgtgagagttctgcaccattataaccggactcacttactcacctgcggcaccggcgcttttgacccagtgtgcgcttttattagagtcgggtaccacctcgaagatcccttgttccaccttgagtcccctcggtccgagcgtgggcggggaaggtgcccttttgaccccagttccagcttcatcagcacccttatcgggtcagagctgttcgcaggcctgtactcagactactggtcgcgagatgctgctatttttagaagcatgggaagactcgcccacataagaaccgaacacgatgatgaacggttgctgaaagaacctaagtttgtggggtcttacatgatcccagacaacgaagaccgcgatgacaataaggtgtattttttctttacggaaaaggctctggaggcagaaaataacgcacatgccatttatacgcgggtgggccggctctgcgtcaacgatgtcgggggtcagaggatactggtcaataagtggtctacatttctcaaggccaggctcgtctgctcagtgcccggaatgaacgggatagacacttatttcgatgaactcgaggacgtgtttttactgccaaccagagaccacaaaaaccctgtaattttcgggctttttaatactaccagcaatatcttccggggccatgcaatctgcgtgtatcatatgtcttcgatccgcgctgctttcaatggcccatatgcacataaagaaggtcccgaataccattggagcgtctatgaagggaaggtcccctatccacgaccggggtcatgcgcctctaaagtcaacggcggccgctatggcacaactaaagactacccagatgatgccatccgattcgcgaggtcccatcccttaatgtaccaagctatcaagccagctcacaaaaaaccaattctggtaaagactgacgggaagtacaatctaaaacagattgccgtcgatcgcgtagaagctgaggacgggcaatacgacgttttgtttatcgggactgacaacggaatcgttttaaaagtcataactatctataaccaggaaatggaatccatggaggaggtaatcctcgaggagctgcagattttcaaggaccccgtgccgataatatctatggaaatttcaagcaagaggcaacaactctatatcggttctgcctcggccgtcgcccaggtcaggtttcatcactgcgatatgtacggatccgcatgcgccgactgttgcctggcacgagacccgtactgcgcctgggacggcatttcctgcagtcgttactaccctaccgggacccatgcaaagagacgcttccgacgacaggacgtccgccacggcaacgcggcccagcagtgcttcggtcagcagtttgtcggagatgccctggacaaaacagaggaacaccttgcttatgggatcgagaacaattccactcttctggaatgcacaccccgttccctgcaggctaaagtgatctggtttgtgcagaaagggcgggagactcgtaaggaagaggtaaagacagatgaccgcgtcgtcaaaatggacctgggtcttctcttcttgcggctgcataaatcagatgctggtacctatttctgccagactgtggaacatagctttgtccacacagtgagaaagatcacccttgaggtggtggaagaagagaaggtggaagatatgttcaacaaggatgatgaggaggatcgtcaccatcgtatgccatgtcctgcacaaagtagcatttctcagggcgccaaaccctggtacaaagagttcctgcagctcatcgggtactctaactttcagcgcgtggaagaatattgtgagaaagtctggtgcaccgaccgcaaacgcaagaagctcaaaatgagtccttctaagtggaagtatgcaaacccgcaagaaaaaaagctgagatctaaacctgagcattatcgactgcccaggcacacactcgactcctag

SEQ ID NO: 133713 - DNA, 2301 bp, Artificial Sequence
  Description of Artificial Sequence: Synthetic coding sequence
atggcctctgcaggacatataatcactctgctcctgtgggggtatctcttggaactgtggaccggcgggcatactgcggacacaacccacccaagactgagactctctcataaagaactgctgaatcttaatagaacaagcattttccactcaccgtttggtttcctcgacctgcatacgatgctgttggatgaatatcaggagcggctctttgtaggcggacgtgatctcgtctactccctgtctcttgagaggatttctgacgggtacaaggagatacattggccatctactgccctaaaaatggaggaatgcatcatgaaaggtaaagacgccggcgagtgtgcaaactatgtccgcgtgcttcaccactacaatcgaacccacctgctgacatgcgggacaggggcatttgaccccgtttgcgcattcatcagggtcggataccatcttgaagacccactttttcacctggaaagccccagatcagagagggggcgggggcgctgtccattcgatccttcatcctccttcatttccaccctgattggaagcgagctcttcgctgggctgtattcagactattggtcccgtgacgctgccatatttcggtcaatgggcagactggcccatataaggacagagcacgacgatgagcgcctgctcaaagaacctaaattcgtcggtagttacatgattccagacaacgaagacagagacgacaacaaagtgtatttttttttcaccgaaaaggccctcgaagccgaaaacaacgctcatgccatttacacacgggtcggcagactgtgcgtgaacgatgtggggggccagcgtattctggtgaataaatggtccaccttcctgaaggcgagactggtttgttcagtgcctgggatgaacggaatcgatacctatttcgatgagcttgaggacgtatttctcctgccaactagggaccacaaaaacccagtaatcttcggactgttcaacaccacctccaatatatttaggggtcacgctatttgcgtctatcatatgagttccatacgagcagcatttaatggaccttacgcccacaaggaaggcccggaatatcactggagcgtgtacgaaggaaaagttccctaccccagacctggatcttgcgcaagtaaagtgaatggagggagatacggcaccacaaaggactatcccgatgacgccattcgctttgcacggtcacaccctctcatgtatcaggccataaaacccgctcataagaagccaatcctggtgaaaactgacggaaaatacaatttgaagcagattgccgtggacagagttgaggcagaggatgggcagtatgacgtcttgttcatcgggaccgacaatggcatcgtattaaaggtcatcacaatctataaccaagagatggagtccatggaagaagttatactcgaagagttgcagatttttaaagatcccgttcctattatctccatggagatctcatctaagcgacaacaactttatattgggtctgcttctgccgtggcccaggttaggttccatcactgcgatatgtatggtagcgcctgcgcagactgctgtctagcaagagacccttattgcgcatgggatggtatctcctgcagccgatactatcctacagggacacatgctaaacggaggtttcgcaggcaagacgtgcgccacggcaacgctgcccagcaatgctttggacagcagtttgtgggcgacgccctggacaagactgaagaacatctagcctatgggatcgagaataactcaacgttgttagagtgcacgccgagatcgttacaggctaaggtcatttggtttgtgcagaaggggcgcgaaacaaggaaagaggaagttaagacagacgatcgcgtggtgaaaatggacctcggacttttatttctaagactacacaagagcgatgctgggacctacttttgtcagaccgtggagcattcatttgtacacaccgtacggaagatcaccttggaggtggtggaggaggagaaagtggaagatatgtttaacaaggacgatgaagaagatagacatcacagaatgccatgcccagcacagtccagcatatctcaaggggctaagccatggtataaggaatttctccagttgatcgggtacagcaatttccaaagggtagaagaatactgtgaaaaggtctggtgtaccgatcgaaaacgtaagaaactgaagatgtccccgagtaaatggaagtacgccaatcctcagcattatcggctccctcggcacaccctcgattcctag

SEQ ID NO: 133714 - DNA, 2286 bp, Artificial Sequence
  Description of Artificial Sequence: Synthetic coding sequence
atggccttacctgcactggggttggacccatggtcactcctgggactgttcctgtttcaactgctccagctgttgttacctaccacaaccgctggaggtgggggccagggaccaatgccaagagtgcgctactatgcaggcgacgagagaagggccctttcattcttccatcaaaagggactgcaggacttcgacactttactgctgtccggagacggaaacactttgtacgtgggcgcacgggaggccatcctggctctggatattcaggatcccggtgtgcctcggctgaagaatatgatcccttggcccgccagtgatcggaagaaaagtgagtgtgcttttaaaaagaagtcaaatgagactcagtgtttcaattttataagggtgctggtgtcctacaacgtgacgcacctgtatacatgtggcacattcgctttctcacccgcatgcacatttatcgaactgcaggactcctacttactacccatcagtgaagacaaggtgatggagggaaaggggcagtccccattcgaccccgcacacaagcatacagcggtgctggttgacgggatgctctactcaggcacaatgaataacttcctcgggagtgagccaatattgatgagaacactgggcagtcagcccgtgctaaagacagacaatttcctgaggtggctccaccatgatgcaagctttgtcgccgctataccgtcaactcaagtggtgtattttttctttgaggaaactgcttccgagtttgatttttttgagcgacttcacacaagtagagtcgcccgcgtgtgcaagaatgatgtggggggagagaagttgctgcagaagaaatggacgacttttctgaaagctcaattgctgtgtacacagccaggccagctgcccttcaatgtaattcgtcacgcggtcctgctaccagctgattcaccaaccgccccacatatatacgcagtgttcacttcacagtggcaagttggtggcaccagatctagcgcggtgtgtgccttttctctcttggacattgaaagagtctttaaggggaagtataaggagctgaacaaggagaccagccgctggaccacctataggggccctgaaaccaatcctcgaccaggtagttgctccgtaggccctagcagtgacaaagcactgactttcatgaaggatcatttccttatggatgaacaggtcgtcggcacaccactcttggtcaagtctggggtggagtatacaaggctggctgtggaaacagctcagggtctggatggtcattcgcatttggtaatgtacctggggactaccaccggctctttgcataaggccgttgtcagcggagattcttctgcacatctggtggaggaaatccaacttttccccgaccccgaaccagttaggaacctacaactggcgccaacccagggcgccgtgtttgtggggttctccggaggagtctggagggtcccacgggccaattgtagcgtctacgaatcctgcgtcgattgcgtactggccagggatcctcactgtgcctgggacccagagtctcgtacttgttgcctgctgtctgcacccaaccttaacagctggaagcaggatatggaaagaggaaatccagagtgggcctgcgcttcaggtccaatgagtcgcagtctgagacctcagagcaggcctcagataattaaagaggtgctcgccgtgcctaactctatcttagaattgccatgcccccacctatctgccctggcgagctactactggtcccacggacccgctgcagtgccagaagcctctagcacagtgtataacgggtcacttctcctcatcgtgcaggacggggtggggggcctttatcaatgctgggcgaccgaaaacgggttcagctaccccgtgatcagctactgggtggattcccaggatcagactctggcgctggatccagagctggcaggaattcctcgcgaacacgtcaaggtgccactgacaagagtgtccgggggggcagccctggctgcgcaacagtcctactggcctcacttcgtgaccgtcactgtgctgtttgccctggtgctgtcaggcgccctcattatcctggtggcgtcccccctgcgcgctctccgagctcgtggaaaagtgcagggttgcgagaccctgcggcctggcgagaaagcccctctgtcccgagagcagcacctgcagtctccaaaggagtgtcgcacttccgcttccgacgtggatgcagataacaattgtcttggtaccgaggtggcatag

SEQ ID NO: 133715 - DNA, 2286 bp, Artificial Sequence
  Description of Artificial Sequence: Synthetic coding sequence
atggctcttccagccctcggattggacccatggagtttgctgggtctttttctctttcagctgctgcagttacttctcccaaccaccacagcaggagggggcgggcagggccctatgcctagagtgagatattacgccggggacgaacgccgcgcattgagtttttttcatcaaaaggggctgcaagactttgataccctactgctcagcggcgacgggaacactctatatgtgggggcccgtgaagcaatcctagcacttgatatccaggaccccggtgttcctaggctgaaaaacatgattccctggcctgcatcagaccgcaaaaagagtgaatgtgcctttaaaaagaagtctaatgaaacccagtgtttcaactttattagggttctggtttcctataacgtgacacatctgtacacttgcggtacatttgcattcagcccagcctgcacgttcatcgagctgcaggattcctatctgctgcccatttccgaggacaaagtgatggagggcaagggccagagcccgtttgatcctgctcacaagcacaccgcagttctcgttgacggcatgctttattctgggaccatgaacaattttctaggaagcgaacctatactcatgagaacgctgggctcccaacctgttcttaaaaccgacaacttcctacggtggctgcaccacgacgcctctttcgtggccgcaatccctagtacacaggtggtttattttttttttgaagaaactgccagtgaattcgactttttcgaacgtctgcacacgtcgagggttgccagagtgtgtaagaacgatgtggggggcgaaaagttacttcagaagaaatggaccaccttccttaaagcccaactgctatgcacgcaaccgggacagcttccctttaatgttattcgtcacgccgtgcttctgcccgcggacagtcctacagcgcctcatatatacgccgtcttcactagccaatggcaggtgggtggtacccgaagttccgcggtttgcgccttttcactgctcgacatcgaaagagtgtttaaagggaagtacaaagaacttaacaaggaaaccagccgttggacaacctacagggggcctgaaaccaatccccgtcccggctcatgttctgtgggaccgtcctcagataaagccttaacattcatgaaggaccactttctgatggatgagcaagtggtcggcaccccgctgctggtgaagagcggtgtggagtacaccaggcttgctgtggaaacggctcagggcctagatgggcattcgcacctggtgatgtacctgggtacaacgactgggtccctgcacaaggcggtggtaagcggagactccagtgcacacctagtagaggaaattcaactgttccccgatccagagccagtgcgtaacctgcaactggcccctacccagggagccgtgttcgtggggtttagtggcggtgtgtggcgcgttccgcgcgcaaactgcagtgtctacgagtcgtgtgtcgactgcgtgttggcgcgggacccccactgcgcatgggaccctgaaagtcgcacctgttgtttgcttagtgcccctaatctgaattcttggaagcaggacatggagcggggaaaccccgaatgggcatgcgcaagcgggccgatgagcaggagcttgcgcccacagagtcgtccccagatcatcaaggaggtactcgccgttcccaattctatcctcgagctcccctgcccccatctgtccgccctcgcctcctactactggagtcacggaccagctgccgtgccagaggccagcagcactgtatacaacgggagccttctcctgattgtgcaggacggggtcggcgggctatatcagtgctgggccaccgagaacggattcagctatccagtgatcagttactgggttgactctcaggaccaaactctagcgcttgaccccgaactggccggtatccccagagaacatgttaaggtgcccctcactcgtgtgagcggaggcgccgccttggcagcccaacagagctactggcctcatttcgttactgtgacagtcctgttcgccttggttcttagtggggctctcatcatactggtagcctcgcccctcagagcccttagagcacgcggaaaagtccagggctgcgagacactcagacctggcgagaaggctcccttaagcagagaacagcatctgcagtctccgaaggagtgtagaacctcagcttctgacgttgatgcggacaataactgtctcggcaccgaagtcgcatag

SEQ ID NO: 133716 - DNA, 2172 bp, Artificial Sequence
  Description of Artificial Sequence: Synthetic coding sequence
atgcccagggttcggtactatgccggagatgaacgtagagccctgtctttcttccaccagaaaggccttcaggacttcgataccctgcttctgtccggggatggaaacaccttgtatgtgggagcccgggaggctattcttgccctcgacatccaggaccctggtgtgccgcggctgaagaacatgatcccttggcctgccagtgatagaaaaaaaagcgaatgtgcgttcaagaagaaaagcaacgagactcagtgcttcaacttcatccgggtactggtgtcctacaatgtgacccacctgtatacttgcggcacattcgcattttctcccgcttgtacattcatagaactccaggactcctatctactgcctatctcagaagacaaagtcatggagggtaagggccagtctccattcgaccctgcccataagcacaccgctgtgctcgtggacggaatgctttatagtggtacaatgaataatttcctgggctccgaaccaatcctgatgcgcactctggggtctcagccagtcctgaaaacagataattttcttagatggttgcatcacgacgcttcgttcgtggctgccatcccgtctactcaggtggtttacttcttttttgaagaaacggcatcggagttcgatttttttgaaagactccacacgagcagggtggcacgcgtctgtaaaaatgatgtcggaggggagaagctgctccaaaaaaaatggacaaccttcctgaaggcccagctgctctgtacccagcctggccagctgccctttaacgttatacggcatgccgtcctccttccggctgactcaccaaccgcacctcacatctacgctgtgttcacatcgcagtggcaagtcggggggacaaggtcgagtgccgtctgtgccttttctcttttggatatcgaacgggtcttcaagggcaagtataaagagttgaataaggagaccagtaggtggaccacctaccgtggccccgagaccaaccctcggcctggatcatgctctgtggggcccagcagtgacaaagcgttaacttttatgaaagatcacttcctgatggatgaacaggtcgttggaacccctctcctggtgaagagcggagtcgagtatactcggctggcagtggaaaccgctcagggacttgatggccacagccacctcgtgatgtacctgggcacgacaactggatctctgcacaaggccgtagtaagtggcgacagttcagcccacctcgtcgaagagatacaactctttccagatccggagcctgtgagaaatctacaactggctcccactcagggcgccgttttcgtcggattttctggaggggtttggcgggtcccaagagcaaactgtagcgtgtacgaaagttgcgtggattgtgtgctggcgcgggacccacattgtgcatgggacccagagtcacgcacctgctgtcttttgagtgctcccaaccttaacagttggaagcaagacatggaaagaggcaaccccgagtgggcttgcgcctctggaccaatgtcacggtctctaagaccccagtcccgccctcaaatcatcaaagaagtgttggcagtaccgaactctattctggagctgccatgtcctcatctctccgccttggcgtcctattactggagtcacggcccagcagccgtacccgaagcctctagcaccgtgtacaacgggtcccttttgttaattgtccaggacggcgtgggcggactgtatcaatgttgggctaccgagaacggcttttcctatccagttatttcttactgggtggatagccaggatcagactctggcactggatccagagctcgccggaattccgagagaacacgttaaggtccccttaactcgggtttctggcggggccgccctggcagcccagcagagctactggccacactttgtgacagtcacagtcttatttgccctggtactctccggggccctcatcatcttggtggcatctcctctacgagctctgcgggcccggggaaaggtgcaggggtgcgagaccctgcggcctggcgaaaaggcaccactgagccgtgagcagcacctgcagtcacctaaggaatgcaggaccagcgctagtgatgtggatgcagataacaattgtctcgggactgaggtagcctag

SEQ ID NO: 133717 - DNA, 1890 bp, Artificial Sequence
  Description of Artificial Sequence: Synthetic coding sequence
atgataccatggcctgcttctgatcgaaagaagtcagaatgtgccttcaaaaaaaagtcgaacgaggagcttcaggacagctatcttcttccaatcagtgaggacaaagtgatggaaggtaaggggcaatctccgtttgaccccgcccataagcacaccgcagtactcgttgacggaatgctgtattccgggacaatgaacaatttcttgggatctgagcctatactgatgcgaacgctgggcagccagcccgttctcaagaccgacaacttccttaggtggctgcatcacgatgcaagcttcgtggccgcgattccttccacgcaggtggtatattttttcttcgaggaaacagcttccgagtttgactttttcgaacgcttgcatacctcaagagtggcccgggtatgcaagaacgacgtgggaggtgagaagctgctccagaagaaatggacaacatttctcaaggcccaactgctgtgcacacagcctggccagctgcctttcaatgtgatccgccacgcagtgctgttgccagctgattctccgactgccccccatatctatgcggtttttacctcacagtggcaggtgggaggcacccgttcttccgctgtgtgcgcgttctctctcctcgacatcgaaagagtttttaaggggaagtacaaggaattgaacaaagaaacatctcggtggacgacctaccgtggacctgagacgaacccccggcctggatcctgcagtgtggggccttcctcagacaaggccctgacatttatgaaagaccactttctgatggatgagcaggttgtggggacccccctgcttgtgaagtcgggggtcgagtacacaaggctcgctgtagagacggcacagggtctcgacggccacagtcatctggtgatgtacttgggaacaaccactggttcactgcataaggccgtggtgtctggagattctagcgctcatctggtcgaggagatccagttgtttccagatccagaaccagtacgcaatctgcagctcgccccgactcagggcgccgtgtttgtgggattttcgggcggcgtctggagagtgcccagagccaactgttccgtctacgaaagttgtgtggactgtgtgctggcacgcgatccccactgcgcctgggatcctgagagtcggacttgctgtctgctaagtgcacctaaccttaactcctggaagcaggacatggaacgtggcaaccccgaatgggcctgcgccagcgggcccatgtcccggagcctacgcccccagagccgtccacagataatcaaggaagtcctcgccgtgcccaactctatcctggagctgccctgccctcacttaagtgctcttgcaagctactactggtctcacggccctgcagcagtgcctgaagccagttcgacagtgtacaacggaagtttgttactgatcgtccaggatggcgtcggaggattataccagtgttgggccacagaaaatgggttctcttaccctgtaatcagctattgggtcgactcacaggatcagacactagcccttgatcccgagctggcaggcatcccccgggagcacgtgaaagttccactcacacgagtctccggtggggctgccttggccgcgcagcaatcgtattggcctcatttcgtcactgttaccgtcctgtttgctcttgtgctgagtggcgcactaataatccttgtcgctagtcctttgcgtgctcttagagctaggggaaaggtgcaggggtgtgaaaccctgcgtcccggcgagaaagcccccctgagtagagagcagcacttacagtctcccaaagaatgtaggacaagtgcatcagacgtggacgcagataacaattgtttgggcactgaagttgcttag

SEQ ID NO: 133718 - DNA, 2286 bp, Artificial Sequence
  Description of Artificial Sequence: Synthetic coding sequence
atggcgctgccagcattgggcctagacccatggagcctgttaggcctcttcctgtttcaactcctgcagttgcttttacccacgaccacagccggggggggcgggcaaggccctatgccccgggtgagatattatgccggggatgaacgacgggccttgtcattcttccatcaaaaggggctacaggatttcgatacgttgctgcttagcggggacggcaacactctttatgtcggcgcccgggaagccatcctggccctcgacatacaggatcccggggtgcctaggctgaagaatatgattccctggcctgcctctgataggaaaaagtccgaatgcgcattcaaaaagaagtccaatgagacacagtgttttaatttcattcgggtgctcgtatcctataacgtgacacacctgtacacttgcggaacatttgcattttctcccgcctgcacctttatagaattgcaggatagctacctattgccaattagcgaggataaagttatggaggggaaagggcagagtccattcgaccccgcccacaagcatacagcggtgttagtcgacggcatgttgtactccggtaccatgaataactttcttggctccgaacctatcctcatgcggacactcggatctcagccagttctgaagaccgacaacttcctccggtggcttcaccatgatgcatcattcgtggctgccatacccagcacccaggtcgtttacttcttctttgaagagaccgctagtgaatttgacttctttgaaagactccacacaagccgcgtcgcacgggtttgtaaaaatgacgtgggaggagagaagttgctgcagaaaaaatggactacttttctgaaagctcagctgctgtgcactcagcccggccagctcccattcaacgtgataaggcatgcggtgctcttaccagctgattccccaacagcccctcacatatacgctgtgttcacctcccagtggcaggtcggcggcaccaggagtagcgccgtttgcgcctttagtttgcttgacattgagcgagttttcaaggggaaatataaggagctaaataaggagactagtagatggacaacataccggggcccagaaaccaatccaaggcccgggtcctgcagcgtgggtccatcttccgacaaggcccttacatttatgaaggaccacttcctgatggacgagcaggtggtcggaactcctcttttagtgaagtctggggtggaatatacccgactcgccgtagagaccgcccaaggtttggatggccactcacacctagtgatgtaccttggcacaacgactggaagcctccacaaagcagtggtctctggtgactcttctgcccacctggttgaagagatccaactttttccagaccctgagccagtacgcaacctccaactagctcccactcaaggcgccgtcttcgtcggcttcagcggaggggtctggcgcgtgccccgggcaaattgttccgtgtacgagtcttgcgtcgattgcgttctggcccgggatccacactgcgcctgggatcctgaatcacgcacttgctgtctgctatcggcgccaaatctgaactcttggaaacaggatatggaacgaggtaatcctgagtgggcctgtgccagcggacccatgtctcgctccctacgcccccaatcgagacctcagataattaaggaagtgttggccgtgcctaacagtattctcgagctgccttgcccacacttgagtgcgctggctagttattactggtctcacgggccagcggctgtcccggaggcatctagtacagtgtataacggaagcctgctccttattgtgcaggacggcgtgggagggctttatcagtgctgggcgaccgagaatggattcagctacccagtcatttcctattgggtcgatagtcaggatcaaacgctcgctctggaccctgagctagctggaattcccagggagcatgtaaaggtccccttaacaagggtatccggcggtgctgcgctggcagctcaacaatcatattggccacactttgtgacagttactgtcctattcgcgctcgtactgtccggcgcactcataatcttagttgcctcgccactacgggccctacgcgcccgcggcaaggtgcaaggatgtgaaaccttaaggcctggggaaaaagcaccactaagccgggaacagcacctacagagcccgaaggaatgccgcacaagtgccagcgacgtggatgcagataacaactgtctggggaccgaagtggcttag

SEQ ID NO: 133719 - DNA, 1890 bp, Artificial Sequence
  Description of Artificial Sequence: Synthetic coding sequence
atgataccttggcccgccagtgatcgcaagaaatccgaatgcgcttttaaaaaaaagagcaacgaggaacttcaggacagttatctcctgccaatcagcgaggacaaagttatggaggggaagggacaatctcctttcgaccccgcccacaagcacacagccgttctcgttgatggaatgctgtacagcgggaccatgaacaattttcttggcagcgagccaatcctgatgaggacgctgggaagtcagcccgtgcttaaaactgacaacttcctgcgctggctccaccacgatgccagttttgtggccgcaatccccagcacacaggtcgtttatttcttttttgaggaaacggcaagtgagttcgacttttttgagcggctgcacactagccgcgtggccagggtctgcaagaacgacgttgggggtgagaaattactgcagaaaaagtggacaactttccttaaggcacagctcctgtgcacacagcccggtcagttgccctttaatgtgattagacacgccgtactcctaccggcagactcccccaccgctcctcacatttacgctgtgtttacaagtcagtggcaagtcgggggaactagaagttccgccgtgtgtgctttttcactcttggatatcgaaagagttttcaaaggtaagtataaggaactgaacaaagaaacatcaagatggactacttaccgaggtccagagacaaaccctagacctgggtcctgctctgtaggcccttcgtcagacaaggcactgactttcatgaaggatcacttcttaatggatgaacaagtcgtagggacccctctgctcgtgaagtctggggtggagtacaccaggctggcagtggaaaccgctcagggactggatggccattcccacttggtgatgtacttgggcaccaccactggcagcctacataaggctgtagtttccggcgattcaagtgcgcatttagtggaggagatacagttgttccccgatcctgagcctgtgaggaacttacagttagctcctacccaaggagcagtcttcgttggatttagcgggggtgtgtggcgagtgcccagggcgaactgcagtgtctatgagtcatgtgtggactgtgtgctggcacgtgacccccattgcgcttgggatccggagagcagaacttgttgcctcctctccgctcccaatctaaattcctggaaacaagatatggagcgtgggaatccagaatgggcttgcgccagtggtcccatgtcccgcagcttgcggcctcagagtcggccacaaataattaaggaagttctagccgtcccaaactccatacttgagttaccctgtccccatctcagtgcactggcctcttattattggtcccatggcccagcagcagtacctgaggcgtccagcaccgtgtacaacggaagtctccttctgatcgtgcaggacggggttggagggctctaccagtgctgggcaacggagaatgggttttcctaccccgtcatcagttactgggtggatagtcaggatcagaccctcgcactggatcctgagctggccgggatcccccgggagcacgtgaaggtgccattgacacgcgttagcggaggcgccgcactggccgcccagcagtcttattggccgcatttcgtgacagtcaccgtgctgttcgcgctagtcctcagcggcgccctcattatcctagttgcttctccactcagggcattgcgggctaggggcaaggtgcagggttgtgagaccctgagacctggggaaaaggcaccactttcccgcgagcagcacctgcagtctcctaaagagtgtcgaaccagcgcttcagatgtggacgccgataacaattgtctgggcactgaagtggcgtag

SEQ ID NO: 133720 - DNA, 663 bp, Artificial Sequence
  Description of Artificial Sequence: Synthetic coding sequence
atgataccgtggcccgccagcgatcggaaaaagagcgaatgtgcatttaagaagaaaagcaacgaaacccaatgtttcaatttcataagggtcctggtgtcatacaacgttacacacctgtacacatgcgggacttttgcctttagccccgcatgtacatttatcgaattgcaggatagctatcttctgccgatttcagaagacaaagtaatggagggaaaggggcagtcccccttcgatccagcccacaagcacactgcagtccttgtagacgggatgttgtactcaggtacgatgaataattttctgggttcagagcctattctcatgcgaactcttggcagccagccggtcctcaagactgacaatttcttgagatggctgcaccatgacgcaagctttgtcgccgctattcccagcacgcaggtcgtctattttttcttcgaagagacggccagtgagttcgacttctttgaacggttacatacatccagggttgcgcgggtctgcaaaaatgacgtggggggcgaaaaactactgcagaaaaaatggactacattcctcaaggctcagctgctgtgcacacagcccggccagctcccttttaatgtgatccgacacgccgtcttattgcccgccgactcacctacggctcctcattag

SEQ ID NO: 133721 - DNA, 966 bp, Artificial Sequence
  Description of Artificial Sequence: Synthetic coding sequence
atggcactgccggccctagggttggatccgtggtcactcctgggactctttttgtttcagctgctccagttgttattgccgacgacaacggcgggggggggaggtcaagggccaatgccgagagtacgatactatgccggcgatgagagaagggccctgtctttttttcaccagaaaggcctacaagactttgacactttgctcctctccggagatggcaacactctctacgtcggcgccagggaagccatactggccctagacattcaggatccaggtgttcccaggctcaagaatatgatcccttggccagcaagtgatcgcaaaaagagcgagtgtgcgttcaagaaaaagtccaatgaaacacaatgcttcaacttcatccgggtgttagtgtcatacaatgtcactcacttgtacacatgtggaacatttgccttcagtccagcctgcacttttattgaactgcaggacagctaccttctgcctatttccgaggataaagttatggagggaaaaggccagtcccccttcgacccggcacataagcacaccgctgtgctcgtggacgggatgctctattctggcactatgaataactttctgggcagcgagcccatcctgatgagaaccctcggctcccaaccggtcctaaagaccgacaactttttacggtggttgcaccatgatgccagcttcgtcgctgccatcccctcaacacaggtggtgtacttcttctttgaggagacggctagtgagtttgatttttttgaacggctccacacgagccgggtagcaagagtctgcaaaaacgatgtaggaggagagaagttgctacaaaaaaagtggaccacctttctgaaagctcagctgttatgcacacagccgggtcagctgcctttcaacgtcattcgccacgctgttctcctccccgcagatagccctaccgctccccacatttactag

SEQ ID NO: 133722 - DNA, 711 bp, Artificial Sequence
  Description of Artificial Sequence: Synthetic coding sequence
atggcgctgccagctttaggtctcgacccttggagtctgctggggctgttcctgtttcagttgcttcaattgctgctgccgaccactacggctggtgggggcggccaaggacccatgccccgggttcgctactatgcaggagacgagaggcgagccctgagcttcttccaccagaaggggctccaggacttcgatacactgctcctgtccggcgacggaaacaccctgtacgtcggcgctagagaggcaattctggccctggacatccaggatcccggtgtgcctagactaaagaatatgatcccctggccagcctcagatagaaaaaaatcggaatgtgcttttaaaaaaaagtcaaatgaggagcttcaggactcttacttgctgcctatctcggaggacaaagtaatggagggtaagggacaatcacctttcgaccctgcgcacaagcacaccgcggtgcttgtggatggcatgctctattcaggtaccatgaacaacttccttggtagtgaacctatcctaatgaggaccttgggctcccagccagttctgaagaccgataatttcttgcggtggctccatcatgacgctagttttgtggccgctatccccagcactcaggttgtttatttcttcttcgaggagaccgcctccgagtttgatttttttgagcggttgcacacaagtagagtggctcgagtatgttag

SEQ ID NO: 133723 - DNA, 2172 bp, Artificial Sequence
  Description of Artificial Sequence: Synthetic coding sequence
atgccaagagtgcggtattacgccggcgatgagcgaagagccctgtccttcttccaccagaagggacttcaggatttcgataccctcctgcttagtggagatgggaacaccctctatgtcggggcccgagaggccattcttgcattggatatccaggatccaggcgttcctagacttaagaacatgatcccatggccagcttcagacaggaaaaaaagcgagtgcgcctttaagaagaagagcaatgaaactcagtgtttcaatttcatacgggtattagtgtcctataacgtaactcacctttatacatgtggaacttttgccttttctccagcgtgcaccttcatcgagcttcaagattcctatctgctgccgatcagcgaggataaagtgatggaagggaaaggacagtctcccttcgaccccgcccacaagcatacggccgtgttggtggacggcatgctatattctggaaccatgaataacttccttggctccgaaccgatccttatgcgtactcttggctcacagcccgtcctcaagacagacaactttttgcgctggctgcaccatgatgccagttttgttgcagctataccctcaacacaagttgtgtactttttcttcgaagaaaccgcaagtgagttcgacttttttgaacggcttcatacctcacgcgtcgcacgagtgtgcaagaacgatgttggcggtgaaaagctcctgcagaaaaaatggaccactttcctcaaagcccaactcctgtgcacacaacccggccagttgccgtttaacgtgatcagacacgccgtgttgctacctgccgattctccgactgccccccatatctacgcggtattcaccagccaatggcaggtcggaggcacccgttcttcagcagtgtgtgctttcagtttgcttgacattgagagagtctttaaggggaagtacaaggagctgaataaggagacgagccgttggacgacatacagagggcctgagactaatcctcgcccgggctcctgctcggtaggcccatcctccgacaaggccctgacgtttatgaaagatcacttcctgatggatgagcaggtagtgggcacccctctccttgtgaaatcaggggtcgagtatacacggctagctgtcgaaaccgctcaggggctcgatggccatagccacctggtgatgtacctgggcacgacgactggcagcttacataaggctgtcgtgagtggggactccagcgcacacctcgttgaggagatccagcttttccctgaccctgagcccgttcggaatctgcagctagccccaacacaaggggccgtgttcgtgggattcagcgggggcgtctggagggtgcctcgagcaaactgcagcgtgtatgagtcgtgcgttgactgtgtcctggctagggatcctcactgtgcttgggaccctgaaagcagaacttgttgtttactgtccgcaccaaacttgaactcatggaaacaagatatggagcgagggaaccccgagtgggcctgcgccagcggccccatgtcccgcagcctacgcccccagtcgcgacctcagattattaaagaggtgcttgctgtccctaattccatcctggagcttccctgcccccaccttagtgcactggcaagttactattggtctcatggtccagccgctgtcccagaagcctcttccacggtctataatgggtccctactgctgatcgtgcaagatggagtcggggggctgtatcagtgctgggcaacagagaacgggttcagctatcccgtgatttcttattgggtggattctcaggatcagacactggcgctggaccctgaactggctggaattccaagggagcatgtgaaagtgccgctgacccgtgtaagcggcggagccgcccttgctgcacagcagtcatactggcctcacttcgtcacggttacggtcctgttcgcattggtattgtctggcgcgttaattatattggtggcatcccctctccgggcccttagggcacgcggaaaggttcaaggttgcgaaaccctgcggcccggtgagaaagcgcctctatcccgggagcagcacctgcagtcacctaaggagtgcagaacttccgcaagtgacgttgatgccgataacaattgcctggggactgaggtggcatag

SEQ ID NO: 133724 - DNA, 3225 bp, Artificial Sequence
  Description of Artificial Sequence: Synthetic coding sequence
atgaagggcacctgcgttattgcgtggctatttagttccttgggcctttggcgcctggcgcatccagaggctcagggcaccactcaatgtcagcgcactgagcacccagtcatatcgtacaaggagataggcccttggctcagggagtttcgggctaaaaacgccgtagatttttctcaactaacctttgatcccggtcagaaggagttggttgtgggcgcgagaaattaccttttcagactgcaacttgaagacctgagcctcattcaggccgtggagtgggaatgcgacgaggctaccaagaaggcctgttactcaaaaggaaagtccaaggaggagtgccagaactatattagggtgttacttgtgggaggagacaggctgttcacttgtggtaccaacgcatttacgcccgtatgcactaaccgcagtctgtcaaacctcaccgagattcatgatcagatctccggcatggcccgatgtccatactcaccacaacacaacagcaccgctcttttgacagctggcggcgaattgtacgctgccaccgcaatggattttcccggacgagaccctgccatctatcggagccttggaatccttccacctcttcgaactgcccagtacaacagcaagtggctcaacgagcccaattttgtgtccagttatgacattggaaattttacctatttttttttccgggaaaatgccgtcgaacacgactgcggaaaaacagtgttcagccgtgcggcgcgcgtgtgcaagaatgacatcggaggacgttttctgctcgaagatacctggacaacatttatgaaggctagactgaactgttctcggccaggggaggtaccattctattataacgaattacagagcaccttttttctgcctgagctggacctcatctatgggatctttaccacaaatgtgaattctattgcagcctccgctgtctgcgtgtttaatcttagcgctattgcacaggcattcagtgggccttttaaatatcaggagaatagtagaagcgcgtggctaccttacccaaaccccaacccacacttccagtgtggtacggtggatcaggggctgtacgtgaacttaacagaacggaatcttcaggacgcacagaaatttatccttatgcacgaagtggtccagcccgtcactaccgttccgagctttatggaggacaattcgaggttcagccacgtagcagtggatgtggtgcagggacgggaggcactggtacatatcatctacctggcaaccgattatggaaccataaagaaagtgcgtgtccccctgaaccaaaccagtagctcctgcctgctggaggagattgagctgtttccagagcgtaggcgggaaccaattaggagcctgcagatactccattcccaatcagtcctctttgtgggtctgagagaacatgtagtgaagatccccctcaagcgttgccagttctaccgtacaaggtcaacatgcatcggagcccaggatccttactgcgggtgggatgttgtcatgaaaaagtgtacttcactggaagagagtctgtcgatgacgcagtgggagcagtctatatccgcatgccctacccgaaacctgacggtagatggccactttggcgtgtggagcccgtggacaccttgtacacatacagatggttcagccgtaggttcttgcctgtgtagaaccaggagctgtgattcgccagcccctcagtgcggaggctggcagtgcgaaggcccaggcatggaaattgccaactgttctcgcaacggaggatggaccccttggacctcctggtccccatgctctaccacttgtggcatcggctttcaggttcgccagcggagctgtagcaacccaactcccaggcacggcgggagggtatgcgtcggacagaacagagaagagcggtactgcaacgagcacctgctgtgcccgccccacatgttctggacaggctggggtccctgggagaggtgtacagctcagtgcgggggcggcatacaagctaggcgcaggatttgtgaaaatgggcctgactgcgctggttgcaacgttgaataccagtcctgcaacacgaacccctgtccagagctgaaaaaaactactccctggaccccttggacccctgtcaatatctccgataacgggggccactatgaacagcgtttccggtacacttgcaaagctcggttagctgatccaaacttactggaagtcggccggcaacgaatcgaaatgcggtattgtagctccgatggaacaagcgggtgtagtaccgacggcctgtcaggggattttctgcgtgctgggaggtactccgcccacactgttaatggtgcatggagcgcgtggacatcttggagccagtgcagccgcgactgctcgcgcggcattcggaataggaagcgcgtctgtaataaccccgagcctaagtatggcggaatgccctgcctcggaccaagccttgagtaccaagaatgtaacattcttccttgtccagtggatggggtatggtcatgctggtctccctggaccaagtgctctgccacttgtggaggggggcactatatgcgcacaaggagctgctctaatcctgccccggcttacggcggggacatctgtctgggtttacatactgaagaggctctttgtaacacccaaccctgccctgagtcctggtccgagtggtcagattggtcagaatgtgaggcctctggggtgcaggtccgcgccaggcaatgcatcctcctgttccccatgggatctcaatgttccggtaatacaacagagtctagaccatgcgtgttcgatagtaatttcatccctgaggtgtcagtagctaggagctctagcgttgaagagaagcgctgtggcgaattcaacatgttccacatgattgcagtcggcctgtcatccagcatcctcggctgtctcctgaccctgctcgtctacacctattgtcagcgataccagcaacagtcacatgacgccaccgttatacatccagtgtcccccgccccactcaacacctcaatcaccaaccatatcaacaagctggacaaatacgatagcgtggaggccatcaaagccttcaacaagaacaatctgatactcgaagaacgcaataaatattttaacccccatctgacgggaaagacttactcaaatgcatactttaccgatctgaataattacgacgaatattag

SEQ ID NO: 133725 - DNA, 765 bp, Artificial Sequence
  Description of Artificial Sequence: Synthetic coding sequence
atgaagggcacttgcgtgatcgcctggttgttcagctctcttggactttggaggctcgcccatcctgaggcccagggaacgacacagtgccaacgaactgagcatccagtaatttcctacaaggaaatcgggccatggctgagagagtttagagcaaaaaacgcagtagactttagtcagttaacgtttgaccccgggcagaaggaactggtggttggtgcacggaattatttattccggcttcagctcgaggacctctccctcattcaggccgtggagtgggaatgcgacgaggcaaccaaaaaagcttgctacagcaaagggaagtctaaggaggaatgccagaattacatcagggtgcttctggtcgggggcgatagactcttcacgtgcggtacaaacgccttcacacctgtgtgcactaataggtctctgtccaatctgacagaaattcacgatcaaatttctgggatggctcgatgcccctacagtcctcagcacaacagcaccgcactcctcacggcaggcggagagttgtacgccgcaactgcaatggatttccctggccgtgatcccgccatctatcggagcctcggaatcctgccccccctgcggaccgcacagtataatagcaaatggttgaacgagcctaatttcgtctcatcttacgacatcggaaatttcacatactttttcttccgagaaaatgccgtggagcatgattgcggcaagaccgtgttctcccgggctgcgagggtttgctag

SEQ ID NO: 133726 - DNA, 2001 bp, Artificial Sequence
  Description of Artificial Sequence: Synthetic coding sequence
atgactccccctccacctgggagggccgctccaagtgcgccaagagctagagtgcctggtcctcctgcacgcctgggactgccacttcgactgaggctcctgctgcttctctgggcagccgcggcttctgcccagggccacttgcgctccggtccccgtatttttgcagtctggaagggtcatgttgggcaggaccgcgtggacttcgggcaaaccgagccacacactgtgctgttccacgaaccgggaagcagctcggtttgggtgggtggacgcggcaaggtttatctcttcgatttccctgaaggaaaaaacgcctctgttagaacagttaatataggaagcactaaaggttcttgcttggacaagagggattgtgagaactacataaccttgctggagagacgaagcgagggcctgttggcttgcggaaccaatgcgaggcacccaagctgttggaacctggttaacggaactgtggttcccctgggggaaatgagggggtacgcaccatttagccccgacgagaacagtttagtcttattcgaaggagatgaggtgtacagcacaattcgtaaacaggaatacaacggtaagatccctagatttcgcagaattcggggggaaagcgaactgtacacaagcgataccgtaatgcaaaatccacagtttattaaggccaccattgttcatcaggatcaggcttacgatgacaaaatttactacttttttcgtgaagacaacccggacaagaaccccgaagccccgctcaacgtgagtagggtcgcgcaattgtgccgtggcgatcagggtggggaatcctcactctcggtgtcaaagtggaacacctttctcaaagctatgctggtgtgttccgacgcggctacaaacaaaaatttcaacagactccaagacgtcttcctattacccgatccatccggccagtggagggacacaagagtgtatggagtgtttagcaatccttggaactatagtgctgtttgtgtatattctcttggggatatcgacaaggtgtttcgaaccagcagcctgaaggggtatcactcctccctgccaaaccctcgccctgggaagtgcctacctgaccagcagccaatccccacggagaccttccaggtggctgaccggcatcccgaagtggcacagcgcgttgaacctatgggccctctgaagactccgctgttccactcaaaatatcattatcagaaggtggccgtacaccgtatgcaggcaagccacggtgagaccttccatgttctgtacttgacgacagaccgcgggacaatacacaaagtcgtcgaacccggcgaacaggagcattcgttcgctttcaacattatggagattcagccgttccgccgcgcagcagcaattcagaccatgagcctggatgcagagcgccggaagctgtacgtgagtagtcagtgggaagtgagccaggtacctctggacctctgtgaggtgtacggaggcgggtgtcacggttgcctcatgtctagagatccgtactgcggctgggatcagggccgatgtattagcatttatagctccgaaagaagtgtgttgcaatcgattaatccagctgagcctcacaaggagtgtcctaatcccaagccagacaaggcccccctacagaaggttagcctggctcctaattccaggtactatctttcctgtccgatggaaagcaggcatgccacttactcctggcgacataaggagaatgtggagcagagttgcgagcctgggcaccaatctcctaattgtattctgtttatcgagaatctaacagcccagcagtatggccattatttctgtgaagcccaggaagggtcatactttcgtgaggcacaacactggcaactgctgccagaagacggcataatggcagagcaccttctggggcacgcttgcgcactcgcagcgtcactgtggctaggagtgctgcctaccctcaccctggggttattagtccactag

SEQ ID NO: 133727 - DNA, 1506 bp, Artificial Sequence
  Description of Artificial Sequence: Synthetic coding sequence
atgcgtggctacgcgccgttcagcccggacgagaactcattggtgttgtttgagggcgacgaggtttacagtaccatcaggaagcaggaatacaatggcaagatcccaaggtttaggcgtattcggggagagtccgaactgtacactagcgacacagtcatgcaaaatccccagttcattaaggctaccatcgtccatcaggatcaggcttacgacgacaagatctattatttcttccgagaggataaccctgacaagaaccccgaagctccactgaatgtctccagggtggcacagctgtgcaggggtgatcagggaggcgagagtagtttaagcgtgtccaagtggaacacttttctcaaggcaatgctcgtttgctccgatgctgcaactaataaaaactttaacaggctccaagacgtctttctcctgccagatccttccggacagtggcgtgacacgcgtgtatacggtgtattctctaacccctggaattacagcgcagtgtgcgtgtactccttgggagatatagacaaggtcttcaggacgtctagcctgaaaggctaccactccagcctccccaatccccgacccgggaaatgcctcccagaccaacagcctatccccacggagacattccaggtggctgatcggcacccagaagtggcacagcgggtggagcccatgggtccactgaaaacgccattatttcactcgaaataccactaccagaaggtggctgtgcaccggatgcaggcatctcacggagaaacctttcatgttctttacctgacaaccgatcgaggcaccatccacaaagtggtggaacccggtgaacaggaacactcttttgcgttcaatatcatggagatccagcccttcagaagggccgcggccatccagacaatgtcattggatgccgagagacggaagctgtacgtgagttcacaatgggaagtctcacaggtccccctcgacctgtgtgaagtgtacggtggcggatgtcacggctgcctcatgagtcgcgacccctattgcggctgggaccagggcaggtgtatctcaatctactctagtgagaggagcgtcctgcaaagcattaaccccgccgagccccataaagagtgcccaaaccctaagcctgataaagccccgctgcaaaaagtcagcctcgcccccaattcacggtactacctatcttgtcctatggagtcaagacacgctacatattcgtggagacacaaagagaacgttgagcagtcttgcgaacccggccaccaaagccccaactgtattctgttcatcgaaaacctgacggcacaacagtacggccactacttctgcgaggcccaggagggatcctattttagggaggcccagcattggcagttgctgccagaagatggtattatggctgaacatctattaggacatgcttgcgctctggctgccagcctgtggctgggcgtgttgcctaccctgactcttggccttctcgtgcattag

SEQ ID NO: 133728 - DNA, 1959 bp, Artificial Sequence
  Description of Artificial Sequence: Synthetic coding sequence
atgactccaccccctccagggagagccgcgcccagcgccccaagagccagggttccgggacctccagctcgtctgggcctcccacttagactgcggctactcctcctgctgtgggctgccgccgcatcggcccaggggcatcttcggtctgggcctcggattttcgcagtctggaagggacacgtgggccaggaccgagttgattttgggcagactgaacctcacaccgtgttattccacgagcctggttcctcctccgtctgggtggggggacgcggcaaggtgtacctattcgatttcccagaagggaaaaacgccagcgtccgcacggactgcgagaattatattactctcctggaaaggagatcggaaggattactggcttgcggtaccaacgctcgccacccctcctgctggaacttggtcaatggtactgtggtgcctctgggcgaaatgcgggggtacgctccattttcccctgatgaaaatagcctggtgctcttcgaaggagacgaggtgtattccacaattcgcaagcaggagtacaatggtaagattcccagattccggcggatacgcggggagagtgagctttacactagtgataccgtgatgcagaacccgcagttcatcaaggccacaatagtccaccaagatcaggcatatgacgacaagatatactatttctttagagaagacaaccctgataaaaatccagaggcccctctgaatgtgtctcgtgttgcccagctttgcaggggtgaccagggaggtgagtcctccctgtccgttagcaagtggaacacatttctgaaggcgatgcttgtgtgcagtgatgcagctactaataaaaactttaacagactccaagacgtatttcttctaccagatccttctggacaatggagagacactcgggtgtacggggtcttttccaatccatggaattacagcgctgtgtgcgtctattccctcggggatattgataaagtgttcagaacctcttccctaaaggggtaccacagctctctaccgaatccgagacctggcaagtgcttacccgatcagcagcccatcccaaccgagacctttcaggttgcagacaggcacccggaggtggcgcagagagtcgagcccatgggccctttgaagacacctctgtttcacagcaaataccattaccagaaggtagcagtgcatcggatgcaggcctcacatggcgagacgtttcacgttctgtaccttaccaccgaccggggcacaattcacaaagtagtcgaacccggagagcaggaacatagctttgcattcaatatcatggaaatccagcctttcaggcgagctgccgctatacagacgatgtccctggacgctgaacgcagaaagctgtatgtgtcaagccaatgggaggtgagccaggtgccgctcgatctatgcgaagtatatggtggagggtgccacggatgccttatgtcgcgtgacccgtattgcggatgggatcagggaagatgtatatctatttattcttcagagcggtctgtgcttcagtcaatcaaccctgccgagccacacaaagaatgccccaatccaaagcctgataaagctcccttgcagaaggtttctttggcccccaactctcgctactacctcagttgccccatggagtctcgccacgcgacctacagctggcgccacaaagaaaatgtggaacagagttgcgagcccggccaccagtccccaaactgcatcctgtttatcgaaaacctgacagcacagcagtacggccactacttctgtgaggcgcaggaagggtcctattttcgagaagctcagcattggcagttactcccagaggatggcatcatggcagagcatctgctgggtcatgcgtgcgccctggctgcatctctgtggctgggggtcctaccaacactgactttgggcctgttagtgcattag

SEQ ID NO: 133729 - DNA, 1209 bp, Artificial Sequence
  Description of Artificial Sequence: Synthetic coding sequence
atgaaaccaaacataatctttgtcctctctctactgctgattcttgagaaacaggccgcagtcatggggcagaaaggaggctctaaaggaaggttacccagcgaattttctcaatttccccatggacagaagggccagcactacagtggccagaaaggaaaacagcagacagaaagtaagggaagcttctcaattcagtacacttaccacgtggatgcgaatgatcacgatcagtctcgcaaaagtcagcaatatgacttgaatgctctgcacaaaactaccaaaagccagcgacatctcgggggttctcagcagctgttgcacaacaaacaagagggcagggaccacgataagtcgaaaggccactttcacagggtagttatacatcacaagggagggaaagctcaccgaggaacacagaacccatcgcaagatcaaggcaacagtcccagcggaaaggggatctcttcacagtattccaataccgaggagcggctctgggtgcatggtctttccaaggaacaaactagcgtttccggcgcccagaaaggcagaaagcagggaggctctcagagctcttacgtcctgcagaccgaggagttggttgccaataagcagcagagggagacaaagaacagccaccaaaataagggtcactaccagaatgtcgtcgaggttagagaggagcactccagcaaagtgcagacgtctttgtgtccagcccaccaggacaaactgcagcacggtagtaaagatatcttctcaacccaggacgagctgcttgtgtacaataagaaccagcatcaaactaaaaacttgaaccaagatcaacagcatggtaggaaagccaacaaaataagttaccaaagctctagtaccgaagaacggcgactgcactatggagagaacggcgtgcaaaaagatgtctctcaaaggagtatctatagccaaacagaaaagctggtggcgggcaaatcccagattcaggcacctaaccctaagcaagagccgtggcatggcgagaacgctaagggcgagagtggccagtcaacaaatagggagcaggaccttctcagtcatgagcagaagggtcgccatcaacatgggtcacatggcggcctggacatcgtgatcattgagcaggaagacgacagcgataggcacctcgctcaacatctaaacaacgaccggaacccccttttcacctag

SEQ ID NO: 133730 - DNA, 1389 bp, Artificial Sequence
  Description of Artificial Sequence: Synthetic coding sequence
atgaagccaaacatcattttcgtcctgtccctcctgttgatcctcgaaaaacaggccgctgttatgggacagaagggaggatccaagggaaggcttcccagtgaattttcgcagtttcctcacggtcagaagggccaacactacagcgggcaaaagggaaagcaacagaccgaatctaaaggatcattcagtattcagtatacctatcatgtggatgcaaatgatcatgaccaatccagaaaatcacagcaatacgacctgaacgcactgcataagacaaccaagtcccagcgccatctgggcgggtcacagcagctcctccataataaacaggagggccgagatcatgataagtctaagggccattttcatcgggttgtgattcatcataagggagggaaagctcataggggcactcaaaacccttctcaggaccagggaaatagtccctcaggtaaagggattagtagtcagtattcaaacaccgaggaacgcctatgggtgcatgggttgagcaaggagcagacatctgttagcggcgcacagaaaggacgaaaacaggggggcagtcaaagttcttatgtgctgcaaactgaggagctggtcgctaacaaacagcagcgtgagactaagaacagccatcaaaacaagggacactaccagaacgtagtggaagtgcgggaggagcactcctccaaagtgcagacgtccctgtgtcctgctcaccaggataagctgcagcacggaagtaaggatattttctctactcaggacgaactgctcgtgtataataaaaaccagcaccagactaaaaacctgaatcaggaccagcagcatggcaggaaagccaataagatctcatatcagtcctcttcaacggaagagagacgtctccattatggagaaaacggggttcagaaagacgtcagtcagagtagcatctattcacaaaccgaggaaaaggcccaaggcaagagtcagaagcagattaccattccctcacaggagcaggagcactctcagaaggccaataaaatatcctatcagtcgagtagtacggaggagcgcagattacactacggcgaaaatggcgtgcagaaggatgtcagtcagcgatcgatctattctcagaccgaaaagctggtggcaggcaagtcacagatccaggctcccaaccccaagcaagaaccatggcacggtgagaacgcaaagggagagtcagggcaatctaccaacagagagcaggatcttctgtcgcatgagcagaagggtcggcatcaacacgggagtcatggcgggctcgacatcgtcatcatagaacaggaggatgacagtgatcgccaccttgcccagcacctaaataatgataggaatccgctgttcacctag

SEQ ID NO: 133731 - DNA, 1749 bp, Artificial Sequence
  Description of Artificial Sequence: Synthetic coding sequence
atgaaatccattattctctttgttttatctctattgctaattctcgagaaacaggcagccgtcatgggacagaagggcggaagcaaaggccagctcccttccgggtcttcccagttcccccacggccaaaagggccagcattatttcggacagaaagaccagcaacatactaaatccaaaggttcctttagcatacagcacacgtaccatgtggacattaatgatcacgactggacccgcaagagtcaacaatatgacctgaacgcactccacaaggccaccaagtcaaaacagcacctaggtggctcacagcagctgctaaattacaaacaggaaggtcgtgatcacgacaaatcgaaaggacattttcatatgattgtgatacaccataagggcgggcaggcgcaccacggtactcaaaacccctcccaggatcagggaaactccccgtcaggcaaagggttatcgtctcagtgtagcaataccgaaaagcgcctgtgggttcatggtttgtccaaagaacaggctagcgcgagtggcgcccagaagggacggacacaggggggatctcagtctagttacgtcctccagactgaggaactcgtcgtgaataaacagcagcgggaaacaaaaaatagtcatcagaacaagggccactatcaaaacgtcgtagacgtgcgggaggaacactcgagtaagttacaaacatcactacaccctgcccaccaggaccggttgcagcatggtccaaaggacatttttactacgcaagacgagctgcttgtctataataagaaccaacatcagacgaaaaatttgagccaagaccaggaacacggtcggaaggcccataaaatctcatacccctcttcaaggaccgaggaaagacaactgcatcacggtgagaaatccgttcaaaaggacgtgtccaagggatctatcagcatccagacagaagaaaagattcacggcaaaagccagaatcaggtcactatacatagtcaagaccaggaacatgggcacaaggaaaacaaaatcagctatcaaagctccagtactgaagagagacatctcaattgtggcgagaaaggtatccaaaagggtgtgtcaaaagggtcaatttcaattcagaccgaggaacagatccacggtaagtcccagaaccaggtgcgcataccttcgcaagcacaagagtatggtcacaaagaaaacaagatatcttaccaatcctcctcaaccgaagaacggaggcttaattctggcgaaaaggatgtgcaaaagggcgtgtcgaaaggttcgatttccattcagacagaggagaagattcacggcaagtcccaaaaccaggttacaatcccatctcaggaccaagaacacgggcataaggagaacaagatgtcctaccagagctctagcactgaagagcgacgtctgaattacggcggcaagagtacccaaaaggacgtctctcagagctcaatttctttccagatcgaaaaactggtcgagggcaagagccaaattcaaaccccaaatcccaaccaggaccaatggtcaggccaaaacgcaaaagggaagagcggccagtctgcagacagcaagcaagatttgttgtctcacgaacagaagggtcgctacaagcaggagtcatccgaaagccataacattgtgattactgagcatgaggtggcacaagacgaccacttaactcagcagtacaatgaagatcgtaatccgatttcaacatag

SEQ ID NO: 133732 - DNA, 447 bp, Artificial Sequence
  Description of Artificial Sequence: Synthetic coding sequence
atggcagagagcgactgggacacagtgacagttctgcgtaaaaagggccccaccgcggctcaggcgaaatccaagcaggctatccttgccgcccagcgccgcggggaagatgtagaaaccagcaaaaagtgggctgccggacaaaacaagcagcactccatcacaaaaaacactgctaaactcgacagagagacagaagagcttcatcatgacagggtaaccttggaagtgggcaaggtgatccagcagggtcgtcaaagcaagggacttacgcaaaaggacctagctacaaagatcaatgagaaaccccaagtaattgccgattacgagagtggacgcgccataccgaacaatcaagttcttggcaagattgaacgcgccataggcctgaaactgaggggtaaggacattggcaagccgatagaaaaaggtccaagggcaaagtag

SEQ ID NO: 133733 - DNA, 8121 bp, Artificial Sequence
  Description of Artificial Sequence: Synthetic coding sequence
atgagtacatgttgctggtgtacgccagggggtgcatctaccattgattttctgaaaagatacgcgagtaacacccccagtggtgagtttcagacagccgatgaggacctctgctattgcctggagtgtgtggctgagtatcataaggcccgtgacgagctgccctttctccacgaggtactgtgggagctcgaaactctacgcctaatcaatcacttcgagaaatccatgaaagcggagattggcgatgacgatgagctgtacatcgtagacaataatggcgagatgcctctgtttgacatcactggccaggatttcgagaataagctacgcgtcccattgcttgagattctgaagtatccatatcttctgctacatgaacgcgtaaatgagctatgcgttgaggctctctgccggatggaacaagccaactgtagctttcaagttttcgacaagcaccccgggatttacctgtttttggtgcacccaaacgagatggtccgacgctgggcaattctcactgcgcgcaacctagggaaggtggatcgcgacgactactatgacctacaagaagttctgctgtgcttattcaaggtcattgaactgggccttctggagagtcctgacatttacacctctagtgtgctcgagaagggcaagcttatcttgctgccttcccatatgtacgacactacaaactacaagtcctattggctaggaatctgtatgttgctcaccatcctggaggagcaagctatggactccctcctgctaggcagtgataagcagaacgacttcatgcaatctatcctccatactatggaacgtgaagcggatgatgactcagttgaccccttctggcccgcgctgcattgttttatggtgattctcgatcggttgggctcaaaagtgtgggggcaactcatggaccccatagtcgctttccagaccatcatcaataatgcttcttacaatagagagattcggcacatcagaaatagcagtgttcggacgaaactagagccggagtcttatttggatgacatggtgacatgtagtcagatagtctacaattataaccctgaaaagaccaaaaaggatagcgggtggcggaccgcaatttgtcccgactactgtcccaatatgtatgaagagatggagaccctggctagtgtcctccagtcagatattggccaggacatgagagtccataattctacatttctgtggttcattcccttcgtgcagagcttgatggacctcaaagatctgggtgttgcgtacatcgcccaggtcgttaaccacttgtatagtgaggtcaaggaggttctgaaccaaacagacgcagtgtgtgacaaagttacggagttcttcctacttattcttgtctccgtgattgaacttcacagaaataagaaatgcctccacctgctgtgggtctctagtcagcagtgggtcgaagcagttgtgaaatgtgctaaactcccaacgaccgcgttcaccaggtcaagtgaaaagtcttctggaaattgtagcaaggggacagccatgatatcaagtctgtcgcttcacagtatgccaagtaactccgtgcaactcgcttacgtccagctgattcgtagcctgcttaaagagggctaccagctggggcaacagagtttgtgcaaaaggttttgggacaaactgaacctcttcctgagaggaaacctgtccctcgggtggcagcttacaagccaggagactcacgaactgcagagctgcttgaagcagatcattcggaatatcaagtttaaggcaccgccatgtaacacattcgtcgacctcacctcggcatgcaaaatatctcctgcctcttacaacaaagaggagtccgagcagatggggaaaaccagccggaaagacatgcattgtctggaagcgtccagtcccactttctcaaaagagcctatgaaagtgcaggactcagtgttaattaaggccgacaatactatagagggggacaacaacgagcagaattatatcaaggatgtcaaattagaggatcatctgctggctggaagttgtctcaagcaatcctcgaagaatatttttactgaaagagccgaggaccaaattaagatcagcacaagaaaacagaaatctgtcaaggagatttcgtcgtacacgccgaaagactgcaccagtcgaaatggcccagagcggggatgtgaccgcggtatcatcgtctcaacgcgtctgctaactgactcttctaccgacgccttggagaaagtctctacgtccaacgaggacttttccctgaaggacgacgccttggccaaaacgtccaaaagaaagactaaagttcaaaaagacgaaatctgcgcaaaactcagccacgtaatcaagaaacagcatcgaaagagcacgctcgtggataacacgatcaacctggatgaaaacctgacggtgagtaatatcgagagcttttactctcgaaaggacaccggggtgcagaagggggatgggtttatccacaacttgagccttgaccccagtggggtcttggatgataaaaacggcgaacaaaagagtcagaataatgtgcttcctaaagagaaacagctcaaaaacgaagagctggtgattttttcattccatgaaaacaactgcaagatccaagaatttcacgtggacgggaaagagctgataccatttacagaaatgaccaatgcttctgaaaagaaaagctctccttttaaagacctgatgactgttcctgaatcccgcgatgaggaaatgtccaacagtacttctgtgatctattccaatcttacccgggaacaggctcctgatatcagtcctaagtccgataccctgaccgacagtcagatcgacagggacctgcacaaactgtccctgttagcacaggccagtgtgattacatttcctagcgactctccccagaactccagccagctgcagcggaaagtgaaagaggacaagcgctgttttaccgccaaccaaaacaatgtaggggacacttctaggggccaggtcattatcatatccgattccgacgacgacgacgatgaacgcatactctctctggaaaagttgactaagcaagataaaatttgcttggaacgggagcacccagaacagcacgtctctacagtaaattctaaggaagaaaaaaacccagttaaagaggagaagacggaaactctctttcaatttgaggaatcagatagtcaatgtttcgagttcgagagctctagtgaggttttttctgtgtggcaagatcaccctgatgataataactccgttcaagacggggagaagaagtgtctcgcgccaatagctaataccacgaatggccaggggtgcactgattacgtgtcagaggtggttaaaaagggagccgaaggcattgaggaacacactagaccacggtccatttccgtggaagagttctgcgaaatcgaagtcaagaagccaaagaggaagcggtcagaaaagccgatggccgaagacccagttcggccgagctcttcagtgcgtaacgaagggcagagcgataccaacaagagagatcttgtcgggaatgatttcaaatctattgatagaagaacctctacacccaattctcgaatccagagagcaactactgtgagtcagaaaaagagcagcaaactttgcacttgtacagaaccaattcgcaaagtccccgtgtccaagacacccaagaagacacacagcgacgccaaaaaggggcagaataggtcgagcaactacctgtcatgtcgaaccactccagctattgtccctcctaagaagtttcgccagtgtccggagccaacctctaccgccgaaaagctgggtctgaagaagggtcctcgaaaggcctatgagctttcccaacgctcactggattatgtggcacaattacgggatcacggtaaaacagtgggggtagttgatacgagaaaaaaaacaaagctgatctccccacagaatctgtcagttcgaaacaacaaaaagctgcttacatcccaggagctgcagatgcagagacagatccgacctaaaagccaaaaaaacaggcggagactgtctgactgcgagtccactgacgttaagcgggcaggtagtcacaccgcccagaactcagacatttttgtccctgagagtgacaggtctgactacaactgtactggcggcactgaggtgctggccaacagcaaccgcaagcagctgatcaagtgtatgcccagtgagccagagacgatcaaggcaaaacacggctctcctgctacagatgacgcatgtccactaaaccaatgcgattcagtggttcttaatgggactgtcccgactaatgaggtgattgtatccacgagcgaagaccccctggggggaggagatcccacagcacgacacatcgagatggcagcacttaaagaaggcgagcccgactcctcctccgatgccgaggaagacaatctgttcttgacacagaatgacccagaggacatggatctgtgtagtcagatggaaaacgataattataagttgattgaactaatacatggcaaagacacagttgaagtggaggaggattccgtctccagaccccagttggagtccttgagcggcaccaagtgtaagtacaaagactgcctggaaactacaaaaaatcagggcgagtactgtccaaaacatagcgaggtgaaggccgcagacgaggatgtgttccgcaaaccgggcctcccacctcccgcaagcaagccgctgcgtcctacgacgaagatattctcctcaaagagtacatctcgaattgccggattgagcaaatcacttgaaacttctagtgccctgagtccatctctgaaaaacaagagtaagggcatacagtccatcctaaaagtcccgcagcctgtgcccctgatcgcccaaaaaccagttggagagatgaagaactcttgcaatgtgcttcaccctcaaagccctaacaactctaacagacagggctgtaaggtaccatttggtgagtctaagtactttccatcctcaagtcccgtgaatatcctgttgagttctcaaagcgtctctgacacattcgtaaaagaggtcctgaagtggaaatatgagatgttcttaaacttcggccagtgcggccctcccgcctctctctgtcagagcattagccggccagttccggtacgatttcataactacggggactactttaacgtgttttttcctctaatggtcctgaatacgttcgagacggttgcccaggaatggctgaatagccctaaccgagaaaacttctaccagctgcaggttagaaagttcccggctgattacattaaatattgggagttcgctgtctacctcgaagagtgtgagctggccaagcagctgtatcctaaggagaatgatcttgtgtttttagcaccagagagaatcaatgaggagaaaaaggatacagagcgaaacgacattcaagacctccatgaatatcattccgggtacgtacataagttcaggcggacaagtgtgatgcggaatggaaaaaccgagtgttatctgtctattcagactcaagagaatttccccgccaatctcaacgaactggtgaactgtatagtcatctcaagtctcgtaactacccaaaggaaattaaaagcaatgtctttgttgggatccagaaatcagttggcaagagccgtactgaatcctaacccgatggacttctgcacaaaagatctgctcactacaacgtccgagagaatcatagcttacctgcgagatttcaatgaggatcaaaaaaaggcgattgaaactgcttacgctatggtcaagcatagccccagtgtggccaaaatttgccttatccatggcccaccgggcacagggaagtcaaaaactatcgtgggcttgctgtacagactgcttaccgagaaccagaggaaaggccactccgatgagaattccaacgcaaagatcaagcagaatagggtactcgtttgtgcaccttccaacgccgcagtagacgaactgatgaagaaaattattcttgaattcaaggaaaagtgcaaggataagaagaaccctctcgggaattgcggcgacattaacctcgtgaggttaggacccgaaaaaagcataaactccgaggttttgaaattttctctggattctcaggtaaatcacaggatgaagaaagaactgcccagccatgtccaggcaatgcacaagaggaaagaatttctggattatcagctggacgaattgtcacgacaacgcgcactgtgcaggggtggccgagagatacaaagacaggaactcgatgagaatatctctaaggtctccaaggagaggcaggagctcgcttctaaaatcaaagaggttcaaggaaggcctcagaagacccagagcataatcatcctggagtcacatataatctgttgcacattaagcacgagtggaggcctgctactcgagagcgcctttcgtggacaggggggcgtaccattttcctgtgtcatcgtcgatgaagcagggcagagctgtgaaattgaaaccctcacccccttgattcataggtgcaataagctaattctcgtcggcgatccaaagcagctgccccccacagtgatctccatgaaagcccaggagtacggctatgatcagtctatgatggctcgcttttgccgcctgttagaagaaaatgtcgagcataacatgatctcaaggctgccaattctgcagcttaccgtccaataccggatgcaccctgatatatgtctgtttccatcaaactatgtgtataaccgaaacctgaaaacgaatagacagactgaagcgattaggtgttcctctgactggccatttcaaccatacctggtgtttgacgtgggcgatggtagtgaaaggagagataatgactcatacataaatgtccaggaaattaaattagtgatggagatcattaaacttatcaaggataagaggaaggatgtctccttccggaatattgggatcattacacattataaggcacagaaaactatgattcaaaaggatctcgacaaggaattcgaccgcaagggcccggctgaagtggacacagtggatgcatttcaggggagacagaaagattgcgtgatcgtgacttgtgtcagagctaactcaattcagggctccatcggatttctagcctccctgcagagattgaacgttacaattactcgcgctaagtattcactcttcatacttgggcatcttcggacattaatgcagctgctcccaaggtccttttgcgttcacgttaaccattcaccattttttagtcctgagcccaagtaccttcattgggccctaaaagagaaccagcattggaatcagctgattcaagatgcccagaagcgcggtgcaattataaaaacctgtgataaaaactacaggcatgacgcagtgaaaatcctcaagttgaagccggttcttcaaagatctctcactcatccaccgaccatcgcaccagagggctcgagaccccagggcggcctgccttccagcaagctcgactccggattcgccaagaccagcgttgcggcttctttgtaccatacaccgagcgacagcaaagaaattacgctgactgtcacaagcaaggacccagaaaggccgcctgtccatgaccagctgcaagaccctaggttgctcaaaagaatggggatcgaagtgaaaggaggcatatttctctgggatcctcaacccagctcgccacagcatccaggggctacgcccccgacaggcgaaccaggcttcccagtggtgcatcaggacctgagccacattcagcaacccgctgctgtggtggcggctctgtcctctcacaagcctccggtgaggggtgagccacctgccgcatcaccagaggcatcaacatgccaaagcaagtgcgacgatcccgaagaggagctgtgccatcggcgggaggcacgcgccttctctgaaggggagcaggaaaagtgcggatctgagacccatcataccaggagaaatagtaggtgggacaaacgtactctggaacaggaggacagctcctccaaaaagaggaagctcctctag

SEQ ID NO: 133734 - DNA, 7935 bp, Artificial Sequence
  Description of Artificial Sequence: Synthetic coding sequence
atgtcaacctgttgctggtgcacacctggcggtgcctcaaccatcgattttctgaaacgctatgctagcaatactccctctggagaatttcaaacagcagacgaggacctgtgttactgtttggagtgtgtggctgagtatcataaggctcgagatgagctgccctttttacacgaggtgctctgggagcttgaaaccttacggcttattaaccatttcgagaagtctatgaaggctgaaataggcgatgatgacgaactgtatatcgtggataacaatggggaaatgcctcttttcgatattaccgggcaggattttgagaataaacttcgcgtaccactgcttgaaatcttaaagtacccctacttgctgttgcacgagcgggtcaacgagctctgtgtcgaagccctgtgtcgcatggagcaggcaaactgctcattccaggtgttcgataagcatccaggcatctatttgttcttagtgcaccccaacgaaatggtgaggcgttgggcgattctgacagcaaggaatttaggaaaggtggacagagacgattattacgaccttcaggaggtcctactgtgcctcttcaaggtaattgagctgggactcttagaatctccagatatctacacaagttcagtactggagaaagggaaattgatccttcttccttctcacatgtatgatacaacaaactataagtcatactggttggggatctgcatgctgctgacgatcctagaagagcaagcgatggattccctgctgttgggctccgacaaacagaacgatttcatgcaatctatactccatactatggagagggaggccgacgacgatagtgtcgaccccttttggccagctttacattgcttcatggtgatcctcgataggctgggcagcaaagtctggggccagctgatggaccccatcgtggcatttcagaccatcatcaacaacgccagctataaccgggagatccgacatattcgaaacagcagtgtcaggaccaaactagagcccgagagctacctggacgatatggttacctgtagccagatagtgtataactataatcctgagaagactaagaaggactcaggctggaggactgccatctgccccgactactgccctaacatgtacgaggagatggagacgctggcgagcgtcctgcaaagcgatattggccaggacatgcgtgtgcataacagcactttcctgtggttcatcccttttgtgcagtcactaatggatctgaaggacttgggagtcgcctatattgctcaggtggtgaatcacttgtactccgaagtaaaggaagtgttgaatcagactgatgcagtctgcgacaaggttactgagtttttcctgctgatcctggtgagcgtcattgaactgcaccgcaacaagaaatgcttgcacctactatgggtgagcagccagcagtgggtggaggcagtggtaaaatgcgccaaattacctacaacggctttcacaagaagctccgaaaaatcaagtgggaactgcagtaaaggcactgccatgattagtagtctctctctgcacagtatgcctagcaattctgtccaactcgcatacgtgcagctgattcgcagcctactgaaagagggatatcagctgggacagcagtctttgtgcaagcggttctgggataaactgaaccttttcctccggggtaacttgtcacttggttggcagctgacctctcaagagacccatgaactgcagtcctgtctgaagcagattattcgaaacatcaagtttaaggcgcccccctgcaatacgtttgtggacttaacatctgcctgtaaaattagtcccgcatcttataataaagaagaaagtgaacagatggggaagacctctcggaaggatatgcactgtttagaagcgagcagccctacattttccaaggagcccatgaaagtgcaggatagtgtcctgatcaaagctgacaatactattgaaggtgacaacaatgagcaaaattacatcaaggatgtgaagctcgaggatcacctgctggctggctcgtgcctcaagcaaagtagtaagaatatttttaccgagcgcgccgaagaccagatcaagatttccacgcgtaagcaaaaatctgtgaaagaaatcagttcttatacccccaaagactgcacctcccgtaacgggcccgagcgcggatgcgaccgaggaatcatcgtgtcaaccagactgctgaccgactcctccaccgatgctctggaaaaggtgagtacctcaaatgaggacttcagtttaaaagatgacgcactcgctaagacatccaagcgtaagacaaaggtgcagaaagacgagatttgtgccaaactgtcccacgtgattaagaagcagcatcgaaaatctaccctagtggataatacaatcaatctggacgagaacctgactgtttccaatattgagagcttctacagcaggaaggacacaggggttcaaaaaggggacggtttcatacataacctatccttggacccatcgggggttttagatgataagaacggggaacagaaaagccagaacaatgtgctgcccaaagagaagcaactgaaaaacgaagagctcgtcatattcagctttcatgaaaacaactgtaagatccaggagtttcatgttgacggcaaagagctcattccatttactgagatgacaaatgcaagcgaaaagaagagctcccccttcaaggacctgatgaccgtgcccgagtcgcgtgacgaggagatgtccaatagcacatccgtcatatacagtaatctgacacgagaacaggcccctgacatctcccctaaatcagataccttaacagactcacaaattgacagagacctccataaactgtccctcttagctcaggccagcgttatcactttcccctctgattccccacaaaactccagccagctgcaacgcaaagtgaaagaagacaagaggtgttttacagctaatcaaaacaacgtcggtgacacctcccgcgggcaggtgatcatcataagcgactccgacgacgacgatgatgaacgcatcctgtcactcgaaaagcttaccaaacaggacaaaatctgtttagagcgggagcatccggagcagcacgtctccacggtcaattcaaaggaagagaaaaatcccgtaaaggaggagaaaaccgaaactctgttccagtttgaagaaagcgattcccagtgttttgagtttgaaagcagcagcgaggtgttctccgtgtggcaggaccatcctgatgacaataacagcgtgcaggatggcgagaaaaaatgtctggctcccatcgccaatacaaccaatggccagggatgcactgactatgtgtctgaggtggtgaaaaagggcgccgagggtatcgaagaacatacaaggccccgatccatctcagtcgaggaattttgcgaaatcgaggtcaagaagccaaagagaaaacggtcagagaagccaatggctgaggaccccgtacggccttcgtcctcggtgaggaatgaaggacaatcagatactaacaaacgagatctcgtggggaatgatttcaaatctattgacaggagaaccagtacccccaacagccggattcagcgcgcgacaactgtgtcccagaaaaaatcatccaaactttgcacctgtactgagccgattagaaaggtacctgtgagcaagactcccaaaaagacccatagcgatgccaagaaaggacagaaccggtctagcaactacctgtcatgcaggacaacaccggctatcgttccaccgaaaaaatttcgccaatgtcctgagcccacttccacagctgaaaaactgggacttaaaaaggggcctagaaaagcctatgaactgtctcaacgatctctcgactacgtggctcagctgagggaccatggcaaaaccgttggggtggtcgacaccagaaagaaaacgaagctgatttccccgcagaatttgagtgtgagaaacaacaagaaactgctcaccagtcaggagttacagatgcagagacagatcagaccaaaatcccagaagaatcggcggaggctgtctgactgtgagtctacggatgtaaaaagagccggatcccacactgcccagaactcagacatcttcgtgcctgaaagcgaccggagcgactacaactgcaccgggggtaccgaggtgctggcgaattcaaatcgcaaacagctcattaagtgtatgccaagcgaacctgagaccataaaggccaagcatgggtcacccgcaactgacgatgcgtgcccccttaaccaatgtgacagtgtggtgttgaatggcactgtacctactaacgaagtgattgtctctactagcgaggaccccctgggagggggcgaccccacagcacggcacatcgagatggccgccctgaaagaaggggaaccggactcctcctctgatgccgaggaggataacctcttcctaacacagaacgatcccgaggacatggatctgtgctctcaaatggagaatgacaactataaattgatcgagctaatacacgggaaggataccgttgaagttgaggaggactcagtgtctcgcccccagctcgaatccctttccgggaccaaatgcaaatacaaggactgtttggagacgaccaaaaatcaaggggagtattgcccgaaacactccgaagtaaaggccgccgatgaggacgtgttccggaaaccaggcctcccaccacctgcctcaaaacccctgcgaccaaccaccaagatttttagcagtaagtcaacgagcagaattgcaggactgtccaagtccctggagactagtagcgctctctcccccagcttgaagaataaaagcaagggcatacagtctatcttgaaggtgccccagcctgtgcctctcatagcccagaaacctgtgggagagatgaagaattcctgcaacgtattgcacccacaaagtccaaataattccaaccgccaaggatgtaaggtgccttttggtgagtcaaaatatttcccatcgagcagtccggtgaacatcctgctgagcagccaatccgtcagtgacacctttgtcaaggaggtactgaagtggaaatacgaaatgtttttaaactttggccagtgcggccctcccgcctccctctgtcaatctatcagtcgacctgtgcccgtgcggtttcataattacggggactacttcaacgtctttttccctctaatggtcctaaacaccttcgaaacagtagcacaggaatggcttaattcacccaaccgagagaatttttaccagctccaggtacggaagttccctgctgattatattaagtactgggagtttgccgtatacctcgaggagtgtgaacttgctaaacagttgtacccaaaagaaaacgatttagtctttctggctcccgagaggataaacgaagagaagaaggacactgagcgcaatgatattcaggacttgcacgaataccacagtggttatgttcacaagtttcgccggacctcagttatgaggaatggcaagaccgaatgctacttgagcatccagacccaggagaacttcccagccaatctaaacgagctggttaactgtatagttatcagtagcctggttaccacccagcgaaagcttaaggccatgagtctgcttggcagtagaaaccagttagctagggcggtgcttaaccccaatcctatggatttctgtaccaaagatctcctgacgaccacatccgagaggattatcgcttatctcagggacttcaacgaggaccaaaaaaaagcaattgagacggcctacgccatggtaaagcattctcccagcgtggccaagatatgcttgatccacggtcccccagggaccggcaaatcaaagacgattgtagggctgttatatcggttgctgacggagaaccagcgaaaagggcactcggacgaaaatagtaacgccaagattaagcagaatagggtcttagtttgcgcaccgtccaacgccgcagtggacgaactgatgaagaagataatcttagaattcaaagaaaaatgtaaggataaaaagaatcctctaggcaactgcggggatataaacttagtgaggctgggaccggagaagtccatcaacagtgaggtcttgaaatttagcctggactctcaggtgaaccacagaatgaaaaaggaattaccttcgcacgtgcaggctatgcacaagcgaaaggagtttctggattatcagcttgatgagctctcccgccagagagccctgtgccgtggtggccgtgaaatccagcgccaggaattggacgagaatatcagcaaagtctcaaaggaacgtcaggagctggcttctaaaattaaagaggtccagggcagacctcaaaaaactcagagcattataatcctagagtcccatatcatatgttgtacactgtctacgtccggcggcctgctgctcgagtccgcattcaggggtcaaggcggggtgccctttagctgtgtgattgtggacgaggccggccagagctgcgagatagagacactgaccccacttatccatcgatgtaacaagttgattctggttggtgatccaaaacagttgccacccacagtcatttcaatgaaagcgcaggagtatgggtatgatcagtctatgatggctcgtttttgtcgtctacttgaggagaacgtggaacataatatgattagtagactgccgattctgcagttaactgtgcagtacaggatgcatcctgatatttgcctcttcccttcaaattacgtgtacaaccgcaatctgaaaacaaatcgacagacggaagccattcgctgtagtagcgattggccatttcagccctatctcgtgtttgatgtgggggatgggtccgagaggcgggacaacgacagctacatcaacgtccaagaaatcaaacttgttatggaaataatcaagctcatcaaggacaagcgaaaggacgtatccttccggaacatcggcattatcacccactacaaagcccagaaaaccatgatccagaaagatttagataaggagttcgacaggaagggattcctggcatccttacagaggctgaacgtgaccatcacacgcgccaaatactcactctttatactcggccatctcagaactcttatggagaatcagcattggaaccagcttatccaggatgcccaaaagcgcggtgccatcattaagacatgtgataagaactatagacatgacgctgtcaagatcctgaagctgaaaccagtcctccagaggtctctgacacatccccctaccatcgctcctgaaggatccagacctcagggtggcttgccctcaagcaagctggactctggattcgctaagaccagtgtggccgcctccctgtaccatactccctcagatagcaaagagatcacattgacagtcacttctaaggacccggaaagacccccagtgcatgaccagcttcaagaccctagactcctgaagcgtatggggatcgaagttaagggaggcatcttcctttgggatccacagccgtcttccccccaacaccccggggccaccccccccacgggggagccgggcttcccagtcgttcatcaggacttgtcccatattcaacaaccagcagccgtggtggcagccctctcaagccataagccacctgtgcgcggcgaaccccccgcagccagccccgaggcatcgacctgccaatctaagtgcgacgacccagaagaggagctctgtcatagacgggaggccagagcctttagcgaaggtgaacaggagaaatgtggaagtgagacacaccacacgaggcggaactcacgttgggacaagcggacgctggaacaagaagattcctcctcaaaaaaaaggaaattgctgtag

SEQ ID NO: 133735 - DNA, 2847 bp, Artificial Sequence
  Description of Artificial Sequence: Synthetic coding sequence
gtcgcacaggaatggctgaactcccccaacagggaaaacttctatcaactgcaggtgagaaagtttccggcggattatataaagtattgggagttcgccgtctacctggaggagtgtgaattggccaagcagctataccctaaggaaaacgacctcgtgttcctggcccctgaacggatcaatgaagagaaaaaggatactgaaaggaacgacatccaggatcttcatgagtaccactctgggtatgttcataaattcaggaggaccagcgtcatgcgcaacggaaagaccgagtgctatttatctatccaaacacaggaaaacttccccgcaaacctgaacgaactagtaaactgtatcgtgatcagctctctggtgactacacagcgcaagctgaaagccatgagtctcctgggcagccgcaaccagctcgcccgggccgttctgaatccaaatccaatggacttttgtactaaggacctcctaaccaccacctcggagcgaatcatcgcatacctaagggattttaatgaggatcagaagaaggcgattgaaacggcttatgctatggttaagcactctccctctgtcgctaagatctgcctcatccacgggccaccaggcactggcaaaagtaagaccatcgttggactcctgtacaggctcttaacggagaaccagcgtaaaggccacagcgacgagaatagtaatgccaagatcaaacagaatcgtgtgctagtctgtgctcctagtaacgccgccgtcgacgaactcatgaaaaagatcatactcgaattcaaagagaagtgcaaggataagaagaacccactgggtaattgcggcgatatcaacctcgtgcgtttaggcccagaaaagtccattaacagcgaggtcctcaaattctcattagacagtcaggttaatcatcggatgaagaaggagctgccttcgcacgtacaagccatgcataaacgcaaggagtttctcgactatcagttggatgagctcagtaggcagcgagctctgtgccgtggcgggagagaaattcagaggcaggaattggacgagaacatttctaaggtgtccaaagaacggcaggagctcgcatcaaaaattaaggaagtgcagggtcggcctcagaaaacgcagagtattattatcctagaatcacatatcatttgttgcacactttctacatcgggtggtcttctgcttgagtccgcctttaggggacagggaggcgtcccgttctcttgtgtgatcgtggacgaggccgggcagagttgtgaaatagaaacactaacccccctgatccaccgatgtaataagcttatccttgtcggcgatcctaaacagctgcctccaaccgtcatttctatgaaggcacaggaatacggatatgatcaaagcatgatggctcgattctgccgcctgttggaggaaaacgtcgagcataacatgattagtaggttaccgattctgcagctgacggtgcaataccggatgcatcccgacatatgcttatttccgagtaactacgtgtacaaccgaaatctcaaaactaatcgacaaacagaggcaatacgatgcagcagcgattggccgttccagccatatttagtgttcgacgtgggggatggctccgaacgcagggataatgattcttatatcaatgtgcaggagattaagctggtcatggagatcattaaattgatcaaagataagcgcaaggacgtgagcttcaggaatattgggataataacccactataaggcccagaagacgatgatccagaaagaccttgataaggaatttgaccgcaaggggccagccgaggttgatactgtagacgcctttcaaggtcggcagaaggactgcgttatcgttacatgcgtcagagccaactctatacagggcagcattgggtttctggcctctcttcagagactaaatgtgaccattacaagggccaaatattccttattcattctgggacatcttcgcactttgatgcagttactccccagaagtttctgtgtgcatgtgaatcattctccatttttctcgcccgagccaaaatacctccactgggctctaaaggaaaaccagcactggaatcagctcatccaggacgctcagaaacgaggcgccatcattaagacatgtgataaaaactaccgtcatgacgccgtcaaaatactgaaactgaaacctgtacttcaacgcagtcttacacatccgcccacaattgcaccagaaggcagtaggccccaggggggacttccatcctctaagctggatagcgggttcgctaagacctccgtggcggcttccctatatcacactccatccgattcaaaggaaataactcttacagtgaccagcaaagatcccgaacgaccccctgtccacgaccaactgcaagaccctcggctgctcaagcggatgggcatcgaggtcaaaggaggcatattcctttgggatccgcaacctagttcccctcagcaccccggcgctacaccaccaactggggagcccggatttcctgtcgtgcatcaggatctctctcatattcagcagcccgcagccgtggttgctgcgctgtctagccacaagcctccggtcaggggcgagcctcctgctgctagccccgaagcgagcacttgccagtccaaatgtgacgatcctgaagaggagttgtgtcacaggcgcgaagctcgcgccttctcagagggagaacaagaaaagtgcgggtctgaaacacaccacactcgccgcaactctcgatgggacaagaggactctggagcaggaagacagcagcagcaaaaagcggaagctcctatag

SEQ ID NO: 133736 - DNA, 1269 bp, Artificial Sequence
  Description of Artificial Sequence: Synthetic coding sequence
atgtccacaagctacggatgtttttggcgcagattcattcacgggattggccgctccggagatataagtgccgtgcaacccaaggctgccggatcttctttgctaaataagatcaccaacagtctagttttggacataataaagttagcgggagttcatacggtggctaattgttttgtggtgccaatggctactggaatgtcccttacactttgtttcttgaccctccggcataaaagacccaaagctaagtacataatctggcctcgtatcgaccagaagagttgttttaagtcaatgatcaccgccggattcgaacctgtggttattgaaaatgtacttgagggggacgaactgagaacagatctgaaggctgttgaagccaaggtgcaggagctgggacctgactgcattctatgcattcattccaccacaagctgttttgcacctcgggtgcctgatagactcgaagagctggcggtcatttgtgcaaactacgacatcccgcacatagtgaacaacgcatacggagtgcagtcaagcaaatgcatgcacttaatacagcaaggcgctcgggtcggacgcatcgacgcttttgttcagtctttagacaaaaattttatggttccggtgggcggtgcgatcatcgcggggtttaatgactcattcatccaggagatctcaaagatgtatcctggcagggcttctgcatccccctcccttgatgtcctgatcaccctattaagtctgggaagcaacgggtacaagaaactactcaaggagcgcaaagagatgttttcttatctgagcaaccagataaagaaactgtccgaagcctataatgagagattactgcatacaccgcacaatcctatcagcctagccatgacacttaaaaccttggatgaacaccgcgataaggctgtgacccaactgggatcaatgctgttcaccagacaggtctctggggctagagttgttcctttgggctccatgcagaccgtgagcgggtacaccttcagaggattcatgtctcacacaaacaactacccctgcgcatatctaaatgccgcatctgcaattggcatgaaaatgcaggacgttgacctttttattaagcggttggatcggtgcctgaaagccgtgagaaaggagcgtagcaaggaatccgacgacaactatgacaaaactgaggatgtggatatcgaggagatggcgctcaaactggacaatgtccttctcgacacttatcaggatgcaagtagctag

SEQ ID NO: 133737 - DNA, 1506 bp, Artificial Sequence
  Description of Artificial Sequence: Synthetic coding sequence
atgaacagggagtcgtttgccgctggtgagagactggtgtcccccgcttacgttcggcaagggtgcgaagcccgcagatcccacgagcacttgattcggctgttgctggagaaaggcaagtgcccagagaatggctgggacgaaagcactttggagctgtttctccacgagcttgccattatggattctaacaattttttaggaaactgcggcgtgggcgagcgagaagggagggttgcgtccgctttggtggcgcgtcgacattaccgatttatccacggcattggtcggagcggggacattagcgccgttcagcccaaagcggctggcagtagtctgctgaataaaataacaaacagcctggtgctggatatcatcaaattagctggagtccatacagtagctaactgcttcgtggttcccatggccaccgggatgtcactcaccttatgtttcctgaccctgagacacaagcgacccaaggctaagtacatcatttggccaagaatcgaccagaagagttgctttaagtcaatgatcacggcgggcttcgagcccgtagtgattgagaatgtcctcgagggcgatgagctccggaccgatttgaaggctgtggaggccaaagtccaggaactcggccctgactgcatcctctgtattcacagcacaacttcttgttttgcaccccgagtgcctgatcggctcgaggagctggctgtgatatgcgcaaattacgatatcccccatatcgtcaataatgcatacggagtccaatctagtaaatgcatgcaccttatccagcagggcgcccgagtgggaaggatagacgcctttgtacagtcattagacaagaatttcatggtgcccgttgggggagcaatcatcgccggctttaacgactcctttatccaggagatcagtaagatgtatcccgggcgggcttctgcttcaccttccctagatgtgcttatcactttactgagcctgggctccaacggatataagaaactcctaaaagaaaggaaggaaatgttctcctacctgagcaatcagattaagaagctctctgaggcatacaacgaacgccttctgcacaccccacataaccctatttcacttgccatgactctgaagaccctggacgagcacagagataaagccgtgacgcagctgggctccatgctttttactcggcaggtttccggtgcccgggtggtgccactgggctcaatgcaaacggtaagtggctacacatttagggggtttatgagtcataccaacaactacccatgcgcatacctgaacgcagcttccgctatcggaatgaagatgcaggacgtggatctgttcataaagcgactggaccgttgtctcaaagctgtgagaaaggagcgatctaaagagagcgacgataattatgataagacagaagatgttgacatagaggaaatggccctcaagttggacaacgtcctgctcgacacatatcaagatgcgtcctcctag

SEQ ID NO: 133738 - DNA, 903 bp, Artificial Sequence
  Description of Artificial Sequence: Synthetic coding sequence
atggaaggtgtgctttataaatggaccaactacctcaccggatggcaacctaggtggttcgtccttgataacggcatcctgtcatactatgattcccaggatgatgtttgtaagggcagcaaagggtccataaaaatggctgtttgtgagataaaggtgcatagtgcagataacaccaggatggagctgattattcctggcgaacaacatttctacatgaaggctgttaacgctgcagagagacagaggtggcttgtggccttgggaagttctaaagcttgccttacagatacccgaacaaagaaagagaaggaaatttccgagactagtgagagcctgaagactaaaatgtccgaactgaggctgtattgcgatctcctcatgcaacaagtgcacacgattcaggagttcgtgcatcatgacgagaatcattcttctcccagtgcagagaacatgaacgaagccagttccttactctccgctacatgcaatacttttattacaaccctcgaagagtgcgtgaaaatcgcaaacgcaaaattcaagcccgagatgttccagctgcaccatccggatccgttggtgtcccccgtgtccccatcgcccgtccagatgatgaaacggagcgtctcgcacccaggttcatgttcaagcgagaggtcaagccacagcattaaagagcctgttagcactcttcacaggttgagccaaaggaggcgcaggacatattccgataccgactcctgctctgatatccctctggaggaccccgaccgtcccgttcattgcagtaagaataccctgaatggagacttggctagcgcaaccattcccgaagaatcccgcctgatggccaaaaagcagtctgaatcagaggacacactgccgtctttcagtagttag

SEQ ID NO: 133739 - DNA, 1104 bp, Artificial Sequence
  Description of Artificial Sequence: Synthetic coding sequence
atggacaaagagtacgtggggttcgccgccttacctaaccagttacacagaaagtccgtcaagaaggggtttgatttcacgctcatggttgccggcgaatcagggctggggaaaagcacccttattaattcactgtttctgactaacctctatgaagaccgtcaggtgcctgaggcctctgctaggttgacgcagacactggcaatcgagcgccggggggttgagattgaggaaggcggcgttaaggtcaaacttacgttggtggacactcccgggttcggtgactccgtcgattgctcagactgctggctcccagttgtaaagtttatagaagaacaattcgaacagtacctgagggatgagagcggcctgaatcgcaagaacattcaggacagcagagttcactgctgcttgtacttcatatcgccattcggaaggggcctccgacccctggatgtggcctttcttcgcgcagtgcacgagaaagtcaatattattcctgtcatcgggaaagctgatgcattaatgccgcaggaaactcaggcactgaagcagaaaattcgggaccagttgaaggaggaagaaattcacatctatcagttccctgaatgcgactccgatgaggacgaagattttaagaggcaggatgcagaaatgaaggaaagcattccattcgccgtggttggaagctgcgaagtcgttagagacggtggcaacagacccgtccgtggccggcgttacagctggggaactgtggaggtggagaacccacaccactgtgacttccttaatctgcgcagaatgctcgtgcagacacatcttcaggacctcaaagaggtgacacatgacctgctatacgaagggtaccgagcaagatgcttgcagtctctggcaaggcctggtgcccgtgacagggccagcaggagtaagctttccagacagagcgctaccgaaattcccctacctatgctccccctggccgacactgagaagctgataagagagaaggatgaggaactacggaggatgcaagaaatgcttgagaagatgcaggcccagatgcagcagagccaggcccagggagagcagtccgatgccctctag

SEQ ID NO: 133740 - DNA, 1104 bp, Artificial Sequence
  Description of Artificial Sequence: Synthetic coding sequence
atggataaagaatacgtgggctttgcagccctgcccaatcagctgcaccgtaagagtgttaaaaaaggctttgactttacccttatggtggccggcgagtccggattggggaaatctacactcatcaactctttgtttctgacaaacctctacgaagacagacaagtgcctgaggcatctgctagattgactcagaccctggcaatagaaaggagaggggtcgagatcgaagagggtggtgtcaaagtgaagctgaccttggtggacacccccggatttggagattccgttgactgttctgactgctggcttcctgttgtgaaatttattgaggagcagtttgagcagtacctgcgcgacgaatccggtctgaatcggaaaaatatccaagattcccgggtgcattgttgtctctatttcatttcaccttttggcagagggttacggcccctggacgtggccttcctcagggctgttcacgaaaaggtgaatataattcctgtcatcgggaaagcagacgccctgatgcctcaggagacccaggccctgaagcagaagatacgcgatcaactaaaggaagaggagattcacatctaccagtttcccgagtgcgattccgatgaggacgaggactttaagagacaagatgctgagatgaaggaatcaattccctttgccgtagtgggaagctgcgaggtcgtgcgcgatggaggaaatcgccctgtgcggggtaggcgctactcctggggtaccgtcgaggtggagaaccctcaccattgcgactttcttaacctgcggagaatgttagtccaaacccacctgcaagaccttaaggaggtgacacacgacctgctgtacgagggctaccgggctagatgcctccagtcacttgccagacccggcgcccgtgaccgtgccagcagatctaaactgtccagacagagtgctactgaaatccccctgccgatgctgcctctggctgacacagagaagctgatcagggagaaagacgaagagctccgcaggatgcaggaaatgctcgagaagatgcaagctcaaatgcaacagtcacaggcccagggcgaacagtccgatgcactgtag

SEQ ID NO: 133741 - DNA, 966 bp, Artificial Sequence
  Description of Artificial Sequence: Synthetic coding sequence
atgatgaaccgatactaccaacccattgtggattatattgatgcacaattcgaggcatatctccaggaagagttgaagattaagcggtccctgttcacataccatgatagccgtatccacgtgtgcctctatttcattagccctacgggccacagccttaaaaccttggatctccttacaatgaagaacctggacagcaaagtcaatattattcccgtaatcgcgaaggccgatactgtgagtaagactgagcttcaaaagtttaaaattaagctaatgtccgaactggtgtctaacggtgtgcagatatatcagtttccaacagacgacgatacaatagctaaagttaacgcagccatgaatggtcaactgccctttgccgtcgtgggatccatggatgaggtcaaggtgggaaataaaatggtcaaggcccgccagtatccctggggcgttgtgcaggtggagaacgagaatcactgtgattttgtcaagctacgtgaaatgttgatttgtaccaacatggaggacctgagggaacagactcatacaagacactatgaactgtacagacgctgcaaacttgaagaaatgggttttaccgatgtgggacccgagaacaaacccgtttccgtgcaggagacttacgaggccaagcggcacgaatttcacggggaacggcaacgcaaggaggaggagatgaaacagatgtttgtccagagggtgaaggagaaggaagccatccttaaggaagcagagcgtgaattacaggcaaaatttgagcacctgaagagacttcatcaggaggagcgtatgaaactggaggagaagaggaggctcctcgaagaagagatcatcgccttttccaaaaaaaaagcaaccagcgagatttttcacagtcagtccttcttagcgacaggctccaacttacgaaaggacaaagatcgaaaaaattccaattttctgtag

SEQ ID NO: 133742 - DNA, 954 bp, Artificial Sequence
  Description of Artificial Sequence: Synthetic coding sequence
atgagcggacacgtgggctttgagtcactgcctgaccagttggttaaccgctcgattcagcaggggttttgcttcaatatcctgtgcgtgggagagaccggaatcggcaaatctacgcttattgacaccttatttaacaccaatttcgaagactacgaaagcagccacttctgcccgaacgttaaactgaaggctcagacatatgagctgcaggagtccaatgtgcaattgaaactgacgatcgtgaacacggtgggttttggggatcaaattaataaagaggaaagttaccaacctatcgtcgattacatcgatgcacagtttgaagcctatctccaggaggagctgaaaatcaagagatccctctttacttatcacgactcgcgcatccacgtatgcttatactttattagccctacagggcattcgctgaaaacactggatcttctgaccatgaagaatctcgacagcaaggtgaacatcatccctgtgatagctaaagcggatacagtgtctaagaccgaacttcaaaagtttaaaattaagctcatgagcgagttagtgtccaacggcgtgcagatctaccagttccctacggatgacgacactattgctaaggtgaatgccgccatgaacggccagctaccgtttgctgttgtcgggtctatggacgaggtgaaagttgggaataaaatggtcaaggcccggcaatacccttggggggttgtgcaggtggagaacgaaaaccattgcgactttgtcaagctgcgcgagatgttaatttgtaccaacatggaggaccttcgagagcaaacacatacgcgacattatgaactgtacaggaggtgcaagctcgaggaaatgggatttaccgatgtgggtcccgagaacaagcctgtttcttataggcctaacctgtccacgctgagagactttacgaaaaagcgggagtag

SEQ ID NO: 133743 - DNA, 1635 bp, Artificial Sequence
  Description of Artificial Sequence: Synthetic coding sequence
atggcctcttccgaggtggccaggcatctcctgttccagagtcacatggctaccaagacgacctgcatgtccagtcagggctctgatgacgaacaaattaaacgagagaacatccgctctcttacgatgtctggtcacgtaggatttgaaagtctgccggaccagttggtgaaccgatcaatccaacagggcttttgctttaacatcctgtgtgttggtgagacaggaattggcaagtctaccctcatcgacaccctttttaacaccaactttgaagattatgagtcttcgcacttctgcccgaacgtgaagttaaaagcccaaacgtatgaattgcaggagtccaacgtgcagctaaagttgaccattgtgaacaccgtgggcttcggggatcagattaataaggaggagagctaccaaccgattgtggattacatcgatgcacagtttgaggcctacctgcaagaagagctgaagataaagaggtccctcttcacgtatcacgactctcggatccatgtctgcctctacttcatctcaccgaccgggcattccctcaagaccctggatctgttgactatgaagaacctggactcaaaggtcaatatcattccagtgatagccaaggccgatactgtatccaaaacagaactccaaaagttcaagattaaactgatgagcgagctggtgtcaaacggggtgcagatataccagtttccaacagatgacgacaccatagccaaagtaaatgcagcgatgaacggccagttacccttcgccgtcgtcgggtcaatggacgaggtcaaagtaggcaacaagatggtaaaggcccgccagtacccctggggcgtcgtacaggttgaaaacgaaaatcattgcgattttgttaaattaagagagatgcttatatgtacaaacatggaggaccttcgcgagcagacacacaccagacactacgaactgtaccgcagatgcaaactggaggaaatgggattcacggacgtggggccagagaataagccggtgtctgttcaggagacatacgaagcaaagaggcacgagtttcatggtgagcgacagcgcaaggaggaggagatgaagcagatgttcgttcagagggtcaaggagaaggaggccatcttaaaggaagctgaacgggaattacaggctaagtttgaacaccttaagaggctccatcaggaggagagaatgaagcttgaggagaagcggaggttactcgaagaagagattatagccttcagcaaaaagaaggccacttcagagatattccacagccagtctttcctagctactgggagtaacctgcgaaaggataaggaccgcaagaaagaacctgggtgccggtttgagctgctttgcattgacgtgagagcctgtgagacaaatggaggaagaaaagatgccgagaaagctcccatcttctgcaaaacggaggtaccagagcacaggagatctagtagtcaagctaactttatcaaaaagaaactggaagtgtgtttcgatttcgcagtcatttgttttataacctccattttcggcgagcagccgcagttgcttatttttatggagaaatacttccaagtacagggtcagtacatctcacagagtgaatag

SEQ ID NO: 133744 - DNA, 1365 bp, Artificial Sequence
  Description of Artificial Sequence: Synthetic coding sequence
atggcctcctcggaagtggcaagacatctgctattccagtcccacatggccaccaagaccacatgtatgagttctcaaggcagcgatgacgagcagatcaagagggaaaatataagaagcctgaccatgtctggacacgtcgggtttgaatccttgccagatcagctggtgaacagatccatccaacagggcttctgctttaatattttgtgcgtaggggagactggcattggcaaatcgaccctgatcgacacactgttcaataccaatttcgaagactatgagtctagccatttctgtcccaacgtgaaactgaaagcacagacttatgagctccaggaatctaacgtccagctgaagctcacaattgttaacactgtgggttttggcgatcaaatcaataaggaggagagttaccagccgattgtcgactacatcgacgcccaatttgaagcctacctccaggaagaactgaaaataaaaaggtccctcttcacataccatgactctcgtattcacgtttgcctctatttcatttctccgacaggccactctctgaagacccttgatctactcactatgaagaacttggattctaaagtcaacattatccccgttatcgccaaggccgacacagtgtctaagacagagctccagaagttcaagatcaagttgatgtctgagctagtgtccaacggcgtccagatatatcagtttccgacagatgacgatacaattgctaaagttaacgctgccatgaatggccagctaccattcgcagtagtggggtctatggacgaggtgaaggtgggcaataagatggtgaaggcccgccagtatccttggggtgtcgtccaggtcgagaatgaaaatcattgcgatttcgttaagcttagggaaatgctgatctgtaccaacatggaagaccttagagagcagacgcataccagacattacgaactttatagacgatgcaaactggaagaaatggggtttactgacgttggcccagagaataagccagtaagcgtgcaggaaacttatgaggccaagaggcacgagttccacggagagcggcaacgcaaggaggaagagatgaagcagatgttcgtccaacgggtaaaggagaaggaggccattctgaaggaagccgaaagagagctccaggctaagtttgagcacttaaagaggctgcatcaggaggagaggatgaaactggaggaaaagcggcgcctgctggaagaggaaattattgcattctcaaagaagaaggctacgagcgagatatttcacagtcagtctttccttgcaaccggttcaaacctgcggaaggataaggatcggaagaattccaactttctctag

SEQ ID NO: 133745 - DNA, 1296 bp, Artificial Sequence
  Description of Artificial Sequence: Synthetic coding sequence
atggcgtctagcgaagtcgccagacacctcaaaagagagaacatccgctccctcacgatgtccggccacgtcggcttcgagagtctgcccgaccaactggttaaccgcagcattcaacaaggcttttgctttaacatcctttgtgtgggggagacaggcattggtaagtctaccctgattgacacactcttcaacaccaatttcgaagattatgagagctctcatttttgtcctaacgttaaactcaaggcccagacctatgagctccaggagagcaacgtacagctgaagcttactatcgtaaacaccgtaggttttggcgaccagatcaataaggaagaatcttatcagccaattgttgattatattgacgctcagtttgaggcctatctgcaagaggaattaaaaatcaagcggtccttatttacctatcatgactcaagaattcacgtgtgcctgtacttcattagtccaactggacactcattgaaaacgcttgacctgctcacaatgaagaacctagacagcaaagtcaacattatccccgttatcgctaaggctgatacggtttctaagacagagctgcaaaaatttaagattaagctaatgagtgaactggtctcaaacggagtgcagatctaccaattccctactgatgacgatactatagcgaaagttaatgcggcaatgaacgggcaattaccgttcgcggtagtcgggtccatggatgaggtgaaggtgggtaataagatggtgaaagccaggcagtacccttggggggtggtgcaggttgaaaacgaaaaccactgtgacttcgtgaagttacgagaaatgttaatttgcacaaatatggaagaccttagagagcagacccatactagacactacgagctttatcggagatgcaagctggaggagatgggattcacagacgtaggtcctgaaaacaaaccagttagtgtacaggaaacctacgaggcaaagcgccacgagttccatggtgagcgtcagaggaaagaagaagagatgaagcagatgttcgttcagagggtcaaagaaaaagaggctatcctaaaggaggcagaacgggagttgcaggccaaattcgaacatttgaaaagactgcaccaggaggagagaatgaagctcgaggagaaaaggaggctactcgaggaggagattattgccttcagcaaaaagaaggctacctccgagatttttcatagccagtcctttctggccactggcagcaatcttaggaaggacaaggatcgtaagaacagtaatttcctttag

SEQ ID NO: 133746 - DNA, 1353 bp, Artificial Sequence
  Description of Artificial Sequence: Synthetic coding sequence
atggcttctagtgaggtcgctcggcatctgctgttccagtcgcacatggcaaccaagacaacttgcatgtccagccaggggtcagatgacgaacaaattaagagagagaatatacgctctctcactatgagcgggcatgtcgggttcgagtccctgccagatcagctggtgaatcgaagcatccagcaggggttctgtttcaacatcctgtgcgtgggcgagactggtatcggaaaaagtactctcatagacactcttttcaacacaaacttcgaggactatgagagctcccatttttgcccaaacgtcaagctgaaagcccagacctacgaactgcaggaaagcaatgtacagctgaagcttacaatcgtgaataccgtgggatttggcgatcagattaacaaggaagagagctatcagcccatcgtagactatatcgatgctcagtttgaagcctatttgcaagaagagctcaagattaagcggagccttttcacataccatgattcccgtatccacgtgtgcctctatttcataagccctactggccatagtctgaaaactctggatctcctgactatgaaaaacttggactcaaaagtgaatatcatccccgtaattgcaaaggcagacactgtttccaaaactgagctccagaaatttaagattaagctcatgagcgaactggtgtcaaacggcgtgcaaatttaccagttccctaccgatgatgatacgatcgccaaggtcaatgcagctatgaatggacagctacctttcgccgtggtaggttccatggacgaggttaaggtcggaaacaaaatggttaaagcccgacagtatccctggggcgtggtgcaggtcgagaacgagaaccattgcgatttcgtgaaattgagggagatgctcatttgtacgaacatggaggatctgcgggaacagacccacacgaggcattacgaactataccgaagatgcaaacttgaggagatgggattcacagacgtagggcctgagaacaagccggtttcggtgcaggaaacctatgaagctaaacgccacgaattccacggtgagaggcaaagaaaagaggaggagatgaagcagatgttcgtgcagagagtaaaagagaaagaggccatattgaaggaagccgaaagggaactccaggccaaattcgagcacttgaagcgtcttcatcaggaggaacgaatgaaattggaggagaaacgcagattactcgaggaagagataattgccttttctaagaagaaggccaccagcgagatcttccactcacaatcatttctcgccaccggcagtaacctgcgaaaggacaaggaccggaagaagtag

SEQ ID NO: 133747 - DNA, 1422 bp, Artificial Sequence
  Description of Artificial Sequence: Synthetic coding sequence
atggcgactaagactacttgcatgtcttcacaaggatccgacgacgagcagattaagagggagaatattcgctccctcaccatgagtggacacgtcggatttgagagcctccccgatcaactagttaatcgttcaattcaacaggggttctgctttaacatattgtgcgtcggcgagaccggaatcggaaaatcaactttaatagatactctcttcaacacaaatttcgaggattacgaaagctctcacttttgccccaacgtgaaactgaaggctcagacatacgagcttcaggagtccaacgtgcagttaaaactgactatagtcaatacagttggtttcggagaccagatcaataaagaagagtcctatcagcccatcgtcgattacattgacgctcagttcgaggcctacttacaggaagagttgaaaatcaagcggtcactgtttacatatcacgattctaggatccacgtttgcctatattttatttctcccacgggacactccctcaaaactctggatctcttaaccatgaaaaatctggacagcaaagtgaatatcatcccggtgatcgctaaggctgacactgtttcaaagactgaactgcaaaaattcaagatcaagctgatgtccgaattggtgtccaacggggtgcagatttatcaatttcccaccgacgacgatacaattgccaaagtcaatgctgccatgaacggacagctgccattcgccgtagtcgggtcaatggatgaagtcaaagtaggtaataagatggttaaggctcgtcagtatccttggggcgtcgtgcaggtggagaacgagaaccattgtgatttcgtaaagcttagagagatgctgatttgtaccaacatggaggatttgcgcgagcagacacacactaggcactatgagctgtatcgccgctgcaaactcgaggagatgggtttcacagatgtggggccggaaaacaagcccgtttcagtacaggagacttatgaggctaaacgccatgagttccacggggaacgccagcggaaagaggaagagatgaagcagatgttcgtccagagagtgaaagagaaggaggcaatattaaaggaggccgagcgcgagttgcaagccaaatttgagcatcttaaacggctgcaccaggaggaaaggatgaaactagaggaaaagcgccgcctgttagaggaggaaattatagcatttagcaagaagaaggcaacatcagagatcttccactctcaaagtttccttgctaccgggagcaacttacgtaaagataaagacaggaagaaggaacctggctgccgattcgagctgctttgtatcgatgtgagggcctgtgagactaacgggggtaggaaggatgccgagaaaggaagggaaggccactctgcccgcggccagccgtag

SEQ ID NO: 133748 - DNA, 852 bp, Artificial Sequence
  Description of Artificial Sequence: Synthetic coding sequence
atggccagcagcgaggttgcgaggcacttactctttcagagtcacatggctacaaagactacatgcatgagttcccagggctccgatgatgaacagatcgtcaatattatccccgttattgccaaagccgataccgtgtccaaaactgaactccagaaattcaaaatcaaactgatgtcagagctcgtctctaatggtgtgcaaatctatcagtttcccacagacgatgacaccattgcaaaggtgaatgcggctatgaatggacagctccctttcgccgtcgtggggagtatggacgaggtgaaggtcggaaataagatggtgaaagcaaggcagtatccttggggggtggtccaagtagagaatgagaatcattgtgacttcgtcaagctgagagagatgttgatatgtaccaatatggaagaccttcgcgaacagacccatacaagacattatgaactgtatagacgttgtaagctagaagaaatgggatttacagacgtcgggcccgagaacaaaccagttagcgtccaggaaacctatgaggccaaacgccacgaattccatggcgagagacagaggaaagaggaagagatgaagcagatgttcgtgcaacgggtgaaagaaaaagaagcaatcctgaaggaagctgagcgcgagttgcaggccaaatttgaacatttgaagaggctgcaccaggaggaaagaatgaagctcgaagaaaagcgccgcctcttagaagaagagataatcgctttcagcaagaaaaaggcaacgtctgaaatttttcactcccagtctttcctcgcaaccgggtctaatctgaggaaggacaaagatagaaaaaaatag

SEQ ID NO: 133749 - DNA, 1290 bp, Artificial Sequence
  Description of Artificial Sequence: Synthetic coding sequence
atggcagtcgccgtcggaagaccctcgaacgaagagttgcggaatctctcactttctggccacgtaggctttgactccttacccgaccagttggtgaacaaatctacgtctcaaggtttctgtttcaatatcctctgcgtgggcgaaacaggcatcgggaagtctactctgatggacaccctgttcaacacaaaattcgagagcgacccggctacccataacgaacctggcgtcaggctaaaagcaagaagctacgagctgcaagagtctaatgtgagactgaagttgacaatagtcgataccgtaggttttggggatcagatcaataaagacgatagctataaacctatcgtcgagtatatcgacgcacagttcgaggcatacttgcaggaagaactgaagatcaaaaggtccttgtttaactatcatgataccagaatccacgcttgcttatacttcatagcccctactgggcattcattgaagtcactggatctagtcactatgaaaaagctcgacagtaaagtgaacatcatacctataatcgctaaggctgatactatcgcgaagaatgaattacacaagttcaagtccaaaattatgagtgaacttgtgtccaatggagtgcagatttatcaatttccaaccgacgaggaaacagtcgctgagattaacgcgacaatgtcggtacatttgccttttgcagtcgtaggatcaacggaagaagttaagatcgggaacaagatggcaaaggctaggcagtacccatggggggttgtgcaggttgagaacgaaaaccactgtgactttgtcaagttgagagagatgcttatccgagtcaacatggaagatctccgggaacaaactcacaccaggcattatgaactctatcgcaggtgcaagctggaggagatgggcttcaaggacactgatcccgacagtaaacctttttcgctgcaggagacttatgaggctaagagaaacgagtttctcggggagctgcagaaaaaggaagaggagatgagacaaatgtttgtcatgagagtgaaggaaaaagaggccgaactgaaagaggctgagaaggagttgcatgagaaattcgatctgctgaaaaggactcatcaagaggagaagaagaaagttgaagataaaaagaaggagcttgaagaggaagttaataactttcaaaaaaagaaagccgcagcgcagctgcttcagagccaggcacagcaatctggggcacagcagactaagaaagataaagacaagaagaacgccagcttcacttag

SEQ ID NO: 133750 - DNA, 1278 bp, Artificial Sequence
  Description of Artificial Sequence: Synthetic coding sequence
atggcggtggcagtggggaggccctcaaatgaggagctgcgcaatttaagcctttccgggcacgtcggctttgattcactgcctgaccagctcgtaaacaagagtacttcccaagggttttgtttcaacattctgtgcgtaggagaaaccggaatagggaagtcaactctgatggataccttgttcaataccaagttcgaatccgatcctgccactcataatgaaccaggcgttcgactgaaagcaagatcctacgagcttcaggagagtaatgtgaggctgaagctcactattgtggataccgtaggattcggtgaccagattaacaaggatgacagctacaaaccaatcgtcgagtatattgacgcccagtttgaggcttatctgcaggaagagctcaagatcaagagaagcctttttaactatcacgatacacgtatacatgcctgtctgtactttattgcccccactgggcactctctgaaatctctggacctagtcactatgaagaagctggactccaaggttaatattatacccatcattgcgaaagcagacacaattgccaaaaatgagttgcataaattcaaatcaaaaatcatgtctgagctcgtttcaaacggtgtccagatctatcaattcccgaccgacgaggagacagtggcagagataaatgcgacgatgagcgtgcatctcccattcgctgtcgtggggtccaccgaagaagtgaagataggcaataagatggcgaaagcacgacagtacccttggggagtagtacaggtggagaacgaaaatcactgtgactttgtgaagctgcgggagatgttgattagggtgaatatggaagacctcagagagcagacacacaccagacattatgaactttaccggagatgtaagctggaggaaatgggttttaaggacacagacccagactctaaaccattttctcttcaagagacatatgaagcgaaacgcaacgagtttttgggagagctgcagaagaaagaggaggaaatgcgacagatgtttgtgatgcgagtcaaggaaaaagaggcagaacttaaggaggcggagaaagagctgcatgaaaagttcgacttgctaaagcgcactcaccaagaagagaaaaagaaggtagaggacaagaagaaggagctcgaagaagaagtcaacaatttccaaaaaaaaaaggctgcagcacagctgcttcagtcccaggcccagcagagcggagcccagcagacaaagaaagacaaagataagaagaaatag

SEQ ID NO: 133751 - DNA, 1320 bp, Artificial Sequence
  Description of Artificial Sequence: Synthetic coding sequence
atggaagaaaggaaaccagcgcacgttctgagatcttttaaatacgctgctttcatgaatgaagagcttcggaatctgagcttgtccggccacgttgggtttgattccctgccggaccaactggtgaacaaatcaacttcccaaggcttttgtttcaatatcctatgtgtcggagagactgggatcggcaagtccacccttatggataccttatttaatacaaagttcgagtcagacccagcaactcataatgagcccggcgttcgcttgaaggctagaagttatgaactgcaggagtccaacgtcaggttgaagcttaccattgtggataccgtcggtttcggcgaccagatcaataaggacgattcatataagccaattgtggagtacattgatgcccaatttgaagcatacttgcaagaggaactgaaaattaagcgaagtctcttcaactaccacgataccagaatccatgcgtgtttatactttatagctccaactggtcatagcttaaagtccttggacctggttaccatgaaaaaactggacagtaaagtgaacatcattcccattatagctaaagccgacactatcgccaagaatgagctccacaaattcaaaagtaagatcatgtcagagcttgttagcaacggagtgcagatttatcagtttccaacagacgaggagaccgtcgccgagatcaacgctaccatgtcagtacacctgcccttcgcagtcgtcggttctaccgaagaagttaagataggcaacaagatggcaaaggcaagacagtacccatggggggttgtccaggttgagaacgagaaccactgtgacttcgtgaagcttagggaaatgctgatccgggtgaatatggaagacctgcgagaacagacacatacccgccactacgagctgtatcgtcgctgcaaattagaagagatgggatttaaagatactgatcctgacagcaagccattctcgttgcaagagacttacgaagcaaagcgtaacgagtttctgggcgaattacagaagaaagaagaagaaatgcgacagatgttcgtgatgagggtgaaggagaaagaagccgagcttaaggaagccgagaaggaattgcatgaaaagttcgacctgctcaagcgcactcaccaggaggagaagaaaaaggttgaggacaagaaaaaggaactggaggaagaagtgaataattttcagaagaagaaagcagccgcgcagctgctgcagtcccaggcacagcagagtggcgcacagcagactaagaaggacaaggataagaaaaatgcctccttcacatag

SEQ ID NO: 133752 - DNA, 1077 bp, Artificial Sequence
  Description of Artificial Sequence: Synthetic coding sequence
atggaccctctacggcggagtccaagcccctgtctttccagccagcccagcagcccatccacacctccttgtgagatgctggggccagtgggtatcgaagcggtgttggatcaactgaagattaaggccatgaagatgggctttgaatttaatatcatggtcgtggggcaatcaggactgggaaaaagtacgatggtaaatacactttttaagagtaaggtgtggaagtcaaaccctccagggctgggcgtgccaacccctcagacactgcagctccactctctgactcatgtgattgaagaaaaaggagtgaagctgaaactaaccgtgacagacactccggggtttggcgatcagattaataatgataactgttgggatcctattttaggctacattaacgaacagtacgaacagtacctgcaggaggaaatacttatcacacggcagcggcatattcccgacactcgcgtacactgttgtgtttactttgtacctccgaccgggcattgtctccggcctcttgacatagagttcctacagcgactgtgccggaccgtgaatgtagtgcctgtcatagctcgagccgattctctaaccatggaagagagagaggctttccgtcgcaggattcagcagaacctgcggacgcactgcatcgacgtgtatcctcagatgtgcttcgacgaggatatcaatgacaagattctgaattctaagctccgagacaggatcccttttgcagtcgttggagccgatcaggagcacctcgttaatggtagatgcgtgctcgggcgaaagacgaaatggggcattatcgaggtggagaacatggcccactgtgagtttccacttctgcgggacttactgattcgttctcacttgcaggaccttaaggacatcacacataatattcactacgagaactaccgtgttatcagactgaacgagagccatctgttgcctcgggggccaggatgggtgaatctggcgcccgcaagtccagggcaattaacaacccccagaacttttaaagtctgccgcggagctcacgacgactctgatgacgagttttag

SEQ ID NO: 133753 - DNA, 939 bp, Artificial Sequence
  Description of Artificial Sequence: Synthetic coding sequence
atggatccgcttcggcggtcaccaagtccctgcctgagctcacagcccagttcccctagtacacctccttgcgagatgctggggccggttggtatcgaggccgtgttggatcagctgaagattaaagctatgaagatgggttttgaatttaatattatggtggtggggcaatctggtttagggaagagtacaatggtaaacacactttttaaatcaaaagtctggaagtcgaacccccctggcctgggagtgcccactccccaaacgcttcagctccattccctaacccacgttatcgaggagaagggagttaaactgaaactgacagtcaccgatacaccagggtttggcgaccagattaacaacgataactgtctgaggccactggatattgaatttcttcagagactgtgtagaacagttaatgtggtgccggtaatcgctcgggctgatagcctcacaatggaagagcgggaggctttccgccgcagaatacaacagaacctcaggacacactgtattgacgtttatccccagatgtgtttcgacgaggacataaatgataaaattttgaactccaagctgcgagaccgaattcctttcgccgtggttggggcagaccaagaacacttggtcaatgggaggtgcgtactcggaaggaaaactaagtggggaattatcgaagtggagaatatggctcactgcgaatttcctctactccgggatcttcttatcagatcgcacttgcaggaccttaaagacatcacgcataatatacactacgaaaactacagggtaatcaggcttaacgaaagccacctgctgcctagggggccaggctgggtgaatctcgcccctgctagccccgggcagttgactaccccccggacttttaaggtatgtcgcggcgctcatgatgacagcgatgacgagttttag

SEQ ID NO: 133754 - DNA, 1299 bp, Artificial Sequence
  Description of Artificial Sequence: Synthetic coding sequence
atggcagaaaggactatggcaatgcctacacagatcccggccgacggagacactcagaaagagaataatattagatgcctgaccaccatcggtcattttggtttcgagtgcttgccaaaccagctggtttctcgttcaatccggcaggggtttactttcaacattctgtgcgtgggagagacaggcatcggtaagtcaaccctgatcgacacactgttcaacaccaacttgaaggataataagtcgagtcacttctactctaacgtgggcctgcagatccaaacatacgaattgcaagaatctaatgtgcaactgaagctgacggtggtggagactgtcgggtatggagaccaaatcgataaagaggcctcgtaccagccaattgtggattacatcgatgctcagttcgaggcctacctgcaggaggagttgaaaattaagcgttctctgtttgagtaccacgattccagagtgcatgtctgcctgtatttcatttccccgactggacacagcttgaagtcattggatctcttaacaatgaaaaatctcgactctaaggtgaatataattcccctgattgcaaaggccgacactatatctaaaaacgacctgcagacttttaaaaacaaaatcatgtcagagcttatttcaaatgggattcagatctatcagctgcctacagatgaggaaacggccgcccaggctaactcatctgttagcggcctgcttccattcgccgtggtggggtcaaccgacgaagttaaggtgggtaaacgaatggttcggggaagacattatccttggggagtgttgcaggttgagaacgagaaccattgtgattttgtgaagttacgcgatatgctgctgtgtaccaacatggaaaatttgaaagaaaaaacccatacccagcactatgagtgctaccggtatcagaagctgcagaaaatgggttttactgacgtcggtccgaacaaccagccggttagtttccaggagatctttgaggccaaacgccaagaattctacgaccagtgtcagagagaagaagaagaattgaaacaaagatttatgcagagagtgaaagagaaggaggctaccttcaaggaggccgaaaaagagctgcaggataagtttgagcatctgaaaatgatacagcaggaggaaattcgtaagttggaggaggagaaaaagcagctcgaaggagaaataatcgacttctacaagatgaaggccgcctctgaggccctgcaaacacagctcagcaccgacactaagaaagacaaacacagaaagaagtag

SEQ ID NO: 133755 - DNA, 1086 bp, Artificial Sequence
  Description of Artificial Sequence: Synthetic coding sequence
atgagtaagcaacagcccactcagtttatcaatcccgaaacacctggttacgttggcttcgccaacctgcctaaccaggtgcaccgaaaaagtgttaagaaagggttcgagttcacactcatggtcgttggtgaatcaggactgggcaagtccactctcattaatagtctattcctgaccgatctctatcccgaacgcgtaatacccggagccgctgaaaagatcgagaggacagtccagatagaagcatccaccgttgagattgaggaaagaggagtaaagcttagactgactgttgtggacacacccggctatggggacgccattaactgtcgagattgcttcaagaccatcatcagctacattgatgaacagttcgaacgatatctccatgacgagtcagggctgaataggcgacacattatcgataaccgagtgcactgttgcttttacttcataagcccatttggccacggcttaaagccgctggacgttgcttttatgaaggccatacacaataaggttaatatcgtacccgtgatcgcaaaggctgacaccctgacgttgaaagaacgcgaacggcttaaaaagaggatcctggacgaaatcgaagagcacaacatcaaaatctaccatctgcccgacgctgagtcagacgaggacgaggatttcaaggaacaaacgaggctgctcaaggcctccataccatttagcgtggtgggatcaaaccagctcatagaggccaaagggaaaaaagtgcgtggcaggctgtatccatggggtgtggtggaggtcgagaatccagagcataacgacttcttgaagctgagaaccatgctcatcacacatatgcaggatctgcaggaggtcacacaggatttgcactacgaaaactttcggtctgagaggctgaagagaggaggacgcaaggtagaaaacgaggacatgaacaaggatcagatcctgctggagaaggaggcagaactccggagaatgcaggagatgatcgcaaggatgcaggcacagatgcagatgcagatgcagggaggggacggagacgggggggcgctcggtcaccatgtctag

SEQ ID NO: 133756 - DNA, 1086 bp, Artificial Sequence
  Description of Artificial Sequence: Synthetic coding sequence
atgtccaaacagcagcccacccagttcattaacccagagacccccggttacgtgggcttcgcaaacctccccaaccaggtgcacaggaaatccgtgaagaaaggatttgaatttaccctcatggtcgttggcgagtcagggcttggcaaaagcaccctgatcaactctctgttcttgacggacctgtacccagagcgtgtgatacctggtgcagcagaaaagatagaaagaaccgttcaaattgaagctagcactgtggaaattgaagaacgcggagtgaagctgaggcttaccgtggtggatacgcccggttatggcgacgccatcaattgccgggactgcttcaaaacaattatttcctatatagacgaacagtttgagaggtacttacacgatgagtcgggacttaataggagacacatcatcgacaatcgtgttcactgctgtttttactttatttctcccttcggccacgggcttaagcctctcgacgtggcctttatgaaagctatccataacaaagtcaacattgtgccggtgatcgccaaggctgacactctgactttgaaggagcgcgagaggctcaaaaagagaattttggatgagattgaagaacataatattaaaatttatcacctcccagacgctgaaagcgacgaagacgaggactttaaggagcagacccgtcttctgaaagcatccattccattctccgtggtaggatcaaaccagctgattgaggcaaagggcaagaaagtgagagggaggctttatccctggggtgtggtcgaggtggaaaaccccgagcataacgacttccttaaactaagaaccatgctgattacacacatgcaggatcttcaagaggttacgcaggatcttcattacgagaattttaggtcagagcgattgaagcgcgggggacggaaggttgaaaacgaggatatgaacaaggaccagatcctattggaaaaagaagcagaactgcgacgcatgcaggaaatgatagctagaatgcaggctcaaatgcagatgcagatgcagggcggcgatggagatggaggggcactgggacaccacgtatag

SEQ ID NO: 133757 - DNA, 1191 bp, Artificial Sequence
  Description of Artificial Sequence: Synthetic coding sequence
atgccctggatctccgaggggagagcgacaaggccatgcttaagagtgccttctgcacgccgcggcgatgagggcctccaccaacgggatgaggccagccagaaaatgagtaagcagcagcccactcagttcatcaatcctgagacaccaggttatgtggggttcgctaatctgcccaaccaggtgcatagaaaaagcgtgaaaaaaggttttgaattcaccctcatggtggtaggtgagtcaggactcggtaagtctaccctgatcaacagtctgttccttactgatctttacccggagcgcgtcattcccggagcagccgagaagattgaaaggacggttcagatcgaggcctctaccgtggaaatcgaagagagaggggtcaagctgaggctgacagtagtcgataccccaggttatggcgacgctatcaattgtcgagattgcttcaaaaccatcataagttatatcgatgagcaattcgaaaggtaccttcacgacgagtccggattgaacaggcggcacatcatcgataatcgggtgcattgctgcttttacttcatatcccccttcggccacggtctcaagcccctggacgtcgcattcatgaaagcaatccacaacaaagtgaacattgttcctgtcatagccaaggccgacacgttgaccctgaaagagagggagcgtctcaagaagcgaatcttggacgagattgaggaacacaatattaaaatctatcacctgccagatgcggagtcagacgaagacgaggattttaaggagcagactaggttactgaaagccagcattccatttagtgtggtggggtctaaccagttgatcgaagcaaaagggaaaaaggtccgagggaggctgtacccatggggcgtcgttgaggtggaaaatcccgaacacaatgatttcctgaagctcagaactatgttgataacacacatgcaagacctgcaggaagtgactcaggatctccattatgaaaacttccgcagtgaaaggctcaaacggggtggccgaaaggtagagaacgaagatatgaacaaggaccagatacttctggagaaagaagccgagttgcgacgaatgcaggagatgattgctaggatgcaggcacagatgcagatgcaaatgcagggcggagatggagacgggggggccctgggccaccatgtctag

SEQ ID NO: 133758 - DNA, 1086 bp, Artificial Sequence
  Description of Artificial Sequence: Synthetic coding sequence
atgagcaagcagcaacccactcagttcatcaaccccgaaactccgggctatgtggggttcgcaaacctgcccaatcaggtgcatcgaaagtccgttaaaaagggatttgaatttaccctcatggtagttggagaatccggccttggcaagtctactcttatcaactctcttttcctgactgatctataccccgagagggttatccctggcgctgcagagaaaattgaacggacggtgcagattgaagcttcgacggtggagatcgaggagcggggcgtgaagctccgtttgactgtcgttgacacccccgggtacggcgatgccattaactgccgtgactgtttcaagactatcatttcgtacattgatgaacagtttgagagatatctgcacgatgagtccgggctcaaccgaagacatattattgacaatagggtccattgctgtttctatttcatctctcctttcgggcacggtttgaaacccctcgacgttgctttcatgaaagctatccacaataaagtcaatattgtgccggtgatagcaaaggcagacaccctgaccctcaaagaaagggagagattgaagaagaggatcctcgatgagattgaggaacacaacataaagatctaccatctgccggacgcagagtcagatgaggatgaggacttcaaagaacagacccggctgctgaaggcctctattccattttcagtggtgggctcaaatcagctgatagaagcgaaggggaagaaggtgcggggcaggctttacccatggggggtagtcgaagtggaaaatcccgagcataatgattttttaaaactgaggacgatgcttataacacatatgcaggatctccaggaggtcacacaggatctgcattacgagaattttaggtcagagcgtcttaaaagaggaggaagaaaggtcgagaatgaggacatgaacaaagaccagatacttctggagaaggaggctgaattaagacgaatgcaggaaatgatcgcgcgcatgcaagcccaaatgcagatgcaaatgcagggaggagatggtgacggcggtgcactcggtcaccacgtctag

SEQ ID NO: 133759 - DNA, 1086 bp, Artificial Sequence
  Description of Artificial Sequence: Synthetic coding sequence
atgagcaagcagcagcctacccagttcatcaaccctgaaaccccgggctacgtgggttttgcaaatctccccaatcaggtccaccgaaagtccgttaagaaaggcttcgagtttactctgatggttgttggagagtctggtttaggaaagtccaccttgatcaacagcttgttcttgacagacctgtatcccgagagagtgataccaggggccgctgagaagatagagcgtacagtacagatcgaagccagcactgtggagatcgaggagcgaggggtgaagctgaggcttaccgtggtggacacccctgggtacggcgacgcaattaattgtcgggattgcttcaaaacaatcatttcctacatcgacgagcagtttgaacgatacctgcacgacgagtccggactgaaccgcagacatatcatcgataatagagtccattgttgtttttacttcatcagtcccttcgggcatggccttaaaccccttgatgtagcctttatgaaggccatccataacaaagtgaacatagtgccagtgattgcgaaagctgacacccttaccctcaaggaacgagagaggctgaagaaaaggattctcgacgaaatcgaggagcataacattaagatttaccatttacccgacgccgagagcgacgaggacgaagactttaaggaacagactaggctgctgaaggcctctatccctttcagcgttgtaggtagtaatcaactaattgaagcgaagggcaagaaggtgaggggacggctctacccctggggcgtcgtagaagtggagaacccagagcataacgattttctcaaattaagaaccatgctgattacccatatgcaggatctccaagaggtgactcaagatttgcattacgagaactttaggtctgaacgcctgaagaggggcggccgtaaagttgagaatgaagacatgaacaaagaccaaattcttctggaaaaagaagccgaacttagacgcatgcaggagatgatcgccagaatgcaggctcagatgcaaatgcagatgcaagggggggacggtgacgggggagctctggggcatcacgtctag

SEQ ID NO: 133760 - DNA, 159 bp, Artificial Sequence
  Description of Artificial Sequence: Synthetic coding sequence
atgagcaagcaacaaccgacacagttcatcaatccagagaccccaggctacgtgggctttgcaaatctgcccaaccaggtgcaccggaagtccgttaagaaggggttcgagtttaccttgatggtggtcggagaatctggcctgggcaaaagcacatag

SEQ ID NO: 133761 - DNA, 153 bp, Artificial Sequence
  Description of Artificial Sequence: Synthetic coding sequence
atgtccaagcagcagcccacacagtttattaatcccgagacacctggctatgtcgggtttgctaatctgcctaaccaggttcaccgcaagtccgttaagaagggttttgagtttaccctgatggtcgttggagaatcaggtctgggcaaatag

SEQ ID NO: 133762 - DNA, 72 bp, Artificial Sequence
  Description of Artificial Sequence: Synthetic coding sequence
atgtctaagcaacagccaacccagtttatcaatccagagacgcccgggtacgtgggcttcgccaatctgtag

SEQ ID NO: 133763 - DNA, 447 bp, Artificial Sequence
  Description of Artificial Sequence: Synthetic coding sequence
atgagcaagcaacagcccactcagttcataaaccctgagacaccggggtacgtggggtttgcgaatctgcccaaccaggtccatcgtaaatcagtcaagaagggattcgaattcaccctgatggtggtgggggagagcggcctgggcaagtcaacccttatcaattcccttttcctgaccgacctgtacccggagcgggttatccctggcgctgctgaaaagatcgaaagaaccgttcagatagaagcgagtaccgtggaaatcgaggagagaggcgttaaattgcggttgactgtggtcgatacgcccggatatggcgacgccatcaactgtagggattgttttaaaactataatttcctatattgatgagcagtttgagaggtacttgcacgacgagtcgggcttaaatagacgacacatcatcgacaatagggttcactgttag

SEQ ID NO: 133764 - DNA, 396 bp, Artificial Sequence
  Description of Artificial Sequence: Synthetic coding sequence
atgagcaaacaacagcccactcagttcattaacccagagactccaggctacgtggggtttgcaaacctgcccaaccaagtccaccggaaatctgtgaaaaagggcttcgagttcacactcatggtcgtgggcgaaagcggccttggtaagtccactctgataaattcgctcttcctcaccgacctctaccctgagagggtcatacctggggctgctgagaaaatcgagagaactgtgcagatcgaggcctcaacagtggagatcgaggagcgaggggtgaaactaaggttgacagtggtcgacacgcctgggtacggggatgccatcaactgcagagactgtttcaagaccattatctcttatatcgacgagcagtttgaacggtatctgcactag

SEQ ID NO: 133765 - DNA, 219 bp, Artificial Sequence
  Description of Artificial Sequence: Synthetic coding sequence
atgtctaagcagcaaccaacccagttcattaatcctgagacccctggatatgtcggttttgccaacctgccaaatcaggtacaccggaagtcagtcaagaagggatttgaattcaccctgatggtcgtaggagaaagtgggctcgggaaatcaaccctaataaactctctcttcctcacggacctctatccggaaagggtgattccaggagctgcgtag

SEQ ID NO: 133766 - DNA, 219 bp, Artificial Sequence
  Description of Artificial Sequence: Synthetic coding sequence
atgtctaagcagcagcccacacaattcatcaatcctgaaacccccggctacgtcggttttgctaacctacctaaccaagtgcaccgcaaaagcgtcaaaaagggctttgaattcaccctcatggtggtcggagagtcagggttagggaaaagcacgctaatcaactccctcttcctgaccgacctgtaccccgaaagggtgatcccaggagctgcgtag

SEQ ID NO: 133767 - DNA, 522 bp, Artificial Sequence
  Description of Artificial Sequence: Synthetic coding sequence
atgagcaagcagcagcccactcagttcataaatcctgagactcctgggtatgtgggctttgccaatcttccgaatcaggtgcaccggaaatccgtcaagaaaggctttgagttcaccctgatggtagtgggcgagtctggcctcggcaaaagcacactcattaatagtctcttcttgacggacctgtatcccgaaagggtgattccaggtgccgctgaaaaaatcgagcggactgtccaaatagaagccagtaccgtagagattgaagaaaggggcgttaagctcaggctcacagtcgtcgacacaccaggctacggggacgcaattaactgccgcgactgttttaaaacaatcatttcttacatcgatgagcagttcgaaaggtacctgcacgacgaatccggtctgaaccgccgccacattatcgacaacagggtacattgctgtttttacttcattagcccctttggtcatgggctcaaaccccttgatgtggccttcatgaaagcaattcacaactag

SEQ ID NO: 133768 - DNA, 90 bp, Artificial Sequence
  Description of Artificial Sequence: Synthetic coding sequence
tgagagatgattgctaggatgcaagctcagatgcagatgcaaatgcaggggggtgatggcgacgggggtgctcttggccaccacgtttag

SEQ ID NO: 133769 - DNA, 861 bp, Artificial Sequence
  Description of Artificial Sequence: Synthetic coding sequence
atgagcaaaggtcaaagtggtctaggaaaatcgactctggtaaatacactgtttaagagccaagtgtcccggaaggcctcttcttggaatagggaagaaaaaatcccaaaaacggtggagattaaggcaatcggacacgttatcgaagagggtggagtgaagatgaagcttacagttatcgacacaccgggatttggcgatcagatcaacaacgagaattgctgggagcccattgaaaagtacatcaacgaacaatacgaaaagttcctgaaggaggaggtgaatatcgctagaaagaagagaattccagacactcgagtccattgctgcctgtatttcattagtcctacgggccacagcctacgccccttagacttggaatttatgaagcatctgtccaaggtggtgaatattattccggttattgcaaaggcagacactatgacgctggaagagaagtccgagttcaaacagagggttcggaaggaactcgaggtaaacggcattgagttctacccccagaaagagtttgatgaggacctcgaagacaagaccgagaatgacaagattagacaagaatctatgccttttgcagtcgttggctctgataaagagtatcaggtaaacgggaaaagggttttgggacggaaaactccatggggaataatagaagtggaaaacctgaaccactgtgagttcgcgcttctccgggactttgtgattcggacccacctacaagacctgaaggaagtgacccacaacatacattacgagacgtacagggccaagcgtctgaacgataatggaggtctgccccctgtgtcagttgataccgaagagagtcacgactcgaacccttag

SEQ ID NO: 133770 - DNA, 252 bp, Artificial Sequence
  Description of Artificial Sequence: Synthetic coding sequence
atgagcaagggactgcctgaaacgagaacggacgcggcaatgtctgagctggttccggagccacggcctaagccggcagtccccatgaaacctatgtccatcaacagtaaccttcttgggtacataggcatagatacaattatcgaacaaatgcgcaagaaaacgatgaaaacagggttcgacttcaatataatggtggtagcgggaagtccactcagaagtacctccatgtcgtcaactagaagctcatag

SEQ ID NO: 133771 - DNA, 1053 bp, Artificial Sequence
  Description of Artificial Sequence: Synthetic coding sequence
atgtcaaagggcctgcccgagaccaggactgatgctgccatgtcagagctggtcccagagccaaggccaaagcctgctgtgcccatgaagcctatgtctatcaacagtaatcttctgggctacatcggcattgacacaatcatcgaacagatgcgaaaaaaaacaatgaaaacgggttttgatttcaatattatggtggttggccagtccgggttgggtaagagcaccctcgtgaacaccctgttcaaatcgcaagtatcccggaaagcatcatcttggaaccgagaagaaaaaattcccaagactgtagagattaaggccatcgggcacgtgatagaggagggcggcgtgaagatgaagttgactgtcattgacacaccaggttttggcgaccagattaacaatgagaattgttgggagcccatagaaaagtacatcaatgaacagtacgaaaagttcttgaaagaagaagttaacatagcacgcaagaaacgcattcctgatactagggtccactgttgtctttactttataagcccgacagggcactcattgcggcctttggacctggaatttatgaagcacttatcaaaggtcgttaacatcattcctgtgattgctaaggccgataccatgaccctggaggaaaagtcagaatttaaacagagggtacgcaaggaactggaagtaaacggcatcgagttttaccctcagaaggagttcgatgaggatctagaggacaaaaccgagaacgataagatccggcaggaaagtatgcccttcgctgtggtgggaagtgacaaagagtaccaggtcaatggaaagcgcgtcttaggaaggaaaacaccctggggcataatcgaagtggagaatctcaaccattgtgagtttgccctgctgcgcgattttgtcatccgcacgcacctccaggacctgaaggaagtaactcataatatccattatgagacgtatcgagctaaaaggctgaatgataacggaggtctcccccccgtttctgttgatacagaagaatcgcacgacagcaatccatag

SEQ ID NO: 133772 - DNA, 1077 bp, Artificial Sequence
  Description of Artificial Sequence: Synthetic coding sequence
atgtccaagggtctccctgagacccgcactgatgccgccatgtctgagctcgttccagagcctaggccaaagcctgccgttcccatgaagcctatgtctattaatagcaatcttctgggctacattggaatcgatactattattgagcaaatgcgcaagaaaactatgaaaaccggatttgacttcaacatcatggtggtcggtcagagcggcctgggcaaaagcacactggtaaacaccttgtttaagagtcaggttagtaggaaagcatcctcatggaatcgagaagagaagatccctaaaactgtcgaaattaaggcgatcggtcacgtcatcgaagaggggggggtgaaaatgaagctgacggttatcgacacccccgggttcggagatcagatcaataacgagaactgctgggaacccattgaaaagtacattaacgaacaatacgaaaaatttctgaaggaagaagttaatatcgctagaaagaagagaatccctgatactcgggtccattgttgcctgtatttcatttcccccacagggcactccctgcgaccactagacttggagttcatgaagcacctgagcaaagtagtcaacatcatcccagtgatagcgaaagctgacaccatgaccctggaggaaaaatcggaattcaagcagcgggtgagaaaggagcttgaagtcaacggtatcgaattttatcctcagaaggaattcgatgaagatctagaagacaaaaccgagaatgataaaatacggcaggaatcaatgccatttgccgtcgttgggtctgataaggagtaccaagttaacggtaagcgggtcctcggcagaaaaactccctggggcatcatcgaagtggaaaacctaaaccactgcgaattcgcgctgctgcgagatttcgtcatcaggactcacctccaagatttgaaggaggtcacacacaacatccattacgaaacctaccgcgcaaaaaggctgaatgataacggtggcctgcccccaggcgaaggattgcttggcaccgtgctcccacccgtgcctgccaccccttgtcctacagccgaatag

SEQ ID NO: 133773 - DNA, 885 bp, Artificial Sequence
  Description of Artificial Sequence: Synthetic coding sequence
atgtcaaagggacagtcagggctcggtaaatcaactctcgtgaatactctgtttaagtcacaagtaagtagaaaagcgagtagttggaatcgcgaggaaaaaattccgaagactgtggagattaaggctatcgggcatgtcatagaggagggtggagtgaaaatgaagctgaccgttatcgatactcccgggtttggcgaccagattaacaatgagaactgttgggaacctatcgaaaaatacataaacgaacagtatgagaagtttcttaaggaggaggtgaacatcgccaggaagaagcggattccggacacaagagtgcactgttgcctgtactttatttctccaacaggccatagcctgaggccgctggatctggaatttatgaagcacttgagtaaggttgtgaatatcatcccagtaatcgccaaagccgacacaatgactttggaagaaaaatcagaattcaaacaacgcgtgaggaaggaactcgaggtgaacggaatcgaattttacccccagaaagagtttgatgaagatttggaagataagacagagaacgataagatccggcaagagagcatgcccttcgccgttgtggggtctgataaggagtaccaggtaaacggcaagcgcgttctggggaggaaaacgccctggggaatcattgaggtggaaaacctgaatcactgcgagttcgccctcttgcgcgattttgtgatccgaacccatctgcaggacttgaaagaggtcacccacaatatccactacgaaacatacagagccaagaggctgaatgacaacgggggcttgcctccaggggaggggctgttgggcaccgtgcttccaccagtcccggccaccccttgccctactgcagagtag

SEQ ID NO: 133774 - DNA, 537 bp, Artificial Sequence
  Description of Artificial Sequence: Synthetic coding sequence
atgtccgaattggtgccagagcccaggcctaaacccgctgtccctatgaaacccatgtccatcaatagcaatcttctcgggtacatcggcatcgatactattattgaacagatgcggaagaaaaccatgaaaacaggcttcgattttaacatcatggtcgtggggcagtctggtctgggcaaatccacccttgttaacactctcttcaagagtcaggtgagtcgtaaggcgagcagctggaatcgagaggagaaaattcccaagaccgtcgagatcaaagctatcggacacgtgatcgaggaagggggggtgaaaatgaaactgaccgtgatcgacactccaggtttcggagatcaaatcaacaacgaaaattgctgggagccaatcgagaaatacataaacgaacagtatgagaaatttcttaaagaggaggtgaacattgctagaaagaagagaattcctgacacaagagtgcactgttgcctgtacttcatttcgccaaccggacacagcttgagaccactggacctcgaatag

SEQ ID NO: 133775 - DNA, 1137 bp, Artificial Sequence
  Description of Artificial Sequence: Synthetic coding sequence
atggatagtttagccgcaccccaagaccgtcttgtggagcagctgcttagcccaaggacccaggcacagagacgcctgaaggacatcgataagcaatatgttggctttgcgaccctgcccaaccaggtgcatcggaagtctgtgaaaaagggcttcgactttacactcatggtggctggtgagtctggtttgggaaaatcaactctagtccactctctattcttaacagatctttacaaagacagaaagttgcttagtgccgaggaacgaatcagtcagacagtcgagattttgaaacacaccgtggatattgaggagaaaggagtgaaactgaaactcactatcgtggacacccccggttttggagacgccgttaataacaccgaatgttggaaaccaatcactgactacgtagaccaacaatttgaacagtactttcgcgacgagtctgggctaaatcgtaaaaacatccaagataaccgcgtacactgttgcttatactttatttcacccttcggccacggcctgagaccggtggatgtaggattcatgaaggccctccacgagaaggtcaacatcgtgccccttatcgccaaagccgactgtctggtcccgtcagaaattcgcaagctgaaagaaagaatccgtgaagagattgacaaattcgggattcacgtgtatcaatttccagagtgtgactcagacgaggacgaagacttcaaacagcaagaccgcgagctgaaagaaagtgcgcccttcgccgtcattgggagtaacaccgtggtagaggcaaaagggcagcgggtcaggggccgcctctatccatggggcatcgtcgaggtcgagaatcaggcgcattgcgatttcgtaaagctgcgcaacatgctcatccgcacacatatgcatgatctgaaagatgtgacttgcgatgtgcactacgagaactaccgggcccactgcattcaacagatgaccagcaaattgacgcaggactcccgaatggagtcacccataccaatcctgccactgcccacccctgacgcggagacagagaaactgattcggatgaaagacgaagaattacggcgcatgcaagagatgctgcagcgaatgaagcaacagatgcaggaccaatag

SEQ ID NO: 133776 - DNA, 969 bp, Artificial Sequence
  Description of Artificial Sequence: Synthetic coding sequence
atggtagccggcgagtctggactagggaaatccacactcgtgcatagcctgttcttgacagatctgtacaaggaccgcaaattgctgtctgctgaagagcggatatcacaaaccgtggagatcctgaaacatacggttgacattgaagagaaaggggtgaaactgaaactaaccattgtggatacccccggctttggagacgccgtgaacaacaccgaatgttggaagccaattactgattacgtggaccagcagtttgagcagtactttagggatgagagcggtctgaatcgcaaaaacattcaggacaatagggtccactgctgcttgtactttatttcaccatttggtcacggcttgaggcccgtcgatgtcggattcatgaaggctctccacgagaaagtgaatattgtacctcttatcgccaaggccgactgcctagttcccagtgagattcgcaaactcaaagagcgaatccgggaagagattgataaatttggcatacatgtataccagtttcctgagtgtgattctgatgaggatgaggattttaaacagcaagaccgggagctcaaggagtcagctcccttcgcagttattggctccaatacagtcgtggaggctaagggccagagggttagagggagactttatccatggggaattgtggaggtggagaatcaggcacactgcgattttgtgaagctcagaaatatgctgattaggactcatatgcacgatctaaaggatgttacctgtgacgtgcactatgagaattatagagcacattgcatccagcagatgacttcaaagttgacgcaggactcgagaatggaaagtcccatcccaattctcccgttgcctacaccagacgccgagacagagaaattaattaggatgaaggatgaagagctccgtcgcatgcaggaaatgctgcagaggatgaagcagcagatgcaggaccagtag

SEQ ID NO: 133777 - DNA, 1041 bp, Artificial Sequence
  Description of Artificial Sequence: Synthetic coding sequence
atggactctcttgccgctcctcaggataggctcgtggaacagttgttatcaccaagaacacaggcccagcggcggctgaaggatatcgacaagcaatacgtcggcttcgctacacttcccaaccaggtccatcggaagtccgttaaaaaaggatttgattttacacttatggtggctggcgaatctgggctgggcaagtcgaccctcgtgcatagcctgttcctgactgacctttataaggaccggaagctgctgtctgccgaagagaggatatctcagacagttgagatcctgaagcacactgtcgatattgaagaaaaaggggtcaagctgaaattaactattgtggatactccgggctttggcgatgcagtgaataacacagaatgttggaaaccaatcacagactacgtcgaccaacagttcgaacagtatttccgagacgaaagtgggctgaaccgcaagaatattcaggacaatcgggttcattgctgcctgtacttcatttccccttttggccacgggttgcggccagtggacgtggggttcatgaaagccctgcacgagaaagtgaacatcgtccccctcatcgcgaaggccgactgtttggtcccgagcgaaattaggaagctgaaggaaaggatacgggaagaaatagacaaatttggaatccacgtgtaccagttccccgaatgtgatagtgatgaagatgaagactttaaacagcaggatcgcgagctgaaggaatcagctcctttcgcagtcattgggagtaacactgtggtcgaggctaagggccagcgcgtgagaggcaggttatatccctgggggatcgtggaaggagctcttcggctgcgcgaggctgcccagcacgctcacccacacgcgtacgctcggccccagggtcgggacgtgaggagggctctgcgggaactcccccgcgcactacacccagccgatgatcagcagactgacccgggacagccccacggcgagccccaccctgaccctgccgctgcccaccctgggcggcgggactag

SEQ ID NO: 133778 - DNA, 450 bp, Artificial Sequence
  Description of Artificial Sequence: Synthetic coding sequence
ctgcccaaccaggtacaccgcaagtcagtgaagaaaggttttgactttaccctcatggtcgctggcgaaagcggattgggaaaaagcacactcgtgcactctctgtttctgacagatctgtacaaggacaggaagcttttgagcgcggaagaaaggattagccaaactgttgaaatcttaaaacacactgtggacatcgaagagaagggcgtgaagctaaagctgactattgtggatacccctggcttcggggatgccgtaaacaacactgaatgttggaagcccatcacagactacgtggaccaacagttcgagcagtacttccgagatgagtcgggcctgaatagaaaaaatatacaagacaatcgcgtccattgctgcttatatttcatcagtccattcggccacggattgcggcctgtggacggattccacgagggaatagcgtag

SEQ ID NO: 133779 - DNA, 1110 bp, Artificial Sequence
  Description of Artificial Sequence: Synthetic coding sequence
atgtcgactggcctacggtataagtccaaactcgccaccccggaagacaaacaagatatagataagcagtacgtggggtttgccacacttcctaatcaggttcaccgcaagagcgtaaagaaaggctttgactttaccctgatggtcgccggcgaatcaggtcttgggaaatctacattggtgcatagcctgtttctaactgacttgtataaggacagaaagttgctttccgctgaagaacgcataagccaaacagtggagatcttgaagcacacagtggacatcgaggaaaagggtgttaagctgaaactgacgatcgttgatactcccgggttcggcgacgccgttaataatacagagtgttggaagcccatcactgactacgtggaccagcaattcgagcagtacttccgggacgaaagtggtctgaatcggaagaacatccaggataaccgagtccactgctgcctctacttcatctctccattcgggcatggtcttaggcctgttgatgttggcttcatgaaagctcttcacgagaaagtcaacatagtccctctgattgccaaggccgattgtctcgtgcctagcgagattagaaaactcaaggagagaattagggaggaaatagataaatttgggattcatgtttaccagttccctgagtgtgattccgatgaggacgaggacttcaagcagcaggacagagaattgaaggagagcgcaccttttgctgttatcggatcaaataccgtggtggaggcgaaggggcagcgggtaaggggccgtctgtacccctggggcattgtggaagtcgagaaccaagcccactgcgactttgtgaagctcagaaatatgctgatcaggactcatatgcatgacctcaaggacgtcacttgtgacgttcattacgaaaactaccgggctcactgtattcagcagatgacctctaaacttacccaagactctaggatggaaagtcccatccctatactaccactgccaacgcctgatgccgagacagagaaacttattcgtatgaaagacgaagaattgcgacgcatgcaggaaatgctgcagcgcatgaagcagcagatgcaggaccaatag

SEQ ID NO: 133780 - DNA, 1137 bp, Artificial Sequence
  Description of Artificial Sequence: Synthetic coding sequence
atggattccttggccgccccacaggatagactggtggaacaacttctgtctcctagaacccaagcccagcggcgcctcaaggatattgacaagcagtacgtgggatttgccaccctgcccaaccaggttcacaggaaaagtgtgaaaaaaggcttcgattttaccctgatggtcgctggggagagcggactcggtaaatctactctcgtgcactctttatttctaaccgacctgtacaaagaccgcaaactcctatctgcggaagagcggatttcccagactgtcgagatcctgaagcacaccgtggacattgaggagaagggagtgaagttaaagctgacaattgtggacacaccaggattcggtgacgccgtaaataataccgaatgctggaagcctattacagactacgttgaccaacagttcgaacagtacttcagggacgaaagcgggctgaataggaagaacatccaggacaaccgggttcattgttgcctctattttattagcccattcgggcacggcctccggcctgtagacgtcggttttatgaaagcgcttcacgagaaagtgaatatcgtgccgttaatcgccaaagccgactgccttgtccctagcgaaattcgcaagctgaaggagcggatacgagaggagatagacaaattcggtattcacgtgtatcagtttccagaatgtgacagtgatgaagatgaggactttaagcaacaagatcgtgaactaaaagaaagtgccccttttgctgtcatcggtagtaacaccgttgtggaggccaagggccagcgcgtgcggggacgtctgtacccttggggaatagtagaagtagaaaatcaagcccattgcgactttgtgaagctgcgcaacatgctcatccgaacccacatgcacgatctgaaagacgtcacctgcgatgtacactacgaaaactaccgagcccactgcattcagcagatgacttctaaactgacccaagactcccggatggaatcgccgattcccattttacccctacctactcccgatgctgaaaccgaaaagctcatccggatgaaggacgaggaactgcgccgaatgcaggagatgctgcagagaatgaagcagcaaatgcaagatcagtag

SEQ ID NO: 133781 - DNA, 1305 bp, Artificial Sequence
  Description of Artificial Sequence: Synthetic coding sequence
atggccgccacggacatcgctcgccaggttggagaagggtgccgaactgtcccactggctggccacgtcggctttgattccctacctgaccagctagtgaataaaagcgtcagccagggcttttgcttcaatattctctgcgtgggggagaccggactgggaaagagcacactcatggacaccctgttcaacaccaaattcgaaggagagcccgcaacgcacacccagccaggcgtgcagttgcagagtaatacatacgaccttcaagagagcaacgttcgccttaaattgacgatagtgtctactgtcggcttcggtgatcagatcaataaagaggactcatataagccaattgtcgaatttatcgatgcgcagtttgaagcatatctccaggaggaattaaaaatccggcgggtcttgcatacttaccacgattcccgcatccatgtctgcctctattttatcgcccctacagggcatagccttaagagtctggatctggtcactatgaagaagctggattccaaagttaatattatcccaattatcgctaaggcagacgctatctccaagtcagagctcaccaagttcaagattaagattacttccgaattggttagcaatggggtacaaatttaccagttcccgacagatgatgagtctgtagcagagatcaacggaacaatgaatgcccaccttccattcgctgttatcggctctaccgaagagctgaaaattgggaataagatgatgagagcccgccaatatccttgggggaccgtgcaggtggagaacgaagctcattgcgatttcgtgaagttacgggaaatgctgattcgggtaaatatggaggacttgagggagcaaactcacacccgtcattacgagctgtaccggcgctgtaaattggaagagatgggctttaaggacacagacccggattctaagcctttcagccttcaggagacttacgaggccaagcgaaatgagtttttgggagaactgcagaaaaaggaggaggaaatgcgacaaatgtttgtccagagagtcaaggaaaaagaggccgagctgaaagaggcagaaaaggagcttcacgagaaattcgacaggctcaaaaagctgcatcaggacgagaagaagaagctcgaagacaagaaaaaatcgttagatgacgaggttaatgcgttcaagcaaagaaagactgcggctgagctcctccagtcacaaggtagccaggctggaggtagccagacactgaaacgcgacaaggaaaagaaaaataatccttggttgtgcaccgaatag

SEQ ID NO: 133782 - DNA, 1290 bp, Artificial Sequence
  Description of Artificial Sequence: Synthetic coding sequence
atggctgccactgacatcgcccgccaagtcggagagggctgcagaaccgtcccactggccggacacgtgggcttcgactctttgccagaccagttagtgaacaagtccgtgtcacaaggtttctgctttaatattctgtgtgtgggggaaaccggtctcggcaaaagcactctgatggacacgttgttcaatacaaaattcgaaggagagcctgccactcacactcagcccggcgtgcagctgcagtctaacacttacgacctgcaggagtcaaacgtccgactgaaattgaccatagtttcgactgtcgggttcggggaccaaatcaataaagaggattcttataaacccattgtggaattcatcgatgcccagtttgaagcctacctgcaggaggagctaaaaatcaggcgcgtactccacacttatcacgacagcagaattcatgtgtgcctgtacttcatcgctccaactggtcatagcctcaagtcactggatctggtgacaatgaagaaactcgacagcaaggtcaatattattccaattatcgccaaagctgatgccatatcgaaatctgagcttacaaaatttaagattaaaattactagtgaactcgtctcaaacggcgtgcagatttatcaattccctaccgacgatgagagcgtcgctgaaatcaatggaaccatgaacgcgcacctaccgtttgcggttatcgggagtacggaagagctgaagattggaaataagatgatgagagccagacagtacccctggggtactgtccaggtggagaatgaggcacattgtgacttcgtgaaactgagggaaatgcttatccgggttaatatggaggacctcagagaacagacacacacgagacattacgaactataccggcggtgcaagctcgaggagatgggtttcaaagacactgatccggatagtaagcccttttctctacaggagacctacgaggctaagcgaaatgaatttctgggcgagcttcagaaaaaggaggaagaaatgagacagatgttcgtgcaacgcgtgaaggagaaagaagctgagctgaaagaggccgaaaaggaactccatgaaaaatttgaccgactgaaaaaactccaccaggacgagaaaaaaaaactggaagataagaaaaaatctttagatgatgaggttaacgcctttaagcagcgaaaaacggctgcggaacttctgcagagccaaggaagtcaggccggagggagccagaccctgaagagagacaaagaaaaaaaaaacttcttctag

SEQ ID NO: 133783 - DNA, 1296 bp, Artificial Sequence
  Description of Artificial Sequence: Synthetic coding sequence
atggcagccaccgatatcgcacggcaggtgggggaaggatgtcgtaccgtgcccctggccggacatgtggggttcgatagcctacccgaccagttggtaaataaatcggtctcccagggcttctgcttcaacatcctgtgcgtgggcgagaccggtctcggcaagtcaactctgatggataccctgttcaacacaaagtttgaaggcgagcctgctacccacacacagccaggagtccagttgcagtcaaacacatacgatctacaggagtcaaacgtgaggttgaaactaacgatcgtgagcactgtcggctttggcgaccagatcaacaaagaagactcctataaaccaattgttgaatttatcgacgcccagtttgaggcctatctgcaagaggaactcaaaatccgaagagttctacatacttaccacgactcccgaatccacgtgtgtctgtacttcatcgcgcctacaggccattcactgaagagtctggatttggttaccatgaagaaactggactccaaagtgaacattattccgattatcgcaaaggcagacgctatctccaagagcgaattgacaaagttcaaaataaaaatcacttctgagctcgttagtaacggagtgcagatatatcagtttccaaccgacgatgaatcagtggccgagataaatggtacaatgaatgcacaccttccttttgctgttatcggctctaccgaggagcttaagattggcaataagatgatgagggcccggcagtacccttgggggaccgtacaggtggaaaacgaagctcactgtgactttgtgaaactgagggagatgctaatccgggtgaatatggaagatcttcgtgagcagacccacacacggcactatgagttgtaccgaaggtgtaagttagaggaaatggggttcaaggataccgaccccgactcgaagccattcagccttcaggagacatacgaagccaagaggaatgagttcctaggcgaactgcagaagaaggaggaagaaatgcggcagatgtttgtgcaaagggtgaaagagaaggaagctgagctgaaagaggccgagaaggaactccatgagaaatttgataggcttaagaagctgcaccaggatgagaagaagaagctggaagacaagaagaagtcactcgacgatgaagtgaacgcattcaagcagagaaagactgcggccgagctgctacaaagtcaggggtctcaggctggagggagccagacacttaagagggataaggaaaagaagaacctggggtttctctag

SEQ ID NO: 133784 - DNA, 1284 bp, Artificial Sequence
  Description of Artificial Sequence: Synthetic coding sequence
atggccgccacagacattgcgcgccaggtcggcgaagggtgtaggacagtgcctctggcgggccatgtcggatttgactcattgccggatcaacttgtcaacaagtccgtgtcacagggattctgctttaatatcctttgcgtgggtgagacagggctgggaaagtcaactctgatggataccctattcaacacaaaatttgaaggggaacctgctacccatacccaacctggcgttcagctgcagtctaacacatacgatcttcaagagtctaacgtccggctgaaactgactattgtgagcaccgtcgggttcggtgaccagatcaataaggaggactcatacaaacctatcgtcgaatttatcgacgcccagtttgaagcatatttgcaggaagagttgaagatcagacgagtgctccatacataccatgacagtaggattcacgtgtgtctgtactttatcgccccaaccggccatagcctaaaatccctggacctcgtcaccatgaagaagttggacagcaaagttaacataatcccaattattgccaaagcagatgccataagcaaaagtgaactcacaaaatttaagattaaaatcacatcggagttggtaagcaacggcgtgcaaatctaccagttccccacagacgacgagagtgtcgccgagattaatgggacaatgaacgcccatctgcccttcgcagtgattggctccactgaagaattaaaaattgggaacaagatgatgcgagccaggcagtatccatggggtaccgttcaggtggagaacgaagcccattgcgacttcgtgaagctgcgggagatgctaattcgggtgaatatggaggacctgcgggaacagacgcacacgaggcactacgagctctacagacgatgcaagctcgaggagatgggcttcaaggacactgatcccgattcaaagccctttagtctccaggaaacatatgaagccaagagaaatgagttcctgggcgagctgcagaagaaagaggaggaaatgcggcaaatgttcgtccagagggtcaaggagaaggaggccgagctcaaagaagccgaaaaggaactgcatgaaaagttcgaccggcttaagaaactgcaccaggacgaaaagaagaagctggaggacaagaagaaaagtcttgatgacgaggtcaatgcctttaagcagcgtaaaactgccgcagaactgctgcaatcccagggttcccaggcaggaggcagccaaactctgaagcgggataaggagaagaagaactag

SEQ ID NO: 133785 - DNA, 1284 bp, Artificial Sequence
  Description of Artificial Sequence: Synthetic coding sequence
atggccgccactgatatcgccagacaagttggcgagggctgcagaaccgtgcccctggcgggtcatgtagggtttgacagcttgcctgaccagcttgtcaacaagagcgttagccagggtttctgcttcaatattttatgcgttggggaaacgggcctgggcaagtctactctgatggatacattattcaacaccaagttcgaaggcgaacccgccacccacacccagccgggcgtacagctgcagtcaaacacatatgacctgcaggagtccaatgtgaggttgaaactgactattgtttctactgtcggcttcggtgaccagatcaataaagaggactcgtacaaacctattgtcgagtttatcgacgctcagttcgaggcatatctccaggaggagttgaaaatccggagagtgctgcatacatatcacgacagccggattcacgtatgcttgtattttatcgccccaactggccacagcttaaagtccctggacctagttaccatgaagaagcttgactcaaaggtgaatatcatccctatcattgcaaaggctgatgctatatcaaagtcagaattaaccaaattcaagattaagataacaagcgagctggttagcaacggtgtgcagatatatcaattcccaactgacgacgaaagcgtcgccgagataaatgggactatgaacgcccacctgcccttcgctgtcatcgggagtactgaggaactaaagatcggaaacaagatgatgcgagcacgtcaatatccgtggggtactgtgcaggttgagaacgaggctcattgcgacttcgtgaaactgagggaaatgctaataagagtgaacatggaagacttaagagaacagactcatacgagacactatgagttataccgccggtgcaaactggaagaaatggggttcaaggatacagaccctgatagcaagccatttagcctgcaggagacctatgaggcaaaaaggaacgagtttttaggagagctgcagaaaaaggaggaggagatgaggcagatgttcgtccagcgagtgaaagagaaagaggccgaactgaaagaagccgagaaagaactacacgaaaaattcgataggctgaagaagctccaccaggacgaaaagaaaaaactcgaagacaaaaaaaagtcacttgatgatgaggtaaacgcctttaagcaacggaagacggctgcagagctgctacagtcacaaggaagtcaggcgggaggctctcagactctgaagcgagataaggaaaaaaaaaactag

SEQ ID NO: 133786 - DNA, 1110 bp, Artificial Sequence
  Description of Artificial Sequence: Synthetic coding sequence
atggatacactgttcaataccaaatttgaaggtgagcctgctacccacacacagcctggcgtgcagctccagagcaacacctacgatttgcaggagtctaacgtgaggcttaagttaaccatagtgagcactgtgggattcggcgatcagataaataaggaagactcttacaaaccaatagtggagttcatcgacgcgcaatttgaggcatacctgcaagaggaacttaagattcgccgggtcctgcacacttaccatgactcaaggatccatgtctgcctgtatttcatcgctcccaccggtcattcactgaagagcttagatctggtgaccatgaaaaaactggacagcaaagtaaacattattccgatcatcgccaaggctgacgccatatccaagtcagaattaaccaaattcaaaatcaaaattaccagtgaactagtgagcaacggcgtgcagatttaccagttcccaaccgatgatgaatcagtggccgagatcaatgggactatgaacgctcacctgccctttgcagttatcgggtctaccgaagaattaaaaatcggcaacaagatgatgagggctcgacagtatccctggggcaccgtccaagtcgaaaatgaagctcactgcgattttgttaaacttcgggagatgcttatccgggtgaatatggaggaccttagggagcagactcacacaagacattatgaattgtatcgacggtgtaagttggaggagatggggtttaaagacactgatcctgatagtaaaccattctcacttcaggagacatacgaagctaagaggaatgaattcctcggcgaactgcagaaaaaggaggaagaaatgcggcagatgttcgtgcagagagtcaaagagaaagaagccgagttgaaggaggccgagaaagaactccacgagaagttcgatcgactgaagaaacttcatcaggatgagaagaagaagctcgaagataagaagaaatccctggacgatgaagtcaatgctttcaagcaacggaaaacagccgcagaactcctgcagagtcagggtagccaagctggaggtagccagacgctgaagcgcgacaaagagaaaaagaagtag

SEQ ID NO: 133787 - DNA, 1374 bp, Artificial Sequence
  Description of Artificial Sequence: Synthetic coding sequence
atggccgctactgatatcgctaggcaggtcttcggccgcagacgtcttctgcttctgggcttcgaaaccgtcgggttttccgctgcctgcactgaggagggcggccacatgcttagaagaggagaaggttgtcggaccgttcccctcgccggtcatgttggttttgatagtctgccagatcagctggtgaataagtcagtgtcacagggtttttgcttcaatattctgtgcgtcggtgagacagggctgggaaaaagcacacttatggatacattgtttaacacaaagtttgaaggcgaacccgctactcacacgcagcctggcgttcagttgcagtctaatacctacgatctccaggagtccaacgttcggctcaagctgaccatcgtgagtacggtgggctttggcgatcaaattaataaggaagatagctacaagcccatcgttgagtttatcgacgcccagttcgaggcctacctgcaggaggagcttaagattcgccgggtccttcacacgtaccacgattcaaggatccacgtgtgcctctatttcatagctcccaccggtcatagcctgaagtcgttggacctagtgacgatgaagaaactggacagcaaagttaatatcattcctataattgccaaagcagatgctatcagtaaatctgaattaactaaatttaagatcaagatcacttccgagctcgtctcgaatggagtccagatttatcagtttcccacagatgacgaatctgtggctgagatcaatgggacaatgaacgcccatctgccatttgccgtgatcggctctaccgaggaactgaagatcggcaacaaaatgatgagggcacggcaatacccctgggggaccgtacaagtcgaaaatgaagcccattgcgattttgtaaaactgcgggagatgttaatccgggtcaacatggaggatcttcgcgagcagacgcatacgcgacattacgagctctatagaagatgtaaattggaggagatgggtttcaaggataccgatcctgattctaagcccttctccctccaggaaacgtatgaggccaaaagaaacgaatttctgggtgagctccagaaaaaagaagaggagatgagacagatgtttgtgcagagagtgaaagagaaagaggccgagctgaaggaggcagaaaaggagcttcatgagaagttcgataggcttaaaaaactgcaccaggatgaaaagaagaagctggaggataaaaaaaaatccttagacgatgaggtaaacgcattcaagcaaaggaaaactgcggcggaactcctgcagtcacagggctctcaggcaggaggcagccagactctcaagcgcgacaaggagaaaaagaagtag

SEQ ID NO: 133788 - DNA, 1284 bp, Artificial Sequence
  Description of Artificial Sequence: Synthetic coding sequence
atggctgcgactgatatcgctcggcaagtgggtgagggctgcagaacagtccccttagcaggccatgtgggcttcgacagcctccccgatcagctcgtgaacaagtcggttagccaaggcttttgcttcaacattttatgcgtgggagagacaggccttgggaaatcaactttgatggacacactcttcaatacgaagtttgagggcgaacccgccactcacacccagccaggcgtgcaactgcaatctaacacctacgatcttcaggaaagtaatgttcgcttgaaactgactatcgtgtccactgtgggctttggggatcaaataaacaaggaagatagttacaagccgatcgtagagttcatagacgctcagttcgaggcctacctccaggaggaacttaagatccgacgagttttacacacgtaccacgatagtcgcatccacgtgtgcttgtactttattgcgcctacagggcactcccttaagtctctcgacctagtcaccatgaagaagctcgacagtaaggtgaacattatcccaataatcgccaaagcggacgctattagtaaatctgaactgacaaagttcaaaatcaagataacttctgaacttgtaagcaatggcgtccagatttaccagttccctacggatgacgaatctgtggccgagatcaacggtaccatgaatgctcacctgcctttcgccgtgattggttctacagaggagctgaagattgggaataaaatgatgcgcgctaggcagtacccctgggggaccgtccaagtagaaaacgaggctcactgcgacttcgtgaaactgcgagagatgctcatccgggtcaacatggaagatctgcgggagcagacgcacacaagacactacgaactgtaccgccgatgcaagcttgaggagatgggctttaaggatacagatcccgattctaagcctttcagcctgcaggaaacatacgaagcaaagcggaatgaatttctgggtgagctccagaaaaaagaagaagagatgcgacagatgtttgtgcagcgggtcaaagagaaggaggcggagctgaaagaggcagagaaggagctgcatgaaaagttcgaccgcctaaagaaattgcaccaggatgaaaagaaaaagctggaggataaaaaaaagagcctcgacgacgaagtcaacgccttcaaacagcgtaagaccgcagcggagctgttgcagagtcaaggcagccaggctggtggcagtcaaacccttaagagagataaagaaaaaaagaactag

SEQ ID NO: 133789 - DNA, 804 bp, Artificial Sequence
  Description of Artificial Sequence: Synthetic coding sequence
atggcagcgacagacatcgcccgtcaagtgggagagggatgtagaactgtgcctttggccggacacgtcggcttcgacagccttccggatcagttggtcaataaatcagtaagccaaggcttctgtttcaatatcctctgtgtgggagagaccggactggggaaatccaccctgatggataccctgtttaacactaaattcgaaggggagccagctacgcatacccagccgggagtccaactgcagagtaatacctacgatctgcaagagagcaacgtgcgccttaaacttaccatagttagtactgtcggcttcggggatcagatcaacaaggaggacagttataaaccaattgtcgaatttatcgacgcccagtttgaagcctatttacaggaggaactgaaaatccggagggtccttcacacataccacgattcgcggatccatgtttgcttgtactttattgctccaacagggcacagcctaaaaagcctcgatctggtgacgatgaagaagctggattcaaaggtgaatataatccctatcattgctaaagcagatgccataagtaagtctgagctgactaagtttaagattaagatcacctcagagctggtgtctaacggggtgcaaatctatcagttccctaccgacgacgaaagcgttgccgaaatcaatggtaccatgaacgcgcatctgccttttgccgttatcggctctacagaggaactaaaaattggaaacaaaatgatgagggcgagacagtacccctggggcactgtgcaggggtcaagccaagtttag

SEQ ID NO: 133790 - DNA, 1452 bp, Artificial Sequence
  Description of Artificial Sequence: Synthetic coding sequence
atggctgcaacagacctggaaagattcagcaatgcggagccggaaccaaggagtcttagtcttggaggacacgttggatttgactctctcccagatcagctcgtatcaaagtccgtgacacagggcttttcttttaacattctttgcgtgggagaaacaggcattggcaagtccactcttatgaacacactgttcaacacgacattcgagactgaagaggcttcacaccatgaagcatgtgtgagattgcggcctcagacgtacgaccttcaggaatcgaacgtgcaattgaaattgacaatcgtcgacgctgtgggctttggcgaccagattaacaaggatgagtcctacaggccgattgttgactacattgacgcgcagtttgagaactatctccaggaggagctcaaaattcgaaggtctctgttcgactaccacgatacacggattcacgtctgcctttattttattactccaactggccatagtctaaagagtttggatctcgtaacgatgaaaaagcttgacagtaaggtcaacatcatcccaatcattgcgaaagccgacactattagcaagtcggaactgcacaagtttaaaatcaagattatgggggaattggtttctaacggggttcagatctaccaatttccaaccgacgatgaagcagttgcagaaatcaacgccgtgatgaatgctcatctgcctttcgcggttgtgggctcaaccgaggaagtcaaggtgggaaataagctggttcgcgcacggcaatatccatggggtgtagtccaggtagaaaacgagaaccactgtgacttcgtgaagctccgtgaaatgctcatccgagtgaatatggaagacctgcgagagcagacccattcccgacattatgagctctaccgccggtgcaagctggaggagatgggatttcaggattctgatggggacagtcagccttttagcctgcaggagacctacgaagcaaaaaggaaagagtttttgtccgaactacagaggaaggaggaggagatgcgacagatgtttgtaaacaaggtgaaagaaaccgagctcgaattgaaggagaaggagagagagctgcatgaaaagttcgaacatctgaagcgcgtccaccaagaggaaaagcgcaaagtggaagaaaaaaggcgggagctcgaggaagagaccaacgctttcaacagaagaaaagccgccgtggaagccctacagagtcaagcactgcatgccacttcccagcaaccactgcgtaaggataaggataaaaagaataggtcggacataggcgcacatcagcccggcatgtcactatctagttcgaaggtgatgatgaccaaggctagcgtcgaacccctgaattgtagctcatggtggccggcaatacagtgttgttcatgcctggtgcgcgacgcgacatggagagaggggttcctctag

SEQ ID NO: 133791 - DNA, 1110 bp, Artificial Sequence
  Description of Artificial Sequence: Synthetic coding sequence
atgaataccttgttcaataccacatttgaaacggaagaagcaagccaccacgaagcctgcgtgcgtttgcgtcctcaaacttatgatttgcaggaatctaacgttcagttgaaactgacaatcgtggatgcggtcggcttcggggaccaaatcaacaaggacgaaagctacagacccattgtggattatatcgatgcccagtttgagaactacctacaagaggaactgaagattagaaggtcactcttcgactaccacgatacccggatccatgtctgcctgtactttataaccccgacgggacacagccttaaatcacttgacctggtgactatgaagaagctggattctaaggtgaacattatacccattattgccaaggccgataccatttccaagtctgagttacacaagttcaagatcaaaattatgggcgaactcgtttccaatggtgttcagatataccagttccctacagacgacgaggcagtggccgagatcaacgcagtgatgaacgcacatctgccttttgccgtcgttggatcaactgaggaggtgaaggttggcaataaactcgtgcgtgcccgacagtatccatggggagtcgtgcaggttgaaaatgagaaccattgcgacttcgtgaagctgagggagatgctcatcagagttaacatggaggatctgcgggagcagacccatagtaggcactacgagctctatcgccgatgtaagttggaggagatggggttccaggactctgacggtgactctcaacccttttcgttacaagaaacatatgaggcaaaaaggaaggagtttctctctgaactgcagcgcaaagaggaggagatgagacagatgtttgtcaataaggtgaaggaaactgaactagaactcaaggaaaaggaacgtgaactgcatgagaagttcgaacacttgaagcgagtgcaccaggaagagaagcgcaaggttgaggaaaagcgccgtgagctagaggaagagactaatgcgttcaatcggcgcaaagccgctgtggaggctctccaaagccaggccctccatgccaccagccaacaaccactacggaaagacaaggataagaagaactag

SEQ ID NO: 133792 - DNA, 1290 bp, Artificial Sequence
  Description of Artificial Sequence: Synthetic coding sequence
atggctgccacagacctcgaaagattctctaacgccgaacctgagccccgttctctgagccttggtggtcacgttggttttgacagcttacctgatcagctggtaagcaagtccgtcactcagggtttctccttcaatatcctgtgtgtcggagagaccggcatcgggaaatcaacccttatgaatacactgttcaataccaccttcgaaacggaggaagcaagccaccatgaagcctgtgtcagactcaggccccagacctatgacctgcaggagtccaacgtccagcttaaactcacaatagttgacgcagtggggttcggcgaccagatcaacaaggacgagagctataggccaatcgtggactacattgacgctcagtttgagaactatcttcaggaggagcttaaaatcagacggtcgctcttcgactatcatgacacacgcatccacgtctgtttgtattttataacacccacagggcactccctgaaatccctcgaccttgtcacaatgaagaagctggatagcaaagtgaatatcatccctatcattgcgaaagcggatacaatttctaagtccgagctgcacaaattcaagatcaagattatgggcgaattggttagtaacggcgtgcaaatttaccaattccccaccgacgatgaagccgtggccgagataaacgccgtcatgaatgctcacctgcctttcgccgtcgtgggtagtaccgaggaggtcaaggtcggtaacaaactcgttcgtgcccgtcagtacccttggggggtggttcaggttgagaatgaaaaccattgcgattttgttaagctccgggaaatgctgatcagggtcaacatggaggatctccgggaacaaactcacagtaggcactacgaactgtatcggaggtgtaagttggaagaaatgggctttcaggattccgacggtgactcccaaccattctctctccaggaaacatacgaggctaagcggaaagaattcctttcagagctccagcgcaaggaggaggagatgcggcagatgttcgttaacaaggtgaaagaaactgaacttgagctgaaggagaaagagagggaactgcacgagaagtttgagcatctgaagagggtccatcaagaggagaaaagaaaagtggaagagaagcgtagggaattagaggaggagacgaacgctttcaatagacggaaagcggccgttgaggcactgcagtctcaggcccttcacgctacatctcagcagccactgcggaaggataaggacaagaaaaactag

SEQ ID NO: 133793 - DNA, 1329 bp, Artificial Sequence
  Description of Artificial Sequence: Synthetic coding sequence
atggcagctacagacctggagagattttccaacgccgaacctgagcctaggtccctgtcattagggggccatgttggctttgactccttaccagaccaattggtcagtaagagtgtgactcagggcttcagctttaacattctttgcgtgggtgagactggcatcggtaagtccaccctgatgaatactctttttaatacaacctttgagactgaagaagcttcccaccacgaggcctgcgtccggcttcgaccacagacatatgacctgcaggaatctaacgttcagctgaaactaacgatagtggacgctgttggcttcggcgatcaaataaacaaagacgagtcttatcgccccattgtggactatatcgacgcgcagttcgagaattatctgcaggaagagttgaagatccggagaagcctgttcgactaccacgatacacgcattcatgtgtgtctttacttcataaccccaaccggtcatagtctgaagtcgctggatctcgttaccatgaaaaagctcgactcaaaagtcaacatcatcccaattatcgctaaggcggacaccatctcaaagtccgagctgcataaatttaaaattaaaattatgggcgaacttgtgtctaatggggtacagatctatcagtttccaactgacgatgaagctgtcgctgagataaatgccgtgatgaacgcccaccttcctttcgcagtcgtgggctctacagaggaggtgaaggtgggcaacaaactggttagggcacgccagtacccgtggggggtggtgcaggttgagaatgaaaaccactgtgatttcgttaagttgagggagatgctgatccgcgtgaacatggaggatctccgggagcagacacatagccgccactatgagttataccgacgctgcaagctggaggagatggggtttcaagattctgatggtgacagtcagcccttctctctgcaagagacatacgaagctaagcgcaaagagttcctgtcggagctgcagcgaaaggaggaagagatgcgccagatgtttgtcaataaagtcaaagaaactgagctggagctaaaagagaaagagcgcgaactgcacgaaaagtttgagcatctgaaacgcgtgcaccaggaagagaagcgcaaagtagaagaaaagagaagggagcttgaggaagagaccaacgcatttaatagacgcaaggccgcagtcgaagccttgcagtcacaagctttgcatgcaacatcgcagcagcctctgaggaaggacaaagacaaaaaaaaagcctctggctggagttctatctactccgtcacaattccttag

SEQ ID NO: 133794 - DNA, 1707 bp, Artificial Sequence
  Description of Artificial Sequence: Synthetic coding sequence
atggaacgagatcggattagcgccctgaagcgaagtttcgaggtagaggaagtcgagacccctaactctaccccacctcggcgggtccaaacccccctgcttcgagcgacggtcgcctcaagcacccagaaattccaggatctcggggtcaaaaactcagaaccaagcgcgcgccatgtagactccctgtcccagcgaagtcctaaagccagtctcaggcgcgttgagctgtccgggccaaaagcagcagagcccgttagcagacggactgaattgagtatcgatatcagctctaaacaagtagagaatgccggcgctatcggaccatctagatttggactgaagagggcggaggtgctgggccacaaaactccagagcctgctccccggaggaccgagatcactatcgtcaagcctcaggagtccgcccatcgtagaatggaaccgcccgcctccaaggtcccagaagttccgaccgcccccgctaccgatgcagcacctaaacgcgtggagattcagatgccaaaacccgccgaggcccccactgcgcccagtcctgctcagaccttagaaaatagcgagcctgcacccgtgagccagctgcaaagcagacttgaacccaaaccccaaccacccgtggccgaggccacccctcgctcacaggaagcaacagaggccgctccatcctgcgttggcgatatggcagacactccgcgcgatgccgggctcaaacaggctcctgcttcccgaaatgagaaggcgcccgtcgactttggatacgttggaattgattccattctggagcagatgagaagaaaagccatgaagcaagggttcgagtttaatattatggtcgtcggccagtctggtctaggtaaatctactcttattaacactctgttcaagtccaagatctcacgaaagtccgtccaacctaccagcgaagaaagaattcctaaaacaattgagattaagtccatcactcacgacatcgaggagaagggcgtccgcatgaaactgactgtaatcgacacacctggcttcggcgaccacatcaataatgaaaattgctggcaacctatcatgaaattcataaatgatcagtacgagaagtacctgcaagaggaggtcaatattaaccgcaaaaaaaggattcctgacacgcgggtccactgctgtctctactttatcccagctacaggacatagtctgagaccactggacattgaatttatgaagagattgagcaaggtggtgaacatagtgcctgtcatcgccaaggcggatacgctaacacttgaggaacgcgtccactttaaacaaagaattaccgccgatctgttaagcaacggcatcgatgtctatcctcaaaaggagtttgatgaggatagcgaagatagactcgtgaatgaaaagtttagggaaatgattccatttgccgttgttggctctgaccacgaataccaagttaacggcaaaaggatactcgggcgtaaaactaaatggggcacaatcgaagtggagaacaccacacactgcgaattcgcttatctccgggatctactgatccgcacacacatgcagaacattaaggatataaccagctctattcacttcgaagcttaccgggtgaaacgacttaatgagggcagttccgccatggccaacggaatggaggagaaagagcctgaagccccagagatgtag

SEQ ID NO: 133795 - DNA, 591 bp, Artificial Sequence
  Description of Artificial Sequence: Synthetic coding sequence
atggccgatactccgagggacgcaggtctgaagcaggcaccagccagtcgaaacgagaaggctcctgtggacttcggttatgttggcattgactccatactcgagcagatgcgaagaaaggccatgaaacagggatttgaattcaatataatggttgtgggccagtctggcctggggaaatcgaccctgatcaatacgctctttaaatcaaagataagtagaaagtccgtccagcctacctccgaagagagaatccccaaaactatcgaaatcaagagtatcacgcatgatattgaggaaaagggcgtccggatgaaactgactgtcatcgacactcccgggtttggagaccatatcaataatgaaaactgttggcagccaatcatgaagtttatcaatgaccagtacgaaaagtacctgcaggaggaagtcaacattaaccggaaaaaacgcatcccagacacacgcgtgcattgttgtctatacttcattccagccactggtcattctctaccacttctggaacaaaaggtacccctatcccaacctagtgccgactgtttggccagatgtggcgaccgcctcgagtag

SEQ ID NO: 133796 - DNA, 1740 bp, Artificial Sequence
  Description of Artificial Sequence: Synthetic coding sequence
atgagtgatcccgctgttaatgctcaattggatggaattattagcgatttcgaggcattgaagagatcctttgaagtggaagaagtggaaacccctaacagcactccgcccagacgtgtgcaaaccccccttcttcgagccaccgtggcttcttctacccagaagttccaggacttaggcgtgaaaaattcagaaccatcagcacggcatgtggactcactgagccagcgatctccaaaagcctcactgagacgtgtcgaactctccggcccgaaagcagcagagcctgtttcgcggcgcacagaactgtccattgatataagctccaaacaagttgagaacgccggagctataggtccatctcgcttcggcctgaaacgagcggaagtgttgggtcacaaaactccagagcccgccccccgcaggacggaaatcaccatcgtgaaacctcaggagtccgctcaccggagaatggagccaccggccagcaaagtgcccgaagtgcccaccgcccctgccactgatgcagccccgaagcgggtagaaattcagatgcctaaacctgccgaggcaccaaccgctccctcaccagctcagaccctggagaattccgagccagcacctgtctcccagctacaatctcgcctggaaccaaaaccgcagccacctgttgctgaagccaccccccgttcccaggaagcaacagaggcggccccgtcttgtgtgggggacatggctgatactccaagagacgccggcctcaaacaagcccctgcgtcccgcaacgagaaggctcctgtggatttcgggtatgttggcattgattccattttagagcagatgagacgcaaggccatgaagcagggtttcgaattcaatatcatggttgtcggccagtctgggctgggcaagagcactcttatcaatacactttttaaatcaaaaatctcgcgcaagagtgtgcaaccgacttccgaggaacgaatcccaaagacaattgagattaagagtatcacacacgacatagaagagaaaggcgtgagaatgaaactgacagtgatcgacaccccggggttcggtgaccacatcaataatgaaaactgctggcagccaattatgaaatttatcaacgatcagtacgaaaaatacctgcaagaggaggtcaatatcaaccggaaaaagcggatccccgatacgagagtgcactgctgtctgtattttatccccgcaacaggccatagcctgcgacctctggacattgaatttatgaagaggctatcaaaggttgttaacattgtccccgtgatcgcaaaagccgacacccttactcttgaagaacgggtgcactttaaacagaggattaccgctgatctattaagtaacggtatcgatgtgtaccctcagaaagagtttgatgaagatagtgaagacagattagttaacgagaagttccgcgagatgattcccttcgcagtagtcggctcggaccatgaataccaggttaacggcaaacggattttgggacgcaaaactaagtgggggaccatcgaagtggagaacactactcattgcgagttcgcgtatttgcgagatttgctcatccgcactcatatgcagaatatcaaagatattacctcttcaattcatttcgaggcatatcgggtcaaacgcctgaacgagggtagtagcgcgatggccaacggtatggaagagaaagaaccggaggccccggagatgtag

SEQ ID NO: 133797 - DNA, 1761 bp, Artificial Sequence
  Description of Artificial Sequence: Synthetic coding sequence
atgaagaagagttactcgggagggacccggaccagcagcggaagactccgcaggctcggagacagtagcggaccggcgttgaagagaagcttcgaggtggaggaggtggagacacccaatagcacacctcctagacgagtgcagacaccactcttacgtgctaccgtggcttcatccactcagaagtttcaggacttgggggttaaaaattccgagccttcagcccgtcacgtggactccctgtcccagcggagtcccaaggcgagcctgcgcagggtcgaactctctgggcctaaggctgcggagcccgtgtccagacgaacggagctgtccatcgatatttcatccaagcaagtggaaaacgccggcgcaataggtcccagccggttcggcctgaaacgggcagaggtgctcgggcacaagaccccagagcctgctccccggaggacagaaatcacaatcgttaaacctcaggagtctgcacatcgcaggatggaaccgcctgcttctaaggtccccgaagtcccaactgctccagccaccgacgcggcacctaagagagtggagatccagatgcctaagccagccgaagcacccacggcaccaagccctgcgcagaccctggagaactctgagccggcgccagtgagtcagcttcagagcaggcttgaacctaagcctcagccacctgtggctgaggctacccctagaagccaggaagccaccgaggctgctccaagttgcgttggcgatatggccgatactccaagagacgcagggctgaaacaggcccctgcctcacgcaatgagaaggcccccgtagacttcggatatgtgggaattgacagtatactcgaacaaatgcgcaggaaggccatgaagcagggctttgagttcaacattatggtcgtgggtcagagcggcttgggcaagtctaccttgatcaacactctattcaagtcgaaaatatcacgcaaatctgtgcaaccaacctcagaggagaggataccaaagaccatcgagatcaaaagcataactcacgatatcgaggaaaagggcgttagaatgaaactcaccgttatcgacacacccggcttcggtgaccatattaataacgaaaactgttggcagccaattatgaaattcataaatgatcagtacgagaagtacctacaggaagaggtaaatataaatcgcaagaagaggatacccgacacgagagtgcattgctgcctttatttcatacctgcgacgggccactccttaaggccacttgatattgagttcatgaagcgtttatcgaaggttgtaaatatcgtccccgttattgccaaggccgacaccctgaccttggaggagagagtccattttaagcaacggattactgctgatctgctgagcaacggcatagacgtgtacccacagaaggagtttgatgaggatagtgaggacaggctcgtgaatgagaagtttagagagatgattccgtttgcggttgtggggtccgaccatgaataccaggtaaacggcaagcgcatactgggaagaaagaccaaatgggggaccatcgaggtcgagaatactactcactgtgaattcgcctacctcagggatctgctcatccggacacatatgcaaaacatcaaagatattacctctagtatccactttgaagcttaccgcgtgaagagacttaacgaaggctcctctgccatggctaacgggatggaggagaaagaaccagaggctcctgagatgtag

SEQ ID NO: 133798 - DNA, 1425 bp, Artificial Sequence
  Description of Artificial Sequence: Synthetic coding sequence
atgggcagttcattttgggaaggcctgcaagtggctgtgggcttgcctcaaggttgttggccccaggggttagacagcggcgaacctgccgagggtggacagctggaagctgcgccagtttgtatagtaacacggcagtctaaagagacagctgggccaactctcggacgcggcggatggagacaggggtctttgagacgaggcaaaggaacctcctgtcgctgccgccagctctcacctgggcatggtcccggcagactgaccgggtgcggcgaatgccaccggctgccatgccgtgggctggtgagcggtttcacaggcctccgcggccaggaagaagacgatctcgcgttctgcctggctacgataggatctgaccgtcaagctacggaggccgcgcctagctgtgtcggagacatggccgacactcctagagatgccggacttaagcaagcccctgcgtccaggaacgaaaaagctcccgtcgatttcgggtacgtggggatagactctatactggaacaaatgcgcagaaaggcaatgaagcaggggtttgaatttaatataatggttgtcggccagtccggacttggaaagagcacccttattaacacactctttaagtccaagatttctcgtaagagtgtccagccgacatccgaggagcggataccgaagaccattgagattaaatctattacacacgacatcgaagagaagggagtgcgaatgaaattgaccgtgatcgatactccaggattcggagaccacataaataacgaaaactgctggcagcccattatgaaattcattaatgaccaatatgagaaatacttgcaagaggaagtgaacattaatcggaagaagcgaattcctgacacacgcgttcactgctgtctatactttattcctgcgaccggacacagtctgcgtccattagacatcgagttcatgaaacggttatccaaagtggtcaacatcgtgcccgtgattgctaaagccgacactctgacgctggaggaaagagtccattttaaacaacggattactgccgatctcctgagcaatggaatcgacgtttatccccagaaggagttcgacgaagacagcgaagacagactcgtcaatgagaaatttcgggaaatgattcctttcgccgtagtcggatccgaccatgagtatcaggtgaacggaaagcgcatattaggccgcaagacaaagtggggcacaatcgaagtcgagaatacaactcactgcgagtttgcgtatctgcgcgatctgctgatcaggactcacatgcagaatatcaaggacatcacttccagcatccacttcgaggcatacagggtgaagaggttaaacgaaggcagtagcgccatggctaacggaatggaggaaaaagagcctgaggcaccggagatgtag

SEQ ID NO: 133799 - DNA, 1269 bp, Artificial Sequence
  Description of Artificial Sequence: Synthetic coding sequence
atggagccccccgctagcaaggttcctgaggtgcctacggcgccagccacagatgctgcccctaagcgggtagaaatccagatgcccaaacccgctgaggctcctacggccccgagtcccgcccagaccctggagaactccgagccagctcctgtgtcacaacttcagtctcggctcgaaccaaaacctcagcctcctgtagccgaggcgacaccacgaagtcaagaagctactgaggccgccccctcctgtgtgggggacatggccgacacaccgagagatgccggcttgaaacaagctcccgcctcacgaaacgagaaggcccctgtggatttcggctatgtgggaatcgatagcatcttagaacagatgaggaggaaggctatgaaacaggggtttgaattcaatattatggtcgtgggacaatcaggtttaggcaagagcacactaatcaacacattgtttaaatccaaaatctcgcggaaaagcgttcagcctactagtgaggagaggattcccaaaaccattgagatcaagtctattacacacgacattgaggagaaaggggtaaggatgaagttgactgtaatcgacactcccggcttcggcgatcacataaacaatgagaactgttggcagccaatcatgaagttcatcaatgatcagtacgaaaaatatctgcaggaagaggtcaacattaaccgcaaaaagagaattccggatacccgagtacactgctgtctgtattttatcccggctactggccacagtctacggccactggatatcgagttcatgaagcggttatccaaggtggtgaacattgtcccagttattgcaaaggccgatactctgaccttagaagaacgggtgcattttaaacagaggattaccgccgacctgctttctaatgggattgatgtgtacccccagaaagaatttgatgaggactccgaagacagactggtaaacgagaagttccgtgaaatgatcccctttgcagtcgtaggctcagatcacgaatatcaggtgaatggaaagcgcatcctgggccgcaaaactaagtggggcacaatcgaagtggagaacactacacactgcgaatttgcttaccttcgtgacctgctgatacgtacccatatgcagaacatcaaggacatcacctcttccatccatttcgaggcatacagagtcaagcgacttaatgagggatcttcggccatggcaaatgggatggaggagaaagaacctgaggctccagagatgtag

SEQ ID NO: 133800 - DNA, 1008 bp, Artificial Sequence
  Description of Artificial Sequence: Synthetic coding sequence
atggctgacactcctcgcgatgctggtttgaaacaggcacccgcttccagaaacgaaaaggcccccgtggatttcggctatgttggcattgactccatcctcgaacaaatgcgccgcaaagcgatgaaacagggttttgagttcaacataatggtggtgggacagagtggattgggcaagtccaccctgattaacacactgttcaagtctaagatcagccggaagtctgtgcaacctactagcgaagaacgcatacccaaaaccattgagattaagtcaattacacacgatattgaggagaagggagtgagaatgaaacttaccgtgattgatacaccaggtttcggagaccacattaacaacgagaactgctggcagcccatcatgaagttcatcaatgaccagtacgaaaaatatctgcaggaagaggtgaacatcaatcgaaagaagaggattccagacaccagagtccattgctgcttgtatttcatccctgcaacaggacactcactgagacccctggatattgaatttatgaaaaggctgtccaaggtcgtgaacatagttccagtgatcgcaaaagcagatactctcaccctggaggagagggtccactttaagcagagaatcacagcagacctgttgtccaacggaatcgacgtttatccacagaaggagttcgatgaggactcagaagataggctcgtgaacgaaaagttcagagaaatgattccatttgctgtggttggttccgaccatgaataccaggttaacggcaaaaggattctggggcggaaaaccaaatggggcacaatcgaggtggaaaatacgacacattgcgagttcgcttatttgcgagatcttttgatccgcacccacatgcagaacatcaaggacatcacctcgtctatccattttgaggcataccgggtgaagaggctgaatgaggggtcttccgccatggcgaacggaatggaggaaaaggagcccgaggccccggagatgtag

SEQ ID NO: 133801 - DNA, 1269 bp, Artificial Sequence
  Description of Artificial Sequence: Synthetic coding sequence
atggagccacctgcctctaaagtgccagaagttcctaccgcaccagccaccgatgccgctcctaagcgcgtagagattcagatgcccaagccagccgaggcaccaactgccccttcacctgcacagacgctggaaaacagtgagcccgcaccagtaagtcaacttcagagcaggctggaacctaaacctcagccaccggttgctgaagccactccccggtcccaggaagcgaccgaagccgccccttcatgcgttggcgacatggccgacacgccccgcgatgcgggactcaaacaagcgcccgccagtcggaacgaaaaagctcctgtggacttcggctacgtaggtatcgacagcatcctggaacagatgcgcagaaaggcaatgaagcaggggttcgagtttaacattatggttgtcggacagtccggactcggaaaatctactcttatcaatacactattcaagagtaaaatctctcgtaaatccgtccagccaaccagtgaggagcggattcctaaaactatcgagatcaaatcaatcactcacgacatcgaggaaaagggcgtccgcatgaagctgaccgtgattgacactcccggtttcggagaccacattaacaacgagaactgttggcagcctatcatgaaatttataaacgatcagtacgagaagtacttgcaggaggaagttaatataaatcggaagaagcgcatccccgacacacgagtccattgttgcctgtatttcatccccgctacagggcacagtctaagacccttggatattgaattcatgaagcgcctcagtaaagtggtgaacatcgtcccagtaattgcaaaagcagacacactgaccctggaggagagagtgcacttcaagcagagaatcacagcagacctattgagcaatggcattgacgtgtaccctcagaaggagtttgatgaggattccgaggaccggctggtgaacgagaaattcagagaaatgatccccttcgccgtggtggggagcgaccatgaataccaggttaacggcaagaggatcctagggcgcaagactaagtggggcaccatcgaagtggaaaacactacacactgcgaatttgcctacctgcgcgacttgttgataagaacacacatgcagaacatcaaagatattacctcaagcatacacttcgaagcttatcgagttaagcgcctcaatgaaggatcttcggccatggccaatggcatggaggagaaggagcccgaagcacccgagatgtag

SEQ ID NO: 133802 - DNA, 1089 bp, Artificial Sequence
  Description of Artificial Sequence: Synthetic coding sequence
atggcaggagccgggtgcaccggcacctggagctggctgtgggggactgcaaccgaagccgctcccagttgcgtcggtgatatggcggacaccccaagagatgcaggtcttaagcaggcccctgcttcccgcaacgagaaagcacccgttgacttcggctacgtggggattgattccatcttggagcagatgcgcaggaaggctatgaagcagggatttgaattcaatataatggtagtgggacagtcaggtctgggcaagagcaccctcattaatacacttttcaaatctaaaatttcaaggaaatctgtgcaaccgactagcgaggaaagaatccccaagacaatagaaattaagtctattacccatgacattgaagaaaagggcgtccgaatgaagctgaccgtgatcgatacacctggatttggcgatcacataaacaacgaaaactgttggcagcctatcatgaaattcatcaatgatcagtacgaaaaatacctgcaggaggaggtgaacatcaatagaaaaaaacggataccggatacgagggttcactgctgcctgtactttattcctgcgactgggcattcactgcgcccgcttgacatcgagttcatgaagcggttgtcaaaggttgttaacatagtgccagtgattgcaaaagccgatacccttacccttgaggaaagagtccacttcaaacagagaataactgccgatctcctgtcaaacggcatcgacgtataccctcagaaggagttcgacgaggacagcgaggatagattagtgaacgaaaaatttagagaaatgatcccctttgccgtggtgggatcggaccacgagtatcaggtgaacggcaagcgcattttgggtcggaagacaaagtggggaacaatagaagtcgaaaatactacccattgcgagtttgcatacctaagggatttgctcatccgcactcatatgcagaacatcaaggacataacaagtagtattcacttcgaggcttatagggtcaagcggcttaacgagggttctagcgctatggcgaatggtatggaagaaaaagagcccgaagctccggagatgtag

SEQ ID NO: 133803 - DNA, 582 bp, Artificial Sequence
  Description of Artificial Sequence: Synthetic coding sequence
atgacattgtgtccccaggcttggctccctgaaggaagcgaagaacagctccgctgtgcagaccatccctcatgtggagttctgtcagccggcccatgggggggcggacaggcgtcacacctccagaggtctcccgtcggatgtaccctgccctctatcccgattggcccagtgccatggtcagtatctgagccacggggagagtgtagccctcccggcgctcccgggccacctgctcgacatatggtgtggcctagcctctccccttacccctgccctgcccctaagggtcgaaaactgcagggaccactgcctcccaccgcccaacccttacaggctccgtggcaactcccactcctcgagcaaaaagtccccctcagccagccaagcgctgactgctggccggacgcaggcactggatggaatgaaggtggtgtgttcatctcgctgccgtcccccagtcacgctaccccagctcccactggcctgcaggtgcttctgatgaggtgggacttgatcgaggataagaaggagggtgaaatgacaccaactccgagttctccgtccttcgaaaaggtgtag

SEQ ID NO: 133804 - DNA, 1071 bp, Artificial Sequence
  Description of Artificial Sequence: Synthetic coding sequence
atggccatgtcctatgtgaaggatgacatcttcagaatatatattaaggaaaagaaagaatgcaggcgagaccacagaccgccttgcgcccaggaggcccctaggaatatggtccatcccaacgtgatttgcgatggatgtaatggccctgttgtggggacaaggtacaagtgctcggtttgccctgactatgacctgtgcagcgtgtgtgagggcaaaggactccataggggtcacacaaaactggcctttccctctccattcgggcatctaagcgagggttttagtcattctaggtggctccgcaaagtcaaacacgggcatttcggatggccggggtgggagatgggaccgcccgggaactggtcgccaagaccgccccgcgccggagaggccaggcctggccccactgcggagagcgcatctggtccttctgaagacccatcggtcaatttcttgaaaaatgttggtgaaagcgtggctgccgcactgtcgccactcggaatcgaggttgatatagacgtagagcacggcggaaaaaggtcgagattaactcccgtgtctccagagtcatcaagcacggaggagaaatctagctcccaaccgtctagctgctgctccgacccaagcaagcctggtgggaatgttgagggggccacacagtctctggcagaacagatgcggaagattgcgctggaatcagagggccggccagaggagcagatggagtccgataattgttccgggggcgacgacgactggacacatctgtcgagcaaggaagtggaccctagcactggtgaactccagagcctccaaatgccagaatccgaaggtccaagcagcctggacccctcccaggaggggcctactgggctcaaggaagccgcgctttatccgcatttaccgccagaagccgatcccagacttatcgaaagcctttctcaaatgctgtctatgggcttcagtgacgagggcgggtggcttacaaggctactccaaactaaaaattatgatattggcgcagccctcgatacaatccagtactccaagcaccccccacccctgtag

SEQ ID NO: 133805 - DNA, 1071 bp, Artificial Sequence
  Description of Artificial Sequence: Synthetic coding sequence
atggccatgtcatacgtcaaagacgacatcttccgtatttacataaaggaaaagaaagaatgccgccgtgaccatcgccctccgtgcgcccaggaggcgcccagaaacatggtgcatcctaacgtaatctgcgatgggtgcaacggcccggtggtgggaacccgttataaatgttccgtgtgccccgactacgatctctgttctgtctgcgaggggaaaggactgcatcgcggacacactaagttggctttcccgagccctttcggtcatctgtctgaaggtttttcacatagccgctggcttagaaaggtaaagcacggccacttcggctggcccgggtgggaaatgggtccgcccggcaactggtcccctcgccccccacgggctggggaggcacggcccggacccaccgctgaaagcgcgtcagggcccagcgaagatccgagcgtgaactttttgaaaaatgtgggagagagcgtggcagccgccctcagtccgctcgggatcgaggtcgacatcgatgtcgagcacggcggaaagcgcagcagattgacccctgtctcacccgagtctagcagtactgaagagaagtcctcttcccagcccagctcttgctgctccgatccctctaaaccgggcgggaacgttgaaggtgcaactcagtcgctggccgaacagatgcggaaaatagctcttgaatcagaaggacgacccgaggagcagatggaatcggataattgcagcggaggagatgatgattggacgcacctgtccagcaaagaggtggatcctagtaccggcgaactccagtcactccagatgccagaatccgagggaccttcttcgttagaccccagtcaggagggccctacaggtctcaaggaagccgccctatacccccatctgcctcctgaagccgaccccaggttgatcgagagcttatcccagatgctaagcatgggtttctcagatgaggggggctggctcacgagattgctgcagacaaagaattatgacatcggcgccgccctcgatactatccaatacagtaaacacccccccccgttatag

SEQ ID NO: 133806 - DNA, 1323 bp, Artificial Sequence
  Description of Artificial Sequence: Synthetic coding sequence
atggccagccttactgtaaaggcctatctgctggggaaggaagacgccgcccgcgagatccggcgtttcagcttctgctgttccccagagcctgaggccgaggctgaggctgctgccggtcctggcccttgtgaacgtctgctgagcagggtcgctgctctgtttccagcactgcgacctgggggtttccaggcacactatagggatgaggacggcgatctagtggccttcagtagcgatgaagaactgaccatggccatgtcatatgtcaaagacgatatctttcgaatttatattaaagaaaagaaggaatgtcggagggaccataggccgccatgtgcccaggaagcgccacggaatatggtccatccgaatgtaatctgcgacgggtgcaatggcccagtggtgggcacaagatacaagtgtagtgtctgccctgattatgacctctgttcagtctgcgaaggcaaagggcttcaccgaggacacaccaaactagcattcccatccccattcggacacctcagcgaaggcttcagccacagcagatggcttcggaaggtgaaacacgggcacttcggttggcctgggtgggaaatgggacctccgggcaattggagtcccagacctccccgtgccggagaagcgcggcccgggccaactgccgaaagtgcctctggcccatccgaagatccctccgtcaacttccttaagaatgtaggggaatccgttgcagccgccttgtccccgctcggcatcgaagttgatatagacgtcgaacatggcggtaagaggtccaggttgactcctgtctcaccagagagctcttccaccgaggaaaagagctccagccagccaagctcgtgttgttcagacccatcgaaacctggcgggaatgtggagggcgcgacccagagcctcgccgagcagatgcgcaaaatcgctctggagtctgaaggacgacctgaagaacagatggaaagtgacaactgctcaggcggtgacgatgattggacgcacctgtcctccaaagaagtggacccatccactggcgagctgcaatcactgcagatgcccgaatccgaagggccttcctctctcgatccctcccaagagggccccaccggcttgaaagaggctgcactctacccccacctgccccctgaagcggacccccgattgatagaatctctttcacagatgctttccatgggtttttctgatgaaggaggttggcttactcgcctcctccaaaccaaaaactatgacataggcgctgcccttgataccatccagtatagtaaacacccaccgccactgtag

SEQ ID NO: 133807 - DNA, 1071 bp, Artificial Sequence
  Description of Artificial Sequence: Synthetic coding sequence
atggcaatgtcgtatgtcaaggacgacatcttcagaatatacattaaagagaaaaaagagtgcaggcgagatcaccgacccccttgcgctcaggaggcaccacggaatatggttcaccctaatgttatttgcgatgggtgtaacggacccgtggtcgggacacgatacaagtgttccgtctgccccgattatgatctgtgctctgtctgcgagggcaagggtctgcatagaggacacaccaagcttgcttttccaagcccattcggtcatctgtctgaaggattttctcatagtcgctggctgcggaaggtgaaacacggccacttcggctggccaggatgggaaatggggcccccaggtaactggtctcctcgtccacccagagccggggaagcccgccctggccccaccgccgagagcgcctctggtccctcggaggatccctccgttaattttctgaagaacgtgggagagagtgtcgccgctgctctctcgcctttgggcatcgaagtggatatcgacgtggagcacggagggaagaggtcccgcctcacccctgtgagccccgaatcctcatcaacagaggaaaaatctagtagccagccatcttcctgctgctctgatccttcaaagccgggcggcaatgtggaaggagctacacaaagtcttgctgagcaaatgcggaagattgctctagaatcagaaggccggcccgaggaacaaatggagtcagacaattgcagcggcggcgacgatgattggacccacctcagtagcaaggaggtggatccgagcacaggtgagctccaatcgctgcagatgcctgaatcagaggggccatcttctctggaccctagccaggaaggcccaacggggctcaaggaagcagcgctgtatccgcatttgccaccagaggcggacccccgtcttattgagtccttgagccaaatgctgagcatgggttttagcgacgagggaggctggctgactagactgcttcagactaagaattatgatattggggcggccctggacaccattcagtactccaaacacccgcctccactctag

SEQ ID NO: 133808 - DNA, 423 bp, Artificial Sequence
  Description of Artificial Sequence: Synthetic coding sequence
atggcaatgagttacgtcaaagacgatatttttagaatttacattaaggagaagaaagagtgccggcgcgatcacaggccgccctgtgcgcaagaggctcccaggaatatggtccacccaaatgtaatatgcgatggttgtaatgggccagtagtcggtactaggtacaagtgctcagtctgccctgattatgacctgtgctccgtgtgcgagggcaagggtttacatagaggtcacactaagctcgctttcccaagtccattcgggcatctgtcagaagggttcagtcactcacggtggctgcgtaaggttaaacacggccatttcggatggcctgggtgggagatgggcccacctgggaattggagcccaaggccaccacgggcaggggaagctagaccaggtcccaccgctgaatcttag

SEQ ID NO: 133809 - DNA, 891 bp, Artificial Sequence
  Description of Artificial Sequence: Synthetic coding sequence
atgactagctccgagagcaccttgaagaggaaaaagtctgccggtgggactactgcccaccgggtcctcagacgtcgtccatttggccatctgagtgagggattctctcatagccggtggcttcgaaaagtcaaacacggccattttggctggccgggttgggagatgggtcccccggggaattggagccctaggccaccacgtgctggggaggcacgacccgggccaacagccgaaagcgcttccggcccctccgaagatcctagcgtgaatttcctcaagaatgtgggggaaagcgtggccgcagccctatctccacttggcatagaggtcgatatagatgtagaacatggaggaaaaaggagccgtctcactccagtgtctccagaatcctcctccactgaagagaaaagctcctctcagcccagctcttgctgtagcgatccatctaaacccgggggaaatgtggaaggcgccacacaaagtttggctgaacagatgcgtaaaattgccctggaatcagagggccgcccagaggagcagatggaatccgacaactgtagcggcggcgacgacgactggactcatctgagttctaaggaagtagacccttcaaccggagaattgcagtcactgcagatgcctgaatcagaaggaccatcctctttggatccatcacaggagggtcctacaggacttaaggaggcagcactgtaccctcatttacctccggaggccgaccctcggttaatagaatccctgtctcaaatgctatccatgggctttagcgatgaagggggttggctcactcggctcctgcagaccaagaactatgacatcggagcggcgctagatactattcagtactctaagcacccacctcccctttag

SEQ ID NO: 133810 - DNA, 504 bp, Artificial Sequence
  Description of Artificial Sequence: Synthetic coding sequence
atggcaatgtcctacgtcaaagacgatatcttccgcatatacattaaggaaaagaaagagtgtcggagggatcacagaccaccctgcgctcaggaagccccgcgtaatatggtgcaccctaatgtgatctgcgatgggtgcaacgggcctgttgtcggcaccagatacaagtgctccgtctgtccggactatgacttgtgctcagtgtgcgagggaaagggcttgcatagaggccatactaagctcgcctttcctagcccttttgggcacttgagcgagggcttttctcattctcgatggttgaggaaggtgaagcatgggcacttcgggtggcctggttgggagatgggccctcctgggaattggtcacctcggccaccgcgagcaggcgaagcccgtcctggccctacagcagagtcggcctctggcccatctgaagacccgtcagtgaactttctaaaaaacgtgggagaatcagtcgctgcagctcttagccccctttag

SEQ ID NO: 133811 - DNA, 477 bp, Artificial Sequence
  Description of Artificial Sequence: Synthetic coding sequence
atgatgcaaaagttgctgaagtgcagccgattggtgctggctcttgcgctaattttagttctggagtccagcgttcagggttaccccacacggagagcacggtaccagtgggtaaggtgcaatcctgatagtaactctgctaactgcctggaagaaaaggggcccatgttcgagctactgcctggcgaaagcaacaagattcctaggctgcggacggatctttttcccaaaacacgaattcaggacctgaacaggattttcccattgtcagaggattacagtggctcgggctttggtagcgggtcaggttcagggagtggttccggcagcggcttcctgaccgagatggagcaggactaccagctcgtggacgagtccgacgctttccacgataatctgcgctcactggatagaaatctaccttctgatagccaagatctcgggcagcacggccttgaagaggattttatgttatag

SEQ ID NO: 133812 - DNA, 987 bp, Artificial Sequence
  Description of Artificial Sequence: Synthetic coding sequence
atgatgtctggggaacccctgcacgttaagacacccattcgcgatagtatggctctatctaagatggctggtacatccgtatacctcaaaatggactcagcacagcccagtgggtcctttaagattagggggattggtcacttttgtaaaaggtgggcaaaacaaggctgtgcacacttcgtgtgttcaagcgccggaaacgccggtatggcggccgcttatgcagcgagacagctgggtgttccagcgacaatcgttgtcccaagcaccacaccagctctcacaatagagcgccttaagaacgaaggcgcaacggtgaaagtggtgggcgagttactggacgaagctttcgagctagccaaggccctggcaaagaacaaccctggatgggtttacatccccccattcgacgatccgttaatttgggaggggcacgctagcatcgttaaggaactgaaggaaactctctgggagaagcccggagcaatcgccctgagcgtgggaggcggaggcctgctgtgtggcgtggtgcagggtctccaggaggtcggatggggtgatgtcccagtgattgcaatggagactttcggggcccacagcttccatgctgctacgacagctggtaagcttgtttcattaccaaagattacgagtgtggccaaggctctcggggtaaaaacagttggggcccaggcgctcaaactttttcaggaacatcccattttctcagaggtgatttctgatcaggaggcggtagcagctattgagaaatttgtggacgatgaaaaaattctcgttgaacccgcctgtggagcagccctggccgctgtctattctcacgtgatccagaagctccagctcgaggggaatttacggacccctctgccctccctcgttgtgattgtatgtggaggatctaatattagccttgcccaactgagagctctgaaagaacagctcggaatgacaaaccggcttcccaaatag

SEQ ID NO: 133813 - DNA, 657 bp, Artificial Sequence
  Description of Artificial Sequence: Synthetic coding sequence
atgatgagtggagagcccctgcacgtgaagacacccatccgagactcaatggctctgagtaaaatggccggcacatccgtgtacttgaagatggattctgcccaaccctcaggctcattcaagatcagggggatcgggcacttctgtaaacgatgggctaagcagggctgcgctcacttcgtgtgctcatcagctggaaatgccggaatggcagccgcatacgcagcccgccagttgggagtgcccgcaaccattgtagtcccaagcaccactcctgctctgaccattgagcggctgaagaacgagggtgccacagtcaaggtggttggggagctgctggatgaagcttttgagctcgccaaagctctggcaaagaataatcccggatgggtgtacataccgccatttgacgacccactcatttgggaagggcacgccagtatagtaaaggaactcaaggagaccttatgggaaaaaccgggcgcaatcgcgctgtctgtaggcgggggagggctattgtgtggagttgtacagggcttgcaagaagttggatggggtgatgtgccagtaatagcaatggagacttttggcgcacattcattccacgcagccacgacggcaggcaagctggtgtccttgcccaagataacgaggtag

SEQ ID NO: 133814 - DNA, 1452 bp, Artificial Sequence
  Description of Artificial Sequence: Synthetic coding sequence
atgacgatgccagtcaacggcgcccataaggacgcagatctttggagcagccacgacaagatgcttgcccaaccactgaaagacagcgacgtggaggtttataacatcattaaaaaggagagcaacaggcaaagagttggtctggaattgatcgcttccgaaaatttcgctagccgcgcagtgctcgaggcactaggcagttgtctcaataataagtactctgaagggtatcccggtcagcgatactacggtggaaccgaattcattgacgaactagaaacgctgtgtcagaagcgcgctctgcaggcctataagctggaccctcagtgttggggcgtaaatgttcagccttatagtgggtcccccgcaaactttgcagtttacaccgccttggtcgaaccacacgggcgaataatgggtctggacctccctgacggtggacatttaacacacggcttcatgacggataaaaagaaaatctccgccacctcaatcttctttgaatctatgccgtataaggtgaaccccgacaccggctacattaattatgaccaactggaagaaaacgcaagactgttccacccaaagctgatcatcgctggcacctcgtgttactcccgaaatctggagtatgcccgcttgcggaaaattgctgatgaaaacggcgcctacctgatggcggacatggcccatatttcagggctcgttgcggcaggggtcgtcccatccccttttgaacactgccatgtggtgaccacaacaacacataagaccctgaggggatgcagggcaggaatgatcttttatagaaagggcgtaaagtctgttgaccccaaaacgggcaaggagattctgtataacttggagagtttaatcaacagcgccgtgtttcccggtctccaggggggaccccataatcatgctatagctggcgtggctgtagcactgaaacaggcaatgactctggagtttaaagtgtaccagcaccaggtggtggccaattgccgcgccttgtccgaagcactgactgaactggggtataagatagtgaccggtgggtcagacaatcatctgatcctggtggatctgcggtcaaagggcacagacggcggtcgggctgagaaagttcttgaagcttgttctatcgcctgcaataagaacacttgccccggcgataggtcagccctgcgcccttctggtctgcgcttgggcacccccgccctgacttcacgcgggctgctcgaaaaagattttcaaaaggtggcccactttatccatcggggtattgagctaactctgcagattcagtctgatactggcgtgcgcgctactctaaaggagttcaaggagcgtctggccggtgataagtatcaggccgcagtgcaggctcttagggaagaggtggaaagcttcgcctctctgttcccactgccaggcctgcccgacttttag

SEQ ID NO: 133815 - DNA, 378 bp, Artificial Sequence
  Description of Artificial Sequence: Synthetic coding sequence
atgcggtacctgcttcaggtcgcccagctggtctggctgactgtggacagtcggggaatcggcggtacgcttgaccacgccggtttctctatttgcatcttcaccgtccccccccttagtttcttcggactgtgcgaggcgcaaaccttcggactcagcgggtccaagtccccggcattgcatcggtactacggaggaactgagttcatcgatgagctcgagaccctctgccagaaacgagctctgcaagcctacaaattggatccccagtgttggggagtgaatgttcccactcaggttctggtctccagcatatggccaggtgcagcaagcagttgtgcctcccccagagccgatatgcatcaggaagagtcttag

SEQ ID NO: 133816 - DNA, 1212 bp, Artificial Sequence
  Description of Artificial Sequence: Synthetic coding sequence
atgacgatgcccgtgaatggggcacataaagacgccgatctctggtcctctcacgacaaaatgctcgctcagcccctgaaagattccgatgtggaggtgtacaacatcataaaaaaggaatcaaatagacaacgtgtaggattggaactgattgcttccgagaacttcgcaagtcgggctgttctggaggccctggggtcctgtttgaataataagtacagtgagggataccctggacaacgatattatggaggcactgaatttattgacgaattggagactctctgtcagaagagggccctccaggcgtacaaactggacccccagtgctggggcgtcaacgtgcagccttactccggaagccccgccaattttgctgtgtacacagcactcgtggagccccatggcaggatcatgggcctggacttaccagatgggggccatcttactcatggatttatgacggataagaagaagattagcgctacaagtattttcttcgagtccatgccctacaaagttaatccagacaccggatatattaattatgaccagctcgaggaaaatgctaggctgttccatcctaaattgatcatcgccggtacctcatgttactcccgcaatctggagtacgcccgccttaggaaaattgccgatgagaatggcgcgtacctgatggctgatatggctcacatttccgggctggtcgccgctggggtggttccaagtccattcgagcattgccacgtagttacaactaccacccacaagacactaagaggctgtcgtgccggcatgatcttttatcgaaagggcggctcagacaatcacctgatcctggtggatctgcgctccaaggggaccgatgggggcagagcggagaaagtgttggaagcctgttccattgcctgcaataaaaacacctgcccaggcgaccgatcagccctgagaccatccggccttaggctgggaaccccagccctcacgagccgcggccttctggaaaaagatttccagaaggtggctcattttattcacagaggcatcgagctcaccttgcagatacagtccgacactggcgtgcgagctaccctcaaggagttcaaagagcggctggctggggacaaataccaggcagccgtacaagcactccgtgaggaagtggagtctttcgccagtctgtttcccctccccggactgcccgatttttag

SEQ ID NO: 133817 - DNA, 1335 bp, Artificial Sequence
  Description of Artificial Sequence: Synthetic coding sequence
atgactatgccggtaaacggagcacataaggatgccgacttatggtcctcccacgataagatgctggcccagcctctaaaggatagtgatgtggaggtgtacaacattattaagaaggaatccaacagacaaagagttggactggagctcatcgcaagtgagaattttgcctcacgcgcggtgctggaggctttggggtcatgtttgaataataaatatagcgagggctacccggggcagcggtactacggaggcaccgaattcattgatgagctggaaaccctctgtcagaaacgagcccttcaggcctataagctcgaccctcagtgttggggggtgaatgtgcagccttactccggatcacctgcaaactttgccgtgtatacagcgctggtagagccacatgggaggataatgggattggacttacctgacggaggacacttaacacacggcttcatgacagacaagaaaaaaatcagcgctactagtatattcttcgagtccatgccgtacaaggtaaaccccgataccgggtacataaactacgatcagctggaagagaatgctcgcctctttcatccgaaactcataattgctgggactagctgctattcgagaaacctggaatacgctcgtctgagaaaaatcgcagatgagaatggcgcctatctgatggccgacatggcccacatctccggactagtggccgctggcgttgtgccctccccattcgaacactgccacgtggtgaccacaaccacccacaaaacgctgagaggctgtagggcaggcatgatcttctatcgcaagggggtcgccgtggctctgaaacaggctatgaccctggagtttaaagtgtaccagcatcaggtcgtggctaactgtagagctttgtccgaagctctgactgagcttgggtacaagatcgttactggtgggagcgataatcatcttattctggtcgacctcagatcgaaagggactgatggaggcagggctgagaaggtcctggaagcatgttccatagcctgcaataaaaatacatgtcccggagaccgctccgctttaaggcccagcggcttacgtctgggtacccctgccctgaccagccgcgggcttctagaaaaagatttccagaaggtggcacacttcatccaccggggaatcgagcttactctacagatccagtccgatacgggcgtgagggcaactctgaaggagttcaaagagcgcttagctggcgacaagtaccaagctgctgtccaggccctcagggaggaggtggaaagctttgcatctctctttccgctgccaggactgcctgacttctag

SEQ ID NO: 133818 - DNA, 285 bp, Artificial Sequence
  Description of Artificial Sequence: Synthetic coding sequence
atgactatgcctgtgaacggggcccataaagacgcagacctctggagtagccatgataagatgttggcccaaccactaaaagactcggatgttgaggtttacaacattataaaaaaggaatctaaccggcagagggtcggactggaattgatcgcctccgaaaactttgccagccgtgccgtcctggaggccctgggaagctgtctgaacaataaatatagcgaaggatatcctggtcagagatacgtcaacatcttcaaggggctggtcctgactcagtcttag

SEQ ID NO: 133819 - DNA, 777 bp, Artificial Sequence
  Description of Artificial Sequence: Synthetic coding sequence
atggctgatatggcccatatcagcggtcttgtggctgcaggcgtggtgccgtcgccctttgaacactgccacgtagtcaccacaaccacacataaaactttaaggggatgtcgggctgggatgatattttaccgcaagggcgtcaaatctgtggacccaaagaccgggaaggagatcctgtataatctggaatcccttattaattccgccgttttccccggacttcaaggtgggcctcataatcatgccatcgccggcgtggccgtggccctgaaacaggccatgacactcgagtttaaggtttatcagcatcaggttgtagccaactgcagagcactgagcgaggctttgacagagctgggctataaaatcgtgacaggcggttctgataatcacttgatactggttgaccttcggagcaaaggaaccgacggagggagggctgaaaaagtgctggaagcctgctccatcgcttgcaataagaatacctgtccgggcgaccgctcggcgctccggccttcaggtctcagactcgggactccagccctgacaagtcgaggcctgctggagaaggactttcagaaagttgcccattttattcatagaggaattgagttaacacttcagattcaaagcgacaccggggtgcgcgctacactgaaggagtttaaagaaaggctggccggggataagtatcaggctgccgtgcaagctctgcgggaagaggtcgaatcattcgccagcctatttcctttgcccggcctgcccgatttctag

SEQ ID NO: 133820 - DNA, 1341 bp, Artificial Sequence
  Description of Artificial Sequence: Synthetic coding sequence
atgacgatgcccgtgaacggggcccataaggatgcagacctctggagttcccatgacaagatgctggcacaaccactcaaggattcggacgttgaagtgtataatatcattaaaaaggaaagcaacaggcagagggtgggactggagctaatcgccagcgaaaacttcgcatcacgcgcagtgctagaagctcttggttcatgccttaataacaagtatagcgaaggatatcctgggcagcgatactatggtggcacggagtttatcgacgagctcgagaccttgtgtcaaaaacgcgccctacaggcttacaaactggacccacagtgttggggcgtgaatgtgcagccatattcgggaagcccggccaattttgccgtgtatacagccctggtggaaccacacggacgtattatgggactggacctccccgacgggggccatctaactcatggctttatgaccgataaaaaaaagattagcgccacctccatattcttcgagtcaatgccctacaaggtaaacccagacacaggctacattaactatgaccagcttgaggaaaacgctaggctcttccatccaaagctcattattgctggaactagctgctattcaaggaacctggagtacgcccgcctcaggaagatagcggatgaaaacggcgcctacctgatggctgacatggctcatatttctggcttggtggcagctggagtggtacccagccccttcgaacactgccacgtggtcactactaccacacataagacattacggggttgcagggcgggcatgattttctaccgtaaaggagtgaaaagcgtggacccaaaaactggtaaggagatcctttataatctggaatcactcattaactccgctgtgtttcccggtctgcagggcgggccccataatcacgcgatcgctggtgtcgcagtcgcgcttaagcaggctatgacactggaatttaaggtctaccagcaccaagtggtggccaactgcagagcactgtctgaggccctcaccgagctcgggtataagattgtaactggtggctccgacaatcacctcatccttgtggacttacgatccaagggaacagatggaggtcgggcggaaaaagtgcttgaggcctgtagtattgcatgcaataagaacacttgcccagggatagagctgacattgcagatacaatccgacacaggagtgcgggctaccttgaaggaatttaaggagcgcctggcaggagataaataccaagcagctgtgcaggcactgagggaggaggtggaaagttttgcgtccctcttccctctgcccggattgcccgatttctag

SEQ ID NO: 133821 - DNA, 1038 bp, Artificial Sequence
  Description of Artificial Sequence: Synthetic coding sequence
atggggctggatctgcctgatgggggacacctaacccacggattcatgacagacaagaaaaagatttctgccacatctattttctttgagtccatgccatacaaagttaatccggatactggctacatcaattatgatcagctggaggagaatgcacgcctgttccaccccaagttgatcattgctgggaccagttgttatagtaggaatctggagtacgccagactgagaaaaatagctgacgagaacggtgcttacctcatggccgatatggctcacatttccgggcttgtggctgccggagttgtgccatcaccctttgaacactgccacgtcgtgaccacaacaactcacaagacgctgcgaggctgcagggcaggaatgattttctacagaaaaggcgttaaaagcgttgacccaaagacagggaaagaaattctctataatctggagagcctcatcaattcggcagtcttcccaggactgcaaggcggaccccacaaccacgccattgccggagtcgctgttgcactcaaacaggctatgacgctggagttcaaggtgtatcaacaccaggtggtcgcaaactgtcgagcccttagtgaagccctcaccgagctcggctataagattgtgacaggcggttcggataatcatttaattcttgtcgacctcagaagtaaaggcacggatggcggccgggccgagaaggttctggaagcatgctctattgcctgtaacaaaaacacctgccctggagatcggtccgccctgcggccatcaggcctgagactggggacgcccgcattgacttcgaggggacttctagaaaaggactttcaaaaggtggcccacttcatccacagaggaatagaactcaccctccaaattcagagcgacactggggtaagagccaccctgaaagaatttaaggaacggctggcgggcgataaataccaagccgcggtgcaggccctgcgagaggaggtggagtcttttgccagcctgttccccttgcccggattacctgacttctag

SEQ ID NO: 133822 - DNA, 1515 bp, Artificial Sequence
  Description of Artificial Sequence: Synthetic coding sequence
atgctgtatttcagcctgttctgggctgctagacccttgcagagatgtgggcaactcgtgcgcatggcaattcgagcccagcattctaacgctgctcaaacccagacaggagaagcaaataggggctggacaggacaagagtccttgtccgattcagatcccgaaatgtgggagctgctgcaacgagaaaaagacaggcagtgtagaggattggagcttattgctagtgagaatttttgctcccgagcagccctcgaagctctgggctcttgccttaataacaaatattctgagggctaccccggtaagcggtattacggcggggcggaggttgttgacgaaattgagctgttatgtcagcgacgagccctcgaggctttcgatttggatcctgctcagtggggggtgaacgttcagccgtattccggatcccctgccaaccttgcagtatacaccgcgttattacaacctcatgacagaatcatggggttggacctacctgatggcggccatcttacgcacggatacatgtccgatgtgaagagaatttctgctaccagcattttcttcgagagcatgccctataaacttaacccaaaaacggggctgattgactacaaccaattagcgttgactgcacggttgttcaggccgaggctaatcattgctggtacctccgcatacgcacgccttatagattacgcaagaatgcgtgaggtttgtgatgaggtgaaagctcacttattagccgatatggcacatatctctggcttggtggccgccaaggtaatcccttccccttttaaacacgccgatatcgtgaccacaactacccacaagacacttcgcggggccagatcaggactgatcttttaccggaagggcgtgaaagcggtggaccccaaaactggccgcgagatcccctacacttttgaagaccgaattaatttcgctgtgttcccctccctccagggcgggccccacaatcatgccattgccgccgtcgccgtggcacttaagcaggcctgcacccccatgttccgggaatattcactgcaggtactcaagaatgcccgggccatggccgacgcccttctggaacgcggctactctctagtgagtggggggacagataaccacctggttctggtggacctgcgacctaaggggctcgacggcgccagggcagaaagagtcctggaattagtctctatcacagccaataaaaatacttgtcccggagaccgaagtgcaatcacaccaggcgggctgcgtctcggggcacctgccctcaccagtcgccaatttagggaggatgatttcaggcgagtggtggattttatagacgagggagttaacatcgggctggaggtcaagtctaaaaccgccaaactgcaggattttaagagtttcctactcaaagatagcgagactagccagagactggccaacctccggcaaagagttgagcaatttgcccgtgctttccccatgccaggctttgatgagcactag

SEQ ID NO: 133823 - DNA, 1227 bp, Artificial Sequence
  Description of Artificial Sequence: Synthetic coding sequence
atgggagaacagaggtggtggatgaagctgtcctgctgcgcaagtgctggtccttggaaacctctcacctggattctgcactccggcgagagtatgtcttcacctacacctgggccacaacccacctggccatccactcagcctttttgtaatttgacaaccggtagctggggctggacgtgcccgatgggtgctatctcacccaccgccacatgcctgactagctcaggttaccagccgagaccttcatccagctccttgtgccccattagcagtaccgcactcgcggtgtgcgtgtcagtccagccaaagactggtttaatcgactataaccagttagctctaacagcccgtttgttcaggcccagactgattatcgcaggcactagtgcctacgcacgtctaatcgactatgctcggatgcgagaggtgtgcgacgaagtcaaggcacacttactggcggacatggcacacatcagtggcctcgtcgcggcaaaagttattccatcgccttttaagcatgccgatatagtgacgaccaccacacacaaaactctcaggggagctcggagcggattaatcttttaccgcaaaggcgtcaaagccgtagatccaaagaccgggagagaaattccttacacatttgaggacagaatcaatttcgctgtgttcccttctctccaaggaggcccccataaccatgccattgcggccgttgctgtggcgctgaaacaggcttgtactcctatgtttagggagtattcacttcaggtattgaaaaacgctagggccatggcagacgcactgctcgagcgcggatatagtctggtctcgggcgggactgataaccatcttgtactggtggatctccgccctaaggggttggacggggcccgagctgaaagagtgctcgaactggtgagcataacggcaaacaaaaatacttgtccaggcgaccgatccgcaataacgccaggtgggctgagactaggggcacccgcactgacatcacgccaattccgggaggacgatttccgacgggtggtggatttcatcgatgaaggagtgaatatcggcctagaggtgaagtcgaagactgcaaagctacaggactttaagagctttctgctgaaggactctgaaacatcacagcggctggccaacctccgccaaagagtggagcaatttgccagggcctttccaatgccagggtttgatgaacactag

SEQ ID NO: 133824 - DNA, 1452 bp, Artificial Sequence
  Description of Artificial Sequence: Synthetic coding sequence
atggccatccgcgctcagcattccaacgccgcccagacacagaccggtgaggcaaatcgtggatggaccggccaggaaagcctctctgacagtgaccctgagatgtgggagttattgcagcgggagaaggacaggcagtgccgaggcctcgaattgattgcatctgagaatttctgcagcagagctgctctggaggccctcggctcttgcctcaacaacaaatatagcgagggctaccccggcaagcgatattatggcggggccgaggtcgtcgatgagatcgaactcctgtgtcagagaagagcgctggaagcattcgatctggacccagcgcaatggggcgtaaatgtgcagccttacagtggttccccagccaacttggccgtctacacagcattgcttcaacctcacgaccggatcatgggcttggatctgcccgatggcggacatctgacccatggctatatgagcgacgtaaagcgtatctccgcaacctctatattctttgagagtatgccctacaaacttaatcctaagactgggcttatagactataatcagctcgctctgacagccaggctgtttcgccctcgcctcattatcgcaggtacttcggcctacgccaggttgattgattacgcacggatgagagaggtgtgcgatgaggtgaaagcgcatctgctcgcagatatggcacatattagtggactggtggcagcaaaggtgattcctagccccttcaaacacgcagacatcgtcaccactacaacccataagactcttaggggggctcgctcgggactaatattttatcgcaagggcgtgaaagccgtcgatccgaaaacagggagagaaatcccatacacgtttgaggacagaattaattttgccgtatttccgtccctacaaggcggcccacacaaccacgctatcgcagccgtggcggtagccttaaagcaggcgtgtacgccaatgttccgagaatactctttgcaggtgctgaaaaacgctagagcgatggcagacgctttgttagagcgcggctactcccttgtcagtggggggacagataatcatcttgttctagttgatttacggccaaaggggctggacggtgccagagccgagcgcgtgctcgaacttgtgtccattaccgctaataaaaatacgtgcccaggtgacagatcagcaattacgcctgggggcttacgcctcggagcccctgcgctgaccagtagacagttcagggaagacgactttagacgagtggttgactttattgacgaaggggtgaatatcggactggaggtgaaatcaaaaacagctaaactgcaggactttaagtccttcctccttaaagatagcgagacatctcaacgcctggcaaacttgaggcagcgggtagagcaatttgcacgtgcgttccccatgccggggttcgacgagcactag

SEQ ID NO: 133825 - DNA, 1452 bp, Artificial Sequence
  Description of Artificial Sequence: Synthetic coding sequence
atggcaattcgggcccagcattccaatgccgcccaaactcagacaggggaagcgaatcggggatggactggccaggagtctttaagtgattctgaccccgagatgtgggagctgctgcagagagagaaggacagacaatgcaggggcctcgaactgattgcctccgagaacttctgctctcgggctgctctggaagcgttgggttcttgtttaaataacaagtatagcgagggatacccaggcaagaggtattatggcggtgccgaagtggtcgatgaaatcgaacttttatgtcagcgcagagctttagaggccttcgatttggaccccgctcagtggggcgttaacgtccagccttactccggaagtcctgccaacctcgcggtttacaccgcgctactgcagccgcacgacagaatcatggggctagaccttccagacgggggacacctaacccacggttacatgtcagacgtaaaaaggatttcagcaacttccatcttctttgagagcatgccctacaaactcaacccaaagaccggacttatcgattacaaccagttagctctcaccgcacgactgtttcgcccacgcctcataatcgcgggcacttccgcttacgcaaggctgatcgattacgctagaatgcgtgaggtgtgtgatgaagttaaggcacaccttctggctgacatggcccacatttccgggcttgtggcagccaaggtcatcccatccccattcaagcatgcagatatagttacaaccaccacccataagaccctcaggggcgctcggagcggcctgattttttataggaagggcgtgaaagcggttgatcctaagactggcagggagattccatatacctttgaggatcggattaactttgcggtgtttccctccttacagggaggtccacataaccatgccatcgccgctgtcgcagtcgcacttaagcaagcctgtactcctatgtttagagagtactcgctgcaagtgctgaagaatgccagggctatggccgacgcactgcttgaaaggggatattctttggtctcaggcgggaccgataatcatctggtgttagtcgacctccggccaaagggattagatggcgcaagagcagagagggtgctagaactggtgtccatcaccgctaacaagaatacatgccctggggatcgctccgccataacaccagggggtctgcgtcttggcgcccctgcactgacatctcgacaatttcgggaagatgattttcgccgggtcgtggatttcatagatgagggcgtcaacatcggattggaggtgaagagtaaaacagctaagctgcaggattttaaatcatttcttttgaaggatagcgagacttctcagagactggccaacctgagacagagggtggagcagtttgcccgtgcctttccgatgcccggatttgacgagcactag

SEQ ID NO: 133826 - DNA, 1452 bp, Artificial Sequence
  Description of Artificial Sequence: Synthetic coding sequence
atggctatcagagcccaacactccaacgcggcccagacacaaacaggggaagccaacagaggatggacagggcaggagtccctctccgatagcgacccagagatgtgggaactactgcaaagggagaaagaccgacagtgccgcgggctcgagttgattgcaagtgagaatttttgctctcgggccgctctagaggcactgggttcatgccttaacaataagtacagtgaaggctatcctggtaagcgatactatgggggtgctgaagtcgtggacgagatagagctgctttgtcaaaggagggctctcgaagccttcgacctcgaccccgcgcaatggggggtgaatgttcagccttactccggtagtcccgcgaaccttgcagtttataccgccctgcttcagcctcacgatcggatcatgggtttagacctgcccgacggaggacatttgacacatggatacatgtctgacgttaaacggatttcggccacgtctatattctttgaatcaatgccctataagctcaatcccaagaccggtctaatcgattacaaccagctggccctgaccgctcgactgtttaggcctcgtctcatcattgccggaactagcgcctacgcaaggctaatcgactatgctcggatgagggaagtgtgtgacgaggtaaaggctcatctgttggctgatatggcgcatatcagtggtttggtcgctgccaaggtcatcccctcccccttcaagcacgctgatatcgtgactaccacaactcacaaaactctcaggggtgcgcggtcgggcctgatattctaccggaagggcgtcaaggccgtagatcctaagaccggacgggagatcccgtacaccttcgaggacagaatcaacttcgccgtgtttccatctttgcaaggtgggccacacaaccacgcaatcgcagccgtggccgttgcacttaaacaggcctgcaccccgatgtttcgggaatattctttacaggtcctgaagaatgctagggctatggccgacgctctgctggagaggggatactccctggtgtccgggggaacagacaaccacctggtgctagtggatttaaggcccaaggggctggatggcgcccgggccgagcgtgtgctggaattagtgtctataacagccaataagaacacatgcccaggagacaggtccgccataactcccggtggtcttcgcctcggcgcgcctgccctgacaagtaggcagttccgagaagacgactttaggcgagtggttgattttatcgacgagggagtcaacattgggctggaggtgaaaagcaaaactgccaagctgcaagactttaagagcttcttactgaaagatagtgaaacttctcaacgactagccaatctgcggcagcgcgtcgaacagttcgcaagggctttccccatgcctggttttgatgaacactag

SEQ ID NO: 133827 - DNA, 1485 bp, Artificial Sequence
  Description of Artificial Sequence: Synthetic coding sequence
atgctgtacttttccctgttttgggccgctcgaccgctccaacgctgcggtcagcttgtgcggatggcaatccgggcccaacattctaatgccgcacagacacagaccggagaagcaaatcgtgggtggaccggtcaggagtcactctcagacagtgaccccgaaatgtgggaattgcttcagagagagaaagaccgacagtgtagaggcctggagcttattgcttcggagaatttttgctcccgcgctgccctggaggctcttgggtcttgtcttaacaacaaatattcagaggggtacccaggtaagcggtactacggtggggctgaggtagtggacgagattgagctgctgtgtcagagacgagccctggaagcattcgacctggatccagcccaatggggagtgaacgtacagccttactctgggtcccccgccaacctggctgtgtatacagcccttctccaacctcatgaccggatcatgggattagacttgccagatggcggtcacctgacccatggttacatgtctgacgtcaaaagaatatctgcaacttccatcttcttcgaaagtatgccatacaaacttaacttagcactcactgcaagattgttccggccgagactcattatagcagggactagtgcatacgctcgactgatcgattacgcccgaatgagagaggtgtgcgatgaagttaaagcacatctactggccgacatggcacacatcagcggactggttgctgccaaagtgatacccagccccttcaaacacgcggacattgtgactactacaacacacaaaacgcttcggggggcgcgctctggacttattttctatcgaaagggagtgaaggctgtggacccaaaaacaggaagagagatcccgtacacatttgaagatcggatcaactttgcagtctttcccagcctccagggcggaccccacaaccacgctatcgcagctgttgcagtggccctgaagcaggcttgcacccccatgtttcgtgagtactctttacaggtgcttaagaacgcccgggcaatggccgatgcactacttgagagagggtactctctggtgtccgggggcacagataaccatctagtgctagtggatctccgcccaaaggggcttgatggtgcccgggccgaacgggtgttagagttagtgtcaatcacagcaaacaagaacacatgtccaggagaccggagcgctatcacaccaggcggattgcggctgggggcacccgccctgacatcgcggcagttcagggaggatgactttcggcgggtcgtcgatttcattgatgagggggtgaacattggcctggaggtcaagtccaagaccgcgaagctccaggatttcaaaagtttcctgctaaaggattccgagacctcccagagactggctaatctgagacagagagtggagcagtttgccagggccttccctatgcctggttttgacgagcattag

SEQ ID NO: 133828 - DNA, 1422 bp, Artificial Sequence
  Description of Artificial Sequence: Synthetic coding sequence
atgggggcggttctcggtgtattttccctggcaagttgggtcccttgtttgtgctcgggggccagttgcctgctgtgcagctgctgccccaatagcaagaattccaccgtgacacgactcatctatgctttcattctgctccttagcacagtggttagctacatcatgcagcggaaggaaatggagacctacttaaagaaaatcccagggttctgcgagggcgggttcaaaatccacgaggctgatatcaatgcagacaaagactgcgacgtcttggtaggttacaaagcagtctataggatttcctttgccatggcaatattcttcttcgtgttctctctcctcatgttcaaggtaaagactagtaaagatctcagggcggcggtccacaatggcttttggttctttaaaatcgctgcactcatcgggatcatggtaggttccttttacatccctgggggttactttagcagcgtatggtttgtcgtgggtatgattggggctgccctattcatcctcatccagctcgtgctgctggttgattttgcacattcatggaatgaaagctgggttaaccgaatggaagaagggaacccccgtctatggtacgccgctcttttaagcttcacctcagctttctacattctgtctattatttgtgttggtcttctgtatacatactataccaagccggacgggtgcactgagaacaagttctttatcagtattaacttaatactgtgcgtggtcgcctcaattatcagcatccaccccaaaatccaggagcaccaacctcgctcaggtttgctccagagctctctaatcacactatacacaatgtatctaacatggagcgccatgtctaatgagccggaccgctcttgcaatcccaatttgatgtctttcatcaccaggatcaccgctccaacactggccccaggaaactccaccgctgtcgttcccacccccacaccacccagtaaaagcggtagcctgcttgactccgacaacttcattggactgttcgtgttcgtcctttgtctcttgtactcatcaattcgtacctccaccaacagccaagttgacaagcttactctcagtggctccgattccgtgatactcggcgatacaacaacctcaggggcctcagatgaagaagacggccagccccgcagggccgtggacaacgaaaaggagggcgtgcaatatagttacagtctattccatctaatgctttgcctggcctccttgtatataatgatgacattgacgtcctggtattcccccgacgctaagtttcaatccatgaccagtaaatggcccgctgtgtgggtcaaaatcagcagctcctgggtatgcttgcttctatacgtctggaccctggtggcaccattggtcctgacctctcgggactttagttag

SEQ ID NO: 133829 - DNA, 1422 bp, Artificial Sequence
  Description of Artificial Sequence: Synthetic coding sequence
atgggggcagtcctgggggtgttttcgctcgcctcatgggtaccctgtctgtgttcaggggcaagctgtctgctatgcagctgctgtccaaactctaaaaattccacagttacaaggttaatctacgctttcattctcctcctgagtaccgtggtgtcctacataatgcagagaaaggagatggaaacctatctcaagaaaatccccggattttgcgagggcggattcaagatccacgaagcggacatcaatgctgataaagactgtgatgtgctagtgggttacaaggccgtctaccgcatctctttcgccatggccatcttcttctttgtctttagtctgttgatgttcaaggtcaagacttctaaggatctgagagctgccgtgcataatgggttttggttctttaagattgccgccttaataggaatcatggttggttccttttacataccaggaggctacttttcttctgtctggtttgtggttggcatgatcggggctgcgctttttatccttatacagctcgtcctgctcgtagattttgctcatagctggaacgaaagttgggtgaacagaatggaggagggtaatcccagactgtggtacgccgctctgctgtcatttacttccgctttttatatcctaagtataatctgtgtgggattactgtatacatattacaccaagcccgatgggtgcactgagaataagtttttcattagcattaacctaatcctgtgcgtggtcgcaagtatcatatcaatccaccctaagatccaggaacaccaacccaggtcaggcctgttgcaatcaagcttgatcactctttacacaatgtatctcacatggtccgcgatgagtaatgagccagacaggtcctgcaaccccaatctgatgtccttcatcacacggatcacagccccgaccctggctcctgggaactctaccgcagtcgtgccaacgcccacgccaccatccaagagcggatctctgctcgactccgataactttatcggcctgtttgtgttcgtgctttgccttctgtacagtagtatcaggacttctactaacagccaagttgataaactgactcttagcgggtctgattccgtgatactgggcgacacaacaacaagcggagccagcgacgaagaggacggtcagcctagaagggccgttgacaacgaaaaggagggggtccagtactcttatagcttgtttcacctcatgctctgcctggcaagtttgtatatcatgatgactcttacttcatggtattcccctgacgctaaatttcagagcatgacttcaaagtggcccgccgtctgggtaaaaatctcttcttcctgggtgtgcctactgttgtatgtgtggactcttgtcgctccactggtcctgactagtcgagacttcagctag

SEQ ID NO: 133830 - DNA, 639 bp, Artificial Sequence
  Description of Artificial Sequence: Synthetic coding sequence
gagcaccagccccgatctgggctgcttcaatcttctctcataacgctctatacaatgtatttgacgtggtccgccatgtccaacgaacccgatcgctcctgtaaccccaacctgatgagttttattaccagaataaccgcccctactctggcccctggtaattctacagccgtggtgcctacccctactcctccctccaagagtgggtctctgctggacagcgacaattttatcggtctttttgtattcgtgctttgtcttctttactcatccatacgtacatccaccaactcccaggtagacaagttgaccctgagtgggtcagatagcgttattctgggcgatacaacaacctctggagccagcgacgaagaggatggacagccaaggcgggctgtagataatgagaaggagggggttcagtattcttactcacttttccacctgatgctctgtttggcatctctgtacatcatgatgactttaacctcatggtacagtccagatgccaagtttcagtcgatgactagtaaatggcccgcggtatgggtcaaaatctcatcaagctgggtgtgtctcctgctatatgtgtggacactcgtcgcaccactagtgctgacatctagggactttagctag

SEQ ID NO: 133831 - DNA, 1323 bp, Artificial Sequence
  Description of Artificial Sequence: Synthetic coding sequence
atgccccttcaacgctgtctcatttacgcctttattctgctcctatcaacagtagtcagttacataatgcagcgcaaggagatggaaacctacctgaaaaaaataccgggattctgtgagggaggatttaagattcacgaggcggatattaatgccgataaggattgtgacgtgttagtaggctataaggctgtgtatcggatttcattcgcaatggccatcttcttttttgtattcagccttctcatgttcaaggtgaagacctccaaggatctgcgcgccgcagtgcacaatgggttctggtttttcaagatcgcggccctgatcgggatcatggtaggctcgttctacattccaggaggctatttttcttctgtctggtttgttgtcgggatgataggggccgcacttttcatcctcattcagctggtactgttagttgattttgcccattcttggaatgaaagttgggtcaataggatggaggaaggcaaccctaggctctggtatgccgccctcctgagttttacatctgccttctatatactgagcataatttgcgtggggctcctttatacctattacacgaagcccgacgggtgcaccgaaaataaattcttcatcagtatcaaccttatcctttgtgtcgtggcgtccatcatttctatacacccaaaaattcaggagcaccaaccccgctcaggactcctgcaatcgagcctgatcacgctgtacaccatgtaccttacgtggtccgcaatgtcgaacgagcccgatagaagctgcaaccccaatctgatgagtttcatcacaagaatcaccgcccctactttagctcccggcaatagtacagctgtggtgccaactcctacacccccaagcaagagcggctccctgcttgattccgataattttatagggctcttcgtctttgtgctgtgcctgttgtactcctcaatacggaccagtactaatagtcaagtagacaagttaaccctgtccggttccgattcggtcatcctgggagacaccaccacgagtggagcgagtgatgaggaagacggtcaaccacggcgggccgtggataacgaaaaggaaggcgtgcagtacagctatagtctgttccatctcatgttgtgcctggcctcgttgtatattatgatgacccttacttcctggtactcccccgacgccaagtttcagagcatgacctcaaagtggccagccgtatgggtcaaaattagctcctcctgggtttgtctgctgttatacgtatggactctagtagccccgttggtcctcacgtctcgagatttttcgtag

SEQ ID NO: 133832 - DNA, 1257 bp, Artificial Sequence
  Description of Artificial Sequence: Synthetic coding sequence
atgcaaaggaaggagatggagacttacctcaaaaaaattcccggattctgcgaaggtggattcaagatacatgaagctgacataaacgcggataaagattgtgatgtcctggtaggctataaagctgtctataggatctcctttgccatggcgatcttctttttcgtcttctccctcctgatgtttaaagtgaagacatcgaaagacctcagagccgccgttcacaatggattttggtttttcaaaatcgccgcattaatcgggataatggtagggtcattttatatccccggcggttacttctccagcgtgtggttcgtcgtggggatgattggcgcggccctgtttattctcatccagttagtgctcctcgtcgactttgcccactcctggaatgaatcctgggtgaatagaatggaagaaggaaatcctcgcctgtggtacgcagctttgctctcattcacttccgctttttatatcctcagcattatctgcgtaggtctgctctatacctactataccaaaccggatggatgtaccgagaacaagtttttcatatctattaacctcattttatgtgtggtcgcatctattatcagcattcaccctaagatacaggagcatcagccaagaagcggcttactgcagtcttctctaattaccctttacacgatgtaccttacctggtcagccatgtctaatgagccagatcgatcttgcaatcccaacctgatgagcttcatcacacgaataaccgctcccacccttgccccagggaatagcactgcagtagtaccgactcccacgccaccttctaaaagtgggtctctgctggattcagacaactttatcgggctgtttgtgttcgtgctttgcctcctgtacagtagcattcggacatctacgaactcccaagtggataaacttacgctgagcggctccgactccgttattctgggtgataccacaacatctggagccagcgacgaagaggacggtcagccaaggagggcagtagataacgaaaaggaaggagttcaatatagttactctctcttccacttgatgctgtgtctcgcgagtctctatatcatgatgaccctgaccagctggtactcccccgacgcaaagttccagagcatgacctcgaagtggcccgccgtgtgggtaaaaatttcttcatcatgggtctgcctgctgttgtatgtgtggacgctggtggcgcctctggtgctgacatcacgtgactttagctag

SEQ ID NO: 133833 - DNA, 1422 bp, Artificial Sequence
  Description of Artificial Sequence: Synthetic coding sequence
atggccacggcgaccgagcagtgggtgttagtggagatggtgcaggccctttacgaagcgcctgcctatcatttaattctggagggcatccttattctgtggattatcaggctcctgttctcaaagacttataagcttcaagaacggagcgacctaactgttaaggagaaagaagagctgattgaagaatggcagcccgagcccttagttccaccggtgcccaaggaccacccagccttgaattataatatagtgagcggccctccgagtcacaagacagtggttaacggcaaagaatgtatcaacttcgcatcctttaacttccttggtctgttggacaatcctcgagtgaaggcagccgctctcgcatctctgaagaagtatggcgtgggcacctgtggccctaggggattttacggtacctttgatgtccacctggacttggaggaccgactggctaaattcatgaagaccgaggaggccatcatttattcatatggcttcgccaccatcgcctccgcgattcctgcttattcaaagagaggcgacatcgtgttcgtggaccgcgccgcctgtttcgcaatacagaaagggttacaggcatctagatcggatatcaagctctttaagcataacgacatggctgatctggagaggttgctaaaggagcaagagattgaggatcagaaaaacccacgtaaggcgcgagtcacacgccggttcattgtggtagagggtctgtatatgaatacagggaccatctgtcctctgcccgagttagtgaagctcaaatacaaatataaggctaggatctttctggaggagtcactttctttcggggtgctgggagagcatggaaggggggtcactgagcactacggcataaatattgacgatatcgacttgatctccgccaacatggaaaatgccctcgcttccattggtggtttctgttgcggtaggagcttcgttattgaccaccagcggctgagcggtcagggttattgtttctcagcgtccctgcctccactgcttgccgcagcagccatagaggctctaaatatcatggaggaaaaccctggaattttcgccgtcctgaaggagaagtgtggacagattcataaggccctgcaggggatctcagggttaaaagtggtgggcgagtctctctcccctgctttccatttgcagctggaggaatcaacagggagtcgggagcaggatgttaggcttctgcaggaaatagtggaccagtgcatgaataggtcaatcgcactcacacaggcccgctatttagaaaaagaagagaaatgcctgccgccacctagcatccgcgtcgttgtgaccgtcgagcagaccgaggaagagttggagcgagccgcctctaccataaaggaggttgctcaggccgtgctcctgtag

SEQ ID NO: 133834 - DNA, 432 bp, Artificial Sequence
  Description of Artificial Sequence: Synthetic coding sequence
atggccaccgctaccgagcagtgggtattggttgaaatggtgcaggcgctgtacgaggcacccgcctaccatctcattctggaagggatcctaattctgtggattatccgactcctattctcaaaaacctataagctacaggaaaggagcgatctgacggtgaaggagaaggaggaactaatcgaggagtggcagcccgaaccccttgtccccccggtgcctaaggaccatcccgcactaaactacaacatagtctctggccccccctctcacaagactgtcgtcaacggcaaagaatgcattaattttgcctccttcaacttcctgggactgctcgacaacccccgagtgaaggctgcagcccttgcttcgctgaagaagtatggggttggaacatgcgggccgcgcggtttttatggaaccttcgaatag

SEQ ID NO: 133835 - DNA, 1017 bp, Artificial Sequence
  Description of Artificial Sequence: Synthetic coding sequence
atggcaaagtggggggagggtgatccgcggtggattgtcgaggagcgggccgatgccaccaatgtcaataattggcattggactgagcgggacgccagcaactggtccaccgacaagctcaagacactattcctggctgtgcaggtgcagaacgaggagggtaagtgcgaggttactgaggtgagcaaactcgatggagaagcctcaatcaataatcggaaaggcaagctgatttttttttatgaatggagtgtgaagctcaactggactggcaccagcaagagtggcgttcagtataaaggtcatgtcgagataccaaatctgtccgacgagaattccgtcgacgaggtggagatttctgtgagcctggccaaagacgaacctgacaccaatcttgttgctttgatgaaagaagagggggtcaaactattgcgcgaggccatgggcatctacatttcaacactcaagaccgagttcactcaaggcatgattctccccacaatgaacggcgaaagcgtcgacccggttggccagccggcacttaaaactgaggagagaaaagctaaacccgcccctagcaagacacaggcacgtccggtcggcgtgaaaattcccacttgtaagattacgttgaaggagacttttcttacctcaccagaagaactgtatcgtgtgttcaccactcaggagttggtgcaagcatttacacacgccccagccaccttagaagcagatcgcggcggaaaatttcatatggttgatgggaatgtgtccggagagttcacagacttggtgccagagaagcacatcgttatgaaatggcgcttcaagagttggcctgaggggcattttgctaccataacgctaacttttattgataaaaacggcgagactgaattgtgcatggaggggagagggatcccagctccagaagaagagaggacccgccagggttggcagcgctactactttgaaggaatcaaacagacctttggatacggggcaaggctgttctag

SEQ ID NO: 133836 - DNA, 990 bp, Artificial Sequence
  Description of Artificial Sequence: Synthetic coding sequence
atggcaaatcctggcggaggtgctgtgtgcaacggcaagctgcataaccacaaaaaacaaagtaacgggtctcagtcccgaaattgcacgaaaaacggcattgtaaaggaagctcagcagaatggcaaaccacacttttacgataagctcatcgtggaatccttcgaagaggccccgctgcacgtgatggtctttacatacatgggatatgggatcggaacattattcgggtacttacgcgactttctgagaaactggggtatcgaaaaatgtaacgcggcggtggagcggaaggaacagaaggactttgtgcccctataccaggattttgagaatttttacaccagaaacctttacatgaggatacgggataactggaataggccaatatgttccgccccaggacctctttttgatttaatggagcgcgtgtctgacgactataactggacattccggttcacaggaagagttatcaaagatgtgatcaacatgggctcttataactttttaggtctggcggctaagtacgacgagtctatgcggaccattaaagatgttctggaggtatacggcaccggtgttgcttctacgagacacgagatggggaccctggacaaacacaaagaactggaggaccttgtggccaagttcttgaacgtagaagccgccatggttttcggtatgggtttcgccaccaactctatgaacatcccggctttggtgggcaaaggatgcctcattctgtccgacgaattgaaccacacaagtcttgtgctgggagcaagattaagtggcgccacaatcagaattttcaaacacaacaacactcagtcattagagaaattgttaagggacgctgtgatttacgggcagcctcgaacaaggcgcgcttggaaaaaaattttgatccttgtggaaggcgtgtatcgcacctcttggattatttacggcttcacgcggatcgttctcttcatgcttcacccatag

SEQ ID NO: 133837 - DNA, 1659 bp, Artificial Sequence
  Description of Artificial Sequence: Synthetic coding sequence
atggccaacccaggtggaggcgccgtgtgcaacggaaagctgcacaaccataagaaacagagcaacggatctcagtcacgtaactgcacaaaaaacggaattgtgaaggaggcacagcagaacggaaaaccgcatttctacgataaactaatcgtcgagagcttcgaagaggcacctctgcacgtgatggtgttcacttacatgggatacgggattggcactctgtttgggtatctccgcgatttcttacgtaactgggggattgaaaagtgtaacgcagcagtcgagcgaaaagaacagaaggattttgtccctttataccaggatttcgagaacttctacacgaggaatctgtatatgagaattcgagacaactggaacaggcccatatgctccgcgccgggtccactgtttgatctcatggagagagtttcagatgactataattggacctttcgctttacgggtagagtgatcaaggacgtgattaacatgggaagctataattttctgggcttggctgcaaagtacgacgagtcaatgagaaccattaaggacgtcctggaggtgtacgggaccggtgtggctagcacccgccacgagatgggtacacttgataaacacaaggagttagaagatctcgtagccaaatttctcaacgtggaagcagctatggtttttggtatgggattcgccacaaattccatgaatatcccggcccttgtgggcaaaggctgtctgattttgtccgacgagctcaatcacacaagcctagtattaggtgccagactctctggagccacgattcggatttttaagcataacaacacccagtcacttgagaaacttctgagggatgccgtcatctatggccagcctcgcactcgtagggcatggaagaagatcctgattctggtcgagggcgtgtactccatggagggcagtattgtccatctgcctcaaattatcgccttaaaaaagaagtataaggcctatttgtacattgatgaggcacattcaattggtgccgtgggccccaccggaagaggggtcacagaatttttcgggctagacccacacgaggtggacgtcttaatgggcacatttaccaagagctttggagctagcggagggtacatcgctggcaggaaggacctggttgactacctgagggttcatagccacagtgccgtatatgcctcctccatgtccccacccatcgctgagcaaattataagatcactgaagctgatcatgggcctcgatgggaccacccagggacttcagagagtccagcagctggccaaaaatacccgttacttccgccagcgacttcaggagatgggattcattatctacggcaatgaaaacgcttccgtggtgccactgttgctctacatgccaggtaaggtggctgccttcgcccgccatatgctcgagaaaaaaatcggcgtagtggtggtcggcttcccagccaccccattagctgaggcgcgcgcccgcttctgcgtttctgccgcccatacccgggagatgctcgacacagttctggaggctctcgatgagatgggagacctcctgcagctgaagtacagcagacacaagaagagcgcacgaccagagctttacgatgaaacctcgtttgagctcgaggactag

SEQ ID NO: 133838 - DNA, 366 bp, Artificial Sequence
  Description of Artificial Sequence: Synthetic coding sequence
taaagccctcccattgccgagcagatcatcagatcgctgaaattaatcatgggcctggacggaaccacacaagggctgcagcgggtgcaacagttggcgaaaaacacccgatacttccgccagcgcctccaggaaatgggtttcatcatttatggaaacgagaacgcgagcgtggtccctctgctattatatatgccaggcaaggtcgccgccttcgctaggcacatgctcgaaaagaaaatcggggtagtggttgtgggcttcccggcaacccccctggccgaggctagggctaggttctgcgtctcagcggcccacacacgagagatgcttgacactgtgatctgctgtgtgatgaagatctag

SEQ ID NO: 133839 - DNA, 420 bp, Artificial Sequence
  Description of Artificial Sequence: Synthetic coding sequence
atggccaaccccggcggcggggcagtatgcaacggcaagctgcacaatcacaagaaacagagtaacgggtcccaaagccgtaattgtacgaagaacgggatcgttaaagaagcccaacagaatggcaagccacacttttatgacaagctaatagtcgagtctttcgaagaggcgccccttcacgtaatggtcttcacctatatggggtatggaattgggaccctgtttggctatctcagggacttcctccggaactgggggatagaaaagtgcaacgccgcagttgaacggaaagagcaaaaagacttcgtcccgttatatcaggatttcgagaacttttatacgcgaaacctttacatgcggattagagataactggaacagaccaatatgcagcgcacccggacccctgttcgattag

SEQ ID NO: 133840 - DNA, 648 bp, Artificial Sequence
  Description of Artificial Sequence: Synthetic coding sequence
aattgcacaaagaatggtatcgtcaaagaggcccagcagaatggaaagccacacttttatgacaagttgattgtcgagagttttgaggaggccccgctccatgtaatggttttcacatacatgggttatggcattggcaccctctttggatatctccgagatttcctgcgtaattggggcatcgaaaagtgtaacgccgccgtggaaaggaaggagcagaaagatttcgtgccactttatcaggactttgaaaatttctacaccaggaacctgtacatgagaattagagacaattggaatcgtccgatctgttccgccccgggccccctgttcgatctgatggagagggtcagcgacgactataactggacctttcgcttcacggggcgggttatcaaggatgttatcaacatggggagctacaactttctgggcctcgccgccaagtacgacgagtctatgcgcaccataaaggacgtcttggaggtatatggcaccggagtggcatcaactcgacatgaaatgggggagtttacatctagttggcagaacgcactgtgcgtcggcggggtgctgcaggccgactcagtgccccaggggccaccatggtcatggaaaatgggaagacattcatcccttttagaatag

SEQ ID NO: 133841 - DNA, 360 bp, Artificial Sequence
  Description of Artificial Sequence: Synthetic coding sequence
atggctttgagtgtgcttagacttgccctgctactcctggcggtcacttttgccggctccgcacggagcggccctggggaacggggccccccagaaaaatctggcttcggctcccaaacaggtggaggcccttgcccagctccaggcggcttgggtgacgcttctttgattccccaatttggtcttttttccaagtatagaacccctaactgttcacagtatcgtttgccaggttgccccagacacttcaatccagtgtgcggttcggacatgtcaacctatgctaacgaatgcacgctgtgcatgaagatccgcgagggcggacataacatcaagattattagaaatggaccctgctag

SEQ ID NO: 133842 - DNA, 405 bp, Artificial Sequence
  Description of Artificial Sequence: Synthetic coding sequence
atggctctcagtgtgttacggctcgcactgctattgcttgccgtgacattcgccggctccgcgagatctgggcccggcgagagggggccccctgagaagtctggctttggctcccagactggaggaggcccctgcccggcaccaggcggtcttggcgacggcactcgagctccagtgacaggcggttctcccgaggatctcccggctagtctcataccccaattcggactgttctctaaatatcggacgcccaactgctctcagtaccgcctgccaggctgtcccagacatttcaatccagtgtgtggaagtgacatgagtacatacgcaaacgaatgtaccttgtgcatgaaaatccgggaggggggccacaacataaagatcatacggaatggcccatgttag

SEQ ID NO: 133843 - DNA, 240 bp, Artificial Sequence
  Description of Artificial Sequence: Synthetic coding sequence
atgaaagtgacaggcatcttcctcctgtctgccctggccctcttgagcctgagtggaaacacgggggctgatagcctagggcgggaggcaaaatgctataacgaactgaatgggtgtacaaaaatttacgaccctgtttgcggaacagacgggaacacatacccaaatgagtgcgttctctgttttgagaatcggaagcgtcaaacttctattctgatacagaagtcgggaccttgttag

SEQ ID NO: 133844 - DNA, 255 bp, Artificial Sequence
  Description of Artificial Sequence: Synthetic coding sequence
atggccctgtcggtgctccggcttgctctgttgctgctagccgtaacatttgcggccagcctgatcccccaattcggactgtttagtaaatacagaacacctaattgcagccagtaccgcctcccgggctgtcctcggcattttaaccctgtttgcgggtctgatatgagcacgtacgcgaacgaatgcacactttgcatgaagatccgcgagggcggccataatattaagatcatccgtaatgggccctgttag

SEQ ID NO: 133845 - DNA, 261 bp, Artificial Sequence
  Description of Artificial Sequence: Synthetic coding sequence
atggccgtgcgtcagtgggttattgcactggcccttgccgccctgttagtcgtagaccgcgaggtgcctgtggccgccggaaaacttccattctcccggatgcctatttgtgaacatatggtggagtctcccacttgttctcagatgtccaacctggtatgcggtaccgatgggctgacctacaccaatgagtgccaactctgccttgcgcgaattaagaccaaacaagatatccagatcatgaaagatgggaaatgttag

SEQ ID NO: 133846 - DNA, 330 bp, Artificial Sequence
  Description of Artificial Sequence: Synthetic coding sequence
atgatacttggtattggcagctctcctcacctgctgtggacccttgaaggcacacacatttggagtctgcttggggacgcctcacacaccgaccgcctgccggaggcgggggccggaaaacttctgtcagaagtgccagtggcagctggaaaactccctttcagccgcatgccgatttgtgaacacatggttgagagccctacatgcagccagatgtcgaatttggtttgcgggacagacggactgacctataccaatgaatgtcagttatgcttagcccgtatcaaaaccaagcaggatatccagatcatgaaggatggcaaatgctag

SEQ ID NO: 133847 - DNA, 330 bp, Artificial Sequence
  Description of Artificial Sequence: Synthetic coding sequence
atgatcctcggcatcggctctagtccccatttactgtggacattagaaggcacacatatctggtccctgcttggggacgcatcgcacaccgatagactgcccgaggctggagcagggaagttgctgagcgaggtccccgtggcagctggtaaactgcctttttctcgaatgcccatctgtgaacacatggttgaaagcccaacctgctcacagatgagcaatctggtttgtggaacagatgggctcacatacacaaatgaatgccagctgtgcctggccagaatcaagaccaagcaagatatccagatcatgaaagacgggaaatgttag

SEQ ID NO: 133848 - DNA, 3195 bp, Artificial Sequence
  Description of Artificial Sequence: Synthetic coding sequence
atgaagattgccacagtatccgtcctgctgcctctggcactttgtctgattcaggatgcagcctccaaaaacgaagaccaagagatgtgccacgaatttcaggcattcatgaagaacggtaaactattctgtccccaggacaagaagtttttccagtccctggatggcatcatgttcattaacaaatgcgccacctgtaagatgatcctggagaaggaagctaaaagccaaaagcgggcccgacatctagcacgagctcctaaggcaaccgctcccacagagctgaactgcgacgactttaaaaagggtgaaagagatggcgacttcatatgcccagattactatgaggcagtgtgcgggactgacggaaagacctacgacaataggtgcgctctttgcgccgagaatgcaaaaacaggttcccagataggcgtgaagagcgagggagaatgtaaaagctctaatcccgagcaagacgtctgcagcgcttttcgacccttcgttagggacggcagactgggatgcactcgcgaaaatgacccagtgctgggacctgacggcaagacacatggaaataagtgtgctatgtgcgccgaactcttcctgaaggaggctgagaatgccaaaagagagggggagacgcggatcagaagaaacgctgagaaagacttttgcaaagagtacgagaagcaggtaagaaatggacgactgttctgcacgcgtgagtcagaccccgtgagaggacctgatggcagaatgcatgggaataagtgtgcactgtgcgccgagatttttaagcaaaggtttagcgaagagaatagtaaaacagaccaaaatctgggaaaggccgaggaaaaaaccaaggtgaagagggaaatcgtgaaattgtgcagtcagtaccagaatcaggcaaaaaacggaatactgttttgcacccgcgagaacgaccccattcgcggaccagacggaaagatgcacggtaacctctgttccatgtgccaggcatactttcaggcggaaaacgaggagaagaaaaaggccgaggccagggcaagaaacaagcgcgagtccggtaaagcaacgtcttacgctgaattatgctccgagtatcggaagttggtgcggaatggaaagctggcatgtacaagagaaaacgaccctattcaaggccctgacggaaaagtccacggcaacacctgctcaatgtgcgaagtgtttttccaagcagaagaagaggaaaagaagaagaaggaaggtaagtcacggaacaaacggcaatccaaatctactgcatcttttgaggaactgtgctccgagtaccgcaaaagccgaaaaaacggtcgactgttctgcacgcgggagaatgatcctatacagggccccgacggcaagatgcacggcaacacctgttcaatgtgcgaagcttttttccagcaggaggagagggcccgagctaaggcaaaaagagaagccgccaaagaaatctgctcggagtttagagaccaggtcaggaacggaacgctaatctgcactagagaacacaaccctgtgcgcggccctgacgggaagatgcacggaaacaagtgtgctatgtgtgcttccgtgttcaaacttgaggaagaggaaaagaaaaacgataaagaggagaaggggaaggtcgaagctgagaaagtgaaacgggaggctgtgcaggagctatgctctgagtatcgccactacgtcaggaatgggcgactaccttgtacacgggaaaacgatccaattgaggggcttgacggaaaaatccatggaaatacttgctccatgtgcgaggctttttttcaacaggaggcaaaggaaaaggaacgcgcagagccacgagccaaagtcaaacgggaggctgagaaggaaacgtgcgatgagttccgccgcctgctacagaatggtaagctgttctgcactcgggaaaacgatcccgtgagggggccagatggtaaaactcacgggaataagtgcgcaatgtgcaaagccgtgtttcaaaaggagaatgaagagagaaaaagaaaggaagaggaggaccaaaggaatgcagccggtcacggctcctccggaggcggaggggggaatactcaagatgagtgcgcagagtaccgggagcagatgaaaaacggcagactgagctgtacgcgagaatcagatcctgtgcgcgacgccgatggtaagtcatataataaccagtgtacaatgtgtaaggcgaagttggaaagagaggcggaacgtaagaacgagtattcacggtcccgttcaaatggtacgggcagcgagtctggcaaggatacctgtgacgagtttaggtcacagatgaagaatgggaaactcatctgcacgcgggaatctgatccggtgagagggcctgacggcaaaacccatggcaataaatgcaccatgtgtaaggagaagttggagcgggaggcggcagagaaaaaaaaaaaggaagatgaagaccgctcaaacacaggggagcgaagcaacactggtgaacggtccaacgataaggaggacctctgtagggagttccgatctatgcaacgcaatggaaaactgatctgcacccgggagaataaccccgtcagagggccgtacggtaagatgcacataaataaatgcgccatgtgtcagtccattttcgatagggaggctaacgaacggaagaagaaggatgaggaaaaaagctcttcaaaaccttccaataatgcgaaagacgaatgctctgagtttcgtaactatatacgtaacaatgaactcatttgcccccgagagaacgacccggtacacggcgccgatggcaagttctatactaacaagtgttatatgtgtcgggccgtgtttcttaccgaagccctagaacgagcaaaacttcaagagaaaccaagccacgtccgcgctagtcaagaggaggactctcccgattccttctcttcactggactcagaaatgtgtaaagactacagggtgctccctcgaataggttacttgtgtcccaaggatctaaaacctgtttgcggcgacgacggccaaacatacaataatccttgtatgctgtgtcacgagaatctaatacggcagactaatacacacatcaggagcaccggtaaatgtgaagagtcatcgactcctgggactactgcggcctctatgcctccatcggacgagtag

SEQ ID NO: 133849 - DNA, 3285 bp, Artificial Sequence
  Description of Artificial Sequence: Synthetic coding sequence
atgaaaattgcaactgtgtcagtgctgctccctcttgctctgtgccttatccaagacgctgcctcaaaaaatgaggaccaagagatgtgccacgagtttcaggcttttatgaaaaacggaaagctgttctgcccacaggacaagaaattctttcagtcactcgatggcatcatgttcatcaataagtgtgccacatgcaaaatgattttggagaaagaagctaagtctcaaaagagagctagacacctcgcccgggcccccaaggccactgcgcccaccgaactcaactgcgacgatttcaagaagggcgaacgggacggggacttcatttgtccagactactacgaagccgtgtgtggaacagatggcaaaacatatgacaaccgctgtgcactttgcgcagagaatgctaaaaccgggagccagataggcgtgaagtctgagggagaatgcaagtccagtaatcctgagcaggatgtgtgtagcgcctttcgtcctttcgttcgagatggacgccttgggtgtacccgcgaaaatgaccccgtgttagggcctgatggcaagacccatggtaataagtgtgcgatgtgcgctgagctgtttctgaaagaagctgaaaatgccaaacgcgagggcgaaacccggattaggcgcaacgctgaaaaggatttctgtaaagagtacgaaaaacaagtgagaaatgggagactgttctgtacacgcgagagtgaccctgtacgcggtccagacggccggatgcacggtaataagtgtgcgctgtgtgccgaaattttcaaacagcggttctctgaggaaaactctaagacagaccagaacctggggaaagcagaggagaagaccaaggttaagcgggaaatcgtaaagttgtgctcccagtatcagaaccaggccaaaaatggcatcctattctgcactcgcgaaaatgatccaatcagggggccggacggcaagatgcacggtaatctgtgctccatgtgtcaggcatacttccaggcagaaaatgaggaaaagaaaaaagccgaagctcgggcaagaaataagagagaatcaggcaaggccaccagctatgcagagttgtgtagcgaatatagaaaactggtgcgtaatgggaagcttgcgtgtaccagggagaatgatcccatccaaggccctgacggtaaagtgcacgggaatacatgcagcatgtgtgaagtgttttttcaggccgaggaggaggagaagaagaagaaggaggggaagagtcggaacaagaggcaatccaagtcgacagcgtcattcgaagagttgtgcagcgagtacaggaagtcccgtaaaaatggaagacttttttgcacgcgggagaacgacccaattcagggacctgatggtaagatgcacggaaatacgtgctctatgtgcgaagcattcttccaacaggaagagcgcgcgcgcgccaaggccaaaagagaggcagctaaagagatctgctcagaattccgtgatcaggtgaggaacgggacccttatctgtacccgggaacataatcctgtccgtggtcctgacggcaagatgcacgggaacaaatgtgcgatgtgcgctagtgtatttaagcttgaggaggaggagaagaagaacgacaaagaagaaaaaggtaaagtagaagccgaaaaagttaagagagaggccgtgcaggaattgtgttcagaatatcgtcactacgtgcggaatggcaggctcccgtgcacacgggaaaacgaccccatagagggtctggatggcaaaatccacgggaatacgtgttctatgtgcgaggcctttttccaacaggaggctaaggagaaggagagagctgagccgcgagctaaggtgaaaagggaggcagagaaggaaacatgcgatgagttccgacgcctgctacagaacggaaagttattttgtacgcgcgaaaacgatccagtccgaggtccagatgggaaaacacatggaaacaagtgcgctatgtgtaaagccgtttttcaaaaggagaacgaggagaggaagcggaaagaggaagaggatcagcggaatgcagccggtcacggctcatccggtggaggggggggtaacacccaagacgagtgcgccgaatatcgcgaacagatgaagaacggcagactctcttgtacaagggaatctgacccagtcagagacgccgatggcaaaagctacaacaatcaatgcacaatgtgtaaagctaaattagagcgagaagctgagaggaagaatgaatactcccgctcccgatcaaatggcactggatccgagagtgggaaagacacttgcgatgaatttaggtcacagatgaagaacggcaagcttatttgcacaagagagtctgatcccgtccgtgggcctgatggaaaaacacacggaaataagtgcacaatgtgtaaggagaaactggagagggaagccgcagaaaaaaaaaaaaaggaagatgaggacaggtcaaacactggtgaacgctctaatacaggcgaacgctcaaatgataaggaagacctgtgtcgagaattccgaagcatgcaacgtaacggaaagcttatttgtacacgcgagaacaacccggtgcgaggcccttacggaaagatgcacataaacaaatgcgcaatgtgccagtccattttcgaccgagaggcaaacgagaggaagaagaaggacgaggagaagtcttcctcaaagcctagtaacaatgcaaaagaccagtgtcgtcaggtgcaaaacgaggccgaggacgcgaagttcagacagccaggacgttctctcgcctctgtggcccgtatgagcaccgatgaatgctcagagttccggaactacataaggaataatgaactcatttgtcctcgcgaaaacgatcccgttcatggggctgacggaaagttttacacgaacaagtgttacatgtgccgcgcagtcttcctcaccgaggcgctggaacgggctaaactccaggaaaagccaagtcacgtgcgcgctagtcaagaggaggacagtcctgacagcttctccagcctggattccgagatgtgcaaagactatagggtattacccagaatcgggtatctctgccccaaagatctgaagcccgtctgtggggacgatggccagacttacaataacccgtgcatgctatgccatgaaaacctgattcgacagaccaatactcacattcgatctaccggcaaatgcgaagagagtagtaccccgggcacgaccgcggctagcatgcccccttccgacgagtag

SEQ ID NO: 133850 - DNA, 2751 bp, Artificial Sequence
  Description of Artificial Sequence: Synthetic coding sequence
atgaaaattgctacagtgagcgtgctgctccctctggcactctgtcttatccaggacgctgccagcaagaatgaggatcaggagatgtgccacgagtttcaagcattcatgaaaaatggcaaattattctgtcctcaggacaagaaatttttccagagtctcgatggaattatgtttatcaacaagtgcgcaacttgcaagatgattctggagaaagaagctaaatcacagaaaagggcgagacacctggcccgcgcaccgaaagcaaccgcgcctaccgagctaaattgcgacgattttaagaaaggagagcgcgatggcgatttcatatgtccggattactatgaagccgtttgcggcacagatggcaagacttacgacaacagatgcgccttatgtgcagagaacgctaaaacgggaagccagattggtgtgaagagcgagggagagtgcaaatcctctaaccctgagcaggatgtttgttcagcttttaggccttttgttagggatggccgacttgggtgtaccagggaaaacgatcctgtgttaggacccgatggtaagacgcatgggaataaatgtgccatgtgcgccgagctttttctgaaggaggccgaaaacgctaagcgggaaggtgaaacccggattaggcgaaacgccgagaaggacttctgcaaggagtatgagaagcaggtgcgaaacgggcgcctgttttgcacccgggaatcagacccagtgcgaggccccgatggaagaatgcatggaaacaaatgcgcactctgtgcggaaatcttcaaacaaagatttagcgaggaaaactcaaaaactgaccaaaatctgggtaaagcggaagagaagacaaaagtgaagagggagatcgttaagctgtgcagtcagtatcaaaatcaagctaaaaatggaatactgttttgtacaagagagaacgaccctatcaggggccccgacggcaaaatgcatgggaatttgtgctctatgtgtcaggcttattttcaggccgaaaatgaagaaaagaagaaagctgaggccagggccagaaacaagagagaaagcggcaaagctacttcctatgctgagctgtgttcagagtatagaaaactggtccgaaacggtaaactcgcttgcacaagagagaacgatcccattcaggggcctgatggcaaagtgcacggcaacacttgctcaatgtgtgaggtcttttttcaggcagaagaggaagaaaagaaaaagaaagaaggaaagtcccggaataaaagacagagtaagtctactgcatccttcgaagaactgtgtagtgaatatagaaagtcccggaaaaatggccgccttttttgcacacgagagaacgaccctatccaaggccccgatgggaaaatgcacgggaacacctgctcaatgtgtgaggccttctttcagcaagaggagcgagctcgcgctaaggcaaaaagagaggccgccaaagaaatctgttcagaatttcgcgaccaagtgcgtaacggcacattgatttgtaccagggaacataacccagtgcgcgggcctgacgggaagatgcacggaaacaaatgcgcgatgtgcgccagcgtgttcaagctcgaggaggaggaaaaaaagaatgataaagaagagaaagggaaagtcgaagccgagaaagtgaaacgggaagccgtacaggagctttgctccgagtaccggcactacgtcagaaacggcagactgccatgtacaagagaaaacgatccgatcgagggtctcgacgggaagattcacggaaatacgtgttccatgtgtgaagcttttttccagcaggaggctaaggagaaggagagggctgagccacgagccaaagtgaagagagaagccgagaaggagacgtgtgatgagttcagacgcttgctgcagaacgggaagctattctgtacccgcgagaatgatcccgttaggggacccgatggaaagacgcatggtaacaagtgtgctatgtgcaaagctgtcttccagaaagaaaatgaggagagaaaacggaaagaggaagaagaccagcgtaatgccgccggacatggcagttcgggcggcggcggcggcaacactcaagatgagtgtgcagagtatagagagcagatgaagaacggccggctctcctgtaccagggaatccgaccctgttagagacgcagatggaaaaagttataacaaccagtgcaccatgtgtaaagcgaagctcgagcgggaggccgagagaaaaaatgaatacagccggagcaggtctaacggaaccggatctgagtcaggtaaggatacttgtgacgaatttcgcagtcagatgaagaacggaaaactaatctgcactcgagagtctgatccggttagaggtccagatggtaaaactcatggtaacaaatgtacgatgtgcaaggaaaaactggaacgcgaagccgcggaaaaaaagaagaaggaagatgaggatcggtccaatactggcgaacgctctaatactggtgagcggtccaacgacaaggaagatttatgtcgcgagttcagatctatgcaaagaaacggtaagctgatatgcacccgggagaacaatccagtccgggggccatacggaaagatgcatattaacaaatgcgctatgtgccaatctatcttcgaccgtgaggccaatgagagaaaaaaaaaagacgaggaaaagagctcctctaagccatcaaacaacgccaaggttatctactag

SEQ ID NO: 133851 - DNA, 261 bp, Artificial Sequence
  Description of Artificial Sequence: Synthetic coding sequence
atgcgcgccacagctatcgtgcttctgctggccttgaccctcgcaaccatgttttcaatcgagtgtgcaaagcagacaaaacaaatggtggattgtagccattacaagaagctgccaccggggcagcaaagattttgtcaccacatgtatgatcctatatgcggatccgacggaaaaacttacaaaaatgactgctttttctgtagcaaagtcaagaagactgacgggacattgaaatttgttcacttcggcaagtgttag

SEQ ID NO: 133852 - DNA, 759 bp, Artificial Sequence
  Description of Artificial Sequence: Synthetic coding sequence
atggcccaactgtgcgggttgaggagaagccgcgcatttttggctctcctggggtcactactcttaagcggagtgctcgcagctgatagagagagaagcatccacgatttctgcttggtttcaaaggtagtggggaggtgtcgtgcaagtatgccccgatggtggtataatgtcacagacggtagttgccagttatttgtgtatgggggctgcgatggcaattcgaataactacctgactaaagaagagtgcctcaaaaagtgtgcaacagtgacagagaatgccacaggcgacctggcgacttcaaggaacgccgcggactccagcgtgcctagtgctccccggaggcaggattcagaggaccactccagcgatatgtttaattacgaggagtactgtaccgcgaatgctgtgacaggaccctgccgtgcttctttcccaagatggtatttcgacgtggagcgcaacagctgcaataacttcatttacggaggctgccgcgggaacaagaatagttatcgaagcgaggaagcttgtatgttgcgatgtttcaggcagcaggagaatcctccactgcccttgggctctaaggtggttgttctggccggtcttttcgtcatggtcctaatcctgttcctgggcgcctccatggtttatctcatacgcgtggccagacgaaaccaggagagggccctgaggaccgtttggtcatctggcgatgataaggagcagctcgtgaagaatacctacgttctgtag

SEQ ID NO: 133853 - DNA, 588 bp, Artificial Sequence
  Description of Artificial Sequence: Synthetic coding sequence
atggctcaattgtgcggcctgaggaggtcaagggcgttcctggctctcttggggagtctgctgttatctggagtactggcagccgatagggagaggtccattcacgagaacgctacaggggacctggcaacctcacggaatgcagcagactccagcgtacccagcgcaccgcgccgacaagactccgaggatcactcgagcgacatgtttaattatgaggagtactgtaccgctaacgcagtcaccggcccatgtcgggcttcctttccacgttggtactttgacgtggaacgaaacagctgcaataatttcatctatggcggatgtcgggggaacaagaacagctaccggtcagaagaggcttgcatgctccgctgctttagacaacaggaaaatcctcctttgcctctagggagcaaagtagtagtgcttgccggattgttcgtgatggtccttatcctgttcttgggggcgtcaatggtttatcttataagggtcgctcgaaggaaccaggagagggcccttcggactgtttggtcttccggggatgataaggagcaattggtcaaaaatacctatgtattatag

SEQ ID NO: 133854 - DNA, 1299 bp, Artificial Sequence
  Description of Artificial Sequence: Synthetic coding sequence
atgagcgataaattaccatacaaagttgcggatatcggactggctgcatggggaaggaaagctctggacatagccgagaacgaaatgcccgggctgatgaggatgagagagaggtattcagcctccaaacctctgaagggcgccagaatagctggatgccttcacatgaccgttgagaccgccgtgctcatcgagaccctggtaacgttgggtgcagaagtgcagtggagctcttgcaacatattcagcactcaggaccacgctgctgctgcaatcgccaaggccggcatccccgtgtacgcgtggaagggtgaaacagacgaggaatatctgtggtgcattgaacaaacattgtatttcaaggatggccctttgaacatgatcttggacgatgggggtgacctgacaaacttgatccatacaaagtacccacaactccttcctggcattcgcgggatctccgaggaaactacaactggagtgcataacctgtataagatgatggcgaatggaatactgaaagtgccagcgatcaacgttaatgattcagtgactaagtcgaagttcgataatctgtacggatgccgggaatctttgatcgacggcattaagagggcaacagatgtgatgatcgccggtaaggtggccgtggtcgctggctacggggacgttggaaaagggtgtgcccaggctctgagagggtttggagcccgagtgattatcaccgaaattgaccccatcaatgccctccaggctgctatggaaggctacgaggtgaccaccatggacgaggcttgccaggaaggaaacatctttgtcactaccactggttgtattgacattattctgggtcggcacttcgaacagatgaaagacgatgcaattgtgtgtaatatagggcactttgatgttgaaattgatgtaaaatggctcaacgaaaatgccgtggagaaagtgaacataaagccgcaagtggaccgctatcgactcaagaacggtcgccgtatcatcctcctggccgagggccgcctggtcaatctgggctgcgcaatggggcacccttcattcgtgatgtccaactccttcacaaatcaggtgatggcccagattgaactgtggacgcatcctgataagtacccggtaggggtccatttcttgcccaagaaactcgatgaggcagttgcggaggcacatctgggcaaattgaatgtcaagctgacaaagttgacagaaaagcaagcccagtatctcggcatgtcttgtgacggaccatttaagccagaccactaccgctattag

SEQ ID NO: 133855 - DNA, 1023 bp, Artificial Sequence
  Description of Artificial Sequence: Synthetic coding sequence
atgtgtgctcaatactgtatcagcttcgcagacgtggaaaaagcacacattaacattagagatagcattcacctcactcctgtattgacctctagcatcctgaatcagctgaccggacgtaatctatttttcaagtgcgagctctttcagaagaccggctccttcaagattaggggtgcccttaacgcagtcaggtcactggtccctgatgctctcgaacgaaaaccaaaagcagtggtgactcactcttcgggcaaccacggacaagcgctaacgtacgccgccaaactggaaggcattcccgcctacatcgttgtcccgcagaccgccccagactgcaaaaaactcgcaatccaagcgtatggggcgagtattgtgtactgcgaaccgtcagacgagagcagagaaaacgtggctaaacgtgtgacagaagaaactgaaggcataatggtgcaccccaaccaagagccggccgttatcgccggccaaggcaccattgcgctggaggtgctgaaccaggtgcctctcgtggacgcgttggtggtccccgttgggggcgggggcatgctggccggcattgcgataaccgttaaagccctgaagccttctgttaaggtttacgctgccgagcctagcaacgccgacgactgttatcagtccaaactaaagggcaagctgatgcctaacctctacccccctgagacaatcgcggatggagtgaagagttccattgggctaaacacatggcctattatccgagatctggtcgatgatattttcacagtgaccgaggacgagatcaaatgcgccacacagcttgtgtgggaaaggatgaagctgttgattgagccaactgctggtgttggggtcgccgctgtcttgtcgcagcacttccagacagtcagtccagaggtcaaaaacatctgcatagtgttgtcaggagggaacgtcgatcttacatcttcaatcacttgggtgaagcaagccgagcgccccgctagttaccagtctgtctcagtatag

SEQ ID NO: 133856 - DNA, 1638 bp, Artificial Sequence
  Description of Artificial Sequence: Synthetic coding sequence
atggccgagccgtcagggagtcccgtgcatgtgcagttgcctcagcaggcggccccggtgactgcggctgccgctgccgccccagctgcggccacagccgccccggcgcctgcggcccccgctgcccctgcccccgccccagcccctgcagcacaagcagtgggatggcccatttgccgggatgcctatgaactacaggaggttatagggtccggcgccaccgctgttgtccaagctgcactgtgtaaaccaaggcaagaacgggtcgcaatcaaaagaattaacctggaaaaatgtcaaacttctatggatgaactgctgaaggaaattcaggccatgtcccaatgttctcaccccaacgtcgtgacgtactacacaagctttgtggtcaaagatgagctctggctcgttatgaaactgctgtccggagggagcatgctggatataatcaagtacatcgtcaaccggggggagcataaaaacggtgttctggaggaggctatcatcgcaaccatcctgaaggaagttcttgaaggactggactatctacacaggaacgggcagattcacagagatctgaaggctggtaatatactgctaggagaggatggatcagtgcagatcgcggacttcggcgtgtctgcttttttggctactggaggtgacgtaactcgcaacaaagtacgcaaaacgtttgtgggaactccatgttggatggctccggaagttatggaacaagtgcggggctacgattttaaggctgatatgtggtcttttgggatcacagccatcgaactcgctacgggtgcggctccatatcacaagtatccacctatgaaagtcttaatgctgacactccagaatgatccccctacactcgaaactggcgtggaagataaggagatgatgaagaaatatgggaagtccttccgcaagttattgagtctgtgtctgcagaaggatccctcgaagcgtcctacagctgcagaactgctcaagtgcaaatttttccagaaagcgaaaaatagggagtaccttattgaaaaactcctgacccgaaccccagacattgcacagcgggccaaaaaggtgcggcgggtaccaggatcctcgggccatttacataagactgaggatggcgactgggagtggtccgatgacgaaatggacgagaaatctgaggagggaaaggcagccttctcacaggagaaatctagaagagtgaaagaagaaaatccagagatcgcagtgagtgccagtacgatccccgagcaaatccaatctttatcggtacatgattcccagggcccacccaatgccaatgaagactaccgggaagcctcttcctgcgctgtgaacctcgtgttacgactccggaacagccgcaaggaacttaacgacattcgattcgagttcacacctgggagagacacagctgacggcgtctcgcaggaactcttctctgcgggcttggtcgatggacatgacgttgtaattgtggccgcgaatcttcagaaaatagttgacgaccccaaagccctcaagacgcttactttcaaactggccagtggttgtgatggatctgaaatccccgatgaggttaagttgattggcttcgcccagttgtcagtttcatag

SEQ ID NO: 133857 - DNA, 2715 bp, Artificial Sequence
  Description of Artificial Sequence: Synthetic coding sequence
atggacgcagggtttttccggggtacctctgcagagcaagataatagatttagcaataagcagaaaaagttgttgaagcaacttaaatttgctgaatgcctggaaaaaaaggtcgatatgagcaaagttaacctggaagtcatcaagccatggattactaagagagtgaccgaaattctcggcttcgaagatgacgtggtaatcgaattcattttcaaccaactagaagtgaagaacccagactccaagatgatgcaaattaatctcaccggctttctgaatggcaagaacgccagagaatttatgggagaactgtggccgttgctgcttagcgctcaagagaacatcgctggcatcccgtcggcattcttggaattgaaaaaagaggagattaaacagcgccagatcgaacaggaaaagctggcctctatgaaaaagcaagacgaagacaaggacaagagggataaagaggagaaagaatcttcccgggagaagcgcgagcggtcacgttcgccacggcgccggaaaagcaggagcccaagccccagacggcgctcctctcctgtgcggcgggaaagaaaacgcagccactccagatcccctaggcacagaaccaaatcccgctctccttcccctgcccctgagaaaaaggaaaagactcctgaactgcctgagccatctgtgaaagtgaaagagccaagcgtccaggaggccacttccacgagcgatatcctcaaggtacccaaacccgagcctattcccgaacctaaggagccctcacccgagaagaattcaaaaaaggagaaggaaaaggaaaaaaccagaccgcgctctcgatccaggtcaaagtcccggagccgcacgaggagtcgttctcccagtcacactcgaccccgaaggagacacagatcgaggagccggtcttacagcccccgtcggcgaccatctcctcgacggcgcccaagcccgcgcaggcgcaccccacccaggcgcatgccaccccctccacggcatcgaagatcaagatcacccgtcagacgtaggaggaggtctagtgcctcgctgagtggttccagctcttcaagttcatcttccagatctcgctcccccccaaaaaaaccacccaagaggacttcttctccccctaggaaaacaagacggctcagtccttcagcctctccacccaggaggagacacagaccatccccgccagccacccccccgccgaaaaccaggcatagtccgactcctcagcagagcaaccgcactagaaagagtagagtgagcgtgtcccccggtcggacaagcggaaaagttaccaaacacaagggaaccgagaaacgagaaagtccatccccggccccgaagcctcgtaaagtcgaactgagcgagtccgaggaagacaagggagggaaaatggcagctgcagatagcgtacaacaacgccgacaatacaggcgacagaaccagcagtctagcagcgatagtgggtcaagtagttcgtctgaggacgagagacccaaacgtagtcacgtaaagaacggcgaagtgggtcgacggaggcgacacagtcctagccggtcagccagtccttcaccacggaaacgtcagaaggaaacctcccccagaggacgccgcagacggtcccctagccccccccctactaggcgccggaggagtccatctcctgccccccccccacgacggcgcagaactcctacacctccccctaggcggcgcaccccctccccgcctccacggcggcgcagcccgtcccctaggcgctattctccccctattcagcggaggtactctcctagccctcctccaaaacggcgaactgcctctcctccaccccccccaaagcgccgggctagtccttcaccacctccgaagaggcgtgtttctcatagccctccacctaaacaacgaagttcacctgtgactaagcgacgctcacctagcctgagctctaaacaccgtaagggcagcagccccagtaggagcacaagggaagcccgctcgccccagccgaataaaaggcattctcccagtccacgccctagagccccacagacaagcagtagtcctccccctgtgcgcagaggcgcctcatcgtcaccacagaggcgacagagcccatcaccttctacaagacccatccggagggtcagccgtacacccgagccgaaaaaaattaaaaaggcagccagcccctcaccccagtctgtgcgccgggtatcttccagtagatcagtctcagggtctccggaaccagctgccaaaaaaccacccgctcccccatcaccggtacagtcacaatccccatcaacgaattggtcaccggctgtgccggtgaagaaggccaaaagtcccacccctagtcccagcccgccccgtaatagtgaccaggagggcggcgggaagaaaaagaaaaaaaaaaaggataagaaacacaagaaagataagaagcacaagaagcacaaaaagcataagaaggagaaggcagtagcggctgccgccgccgccgccgtcacacctgcagcgattgccgcagccaccacaaccctggctcaggaagagccggtggccgccccagagccaaagaaggagaccgagtcagaagctgaagataacctcgacgatctcgaaaagcatctgcgagaaaaggctctccgcagcatgcggaaggcacaggtttccccacagtcctag

SEQ ID NO: 133858 - DNA, 2742 bp, Artificial Sequence
  Description of Artificial Sequence: Synthetic coding sequence
atggacgctggatttttcagaggtacctccgccgagcaagacaataggttcagcaataagcaaaaaaagctgcttaaacagctgaaattcgccgaatgcctagaaaagaaagtggatatgtccaaagtcaaccttgaggtgattaaaccatggatcactaaacgtgtgaccgagattctagggtttgaagacgacgtcgtgatcgagtttatcttcaaccagttggaagtcaagaatcccgattcaaaaatgatgcagattaacctcactggttttctgaatggtaaaaacgccagggagtttatgggggagctttggcctctgcttctgtccgcccaggagaatattgccggaatcccatcggcctttttggagctgaagaaagaggagatcaaacagaggcaaattgaacaggagaagctggcatctatgaaaaagcaggacgaagacaaagataagcgggacaaagaagagaaggaatcttctagagaaaagagagagcgcagccggtcacctcggcgccggaagtcacgtagccccagtcctcgcagacgatcttctcctgtccggcgcgagcggaaacggagtcacagcagatcaccacggcacaggactaagtcccgcagccctagtcccgcacccgagaagaaggagaaaacccctgagctccctgagccctcagtcaaagtcaaagagccttccgtccaggaggctacttcaacgtctgatattctgaaagttccaaagccggaaccaatccccgagccgaaagagcctagtccggaaaagaatagcaagaaagagaaagagaaagagaagaccagacctagatctcggtcaagatctaaatcacggagccgcacacgcagccgatccccatctcacacaagaccacggcgtcgtcaccgctcccggagccgccgtcgccctagcccacggaggagaccctctcctcgtcgcaggacccccccccgccggatgcccccccccccgaggcacaggcggagccgcagcccagtgaggcggcgacgccgctcttctgctagtctgagcgggagttcttcgtccagcagctcttcacgctccagaagtccacccaaaaagcccccaaagaggacaagtagcccgcccaggaagactcggagactgtcaccatctgccagccccccgcggcgacgtcaccgtccttcgccgccagcaacacctccccccaaaactagacacagtcccacacctcagcaatccaatcggaccaggaagtcccgggtcagcgtctcccccggtcgtacctccggcaaagtcaccaagcacaaaggtacggagaagcgcgagtctccctctcccgctcctaagcctcgcaaggtcgaactgtctgaaagcgaggaagacaaaggtggcaagatggccgccgctgactcagtgcagcagaggagacagtaccgccgccagaatcaacagtctagctctgacagcggttcctcatcatcaagtgaagatgagcgacctaaacgatcccacgtgaagaacggagaggtgggaaggaggcgcaggcattctccgtcacgcagcgcatcaccaagtccccgcaagagacaaaaagaaacctccccccggatgcagatggggaagcgctggcagtctcctgttacaaaatcaggaaggcgcagaaggagtccatcacctcctccaactcgccgcaggaggtcgcccagtcccgcaccacctcctcgaagaagaaggacgcctactccaccccctagacgtcggacaccgtccccccccccccgtcgccggtctccatcacctaggcggtactcaccccccatccagcgcaggtacagtccgtctccccctcccaaacggaggaccgcgtcacctcctccaccccctaagcgccgggcttccccttcccccccaccgaaaaggcgcgtgagccattcacccccacctaagcagcgctctagtcctgtgaccaagcgtcggtcaccatcactaagcagcaagcaccggaagggctccagtccaagtagaagcactcgcgaggcgagatctccccagcccaataagcggcactctcctagtccccggcctagagcaccacaaaccagctcatctcctcctcctgtgaggagaggcgccagctcaagccctcagaggcgccagagtccgtcgcccagcacaagaccaatccgtcgggtgtcccgaacacccgagcctaagaaaattaagaaggccgcttccccaagtccacaaagcgtgcggcgggtgagctcatctcgaagtgttagcggctctccggagccagccgctaagaagccaccggctcctccaagccctgtgcaaagccagtcccccagcactaattggtctcccgccgttccagtgaagaaggccaagtcccccactcccagcccatccccaccaaggaacagcgatcaagagggaggtggcaaaaaaaaaaagaaaaagaaggataaaaaacacaaaaaagataagaaacacaaaaaacataagaagcacaaaaaagagaaggctgtggctgctgccgctgcggcagctgtgacaccggccgctatcgcagcagccaccacaaccctggcccaggaggaaccagttgctgctcctgagcccaagaaagagaccgagtcagaggctgaggacaacttggacgacttggagaagcacctgagagaaaaagccctcagaagtatgaggaaggctcaggtgtctccacagtcgtag

SEQ ID NO: 133859 - DNA, 2751 bp, Artificial Sequence
  Description of Artificial Sequence: Synthetic coding sequence
atggatgccggtttttttcggggaactagcgcggagcaagataatagattttccaacaagcaaaagaaactcctgaaacaactgaaatttgcagagtgcctcgaaaagaaggtggacatgtccaaagtcaacctcgaagttatcaaaccgtggatcacgaagagggtgactgaaatcctcggtttcgaagatgacgttgtcatagagtttatcttcaatcagctagaggtcaagaatccagactctaagatgatgcagattaacctcaccggcttcctgaacggtaagaacgctagggagttcatgggcgagctctggccactgttacttagcgcgcaggaaaacatcgcggggatcccctcggcgtttcttgaactcaaaaaagaagagatcaaacaacggcaaattgaacaagaaaagttggccagcatgaaaaagcaggacgaagataaagataagcgggataaggaagagaaggaatcgagtcgcgaaaagagagagcgcagccgctcacccagaaggagaaaatctcgaagcccatcaccgagaaggaggtcttcccctgtcaggagagaaagaaagcgatctcattcaagaagcccgcggcatcggacaaaatcgcggtcgccctcccccgcacctgagaaaaaggagaagacccccgaactgccagaaccaagcgtgaaggtgaaggaaccatctgtgcaggaggccacatccacgtctgatatcctcaaagtcccaaagccggagccaatacctgagcccaaggagccatcccccgaaaagaactctaagaaagaaaaagaaaaggaaaaaactcgcccaagatctcgaagccgtagtaagagcagatcgcgcactcgcagccggtcgccatcccacacacgaccgcgacgcaggcaccggtcacgaagcagatcttacagccctcggcggcggccgtcgcctaggcgacgtccgtctccccggcggcggactccaccacgcagaatgcctcccccacccaggcatcgccgctcacgatcaccggtgcggagaaggcgccgttctagcgctagtttgtcaggtagcagttcgtcctcatcatcttccaggagcaggagcccacctaaaaagcccccaaaacggacttcgtcccctccacgcaagacaagaaggctgtccccgtccgccagcccacctaggcggcgccacaggccttcacctccagctacacctcctcccaagaccagacatagcccaacgccacagcaatccaatcgtacacgaaaaagccgagtgagcgtgtctcccggacggaccagcgtcaccaaacataaaggcacagaaaaaagagaaagtccatctccagcaccaaaaccccggaaagtggagctatctgagtccgaggaggacaagggaggtaagatggctgccgcggatagtgtgcaacaacgcaggcagtataggcgtcagaatcagcagtctagcagtgactccggaagttcatcaagctcagaggatgaaagacctaagcgctcccatgtcaaaaacggcgaagttggcaggcgccgtcgccatagcccatctcgaagcgcttccccctctccccgcaaaagacaaaaggagacaagtcctagaatgcagatgggtaagcggtggcagagccccgtgaccaagtctggtcgtaggcggagatctccctctccacctccaaccagacggcgacgatccccctccccagctcccccccccaggaggaggagaactcccactcccccgccccgcagaaggactccctcacctcctccccgtcgtcgttctccttcaccccgacgctattccccaccgatccagagaaggtactctccatcacctccacctaagcgcagaacagcttctcctccccccccccctaagaggcgggcctctcccagtcccccaccaaaacgcagagtctctcactcccccccacccaagcagaggagtagccctgttaccaaacgtcggtctccctcgctttccagtaagcataggaaaggttcaagcccaagccgcagcacgagggaggccaggtcaccgcagccaaataagcgtcatagcccatcacctcgtccccgggccccccagacttctagcagcccgccacctgtgcgtcggggagcatcgagctctccacaacgccgccagtccccttcgcctagcaccagacccatcaggcgggtgtctcggaccccagagcctaagaagattaagaaggccgcaagcccctccccacagagtgtgcgtcgcgtgagcagttccagaagcgtgtctgggagcccagagccagccgccaagaaaccccccgccccaccttctccagtgcagagccaatctccgtccacaaactggtcccctgccgtcccggttaagaaggccaaatcccctacacccagtccatcccctcctagaaacagtgatcaagagggaggcgggaaaaaaaagaagaagaaaaaggacaagaaacataagaaggataagaagcacaagaaacataagaagcacaaaaaggagaaggccgtggctgccgccgcagcagcagccgttacccctgcggcaatcgctgctgccactactacactcgctcaggaagagcccgttgccgcaccggagcccaagaaggaaaccgaaagcgaggctgaagataacttggatgaccttgaaaaacacctgagggaaaaagcccttagatcgatgcggaaggcccaggtgagccctcagagttag

SEQ ID NO: 133860 - DNA, 957 bp, Artificial Sequence
  Description of Artificial Sequence: Synthetic coding sequence
atgggagagctttggcccctcctgctttcggcgcaggagaacatcgccggtatcccatcagcctttctggagcttaagaaggaagaaatcaaacaacggcaaatcgagcaggagaaattggctagcatgaagaagcaggacgaggataaagacaagcgggacaaggaagaaaaagaaagttcccgggagaaacgagaacgatccaggtctcccaggaggacaaagagcagaagccctagccctgcacctgaaaagaaggagaagaccccagagctgccagagccgtcggtcaaagtcaaagaaccaagcgtccaggaggccacctctacttccgacatcctgaaagtgccgaaacctgaacctattccagaaccaaaggagcctagtcctgagaaaaactccaaaaaagagaaggagaaagagaaaacaagacctcgcagtagatctaggagcaaatccaggagcagaacaagatctcggtctccgtctcatactcgccctcggaggcgccaccggtctagaagtcgttcctacagccccagacgccggccttctcccaggaggagacccagtccacgccggcgtacccccccacgccggatgcctccgccaccgcgccatcgcagatccagaagccccgttcggagattttcgggaattctgcctcccaaggtcaatagcgcggaggaggacgtccgtcagcatccatgtctgggggtggcccaccaccccttgcatctggtccacgggcatcaccaacgttctctccccagaggccacccagctccactggggaaattagttggctatttgctgcagcaagtacttcagggagagggcactggccaccatctgttgcaacttcaccatccaaaactgggcatccccttacacccttcctcacaaacagtgcaggagaaggtggtctttctgtgcctgcagggggagctccaatag

SEQ ID NO: 133861 - DNA, 8259 bp, Artificial Sequence
  Description of Artificial Sequence: Synthetic coding sequence
atgtataacggaatcggactccctaccccccgcggtagcggaaccaatggctatgtccaacgcaatttgtctttggtgaggggacggcgaggcgagagacccgactacaaaggagaggaggaactgaggaggctggaggccgcactagttaaaaggccaaatcctgatatcttggatcacgaaagaaagagaagggtggagctcaggtgtctcgagctggaagagatgatggaggaacaggggtacgaagaacagcagatacaggaaaaggtagccaccttccgacttatgctgcttgagaaagacgttaaccctggtggcaaggaggaaactcccggtcagagaccagcggttactgagacacaccagctcgccgaactaaacgaaaagaaaaacgagcgcctgcgcgccgccttcggaatctctgatagctacgtggatggctcctctttcgaccctcagcggcgggcaagagaagccaaacagcccgctcctgagcccccaaagccctactctttggtgcgtgagtcctcctcttcaagatctccaacacccaagcagaagaagaagaagaagaagaaggatcggggccgcagatcggagagcagttcccctaggagggaaagaaagaagtcctccaaaaaaaagaagcataggtccgaatccgaaagcaaaaagcggaaacatcggtcccccacaccaaaatctaaaaggaagtcaaaggataaaaagcgcaagagatcaaggtccacaaccccagccccaaagtctcgccgagcgcacaggagtacctcagctgactccgcatcatcctctgataccagtaggagcaggagccgctccgccgcagccaagacgcataccactgcacttgcgggtcgttcaccatcgcctgctagcggtcggcggggagagggggatgctcctttcagtgagcctggcacaacgtctacacaacggcccagctccccagaaaccgccacaaagcagcctagtagtccatatgaggataaggacaaggataaaaaagaaaaaagcgccaccagaccgtctccctctcccgagagaagctccacaggtcccgaacctcccgcccccactcctctgcttgccgagagacacggggggtctcctcagccattggccaccactcccctgagccaggagcccgtgaatccacccagtgaagcaagcccaacaagggaccgctcaccacctaagagtccagaaaagttaccccagagcagctcatcagagagcagcccaccctctcctcagccaaccaaggtaagccggcatgcctcaagtagtccagaaagccccaagcccgcccccgcacctgggtcccacagggaaatatcctccagtcccacgtcgaaaaaccgctcccacggtagagctaagagggataagtcccattcccatacacccagtaggcgtatgggaagatcccgaagccctgccacagctaaaagaggaaggtcacgaagccgtacccctaccaagaggggacactctcgctctcgctcacctcagtggaggcgctcacggtcagctcagcggtggggccggtcccgctcaccccagcgtcgcggacggagtagaagtccacagaggccggggtggtcccggagcaggaacacacagcggcgtggccgttcgaggtccgcgcggagaggcaggtcccactcgcgatcacctgcaacacggggacggagcagaagtagaacacctgcaagacgaggtaggagccggagcagaacgcctgccagacgacgtagccgaagtcggactcccacgcgccggcgctccagatcacgcacgccagcacgtcgtggcaggtctcggagccgcacaccagccaggcgacgatctaggacaagaagtcctgtccggagacgctcccgttcccgaagccccgcacgaagaagtggacgtagcaggtctcgaacgcctgccagacggggccggagtagatcacgaacccccgcccgcagagggcgctccaggagccgcaccccagcgaggcgctcaggaagatctaggagtcggacccctgcgagaaggggacggtctcgcagtcggacacctcgcagagggcggagcaggtccaggtctctagtccgccgcggccgcagtcactcccgtaccccgcagagaagaggtcgctcgggtagctcctcagagcggaaaaacaagtccagaacctcccagcgacgcagccggagtaattcatcacccgagatgaagaagtctcgcatttcgtctcgccggagccgaagcttgtcttctcccagaagcaaggccaagtccaggctaagtttgcgtagaagcttgtcaggctcatcaccttgcccaaaacagaaaagccagacaccaccaagacgatctcgcagcgggtcgtcccagcctaaggctaaaagtaggacccccccacggcgcagcaggtcttcttcgtcccccccacccaagcagaaaagcaaaactccctctaggcagagtcatagtagttcctcaccccatccgaaagtaaagtcagggactcctcccagacaggggtccatcacctctccgcaggcgaatgaacagtccgtgacaccccagaggcgctcatgcttcgaatcaagtccagaccccgagctgaaatccaggactccaagtcgtcactcttgttctgggagctcgccccctagagtcaagtcctcgacccctccacggcaatccccttctcgctcttcctcccctcaacctaaggtgaaagcaatcataagcccaaggcagaggtcccatagtgggtcctctagcccgtcccccagcagagtgaccagtcgcaccactccgcgcagaagtcggagtgtgtcaccgtgctcgaacgtggaaagccgactgcttcccagatactcacacagtgggagctcctctcccgacactaaggtgaaaccggaaactccgcctcggcagagtcactcaggcagcatcagtccatatcctaaagtgaaagcccagactccccccggaccgagtctgtctggctccaaatccccatgcccacaggaaaaatccaaggattccctggtgcagtcttgccccggcagcttatccctgtgtgcaggtgtaaagagtagcacaccgccgggtgagagctacttcggagtatcttctttgcagctgaaaggtcagtcccagacttctccagaccacagatctgacacctcaagtccagaagttaggcagagccactcagagagcccctccctccagtcgaagtctcagacgtcccctaaagggggccggtcccggtccagctcgcccgttacggagctggcctcacggtcacctattcgtcaggataggggcgagttctctgctagccccatgttaaagtccggaatgtctcctgaacagtcaagattccagagcgattccagctcttatcccactgtggactccaatagcctgctgggacagtctagattggagactgccgaaagcaaggaaaagatggctttgccaccgcaggaggatgcgacagcctcccccccacgccagaaggacaagttttcccctttccccgtgcaggaccggcctgaaagctcattggtgttcaaagacactctccggacacccccaagagaaaggagtggcgcaggctcctccccggaaacaaaggaacagaacagcgccctgccaacctcttctcaggatgaggagctaatggaagtcgtcgagaagtcggaagaacctgcagggcaaatactgtcgcacctgtctagcgaactgaaggagatgagcacaagcaacttcgagtccagtcccgaagtggaagaacggcctgcggtgtccctgactctggaccagtcccagtctcaagctagcctggaggctgtggaagtcccctctatggcctcttcatgggggggtccccatttcagcccggagcacaaagagctgtctaatagcccgctgcgagaaaactcttttggttcgccccttgagtttcggaacagcgggcccctgggcacagagatgaacacagggttctcctctgaggtgaaggaggacctgaatggccccttcctgaatcagctcgaaacagatccctcccttgacatgaaagaacagtctacgagaagctcagggcattcgtcctcggagttgtctccagatgcagtggaaaaagccggaatgagcagtaatcagagtataagctccccggtccttgatgccgtacctcggactccctccagggagaggtcctcttctgctagctccccggaaatgaaggacgggctgccccggaccccttcccgtcgcagtcgatccggcagctctcccggcctgcgcgatggatctggcacacccagcagacactccctctccggatcttcccccggcatgaaggacattccccgcaccccttctaggggccgctctgaatgtgattcttcccccgaaccaaaggcgctcccacagacccctaggcctcgttcaagatcaccaagtagccctgagctgaataacaagtgtctgacgcctcagagggaacgttcaggctccgagtcatcagttgaccagaaaacagtagccaggaccccactcggtcaacgctccagaagcgggagtagtcaggagctggatgtcaagccctccgcttccccacaagaacgcagtgagtctgacagctcccccgatagcaaggcgaagacgcgtactccattgcgacaaaggtctcgctctggcagttcaccagaagttgacagtaagagccgcctgtccccaagacgatccagaagcgggagctcacccgaggttaaggacaaaccccgcgctgcacctagggcgcaatccgggagcgattcctctccagaacccaaggctccagcaccaagggctttgccacgccggtccagaagtggatcatcgagtaagggcaggggaccttctccagaagggtcaagttctacggagagttcccccgagcacccgcctaagagtcgtaccgctagacgcggctctcgatcatctccagaacctaaaaccaagagcagaacacctccccgccgcaggtcaagcagatcttccccagagctgacgcgcaaagccagattatcccgaagatcgagatccgcttccagcagccccgaaacccggagccgcactccacctaggcatcgacgtagccccagcgtgtcgtctccagagccggccgaaaaatctcgtagttccaggcggaggagaagtgccagttcaccccggactaaaactacatcacggagaggacggtcaccgtctcccaagcctcgaggcctgcagcgttcacggagtcgatctcggagggaaaaaacaaggaccactagacgccgtgacagatccggaagctcacagtccacctccaggcgccgtcaacgcagccgctctcggtctcgggtgactcggcgaagaaggggcggctccggctaccattcacgcagccccgcacgtcaggaaagcagtcgaacctccagccgcaggcgtagagggagatctcgaacaccgccaacctcaaggaaaagatccaggagccggacctccccagctccctggaagaggtcccggtctcgagcaagtcccgccacacaccggaggagccgaagcagaactcctctgatctccaggcggaggtccaggtcccgaacaagcccggtgtctaggcggaggtcccggtcgagaacttctgttacccgacggagatcacggtcaagggcgtcccctgtatcccggagacggtcgcggtctagaactccacccgtaacaaggaggcgctctcggagccgcacgccgacgaccaggaggagatccaggtctcgtacacctccagtgacccgaagacgctctagatcgcgcactcctccagtgacccgccggaggagccgcagtcgaacaagtcctatcacccggcgccgcagcagaagcaggacctcaccggtgaccaggcggagaagcaggtcacggaccagccctgtgacccgcaggcgctctcggagccggacaagtccagttacaaggaggaggagtaggtcgaggaccccacccgctatccggcggcgctcaaggagccggacccccctcttacctaggaagcgcagtcggtcacggtctcctcttgccattcgccgaagatcccgttcacgcacaccccgcaccgccaggggcaagcgctcgttgaccagatcacccccagctattcggaggcgcagcgccagcgggtcttctagtgaccgaagccgttctgcaacacctcccgcaactcgcaaccactccggttcccggaccccccccgtcgcactgaactcatcccggatgagctgcttttccaggccaagcatgtccccaacccccctggacagatgtcgctctcccggtatgttggagcctctgggctcgtctcggacccctatgagtgttctccaacaggcaggcggttccatgatggatgggcccgggcctcgtattccagatcatcagcggacaagtgtacccgagaaccatgcccagtctcgaattgcccttgcccttactgctatctctctgggaaccgctaggcccccacctagtatgagcgccgctggccttgcagctcgtatgtcccaggtacccgcccccgttccattgatgagcctgaggactgcgcctgccgctaaccttgccagtcgaattccggccgcctctgccgccgccatgaatctggcttccgctaggacccctgcgatcccaacagccgtaaacttggcagatagcagaacgccggccgccgccgctgcaatgaatctggcgtccccaagaactgcagtagcacccagcgcagttaatttggcagatcctagaacacccaccgcccctgctgtcaacctcgccggcgcacgcaccccagctgcgttggccgctctcagtctaactgggtccgggaccccgccaacggccgcaaactatccttcttctagtcgtactccacaagccccggccagcgcgaatcttgtcgggcctagaagcgcacacgccactgcccccgttaatattgctggatcccgtactgcggctgcattagcacccgctagcctcacgagtgctagaatggctcctgcgctgtctggtgccaaccttacctcccccagggtgcctctgtcagcttacgagcgcgtgtctggccggacgtctccccccctcctggaccgggcacgctcccggactcccccaagcgctccgtcccagtcgaggatgacctctgagagagcaccttcgccatcatcccggatgggtcaagccccctctcaatcccttctaccacctgcacaggatcagcctagaagccctgtgccaagtgcattttcagaccaatctaggtgcctgatcgcccaaacaacaccggtagccggttctcagagtctcagtagtggagccgtggctacaacaacttccagtgctggcgatcataacggtatgctgtcagtaccagctcccggcgttccccacagcgatgtgggggagcctccagcatccaccggtgcccagcaaccatctgctcttgcggcactgcagcccgccaaagaaaggcgctcatctagttcaagctcctcttccagcagcagcagctcctcctcaagttctagttcatccagctccagcagcagcggctcctcctcctctgatagcgagggtagctcccttcctgttcagccagaagtggctctcaagagggtcccctcacctacccccgcaccaaaagaagcagtccgggaaggacgaccacctgaacctactccagctaaacgcaaacggagatcctcctcctcctcctcaagctcttcctcaagcagttcatcttcttccagctccagctctagttccagttcttcctcttcgtcttcatcatccagcagtagtagctcatcttcctcatctagctcgcccagtccagcaaagcccgggcctcaggcactccccaaacctgcttcaccaaagaagcctcctcccggtgaacgcagatcccgatcaccccggaagccaattgattccctgcgggacagtcgctcacttagttacagccccgtggaacgccggaggccatccccgcagccgagcccaagagatcagcagagtagttcgagcgaacgtggctctcgccgagggcaacgcggggattcacgttccccctcccataagcgaaggcgggaaacaccatcaccgcgacctatgagacataggagcagccggtcaccatag

SEQ ID NO: 133862 - DNA, 702 bp, Artificial Sequence
  Description of Artificial Sequence: Synthetic coding sequence
atgatctcttttccaagtttacagagaacggagttggaggagatggatctgatcctccagcaggagggatggcaactcgatctgaagcggaattcactgggttggaaggatcttcagcggagctcccatccatccccctgcttacaagctggtaggcccctcccacagcccacctgtacgcatcggggtctgcccaagctgcgacttagtgaggagggcgactaccctgcctctgcctccacacccgagccccggggcctgattcctccgtcagggacattcttgaggttcaacctggaccccctttgctgcgggcctcaacccgtggccagcgttagtcggggttgggtcagcagccatcactgttcccccgaaaactgttggctgacatggctgggcgagttacctgcccccttttctggcactccaccgcccaccgccgttcccccaggtcagggctcaaggagcagaagcccacggaaaccgatagactctctgcgcgattcacgttctctgtcatacagcccagtagaacgccgtaggccttcacctcagccgtcccccagggaccagcagtccagcagttccgagcgcggatctagacgggggcagcggggggattcccgttcaccctctcataagcgcaggcgtgagacacctagcccccgccccatgcgtcaccgctctagccgcagcccctag

SEQ ID NO: 133863 - DNA, 7005 bp, Artificial Sequence
  Description of Artificial Sequence: Synthetic coding sequence
atgtacaatggcataggactgccaaccccgcgaggctctgggaccaatggatacgtgcaacggaatctgagcttggtgagagggaggcgaggggagaggcctgattacaagggcgaagaggagctccgtagactggaggcagccctcgtgaagagacccaacccagatatccttgaccatgagcgaaaacgcagggttgaactgcggtgtctagaattagaggaaatgatggaggagcagggctacgaagagcagcagattcaggaaaaggtggctacattccgtcttatgctcttggagaaggacgttaaccctggaggaaaggaagagacgccagggcagagacccgctgtgaccgaaacccaccagctggcagaactgaatgagaaaaagaacgagcgccttagggccgcatttgggattagcgactcatacgtggacggcagcagcttcgaccctcaacgccgggcccgggaagccaaacagcccgccccagaacccccaaagccctattccctcgttagggaaagtagtagctcccggtcccccacccctaaacaaaagaagaaaaagaagaagaaggaccgcggcaggcgcagtgagagctcaagtccaaggcgcgagcgtaagaaatcctccaaaaaaaaaaagcatcgcagtgaaagtgaaagtaaaaaacgtaagcatcgctcccctacccccaaatcaaagcgcaagtctaaagataagaagcggaagagatcccgaagcacgacccccgctcccaaaagtcgtagagcgcacaggtccactagcgcagactccgcatcatcaagcgatacatcgagatctaggtcacggtccgccgctgccaagacgcacactaccgccctggccggcaggagtccaagccccgcttctggccgaagaggtgaaggcgatgctccattttccgaaccggggacaacctcaactcagaggccatcctctcctgaaacagcaacaaaacagccaagttctccttacgaggataaagataaagacaagaaggaaaagtctgcaactcgcccctccccctcaccagagcgctcctcaacaggaccagagccacctgctcccacacccttactggcagagcgtcatggtggctctccacagcctctcgccacaacaccactgagtcaagaacctgttaacccccccagcgaggcttctccaaccagggatagatcgccgcctaagtctccggagaaactgccacaaagttccagcagcgaatccagtccaccttccccacaacctaccaaggtttcgagacatgcttccagttcccccgagagtcctaagcccgccccggcccccggcagccacagagaaattagctcctccccaacatctaaaaataggtcacatggtagggccaaacgggacaaaagtcatagtcatacaccctctaggagaatgggccgcagcaggagcccagctacggccaagagagggcgcagccgttctcgcacacctacgaagcggggtcattctcgatcaaggtcaccacagtggcgaagatctaggagcgcccaaagatggggtagaagcaggtccccccagcgcagggggagatcaaggtctccccaacggccgggttggagccggagtcggaacacacagcgcaggggccggtcaagaagcgcacgcagggggcgatcgcattccaggtcacccgcgacgcgaggccgaagtcggtcacgaacaccagccaggcggggtcgctcccgctcgcgcactcccgcgcgccgaagaagccgaagccgcacaccaacacgccggaggtccagatcccggactccagcacggaggggaaggagtcgttcacgtacaccagccagacgcagatcacggactcgttcccccgtgaggcgcaggtctagatccagatcccctgccaggcgatcaggccgcagtcgatcacggaccccagctcgtagaggccgtagcagatctcgtacccctgcacgacgcggccggtcacggagccggactcccgcacgtcgtagtggacggagtaggtcacggacgccggctcgacgaggtagaagcagatcaaggacaccaagacgagggcgcagccgcagtaggagtctggtgagaaggggtagatctcactccaggacaccacagcgtcgcggcaggagcggatcaagcagcgaaagaaagaataaatcaaggacatctcagcggcgctccagatctaactctagcccagagatgaaaaagagtcgaattagttccagaaggagcagatcactctcgtcccctcgttctaaagcgaaatcccgtctgagcttgcggcgctccctgtccggcagcagtccttgtcctaagcaaaaaagccagactcctcccaggcggtcccggtcaggaagttcccagcctaaggccaaatctaggacccccccccggcgaagccgctcaagcagctctccaccacctaaacagaaaagtaagacacctagccggcaatcccactcaagcagctccccacacccaaaggtcaaaagcgggacccccccaaggcagggttccataacttcccctcaagccaacgaacaaagcgttactccacagaggcgatcgtgtttcgagagcagccccgaccctgagctgaagagccggaccccatcccgccactcttgttccggctctagccccccgcgcgtgaagtcatccacacctccaaggcagtctcctagcaggtcctcctccccccagccaaaagttaaggcgattattagtccaagacagcgtagccattccggcagctcctcgccaagcccatcacgggtcacttcacgcactacgccacgccgttcccggtccgtgagtccttgctccaacgtagaaagtcgactcctcccaaggtacagccatagtgggagctcatctcccgacacaaaagtgaagcctgagaccccaccccggcagtctcattcaggaagcatcagtccgtaccccaaggtaaaggctcagactccccctggcccttccctcagtggttcaaagagtccctgtccccaggagaaatcaaaagattctctggtccagagctgtcccggtagtttaagcctgtgtgccggggtcaaaagttccactcccccaggggaatcatatttcggggtgagcagtcttcagttgaaaggccagagtcaaactagtcctgatcatagatctgacacctcgtcaccagaagtaaggcagtctcatagcgaaagtccttcactgcagtcaaaaagccagacatcgccaaagggcggacgatcccggagctcttcccctgtcactgagctcgccagcaggtccccaatacggcaggacagaggggagttctcagcttcccccatgctgaaatcaggcatgagtcctgagcagagcaggtttcagtcagacagtagtagctatccgaccgttgactccaattcactattggggcagtcgcggctggagaccgctgaaagcaaggaaaagatggccctgcccccacaggaggacgctactgcttcccctcccaggcagaaagacaaattttctcccttccctgttcaggaccgacccgagtcgtccctagttttcaaagatacactccgcactcccccaagagaacggagtggggctggtagctctcctgaaacaaaagagcaaaacagtgccctgcctacaagtagccaggatgaggagcttatggaggttgtcgagaaatctgaggagcctgcgggccagattctgtcacacctctccagcgagttaaaagagatgtcaacatctaacttcgaatcaagtccagaggtcgaagaacggcctgccgtttccctcacattggaccagagccagtcacaggcaagcttggaagctgtggaagtaccgtctatggctagttcgtggggggggccccacttctcccccgaacataaggagctctcgaattctccacttagagagaattccttcggctcacctttggaattccgtaactctggccccctgggcaccgaaatgaacacagggttctcatccgaggtgaaagaagacttgaatggaccatttctcaaccagctggagactgacccaagtctggacatgaaagaacagagtacacggtcgtctggccatagtagttccgaactgtccccggacgccgtcgaaaaggccggcatgtcttcaaaccaaagtatcagcagcccagttctagacgccgtgccaagaacgccctcgcgtgagcgctctagctctgcctccagcccggagatgaaagacgggctccctagaacaccttcgagacgctcaagatctgggtcctcaccaggattacgggatggctcaggcacgccttcaagacactcactgtctgggtcttctcccgggatgaaagatatcccacggacaccaagtagagggagatccgagtgcgacagcagtcccgaaccgaaggctctgccacagacacctagaccccggtctcgtagccctagctctcctgaattgaacaacaaatgtctcacaccacaacgagaaagatctgggagcgagagctcagtagatcaaaagactgtggctcgtacccctctggggcagaggtcccggagtggctcttcccaggaactcgacgtgaaaccttccgccagcccacaggagcgatctgaaagcgatagttctcctgattccaaggccaaaactcgaacaccactgcgccagagaagtcgctcggggtcctctcccgaagtcgacagcaagtccagactctcaccccgaaggagtcgctccgggtctagcccagaggtgaaggataagccccgagcagccccaagggctcagagtgggtccgattcttcacctgaacccaaagccccggcgccaagagctttaccccggcgaagtaggtcaggaagctcttccaagggtcgaggcccttctcccgagggaagcagttctaccgagtcttctcctgagcatcctcctaagtcaaggacagctaggaggggtagtcgctccagccccgaacctaaaactaaatcccgtacccccccaaggcgcagatcctccaggagtagtcccgaactaactcggaaggcacgactctcaaggcgctcgcggagtgcctcatctagtcccgagacacggtcacgcacgccaccacgacacaggagatctccaagcgtgtcctcccccgaaccggcagaaaaatcccgatcctcaaggcggaggcggagtgcctccagtcctcggacaaagacaacatctcgacgaggtcggtcccccagcccaaaaccaagggggctgcagagatcgcggtcgcgcagccgccgcgaaaaaacacgcaccaccagacgccgggatcggtccgggtctagtcaatcgacaagtcgtcggaggcagcgaagcaggtctcggtctagagtgacccgtagaaggagagggggtagcggataccatagtcgttccccggcaaggcaggagtccagccgaacatcctctcgtcgtcgacgtgggagaagcaggactccacccacctccagaaagagaagtaggtcccgcacgtcgccagctccgtggaagcggtccaggtccagggccagccctgccacccacagacgctcacgcagtaggactcctctgatctcgcgacggcgaagcaggagcagaacctctccagtttccaggagacgctcacgtagcagaaccagcgtgacacggcgccgatccagaagtagggctagccccgtgagtagacgtcgaagcaggtctaggaccccacctgtgacacgaaggcgttctaggagcagaactccaacaacccgtcggcggagtcggagcagaacgccacccgtaacccgcaggagatcccggagcagaacaccccccgtgacgagacgacgttctcgctcccggacgtcacctattactcgaagaaggtcccgatcccggaccagtccagtgacacggcgccgttcgagatcccgaacatcgcccgtcaccaggaggcggtcaagaagtcgcacttctccggtcacacgccgaagatctcgctcccggaccccacctgctcaagaccaacctagatccccggtgcccagcgcgttttctgatcagagtagatgcctgatcgcccagactacccccgttgccgggtcccagagtttgtcttccggcgctgtggctacgacaacctcttccgccggggaccataacgggatgctcagcgtacccgcgcctggggtgccacattcagatgttggtgaaccccccgcgtccacgggcgcacagcagccctccgccctcgctgcattgcagccggctaaagaaaggagatcatctagttcttctagtagttcctcctcatcttcaagttcaagctcttcgtccagctctagctcttcttcgtctggatcgagctcctccgacagcgagggctcttccctgcccgtacagcccgaggttgccctgaagcgagtacccagccctacaccagctcccaaagaagctgtgcgggaagggaggcctcctgagccaacccctgccaaacgcaagaggcgctcctcatcctcctctagcagcagctcttcctccagctcatcatccagctccagttctagctcctcttctagtagtagttcgtcatcttcttcatcttcgtcttcgtcctcctcttcctcttcatctccctccccagccaaacctggtcctcaggcccttcctaaaccggccagcccaaaaaaacctccgcccggcgaaagaaggtcgaggagcccgaggaaaccaattgacagtttgcgcgatagcaggtccctttcctactctcccgttgagcgccgaaggcccagccctcagccctctcctagggatcagcagtccagcagctctgaacgcggttcgcggcgcgggcagaggggagactcccgatccccctctcacaagagaaggagggagacaccttcaccccggcctatgagacacagaagctcacgatccccatag

SEQ ID NO: 133864 - DNA, 936 bp, Artificial Sequence
  Description of Artificial Sequence: Synthetic coding sequence
atgttactggagaaggacgttaaccctggaggaaaagaagagacaccagggcagcggcccgcagtgaccgaaacacaccagttagccgaactcaacgaaaaaaagaatgagcgcttaagggctgcatttggcatcagcgattcctatgtagatggctcttcctttgatccccagcgcagggcgcgggaggcaaaacaacccgccccggagccgcctaaaccttattccctggttcgggagagctcaagctccagatctcccacccccaagcagaaaaaaaaaaagaaaaaaaaagaccgcggaagaaggtctgagtcaagttctccccgacgcgaaaggaagaaatctagcaagaagaaaaagcaccggtctgagagcgagtccaagaaacggaaacacaggagtccaacaccaaaatcgaagcgcaagtcaaaagataaaaagagaaagcgaagcaggagtacaacaccagctccaaaaagtagaagagcccataggtcaacttctgcggactctgccagtagcagcgacacatcccgctcgcggagtcgctctgccgctgcgaaaacccacactaccgcccttgccggccggtctccctctccagcctcaggcagaagaggggagggtgacgccccgttcagtgagcccggtaccacctctacccagcggccctcttctcccgagactgccactaagcaaccgagcagcccttatgaagacaaggacaaagacaagaaggagaaatcagcaacgaggccgtctcctagtcctgagaggtccagtacgggccccgaaccgcctgcaccaacgcctctgttagccgagagacatggcggaagccctcagccactggccactacccctctcagccaggaacccgttaacccttctccacagcttttcatgtttcttaagggcatcctggtgttctag

SEQ ID NO: 133865 - DNA, 2871 bp, Artificial Sequence
  Description of Artificial Sequence: Synthetic coding sequence
cgccggagacgcctaagacgggctgaccgccgtggagaggcggcagctcccgggccacgcgatagcggggcacgagccgcggcggccgcacgcccactgccactgggtggagggggtcggcgaagacgcgtcaggggctatgaagaacagcaaatacaggagaaggtggccactttccggttgatgctactagagaaagatgtcaacccaggaggcaaggaagagacaccaggacagcggcctgctgtaaccgagacccatcagctggctgaacttaatgaaaagaagaatgagaggctccgcgccgcttttggcataagcgactcatacgtggatggatcttcttttgatcctcagaggcgagcgcgtgaagctaaacagcctgcccctgagccacccaagccatatagcctggtgcgggagtccagctctagcaggtccccaactccaaagcagaagaaaaagaaaaagaagaaagatcgcggcaggcgaagcgaatcctcaagccccaggcgggagcgcaagaagtccagtaagaagaagaagcatcgctctgagtcagagtcaaaaaaaagaaagcatcggagtccgactccgaaatcgaagcggaaatctaaggataagaaaaggaaacgtagcagatccacaactcctgcccccaagtccagacgggctcacagaagcacatctgccgactcggcttcctcctctgacacctctcgatcccgatctaggagcgccgctgctaagacacacaccaccgccctggcaggaaggtctccgtcacccgctagtggcaggaggggcgagggggatgcccctttctcggagcccggcacgacttccactcaaaggccctcctcccccgaaaccgctactaaacaaccaagctccccctatgaggacaaggacaaggacaaaaaagagaagtctgcaacacgaccttcaccttccccagaacgctcgagcacaggaccagaaccccctgcccctacccctctgcttgctgagcgacatggcgggtccccccagcccctggccacgaccccgctgtcacaagagccagtgaacccgcctagcgaagcctcacctactcgcgatcgctcccctcccaaatcccctgaaaagttgccccagagtagctctagcgagagctccccgccttcacctcagccaacaaaggtatcccggcatgcaagtagcagccccgagtctcctaagcctgcccccgcaccaggctctcacagggaaattagtagtagccccacatctaagaacagatcccacgggagggcgaagcgggacaagtctcattcgcacaccccctctcgcagaatgggcagatctagatcacctgcaactgccaaaagagggaggtctaggtccaggactccaaccaagcgcggccacagtaggagtcggtcaccgcagtggaggaggtcccgttcagcacaaagatggggacgcagccgcagtccgcagcggcggggccggagccgaagtcctcaaaggcccggatggtctcgtagccgcaacactcaaaggagaggacgatctaggagcgcacggaggggccggagccatagccgctcgcctgcgacccgaggaagaagtagaagccggactcccgcacggcgtgggcggtcccggagcaggacccccgcacggcggagatccaggagtcgaaccccaacgcggcgtcgctcacgcagtcgaacccccgcgcggcggggcagatcccgttctagaacgccagccagacggaggtcccggacccgttcacccgtcaggcggaggagccggtcaagatcaccagcccgccgttctggcaggtcccgcagtaggacacctgctcgaaggggccgctcgcgaagcaggacccctgcaaggaggggtcgctcccggagtagaacgccagcccgccgctctgggcgcagccgatctaggaccccagctagaaggggaaggtcgaggtcccgaactccgcgccggggcagatcccgttcacgttccctcgtgagaagggggaggtcgcatagtcggacgccacagcgacgcggaagaagtgggtcatcttccgagcgaaagaacaagagccggacgtcacaacggaggtccagatcgaacagcagccccgagatgaaaaagagcaggatctcatctcggaggtcccgctctttgagtagccctcggtcaaaggcaaagtctcggttgtctctgcggcgctctttaagtgggtcgagcccttgccctaagcagaagagtcagactccgccccgaaggagtaggtctggaagttctcagcccaaagctaagtcaagaacccccccaaggcggtcacgcagttcaagtagccctccacccaagcagaagtccaagactccaagcaggcagagtcattcaagttcttcgccgcacccaaaagttaagagtggcaccccgcccagacagggctccatcacttctccccaagccaatgaacagagtgtgacaccccaacgaaggtcttgctttgagagctccccggacccggagctcaagagtcggactccttcccgccattcttgttccggcagcagcccacctagagtcaagtccagtacaccaccccggcaaagtcccagtagatcctcctctccccaaccaaaggtgaaggccataatcagcccccggcagcgcagccactccggctcctccagtccgtctccaagtagggtcacatcgagaaccactccaagaagaagcaggtccgtgtctccatgcagcaacgtcgaaagccgcctgctgcctcgatactctcattcagggtcctcttcacccgatacaaaagtgaagccagaaactccacctcggcagtcccattccggttag

SEQ ID NO: 133866 - DNA, 6036 bp, Artificial Sequence
  Description of Artificial Sequence: Synthetic coding sequence
atgaagaaatctcgcattagcagtagacggagccggtccctgtcctccccaaggtctaaggctaagagcagattgagcctgaggagatctctcagtggatcttccccctgtccaaagcagaagtcacagacaccacctaggaggtcccgttcagggtccagtcagccgaaagccaagagcaggactccgcctcgcaggtcaagaagctcctcatcccccccaccaaagcaaaagagcaagacaccttcgcggcagagccacagctcctcttcccctcacccaaaggtgaagtctggaacccccccacggcaggggagcattacgtctccacaggcgaacgagcaatcagtcaccccccaaagacgctcttgcttcgaatctagtccggatcctgagctaaaaagccgtacaccgtcaaggcactcctgttcggggagttccccgcctcgtgttaaaagtagcacaccgccaaggcaatccccttctagaagctccagccctcagccgaaggtgaaggccatcatttcaccacgccagcgcagtcactcagggtcttcctcaccgtctccctccagagtgacatcacgcacaacccctcgccgatcaagatccgtgtcaccttgcagcaacgtagagtcgaggttgcttccccgatactctcatagcgggtcaagttcacctgataccaaggtcaagcccgaaacaccgcccagacagagtcacagcgggtctatttcaccttaccccaaggtaaaagctcaaacccctcccggtcccagcttaagcggaagcaaatccccgtgcccccaggagaagagcaaggacagcttggtgcagtcctgcccaggtagcctttctctctgcgctggagttaaatcctccacgccacccggcgagtcttacttcggcgtgtcttccctgcagctcaagggacagagccagactagcccagaccataggtcagacacctctagcccagaagtaaggcagtcacactctgaatccccttctctccagtccaagagccagaccagcccaaaaggaggaaggagccgttcttcgtctccagtgacagaactggcctcaagaagccccattcgccaggacagaggtgaattctctgcctccccgatgctcaaatcgggaatgtctcctgagcagagcaggtttcagagcgactcttctagctatccaacggtggatagcaattcacttttgggacagtccagattggaaactgcggagagtaaggaaaaaatggcgttgcctccccaagaggacgcaaccgctagcccccctcgccagaaggataaatttagtcccttccctgtccaggatcggccggagagcagcctcgtgttcaaagatacactgaggacgcctcctcgcgaaagatcaggagccggctctagtcctgaaactaaagagcagaatagcgccctgccaacttccagtcaagacgaggagttgatggaagtcgtggaaaagagcgaggagcctgccggccagatccttagccatttgtcttccgagcttaaagagatgagcacctctaactttgagagctccccggaggtagaagagcggcccgccgtttccctcaccctggatcagtcacagtctcaggcctctctggaggcagtagaagtaccatctatggcctccagttggggtgggccccacttctcccctgagcataaggagttatctaactctccgctgcgagagaactcgttcggctctcccctcgaatttaggaactcaggacccctcggaacagagatgaacactggatttagttccgaggttaaggaggacctgaacggtcccttcctgaaccaactagagaccgatccaagcctagatatgaaggaacaaagcacaaggtctagcggccactcatcctcagagctgagtcccgacgcagtcgagaaggccgggatgagctcaaatcagtctattagcagcccggtcctcgacgctgtacccaggaccccatcaagagaacgcagctccagtgctagcagccctgagatgaaggacggactgccacgcaccccttcgcgtagaagcagatccgggtcatccccgggtttgcgggatggctcaggaaccccttcccgacattcccttagcgggtcctctcctggcatgaaagacataccccgcaccccatccagaggacgcagcgagtgcgactcctcacccgagccaaaggcacttccacagacgcctagacctcgcagccgttcaccgagtagtccagagctgaacaacaagtgcctgacacctcagagagaaaggtcaggaagtgagtcctcagttgaccagaaaaccgtcgccaggacacccctggggcaacgcagtcggtctggatcgagccaagagctggacgtgaagcccagcgcgtccccccaggaacgcagtgaatcagactccagccccgatagcaaggctaagacgcggactcctctacggcagagatctcgctccggcagctcgcccgaggtggattctaagagtcgactttccccccggaggagtagatctggaagttcccctgaggttaaggataagccaagagccgctcctagggcccagtcgggctcagacagctccccggagcccaaggcccccgcccctcgggccctgccgcgcagatctagatccggctccagttccaaaggaagaggcccaagccctgaaggaagtagcagcactgagtcatcaccggagcatccacctaagagtaggactgcacgccgggggagccggagctcccccgaaccaaagacgaagtctagaacgcccccccggaggagaagctccagaagttcacctgagctgactaggaaggcccgattatccagacggagtcgcagcgcttcctcttcccccgagactcgctcccgtactccaccgaggcacaggcgtagcccttcagtctctagccctgagccagcagagaaatcaaggagtagtaggcggcgacgttcagccagcagccccagaacaaagacgaccagtcgacggggacgctccccgtcaccgaaacctcggggccttcagcgctctagatcccgttcgcgacgggagaagactagaacaactagacgacgggatcggagcggatcttcccaaagtaccagtaggcgcaggcaaagatccagatctcggagtcgggtgacgcggagaaggagaggggggtccggctatcattcccggtcacctgctcgccaggaatcatcacggacaagtagtcgccggaggagaggccgttcacgcacccctcctacatccagaaaacgtagcagatctcggacctcaccagccccttggaaacggagccgaagccgtgcttcacctgcaacacaccgtcgcagcagatcgcgaacccccctcatctctcgtaggcgaagtaggtcacgcacaagccctgtgagtaggaggcggagcagaagccgtacttcagtcacacggagacgatctaggagcagggctagtccagtctcacggcgccggtctcggtcccggacgccgcctgtaacccgtcgccggtcgaggtcccgcaccccgacaactaggcgccgaagtaggagcaggacacctcctgtaacccgcagacgctcgcggtcaagaacgcctccagtgactcgacgccgatcacgctcacggacttcccccatcaccaggcgccgcagcaggtccaggacttcccccgtcaccagacgaagatctcgatccagaacctcccccgtgaccagacgacgctctaggtctcggactagcccggtaacacggcggcgtagccgctccaggacccctcctgctattagaaggcggagcagatcgcggacccccctcctgccacgcaaacgcagcaggtcgcgcagcccactggccatcagacgccgctcccggagccggactccgcgaacggcacgcggcaagaggtctctcactcggagtccaccagcaatccgccggcgttctgcatccggcagttcttcagacagaagcagatcagcaaccccaccagcgactcgaaaccacagtggctccaggaccccacctgtggcactaaattcctcccggatgtcatgcttctctaggcctagcatgtcgccaactcctctagatcgttgccggtcaccagggatgctcgagcctctcgggtctagcaggacgcctatgtcagttcttcagcaggcgggaggaagtatgatggacggaccgggccctcgcattcccgaccaccagcgtacatcagtccctgagaatcacgcacagtctagaattgcacttgccttgacagctatcagccttggtacagcacgccccccccctagcatgtccgccgccggcctggcagccaggatgagccaagtgccagccccggtacctctcatgtctcttaggactgcccctgctgctaacctcgcatcacgcatacccgctgcctcagcagcagcaatgaatttagccagcgcaaggacccccgcgatacctactgctgtgaatcttgctgattcaagaacccccgctgctgcagctgctatgaatctggcctcccccaggaccgcagtggccccgtccgctgtcaatcttgccgaccccagaacccccactgctcccgccgttaacctagcaggggcacgaactcctgctgccctggctgctctgtcgctcacaggatcagggacgcctccaacggctgctaactacccgagcagcagccgcaccccccaggctcctgcttccgcgaacctggtgggcccaagatcagctcatgctaccgcacctgtgaacatagctggctcgcgaacagccgccgcattggctccggccagcctcacctccgcccgtatggcccccgcgctgagtggggctaatctcacatcgccaagggtgcccctgagcgcctatgagcgcgtgagtggtaggacatcacctcctttactggatcgggcacgttcaaggacacctcctagtgcaccaagccagagtcgcatgacatctgaacgtgccccttcaccttcctcccgaatggggcaggctccatctcagagcctccttcctccggcccaggatcagcctcggtcacccgtgccctctgccttcagcgatcagagccggtgtcttattgcacagacaacgccggtggcaggctcccagtctctgtcatccggtgctgtcgcaacaacaacatcctccgcgggggaccacaacggaatgctgtccgttcctgcccctggagtgccacattcggacgtgggagagccccctgcaagcactggcgcccagcaacctagtgccctagccgctctgcagcccgccaaggagcggaggagtagcagcagttctagtagtagtagttcatcaagtagttccagtagctcttcctccagctcttcttcgagctccggctccagctcttcagattccgaaggctcatccttgccagtgcaacccgaagtagctcttaaaagagtaccctcacccacccctgcccctaaggaagctgtgagggagggccgtccgccggaacctacaccagccaagagaaagcggagatcctcgtctagctccagttcttcctcctcttccagctctagctcttcatcatcttcaagtagctcatcctccagcagttcctccagctcctccagcagctcttcatctagctcctctagctccagcccctccccagccaagcctgggccacaggctctcccaaaacccgcaagccccaagaagccaccacccggagagcgttccttattgccggtctcgccaagtccgcgacattccctgccccatgtggcccgaggcacgtttttaaagaggactagcgggtatttcccacccctgcacaaaagcttcggcacaccttgtggcctgcaggacaaagcgcctcctctgagggagtggcgcgtgcgccttttcacgaacggtccttgccctccttgtgtgcttctgctccccgccccgacccatgcactctgtagtagccatacacagaggctagcagtctag

SEQ ID NO: 133867 - DNA, 1836 bp, Artificial Sequence
  Description of Artificial Sequence: Synthetic coding sequence
atggcaagcgtgcagcagggtgagaaacagttattcgagaagttctggcgaggcaccttcaaagctgtggccactccaaggcccgaatcaattattgtggcgtctatcaccgcgcgaaagccgttgccccggacagaacctcagaataatccggtagtgcccgctcaagacggcccctctgaaaaactcgggcagcacctggctacagaacccttggggaccaactcctgggaacgtgataaaacttgccgagaacttggcgccaccagaggccactccgcgtcgcacgataaggatctgactccccccccgtcctccaggggcaagaagaaaaagaagaaatccaccagaaagaagcgtaggagaagttcgtcttattcacccagcccagtcaagaagaagaaaaagaagtcatcgaagaaacataaacggcggcgcagctttagcaagaagagacgccatagctcttcgagtcctaagtccaagcgacgcgacgagaaacgacacaagaagcagtcccggtcgcggccacgaaagagtcacaggcatcggcaccatcgctgcccaagcagaagtcagagctccgagagcaggccgagctcttgtgagagccgtcaccgagggaggagtcccgaggagggtcagaagagcagaagaagacactcacggcgctgttccaaaacgttgtgcaaggactccccagaggcccagtcctccagacccccttctcagccactgcagatgttgggctacttatccgcccgcggagtcattactgggtctggatccgctgctgatctgttcaccaagacggcctctccactaacgacctccaggggcagatcacaagaatacgacagtggtaatgatacttctagtccccccagcacgcagacaagctcagcacgctcccggggccaggagaaaggctcaccgagcggaggattatcgaaatcccgggagctgaattctgggaacacgagtgacagtgggaattcattcaccacatcctcccctcagaataaaggggcgatgctggagaatctctcccctacgagccgggggagagaatcacggggcttccaatcaccgtgtctcgagtgcgccgaggttaagaagtcttcactggtccccagcaccgccaggtccagccctatgaaaggatgctccaggtcctcatcgtatgcttcgactagatcctcatcacattcttcacggagcccaaatccccgtgcttcgcctcggtacacgcaatctagatctacatctagtgaaaaacgaagttacagtcggagtccttcctattcctctaaatccggaaaacggagccccccaagccggagttcccgctctagaaggtccccctcatatagtaggtatagtccaagtcgagagcgggaccccaagtattcggagaaagacagccaacaacgagagcgcgagagggcacgacgacgcagacgctcttacagccctatgcgcaagagaagaagggacagcccgtcccacttagaggcgcgacgcataactagtgcaagaaagcggcctataccctactaccgacccagcccttcctcttcgggctccctgtccagtacaagctcgtggtactcttcaagcagctcccgatccgcgagcaggagctattcgcggtccagaagccggtcacggagcaggaggaggtcgaggacgagaacatcctcaagtagctcttccagatccccgtctcctgggagcaggtccagatcgcgaagccggtctcggagccgttctcggtcccggagccaaagcagaagctactcaagcgccgacagctacagttccacccgtcggtag

SEQ ID NO: 133868 - DNA, 747 bp, Artificial Sequence
  Description of Artificial Sequence: Synthetic coding sequence
atgagcggaggaggcgtcattaggggacccgccggcaacaacgactgccgcatttacgtgggaaacctcccacccgacatcagaactaaggacattgaagatgttttctacaaatacggcgccatacgggacatagacttgaaaaacagaaggggggggccgcctttcgcgttcgtcgagtttgaggacccacgcgacgccgaagacgccgtttacggcagagacgggtatgattatgatggataccgtctccgggtcgagttccctaggtccgggcgaggcaccggtagaggcggtgggggggggggaggaggaggcgccccccggggcaggtacgggcccccaagccggagatccgagaatagggtggtcgtctcaggactccctccttccggcagctggcaagaccttaaagaccatatgcgagaggcgggcgacgtttgttacgctgacgtgtatcgtgacggcaccggggtcgtggaatttgttcgtaaagaggatatgacctacgcggttagaaaattagataatacaaagtttaggagccatgaaggggaaacagcctacatccgggttaaggtggatggacctcgctccccttcctacgggcgtagcagaagccggtctagatcaagatcacgttcccgctcacggtctaactccagaagccgtagttatagccctaggaggtctcggggctcccccaggtactcacctagacactcccgatcacgatccagaacctag

SEQ ID NO: 133869 - DNA, 606 bp, Artificial Sequence
  Description of Artificial Sequence: Synthetic coding sequence
atgagcggtggcggggtgatcagaggccccgccgggaacaacgattgccggatctatgtcgggaatctaccccccgacatcagaactaaagacattgaggatgtattctacaagtatggggcaatccgagatatagatctgaaaaatcggcgtggcggccccccctttgccttcgtggaattcgaagacccacgggacgccgaagacgccgtgtacgggcgtgatgggtacgactacgacggctatagattgagagtagagttcccaaggtcaggacggggtacaggccgcggtgggggcggtggcggggggggtggcgcaccccggggtaggtatggccccccttccagaagaagcgagaacagagttgtggtgagtggactgccgccgtccggatcttggcaggatctcaaagaccacatgcgagaggctggagatgtgtgttacgcggacgtgtaccgcgacggaacaggagtggtggaattcgtacggaaggaagacatgacttatgcagtgcggaaactggataacacaaagtttaggagtcatgaagtggggtacacacgcatcctgttttttgatcagaattggatccagtggtcttag

SEQ ID NO: 133870 - DNA, 786 bp, Artificial Sequence
  Description of Artificial Sequence: Synthetic coding sequence
atgtcccggtacctacggccacctaatacttcactgttcgtacgcaacgtcgccgacgacaccagatccgaggatctacggcgcgaatttggcagatatgggcccattgtcgacgtgtatgtccctcttgacttctacacaagaagaccgcgcggatttgcctacgtgcaattcgaggatgtgagagatgctgaagacgcactccacaacctggataggaaatggatttgcgggagacaaatcgagattcaattcgctcaaggcgatcgcaaaactcccaaccagatgaaggcgaaagagggtcgtaacgtttacagtagctcccggtacgacgactatgatcggtaccggagatcgcgcagcaggtcctacgaaaggaggaggtcccgctcccggagcttcgattataattatagacgcagctacagcccccggaaccgcccaacaggccgtcccaggcgatcccggtcacactcggataacgatcggtttaaacataggaataggtcattcagtaggtcgaagagtaattcaagaagcaggtcgaagtcccagccaaaaaaggagatgaaagctaaatcaagatcacgaagcgcttctcacacgaaaactcgcggcacatcgaaaaccgattccaaaacacactacaaatctgggagtagatatgaaaaggagtcccgcaaaaaggagcccccacgttctaaatctcagagcaggtcccagagtaggtctcggtctaaaagtaggagtcgctcatggacctctccaaaatcgtctgggcactag

SEQ ID NO: 133871 - DNA, 552 bp, Artificial Sequence
  Description of Artificial Sequence: Synthetic coding sequence
atgagtcggtatttacgaccccctaacaccagtctctttgtgcgtaatgttgctgatgatacgagatccgaagatctgaggagagaattcggtagatatggcccgatagtggacgtgtatgtgcctctggacttctatacccggcgcccgagagggtttgcctacgtccagttcgaggacgtgcgggatgcagaggatgcgctgcataacctcgaccggaaatggatctgcggaagacaaatcgaaattcagtttgctcagggagacaggaagacgccaaaccagatgaaggccaaagaagggaggaacgtttatagctcctctagatacgatgactacgacagatatcgccgctcccgctcacgcagttacgaacggcgccgttcccggagcagatctttcgattataactacagaaggagctattcccccaggaactcccgacctactggccggccccgccgaagccggtcccattccgataatgaccggcccaattgctcatggaacacccagtactcaagcgcgtattacacgtcgaggaaaatatag

SEQ ID NO: 133872 - DNA, 522 bp, Artificial Sequence
  Description of Artificial Sequence: Synthetic coding sequence
atgtcacggtacctgaggccacccaatacctcgctgttcgtcagaaacgtggcagatgatactcgtagcgaggatctgcgtcgggagtttgggcggtacggacctatcgttgatgtgtacgtacctcttgatttttatactcgccgcccgcgtggttttgcatatgtgcaattcgaagacgtgagagacgccgaagacgcgttgcacaacttggacagaaaatggatctgcggcagacagattgagatccagtttgcccagggagacaggaagacaccgaatcagatgaaggctaaggagggacggaatgtatacagcagttcaagatatgatgattatgaccgctatcgccgatcgagatccaggtcctacgagagacgtcgaagcaggtcaagatctttcgactacaactatagacggtcttactccccccgaaatagccgaccgacagggcgccccagacggtcacgcagccacagcgataacgacagccaggtgagtaagaaaaaaaatgagcggtag

SEQ ID NO: 133873 - DNA, 519 bp, Artificial Sequence
  Description of Artificial Sequence: Synthetic coding sequence
atgagccggtatctgcggcctcccaacacctcactcttcgtccgcaatgttgctgatgacaccagatcagaagacctacgcagagagttcggaagatacggaccaatagtggacgtatacgtcccactggatttctacactagacgtccgcgcggcttcgcttacgtgcagtttgaggatgttcgcgatgcagaagatgccctacataatcttgatagaaagtggatatgtggccgtcagatcgagattcagtttgctcagggtgatcggaaaacaccaaaccaaatgaaggctaaagaagggcgcaacgtctacagctcctcccgatatgacgattacgaccgctaccggcgttctagaagccgttcttacgaaagaagacgatcacgtagcagatcatttgactataattataggaggtcatattcacccagaaacagaccaactggcaggcctaggcgcagtagatcccattccgacaatgactcccaagtgtccaaaaagaagaatgagagatag

SEQ ID NO: 133874 - DNA, 498 bp, Artificial Sequence
  Description of Artificial Sequence: Synthetic coding sequence
atgagtcgttaccttcggccacctaatacttcgctgtttgtgcgcaatgttgccgatgacaccaggtctgaagatctgaggcgcgagttcggtcgttacggaccaatagtcgatgtttacgttcccctcgacttttacacacgccgacctcgggggttcgcctatgtgcagtttgaggacgtcagggatgctgaggatgctctgcacaacctcgaccgtaagtggatttgtggtagacagatcgagatccagttcgcgcagggggatagaaaaaccccaaatcagatgaaagcgaaagaggggcggaacgtatactctagttctaggtacgacgactatgaccgatatcgacgctcaagaagcagaagctatgaaaggcgtagaagtcgctcccggagcttcgactacaactatcgaagatcctattccccaagaaaaccaaattgttcatggaacacacaatattcgtccgcctattacacaagtcgcaaaatttag

SEQ ID NO: 133875 - DNA, 549 bp, Artificial Sequence
  Description of Artificial Sequence: Synthetic coding sequence
atgtctagatacctgcgccccccaaacacctccctcttcgtccgcaatgtggccgacgacactaggtccgaggacctgcgccgcgagtttggaagatacgggcctattgtcgacgtgtacgtgcctctggacttttacactcggcgccccagagggtttgcctatgtgcaatttgaggacgtgcgtgatgcagaggatgctttacacaatctggacaggaaatggatctgcggtaggcagattgagatacagttcgctcaaggtgataggaagacccctaatcagatgaaagcgaaggaaggtagaaatgtctacagttcaagtagatatgacgattacgaccgttacagaagaagtcggagcagatcttacgaaagaaggagaagcaggagcaggtcgttcgattataactatagacgcagctattcacctaggaatcggcccaccggtaggcccaggagaagtcgatcccatagcgataatgacagaccgaactgctcctggaacacgcagtattccagcgcctactacacctcgcgcaaaatctag

SEQ ID NO: 133876 - DNA, 789 bp, Artificial Sequence
  Description of Artificial Sequence: Synthetic coding sequence
atgtcccgatacctcaggccaccgaatacatccctgtttgttagaaacgtggctgatgacaccaggtctgaggacctgagaagggagttcgggagatacgggcccattgtcgacgtgtacgtgccactggatttttacacccgccggcctcgcggatttgcctacgtgcaattcgaggacgtgcgggacgctgaagatgcactccacaatttggatcgcaaatggatctgtggacgacaaatcgagattcagttcgcccagggcgatcggaagaccccgaatcaaatgaaggctaaggaggggaggaacgtgtatagcagttcccgctatgatgattacgaccgatatagacgttcccggtcacgctcttacgaacggcggagaagcagaagcaggtctttcgattacaattataggaggtcctattctcctagaaactcccggcccacaggtagacctaggagatcccggtctcacagcgacaacgatcgattcaagcaccgtaatcgatctttcagccgatccaagtcaaatagccgaagccgaagcaaaagtcaaccaaagaaagagatgaaggcaaaaagccgatctcgtagcgcgtcgcacactaagactcggggaacatccaaaactgattccaagacccattacaaatctgggagcaggtacgagaaagagtcccggaagaaggaacccccacgatctaaatctcagtcccgatcccagtccaggtcgcggagtaagtctaggtcgcgctcgtggacttctcctaaatctagcggccattag

SEQ ID NO: 133877 - DNA, 1275 bp, Artificial Sequence
  Description of Artificial Sequence: Synthetic coding sequence
atgatcaataatcaccgcaatcaggcactctacttttcagaacataaatactttcaacagacccaggtcgtctatcagggtgacattttttgggtgttcctatgcgtgttttgcttgcggaaagagtgcgtgctcatgcaggggtgcttctctgctggcgtgatccctgatgaggctaaagctttgagtttgctggcacccgccaatgctgtggccggcttactgccagggggcgggttactacctacccccaacccactcacccagataggcgcagttcccctggctgctctgggcgctcccaccttggaccccgcactcgctgcactgggactaccaggagccaacctgaatagccagtctctggccgcggatcagctcttgaaattaatgtccaccgtggatcccaagcttaaccacgtcgcagcagggctggtgtctcctagcctgaaaagcgacactagtagcaaagagattgaggaggcaatgaagagggtacgcgaggcccaatccttaatatctgcagcaattgagcctgacaaaaaagaagaaaagagaaggcattcccggagccgtagccgctctagacgcagacgtaccccatcatccagccgccatcggagatcacggtctcgctctaggcgacggagccactccaagtcccgatcccgcagaagaagcaagtcccctcgtcggaggcgtagtcacagcagggagagaggacgtcggtccaggtctacatccaagacccgagataagaaaaaggaagataaagagaagaaacgatccaagaccccacccaagtcttactcaactgcaagacgctcaaggtcagctagtagagaaaggaggcgacggcgatctaggtctggcacacggtcacctaaaaagccgaggagccccaaaagaaagctttcgcggtccccttcccctcgacgacacaagaaagaaaagaaaaaggataaggataaagaaagaagcagagacgagcgggagagatcaaccagtaaaaagaagaaatcgaaggataaagagaaagacagggaaaggaagtctgaatcagataaggacgtaaagcaagtgactcgggattatgacgaggaagagcaggggtacgattcagaaaaagaaaaaaaggaggagaaaaagcccatcgagaccggttcaccgaagaccaaggaatgttctgtggaaaaaggtacgggagactcactgcgggaaagcaaggtgaacggagacgaccatcatgaggaggatatggacatgtccgattag

SEQ ID NO: 133878 - DNA, 1455 bp, Artificial Sequence
  Description of Artificial Sequence: Synthetic coding sequence
atgtccaacactacggtggttcctagtaccgccggccccggccccagcgggggcccaggcggagggggcggaggaggaggaggtggcggaggcaccgaggtcattcaggttactaacgtcagcccctcagcctcatccgagcaaatgaggaccctctttgggttcttgggaaaaatagacgagctgcgattgtttccaccagacgattctccactacccgtcagctccagggtgtgtttcgtgaagttccatgatcctgattcggccgtggtggcccaacatttgacgaatacagtttttgtggatcgggcactgatagtagttccatacgccgagggtgtgatccctgacgaggcaaaagcactcagcttgctggctcctgctaatgcagtggcgggactgctgcccgggggggggcttctgccaacgcccaaccccctcacacaaatcggcgctgttccactggcggccttgggagccccaacactggacccggcactggccgcgctggggctgcccggggcaaacttgaactctcagtcactcgcagcagaccagctcctcaagctcatgtcaacagtggaccctaaattgaatcacgtggcagctggactggtatcgccctctctgaaatcggacactagcagcaaagaaatcgaagaagccatgaaaagagtccgtgaagcccagtccctgatcagcgccgcaatcgagcccgataaaaaagaggaaaaacggaggcatagtcgctctcgcagtcgatcgcgaagacgccgtactcctagttcctccaggcatcggagatcgcgttcaaggtcccggcgtaggtcgcactctaagagcagatcacggaggcgcagcaaaagcccccggcggcgtagatcccacagcagggagaggggcaggagatcacgtagcacctccaagactagggacaaaaagaaggaggataaggaaaagaagcggtccaaaacacctcccaagtcatactctactgctcgccgctccagaagcgcttccagagagaggaggcggagacgatccagatcaggcactcggagccctaagaaaccacgctctccaaaacgaaagttatcacgatctccgtctccaaggcgacacaagaaagaaaagaaaaaggataaagacaaggagcgatccagggacgagcgggagcgctccactagcaaaaagaagaaatctaaggataaggaaaaggaccgcgagcgaaagtccgagtcagataaggatgtaaagcaggtcacccgagattacgatgaggaagaacagggttacgactcagagaaagagaagaaggaagagaaaaagccaatcgagactgggagtccaaagaccaaagaatgtagcgtagaaaagggcaccggcgattctttacgggagagtaaggtgaatggcgacgaccatcacgaggaggacatggacatgagcgattag

SEQ ID NO: 133879 - DNA, 1452 bp, Artificial Sequence
  Description of Artificial Sequence: Synthetic coding sequence
atgagcaacaccacagtggttccgtcgactgcggggccaggaccttcaggcgggcccgggggcggcggagggggaggcggaggtgggggcggaacggaggttatacaagtcacaaatgtctccccatcggcgtcatccgaacagatgcggacgcttttcggcttcctaggaaaaatcgatgagttgagactgttcccacctgatgactccccacttcccgtgagttctagagtgtgcttcgtcaaatttcatgatccggactcagccgtggtggcccagcatctgaccaacaccgtcttcgtggatcgggctctcatagtcgtaccctacgcagaaggggtgattcctgatgaagctaaagctctctctcttttggctcctgcaaacgccgtcgccgggctattgccgggcgggggattgctgccaacaccgaacccccttactcagatcggggctgtccccttggcagctttaggggcacccaccctcgacccagctttggccgcactgggactcccgggagccaacctgaacagccagtcgctggctgctgatcagctcctgaaactaatgagcaccgtagacccaaaattgaatcatgtggctgctggccttgtttcacctagcctcaagtctgatacaagctcaaaagagatagaggaggcgatgaaaagggtgcgggaagctcaatccctcatttccgccgctatcgagcccgacaagaaggaggagaagaggcgccactctcgatcccggagtcggtcacgccggcgtagaacaccctcaagctcccggcacagaaggtccagatccaggtcccggcgaagaagtcactcaaagagtaggagtaggaggcgatccaaaagccccaggcgtcggagatcgcattcccgggaacgaggcagacgtagtaggtcaacaagcaaaaccagagacaagaaaaaagaggataaagagaaaaaacgcagcaagactcctcccaagtcttacagcaccgcacggcgctctcggagcgcctctcgggaaagacggcgtcgccggagccggagtggaactaggtcacccaaaaaacctaggagcccaaagagaaagctgagccgttccccttcccctagaaggcacaagaaggagaagaaaaaggataaagataaggagcgctcccgggatgagcgagaaaggagtaccagtaaaaagaaaaaatccaaggataaggaaaaggacagggaaaggaagtctgagagcgataaagacgtaaaagtgaccagagattatgacgaggaggagcagggctatgactcagaaaaagaaaagaaagaagagaagaagcccatagaaactggttcccccaagaccaaggaatgcagcgtggagaaaggtactggcgactccctgagggagtctaaagtgaacggagacgaccatcacgaagaggacatggatatgtcagactag

SEQ ID NO: 133880 - DNA, 1170 bp, Artificial Sequence
  Description of Artificial Sequence: Synthetic coding sequence
atgagtaacacaaccgtggtaccctccacagctggccccggacctagtgggggccccggtggcgggggcggcggcggcggaggcggaggtggtacagaggtcatacaggtcacaaatgtgtcccctagcgcttcatctgagcagatgcgcaccctgttcggattcctgggcaaaatcgacgaactgagactgttccccccggatgatagtcctttacctgtgagctctagggtatgtttcgtgaaatttcacgaccccgattctgcagtcgtggcacaacatctcaccaacactgtctttgtggatagagctttaatcgtggtgccctatgcagaaggcgttataccagatgaggctaaggccttgagcctcctcgctcctgctaacgcggtcgctggccttctgcctggcggcgggctccttcccacaccaaatcctctgacgcagataggcgccgttcccttggctgccctgggggctccaacccttgaccctgccctggctgccctggggctacccggggctaatttgaactctcagagcctcgccgcagaccagctcctgaaattaatgagcaccgtcgacccaaaactgaatcacgtagccgccggcctcgtgtctccttcccttaagtctgatacctcctccaaagagatcgaggaggcaatgaaaagagtgcgggaggcacaaagccttattagtgccgcgattgaacccgacaagaaggaggagaagaggcggcatagtcgatcaaggtcacgatcccggaggcgccgcactccttcctcaagccgccatcgacggagccggtcgcgaagtcggagacgctctcatagcaaatcccgttcgcgtcgaaggtcgaagtcgcctcgaagaagaagatcccattcacgggaaaggggccgcaggtcaagatccacaagtaaaacccgcgataaaaagaaggaggataaggaaaaaaagcgttccaagactcctcccaagtcttattcaactgcacgacgatccaggtcagcctccagccttcacatctgcgattctcgggaacgtcgacgtagacgctcgcgcagcggaactcggtctccaaagaagccccgatctcccaaacgtaagctctcaagaagcccctcgccgagacgccacaagaaagagaaaaagaaggacaagtag

SEQ ID NO: 133881 - DNA, 1455 bp, Artificial Sequence
  Description of Artificial Sequence: Synthetic coding sequence
atgtctaatactacagtcgtaccctccaccgctggccctggaccctccggcggaccaggcgggggtggtggaggcgggggcggtggaggtggtaccgaagtaatccaagtcactaatgtctccccttccgcctcaagtgaacagatgcggaccctcttcggtttcctgggcaaaatcgacgaactgaggctgtttcctccagacgacagccccctgccggtctctagccgcgtctgttttgtgaaatttcatgatccagacagcgccgtggtggcacaacatctgaccaataccgtattcgtggatagggctctgatagtggtgccctacgcagaaggagtaattcctgacgaagcaaaggccctcagcttacttgcaccggccaacgctgtcgccggactgctcccgggcggaggcctgcttccaactccgaaccccctgacgcagattggagccgtgccgttggctgcactcggcgcaccgacactcgacccagccttggcagctctgggtctgcccggcgcaaacctaaactctcagagtttagcagcggatcaactgcttaagctcatgagtacagtagaccccaagctcaatcacgttgctgctggactggttagtcctagcctcaagtctgacacatctagcaaagagatcgaggaggccatgaagcgcgtgcgggaagctcagtcccttatcagcgccgcgatcgaacctgataagaaggaggagaagcggaggcatagcagatcacggagtcgaagtaggcgccggcgcacaccctctagtagccgccatcgccggtctcggagtaggagcagaaggcgatcccatagcaagtcccgctcacgtaggcggtccaagtccccgcgccggcgccgcagccactcgcgcgaacgaggacgcagatcacggtcaaccagtaagacacgtgataagaagaaggaggacaaagagaagaagcgttccaaaactcctcctaaaagttattctaccgcaagacgtagtagatctgcgtcccgggagcgcagacgacgccgctctcgctctggcacacgctcacccaaaaagcctcggtcaccaaagagaaaactgagccgttccccgtcccctcgacgccacaagaaagaaaaaaagaaggacaaagacaaggagcggtcccgggatgagcgtgaaagatccacttctaaaaagaaaaagtcaaaggataaagaaaaggaccgggagcgtaagagtgagtctgacaaagacgtcaaacaggtaaccagagattatgacgaggaagagcagggctacgactccgaaaaagagaagaaggaggaaaagaaaccaatcgagaccgggagtccaaaaactaaggagtgctccgtcgagaaggggacaggtgacagtctcagagagtcgaaagtgaacggagacgaccaccacgaagaggacatggacatgtctgactag

SEQ ID NO: 133882 - DNA, 387 bp, Artificial Sequence
  Description of Artificial Sequence: Synthetic coding sequence
atgagcaatacaactgtggtgccaagtaccgcggggcccggaccttccgggggccctggaggcgggggtggtgggggggggggcggcggagggacagaagttattcaggtcactaacgtctctcccagcgcatcttccgagcagatgagaaccctcttcgggtttttagggaagatagacgagcttagactgttcccccctgatgattctcccttgccggtcagcagtcgtgtatgtttcgtgaagttccatgaccccgactccgcggtcgtggctcagcacctgactaatacagtgttcgtagatagggctctcatcgtagttccctacgcagaggtgaagcaacccaccagggtagttgtgcataagaccgcttttgagagttag

SEQ ID NO: 133883 - DNA, 396 bp, Artificial Sequence
  Description of Artificial Sequence: Synthetic coding sequence
atgtcaaatacaactgtggtacctagtaccgccggcccagggccctctggaggaccagggggagggggtgggggcggtggcggcgggggcggcaccgaggtgatccaggtgaccaatgtgtccccctccgcgagctcagaacagatgcgcacactctttggcttcctaggaaagatcgacgagctccggctgttcccgccagacgattcccccttgccagtgtccagtcgggtgtgtttcgttaagtttcacgatcccgatagcgctgtcgtcgcccagcacctcacgaacaccgtcttcgttgatcgggcgcttattgtagttccatacgcggaagtatttcatggatccatcaaagccgcagtgaaaaagatcctgctgacacacgaaaactag

SEQ ID NO: 133884 - DNA, 630 bp, Artificial Sequence
  Description of Artificial Sequence: Synthetic coding sequence
atgacaagtcttaaagtcgacaacctcacatatagaacctcccccgataccctgcgacgtgtgtttgaaaagtacggcagggtgggcgatgtatatattcctagagataggtacacaaaggaatcacgtggattcgctttcgtgaggtttcatgacaagcgtgacgccgaagatgctatggatgctatggatggtgccgtcctggacggcagggaacttagggtgcaaatggccagatatggaagacctcctgatagccaccacagtagaagggggccaccacctagacgttacgggggcgggggctacgggaggcggtccaggagccccaggagacgtcgccggtcaagatccaggtctcggtcaaggagccgttcccgctcacgctcccggtacagcagatccaagagtcgatctcggacaagatcccggagtcggtctactagcaagtcacggtccgccaggaggtccaagagtaagtcttcatctgtgagccggtctcgctcaaggtctcgctccagatctagatcacgaagcccccctcctgtgtccaagagagagagcaaaagtcgctctcgttccaaatccccaccaaagtcccctgaggaggaaggagctgtgtctagttag

SEQ ID NO: 133885 - DNA, 606 bp, Artificial Sequence
  Description of Artificial Sequence: Synthetic coding sequence
atgagctatgggcggccgccaccagatgtggaaggcatgacatctctgaaggttgacaatctaacatataggacttcgcccgatacccttagaagagtattcgagaaatacggtagagtgggggatgtctacattcccagagatcggtacacgaaggagagtaggggcttcgctttcgtgcgatttcacgacaagagagacgccgaagatgctatggatgccatggatggcgccgtgttagacggaagggagctccgggtgcagatggcgaggtgtggcggctacgggcgtcgctccagatctccgagacgaagaagacgctcccgctcacgttcaagaagccgcagcagaagcagatcacggtctaggtatagcaggtctaaatccagatccagaacaagaagcaggtctagatccacgtccaagtctcggagcgcaaggaggtcaaaatccaaaagctccagcgtttctcggagcaggtcccggtctcgctcccggtcacggagtcgcagcccccccccagtgtcaaaaagagagagcaagagtcgcagccgctcaaagagcccacccaaatccccagaggaagagggggctgtgtccagctag

SEQ ID NO: 133886 - DNA, 666 bp, Artificial Sequence
  Description of Artificial Sequence: Synthetic coding sequence
atgagctatggcaggccaccccccgatgtggaaggcatgaccagcctgaaggtggataacttaacctaccgcaccagtcctgatacacttcgacgggttttcgagaaatatgggcgcgtgggtgacgtctacatcccaagagatagatatacaaaagagagcagaggattcgccttcgtgcgcttccatgataaaagggatgctgaggacgcgatggatgccatggatggcgctgtgttggacggccgcgagttgcgcgtccagatggcaagatacgggcggccgccagacagccatcactccagacgcggacctccaccccgcagatatggtggaggaggttatggaaggaggagtcggagcccgcgcaggcgccggagatcccgcagcagatctagatctagatctcgctctagaagcagatctcgttactctcgttctaagtcccggtcaaggacaaggagcagatctcgttctacttccaagagcagaagtgccagacgctccaagagcaaaagtagttcggtgtctagatcaaggagccggagtcggtcacgcagccgctccagatcaccgcccccagtatcgaaaagggaatcaaagtcaaggtctcgttccaagtcccctccaaagtctccggaggaggaaggagccgtcagctcttag

SEQ ID NO: 133887 - DNA, 540 bp, Artificial Sequence
  Description of Artificial Sequence: Synthetic coding sequence
atgtcgtatggccgcccccctccggatgtggaggggatgacttccctaaaggtggacaatctaacctaccgtacatccccagatacattaaggagggtgtttgaaaagtacggacgtgttggtgatgtatacataccccgggaccggtataccaaagaatcccggggctttgcttttgtgcggtttcacgataagagggatgccgaagatgccatggacgccatggatggggcagacccaggagtgggcgtcgtcccaggtctagccgccgacctggcaacggctgctaggtccttaggacccgccctggtgctggacctcggacgacccccatctcccgaccctcacgagggtccctctcccagccctaggagatcgccagatctggtccggggcccaggccccggactgggtccaggtgtactgccacagtgccccagagggaatcccaatccggggagggataggcgtgtgcctcctagtttattgaaaagaaaggagcgctgtccgctcaaaaagatgctgcggtctcctgtttag

SEQ ID NO: 133888 - DNA, 669 bp, Artificial Sequence
  Description of Artificial Sequence: Synthetic coding sequence
cccgaacggcgaggagtggcaccccctagggcagaagaagcaggtgccagcagcaggggatctggaccaccgctgcgcgctatgagctatggtcggccaccaccagacgttgagggtatgacgagtctgaaagtggataacttgacctataggacatcacccgataccttaagaagggttttcgaaaagtacggacgggtgggcgatgtatacattccacgggaccgctatactaaggagagtcgcggatttgctttcgtgcggttccacgacaagcgtgacgcagaagatgccatggacgccatggatggagctgtgctcgatgggagggagttacgcgtacaaatggccagatacggccgacccccggactcacatcactctcggcggggaccaccgccccggcgctacggaggcgggggctatggacgccggtcgcgctcccctcggcggcggcgaagaagcagatcccggtctcgctcccgatcacgttcacggtctagatctcggtactcaaggagtaaaagcaggtcccgcaccaggagtcgctctagatctactagcaagagccgcagcgctcgccgcagcaaatctaagagctcctccgtcagtcgatctagatcaaggtctaggagtaggtctaggagccgttctcctccacctgtctag

SEQ ID NO: 133889 - DNA, 375 bp, Artificial Sequence
  Description of Artificial Sequence: Synthetic coding sequence
atgcacagggatagttgcccactggactgtaaggtatacgtcggaaacttgggaaacaatggaaataaaacagagctggagcgggctttcggctactacggacctctgagatccgtgtgggtggcacgcaatcctcccggctttgcttttgttgagtttgaggatccccgagacgctgccgacgcagtgagggaattagatggccgcacgctttgtggatgtcgcgtgagagtcgaactctcgaatggggagaagaggtcacgcaatcgggggccgcctccttcatgggggcgccgccctcgcgatgactaccgacgacggtcacccccaccgagacgcagagtaacaatcatgtcattacttaccactctgtag

SEQ ID NO: 133890 - DNA, 495 bp, Artificial Sequence
  Description of Artificial Sequence: Synthetic coding sequence
atgcacagggacagttgtccccttgactgtaaagtttatgtagggaatttggggaacaatggtaacaagactgagctggagcgcgcattcggctattatggcccattaagatctgtgtgggttgctaggaatccccctgggtttgcgtttgtggaattcgaagacccaagagatgccgccgatgccgtccgggagctggacggacggactttatgcgggtgcagagtgcgggtcgagttgagcaacggcgagaaaagaagtcggaataggggacctcctccctcctggggacgccgtcctcgcgatgattaccgcagaagatctccccctcctaggaggagaagccctagaagaaggtctttctcccgctctagatcacgttccctgagcagggacaggcgcagggagagaagccttagccgagagcgcaatcataaaccttctcgatccttctcccgctctaggagccgttctagatctaacgaaaggaaatag

SEQ ID NO: 133891 - DNA, 1485 bp, Artificial Sequence
  Description of Artificial Sequence: Synthetic coding sequence
atgcctcgggtttatatcggtcgcttgtcttaccaagctcgggaaagagatgtcgagcggttcttcaaaggctatggtaagatcctcgaggtcgatttgaaaaatggctacggtttcgtggagtttgacgatttacgggacgccgatgatgcagtgtacgagctcaacggcaaggacttgtgcggcgaaagggtcatcgtcgaacacgccagggggccccgacgggatggctcctacggctccggtcgcagtgggtacggctatcgacggagtggaagggataagtacggccctcctacccggactgaatatagactgatagtggaaaatctgagcagcagatgttcatggcaagatctcaaagattatatgcggcaggctggggaagtcacgtatgcagacgcacacaaagggcggaagaacgaaggagtcatcgaatttgtgtcatactccgacatgaaacgggccttggaaaaactggacggcactgaagtgaacggcaggaagatccgactggtcgaagataagccagggagccgcagaaggcgatcatattctcgcagtcgctctcactcgcgctcgcgctcccgtagtcgtcacagtaggaagagcagatctcggtcaggctcttcaaagtcttcacatagtaaatcccggtctagaagccgttccgggtctcggagcaggagcaaatcgaggtcgcgtagtcagtcccgttccaggtctaagaaggagaaatctaggtcaccaagcaaggagaaatctcggtcccggagccactcagccggcaagtcccggagcaagtcaaaggatcaggcagaagagaaaatccagaacaatgataatgtgggaaaacccaagtcacggtcaccgagtagacataagagcaagagtaagtcacggagccggtcccaggagaggagagtggaggaggaaaaaaggggaagcgtgtctcggggacggtcacaggagaaatcactgcggcagtctagatctcgatcaagatctaagggaggcagccggagtcgatcaagaagtaggagtaagtctaaggataaacggaaagggaggaagaggagcagggaagaatcccgcagccgctcaagaagcaggtctaaatccgaaaggagcaggaagcgcggcagcaagcgcgactcaaaagccggcagcagcaaaaaaaaaaaaaaggaagataccgatcgctcacagtctcgaagtccttctcgttccgtgagcaaggagcgcgagcatgctaagtctgaatcctcgcaacgggaagggcgcggagagagtgagaacgctggaaccaaccaggagactaggtctaggtcccgctcaaactctaagagcaagcccaacctgccaagtgaatctcgcagtaggtctaagtccgcgagtaagaccagaagcagaagtaagagtagatcccgaagcgccagccgatcaccaagcagatccaggagtagaagccacagtaggtcctag

SEQ ID NO: 133892 - DNA, 1221 bp, Artificial Sequence
  Description of Artificial Sequence: Synthetic coding sequence
atgcccagagtctacatcgggaggctgagttatcaagcacgggagagggatgttgagagatttttcaagggttacggtaaaatactggaggtcgacctgaaaaacggatacgggttcgtcgagttcgacgacttgagggatgccgatgacgcagtatacgagctgaacggcaaggatctttgcggtgagagagtgattgtcgaacacgcgagaggaccgcggcgcgacgggtcttacggaagcgggcgctctgggtatggataccgacggtctgggcgtgacaagtacggaccgccaaccaggaccgaatatcggctgatcgttgagaatctgagcagccggtgctcatggcaggatctgaaggattatatgcggcaagcaggggaggtgacatatgcggatgcccataagggtaggaagaatgaaggtgtgatcgaatttgtatcctacagtgacatgaagcgggccttggaaaagttggatggcactgaggtgaatggcagaaagatcaggctcgtcgaggataaaccaggctccaggagacgtcggtcctactcacggagtaggtcacacagccggtcccgctcccgctctcgtcattcacgcaaatcgaggtcccgtagcggctcatctaagtcatcccattccaaaagtcgcagtaggtccagaagtggcagtagatcaaggagtaaaagcagaagcagatcacagtcaaggtcacgcagcaagaaggaaaaatcacgttccccctctaaggaaaaatcccggagtcgatcccactccgccgggaagtcacggtctaaatccaaagatcaggccgaagagaaaatacagaataacgacaacgttgggaagccaaaatccagatccccatcaaggcataagtctaagagtaaatctaggagcaggtcgcaggagagaagggtggaggaggagaagcgtggttccgtgtctcggggtaggtctcaagagaaatccctccggcagtccaggtcccgctcacgcagcaagggcggctcgagaagtcgaagtcggtcacgtagcaaaagcaaggacaagcgcaagggacgaaaaaggtcccgcgaggaaagcaggtcccgaagcagaagcagaagtaaaagcgagcgctccaggaaacggggcagtctggcatttcgccctggcctgtcctaccgcgagctgtcaaatctggatgggtccaaggccggcatgaccacctag

SEQ ID NO: 133893 - DNA, 477 bp, Artificial Sequence
  Description of Artificial Sequence: Synthetic coding sequence
atgcctagggtgtacatcggaaggctgtcatatcaggccagggagcgagacgtagagagattcttcaagggttacgggaaaatcctggaagtggaccttaagaacggatatggattcgtcgaattcgacgacctccgggatgcggatgatgctgtctacgagctaaacggaaaggacctgtgtggggagagagtgatcgtggaacacgcccgggggcccagacgagatggttcatacggaagcggccgcagtggctatggctatcgacgcagtgggagggacaagtacggtcctccgactaggactgagtataggttgatcgtggagaatctttccagcagatgcagctggcaagatcttaaggttgggctgccactgcccgagcaggagcccgaaccggaacccgaatcggagccagaacaagaacgagagaaacaggagccccagcagggtaaagagcctcaaccccagccctag

SEQ ID NO: 133894 - DNA, 819 bp, Artificial Sequence
  Description of Artificial Sequence: Synthetic coding sequence
atgagcggttgccgggtgtttatcgggcgactgaatcccgccgcccgggaaaaggatgttgagagattcttcaagggctatggacgaatacgtgacatagatttgaagagggggtttggttttgttgagttcgaagatcctagagacgccgacgatgccgtctacgagctggatggaaaagaactgtgcagcgaacgagtgacgatcgaacatgctagagccagatctagaggcggcaggggtagaggcagatattcggacaggttttcatctcgaaggcctagaaatgaccgtcgcaacgctccccccgttcgcacagaaaacagacttatcgtcgagaacttatcctctcgggtctcttggcaagacctgaaagacttcatgcgtcaggcaggcgaggtgactttcgcagacgctcaccgcccaaaactgaacgaaggcgtcgtggaatttgcctcatacggcgacttaaaaaatgcaatcgaaaaactaagcgggaaggagataaatggcagaaaaattaaactgatagaaggaagcaaaagacattcgcggtcgcggtcccggagccggtcacggacacgctcaagttctcgatctcggtcccgtagcagatcccgtagcaggaagtcatattcaagatcacgctcgaggtcccgatctcgctcgcggtctaagtcccggtccgtgagccgtagccctgttcccgaaaagagccaaaagcgtggcagctcctcccggtccaagagcccggcatccgtcgaccgccagagatcgaggtccaggagcagaagtcggtctgtggacagtggcaattag

SEQ ID NO: 133895 - DNA, 417 bp, Artificial Sequence
  Description of Artificial Sequence: Synthetic coding sequence
atgtccgggtgtagagtttttattgggagattaaaccctgccgctagagaaaaagacgtggagcggttttttaaaggctacggacggatcagagacatcgatctaaagcgcgggttcggattcgtggagttcgaggatcctagagacgcggacgacgctgtgtatgagctagacgggaaagagttatgctccgagagagtcaccattgagcatgcccgggcacggagtagagggggccgaggccgcggccgttattccgataggttctctagtagaagaccccgcaacgacagacggaatgcaccacctgtcaggacagaaaatcgattgatagttgagaatttgagctcaagagtgtcctggcagcccgtttgcgtcgtcggtttaatgacacgtagtgcctgcggccttagctag

SEQ ID NO: 133896 - DNA, 819 bp, Artificial Sequence
  Description of Artificial Sequence: Synthetic coding sequence
atgtctggctgtcgcgtgttcatcgggcggttgaatccagccgcaagagaaaaagacgtagaaagattctttaaaggctacggtcggatcagggacattgacctgaaacgaggttttggattcgtcgagtttgaggacccccgtgatgctgacgatgccgtctacgaattagacggcaaagaattgtgtagcgagagggtgacgattgaacatgccagggcccgctcccgagggggtcggggacgaggacggtatagcgacagattcagctcgagacgccctagaaatgacaggcggaacgccccccctgtgcggaccgaaaataggttgattgtggagaacctcagcagccgcgtatcttggcaggaccttaaggacttcatgaggcaggccggagaggtcactttcgccgacgcacaccgtcccaagctcaacgaaggcgtcgtggaattcgcatcctatggtgacctgaaaaacgccatcgagaaattgtctggtaaagaaatcaacgggcgtaagatcaagctgattgagggctccaagcgacactccagatccagaagcagatccaggtcccgtacccgctcaagcagcaggtctaggagccgctcaaggtctagatctcgaaagagttacagccgctccagaagtaggtctaggtcaaggtctcggtctaagtctcggtccgtttcacgaagccccgttcctgagaagagccagaagagggggtcttcctcccggtccaagtctcccgcctccgttgataggcagagatcaagaagccggtctagaagccgcagcgttgattctggaaattag

SEQ ID NO: 133897 - DNA, 819 bp, Artificial Sequence
  Description of Artificial Sequence: Synthetic coding sequence
atgtcgggctgtagggtgtttatcgggcgccttaaccccgccgcgcgagaaaaggacgttgaacgctttttcaagggctatggccgaattcgcgacatcgacctgaaacgaggctttggcttcgtggaattcgaggatcccagagatgccgacgatgcagtgtacgagttagatggtaaggagctttgctcggagcgggtgacaatcgaacacgcacgtgcgaggagccgagggggacgtggacgaggcaggtatagtgatcgattttctagcaggcggccccgaaatgacagacgtaacgccccccctgtcagaacagagaatcggcttattgtggaaaatctcagcagtagggtgagctggcaagatctgaaggatttcatgcggcaggcgggggaggtcacattcgccgacgctcatcgtccgaagctgaacgagggggtggtggaatttgcatcttacggggatctaaaaaacgctattgagaaacttagcggaaaggagataaatggacgtaaaattaagttaatcgaaggttccaagaggcatagccgaagcaggagtagatctaggagtcgtaccagatcctcctcaaggtcccgatccagatcacggagccggtctaggaagagctatagccgttctagatctcggtcacggagtaggtctagatccaagagtcgatcagtgtctcgatccccggtgccagaaaaatcccagaaaaggggcagtagttcacgctccaagagcccagcaagcgtagatcgacaacgcagcaggagccgttctagatccaggtcagtcgactctggtaactag

SEQ ID NO: 133898 - DNA, 1035 bp, Artificial Sequence
  Description of Artificial Sequence: Synthetic coding sequence
atgcctcgcgtatatattgggcggctgtcctataacgtcagggagaaagacatccagcgttttttcagcggatacggacggttgttagaggtggacctaaaaaacggatacgggtttgttgaatttgaggacagcagggatgcagatgatgctgtgtatgaactaaacggtaaagagctgtgtggagaaagagtaattgtggaacacgcccgtggccctcgacgcgaccgcgacggatactcctacggcagtaggtccggtggtggaggctattcctcacgacgcacctcgggtagagataagtatggcccaccagtacgaacggagtatcgtctcatcgtggaaaacttaagttcccgttgctcctggcaagatcttaaggattttatgcgtcaggctggggaggtgacctatgctgatgcccataaggaacgcaccaatgagggtgtgattgagtttcggtcctatagtgatatgaagcgcgcattagacaaactcgatggcactgagatcaatgggcgaaatattcgactgattgaggacaagccgcggacctctcatcgaaggtcttactcagggtctcggtccaggtccaggagcagacgcaggtctcggagcaggtcgcggcgatcttcccgaagcagatctcgctcaatttctaagtcaagaagcagatcaagaagtaggtctaagggcaggtctcgaagcaggtcgaaggggagaaaaagccgtagcaaaagcaagtctaaacctaagtcagacagaggctcgcatagccacagtagaagccgctcaaaagacgaatatgaaaaatccaggtctcggtccaggtcccgctcccctaaagagaacggcaagggggacataaagagtaaaagtcgttctcgttctcagtcccgcagtaactctccactgcccgttcctccaagcaaggctaggtctgtttctcccccacccaagagggccacctctcggtcccggtcaagatcccgtagcaaaagccgatcccggtcaaggtcctcctcccgcgattag

SEQ ID NO: 133899 - DNA, 717 bp, Artificial Sequence
  Description of Artificial Sequence: Synthetic coding sequence
atgagtcgctatggtaggtacggaggcgagaccaaagtttacgtgggtaatctgggtacgggggccggaaagggcgagttggagcgcgctttttcttattacggtcccctacggacggtatggatcgcacgcaatccacctggcttcgcatttgtggaattcgaggaccctcgggacgctgaggacgccgtgagggggcttgacgggaaagtgatatgtgggtcacgggtgcgggttgaactgagcacaggaatgcctcgtcggtcgcggttcgatagacctccagctcgaaggccttttgaccccaacgatagatgttatgaatgtggcgagaaggggcattacgcatacgattgtcaccgatattcgcgaagacgaaggagccggtctcgaagcagatcgcacagccgatctagagggaggcgatactctcgtagccggagccgttccagaggcagacgctcacgctccgcaagccccagacgcagtcgctcaatttcactgagaaggagtcggtctgcttccctgcgcagatctagaagcggatctattaagggttctcgctatttccagtcccctagccggagccgctcacggtcaagatccatcagtcgaccccggtcgtccagatcaaaaagcaggtctcctagccccaagcggtcccgctcaccgagcggctcgccccgaaggagcgctagccccgaacgaatggactag

SEQ ID NO: 133900 - DNA, 681 bp, Artificial Sequence
  Description of Artificial Sequence: Synthetic coding sequence
atgtccaggtacggccggtatggcggggaaacaaaagtgtatgtcgggaatctcggtacaggcgcaggcaagggagagttggagagggctttctcttattacggacctttgcgaacagtctggatagcaagaaaccccccaggctttgcatttgttgaattcgaggaccctcgtgacgctgaagacgcagtaagggggttagacggcaaggtaatatgtggcagcagggtacgagtcgaattaagcacaggtatgccgcgccgctcgaggtttgaccgcccaccagctcgacggccattcgatcccaatgaccggtgttacgagtgtggtgaaaaggggcattacgcgtacgactgccacagatacagcagaaggagacgctccagatcccgatcccgcagccactccagaagtagaggccgacgctacagccgatctcggtcgagatctcgcgggcggaggtcacgctcggctagcccgagaaggtcacggtcgatctcactcaggaggtcacgttccgccagcctgcggagaagtagatccggttcaatcaaagggagtaggtattttcagtcaccgtccagaagtcggtctcggtctcggtcaataagtcggccacggagttcccgcagtcccagcggctcaccgaggcggtcggccagtcctgaaaggatggattag

SEQ ID NO: 133901 - DNA, 1926 bp, Artificial Sequence
  Description of Artificial Sequence: Synthetic coding sequence
atgaattgggcagctttcggagggtccgagttctttatacctgagggcattcagattgatagcagatgcccactgagccgcaatattaccgaatggtaccattactatgggatcgctgttaaggaatcctctcagtactatgatgtcatgtacagcaaaaagggcgccgcatgggtgagcgagacaggcaagaaagaagttagtaagcaaaccgttgcttatagccccagaagtaagctcgggactctcctacctgagtttcctaatgtgaaagacctgaatctgcctgcgtccttgcctgaggaaaaggtgtcaaccttcatcatgatgtacaggacacattgtcaaaggatcctggatacagtgattagggccaactttgatgaggtccaaagctttctcctgcacttctggcagggcatgcctccacacatgttgcccgtcttaggttcttccactgtggtgaacatcgtgggagtctgcgatagtattctgtacaaggctattagtggggtcctgatgcccacagtcctgcaggcccttcccgattctcttacccaggtaattaggaagttcgccaagcagcttgatgagtggctgaaggtggcgctgcatgatcttcctgaaaacctccgaaatatcaaatttgaactcagcagaagattcagccagattctaagacgacaaacatctctcaaccacttgtgtcaggctagcagaacagtcattcactccgccgatattactttccaaatgctggaggattggcgcaatgtagacctgaattctatcacaaaacaaacgctttatactatggaggattcgcgcgacgaacacaggaagctcataactcaactctatcaagagtttgaccacttattagaagagcagtcccctattgagtcttacattgagtggctggataccatggttgatcggtgcgtggtgaaagttgctgcgaaaaggcagggctccctgaagaaagtcgctcagcagttcctcttaatgtggtcttgttttggcacgcgggtgatccgcgacatgaccctgcactcggcccccagctttggaagcttccatctgattcacctgatgttcgacgattatgtgctgtacctgctcgagtccttacattgtcaggaacgcgccaacgaactgatgcgagcaatgaagggcgagggatccactgccgaagtccgggaagaaattattctgaccgaggccgccgctcccaccccaagccccgtgcctagtttcagtcccgctaagagcgccactagtgtggaagtcccccccccctcttctcctgtgtctaacccatctcctgaatacaccgggctgtctacgactggggcaatgcagtcttatacctggtctctaacttacaccgtgacgacagcagccggttcacctgcagaaaattcccaacagctgccatgcatgcggaacactcacgtcccttcatcatcagtgactcatcgcatacccgtctacccccaccgggaagagcatggatacacaggatcatacaattacggctcttatgggaatcaacacccacaccctatgcagtctcagtacccagcactcccccatgacaccgccatctccggcccactgcactatgccccgtaccatcgttcctcagcccagtacccgtttaattcgcctacatccagaatggagccatgtctcatgagtagtaccccacgacttcatcctactcccgtcactcccagatggcccgaggttccaagcgcaaacacatgttatacctctccctctgtacatagtgcccggtacggcaactcaagtgatatgtatacccccttgaccactcggcggaattcagaatatgaacacatgcaacacttcccaggctttgcctacattaacggagaggcgagcacaggctgggctaagtag

SEQ ID NO: 133902 - DNA, 2907 bp, Artificial Sequence
  Description of Artificial Sequence: Synthetic coding sequence
atggcatttgctaatttccgccgaatccttcggctttctacattcgaaaagagaaaaagtcgcgaatacgaacatgtgcgaagggacctggaccctaatgaggtgtgggagatcgttggggaactgggcgacggggctttcggcaaggtctacaaggctaagaacaaggagaccggggccctggccgctgctaaggtgatagagaccaagtcggaggaggagctcgaggactacattgtggagatcgagatactcgcgacgtgtgaccacccatacattgtcaaactccttggcgcctattatcacgatgggaaattgtggattatgatcgaattctgtccaggtggagctgtggatgccatcatgctggagcttgacagagggctgaccgaaccacaaattcaggtagtgtgtcggcagatgttagaagccctcaactttcttcactcaaaacgcattatccacagggatcttaaagctggaaatgtgctgatgaccctggaaggcgatataaggctggccgacttcggtgttagtgcaaaaaacctcaaaaccctgcagaaaagagactcttttatcggcaccccctattggatggccccagaggtggttatgtgcgagaccatgaaggacacaccttacgattacaaagcagacatctggagccttggcattaccctgattgaaatggcgcagattgagccaccacaccacgaactgaaccccatgcgcgtcctcctcaagattgctaaaagcgaccccccgactcttcttaccccaagtaagtggtctgttgaattcagggatttccttaagatcgcactggataagaatcctgagactcgccctagcgccgcacagctgctcgagcacccctttgtgagctctataacctctaacaaggctctgagagagctggtagcggaagccaaggcagaggtgatggaggagatagaggatggccgggacgagggagaagaagaagacgccgtcgatgccgcatccacgttagagaatcacacgcaaaactccagcgaggtaagcccaccttctctcaatgcggataagccgttggaggagagtcccagcacacctctggccccttctcagtcccaggattccgtcaacgagccctgtagccagccctcaggggacagatcccttcaaacaaccagcccccctgtggtcgcccccggtaacgaaaacggcctggccgtccccgtcccactccgcaagtctaggccagtctccatggatgccagaatccaggtggcccaggaaaaacaggtagcagaacagggcggcgacttgagtccagccgccaacaggagtcagaaggcctcacaaagtagacccaacagtagcgcattagagaccttaggcggggaaaaactggcaaacggcagcctcgagcctccagcgcaggcggccccaggaccctctaaacgtgacagcgattgtagttctttgtgcaccagtgaatccatggattatggaacaaacctctccactgatctttctctgaataaggagatgggatccctttcgatcaaagacccgaaattgtacaagaagacgctgaagaggacacggaagtttgttgtcgatggggtagaggtgagcatcaccacatccaagatcatctccgaggacgagaagaaggacgaggagatgcggtttctaaggcggcaggagctgagggagcttcggctgctccagaaagaggagcataggaaccagacgcagttgtcaaataagcacgaactccagcttgagcagatgcacaaaaggttcgagcaggagatcaatgcaaaaaagaagttcttcgatacagagcttgagaacttggagaggcaacagaaacaacaagtggaaaaaatggaacaggaccatgcagtgcgacgcagggaagaggctcggaggatccgattggaacaggaccgagactatacaagatttcaagagcagttgaaactcatgaagaaagaagtaaagaacgaggtggagaaactgcctagacagcagcgtaaagaaagcatgaagcagaaaatggaggaacacactcagaagaagcagctcctggaccgcgacttcgttgctaaacagaaggaggatcttgaactggccatgaagcggctgacgactgacaacagacgggagatttgcgacaaggagagggagtgccttatgaagaagcaggagctactgcgcgatcgggaagccgccttatgggaaatggaggagcatcagctgcaggaaagacaccagctagtgaagcagcagctgaaagatcagtattttctgcaacgacacgagttgttgcgaaagcatgaaaaggagcgtgagcagatgcaaagatacaaccaaaggatgatcgagcagcttaaggttcggcagcagcaagaaaaagcccggcttccaaaaattcagagatctgagggcaagacccgcatggccatgtacaaaaaatccttgcacataaatggaggggggtccgcggccgaacagagagagaagatcaaacagttcagccagcaggaggaaaagcgccagaaatccgagagactgcagcagcagcagaagcacgagaaccaaatgagagatatgctggcccagtgtgaaagcaatatgtccgagctacagcagctacagaatgagaaatgtcacctattagtcgagcacgaaacgcagaagctcaaggcgctggacgagtcgcacaaccaaaaccttaaggagtggcgggacaaacttagaccaagaaagaaagccctcgaagaagatctgaatcagaagaaacgtgagcaggagatgtttttcaagctgtccgaggaagcagaatgtccgaatccttccacaccctctaaggccgctaagtttttcccatattcctccgctgatgcctcgtag

SEQ ID NO: 133903 - DNA, 2907 bp, Artificial Sequence
  Description of Artificial Sequence: Synthetic coding sequence
atggcttttgctaatttcaggcgcatactcaggctgtcaacctttgagaaacgtaagagtcgcgaatacgaacatgtccggcgcgacctcgatcccaatgaagtatgggagatcgtgggtgagctcggtgacggcgcgtttggcaaagtctacaaggcgaagaacaaagaaacaggcgctttggcagcagcaaaggttattgagacaaagtctgaagaagagctcgaagactacatcgtggaaatcgaaatccttgcaacgtgcgaccatccctacatagttaagctattaggagcatattaccatgacggtaaactctggattatgatcgagttctgcccaggcggtgctgtagacgctattatgctggaattggatcgggggctgactgagcctcagatccaggttgtctgccggcaaatgttagaagcattgaacttcttacactcaaagaggattattcacagggatctcaaagccggaaatgtgcttatgactcttgaaggggatattcgactcgcggatttcggagtctctgccaagaacctgaagacactgcagaaaagagactcgtttatcggcacaccttattggatggcacccgaagtagtgatgtgcgaaaccatgaaagacacaccctacgattataaggctgacatttggagtctgggaataactctcatcgagatggctcagattgaaccaccacatcatgagcttaaccccatgcgagtcttactgaagattgccaaatccgacccaccaactctgctgacaccttccaagtggagcgttgagttccgagatttcttgaaaatcgcgctcgataagaaccccgagacccgacccagtgctgctcagctccttgagcacccgttcgtatccagtatcacctctaacaaggctttgagagagctggtggctgaggctaaagctgaagtgatggaggagatcgaagacggcagggatgagggggaagaagaggacgctgtcgatgccgctagcacacttgagaatcatactcagaacagcagtgaggtgagcccaccaagcctgaacgccgataagcccctcgaggagagcccaagcactccactggcaccttcccagagccaggactctgtgaatgagccttgcagtcagccaagcggagatagatcacttcagaccacttctcctccagtggtggccccaggtaacgagaatggcctcgctgtacctgtacccctccggaagtctcggcctgtgtctatggatgcccgaattcaagtggcacaggaaaagcaggtcgctgagcaggggggcgacctctcgccagcggctaacagatcccagaaagcttcccagagcagaccaaacagttcagcattggaaacacttggcggtgagaagcttgccaacggatccctcgaacctcctgctcaggcagcccccgggcctagtaaacgcgactctgactgctcaagtctctgcacctccgagagcatggattacggtaccaatctctccacggatctgagcttaaacaaggagatggggtccctttccatcaaggatccaaaattatacaagaaaactctgaagagaaccagaaagtttgtggtggacggtgtggaggtctccattacgacctcaaaaatcatctcagaggacgagaagaaggacgaggaaatgaggttcttaagaaggcaagagctcagggaactgagattgctgcagaaagaagagcaccgtaaccagacacaattgagcaacaaacacgaactacagctggaacagatgcataaacgttttgagcaggagattaatgcaaaaaagaagttttttgacacagagctggaaaacctggagcggcagcagaaacagcaggtcgaaaagatggaacaggaccacgcagttcggagacgggaagaggcacggaggattcgccttgagcaggacagggactacaccaggttccaggagcagctaaaactgatgaagaaagaggtgaaaaacgaagtggagaaactgcctagacaacagcgaaaggaaagcatgaagcagaagatggaagagcatacccagaaaaagcagctgttggaccgcgactttgttgcaaagcagaaggaggacttggagttggcaatgaaaagattaaccacagataatcgtagggaaatctgcgacaaagagcgcgagtgcctgatgaaaaagcaagaactgctccgggatagagaggccgctctctgggagatggaggagcatcagctacaagaaaggcatcagcttgtgaaacagcagcttaaagatcaatactttctgcagagacacgagctactcagaaagcatgaaaaggagcgcgaacagatgcagcggtataaccagaggatgatcgaacaactaaaggtgagacaacagcaggagaaagctaggctgcccaaaatccagcgctccgaagggaaaacccgcatggctatgtacaagaagtcactacacattaacggaggcggctctgcggcagagcagagagaaaagataaagcagttctcgcagcaggaggagaagcggcagaagtcagaacggttacaacagcagcaaaagcatgaaaaccagatgagggatatgcttgcccagtgcgagtcaaatatgtccgagctacagcagctgcagaatgagaagtgtcacctccttgtggaacatgagactcagaagctgaaagccttggacgaatcccataatcagaacctgaaagagtggcgtgataagctgcgcccgagaaagaaggccctcgaggaagatcttaatcagaagaagcgggaacaggaaatgttctttaagctgtccgaggaagctgaatgccctaacccctctactccatctaaagccgcaaaattctttccgtatagtagcgcagacgcctcgtag

SEQ ID NO: 133904 - DNA, 3300 bp, Artificial Sequence
  Description of Artificial Sequence: Synthetic coding sequence
cgctttggatctgctccacaaagacccgtagccatgactacagcacaacgggactctctactttggaagctggctggactcttacgagagtccggcgatgtggttctgagcgggtgctccacccttagcctgttgacacctaccctgcagcagctgaatcacgtgttcgaactccacctcggtccatgggggcctgggcaaactggttttgtcgcgttgccgtcgcatcctgcagacagccccgtgatcctgcagctgcagttcctctttgacgtgctacaaaagacactctctctgaaacttgttcatgtggccggtcccggtccaactggacctataaaaattttcccattcaaatcactccgccacctggagcttagaggcgtacctctccattgcctgcacggcctgagagggatttatagccagctggaaaccctgatctgttcgcgcagcctgcaggccttggaggaactgctgtcggcctgtggcggcgatttctgtagtgcactcccatggttagccctgcttagtgcgaatttttcatacaacgcactcactgcccttgactccagtctccgtttgctctcggccctaaggttcctgaacctgagccacaaccaagtgcaggactgtcaaggttttctgatggacttgtgtgagctgcatcacctggatatctcctacaatcgtttgcatttagtcccccgaatgggacccagtggggccgcccttggcgtcctgatccttcgtggcaacgagttgcgatctttacacggtctcgagcagctgcgaaacttgagacatctagacctggcttataatctgctcgaaggtcatagggaactgagtcccctgtggttgctggcagagctgaggaagctgtatcttgaaggcaacccactgtggttccatccggaacacagagctgccacggctcagtatttatctcccagagctagggatgcagccaccggcttcctgctcgacgggaaagttcttagtctaacagacttccagacccatactagcttgggactgagcccaatgggaccgcccttaccttggcctgttggctcaactcccgaaacatccggggggcccgatctgtccgacagtctgtcttccggaggggtggtcacccagcccctcctgcacaaggttaagagccgcgtacgcgtgagacgggcttctatttcagaaccatccgatacagacccagaacctaggacgttaaacccatctcccgcgggttggttcgtgcagcagcaccccgagttggaattgatgtccagcttccgcgagaggttcggtcggaactggctacagtataggagtcacctcgaaccctccggaaatccactccctgctacacccacgacaagtgcgcccagcgccccacctgcatccagccagggacctgataccgcccctcgcccatcacctccacaagaagaagcccgaggaccacaggaaagccctcagaaaatgtccgaagaagttagggctgaaccgcaggaggaggaagaagagaaggagggcaaggaagaaaaggaggagggggagatggtggagcagggagaagaagaagccggagaggaggaagaggaggaacaggatcaaaaggaagttgaggccgaactgtgcagacccttactagtttgtcctttagaaggccctgaaggggtgcgggggcgggaatgtttcttgcgggtaaccagcgcccatttattcgaagtagagctgcaggcggctagaacgttggagaggctcgaactgcagtcgctcgaggccgccgagatcgaaccagaagctcaagcccaaaggtcccccagacctaccggatcagacctacttccaggcgctccaatactttccctccgcttttcctatatatgcccagacagacaactgcggcgctaccttgtcctggagccagacgcccacgctgccgtgcaggagctccttgctgtcctgactccagtaactaatgttgcgcgggagcagctgggggaagcacgtgatcttctgctaggaagatttcaatgtcttagatgcggtcatgaattcaagccagaggaaccaaggatgggcctggactcagaggagggctggcgtccattgtttcaaaaaaccgaatcccctgccgtttgccctaattgcggcagcgaccacgttgtgcttctggccgtaagccgaggtacacccaacagagaacgaaagcaaggagagcagtctctggccccctcgccctccgcctctccagtgtgtcatcctcccggtcatggcgaccacctggaccgagccaaaaatagtccacctcaggcgccatcaactcgagatcatggatcatggagcctgtctcctccccccgagaggtgtgggctgaggtcggtggatcaccggctcaggcttttcctggatgttgaggtcttttccgacgcacaggaggagtttcagtgttgcttgaaagttccagtcgccctggccggccacaccggagagttcatgtgcttagtcgtagtctctgatagacgtttgtacctgttaaaggtcaccggagagatgcgggaaccacctgcatcttggctgcagctgacactagctgtaccgctccaggacctgagtggaattgagctgggtttggcaggccagagtctgaggctcgagtgggccgccggagctgggaggtgtgtccttcttcccagagatgcgcgacattgcagggcattcttggaggagctgctggatgttttgcagagtctcccccctgcctggcgaaactgcgtttccgcgacggaggaagaggttacaccgcagcatcgcctgtggcctttgttggaaaaagatagcagtttggaggccaggcaattcttttacctcagagccttcctggtcgaagggccatctacctgcctggtctctctgttattgacacctagtacactcttcctgctggacgaggacgccgccggatcccccgcggagccatccccgcccgcagcctcgggcgaggcctcagagaaagtgcctccatccggccctggccctgctgtgagggtgagggaacagcagccattaagcagtctgtccagcgtcctactgtatcggagcgctcccgaggatttacgactgctattctatgatgaggtgagccggctcgagtccttttgggcgttaagagtggtctgccaggagcagctcaccgcgcttctggcatggatccgcgaaccctgggaggaacttttctctatcgggcttcgcaccgtcattcaggaggctctcgctctggaccgatag

SEQ ID NO: 133905 - DNA, 1938 bp, Artificial Sequence
  Description of Artificial Sequence: Synthetic coding sequence
cgattcggctccgccccccagcgccctgtcgcaatgacaactgcccagagggactccctgctgtggaagctggccggtctgctgagggagagcggcgatgtggtgttgtctggttgctccaccctcagcctcctgacgcctaccctgcaacagctgaatcatgtatttgaacttcatctggggccgtgggggccaggccagacgggtttcgtggccctgccttcccaccccgccgactctcctgttatccttcagctgcagttcctgtttgacgtgctccaaaaaactctcagccttaagcttgtccatgtggccggccccggaccaactggacctattaagatctttccatttaagagtcttaggcatttagaattgagaggggtgcctctccactgcctacatgggttgagaggcatttatagtcaattagaaactttaatttgctcccggagccttcaggcacttgaggagctgctgagtgcttgtggcggtgacttttgctcagcccttccttggctagctctgctttccgccaacttctcctataatgccctgacagccctcgactctagcctccgcttgctgagtgccctgcgatttctaaatctgtcccacaatcaagtgcaggactgtcaaggattcctcatggacctgtgtgaattacaccacctcgatatttcctataatcgactgcacctggtaccgcggatgggaccaagcggagctgcccttggggtgttaatcttgcgaggaaacgagcttcgaagccttcatggcctggagcagcttagaaacctgagacatctggatcttgcatacaatctgttagaaggccaccgggaactcagccctctgtggttgctggccgaactgcgcaaatttctcctggatggtaaagtcctaagtctcacagatttccagactcatacatctctgggactgtccccaatgggtcctccgctcccctggcccgtgggcagtactccagagacctctggtggacctgacttgtccgacagtctttcttcaggaggggtggtgacacagcccctccttcacaaagtgaaaagccgcgtgagggtccggagggcttcaatctccgaacccagcgacaccgaccctgaacccaggacactgaatccttctcctgctggctggtttgtgcagcagcatcctgagctagagctgatgtccagctttagggagagatttggcaggaattggctgcaatacagatcacaccttgagccaagtggcaatcccctgccggccaccccgaccactagtgctccgtctgcccctccagcatctagtcagggcccagatacagcccctcggccctccccacctcaggaagaagcacgcggaccccaagagagccctcagaagatgagcgaagaggttagagccgagccccaggaggaagaagaagagaaggagggcaaagaagagaaggaagagggtgaaatggtggaacagggggaggaggaggcaggagaagaggaggaggaagagcaggaccagaaagaagttgaggcagaactgtgtcgaccactcttggtttgcccccttgaggggcccgagggtgtgcggggaagagaatgttttcttcgagtcacttccgcacacctgtttgaggtagagttgcaggctgccaggacgctcgaacggttggagctgcagtcattggaggctgccgaaattgaaccagaagcgcaggctcagcggagcccacggccaacaggctccgacctgctcccaggcgcaccaatcctcagcttgcggttttcttatatttgccctgaccgccaattacggagatatctcgtgcttgagcctgatgcccacgctgccgtccaggtgatggcgccacgagtaggcgctcaggaagccgttgggatcaaacgcgccagagggaaatggcagcaggcatag

SEQ ID NO: 133906 - DNA, 1095 bp, Artificial Sequence
  Description of Artificial Sequence: Synthetic coding sequence
atgcagaaatggtttagcgccttcgatgacgccattattcagagacagtggcgcgccaaccccagtcgggggggtggaggggtatccttcaccaaggaggtagacactaatgtcgcgacaggagcaccccccaggcgtcagcgtgtacccggacgcgcttgcccgtggagggaacctatcaggggccgtaggggcgctcgccctggcgggggtgatgcgggcgggacgccgggcgagaccgtgagacattgctctgcacccgaggatcccatctttcggttcagtagtttgcactcataccctttccccggcactatcaaatcccgagatatgtcctggaagcgacaccacttgattccagagacctttggtgttaagaggcggaggaagaggggacccgtggagtccgaccctctgcggggagaacccggctcggctagagccgccgtctccgaactgatgcagctgtttcctaggggactctttgaggacgcgcttccacctatcgtcctgaggtcccaagtttatagcttggtgcctgatcggacagtggccgatcgtcaactgaaagagttacaggagcagggcgaaattagaatagtgcagctgggcttcgatttggacgcccacggcattatcttcactgaggattatcgtacacgcgtgctcaaggcctgcgacggtcgaccctatgctggggctgtccagaagtttctcgccagtgtgctccctgcctgcggagatctgagttttcagcaggatcagatgacccagaccttcggatttcgcgatagtgagattacccacctggtcaatgcgggagtcctgacagtgagagacgctggctcgtggtggctcgctgtgccgggggcaggccgattcattaaatactttgtaaaagggcgccaggcagtgctctccatggttcgtaaggccaaatatcgggagctcctgctttcagaactcttggggaggagagcaccagtggtggtaaggctaggtctgacctaccacgtgcacgatttaatcggtgctcaattagtggattgtatctctacgacctccggaacacttctgcgcctcccagagacttag

SEQ ID NO: 133907 - DNA, 1107 bp, Artificial Sequence
  Description of Artificial Sequence: Synthetic coding sequence
atgcagaagtggtttagtgcgtttgacgacgccatcattcaaagacagtggcgggcaaacccgtcccgaggaggagggggagtttcttttacgaaagaagtggacacgaatgtggcaactggtgcccccccacgccgtcagcgcgtgcctggcagagcctgcccatggagggagccaataaggggccggcggggggcccggcccggcggcggcgacgctgggggaacaccaggagagacagtcagacactgctccgctccggaggaccctatcttcagattcagcagcctccatagttatcccttcccaggcaccattaagagccgagatatgagttggaagcgtcatcaccttattcccgaaactttcggagtcaaaaggcgaaggaagaggggaccagtggaatccgaccctctgcgtggagagcccggaagtgctcgggctgctgtcagcgaattgatgcagctcttcccccggggactgttcgaggacgccctcccaccgatcgtcctgagatcacaggtctattcacttgtcccggacaggactgtggcggacagacaactgaaagaattgcaggaacagggggagatccggatagtgcagctcggctttgacctcgatgcccacggcataattttcaccgaggactatcgtactagggtttgtgactgtgttctgaaagcatgcgacgggcggccgtacgccggtgccgttcaaaaattcctggcatctgttctcccagcctgtggcgacctctcctttcagcaggatcaaatgacccagacttttggatttcgcgactccgagatcacacacctggtgaacgcaggagtgctcactgtacgggacgctggtagttggtggctcgcagtcccaggcgccgggaggttcataaaatactttgtcaagggcaggcaggctgtgctcagcatggtcagaaaagctaagtatagagaactcctgctttcagagcttctggggagacgtgccccggtcgtagttcgcctgggtctaacctaccacgtgcacgacctgattggggcccagttagtagactgcatctcgacaacaagcggtaccctcttgagactacctgagacgtag

SEQ ID NO: 133908 - DNA, 1107 bp, Artificial Sequence
  Description of Artificial Sequence: Synthetic coding sequence
atgcagaagtggttttcagccttcgatgacgccataattcagcggcagtggagggctaacccatcaagaggaggtggaggggtgagcttcacaaaagaggtggacacaaatgtggcaactggagcccccccccgccgccagcgagtaccaggacgggcttgtccatggcgggaacccatcagaggtcgaagaggcgcaagaccaggcgggggcgatgctggagggactcccggggagacggttaggcattgttctgccccagaggatcctatttttcgtttctcctctctgcatagctaccccttccccggaaccatcaaatccagagacatgagttggaaaagacaccacctgatccccgagaccttcggcgtgaaacggagaagaaaacggggtcccgtggagtctgacccactaagaggcgagccaggcagcgcgagagctgcagtgtcagaattgatgcagctttttccccgaggcctgtttgaggacgccctgcctcccatcgtgctgcgtagccaggtgtactcactagtgcctgacaggaccgtggctgaccggcagcttaaagagctgcaggaacaaggagagatacgtatagtgcagctcggcttcgaccttgacgctcacggcattatcttcactgaagattatcgaaccagggtgtgtgattgcgttctgaaggcctgtgatgggcggccatatgcaggagctgtgcagaaattcttagcttccgttctccctgcatgcggcgacctgagtttccagcaggaccagatgacacaaacgttcggcttccgtgacagtgagatcacccacttagtcaacgcgggagtgttgactgtgagagacgccggaagctggtggctcgcagttcccggagctggaaggtttattaagtactttgttaaggggcgccaggctgtcctcggtatggtacggaaggccaagtaccgcgagctcttattaagcgagctgttgggccgtcgagccccggtggttgttcgtcttggactgacataccacgtgcacgacttaataggagctcagctagtggactgtatttcaacaacgagcgggacattgttgagactgcctgagacatag

SEQ ID NO: 133909 - DNA, 1095 bp, Artificial Sequence
  Description of Artificial Sequence: Synthetic coding sequence
atgcagaagtggttttcagcttttgacgatgccatcatccagcgacagtggagagccaatccttccagaggtggaggcggcgtgagcttcaccaaagaggtggatactaatgttgcgaccggtgcaccgcctcgcaggcaacgggtgcctgggagggcctgtccttggagggaacctatcagaggtaggcgcggcgccaggcccggcggaggcgacgccggcggcactccaggcgaaacagtccgtcactgtagtgcccctgaagatcctattttccgcttctcttccctccacagctaccccttcccaggtaccattaaatccagggatatgtcctggaaacgccaccaccttattcctgaaactttcggagtgaaaaggaggcggaaaagaggccctgtggaaagcgatccgctccgtggagagcctgggtcagctagagcggcggtgtccgaacttatgcagctttttccacgcggcctttttgaagacgcactgccaccgatcgtcctgcggagccaggtttacagtcttgttcccgaccgtacagtagctgaccgccagcttaaggagctccaggaacaaggggaaattcgaattgtgcagcttgggtttgacctggacgcacacggcatcatcttcactgaggattaccgcacaagggtgcttaaagcgtgcgatgggcgcccgtacgccggggcagtccagaaattcctggcctccgtcctgccagcgtgtggcgatctgtcatttcagcaggaccaaatgacccagacattcggctttcgagacagcgagattacccatcttgtcaacgccggagtgctgacggtcagggacgctggctcttggtggttagccgtcccaggggctggcagatttatcaagtatttcgttaaaggaaggcaggccgtgctgggcatggtgcgtaaggctaaatatagagagctgctattgagcgagctgcttgggaggagagcacccgtggtggtgagactgggtcttacctaccacgtccacgatctcatcggtgcccagctggtggactgcatttctaccaccagcggcacacttctccgattaccagagacatag

SEQ ID NO: 133910 - DNA, 1095 bp, Artificial Sequence
  Description of Artificial Sequence: Synthetic coding sequence
atgcagaagtggttcagcgcgttcgatgacgccatcattcaaaggcagtggcgcgctaatccctctaggggcggaggaggggtgagcttcaccaaggaggtggacacgaacgttgccacgggggcacctccgaggcgtcagagagtgcctggtagagcgtgtccttggagagagcccattagagggcgccgcggtgcccgtccaggtggtggcgatgctgggggaacccctggtgaaacagttaggcattgcagcgctccagaagatcctatttttcgattcagttcattgcacagctacccctttccaggtacaataaagagcagggatatgagctggaaacgccatcacctcatcccagagaccttcggtgttaaacgaaggaggaaaaggggccctgtggagagcgatcctctgcggggcgaacccggaagcgcgagagcagctgtttccgaactaatgcagctgttcccgcgaggcctgtttgaagatgcgctgccccccatcgtactgagaagtcaagtgtactctctggtgccagatcgaacggtcgccgacagacaactgaaggagctccaggagcagggggagattcggatcgtgcagcttggattcgacctggatgcgcacgggattatttttaccgaggactatcgcacacgcgtgctgaaggcatgcgatggacgaccctatgccggagctgtccagaagttcctcgcctccgtgttacccgcctgtggcgatctgtcctttcaacaggaccagatgacacaaaccttcggcttccgggattccgagatcacacatctggttaacgcgggcgtattgacagtgcgcgacgccggaagctggtggctggccgtgcctggggcaggtcgatttatcaaatacttcgtcaaaggccgacaggctgtactatctatggtgcgcaaggctaagtaccgggagctcctcctttctgaactattgggccggcgcgcccccgtggtggtgcgtcttgggctgacctaccacgtgcacgatctgatcggcgcacagcttgtagattgcattagcactaccagcggtactctcttgaggctccccgaaacttag

SEQ ID NO: 133911 - DNA, 1095 bp, Artificial Sequence
  Description of Artificial Sequence: Synthetic coding sequence
atgcagaaatggttctccgctttcgacgatgccattatacagagacagtggcgggcgaatcccagtagggggggaggaggagtctcatttactaaggaagtagatacaaatgttgccacaggtgctccaccgcggcgccagcgggtccccggaagagcctgtccctggcgcgagccaattcgcgggaggcggggcgcaaggcctgggggaggggacgctggggggacccccggggagaccgtgcggcattgttcagcaccagaagaccccatcttccgcttctctagtctgcacagttatccctttccaggtacaattaagagtcgagatatgtcctggaagagacatcatcttatccccgagacctttggcgttaagcggcggcggaagagaggtccagtcgagtccgatccacttcgtggtgaaccaggtagcgcccgcgctgcagtgtccgagctgatgcagctatttccgaggggtctgttcgaggacgcactcccacccattgtcctgcggtcgcaagtgtattctctggtgcctgatcgtacggttgcggacagacaactgaaggaattacaggaacagggggagatccggatcgtgcagctcgggttcgacctggacgcacatggcatcatcttcaccgaagactataggacgagagttctgaaagcctgtgacggccgcccctacgccggtgcagttcagaaattcctggcttcagtgttacccgcttgtggggatctgagttttcagcaggaccagatgactcagacattcggcttcagggacagcgagatcacccacctcgtgaatgctggcgtgctcactgtcagagatgcggggtcatggtggttggccgtgcctggagccgggaggtttataaagtactttgtaaaaggaaggcaggcagtcctcagcatggtgcgtaaagccaaatatcgggaactcttgctgtcagagctgctcgggcggagagcacctgtggtggttaggcttggattaacatatcacgtgcacgacttgatcggggcccagctcgtagattgcatttcaacaacaagcggaactttgcttaggctgcccgaaacatag

SEQ ID NO: 133912 - DNA, 1095 bp, Artificial Sequence
  Description of Artificial Sequence: Synthetic coding sequence
atgcagaagtggtttagcgctttcgatgatgcaattatccagagacagtggagagccaacccgtccaggggcggaggcggtgtgagcttcaccaaggaagtggacactaacgttgctactggggcgccgcctcggagacagagggtcccaggacgcgcatgcccttggcgagagcctatacgcggtaggcgtggagctcggccgggaggaggagacgctggcgggactcccggagagaccgtcaggcattgctctgctccggaggatccgatcttccggttttcatccctacactcatacccctttcctggtactatcaaaagtagagacatgtcctggaaacgacatcacttaatcccagaaacatttggggttaagcgacgccggaagcgcgggcctgtggagtccgaccccttgagaggggaacctggctctgcacgggcggctgtctccgagctcatgcagctttttccaagaggactcttcgaggacgctctgcctcccattgtccttcgatcccaggtgtactccttggtccctgacagaacggtggctgacaggcagcttaaagaactccaggaacagggtgaaattcgaatcgtccagctcgggttcgatctcgacgcccatggcattatattcactgaggattataggacgcgggtgctgaaggcatgtgacgggcggccatacgctggagccgtgcagaagttcttggcgtccgtgttaccggcctgtggagatctgagtttccaacaggaccagatgactcagacgttcggtttcagggactccgagatcacccatctcgttaatgctggagtgctaacagtacgggacgccggctcttggtggctggccgtaccaggagcggggagatttatcaaatactttgtgaagggaagacaagccgtcctgagcatggtgcgcaaggccaagtatagagagctgctgttaagcgagctgctgggacgccgcgcccctgttgtggtccgccttggtcttacctatcacgtccacgacctgattggcgctcagctggtggactgcatttccaccacaagcgggaccttactacgtctgccggagacttag

SEQ ID NO: 133913 - DNA, 1107 bp, Artificial Sequence
  Description of Artificial Sequence: Synthetic coding sequence
atgcagaaatggttctctgccttcgatgatgcgatcatccaaaggcaatggagagccaatccttcgcgaggcggtggcggcgttagctttaccaaggaagtggacacaaatgttgccaccggcgccccaccgcgcaggcagcgagttccgggacgggcttgcccttggagggaaccaatccgggggcgaaggggcgcccgcccaggcgggggagatgcgggaggaactccgggcgagacagtccgccactgcagcgccccggaagaccctatattcaggttcagcagcctgcacagctaccctttcccgggcaccataaaatcccgcgacatgtcatggaaaagacatcatctgattcccgagacttttggtgtcaagcggcgacggaagcgaggccccgttgagtccgaccctctgaggggggaaccaggaagcgctagggcagccgtgtccgagctcatgcagctgtttccgcgtggccttttcgaagatgcgttgcctcctattgttctgagaagtcaggtgtattccctcgtccccgacagaaccgtggcagacagacaacttaaggaactgcaggagcaaggcgagattcgcatcgtacagctgggatttgatttagacgcccacggcatcatctttactgaagattaccggacccgggtctgcgattgcgtcctcaaagcgtgcgacggcagaccctatgccggagccgtgcagaagttcctcgcctccgtgttgcctgcgtgcggcgatctttcctttcagcaggaccagatgacacagaccttcggcttcagagactctgagattacacatctggttaatgccggggtccttactgttcgtgacgccgggtcttggtggctagccgttccaggagccggacggttcattaagtatttcgtaaaagggcgtcaggcagtgctgtctatggtgcgcaaagccaagtatagagaattacttttgagcgagctcctgggccgcagggcccccgtggtggtgcgtcttgggctgacataccacgtgcatgacctcattggagctcagctagtcgactgtatctcaacaacttcagggactctcctgagactccctgaaacttag

SEQ ID NO: 133914 - DNA, 1107 bp, Artificial Sequence
  Description of Artificial Sequence: Synthetic coding sequence
atgcagaaatggttttcagcattcgacgatgccatcattcagcgtcaatggcgtgcaaatccctccagaggggggggcggcgtttcttttaccaaggaggtcgataccaacgttgcaaccggcgccccaccgcgccggcaaagggtcccggggcgggcatgtccgtggcgtgagcccattcgtggtcggcgtggggctagacccggcgggggcgacgccggcggaacacctggggagaccgtccgccactgcagcgccccggaggatccgattttcagattttcttcacttcactcttacccttttccaggaaccatcaagtcaagggacatgagttggaaacgccaccatctcatccccgaaactttcggggtgaaacggcgtaggaagagaggaccagtggaatccgacccactgagaggtgaacccggctctgcacgggctgcagtatctgaactcatgcagctgttccctcgggggctgtttgaggacgccctccctcctatcgtcttgaggagccaggtctactctctggtgccagaccgcactgttgctgacaggcagctgaaggagctgcaggaacagggcgagatacgtatagtccagctgggctttgaccttgacgcccacgggatcatctttactgaggactacagaacaagagtttgtgattgtgtcctcaaggcgtgtgacggccgcccttatgccggcgcagttcaaaagtttctagcctccgtcctgcccgcttgcggggatttatccttccaacaggatcagatgacacagacattcggattccgagatagcgaaataacgcatctcgtcaacgcgggcgtcttaactgtgcgagatgccggttcctggtggctggccgtcccaggtgctgggcgatttatcaagtacttcgtgaaaggacgacaagccgtgctgtctatggttcgcaaggctaagtatcgggagttgttactgtcagagttgttgggacgccgtgcccctgttgttgtgaggcttggcctgacgtatcacgtccacgatctgataggcgcgcagcttgtggactgcatctccactactagcgggactctgctacgcctccccgaaacatag

SEQ ID NO: 133915 - DNA, 1107 bp, Artificial Sequence
  Description of Artificial Sequence: Synthetic coding sequence
atgcagaagtggttttctgccttcgacgatgctattatccagaggcagtggcgtgccaacccgagtagaggcggtggaggggtctctttcacaaaggaggtcgacactaatgtggccaccggggcacctccccgtcgacagcgcgtgcccggcagggcatgcccctggagggaacctatcaggggcaggcgcggggcccgcccgggagggggcgatgctggcggcacacccggtgagactgtgcgccattgtagcgcaccagaagatccaatctttcgattttcttcactgcactcatacccatttccagggacaattaaatctagagacatgtcatggaagcgtcaccaccttatcccagaaaccttcggtgtcaaaaggcgaagaaagcgaggccctgtcgaatccgacccactcaggggggagcccgggtccgccagggcagccgtttccgagctgatgcagctctttccgcgcggcctttttgaagatgccctccctccaattgtgctgcgatcgcaggtatattctctcgtgcctgatcgcacagttgcagaccgccagctgaaggagctccaggagcagggcgaaatcagaatcgttcagctaggctttgatctggatgcacatgggatcatcttcacagaagattaccggacccgggtctgtgattgtgtccttaaggcttgtgatggtcgcccttatgcaggcgcagtacaaaagtttctggctagtgttctacccgcctgcggggacctgagttttcaacaggaccaaatgactcagacctttggtttccgcgactcggaaattacccacctggtcaatgccggggtgcttactgtccgcgacgccggctcttggtggctcgcagttcctggtgccgggaggtttattaagtacttcgtgaagggccggcaggccgttctgtccatggtgcgcaaggcaaagtaccgcgaattgctgctgtctgaactgttgggccggcgagctccagtcgttgtgcggctaggtttaacataccatgtgcatgatctcataggcgcccagcttgtggattgcattagcacaactagcgggaccctcctgcgactgcccgaaacatag

SEQ ID NO: 133916 - DNA, 1095 bp, Artificial Sequence
  Description of Artificial Sequence: Synthetic coding sequence
atgcagaagtggtttagcgcttttgacgacgctataatacagagacaatggagggccaatccctctaggggcggtggcggggtcagtttcactaaggaggttgacaccaatgtagccaccggtgcgccccctcggaggcagcgagtccccgggcgcgcctgtccctggcgggagcccatacgcggtcgcagaggggcccggccaggcggaggtgacgctggcgggaccccaggcgaaacagttcggcactgcagcgcccctgaggaccccattttcagattctcttctctgcatagctatccgttccctggaactatcaagtcccgagacatgtcttggaaaagacatcatctcatacccgagactttcggcgtgaaacgccgccgcaagcgaggccctgtcgaaagcgatccattacggggggagcctggctctgcccgtgccgctgtgtcagagctgatgcagctatttccaaggggattgtttgaggacgccctgcccccaatcgttcttaggtctcaagtgtactccctggtccccgaccggacagttgccgacaggcagctgaaggaattacaggagcagggtgaaattagaatcgtacagctcggatttgatctggatgcacacggaattatttttaccgaggattaccggacgcgcgttttaaaagcatgtgatggccggccttacgcgggcgccgtccagaaatttctcgcttcggttcttccagcctgtggtgacttgagtttccagcaagaccagatgactcaaacgtttgggtttagggacagtgaaattacgcatctcgtgaatgcgggcgtgctgacggttcgagacgccggatcttggtggctggctgtgccaggggcaggtaggtttataaagtacttcgtgaaggggcgtcaagccgtcttgtccatggtgcggaaggccaaatacagagagttgctgttgtctgagctgctgggccgtcgagcccctgtagtggtgcgattaggtctaacataccacgtacatgacctgattggtgctcaactggtggactgtatcagcacgacttcaggcacacttctgaggctgcctgagacttag

SEQ ID NO: 133917 - DNA, 1107 bp, Artificial Sequence
  Description of Artificial Sequence: Synthetic coding sequence
atgcagaagtggttcagcgctttcgacgatgcaattatacagcggcagtggcgcgctaatcccagtagagggggtggaggagtgtcctttaccaaggaggtggacactaacgttgcaactggcgcaccaccacgtcgtcaaagagtgcccgggagggcctgcccatggagagagccaattcgtgggcggaggggggccagacccggcggcggcgatgctggcggcacaccaggtgaaaccgtgaggcactgctctgcgcccgaagaccctatctttcggttctcatcgctgcacagttatccctttccagggaccatcaaatcgagagacatgagctggaaacgccatcacctcatccccgagacatttggtgtgaaacgccggagaaagcgcggacctgtggaatcagatccattacggggagagccaggttctgcccgggctgctgtcagcgagctaatgcagcttttccctagaggcttgttcgaggatgctctgccgccaatagtgctgagatcacaggtttacagtttggtccccgatcgcaccgtcgcggatagacagctgaaagaattgcaagaacagggagaaattagaattgtgcaattgggcttcgatctggacgcacacgggatcatcttcaccgaggattatagaacccgagtgtgcgattgtgtgctcaaagcatgcgatggcaggccatatgccggcgctgttcagaaatttctcgcaagtgtgctcccagcttgtggggacctgtctttccagcaggaccagatgacccagacctttggattccgcgatagcgaaatcacccatctggtcaatgcaggagtgctcacggttagggatgctggatcctggtggctcgcagtaccaggggccgggcgcttcataaagtactttgttaaaggccgccaggcggttctctccatggtgcgcaaggccaaatatagagaactgctgctgagcgagctcctgggacggcgcgctcccgtggtagtcaggctgggactgacttatcacgttcatgacctcatcggggcacagctggtcgactgtattagcacgacatctggcaccctgctgagactaccagagacatag

SEQ ID NO: 133918 - DNA, 339 bp, Artificial Sequence
  Description of Artificial Sequence: Synthetic coding sequence
atgcagaagtggttcagcgcttttgatgacgccatcatccagagacagtggcgggcaaacccctcgcgcggcggtggcggagtgtcctttacaaaagaggtggacactaacgtggcaacaggagcaccacctaggcggcagcgtgtccccgggcgggcttgtccctggagagaaccaatccgtggaagaaggggagcaaggcctgggggaggcgacgcgggcgggacacctggcgagacagtgcgccattgctctgcccccgaagacccgatcttcaggttcagttctttgcattcttaccccttccctggaactattaagtcacgcgatatgtcctag

SEQ ID NO: 133919 - DNA, 966 bp, Artificial Sequence
  Description of Artificial Sequence: Synthetic coding sequence
atgttggtatgtgctagtcctccccccttgcccgcgttgaccggcttaagggatgacaaactcacactactttccagctctcccgggctgggcggtaccccgggtgagactgttcggcattgctccgctcctgaggaccccatattccgattcagttccctccatagctacccttttccaggaactatcaaaagtagagatatgagctggaagcgacaccatttgattcccgagacatttggagtcaagaggcggcgaaagcggggccccgtggagtctgatccactacgaggcgaacctggttccgcccgagctgctgtgtcagagctgatgcagctgttcccccgggggctattcgaggacgccttgccgcctatcgtgttacggtctcaggtgtacagcttagtccccgacagaactgttgccgataggcagttaaaggagctccaggaacaaggcgaaatccggatcgtccagctggggtttgacctggatgcgcatggtatcatattcacggaagattatcgcacaagggtcctgaaagcttgtgacggcagaccctatgcaggggctgtgcaaaagtttctggcgtctgtcctgcccgcttgcggcgacctcagctttcagcaggaccagatgacacaaacatttgggttccgcgatagcgagatcacgcacttggtgaatgctggcgtcttaacagtgcgagacgccggtagctggtggttggccgttcccggtgccggtaggttcataaaatactttgttaaaggcagacaagcggtgctcgggatggtgcgaaaagctaaatatcgcgaactgcttctaagtgaactccttggcagaagagccccggtggtcgttagactcgggctcacataccacgtccatgacctcatcggagcccaattggtggactgcatttctaccacttccgggacactgctgagactcccagaaacatag

SEQ ID NO: 133920 - DNA, 966 bp, Artificial Sequence
  Description of Artificial Sequence: Synthetic coding sequence
atgttggtgtgtgccagtcctccaccattgcccgctctgacgggcttgcgagacgataaacttactctgttatcatcttcccctgggctgggcggaacccctggagagaccgtgcggcattgttcagctcctgaggatccgatctttagattctcttcactgcactcttacccattcccaggcacaataaagagtcgggacatgtcatggaaaagacaccacctcatccctgaaacctttggagtcaagcggcgaagaaagcgcgggcctgtcgagagtgacccactgcggggggagcctggctcggctcgcgccgcagtgagcgagttgatgcagctgttccctaggggattgttcgaggacgctctcccgcctatcgtgctgaggtcccaagtttacagtctcgtgccagacagaaccgtagccgatagacagctaaaggagctgcaggaacaaggagagatccggatcgtgcagctaggtttcgacctcgacgcacacggtattatatttacagaagactatcgcaccagggttttgaaggcctgcgacggccgaccctatgcgggcgccgtgcaaaaatttcttgcaagcgtccttccagcgtgcggtgacctgagctttcaacaagaccagatgacccagacgtttggctttcgggactccgaaattactcaccttgtgaacgctggagtcctgacagttcgtgacgctgggtcctggtggttggctgttcctggtgcaggaagatttataaagtattttgttaaagggagacaggccgtcctatctatggtgagaaaggcaaaataccgagagttgctgctctcagagctcctgggacgccgagccccggtggtggtgagactaggcttaacgtatcacgttcacgatcttatcggagcccaactggtggactgtatctcaaccacatcaggcacactgctccgtctcccagagacgtag

SEQ ID NO: 133921 - DNA, 966 bp, Artificial Sequence
  Description of Artificial Sequence: Synthetic coding sequence
atgcttgtgtgtgcctctcccccacctctgcccgccctcacaggtctgagggacgataagttgactctactgtcttctagtcccgggctgggaggaacccctggcgagacagtgcgccactgctcggcacccgaggacccaatctttcgtttttccagtctccactcctatccctttccgggtacaataaagagcagggacatgagctggaagagacatcacctgataccagaaacctttggcgtgaagcggcggcgaaaaagagggccggttgagtctgatccactgcggggagagcccgggtcagcccgcgcggcggttagtgagctcatgcagttattccctcggggtctgttcgaggacgctcttcctcctattgtcttacgaagtcaggtgtatagtttggtccccgacagaacagtcgcagaccgtcagcttaaggagctgcaggagcagggtgagattaggatcgtgcagttgggattcgatttagacgcgcatggcattatcttcaccgaggattatcgtacacgcgtgctgaaggcttgtgacggtcgtccgtacgctggagccgtacagaaattcctggcgtctgtgctgcctgcctgtggcgatctgagttttcaacaggaccagatgacccagaccttcggattcagggacagcgagatcactcacctagtgaatgcgggggtccttacagtgcgggacgccggtagctggtggctggccgtacccggcgccggacgttttattaaatattttgtcaaagggcgacaggctgttctatctatggtcaggaaagccaagtatcgggagctcttgctgtctgagctgctgggaagaagagcccccgttgtggtgcggttgggccttacctaccatgtgcacgacctgatcggagcgcagcttgtggattgtatttctactacctcgggcacactgctcaggttgcctgaaacctag

SEQ ID NO: 133922 - DNA, 966 bp, Artificial Sequence
  Description of Artificial Sequence: Synthetic coding sequence
atgctggtgtgtgccagtcctccccccctgccagcgctgacagggttgcgggatgacaagctgactctgctctcttccagtccaggtcttggaggaacacctggggagaccgtgagacattgttcagcccccgaagatcctatattccggttttcgtcgctgcactcttatcccttcccgggcactatcaaatcacgggatatgagctggaaaaggcaccacctcatcccagagacattcggtgtcaaacgtcggcgaaaacgcggccccgttgagtcagatcctctgcgcggcgagcccggcagcgccagggctgccgtctccgagctgatgcagctgtttccacggggacttttcgaagacgctctgccacctatagtattgcggtcccaggtgtactcacttgttcctgaccggaccgtcgctgaccgtcaacttaaagagcttcaagagcaaggtgagattagaatcgtgcaactgggcttcgatttggacgctcacggcatcatctttacggaggactaccgaacacgtgttcttaaggcttgtgacggcaggccttacgccggagctgtccagaagttcctagcctctgtgctgcctgcctgcggcgatctatctttccaacaagaccagatgacacagacgtttggtttccgcgattcggagatcactcatctggtcaacgccggagtcctgacagtgagagacgcaggttcctggtggctggcagtaccaggagccgggcggtttatcaaatatttcgttaaaggcaggcaagccgtactgtctatggtgcgaaaagccaaatatagagaactgctcctcagtgaactccttgggcggcgggccccagtcgtagtccgactgggccttacataccacgtgcatgacttgatcggagcgcaacttgtcgactgtatctccacaacgtctggaactttattgcgcctacccgagacatag

SEQ ID NO: 133923 - DNA, 966 bp, Artificial Sequence
  Description of Artificial Sequence: Synthetic coding sequence
atgctcgtttgcgcctcccctccgccgctacccgcccttacaggattgcgggatgacaagctgaccctgctgagctcaagccccgggctcgggggaacccctggggagactgtgcgccattgcagcgctcccgaagatcccatttttagattcagttcccttcatagttatccttttccgggaactatcaagagtcgcgatatgtcatggaaaagacaccatctgatacccgagacatttggtgttaaacggagaagaaaaagaggaccggtcgagtccgatcctctccgcggcgaaccagggagcgcccgcgccgccgtgagtgaactgatgcagctgttcccgaggggtttatttgaggatgcactccccccaatagtgcttaggagtcaggtatactcacttgtgcccgacagaaccgtagctgatcgacaattgaaggaactgcaggagcagggggagatccgcatcgtccagttaggattcgacctagatgcacatgggatcatattcaccgaagattataggactcgcgtcctgaaggcatgcgacggccgcccctatgccggcgccgtccagaaattcttggcgagcgtcctcccagcttgtggcgacctcagttttcaacaagaccagatgactcagacctttggctttcgggattcagagataacacatctcgtaaatgccggcgtcctgactgtccgcgacgctgggagttggtggctggctgtaccaggtgctggccgatttatcaaatattttgtgaagggtagacaggcagtgctcagcatggtaaggaaagctaagtatcgcgagctgctgttgtcagagctgttgggaagacgggctcccgtcgtagtccgcttaggcctcacctaccacgtccacgaccttattggtgctcagcttgtcgactgtatcagcactacgtcagggacattgttgcggttacccgagacctag

SEQ ID NO: 133924 - DNA, 1320 bp, Artificial Sequence
  Description of Artificial Sequence: Synthetic coding sequence
atgcagaatttgaaggctgaccccgaagaattattcacgaaactagagaaaattgggaaaggaagttttggagaagtgttcaaggggatcgataataggacccagaaggttgttgccatcaaaataatcgacttagaggaagccgaggacgaaattgaagatatacagcaggagatcactgtgttaagccagtgcgattcaccatacgtaactaagtattacggcagttacctgaaggacaccaagctttggattatcatggaatatctcggcggcggatccgcgttagacctgttagagcccggcccgctcgacgagactcagatagccactattttgagagagattctgaaaggacttgactatctgcacagcgagaagaagatccaccgagacattaaggccgccaacgttctactgtccgaacatggggaagtgaagctggcagactttggtgtggccggacagctcacagacacgcagatcaagcggaatacattcgtgggcacgccgttttggatggcacccgaggtaatcaaacagagtgcctatgactctaaggccgacatttggagcctgggcatcacagcaattgagcttgcacggggcgagcctccacactcagaactgcatcctatgaaagtgctgttcctcatccctaagaacaatccgcccaccttagagggaaattatagcaagccgctcaaagaattcgtggaagcatgcctaaacaaagagcctagctttcgtccaacagccaaagagctactcaagcacaaatttatactaagaaatgccaagaagacttcatatctcactgagctcatcgacaggtacaagcgttggaaagcagaacagagccacgatgacagctcttcagaagactctgacgccgaaacagatggccaagcctccggaggcagtgatagcggcgattggatctttacaatcagggagaaagaccccaagaatctggaaaatggcgctctgcaaccatctgatctagaccgcaacaagatgaaggacatccccaagcgaccattcagccaatgtttgtccacaatcatcagccccctgttcgctgagttgaaagagaagagtcaggcttgcggcgggaatttaggctccattgaagagctacgtggcgcgatctacctcgctgaggaggcatgcccggggatctccgatacaatggttgcgcaactcgtgcaaaggcttcaaagaagcatacatggcaaccaagcaccgcccgattgccatctagcacaagtccaggcctttggcggctcaggctgcgtgttaggcagcagatcggtgtag

SEQ ID NO: 133925 - DNA, 672 bp, Artificial Sequence
  Description of Artificial Sequence: Synthetic coding sequence
atggccccagaggttatcaaacagagtgcctacgacagcaaggcagacatctggagtctgggcattacagctatcgagctggctaggggcgagccacctcactctgaactgcaccccatgaaggtactctttctgataccgaaaaataaccctcctacactcgagggtaattactccaagccgttgaaagagttcgtggaggcctgtttaaacaaggagccatcatttcgcccaactgcaaaagagctgctgaagcacaaattcatcctgcgtaatgcaaaaaaaacctcgtatctgaccgaattgatcgatcgctacaagcgctggaaagccgagcagtcacacgatgattcatcgtctgaagactctgatgcagagactgatggacaggcttccgggggctccgatagcggcgattggattttcacaattagggagaaagatcctaagaacctggaaaacggtgcccttcagccctctgacctagacaggaacaagctgaaggagaagtcccaagcatgcgggggcaacctggggagcattgaggaactgaggggagccatatacctggcagaggaagcttgtcccggcatatcggataccatggtagcgcagctggtgcagcggctgcagcgctactccctgtctggtggaggtactagtagccactag

SEQ ID NO: 133926 - DNA, 1332 bp, Artificial Sequence
  Description of Artificial Sequence: Synthetic coding sequence
atggattctagggcccaattatggggacttgctctgaataaacgcagagctaccttacctcaccccggggggtccacaaatcttaaagccgaccctgaagagctatttaccaaattagaaaagattgggaaggggtcgtttggcgaagtcttcaagggcatcgacaatcgcactcaaaaagtggtcgccattaaaattatagaccttgaggaagccgaagacgagatcgaggacattcagcaggagataacggtgttgagccagtgtgactctccctatgtcactaaatactacgggtcatacttaaaggataccaagttatggatcatcatggagtacctcggcggagggtcagccctggatctccttgagcccgggccattggacgagacccaaatagcgacaatcttgagggaaatcctgaaaggactggactatcttcactccgagaagaaaatccatagagacatcaaagccgctaacgtgctgctctcggaacatggtgaggtaaagcttgccgattttggagtcgctggccaactgacagatacacagataaagcgcaacacgttcgtaggcactccattctggatggccccagaggtcattaaacaatcagcgtacgattcgaaggccgacatctggtcattagggatcacagccatcgagctggcgcgaggagaaccaccacattccgaattgcatcccatgaaggtgctctttctgatcccgaaaaataatcctcccactctcgaagggaactactccaaaccacttaaagagtttgtggaggcctgtcttaataaggagccatcttttcgccccaccgctaaggaactgctgaaacacaaattcatcctgcgaaacgctaagaaaaccagttatcttacagaattaattgaccgatacaaacgctggaaggctgagcaaagccatgatgactcttcatccgaggactccgatgcggaaacagatggccaggcttctggcggcagtgattccggagattggatctttactatacgagaaaaggaccccaagaacctcgaaaatggcgctctgcagcctagcgacttggatagaaacaaaatgaaggatatcccgaagcgaccctttagtcagtgcttgtcgacgattatttcacctctgttcgccgagttaaaagagaagagccaggcctgcggcggaaacttaggatccattgaagagctgcgcggcgccatctacttagcagaggaagcctgtcccggtatctctgatacaatggtggcacagctggtccagcgtctgcagcggtactccctgagtggaggaggtacatctagtcactag

SEQ ID NO: 133927 - DNA, 1296 bp, Artificial Sequence
  Description of Artificial Sequence: Synthetic coding sequence
atggcccactctccagttcaatcaggcctcccagggatgcagaatctgaaggccgaccccgaggaactctttaccaaattagagaagattggcaaggggagcttcggagaagtatttaagggaatagacaaccggacccagaaagtggttgcgatcaagattatcgacctggaagaagctgaagacgaaatcgaggatatccagcaagaaattacagtgctatcccaatgtgactctccctacgtcacaaaatactatggctcatatctgaaagacacaaagctgtggatcattatggagtatcttggcggcggctccgccctagatttgctggagcccgggccactggatgagacccaaatcgccaccattctgcgcgaaatcctgaaaggactggactaccttcattccgagaaaaaaatccatagggacattaaagcagccaatgttctcttgagcgagcatggcgaggtaaaactcgctgatttcggggtggccggtcagctcacagatacacagatcaagcgaaatacctttgttggcacgcccttctggatggctcctgaggtaatcaaacaatccgcctatgacagcaaggccgatatctggtcacttggcatcacggccatcgaactcgctaggggcgagcccccccactctgagctgcatcctatgaaagtgttgtttctcatccccaagaataacccccctaccctcgaggggaattattcaaagccactgaaagagttcgtggaggcttgccttaataaggagccaagctttaggccgactgctaaggagctgctgaagcataagttcattttacgcaacgccaaaaaaaccagctacctaactgagttgatcgacagatacaagaggtggaaggccgaacagtctcatgacgattcaagcagtgaggattcggatgctgaaacagacggacaggcatcaggcggttcagatagcggcgattggattttcaccatccgcgaaaaggatccgaagaacctggaaaacggcgcacttcagccctcagatcttgacagaaataagatgaaggacattcccaaacgaccattcagtcagtgcctgtctacaatcattagtcccctctttgctgaattaaaggagaagtcccaagcctgcggcggcaatctggggtctatcgaagagttaagaggagccatctatcttgcagaggaggcttgcccggggatctcggataccatggtcgctcagctcgtgcagagactgcaaagatatagcctttcgggtgggggtactagtagtcattag

SEQ ID NO: 133928 - DNA, 1239 bp, Artificial Sequence
  Description of Artificial Sequence: Synthetic coding sequence
atggctcacagtcccgtccaaagcgggctcccggggatgcaaaacttaaaggccgacccagaggaattgtttaccaaactcgagaaaataggcaagggatcgttcggggaggtgttcaaaggaatcgataatagaacacagaaagttgtggccattaaaatcatcgacctggaagaggcggaggacgagattgaggacatacagcaagagatcaccgtgctgtcccagtgcgattctccgtatgttaccaaatattacggcagttacctgaagttggaacccgggcccctcgatgaaacgcagattgctaccattcttagggagattctcaaaggcctcgactacctccactcagagaaaaagattcatagggacattaaggccgctaacgtgctgctaagcgagcacggagaagtcaagcttgcggatttcggagtggctggtcagttaactgatacccagatcaagaggaatacgttcgtcggcacacctttctggatggctcctgaggtcattaaacaatccgcatacgactcaaaagcggacatctggtcgctggggattacggccatcgaactggctaggggcgagccaccacattccgagctccacccaatgaaagtgctgttcttgatcccaaaaaacaacccccccacactggagggcaactacagtaaacctctcaaggagttcgtggaagcctgtctgaacaaggagccaagttttcgacctaccgctaaggagctgctgaaacacaaatttattctgagaaatgctaagaaaacatcctaccttactgaacttatcgatcgatacaagaggtggaaggctgaacagtcgcacgatgactccagctcggaggattcagacgcagaaactgacggtcaggcttctggcgggtcagactcgggggactggatcttcactataagggaaaaagaccctaaaaacctcgaaaacggtgccctgcagcccagcgaccttgacaggaacaagatgaaggacatccccaaacggccattcagtcagtgtctctcaaccataatctcccctctgttcgccgagttaaaggaaaaatcgcaagcatgcggaggcaatcttgggtccatcgaagagttacggggtgcaatatacctcgctgaagaggcttgtcccggcatatctgataccatggtggctcagttagtgcagagacttcaacgttacagcctgagcgggggcggtacttctagtcattag

SEQ ID NO: 133929 - DNA, 1029 bp, Artificial Sequence
  Description of Artificial Sequence: Synthetic coding sequence
atggcacattcccctgttcaatcaggtttgcccggaatgcagaacttaaaagccgaccctgaggagctgttcaccaagctcgagaaaatcggtaagggctcttttggagaagtcttcaaaggcattgacaataggacgcagaaggtggtagccattaagatcatagacctagaagaggctgaagacgagatcgaagacatacagcaggagatcaccgtgctctcccagtgtgactctccctatgtgacaaagtattatggatcgtatttgaaggatactaaactatggataattatggagtacctcggtggcggttccgctctggatctgcttgaacccgggcctctagacgaaacccagattgcaaccattctgcgcgagatcctgaagggactcgactacctgcatagtgaaaaaaaaattcaccgggacatcaaagccgcaaatgtgctgctttcagaacacggggaggttaagctggccgacttcggtgttgcaggccagttaaccgacacacagattaaaagaaatacctttgtaggcacaccattctggatggctcccgaggtgataaaacagagcgcatacgacagcaaggccgatatctggagcttgggaatcacagccatcgaacttgcacggggggagccaccacactctgagctgcacccaatgaaggtgctattcctgattcccaaaaacaatccccccacccttgaggggaattattcaaaacctttaaaggagttcgttgaagcgtgcctgaacaaagaaccatctttcaggccaactgctaaggaactcctgaaacacaaattcatactcaggaatgccaagaagactagttacctgaccgagctgatcgaccgctataaacgctggaaagccgaacagtcacacgacgactcttcctccgaggatagcgatgccgagactgatggtcaagcgtcaggggggtcagattcaggcgactggatctttaccatacgggagtggagcagtagtgctatcggtctaggccagaagtag
